United States Patent 11,260,081 (ENGINEERED PARASITES FOR DELIVERING PROTEIN TO THE CENTRAL NERVOUS SYSTEM (CNS)) - sequence listing, part 2

SEQ ID NO: 1106 - DNA, 3228 bp, Toxoplasma gondii
gtggttgatctgagtgtctgagaggagtgaccgttggactcgcctgtcgtagcagtgtgttcttccatggcagaagcgaacgtcatgaacataatttattttgacaagtgcggacgaggcttgtgaagcgtagtcgccgtaaaccctggtgtccctccgaggcgttgctccctctgaagccagatgagtgccatttgccacctcatctccatcactgtcactgtattgcaccatggggcttcaccagatattatgaattttcaaagtggaacgttacatcactgactgatttgttaaaccttttagtgaggcccgagaaacaagaaggtgccgggagcactgactgcatatatggccaagacgcgtgagtccccatacgacagacacgccattccccattctgctgatttcttgactcggtaaaatggataccatgttcagatgtgcacatttcgcatcgagtcacatgcactcatcagtacacacccatcaacttgttcgctgttgaaaatgggcgggcagagacaaagaccggatcccacaaactgggctcaaccacctgaggaggaaggttgaatgaagcacgtgatggttagcgttcctagacaacatggtcagccatcgatgcgccatgatgttttttttcgtttaggaccgacgcatgtaatgtatgaactttcctttttacatccaaagtgacaaaaagtgcggattctaccacgttcatcacaggaagtctttttctgaagcggaatacctagttaatgtggacgatcatgaggagagataaaattgcacaactctgacagtcttcagcatgaacttctgccctatcgactgcaacagcaccagtgacagcggcgatattctgataggccgtcaccgcggttgaaggaaggccgcacagaaggacgatgtactgcatagaggagttttagagttttacgtacagcgtttcagcagcgtttgcttcagcgacaaataaaaatcattcattgttaactgttccagaccgacacacgtcaacatcacagcgttctcatactgttgtttcccctgagaaaatgctgagcaaggtggtaacgtagacatccacgaatagcaatgcatggaagagggattctacctgtttcctgacaccatcgtttttgtcctttgtttccgtcaaatcagcaccagctttcagtaaatcccttcaagttgttgaggaattctacgatgcacgggaagagcagcaacgccatttgtgtgtgcctggttaagggcacctttgatattttgtcggcaaagagccaacgagagggccaggccacaaagtgcctttttcttgtatcacatggttcgctggagaagacaccagcagcatagagtatcacgagcgcttagctacagatgagttttgatgcaagtgtacgtgcggtacaatatagcggcggtccaagtcctcccgggacctctatacaagccaagtctgatcgcactcttatacgtgcgcgggtatttgtacagtgaaaaaaaagtcgaatcgcaatggttgccagcagtgtcgataaaaagaaacaccggaactgtgtgtgcgtgcaaatgcgacgcggcaaggctgtagcagcagcgacacacaaaaccaacacaacggttgtgttctaacacgaaagagcaggcttttccgcagaagcaacatatacaggaactgcggccagcagggcaaaaacgtttgcgaggtggctacaaacccaacattacgttcaagttaaaaatggcaccacaagcacaacggaccagtaggtccgattgtagcccgggaccgaaggaatgcttttagcgtcgaaaaaaatgctaagcgaagaaacaccacacctaaataccaaacgaagaatcgttttgggaagagtaacgccgtcgcaaacgcctgcacccctcgccattaaaagccgcttacggaagtctaattgtgctttttaccagtcgaaagataatctttaatggtggtaactgttgtgtgctgcatcgtcctgccgttgcgtcggagtgaaatccaacccggctgcctgcaagagacagtgttggattttcgctacacaaaaaaggtggcttctagtgaagcctaaatcgtctttggcgcgaaacaggcaacgcacctaagagtgaggtttatccccttcagatagctcggcagttgggacatttttcactggctctacatcagaacacattcttccttgaacatttccgcgtacgggtcctctcatttactgagacttcttgcccttgctcttcttggggaggagcacagagtggacgttaggcatgacaccaccgcttgcgatggtcactccgccgaggaacttggagagttcctcgtcgttgcggacggccagctggatgtgacgagggatgattctcgtcttcttgtggtcacgagcggcgttgcccgccaactcgaggatctcagcgcacaggtactcgagaacggcagccatgtaaacaggggcgccagcaccaacacgcttggcgtatctgcccttcttcaagtagcgaccgattcttcccacagggaactgaagaccggccttggcagacttgctgctgctcttgccggacttcttcgcgcgaccgcccttgcctttggccgacatcttgtctacgagggaaacggagtggaggaaggaacccaaaaaaacagggagaagacgacctcgtgtagggaaacacgtgtgtgtattgcccgcggaaattttgtaagagtcgaagaatgatacttctggttcctttgcccaatcgcacaaccacatccccccagttggccgcgtgcaaaatgccgccgtccgtccgggagatttcaagacgccgctctcggcgtcacaccctcgccttcttgatcaaactccgcggctagctcctcgaaaagagtggcgagttgctcaggacgcacctctacgaatgacggcagcccaaaattcagcgagcagcggcgccgatccaccccccgaccgaggagtgggaatgacgggtggaagtggcgtgtttccgggaaaggtgcgtctgaccgcggctcgtcttccttcgtcgctccggttggattcggcgtgtggccgccgggaaggtgtacgttgcgggccgccggtcgctgcggtcactaacattctttttcgttccatcgtcgaaagtcaacttctttccccctacgaggagttccccctattgtcctttttggagaagttttcgaaa

SEQ ID NO: 1107 - DNA, 4390 bp, Toxoplasma gondii
ctgaaggctttgccgtcgccttcgccgttttcagctgctcgtccttcctcgttcgccgcgcctcgacgcctttcttgccgcttcccggctttgcttcttcctcccccgagccgtcgccggtcgcgttttctctcgtcgtcagagggctccgaggacttccacgaagcaggcgacgttcgcgagctccgactcgacggcgacaccacctccgagtcgctgctcctctctctccctatctcgcgctcgttctgtctgtctgtctctgtctcctctcttgcgccttccgaagcgtcttcgtcgatggctctgattggcttgaccagtctcctcgcttgagccttttctccgaatggggagagcgcggagaaggcggcagcgagtcgggacggcgaagcgtgcgacaagcagacgcgattctccccttccttctcgtgactcccctcgcgcgggtctgcgagtttcacacacagagttggagaggctgtcacggcgcgtctgaggcgcttccacgttttcggtggagtctggcaaaagctgtcgttcttctccgcttcgtcgccgcggccttcgcagcgccaccgcccccagctgtcagccgtacgtctacctgggcgctcgcatgagggagacaccgaaggtttgtgcagtctgcgtcggcgaggcgtctgctctcgggaggcgctcggggaagagcgaacctccatgtttgtgcggtgtttcgttcgccctcgctcccgcctctttttcgcgcgcttcgtgtgtcgctgcgccttcgcctccacgagcgagagccggagaatcctcgcgaggtcgtcctggctctcccacagtgtccccttttgccaagaggcccgcctgcccctgagaaggcgcgcagagcagcggcggccactggggagggaaggaaattcaggctcgaagtctctcctcggcgagacggagactcgagagccctcaggtcgctcccctcggtctcgtgcgtcttgccagctgctttctctgccttcctccgaagaggctccggacgagcaacttttcgcggatgtacgtgaggcatacgaacccccgctgcatttcgcagcgcctcctcgaggcggcttcagaggcttcaccggcggtcgcagcgggagacggggggcgcgactacctggtgaagagagagaaggggacgtcagcggggcagaagcggagttgaaggacaaggaggaagacgaggtgacagccgaagaagagaaggagaggaaagccgttagggaagcgagggaagacgagttgatggcaggagaagtcaaggaaaaaagaaagggcgtccgcgaggaagaggaacgcgaacgggaagaggagcagctcgtggaagaagaggagtttcggggagagcggagaatcgcgagagaagagaaagacgtggacgagtaaggcgtagtggaagacccaaagaacggagcgagacgcgtgcggcgcgtcaacatgttctcctgaggacggagacaccgagacagcgaatgagaactctctttcttcgaaggatccgctacccggttcgaaggcgtcgtctgcggctgacacaccggaacaatcgatttacgaggagactgcagtggaacagccgtgtatgcattgtgtcgggaagaagagaaagcgtccgccgagcgttcggtcctcaagaacgcacggaagtcccccctctgggtgctgaaaacggagttcgcactgccgccgacatgtcttgtttctaaaagacaggctggaaaagccgaggagactcgtagggaaccttccggctgacggagaaaagaccggtcaaaggactgagtttctgttttcgggccagattgtccgacttttctgggtcgttggccgctgtctaagtcgtcgcgcaccgacgctcgacacgctgcctgcgtagcaactcgccgcggaccagaggcgctcaagtccatgagcagaaatcgagcaaaagagacgaacctgagagcttcagaggaacggaagagaaaaggagaccctccgtaggcaaggactcgagcagatgaaagagaaaaaagcgtctggggctctacttgctcaccaaccttgctactgctcgactgtgtgcgcgtagccttgtgcgaggtgggcaaggccgggcggaagtgaagatcgatttgagggggagagaaaagcaacgatctcgtcgggcaaatctcaccgtcacacagtgcactgtcttttttgttgctgtgaaacgcagggtagcaatcacactgggcagtcgaaaggaagaaacgaacgcgatttcccgtagaccacagcaaccgcaatggagtcgaagagcccaagccacggttctatccatctacttctccactgaacgagacatggtagttagtttcgagagcgaaacggcaaatgcctctcttccgagactcgacctttctttccgttggaactctcgctccagaaagaagaagagaactgggcaagaacgcaccgcggacgcaaacccgttgcaaacgatttacagcacaaacagcgagagatatgggtgcaggagaggtttcaactctctcgagcgccagtgcggaagtgggggaatgtgagtgctgcacacgacacgcagaagcagaccaataatctctgaagagtttccgtttttggcgcgtttgccttcgggaaagccacaacatgccagagcacgcgaagtggggaaagaaacgaggcagagcggcagccaagcctgacagccgttcaggattttcacggcaaaggcactttggggaatgtcagtggctgcacgtgttccatctgagacttttcaccttttctctcccagagcacaaaggggatagtttgggctaccagaggccaagaaagttttcacggagcgacagcgggagaaggatcttcaaatcaattgctgtgattttgaggaacgtaggaaatgccatacagccgactgatgattaatatagtcatcgctcaagcatccaactagctcctgtcagataaatggagctgatttcgctctgtggcttgacatctacagatctagctgtgaaggcaaggggaacactgcacacgtaattgacgaataatatcgtcaccatacacgctctcagatagttactgcgaggcactcacgagcccaacaccataactgcgcactctcaatgatgatggaggcaggtccagagaactatatgtaaggacgatttggcaaaccagcagaccgatctaaagaagtgccgacccctccatagagagcaacttaacacgtctacagcgtcaacgaatctctggcacgagtgggcatctttcggctttatcgagatcaacttgcttttttctatgaagaaaacagtccggaagtaatagagactctggcgacaagatgcaccgaatgccgtgaatttccggtttcaagttcacttgacaacaagaccctttttttctcgtgaaacaagccatcgctttcacggctaaaagtcaggacaaacacaccaaacgtggttctctgaaacttaaaaccaacgagttttttctattgcagctgcatcacgagtttgacactcttcaagatgaaacagtaaccttttgggtagcttcctccaacgttgaactgagttggcatattacatacaatgaccttgaactaaacgatgataaccggttgattccattttaagttgatacgggaaggatcatttgagcgtttaccgccagaacaattgccccgacggtccgttttgtgttggccctcattcgtcgatttcagttgatttgtttcgtacgactcctgaccgtcttcgttgcgacgtatagctgtgtcgattcacctcattcattcttcattttgtgattttggtgatgtcgtgggcagaaccattcaactctaaacccaaaacccagaacacgagagctgcacgcagcgcggatgtcagccgcccagagcgactgcagaagcatgcagacacaggcgcggtacgccgctacatttattctcgactggccgttcgtttaagttttggggattttcttcaaggttttatcgaaacgcgttaaggttagatcttgcatcggttttttccttctttaacttccgctggagcgacagccacggggccgtcccttttccgtagggaatttcatcttgcgacatcacctgaatttcggggttccgtggcgcctttcttgcatgccattctcaccttcagccgtttgcacttcgctctcttttctcccctctctgtctccgttcgcgtgttttgccggtcttcttccctatttctctctttgacatttcttccattggcattttccacaagttgtactcgggtaatctttacgtagtctcgttctcgagcttgctgttgtctcctctctcttagtttcctcgtttccactcacagaa

SEQ ID NO: 1108 - DNA, 4059 bp, Toxoplasma gondii
tgtgaacagcttcgagtactccttcctgtggttgcagaagagatagggaatgacgtccacgaggagctgctttctccactctttctggagttctcccgaggccctcatctcgtctgcgagctcgccaggcagagtgccgcctcggagatgccttcgctcatccgacgctcgtcgcaaatgcctctcagtctctcctcgcagagcgctgccgctctggcgctgagagaaggggcagtctgagctgtacgtacagcaggaggacacgcaggcgccctccgcacccgccgaggctggagagggagactctgaggacggattgatgagtcggtagatcttgaagtcgtgctccaccacgtagacggagctgtcgtgtgcgctcgctgccgcaaagtgacagccgtaactcatccgatatcgacctgtgtagatctcctgcaccgcgcctgagcctgagccaccaggcctcgctcgcgggcgcagccgcgcatgcagcggatgcgagaaatccatggtctgccaggttcttggaacgtccagaaatgactctgctcctttccccgcgagaagaaagggagaccgaggacaagtacgcagggaaaggcgaggtgagacaaagagacgaaacctcccttgaaatagagaaagggagagaggaactgcgatgacacagctgaatgccggaaagagaagagcagaggaagaggcgaagggggcagaggaggagagagagtcacaagataacgagatcgggcgcgagccggaggccacagcaggcgagggtcttcgcccggaaggcgcctatctgcgccttacattgctgcgaaacagtccagggaaatgttagagaaaacctgtcggaaaaaagcactcgaaaaaggctgggttgcgtgctcgagtgttgtcgcggctggcttcgcgacctgcactgccgcgctgcagtctacgaatgcgaagagagaagcgtgtttctccccgcgtacgaaagaacaatatctctgctgggctccatcactctgcctcgaagagacagttgaggcgaaggcgaagaaatggggtcagcgaagggaaagcgcgtcgagacaagtaaccgacagggcaacgcggcgagaagaagggcgcagtctgccaagcgtgcggtgtacccgcgtgcagtggcgatcgagggaaaagcagaaacgaaaacaaatactcctcaccaggagaactgcgaagaaaagacatcggcggtactgttcttgaggacaaaggcgccgccgggtgtcgatttacacgcagaaccccgagtaacacacatcgccaagaaaacgcatgcacagctcgcagacgccgagccagctggaggggggcgaggaaggaaaggtcttttctcattgtgaggttcgtttgagctgttcttgcgtttgtcattgtctaaactgatgcaagcacattcttcgcctgccaagacgagcgctcaaacgtacacatctctgcgatttcacattcatctgcggtggacaaataccgcttgtcggagtcgatcaggcgtttgagagctgatgaatcgtgggagacgtcagagacaagacaagaactgctgcagagataaaaagtgaaaactttgcagaagcaaggggaagtgaagggaagaccgtctgggagcagaccagggaggtgacaggttgttgggggacagcaaggcgcaaatgagaggaaagataaaagacaagacaaacgtgcattggtaaaacacctgaaaaagagtggacagacgtattagagcctctaatcaataaaagaaaggagaaaaacgctcacgaggggtcgtgcggggcatatggctggggtgtatgtacacctgactgttgcgcgtgaagttggcgtcaagtgttggctgcgattcaggcgcctctgggaagtcgcatatgattcttgccactgagtcttcttaattcaacatattttctgcgagaggacgtgctggagctcccaaagagtcacgtctccacctgctataaaccgtggagaacggcagcgggaatgcagttccttccaggaggtgctccacacgccacgtacagcccttaccccgactcgttgtaataccgtcctactagtgcctccgaaagcaaaaagttgtcgccgtctccccgagtatttccgcgtgccctctccctccatgcagcagcagtgaacggttattcggttgacagttccagatttctcttttctggccattcgtttgcgtgtcagcaagtaccatgcttctgatcggaccgatgcactttagttttctcaacaacacagcagtccagttcttcttgagacagtttgtctctttccgtgtccccgctgatagactgccatcgacatacgaagcgcccaagtcgtccatacccagagtgcaccgagaaccgccatgaaaatagcgcggaaaacggtttgcgttcgaggtgcaatatttgggatacccttgtcattcacattcacagcgcaaaagattactggtcctacgcgagtacggccagtaccatcgccctaggaattatgatctctgagacagacctgtttataccccctagctgcctttggacagaggagttcgcgaaagtgagcttcgcagcccgcctccggcagttcactcgagactaaatctccacagtatcgactccgactagtctttgtgacgaggtttcgtgcgttgtagataggcgcagcacccgagcgtgcgttcagtgcccattccatcggaagcgaccacagatgagaagcgtagtgccagtcactaagcagccaggttttcttatcaagacaaaatctgtttaagaattcggtgtctcagttctaaagcctcgagacacgccatctcagtccaccgttactttccccgacgcagctgccgaacgcttcccctgggtcgcctctaagtgcacatcagaatgaccaggaactctcctattggaaggaactttttaacggaaaggccattataacaattcgactgtagtttcttcctggaaagaccagaagacggagtgcatagcgagaacgcgtgtctgcgagacctttcgtcgcgatccttgttttcaggcggcggccacagtgcgtttttgcaagattctgaaaggctcgctcgagtttcaagggaacgctgtttcccttatacgcttaattgtaacggagaaactgcggtggcccagagaaaggccagctgagggcgcaagatccgctgggggtacctttgctccgttttccgcgtagagtttagggtgccctggctgcagtaggcacacccaggggggaagggggggccaggtgagcccgctgcgtggttcgggaactcggtgcttctccagagtgtgcagaggcgtgagagcagggatttcttcttcctttataaatactcttttagcggtttctcgcgctcggcgccgcgacggtcgcctccgctttccgcagtctatgatcgtgtgtatgcatggcgcaagtgcactactagttgtgtttgcctctgatcccgcatcccccgcccgcttccatataagctctgccagattgcccccgtccgcggattctttccttgagcacggctatcaacaggcgctcagcgatttcgcccgtttattctcctttttcggggattgttttgcttctgtttgtctgcgactcgcgaacgcgtctttcgtgcgtcctgcgttgatctagttccgctacagtcgtttcggcgtcccaccccctcgtccggccgggaaaaagcaccgcagtgcgccccacccttcgtctcgcggtcctttcgtttccacccgcagaacacgtctttttctgttgaatttttcttggccgcttcctctgcactgtgctcacgggtccgcaacccaatccgggcggcgtgctgcgccacctcgcttctcgtcgtcctgctctttcctcccgccggttctgcctccgcgtgactcgcaactgcggttccaagcttttcgtttgagagacactcgagaaagttgctggtgcctcttccgttcccatcgtcgaactctttggccgtgcaagctctccttcccccacacctttcctgcaaaa

SEQ ID NO: 1109 - DNA, 4043 bp, Toxoplasma gondii
gtgatgtatttcatgcgtcgtgagctgtacttgcgtggtgcaaggctgcttagtgtcgctatatggtcatttttttcagaataccttgctcccctgtcgcaaagaaagctctgccatgtcagccgcatgatgcggtcgaatgccagaggtgccgggaagcttacgcctgtaaaaactgtagtatcctcagtaacaacttccttcgcttgccgattacagcgcagaacaagcaagaattgttgcgactgggctgggctcgatgtacctgcgtgttgatctcttttgtcactataaagggcagcgaaacgcggtttttggtgacagaatgttgtttgccaacacgcagagaactgagaagcatagtagctgcgatggtgacttttcgggtggaccgtggtagaatatattgttcctgagatttgatggccgtgagtaatagaaggggcaagtcccgcggcatcgtttcaacctacaatagggaaatgcgcgtcacttcacaactccgacggttaaaagtctgtagacttgaccgcagtccacgttataagcaggttcattctgttgcttcaacagcagtcggtgtttgtccggagcccctgtgtggatcagtctcttcgtcatacgcatatccaagtcgcaagcgatacggtatccacgttaaccagaatgtggcagaattcaccagcagaatcaagcagcgaagactgttccgcattatgagatagcacacttgatttttttctctacggcaagaacaacgcggctatggaactttttcagctgtagccccacgaatgagacctacgttttggtgacagcgctatgtgtttgctcacgtgaatcgaggtaaaactagtaagagtcataccttactgcgccgaagaaaccgagcgtccgctactcaaatgcatcagtctgcgggcgactatcaaatagtgcgctgtacaattgctatgcgaaagtgacaatttccgtctccagcggatcgaatgggttacacacctccgctgttattgtgtttgtgcctctgtacttctgggaatgacgaacgatactctcaggtttcatagaatgtggagccttttccccgtctatgcacgcttgcagatgtgtcagctttgaagtcggtcgccgcgccgcacaggcgaaatgattttaacggcgaaagctccgcaagcacatttctttaacttcagtgtggaagacggtttgcaatccgaaggactgttgtgttctctatgagggcacacacagacaggacgacagatgggtgtgtgcttcgggccaacgctgtcgcttctgttggcctgctgcaaatctctgcgtgcattttgctatcacgatgacgtgtaacgttaactggagatctggatatagacttttacgcgcttcgatcacattttgcccactttctttcacggcggatcctataggtcaaagcgccctcgctggtgtggtacggttcgccgttgtgccggttccttgcggcgattgccttccacagtaggtttacgcgttagcgtgttgcctgacagttctacagggacccatcccgcctggaaatcattcttacagaaagagattatgagagttgtgttgacggaaacttccggcgttgcagcacatgacacgtgattcgtgggacagggcagacactccgtggcctccgttgttgatcgtgacactttcacttcaatgttcacctcagataaaagagttgagagggtccgattcgaatggtcgtatcgcccacttccacggccgtgagcatatccaatctgcagaggtcacacgtcccaaaatggcaaaaactacaaacaacgtgaagttgactcagggcaggttgtcccagattcccagttagattctgtgactccagtttgtctgatacagtctgatgtgcatgttatggttgattgattattagttcttcgctagaattgagttcccgcagcctggagaacactgtccgggctttcgatatcagtccttttctgtgctcttgggtggttgcagacagagcggactggcgggtggcctttttccaagatgatgccaaaggcacaccgaagtgtaacttaccgtggatcggagtaactgagtcggtctgtttgggggatctctttcggcgctatgctgagttggctcaagagagcgattcccgcttgtcttttttcgtatgtggctacacatagctcacttgatagagtttgcagttgcctttgtgctacttagcggcaacagggcacatttcggcaattcggtacccactgaataatttctagacgtggcttcaacaagtggaatatcttgtcgacacgtcgccaaacgccagatacttgtgcgccaccgcaagataagtgtcgcagcatctcagagtgcagtacatgcatgctttctcttcaagatcctgctcggatgaaaatatcccgcacgttgcgagttcggagcaaaacggaacagtggatggtggccttgtgttcgcttcaagactacggtgagccgagctgtgtgccataccagttgcgaggtcgccggttcttcggggtcccgccgctcccctgaagtcaactatggcggtggatgcccatatcatctttttaccaaatatagtgctggcatctacttcgagtcacgcgggaaataatcttttgggcatctccaccatccttattttatggccgagcttggttccgggccgctttcctcggacccgacggatttctttgttctggcccgtggggggtcaagcggcgttgctgggttgttggcgcggcaccttacagcggggagggtctcgtgcgcttcgacaaagttcaatcaccgccacattcggggactcgtttttcgctctgaacttcaaggactgcatgtactgtacatgactacagctccaagctgccattggaagtgttttcttcagtttccggaccgctgtttgttcggaccatcgttgacccggagaaaagcgccgctctgtctccattgtcaaggtcaactgcaggcaacgtagcccgtgctgaacgcgtggtgggttcgactgcccggtgccttttgtcccgtatgaagccaacactgtcatccatgtgctgactggcagtgggggagcaaaaatcagttgaatcggttgctctccgaatatctcctcaaagatacctttgtcgaacgaggtcttttttcaacttacgatgagcgttcctcagagggtcctcaccgcctcgcgcgcccccggcgcacgacggttcatgtttgctgccatcttcgtcactctcgcgctcacgtggcgaaccatgagtttggtggctggcgcctcttcttctgggaacactacaacgccagaaggaaagcttaacaaggtattaaggggccacaactcctgaagtgaaaacggcggagggctcagggagagcgcagggctggcaaggggagcgcccttgaatcgactccctgggaagaaccaactggcagccactacacatttccgagcactggctgagcttgacacctctagcatcagctggacatatgccgtctaaagttttgcgcagatctgtgctgattggtggtggaacgctcacagaattggcatatatggccggccttcctgtgcgcagggggccatcatggtggcatcggctgcaagagagaagcaccagttccccctcgcccccctcccccctttcggccagcactgagacagaaagaaagaacgaatttcgtcgtatgctgtactcaccgcatcgccgtcacaggcttcaaggggcttgtgggataggttgctcccgtttttgcgagtgtgacgtggcactgtctccgttcagtcaaagccggcaccattaatggacactcccgttcagaactccgtttaggtggaatatgtgacacacccacgccgtttacctttcttttgctttagaactctccaaccagggacggtctgtgttgcatactcctgtttcgtgtggtatctgccttctatttgcagcctgccagcatcagccgtgacgcgcgtgaccagcttgatcaagctgaagtattggcga

SEQ ID NO: 1110 - DNA, 3334 bp, Toxoplasma gondii
acattgtctctttacatctctgttgatgctgagtggctcccgtagctctcctccctctactccacctgaaccctcctcggagagaagtaagctggcagtctttacctaggttacatacatcagtgtccttccaagagggaagtgccttgaccacgttgacaacacattcaccggtggctaactcattaagtaccttagcggttttgtgtgcgataaagtaggtcggtacaagtgcaattcgttcgcacacttcttcgaatgcggatctgtacattcttttctccctacgtgactctttttttccgtacttactggacttcagtctcactgctgggacctctttttggcccgcaccacgactccttattgtccacacaggttcttgtcggtttgcctttcctctttgttattcccccgtctgtcaccctggcccagcgaccgattttcatcatttgcgctttctctttcccttcgagcttcgatttgttctttagtccattgcacctccctttgggttgtctgctatccgtctcgtcttctgtatttcttttgctgtggtgccggtctgttgttaccgtatatagtctttttcccgccttcggcccagcaccggctaccttccaattcgattggtcaagcagccaactggccattctctgggtcttccaaaatttcttctactcgctggggcaatctgcgttgctatgcttgcagcagatggcaaaatccgagggtgccaccgttctgccacgcgagaatgaattatgcttaagctcagagaattacagctctctgtggttggtatacagttacaacatggaaccgaccgcgagacaccgttctgtgtgtctccctgtagagtcctgaaggtccgcctttttcttcactacgcgcattgagctcataccacagattgtcgggtagcgagatggtcctcccaggaggagcagagatcccggtcggcagtcgtggtcacgatgatggcaaaatatgtgacttttgtgtctagttcgccgcggtatcgtgaggaactggctcgcctattgtggttggacgttcgttttttccctgacgtcaacctcactgccttgaagaaggctgtgaacatgacacatcacgtaggcgcactgacgaggcctgaccttttcgtcgacccgcgtgcgagcgcggaaggactggcctgctacgagggtcaagcgaggcaaacaacattacatcctcgcttggcccgtgcgagtgaattagtgccgacgccgagaatagatcttttccgattttgccgttgcacacacataatcccagctgacagcatacttttctgcctctttgtggacacggaagcccggcgaactcgacgcacagtgattctactatccaggctacgatccagcgaagtatgaaaaccagttttccatgttccattccatccggcgggcgccacatggcctgcagcgtcaccaagccgtaagtgatcctttccagaacgacatgacaccacctaaactacctccagaactagtgttttgtgagcagtgccagttagtggaagcaaactcggccgttgtgcagaaacccgtgttccggcacacacgtaaggtggaaacagggggctcattggcagccttcaagtagttacagtgttggaacagctcctgcaggcgctctgcggaaattcatttgcgcatccttgtacaacaacggcacctagagctctcaaaacctacgcacataagctggagtaagagtgtattctttaaaaataggtattatcgatgggactgacgctgagaggctggctaagcaagcctcgactcgtaagcgatttctcgtgtcccctgcacattcgccatattttatacgcatacctcatactaatgggatgtcgtatgcgcactcatcaactcgtgagagatggggaagtcgcgcggtcctgaaactcggcaggattgtcgtatgttttcttagactcagaactaccggaaggtgctactcacaggcatcggcaggtcaggcgacttgcgaccacgggaataacatagcaaccggcctagcgtgtccctattaacgctggggacacgttggcacctctactttttcagagcgtctacgtatagcttgaatttgctgacacgcacaaatactgcaggacgcccaactcgaaggctcacacatgtacatcctgcaccttggaacgattcttgcctttgcaaattcatctgcgctagcatcgagaatcagtccctggactctccaagctggtacttgatttttgcctgttaagcgtcgctgtctgccgaaattgtcgggcttgccattcgctcacattctgacagctaccccattcctccccctgcgtcccccctccgcgagtatgcagtgctgtcaagaaacaccgacaggcaacgcgtgtcgagaccctgtgacggtcaaatacctcttccgtttgtcatgtcgacagcagccgcgcccattttcgcaaagcctgcgatggattaaaagtaacaaggcaactgtggacaaggcttccccctagagattcttcctttcagcgttgacacccctaaggggctgagaagagcgtgggtcttcgttccgcgcgttctgcttgggccgcacgccgacctgctgtgccacgctcgatgcaagctggcctgctttcgcaagttcggaaaacagggcaagcttgacattgaaaccacgccagcatagacaagaaggagttaatgagaaagcgacagcggcggtctcaagatgacggagctaaagaagcaacacggaacagtacggtagtcgggagcgagcgaccagcgccttgcaacgcatttgtatcgccgtttcctgatcgagttgtttgtgttctaacccaactactttcatagaaccccgctcccctacaaaccagtactgactggatcccccgttggcctgtaagcggtctcactcgctgggtcggtgctcccacaggccttcctcaaaacactctaactaattctcctgtctcttgtcgccttccacaccttcgccgtttgtccactgcccgccaagacaagcttgcgttcgggtcttcgtcttcgtggcgtcctctctttctcagtgttttgcttttgtcgttgttcctttctcttcctcttattttccatccgcgacgtttcgttgtcagctgcctcggtgtctctgcttggccgggcttcccttgctagcgcgactcgttgaggcacaaattgtttcggtgtcctccactacatacggtgctccttgtaccaaccaatgaagctggactgcgtgccgaacccaaagtgattctacgtagatggtgaatgcgtgtgaaacacta

SEQ ID NO: 1111 - DNA, 1477 bp, Toxoplasma gondii
cattcggtggtttgttttctgcgttccgtcgcacgactgagtggaaacggaagcgtcgggcgtaactgccgacccacgttccagcttcttcatgggcgtctgggtccccgtctcgtggttgttctttggagagaactttcctttgctcggccggcgctgcgttgccactggggctctcctcagcgctgcccgccgggtacggggagtctgttgcgccaaagtaaaatccgtaacctgtcacatttcttgccagcctgatgacactgtgtctcgggtcaagacgttcccaaggcaggagcgactttgaggcagaagtgtcaccattgtcttgtcgatgccactcctcggcggtgaggtccaagccatactcgcgaacaacctccaacgcacagtctattcgatccaggtcagccttatcttcggtgcaggcgcttttcggcgtgcaaaacgccccagatctgtcctcggcattgtcaccgtttgccgacatgttaagcggactcgcagatcgagatccagacgaatgccttgagctactagccccggggtgagcgccatcaactggctgtgcgtacagcgtatgattcggttccgagtttcccgcaaggcttccctcgtcggactctgaagaatttgccacccactccgccttcatccgtgtttttaacgagctgctctgtgacgagatagcaatcccgacactctcgtcggtcgactgaagacattccggcctgacaatcacggcatgccggccagatttgagctgcagagactcgcggtcaggcgcgctcccagcaggggactgtcggaagttcttcagattcgcctgggtcactggtgtgctctgcgcagggtctgaccgaaggtgtccgttctggggggtctggagggagtggcgtaacaggggcaggggggggcatggtgaccgcagcgagcctttgcgtgaatcaccgaatacatttgaagaaagtgtgtcctcaaacgcatcgaaatggtttgctaggtttgcggtcgactccgtcccgttctctggatccgtttgaacaatcatcccccgcaacgcctcaggaaccgccgacaggtcggaacctgttgacgggagggaggccatttccacctcttcgcgattatggaaaagctgagtggaaaacaaaaagtcgcgctggcttccctgcagatctatacacggaaagacgcgaaaacgctgtcgcttatgcgcagccgttcacgcagctactggacaaagagaccactgcgtccgacggccgatgtcccgaatttccatgctttgtatgccaagaattaccagctgggaccccttactagaagaaggcgaaaagcgtggcgatgatactatgaaacctcggaatgcaaagagcgtgcgaggaggtccagagcgttaccgccactgtgcagggtgcgttattcacagttggctgaccgagtcatcggaggcgaaccgacggcagaaagaaga

SEQ ID NO: 1112 - DNA, 3544 bp, Toxoplasma gondii
cctcaacttagcgaaacgaaatccgagaagccgaagaaaaactcaaaagcaacgccgcgaacggccgccagattttcccgcacattctaggcatttccatacatatgtatgcacacacctgcatattatatatatatacaaatatatatatacaaatatatatatgtatacaaatatgcgcctctacatggatctttgcatgtatagagatcgagatccagatggggaggaagagctgtgcgcgtacgtccttcagaacacggacagatgcttggctgtgaggtgcagcgacgcgaggaagagcgcagagagaacggaaaacgagaggagcgttcgtcgccgtcgatcctcttcagaacggcgtcgaatgaagggggcgaagaagatgcaccagtaagaaaggcgatcctggtctgccgccagagaaccgccggaagtccgaagcttctgaacggcccgtcacctcttctcagggacagagcaaagcacacaaaagtccgctggttttccagggatccacttgaagcggaataacgtaagagtgcctggcgcgcgcctctcttttccgaacagaggtcaggagcagcgcgacgcggctagcaggcgaagaaggcggaaaaaaacgcaggatgtgtgtcgccagagccctcgtcgagttcgcaggtcagatgtgtctagaagtggaacgcagatgcgttcttgcagacctgaaaaaaacgcgcttcgcgttttcctcgacacgtttgcgagagtttctcccgctcttgccttcgcgccgaatttgcgcttcgcggccgcttctctggcgcctgttgtcgcgcgttttggtcacgaaacttgcggagaaaaggtggcggaacgaagttgcttgcttctttttcaaagcctctttgtggaggagggttcgttccaaaaatcgaaaaacacgcgagagaagttgggcagtcgtcgcgcgcgagcgcgggtaatgccgcacatccgtgcgtcttcccttgccggaaaccgtcgggagaagtgtagcagaaaaggcttctttctctcgaggtcacaacgaacgcgtgagcaacctcaaaaacgctcaagtctccgcgaaacgaaagtccagtctgcgcaactgtgtcgcgcgaagagagccgcgtcagctaactgtcctgtcacagcacagcggggctctccctctcatggcaactctccggaagtccgtgtgggcagaaaccagtaaatttccgcgtgcgacgaaagagacaaggctttggtgttgacgatctgccgacgcgcgggtattttctgcggtttcgcgagcagagagaggggcgcagctcgaagggtcgcgctcaaggcgtttgtctaacgagtgccttgctggtgcagcgtgagaaatctcacagaacgcgacagaacgcgccagcgggctccctcaccccgcacggcgagaaaacggacaatttcgcgacgaaaagtgcagggaaacgaggcgcagaggaagaaagtggaaatacgttggggaaactccaaaaacctggacaacgaatgggaacgaagggcggggaccctcgagaccggccgcggagcggggctcttgggaaaagatgcggttcggcgttttccaccttccttcacagcttcagggaaaccacgcgaacaaacgcgtatatcctgagaagccgagagagagacggttgttatttagagaaaatccaggcgttccgggctcggaacggtagaaaacgtccgaggaagacgaactgaaagcgcagcaaaccaacagcaaagtgcctgcctacaacacgaacacagagcgagtgcggacgagtggaaagaaggaacgcaaacagacgaaacagaaggggaaaagtctctccaactgacaggcacgcatacgcaaaacacagaatggcgacatcgacttacatatgcgcatatatatatatatatatatatatatatacatatgtattatatatgtatatgtgtatgtgtgtgtaggtcgagtagaggaaggtgatctgaggttgtgcgtgtggcagtttctccttccgaacgattatccgcaggcgagttctcgagttgagactcgcagaggaaagagccgagcgcagtgacgagagagggtgacagaagggactccggggcttggacacaagaaaggaaaagactcgaattcgaggggaaggagaggaaacgaaagaaggcgccctgccaactcgaggacacccggtgtcccgaagaacctgacagagaggaaagctgtgagtttgacggtagaatacctctgaatcaagcagagaaaaacgcagaagcgcgcgccacacactaaatccttttcgggggctcgcgttcactcgtctgccgcagaacgatccaccgcgatttcggtgtgtgccctttgctcgcgttgctgcggaagctttttgcaccagccgtgcgtgttgtgctgttgtcttgcggtgacacgacatctttcctcgtcttactcatccccaaagctccctccaagccgagaagctgcgttgtgggttgccatgccgtctctggctgggcgcggattttcgagttcggaactacgcacatgccgtgagttctctgaacaccctctttttcgacgactcccgactcctctagtttccaacagagtttcgcgaccatgccggaccgcaagaaaagcaacaaaggccagagaggcaggttctcatccctcgcagcaagaaaaacgcgcgggcgttcaaccgcagcgttcgtcgaggcgggtcgctcttgttgagtctccacgaggtgatacgggagcgtgtgccctccacggtcgacaggaagcaaacaggcgaaaaaaatcgcggaaacaacatttctttcttgtttgtttcctctcaagcgaccggtgacgacgaaataagctgttctcctctctgtgacgtggacgggcagaaaccgtcgacagaaacactgcgtctttgcgtgtcttgctcctgcgccgagtcccgacaagaaactcgcgttttctctcaagagctgcccgaatttggtttgccttttccactctttctgcgcagttctcctcctcggtcgcttcccaggctcacaaccggcaggttgggggctttttcacgtttctttctccggccaaccgcgtccgccgttctgctctctctatccctctgcatttgcgtttgagtattgaggcaggtgtggcacggttttcttctcgtgtttgtcgcggtgacggttttccatcgaatctccgtttcactcggagaaacggctttcctcgtcgtactcgcgccgctcgttcgtctctccgctgacgcctctcctgaaactgtttttctctctgggaacacgctggctgcatcttttattcgcgtcgctctgcttgttttttcttctccgtccacgcttgccagccgtagcttttccgctgacccgtcgacgtctcgacgctgctcggcatccccctccctctccctctcctgtccgctgcttcttctgtcctttcgcagctctctctctctcctgtctgctgctcagtcgcttttatgaagaggaaata

SEQ ID NO: 1113 - DNA, 2431 bp, Toxoplasma gondii
ttactgcgactctcccatcctcgctaatcttaggccggcattgcgtgcctgtcaacacgcacttacccctcctaattgagcatctgactctgtttcttcccagccgcatccgatgtctgccagttcctccagtcccgagttttccgcatcgctgtcccttgtgtcaggcccttttccccgagacgtcagtgagtagggcgcaaagtaagcagcgttgtccgcgagttgccctgtagctctgagactatcaccgggtacgggtcgtagatgacctgtgagatcgggagtttctgtctcgaaaacccttttcttttttccccactcatttccctcgaacttctgagagctgagggatctctcggagtcgcggtgtttaactctatccatccgagcttgccccgccgccgggcaaactggcttattcgatgcatttggtaacgggggaacacctgaagtagaaccccgcgcaaataccgccaaatcgcgctcaagttgttcacggcacggttccggcaggcgtcgaagagccgagttcgcggtggcaccgcaagaccctgacgggaaggatggcaaattcagcgacgggggacccaaatacgaagagccgcatgccggctcaggcatcctggacaacatagaagacagactgctgaaggggatgcagaagaaggccgttaccttcgtctgccaataacttgttggaagacatccgagaagaaggcgaaagtcagagcgcagaacaaaaagcgatacggcgggaaaagtcgtgcgatagtgggaagtctccaagatgctgttgcttaagagggagcttgaatgtgcacgtgcctaaggagtaatcgaactttttttcagctctgacaggtcactctgtgtcgtccttgtgcttgaaacagtcgggtttcaaggggctgagtccggcagcgacttctagcgaaagcctagagaggaaatgcttcctgcgacgcgcaaattcaaacgaaactcagttgtggccgaatctgagcaacaatcgggtataaagggagctggagatatgaacagcgaagtattagaggagaagaaggggggtgttacttcaagtgatttttgacgccagcgcggccgccccgccaacgactctggccgatcctggaagaaacaacagtttcgcaagttattcagtcgttccaggtgcttcctggtgggtacgagacaagcttatttcaggcaattgttaacaggaaaaacaaaaatctgggagataagcagcgcgaagcaaaataaatgttggaaccctgaagcagacaagaggaacctccgaagacccttcaagggatcttcctcaactggagtccggtcgagacaggtgtgcctttacgagacggaagtgacgctggagagacgataatcagcgatcaccaagaagatatatcatgtctgaccttcagtgacagaaaaaagatcttcaacaggacaagagaactgatatatttttgtgagtacgcgccacatcaactctgcacatcctcaaaacgcgtgccgagttccggcgagcgcggcaagttagggaaaagcagagaaaatgagggaacataaaattccacttacgcgatgcatcgaatgtatttaattgtcacactcagttgcatttagttgtgttggaaactggaaaacattctggggtctggatcctccccgttaggtcgccatgcagagagcccccttggagctgtttggcgctgacgccgggtcggtcgtgccacggtggagaatcgggaaggggaaaaaccggaaaactcgcacttgtttcctcattgaactccacgactgacgattttcaaagtacttctgtgtttgcaacggaaaggttgggatataccggagccagaatcttgattttcctcctgttcgtgtcgcctggaaccgtgcgtgtcttgaagactcgctacgcgctaggcgggaccgcaacagagttcggtgttgaataccatcatctccctgaatcgaggtccccgacctagttttgtgtccagtggtgcgccaatgtgtttttgtttctcttgtgggagtcgtatcttaagttgtggaattttcggcacaaggactgtccagttttcggctgcgagtcagcgagtgaccttccggcccagccctgctttggtgatctgactgatcgtacaatttggcagtgaaccgtggcaacgaagctggctgctctcttcgagtttcgtgcttctgcactttgaaaggtaatatcgttttgactttacacaaccgtttcctgtactcgaaggcacaccctgggactcaagttcccagtttgtctgtccggtgccagtcaccgttctagctgaagtaccgctgtaggcgtagtggcatcttggatcacgcgggcgggtccaatgactgacatctcagtcgttcttcaacctcatcattcaagttccaa

SEQ ID NO: 1114 - DNA, 1929 bp, Toxoplasma gondii
ttcagagtttcaacaaggtcctaaagccttgacttgtttgcgtgctgtagtgaaaactcgccgtggaaatgaactgaggtaatcagggtctccttgtgacgcctagcgcaagttgctgctctttagtcacattcgtcagaatctcgctttccatgtcaacatcccttttctttgagtcacggttttctgcggaacggacgacccgcgaacacgagggcaggaatacgaaaaatcgagtagatctaaggcttcctggcggcgaaacgaggactctaggctcttgaagtatttccacagaacttctgtctcgtcacactcgcgcgtccgtcgtacagtgagagtggctctgcacagcagtcgtctagaactgggtcgtctgcaccggaggacagagacctgtagatggagacttcgatgtgtagacaaaagagtctctaacttctcgtcaacgcgatcactgaaactcgagaacttggcaacacaagttccaggacgagcgagagaaaaaaatctcgcgaattcgcatggtaggaaatttggaagatgcacgcggaattctcaaagttcaggatggtggaaactcgaaactttactgttcaagggaatgaattcgaatcctgagtctcacccgccgaaaacggatctgcctcttcaccgaaaaaagacttcgaatatacttttacatacatatagcaatatatatatatatatatatatgtatgtatattgtgtgtatgtatacatgtatctatctacgtttgtatttgtgttttattcccgctgtagattttctgtctcttcgttgtcttttgcgtttctctgacaagttaaattccaaatgtgaggatagctgcagacgtcttcgtgcaggattccgtggcaacaaaggacgcagccagggtcttcttcaagactgcatcttcctgtgagtttgtccccgactttttgctggtgtccttgtgacggattcgcttgtctcggtgtcttggaagctgcggttcagatgttttcttttccgcggtcgctcgagaagaaacggtgtttttggccgctgccctcgagacggcacacatgccattgccagcttgcgcccgatgaaagcttggggaaaagtacctttgcagaagaaagacctctccacaagaaagatggctgcatgcgaagagtagagagaagagcagaaacacaaacaagcctctgctttccagctttttcccggcaaccggacggtgcccgctgtcgcacacacaaccgactgtgtgcatgcgaagggatcgcctgtgttctaacaactctggcgaccaccgtgtgtctctcgttcgcggattccctggttttcttcgatttcttgtcttcttctcaaggcgccttcccctttgctgtcgcatccacagaaccacactgtcgctccttctctgctccttcgctacggcagcctgctgttgcgcgtcttttttccgcgagattctctcgggggaggctcttcgtcttcgccgcacatttcccctcgccttcgcccctctgcttctcgttttctcccgtctctctcttttcgctttgttcttctgctgtctccaagtctcccctctgctctctgagcttttttctggccgtcacgcgcgcgttctccatctttctgaggtgctggtgttgttttctgtctcggtttttctgcgtcacttcgcctcgccctcgtcttctcctgtccgcatttctcgtttcctccgttgaccttttccttctcacttttctcttgacgcgcactgtccattccctttctctcctccctctgtcttcccttcatagtacgcctgtgtcgcgctgcggagctgcttcctcgggcgtctctctcgtctctcttctctgcagatcttctctgccctccttgtccgtcttcaagaattcctctttctcccgctccttcactca

SEQ ID NO: 1115 - DNA, 2087 bp, Toxoplasma gondii
gacaagcacacttttggcgcgaggctagacacctaaatttgtgtgtccaaacacctgtgttttcgccacagaaatcaacaccgatatgcaaatgtgaacctagacatatgtatgtatatgcataaatatatatatatatatatatatatatatgaatacattctttccagtttagctctcaaggcactcgaacacattcatccgcttggacatcgagatcacatatatatctgtatacgaatatacatatatataactatatatgaatatttttatatacatatatgaatacaacttctgcatctgttcatgggtagcggcatctctttagctctttacctccaactgtgtatttgcggccgcgtagggacatgttctttccgaatgtggtgggagtcgagagtcagtttctcacgacactaaccttgtcagctgcgggcgattccgtcttgccgcgcggctctcacctcgtcagtgtggcagagagccgcgtagaggattttaatgcggacttctccttctttcggaggagcaaccacaatgtcagtgacctgagagagcgcgcaagccgacacagcagagacttgtccataacccaggaagccgtcgtgtcccccgcacgcttcttttctttgtagacgtaatgcacgagtggctgtcacatcccgtaatgacatctagagaaaactactgctcagtctgtctctatacctgaagaggatcccctggggcgaagcacacgaccgccttgcaggtgataggttttgctgacgtcccatctttgcctttcctatccatcttgtcagttttctgcaatttcgcttgctatcgtacactggggaaggaccgttctttcctcgctaggtcgtgagcacacgcttgaggccaagcccacacgtgaagacccaacattaatagccttgtatggtggcataaagcctggtttgccgtgttgagggaagacagcaactgaggcgaatcggcagccgagaggaacgcttgttttttccgtagaaagctgctgccgaacactgaggtcctggtctacacatgcagttgcaaccgccagcgcttgttcgtcacgggaaaagattcgctttttccccgtgtaacggcggactgccgccaaacggcgtttgaagaaaaatgtttcttcttcgggaacacattcaactgtttgtccggcgccttttgtacagaggaaacgacttcaatgaaaaggcagcctgcgaagctcgcatgcacattgccgtgtgccggccgtttgcgagctacgcgggtttcggtgatgtcgcgagttttccggggggggttcatttccccatgaaccgtttaccagtcgtctacatgtgcttcggcgtatctgtaattaaggcagattttgattttccttgggacacaggcgaccccgcggtactgcctgatacagtgctgtctcgtcacagagtcgtcggcatcatcgaatctgctgttcagtgccgcgtacgaaatcctagatcatgtgccctttccctttttccaagagaaaagcgcttcactctcggacggaagatcctacagctgaaaaggctgtatttccgccactctagtgtcgacgggtgccccagtgtgtgagtcgttgctcacagtatgcccaaatcttctctggaatccaaaattccactactccgcttttcacccttcgtccggagttcctttgccgttggtgttacctcttctgtggacaaagtgcgtgtgagcattaaatttatgactctctaaagtcctgctgagacggaggactcaagctgatacgcggttgcatttgttagacgttaacttcccggctaaacataccctctgttgacacatacttccttctgttgcgtcatcattttctcgttgtgagtgttaggctgaagacacacttatcccacctttttaggtcttttgacatccactacgtacccctgtccttggtgaagaattaactctgtgttctcccttgtcggagagaagccggtgaggcggtggaagctgcggataagagagaaacgtagcgaccatttgcactgttgaagactgtgtagtcgtgcagctgtggaaaa

SEQ ID NO: 1116 - DNA, 1324 bp, Toxoplasma gondii
gtgcttgcgccaagaggatgctggcacacaactccaatgcccgtcagagtctgtgtacttgtgatgggacatagcgacagtgtccgcattacctggacctgcaggccgtgagagacagtacggctgctccagggagttaaacgcgaaaacagttacgcacgggccaatcgtggcgtcgatggtgataagattgcccgagtagcccataggctttgcgatgtgaggagagggattttcgcacgttgtcgtcgtatgtttttcattcgcgtttcccttgctttggctgagacgttgagtgagtttgtagaacgaacgccccaaagtgtttctacatgcgctgtaccgatattagagcatctagtccgataatcggaaaatcaacgtttcattgatgtttgcttccactccttgccacgacgggtgtttctacctcgatgcctgcggcgggtggcatgcgacgactgtaaaggaccaccggtcagggtgcttcgagatgcgtgtacgcggagcgctcgagtgatttgctgtcgctgttacgagtgatcataagaaactcccccactgagcttccactcattaaatcaggcgacatactgcacccacacgttcttcacccagtccacgaattccacatgacggtaaaaattcgttcctagtttcaatctaaagcagccttaccttctcatggtgttttctgtggctgctgaaggcggagctgtggggaattgtgggttgcgcaagaccgcgtgagcgacaaatggcagcgtgccacacagtgactcggttgtgacccgtgggaacagcagccgattcgggcagaggagcgctcctaccgatgataccgcgcggcagacgcggccttccaacaagtcggaggttgctgtatcgtatgggagcgacgcacatttcagcagtcaagacccaagtgcgctagagcaacaagacagcgttgcttttcatacgcgttttcgactagtgttcttggacaaggagatgcacgggggcctcacgaggcattcgctccggaacaaaatgggctttcaaattgtaccgtcctcgtctcgccgtgcgcgcagtgccggcgtaacacacaaggctcacggcgtctctgggtcgatcggctctctgcgacggcttctttctcgtcattgctgcctctgatcttgaatgtccatctcacacgccggttaacacggttcttcactttacttgtggatagcctcagattcctgtgtaaccgtaggttcgccacatcaccgcgcaggaactagcagtgacgcgacctcttggcgaggtctagtgtatgcgcacacctcgaggtcga

SEQ ID NO: 1117 - DNA, 1281 bp, Toxoplasma gondii
tttacaatgaatgcgctcacgtacgtttgctaccacgcaccttacagattgacatgcatcggaggaacagcaaacgagtgttgttcgcggatatcaagtaatgtttcaaaagctgttgagtgcgcgtatcttcaaaggtttttgctttggaacttccggaacaaaacctgtccgtggagtgtacgttgtgtacgctcattcaccgctctgaagagttttgagttttcgagtctgtccgtttgttggtccaagcggatgaaaaaacgaggctgagcattctgacgagtacacaggcacttcccgttcgacgaggtagcaagttcgtaaaattggcattctaatcgtgtaacatgtgtgagcactattcgctccttgacctccaaacgttatagcgtttttgcttgttatcgtgtgcgattagaacggcagacgaaattactcttcattgaagtgaatcagcagtcccccatgtaaggttcaaggtacaccgcaaagaaaagatccatgatccgttagatggaggcgggtgaaaaactgttctgctggatcgttcgtcagtgctactggtgaggagaatcgaacagcagcttgcagaaagaacaaaggacactgtttcctcctgtgtcctgtactaggctgcttgatcacccaaaaaactctggtcacccacaggacaacggctagcgggcaaaatctcaatacactgtagaccaaagagcaccgagttttgcgagctcgcttggtttcaagaattctcacgtgcagacaatacaaagcagagcactctcattgcagatgctaaccttgagcacaaagggcaaacgaacggtccagactgatgttggagtgatcgctcgaatgaggcttcaggcattttgacatttctggctagcatcgtctgcagcctatcacagaataacggtgaagaattagacgagccttgggagtgggtgccttctcgagaaacacaaccattctttctctagcgcggttggttagttgctgctaaaaccgatattgccaaatcatgctcagacatagccacagccagctcctcgcgggcacggccggctggacgttctgtgacttccggagtacgttttctttttttgtgaggtgtcagttgctctaatgcaccgattgacgaagccgcgtggaggagcaagtccttcctccgtttcgtcgtaacatttataggacaaatgtagcgcttctgcgacggagcagacctcttgcgttgtttgtcgtcggtgactgtctggctggcgcatagtttcaaga

SEQ ID NO: 1118 - DNA, 2423 bp, Toxoplasma gondii
gtggctcggtaaatccttgtttgtgaagaacgtctaagggatagtttgtcttaattagtttgctgcatccgcgacattcgcgcgtgtatagtgacaaacctgttgattggtttattcgtattagttacgcatgcaggcaggtttgtgcgcctgcgtgacgtaatattgtgttcagcctagctgtacagggacggtaagcctcgccggttcatgtttgtccattgtagtcaccatcgtactgggagtaatcatccctgagacatgatgatttataagctttttctggggagtatatcctgtgcgttcgactattggcttagatcttggaggtcgttgtttgccggatccgccgtctacggtactagtccacgcgctctggttgacgaaaaacagaaagacactaagccagagtgagcgcaccaacatccctgccaatgtctcggacactttcagtttttcagagaagtacaagaaaaaaacacgtccgtctgagccgctggcaacaaagccacgcagtagtggcagtctcgtacttccagaatacaaagcgcattcagatagcgttcagaatgcatggataactccagtatagcacagtgtgagtctaattttgcaaaatttgcatcttcctataaatgttacccaccagctggcccgctgaagttgctcctcagtgcacatagtgaatgtaagctgatgttcgtacatcgcaaatgtggcagcatcttttttgtcaaaaagcgttcggttctccccaacgtgtctcacgattctgcgtctaggttacccttcccgttgtatctcctgcatcccaactgaaagctcgcaaccatcataggagcttataagcatcaggtatttaccctcccacgttccatagtcgtgggttcggaagataccgtttcgtgtttgtggcacaggtatgctggtggcgtagaataccatattgtttcacgctgtattctataccaggggtgctgcaaggtaggtcatgtatctgtactatttcggcataacctcttggaactaccatcagattgtgtttttcccgcacttcagaagttcactcctaacagtatgacagacgtgacaaagatgcagaggactgcagcgttggagactcccacatgacactggtttccaaagcgtcgaagaacatttcgcggagactctgtgtagtaactgaaatggatcgctcggttttcttagtaggggtcaggtgcagcagcttctgcgcagcagggacttgtcatttttcagtacgctatcagtaccacaccgccaatactttctcaggggataacttgcactgtaacattcaggaactttccgttatattcgatggcagtttgtattcacattggtgtaactcaggtcgactacagacaaaatcggagctaggatactgaatacgactccaattatggaatgcatacagtcacgttctttatgaatgctgtataccacttttatctcttgttctttagacatgcgccaatcagcgacgagtgacccgtatggtcacgcgcaagaaggcgacgtcttgcttttcttgcgcagtctccaatcgtttttctttcctatcgtggccgtcaagacgcacagagtgttgaattggtcagttgtgttgcatgttgcagacacatgaacaactacctccagagagccactcagaaccgcaaatgttcacgactgatgcctcttttttctgtgcgtagtgtctcctttacatcggagcacatctgcgaaaacgtcggtggacacgtgttcacgtttgcgttgcatgcaggcggcagcagagacagcaatgggcacatctggtttgcgcatttccttctcttttccgttggaaaggaacttcgggagttcgaaggcgtttgaagtggagatcccgtaaaatgcagtgctagttgagacggccctggcagcacacatcctttccagggggcggacctgaaaaattagcacgtggccaacgcgacccaatcgggcagtcacctgcacacggcatcgggcagaaaagccatttgctttcgtcaaaactcaactgtttttcccgtacacctctgtcgaagttctcctggctcagagctgcgtcttgcccgcaaggacacttctctcgctgtgctgggcgttgtctctgccgtagtaggcacaccgtcaaacgacagaggggcgtatttttcgccgtttgtcccttcttcccgagttctcaactccagttacacttgctcctgtgtttaccgtgggctttttctggcgccggtttctcttcttcgtctccgctttctcctcggcaaaccaccgacaagaccggcaagcagcggtcttgccggtgtcttcccggaggccggacctctgtgctcgccccggggacttccaccccgtgattcacggctgcttttccccgcgaaaaccgaaga

SEQ ID NO: 1119 - DNA, 1223 bp, Toxoplasma gondii
cggcgtcctaggcttacggcaattctccgttgaacctctgcaagaacgctctcgagagtggactccagcctgtcggctaaacgcgccgtttccgtctccggggaagaggcgagagaagacgaagcgacaggcggagcctcaaacgcttgctgctcgagactcctctcaatgcatgcatcgagccaagcgcctgcagagaaagtgggggcagagagggcgttgaaagcagcagagacagccgaagactggagagaagcagaagacgacgaatttgaagaaggaagcggcgacccaggcaaagcgccttctgggggcttcggaactggagacgccatggcctgcaagtgagcagggagaacggaggagaagcagcaggaacgaaagagggcaaaaaggaaagaacgagaaaggaaggcgtatgagaagagtgaagagaatgaggaggaaacgagaaaagcaaagaagcggacgagggaaaagaaagagaagagagagaggaaagagaagaacgaagaaaaggatggtgagtaaggaggggatcgagaagaagaaaacttccaagacaccaaaaccttaaaccgtcagagtgaggcagaaacttaatgcagggcgccacgacagacgcgaggtgtacagacactcgaaggaagccttctgaacgaacttcttgtctcgtttgctaaacagccatcttgtgaaagacgtttacaagctgaagcgtttctgtatgcgtcctcgtatgcgttgggcgactggcgctgcttccgaggattaaaaaaagcataggcctggcgcctcctgctctcagagcgccgctgaagctcgccgtttccgtgacgcaggatatcctctggggtgttcgtacacctcagtccacggggacgggccacagacaccggaagcgcatctctggctgaaagatctgcagagcagaagtcatccatgcgctgggcgggagaccaacagcgagcgttccccagttgcagtttccttcatcagttccgcctcagcgtcgcctcgagacatcttgaatttttgtttctcttcagctcggcttttcgctccttctccgctgttctcctcgcgtgtctccccgtgtatatacagacagctctcaaggttcaggggggtgggtgcatgcatgcgcgttgctggcggcaaagtcgcaagggagaaagcgagtcactttctgagtcctctcatcacccgaaatctccacgata

SEQ ID NO: 1120 - DNA, 2094 bp, Toxoplasma gondii
aaggcgacgccttcctcccgaaccgcgatgattttcaagagggagaccatctgaaatcctccgctgtcggtcaggaggtttcgcccccatcccatgaagcggtgcagcccaccggcggcctccattcgctcgacgccaatgtgtctgtacaggtgaaatgtattgcccagaatgatcggcgagaacgaggccggcggcaggaccgccgcgcagttcaaggcctttgccggcgaagcctcaaaccgcgacgcctcagacgcagcggcctcctctgcagtcgaactcgcagacgcgttctgctcctcaacagaaactgcgtctgcagcggcagaaggagagagagaagacggagaaggaggagaagaagaaggaatagaggacggaggagggtgagcgggagagaagatgagaggaaacgagttccgagatcgcggtgtccggaggcattcgtgggtgaggtaggaggagcgattttctggagagacaggcgccgacgggaaggcagacgagagacaacaagcgtcctcccttcgcactttggacggttctgagacgttcagacttgcgtccctagtaatggggagttctgcaggttccttgccgactttctcggcgtccgtcacagccacggacggcgcgtccccaggaggcgaactacctgcgaatctcccgcgacagccgctgcgccgctcctcccgcagagtctcctcgtggatgagctggaggagacgcgcattcaatcccttcagcgttccgtacgtccccacaggcatgaaaatcggtgtacgtacgtcgccgtgcggcaggtggacgatgctgcaccgcgcgcggccgtctgcatgcagcagggaaaagcggagagacgcctgcagcgcctctgctcgctctctggacacagttggaggcggaggcacagagaaatccacactagaagagtgaggagaagaagaagagcgaggaggaggagaagaagaagaagaagggggtgtcatggtggagggtggagaggagggcgagaggaagaaggcagttgtagatctctggtgacgtggacagttcaggaatctgaagactcttttttctcccctcgctccgctgcgtcatttgttcctttttttcgcgttcgttccaggcgttctgcatgtcgccttgaggcttcggggctccgagaggcgcagagacgagccacagcgcgtttggaagccgagaggagaggcgtagaaactgaggaaaagttgaatgagggatcgtcctagaaggggaggaacagggaaaaggaatgaaagttttacgtggcataaaagacagaaaacggccctggagtgcggcccgcatttgaagcgcagccgcgagcgacgagacttttccgacctcgcgaaccgaagaccggaaccacgagtggagctacacccgaagttggacggcgggcgtttctgtcggcttttccgagaaagccggaaagtgcctcggagaaaaagaacctctgaacagagttcccctcaacgcgcttcagggtgctggatctccggctttcgccgccggcgctgacgcatgcagagaaggcgcgaaaaaggtagaacggtgcatgcagcttctcgccgtcagctgagaagaagaaaagaaaggtcttcatttctctcctttctcctgattgcttgcttcctgtttcttcttcttgcttcttccctcaccgcgcgtgcagggaggaggattcgccgtcttcgcctgcagacccagagactttcaacagaagaagtattcagttctggacagaaaggtgcatgcatgaaaacgttaagcaaagaactaaaatgtctgtgaacttgaatgtgcagttgcgtgtgtctttcaagcgcaggctgcgtctgaggtagctcctgcgtgatcagggatttcttgaagaaactgcgtccgttcttctgaaacgccccggtgtatgtacacccgcgggggtctcgcgcggggcttctcctccgaaagaccgtctcttggagtcctcttttggcggcgagaaacgcgagaagacagcctcggaagaagagaaagatatgaggtaaacgaggggaacctgacgcgcgaaaagaaagcgagaca

SEQ ID NO: 1121 - DNA, 2981 bp, Toxoplasma gondii
cgcatcgtatgcaggtcggtcgatgaagttctacacattctcgaacaagtccgtggatggcctcggtcttgttatttccaaactacggcagagttacgcgaccgtcgggaatctctacaaagccatacagaacgctctgagcaggagatcgggacgtttaggctggtcgttgtggaaagagctcctctacggtgcatgagctgatgttgtgtgtcttgatttgaacaacgtgtgaatgtcatctttagttggccgaatatcggcgcgtcccgtcagcacctgatggccaacaacagctgctgctgtacagtggtactttcccgtagtgtaatacaagtggaagctgtaatgttgcttgtgtgatgtaataaaatcgatttatcagagcaacgtgggtagtgaccgatcacagagattgatcttgtgatggtcaacgcaatcacagctgggaatggccatgacggagccgaaccattggaacgcttaattgcattgttgcatgtgtctgacaattgttgcagaggatacttcagattgataacatgaaacttccctgctcatcaatctgacaacttagaggatgtcagttgtcactcttgtgtttggtaattacagatccaactaagtcattccatcattaccgcgggtttacgtttataacagatctgagactgtttccacacggcgactcagaggtcgtcgtgctctctcagtggggatggtatgctgagcacgctggcttatttttttcgctagaggtggcacagcaactcatatgtatgatcgaaccagcgtagtaagttgtctcggtgcacactgaagtacttccttcttgaagaaacttcccggctaatggcagccatcgccactgctcagccgaagtcacaggtgagccgtggactttcttgccacttccgcagtacgtatcaccggctaaaaggcagtctaaattcgcaaaacgaaggaaacgatggtgagactcggtcggagtacgcgtaacttgagctgttacgcagcagactgaggaagcgcgagtgagagtatgcccaaagcgtcgtgctcaccgcgtgcgctcacagtcgtactgactcccggacgaacgagccatctagatgcgatcgattgtatattcatgtgggtctatcagtctcgctcaaaaacaatgctgacatgatgtcactcgacggaagttgcaagtaaacagcgctttctcgtatttacatcgcctctcaaacgaccgtcgaagagttttgaaacagcaccatggttcacattggaggagagacacaaatcccgaagaaaaccgaaagttgttgcactccagcatttgtaactgttacacctaccacgctgacaaacccgtccggatttctgttgtttctgtcactttccgggggaaaaagaacactacataacatcggatagctgctgctacgtacgtcggacccacggtgggaacgaacacgatcattcccagggcggttgaccgtaacaatatcttaaaccacaataaccagaacagttattcctacagcagcgcggagaaagtgtgccgaactccgtcgtcgctttggttacgcccacttagtgccagtgactcaatctgcagagtactctggagatgctcgcattcatgctaggttctgggcatgtgacgtctaatcgtggaaaagcctgaattctgaattcgggattgtggccttcaggcctgcgactctaccaaatatttagccggcagatcggaagcgcgtctctgtgaaggacacatgtgtcacgggcacttgcttatcaagcggcgtaagactcgccaggcggagagagtcaccgcttctgtttcgaattacaaacagctaataggtaagaacgtgttctatgttgttgagtctcttgagcacggtacacgatgtacaaaaggtgtgcataagaaaggcaccagcgatgccgtcgcgagtactgtgattccatctcgggaccggaggggagggggggggggggaaaccaatcatacctagcatcgtggatgcaacggtgggtagaatttcgacagcgtggatgacactttgttcgtaccgatgagttcactatatatgtttcaaagcctattgtatgtcaaggcggatggatacagacacagccagggcctttttccagctgatcgtcgcactcgccgccgagcgacgcgttaacggggtcattttgtgtggcatcggtcttgtcacacagaatttcggtcgacataggtctcgcattatcgggcattgtcccttctgatgcttgtttcttggtcaggagagtatctttttaccgcctggccgcttccctgagtttgctggttctgcaggtgcccggtgtgatgagcgcagctgcatcggctgcggcttcgttgaacaagcaccatccgtcggggtcactccgcgtgtttcgtgggagtcgctattcggtccgtctccctcgagactatggacaatttcgtcggagcagcggcaattttgtagtaggacatgtttacgtttgttgttatcgttgtttttgttccatcgagggacatcccagcgaccgcttcggcagccgctgctcgccgcttacattagcgctgctctctccgtttcctgcaatccaatcgagaggtacatcctctcggtttcactagcttgtgaacggaacatcctaccgatgaatctaatgactgatcttaaattgcatttagcaagttaatttcatcagctttgttgtcccatttccgtgttccgagcctccagtcacatctgtagggtgaacgccctgtacctgcacccgaggtttttttgtgttgatatctctaccggcagtgcatccaatagcagagacctaaaggttattcgaattgcgtatgctattaaagaatcagaggcattatgaaagtacagattttgatatgctgctgtcggtccatcatcaggtattaaagttccgtgacgcagcagtaatttaacccaccgcca

SEQ ID NO: 1122 - DNA, 3011 bp, Toxoplasma gondii
tcgcctctgtgtcgacagacctgagccatgtgagactgaaggcgatggcgccgaggtggcttgtcgccgcggggagccgggagaaagttggagggcgcctgggctgtggcgcgatgcaggcgactcgggagcctggggtcgtgctccgggcagacgcagcgaaggcgacgcggaccgctgaggctcctgaatcccgcgagcggtcccgcgaccgccgccgtcagacaggggagtcaggcgagagtgcgacagagaattttcatgcacggcgctggagaagaacagcggcggacccgcggcggttaggccagacggagacacgacgcctgaggggaagtgagaggaggaagcctctgcagaactcgcctcggaagcagtcgatttctggtcggaggggaacagaggcgcaaggcgagtcggagactcggacgtctcttgattttccattgtgcagactaaaaactactccggacctggcggaggcgacggtcgcctccggtcgaacagggggacgcggaaagagtggggaacggcggcaacaaggcgaagggacgggagtctggagggggggagggcggaaggcggagcgaaccggaaaatttggtggagaaatgatggagaaacgcggcaacagacagagccggacgagacgagggaaagaccgagtcaaccagacaatgatggccgacaaaaaaactccaacgaaaaacgctggcaacggattatggaaagaacgacggaccctttcgacaaatggcagcaaataaaaggcgggagaagccgagaaagcgcgtgttgagggatttgctgacgtagatacaaactgcagttacttgcattcgcacttgagcaaaactgctgaggtgtacgtacaccgcagcggcgacgggaaaaggtcgccacacactactgaacaagagtagctgcattcactcgtgtgggtgctctgcgatttcttggctgcgaagcagacttgcgggggccacagtatgtcgcgcctacgcaggggaggcgcatcgagcacatccgtcgtcggcgaaacttcgcgtcttccagcgatattccggcagccacaccgtccgttttcgctcgactgcaagtatgctcagcgcgtggccaaggcagaaaccgtaggcaccatgctggttcccgctcttcgaaaaacgacggggaaaagtgtgagatctggaggcgtgcggtaagccgcatgcagcttcaacattctggcgcgagacaaggtacaaacacgcggagtcgggacaaaatgtgaactgtcagcgaaaaaaacggaatggacgaaccgacagataccaagttgacggatgaagtgtctaccggatccatggacgaaaggacatctcaccaaaaccccgtgagtcgaaacatgcgcgaacccggagggacacctgtggaaaaacgaccgacaagaacgaacctcgacaagaacggcacacgtcttcgccctctcctccctggagagacacagcaaacaacagagagagaacgggaatcgcgcgaaacgaaaaaagcagtcttcgcgatcgagaacccagcaacggcggggaaaaggtgcccctggacgcaaaagcgggatggaacgccacgccacgcaaagtttccacgtcaggggtccttgaatcaaaccgggactgtttcacaggttcatctttccttcacattttcctcgactgcgttttgaagcttccccgaacttgaagctggccggttccccagaaacggggccacgacgccctgtctcggatctgtgcccgcctgccagtcgagagcgcttcctaacaagaaacggagaccgtccaacgtttgaaaaatcggaagtgcacttgcaaattgaaagttctcgagggtaagcaagctcagtttcatgggaagccacttttaaccccaaaatcaaacagtcggtacgggggtgtgccgtccacctctatgtctctcgaaatcggccgtctcgggaacggaacagcctgcaagcccaggccctccacagaataccccagaagtttcagctcatgcatttagatgctcgtataacaacacaggagaactcttatttttgttacccagcaaccagacacgcaatcgcgcgttcctaactccagagcgccgtagaagggcggcaattttgtgtcagagacgctcgaatgcacatcaccggctgcttcagatctgtcaacgctccaggcgtgacgggagcttacacttgcaaaaattttgtgctggtgcttggagaacgagcacggcccgccaaactgtgacaagggttgagacttcctgcctttccattgcgaatacgaggcttctctgctggcgtgtcttgagaagccgaactgggtgttctccacgacagttcctcccaagtagacagtcgagaggattcgacccgctgcattgagctttttctagcaatttcgaagcgttgctcgcgggtgcgcctagatatacttttgaaaccaccggtgcctttgagagtgtacgcttccttcccggcggaacatccttcttctttgaaagacgccttcctgcttctcgcggttcgtacgacctcaaagagtacccaatcccacgtgatctgtacagtataacgaggcaatagaccgaaggaagaaaaacccttgtgaccagccgcagacgcagcacaaatggaattctgccaccctcgtcttttccagttcagccgcaatcgcagggtcttgcggagaggacgtggacgaagctagtggagtccttcttcgcgctattcgtgtgggatggtgagaaactgtacataaatctgaatgagcgactttataatgttcctttcacaacaaggctcctccgaagaacggggtgaaactagacgcatgagccatccgacaactccgccgtcagggcgcttgtcgccgcgcttcgtgtaaagaacgcagaacaacaactttctttgtttcggggcaggcgtatcagcgtgaaccagtttcgagcgtccgtttccttacgtggagattcgcaatcccgcg

SEQ ID NO: 1123 - DNA, 3200 bp, Toxoplasma gondii
ggcgggatgcagggtgtttctggcacttccggtttagtcttgattcacaaaacggagtttgtcattgcaaaaaatcacaattcaaggcgcgttggtctacggatggtaggcgaagcagaatgtgcagcccctgtagccgtgtgatgtcatggacgatggctgctctgtgaggcagtcattcaagaacagggttgatcagatgtcgttgtctttctttgtcggaagcttggtaacataaaaatgtgttagtcctcttcttccgactcttcggataacttgtttcccttggcgctgctcgctcctctggagcctttcccctgtgccacatgacattgtcagacgaaacacatactggatcgatagaagcactcttacgtttcttcgttttttcttcccaaaagtgccttctgctcgggactcctcggcacggagtttcgccaggcgatcctgcatgctctctaattttgttagcagaacctctatcttctcatcttcaagctttaaatcatcttttagaaagaccatatcagctttgggctgcaacacggtgtgtctgccatagacgcttatagtgagttcgcgttttactcaccgcagccccagccgcagcgtttgaagtaacctgacgtagctcttcttgaagcttatgccttgacgctttcgtctagaagacagcgtatgcgttagtgagataattcgtgttctgaagaaggacggacttcctgtagcatcgcctccgtgtctttaatctcttcttcgagctgtgctactgtcgttcccttgattgaagccatttcggcgagttttgcagtgcggatagctcgcatttcggcagtgttcatttttcctcggcaggcgatggccctcgaaaactcgagtttctccctaggacaatggtagtgtgggtctgttgaccaatcccagcgtcggaacgggttaactcacattgcgctagtgtcgggagagagtaagacgataactggagccgtatacagaggaggtgaggctgaaagaaatgacggcgttagatagtaactggttggaagacggtgtgctctagcgcacccgctgcttccgttgttatcccttcaagagtctatggttagattataattttcaacagtgaaacctattgttggcaccctatgaacacctacttcttctgccttttcctccgggttcgccgctttctctggttgcggagggttgatcaccgtcgacacgtactccactccctattagagtcaaatggtgaaaaaaactgcattattcaactcccactgagtgcgtcggaccttcctctcatttgctccagttgccttattcaagtcctagatgcttggcgtgtggaacggcttgactattggatgttttaaatgactaacgttgactgcttcttccagcttcgaacccagggattcagctgagttgccgtgtcaagccgtgaaccattattcattttcgcatgtctccgcttaccctccttcagtttctcagtcgcctgattctgaacggctgcctgtggtggggtattatgaggcatcagtgagtgactcaaaagataacactccttacaatatcttgcaagttgactggagcaggcgttggcgtgggctgtgcgccggcgataaccggcgccgggtatgggacagcaggagcagccatgactgccccctctactgctggtggcggaagcggtccctcggcagcaccatctgtgtgtgtgagcacagttttctcataaatatacacgatcgaccaccgaacgctgccgtaccttgctgctgaaggaaacgggagccggctaagttaggagatgctgctttgccccgaacgtgcttccccagcgcatggacggctttatgatgacgcgcatatgccgcagtcataaccaaggaaaaaacaataataagcgaaggcaattttatcaacattttgctttgcgttggccgtttgtgcagtatagagagttaaattcgtgacaataagctttctgcagcagcggcgcctgcaccaccacctcacctggtgtccctacagccgcgagtgcgcagaaaggctgctgaaaaaggcaggcaagccactgattggtcaactgccagtagcatggaaagcgttctccggagagcacaagatataacgaactgctgcgccagttacgcatggttagctgtgaagcttgtgaagagacaccacgcgcaaagcgctgctactgacatacgtttgcatcatggaagagattcgccgttcaaatactgcaggctgtcagttgatgcggagacgcagacatctacctattcaacaaaaggactgtctccaacgtctcaccaatcgctcagtcaacaggcccggaacagcttcattaactttccaggctgctgataccgatcaatttttactccaacgcactgtgaatacttgaagctcagttctgtgtattacatttctttaccattgcagtgtgttggaaatcgttttgacattgcctaccttaatgagggggggggagagcgtccgccaccatcactatggacgtcatctaagcatacataagcgatacttctgccaacgatacctcaaaatgtggaagcgtacgaaccccgtcctcatctgttcacagaatttcttagcaattaatatttgtgtttcgagctaagtttgtttttgacgtaaactgcacatgctctggtagcaatgggcagcgctgtcccgttctgcgaacttcgaatgcaggcatgcatgcatgcatgcgtatggaaagcatttgaggtcgttgagccagcccatgtggggggaggaaacgaacttccataaattcgtcctggggcaatatcatttggtactgtattcattgatgactcagaaattggaagactcaagtgatttgtgctgtgctgcgaggcacgctgtggcctccggtgttctggccagaacctattctatcagagcgaggtatggattctgcgtcaacggtcgcattggctgaacgttatgttcaaagagacaatcaacggccagttatagactgtctcttcgctactggatgcagcagacagcaacgaacctgggttgcacttacaagcgggtcaagttcgaaacggctcgcagcgcttgctgaaacgaggcagcagcaggaaaggaatctatcaattgtgagcctgtcgtcgccgctagaagaacgtctgatacgacgcctgcga

SEQ ID NO: 1124 - DNA, 3507 bp, Toxoplasma gondii
ataactagcctttgtagcggaggcttgtgaatcaggtgctctttgacactttgctggactgctggcctcacatcggccgtctcgcgtgtctggaagcagtcttcgttgtcggctttcaagctggtcggtgtttttcgtgtaacagttttcttgtcatgacagcaattcgacaagggaagccttgccgccttggtcagccaaactagtatatggaaggggtcatgtgtagctttcagcgcgatcagcctccggagccaattctaaatgacaccaggtggcagaatagaatgtctgctatcggaagcaagccatctttttctagcacgatacaggcttttgcacgagaccaccctcttttgtggcgccgatacgagcgcccgcagcgctatgtttattcttaacttcaccccactgtttcttagtgcagagggtagggacgtcattggacaatttccagggactaggagctccaactgagcattctttaaatgcgttttctttgtgcagccgtgctgaaagagagacggtcgtactctacaaatgatgctctgccgcacaatgacctctctcaattctcctctcagctatctgtcatcagtattcccaatgagcgtcagccatcatgagctgcacatggtcatcatgcaccatgaaaaaaggcatcgaatgctcagagatgttcatatggttcactaccatcgtgtacggccactggcagacgacctgcggatgtttcaagcggctatccagccaagggactcaaacattcgcttttcgcagtaccgccatgccgtcctgtttctactgtgaatggcgtgtcacagccatacgggcgattaactacgaaatgactaaaggcaggattgggttactccccaagtgccccattataccggacgatctgagtggctatttcacagtcggggcagaaacgactatcaacgtaatcattctgagggaagttggtttcgtacagcagctactcgctagcaggcgctgccaaaggacgaagaatagatgtgaagactccagcagactgccacgagtaacctgacaacagactttttgtccacgagattgcgattcgcctgaactcgggtttgatcctctttccgttgtgtgtatgttctggcgaatatcgtgggtaacctacagcctccgggggatggttcgagcttcccacgcatgtgagtagtgggaatggtaacatacaaataagttttcttttgtttcaaattttagaaacactggtccaacacgataaacttcatgccatccgtgtgtcttaggcgtggctagtcagctcaagtacacacgagctgggccagtagctgagtggaaaccaaatagtcgtcacacagagtgatagctctcggtccgccaaaacgctaccaggctttttctcgatgcagaacacatgcattcatcaggtaggtgcacgcaacttccccgttcagctggccactgtttctgtcttcctctcgccggagtggcaacgacggtaacgaaagcatagagcgaattcgcaatttcgattcaacttggcggtcgcgatgctgagcgccctgctgctgagcgcctacttgcttctcccggcgggagaaagcagtgctgaatctaggacattctctgtctcccgtcgaatggatgggcattccccgaaagaagggaactcaaggagtgtggacaccggtgtagaaatgatggaacacacaagagggcatgtcccgtccacggacatcaagacctagcgcatcgagcgcttcttcgaccgacgctcttcatcgacaagtttaatacgtcacctgcgaagccagcgtgagaagagaggtgaccaaggttcccttcagagtctgccaaagaacccgaacaaacctttctaatatgatgcgactccagtttcttcaaatttacgtttttgctaaagcaaaccacgataaaacacagttccttttgaaagcaacatggccagatggcgttccgatggtgcgtctgaagcggcgaagagttccatttttcgggacggagcacacaaggaatcgcaaatgttccctctccacatgagtgtcaggagctcgggttcatctgaaattcacactacgtggctgtgaagagttgacatctctcgaatatttttcgtctccgcgctaaagactccaactgaagtaacgctgtcgcacgtgaaccggacactatcgtcgtttgccgccctgacgcacggggatctcctcaaagaaacttctcacgagtcattctcacgttctcaatcagggtaaggacgccaaacactctatctgagtgttttgaactcctgcaagttgcaaccgtgcgtgaacgagaatggacaaaattatataactaccttcaagcgtggggaaacagaggaccgccatcccacagcagtgaacaaagatgctttattgcggcacttgaaaggcttgtttgcggaagtgctggatcagtgcgtggattcaaacatcccctctcagcggtgttacacgattcgcagactcgatacatcttacgactttgccctcaaggctgtcacaaatgttgagttcatatccgtttcgaaagttgcagagaacttggtgcagtcaagatcaagagccactgccagcgctgttccgggagtctttagtccgagcgacttggaacctggtagcattaattcacacactctactacttatgttgcccttgaccaccgcgcggctgctgtactgcgtgtttccgcgagaaattactgtctttggttgaaacggcagaactcccggccactccctcggaagatcgagcccttcagctgttttactacctatgtgccatctacgcacaccgcccagaaactgcctcgcacagtcgcgactttgtttcgcgttccatgaggctcgacaactcaggaaagactctttccgtagacgtgttcgtcaatgaaaggaattctatggcggcagactatcactataaagccgtaaactgcgtccgagttcacctgtactgcgatgacaggtgcgaagcagaagccgagcgagagacccttgagcgttcactcttcgagtccgacgcagcgctttttggcgacgaatcctgcctgattcctttgatgagttgtggctgcgttgcgcagcaatgtgcactcgaaaaatccgcgtggacacgagaacgccgcaacattccaggataaaaaaaattcaggactcgtactggcggttgtacgagtccgcaagacacagaaaggcagctagccagtgggcaggtcggcgccgttcacgcgctgggccccgacgaccagactgtcggatcccccgcgaagtcgcctgaacgttactttttcgtttttttgcgttttttgaatccgtttttcccagggaccctgaagtctctgggtcgttggaaactcggcgttctgttcgagaaagagctgaacagaccaaagtgacccgcaagacacagcggagactgaccttttgtgtccccttcgatcgcgcctttccccttgacacaa

SEQ ID NO: 1125 - DNA, 3911 bp, Toxoplasma gondii
ttgcagcagacacccagaacgcgcagaagacctgcgtcttcttcttcctcttcctctgcaccggagtctacgaagtaaccaccttcggcgcctgttccccgcgccccctgactgtcgccctcgcctttcctctccatccccagaccccacactgccggagacgcaggcgccgtccccgctccgcagcgcccacccaaggcatttcctccggactctcccgcgccgccggggtcctgtgagggaactccgctggcgcaacctggccctccaggccccttgtcgccccggcgctcctcgaattccaacggaaggccctcaagccccttgttgtgcctgcccgagggcccaggaagtgtctcctctcgcgcgggagctggggcgtccgcgctgggcgactcggaacgctctgggcctcgctgaaaccgcttcttccgccggagacgctcttgcgcctgcaaggtccgtcgccgctgtctctccgcctcttcttcgtcgtcacagccgggctcgttgggctgacctgcgccgcggcctggaggagtccgagaagaaaaacgaaaagggaaggctccttctccccctccggaggaggagagtggagcgcgcgaggccccagcgacatgcgctccgggctcgtccaccgaagggcgaggagacacggtcggggcgtcagagtctccgacagacccttccgcccctagagtggagccccagccgccgtcgtcctcgtcgaagtcgagctcgggcgccgccgcccacttgagggcgttggagatgaacagagaccatttgaggctctcgttttcgaccgcaactgccgtcattacatcgtgacctacttggccgctgctgggcgtcgcagggcaagcggggccgatcccgaggcggcctgcgtcgcggcgcccggcattctgacccgggggtctgcggctttctcggaagccttcgtccctgtctccgtggggtgcatctgcgccttgaggggcgactctccccttcagcgcgcccaaaatgccgcccaagccgtctccaggccccgcgcccggcgctcccggagccggccgcctcgaagactggcccccgggtcccggaggatctgtctctctgtctcctcgcgggcccatgctcggggcgccgggcccctccaaggcgtccacctggctgcccagtctcgcaccctttggagcccgactgaccccacccttcccaggatatcctgcttgggctccagcgccccctgcgggccccgccgggccaccgccccgactcgtctccgccgctgcctccgcggcgagggccgcggtcgcggcgacggcggcgactgcgaggctccggctttgttggggagtcacaggcacaaggcccgttgtggggacgtagccgtgctgaacgaactgtccgcctccaaagcctgccccgaaattggaggcggagacagcgcccggaaacggatgaaacgcgggtcccctcgcgggggcgagggcgatgccggctaggcgaggaggcgcaggcccgaggggcgacagagacgcggcgagcgcagccgtggcgccgaaggctccagcgggcgaaggcccagacggggcggtggggcccgacggggaccccagcgagacctgtaggccaacatgcgaagaagcctcagaacgtgcgccggctgcgaaggcttggtagggggcagcaaagcccccagcgtggctgtacgggcctccggggcccgtggggcctccagcgagagacagtgaggccccgagaaagttccctgaaggcgccagaggcaccgccagcggctcctctcggggggcgccgtacccctgagagaaagacatctgggagcatccacgcgcctcgccgcctcgcgcgctcgcgagaaggccggaagagacaagagcgaagccccaaggcgtccttctgtctcctccggggcgcggcaggtcctcgaccggcggggcggcggtgacgaaacctcaggaggcaccagcaaacgacaccctgcggggttcctctttttgcagagaaaagatctcgactctcccggattcgccgagcttctttgttctcgagttcgctttcaggcgaggtaccctctcacacacagaataaacaagtgattcagacggcgcgcttgggcgtcggtctacctcgaggcctctgccgccctttgtgtgctctctcttcgcctcctcttgctctctctttctcttttcagggtgcctcacctccccggcgtcttgttgaggcggcctcgcaagccccgctcgtcccttctgctctccgttcataagccggagggcccaggacgagtgcagcaaggagagactccggcgcggcgacagacgccgagaaagaagacagaggacatcgaagaagagagcatgtgagaggagccagggaaggcaagcgcgagaaaaggaaacaagggtggcgacggaagcgggagagacaagtgaagagaaggcccactaccagaagacgccgccgcgtagcagaagacagacgaggaacgagaaaggacgagtgtatgcagaagaagagacgggctcaaggagaagaagaaagagacctcgggagagggaagaaaccgacgaagaaaagagaacagacatctggaaaagaaacgcgtttctagacagaagagaggggaatgcgcgtagcaattaacatgaaccagagcagagaagggaagaagcaaaggactggagacgtgatgaaaaagacttctctctgccgatggaagaaaacgaaagaaacaaggaaggttggggaaacgaccgacgaaaaagaggcaccgggacggggccgaaacagcgagagggcgcgagcgactccagaggagaagccaagagaggagagaggaacgacaaaaaaggggggagagaaggagaagaaggaaagaaaagaagagagcaaaggagaaaatggttgaggggggggagcgggagaggaaagtgcgtggcagatgtcttttctttcgttttccttgaacggtttttcaccgtcctcaaactctctcttccagtgtccccagacaaagaaggtccgtggagaggctcaagcaaaagaggccgactggtagaagctcgcgattccggatggctgccgaggctgacgtagagaagtctctcgctggagaaggcttcttcaaattttctttcatcggagaaaagcgtccgcgttgccgaaatccggcaccagcgagctgtgtgtcgcactcgctgttcccggctctcgaactcctctcgactctcccgctgcatgcgagcggcgttcctctgctgcgcttcttctgcctcttctctcgcttctcttctttttcagcctctttcacatttgtcttctcctcctcgagctaggtctgtcgcgtcgttatgcctgcctgagaggcgctgtgtgtctctgcctttccagcgggggagagagtgcagatcgcgcttgtacgccgggaaagaattcgagagagcatctctcaccgaaggcctcggcgctctcttccacttctttccgatctctcggaaaacgaaagcgacccacaaagcagactcctcactctccttctgcgcttgcttcttctcgctcttcttctcccgctctcctcctctcgatcttcgcctctctttcttcttctgccgattttttctcgcgaacttctctctcgactttctcccctcgactttctcccctcgactttctctccggcggcgacgcttttcgttgccggccctctccgtgttttctcgcactgtcgcccctccgtgactttttctctctcgagttcgacttcgtttctgtctcctcttcttttagtagtggcgagggaagcacggcgactgtcctcgcatgggagctaaaggctgaggagacattcacctcagtcacgccatttcctcttctcttctctctgatctccaaca

SEQ ID NO: 1126 - DNA, 4806 bp, Toxoplasma gondii
ggaatcaagggatcaacagacgtgggagataataatttgtgtaccacggcagcaaagcatttttaggaaatacagagtctttgtgatggggaacatgcagttctttctcagctcgacttactatggctaatacgctccaaactgctgagctgcgaacatgccgtgacttgcattctcacgcccgactgatacacaaaaagcttcgtgcggcggctatcatacgctcagaagtgagtcatctcagtgtttgctaacacaaagacacttccacgttcctgggtggtcccaaccttgaatatggcctgttttacaaattctccaggcgacactgtgtaggatgcccactgaggaaagcgtgcaaactttcaggcggattggattctcgttggcctgacgcctgtttaggaactagtggaacgctttttacgcctgtctagaaccgcagcacagggggaaagaaaggtaacgaagactgataatttttgtgagaaaaaatctctaaagagttgcttcatatgtagaactacctcttttaaatgaagaccacgacgataacagaagagcagccgttgccgccgaagctggtagccttgattaaccattcgctcaaagatgtttcaagatgactcttcgcactgccgtctgtagcctttgccagctctgcactgtgtggctagacgccaatcaactcgtgacttgataaatgctgttgttaaccgagacaggctcatgcgctcgcttggatcagacccgcggtcaatactttctccaggagttgctccacttgaatcattgatgctttcagcaacgcagcagcaaagctgtggaatccccagggcacgcggaagtcctgaacaaaagacctacactgttgcaaccgtaacggcacacatattccatagacagcacaaaacccagaagcccgcctacacacgtgagatacagacggagtctgtatggggtgtatacgcgaagacaaccctgcttgcacgcaatctcccgtttgattgctgtgacgtgcagctgtttgccggagtgtggcagcgattaaaatctgtattttacagggaaccatcaggctatcgttggcgctagagcatgcgcttgggggctgaagtccctttccacgccacggacagctgtacgactctagggaaatcgccttgattcgtatgagacaaggcactttacggagaactgtctctgtgcactggttgctgaagtgctagtcatatgcacttttttggtactgtaatgtctttttctgtgtactcgatttgaattataccgatatgaaggtcgaggaacagaaggaagaaaaattcatcaggtcgactgcatgcgtgtggcgggtgtagcaccgcggcgaaatagcggcgtggccaaaacgagcattctgtattcggtccttccttcccttttttgctggcatcattgagtggagattcgtccggcacgaagattttgagacagtttacatcaataccaaccgggctgggtggcatccaatgcattggatcttcttcgaactcagcttttcaaggcctagagggtgcatccgcgttcgccggatgtcgatggtcttgtttgtgtttccatattgaccagtacatttcagggttaattctccgcatttgttcattttgtcacagatacagacctcattaccacgctgatcagcttcctccagttgacattttccgtcaccgggaatagtggctggccaggccagcggccatgtctccgaagaaatggatcagactcacacgctacggacccgcgtgatgctccactttgccttcttatcttgaaaatctgtgacgctcagcctctctgtaacggcttcatcgccgtcgtgtgtttctgcttcagtgcggaggtcactgggacctctggtgatgatgccgacacgcatttgaataaggggtttgggagctgcgctttacagccctcacgtggtgcctcaactcggactgatgaggaagttttcttttttgcctgttacagttgagcggctcttgccaagcaaggcaagcctatcccggcacagaacggcgaagttgctaccgatagcacagcccgtctccgcggatgtccgagcgccgtgcttagctggtaagttcttcagaatccgcgaacgataatccagacgtgagaattatgccgtcctcagcctttgcagtcgctctatggtctaactctctcgctcaaaagagccatggagagaatatccaacaaacaggccttgcctgtagtgctaagtatggttcataattcacccctagctggttctgcaagtgttcctttgcctgtgtcgcttctggtctggtcccttgcgtgcagcagatgcaaatcctcgacagcagttcgtgttccaccaccttcagtcgtgtgggaaagaaatgagttcctccgctttccccggaacccgggccgtgtgggggttcgactgtgttgcacctcgcacacaaggtcatgggacgactgtcgaatgcaagttcttaaggaactcgagacgctataaagttgatgcagtcttcaaggggaaaaggtcaatgttccccagcagcgggcccatgcaagactatggagtctctcattttgacaaacaaaaacgcaggacggcggattggctcgaaactgaacgccggcgcattgcggcactgccggaaccattgcggcctcttgaattcgcaagaactttgaatatgtacaaagagaaactaatagaattgtatggcgatgagtacgtgcgtagagagtgggcgacgcttgtcaagctcacacgggcaaaactgatggggacagaataggtcatgggtatttcaggatccggacccaatgtgcggcggttcaagcttcgttttcttggtggctacacgggggagggtgaactttttcagatccattttacacgtgtgcatgaagacagctgctgaccgccctctaaacgaatccccgtaggaagatgaaacgcaatcttcaccgtgctgagagaggaaccagagagagtttggctgggacgccatagcggctcctgagctacccacaaaccagctgtaaaagtggatacatcatggtgaagcgaggaagcagacctacaatgtgcagcgtggatagcgtcggttaagcaatattcctgaccgtttatgccggtacgatgagcttctgcagtgtattccagatcagattttagtgttgcaagtgaggaaatttccacgtgggatggtgatgaataacactgcatctaatatcagggaacacgcaactcttgtgcaaccgaagaaaatcgccctgttgaggactgcgggtaccattccgtaccgccactcctgatgggataaaaaatgagacgtcacgtctgtagtctctgtgttttcttctttgggacgaaacctcaagggcacgagaagcaaagagcgtgcgacgcaacgaagggggtttctttattcacactgttagaggcaaaagggtgcccacccgcattctgtgtcagcgcgttcgcttgcaccattatcatcttcatttatttctgatatgcctcccgcacgttcgtctacaccgcgataacaccacgaagggaatgcaactgtgccgtgtcatcctaaccacagtccacggactgccggagctgttgcctgtggttgaatcgttcctggtggggcagatacagcagttaagctattgtgcaggtgctacagtattttgttccgcgtacatcttcaccggagttatactgaccctccctcaccatgtgaatcagccttgtgcggggatgtgtcacacacacgaatgtttcaacaggtactcacctgtgcctctcaacacaactggctagtgcgcgcgaaagcaccacagcgcgaaagcatctgttctacagacacagcgaagaaatgcgaagtgcgtatgctctgaaaacgactcattctgaagggaacagcgaggcacaggtgccgctggtacgcctgttctaagtcgactgtacacacgaaaaaatccgccctgctcgacctacctttttgtgacaaccacgccttaggcccgcccctcagactgtcgcgtgcagtgctacgatgagtcgttctcctactcacgggaaacaaagtcgttaagtttaacattttacccgagagttcaagaacacgtagaaaacacagcttcccttaagtctctcacagacgcgtggagtggaactagcctgacttcaaagctacatcctgttttcggggccgcacgcggctgtttgacagccagcatgcgacttacgaggcacggcaattgactgtcaccggaaggagcgcgtcacactagtgaagcaccgtagaatgattgaggtttccctcgcgtcttcctctctttccgcaactttccctgtgtctctaagcacacatctttgaaggggcaacttcaggcggactaggcagctgggagcatcgtacgtcactttgtgctgacgagcatcgacgaccaccgagtcgacggacgttgattgctgctaccagaccgctctctagcaagacccgttttgagaactgttaggcagcactgagtctgtccaaaccgtggacagcgtactgcttgctttcgtatcagaatgcccagttgactctgttctttttggtggcttcccatactacgcggacttcccggttgacgtctgcttgtacgcttctctgtcccctgtgaaaaaattcagaaacgggttttggagtcagaactgtgtccacagcgtggtgagtttaccagttttcccgtccttcattgttttcgtgactagcttttcgttccgttccacagacagcgcaa

SEQ ID NO: 1127 - DNA, 2126 bp, Toxoplasma gondii
aacaaacgaacaccaacgatgtcaccaatgtaaccgagtttcttcatcagagaaacacactagttttctaaagtaacctacaagataccacagcctttatatcggtttgtttgacgatgaacacatgaagacactggaccatcctcttgacaaaaggccttggcatagcgaggtaggatgtacacgaaaaaagcagaaaagctagctgacgtcgttctttgtgagtcccaccgacacttaccgtagttgctatagttgatgtgctgcacttctttgccgacttgtaaaccgatatcgtaataaagcgaaccgccgcgaaatatattgataagctggcaccctctacaaattcctaatataggtatgccatccctgtgacaccgctgaagaagctccaactcgatagcatctcggtcctcgtcagacgtgacctcgccagggtgcatcgactgcacctcaagcttctgcacttggtccactgacgcagtgcctctgtatggatcgagtgatgggccgacatcttcgccttcaactagcaacaatccatgcatcggcatgaaaccatccagcatggcgcgggtccacggagttctaggaaccattaccggcacggcattatgaatctgcaacatctccagatgcagttcactaacatatccggtgaggcgacctttgcgcagccatcttcgagtcaccacgagaacacgcacgaagtcgtcaagtgcccgtgggatatcttgctctgccagtaattcgcccgactgtgacaacggtattttcaactggttctggtcgtcagcgatcttcgtaatgccttccccctgagaagccttggcgctgcttctggagggaatcatcgcggaaaacggaacttcctcatcactgtaaaggtcggcaagattaccagcgagtagtccggcggctgtattagatgctactgacgaagtttcatcagtatggttactggctgccgttgtggtggttagcccactgtcaccgcagctccgaaaaaaggagggtgagtccacaggagaaaaactcttatcgatggaaggtttacccgtacgcgagaattccagtgtgagagacatggctctctcgagatgttcaagcatcgagaagacactctctgaacgagaggggtcggcggccaccgtttacaacacggagaggtcacacggttgttaacgcaagaatagctgtgcaacagcaactgaagctaggaaccatgcaaacttgacgtagagtagccgactggatagcacgttctggattttggtgatcccggcgcgctgcgcgaaactgaaacagacgtgtacgtgtgacagcgtatcacactacacgctgggatgcgctggacgcacgctgccgcccccctggcgcgagcagcagttgagccgtgggaaactgtatgagctgggagaacaccgatggaagatttcagacattgggcaagtatgacaatcgatgcaaagacaaagttaagcaaacgctcaatcaaggcggcataaatgaggcaggaaaagctgggccagtccaggagtgcagctagggttccctctgctcgtatgtcgggcgatttttatagaatgaggcaaaaagcgacgcgcttctggtcagcagacacaactcggtagaatgtagcacaaacaggagctctcatctatggacgaaccaacagataaaaaaatattatgacctgccaccactagagctgatgccattttaaacttaactccatgctacagccatggcgtcgttacctcgacacggctgaacccggccgagcggcgagcactattgcagacacacaactcctgcggcccgtgcacgattgctgatgaaagacccatgatggaagtgtctcagcacattagaacgcttactgacaggtggagtataaaagtgcgggagggtactgctttacataaagtcttcggaggagagggactgaaagtgacttgcacgatctagtaacagtggggcgtggagtgtcactacaccgcagttctgcacagctaggatcaacacaagattgttccggtgccacaaatccaacgtggcgttaagcagtgcgatgtactttatagttgggtctcagtgagagacatcactggtcatagaaa

SEQ ID NO: 1128 - DNA, 2195 bp, Toxoplasma gondii
tgcagctgttgcagctggatccgaggatgttggagatcataaatgctccgtttaagtaatgggtggttggcccaagtgccacagagaaaaatgcgatttgtagaaccgtaacgaagcgactggttcacctaattcctgcgtggcaagtgactcccgtgcgggtgtctcaacgggagaatggtctcagatttcaatgttgtgctttatatcatctcgattcactgagcgtcagctcttcaatacattaaggcggccgacagttgtgccccagacccatgtataggcactcgcgcaaagggtcccgtggtcattccttcaggaaagcttgttgtgctccccataacttgtcttttcaagctattcgattctctagattccgtgtacgaacccctgaaccgggtcaactcatccgcttgattcgcatcgtctacacagaacccaatgaactacaccaatgcacgcagtctagaaaactgtccaataccttcagaaggtggtgaactcgtgctcgagatacgtaacttccccatgcattagtctggttactgggaagagattcgttagttcggcgctacgttgtagtcagaattcttggttgtctgatgaaacacaagagcgctcttgacccgcgaagtactgcgggtgagcatgtagacgcccagcacgagtgtttcattcgaacagggaattcccacgtagctccgcatgacctgacaacttcgggtgtgtgtgcattctgtatactgattgagctcacttggtaaaaccttgattctggaatgtccgtggtacacagcaatgtcctcgtggacgcgagcgagttattcgccagttcctttcttgtaattgtggaccatctgcaggtctcgaaggaagattatcactttttaaacggcatgtggcgttttcgttaggtcacatttaggtttccactcccccggtcagttgccaacagcaacggaaagcacaaaggaggaagctggtgagggacttcacgggcttttacacagcgcactatggtgcccagtcatggtatacgcttgcatccagtgttcgagcacacaaaggcgaatgtacaccctttgacaaccgaagcgactccggcgatgcctactctctaatggattgaaaattcgtgcatgcgtccactctttcgaaagcttgatggagtgcacggcgacggaagcacgcttcggtcacgcgttgttctccggcggtggtgttcgtacatcgcgttgacgcaacacaacgtgaaactgcatttgttctgagttgagagagattaatgtttcttatgggataaaagttgtgcttgtgttctcttccaaatctgttgcgttcaatctgggcaacaaggtgagcctccatgccacccacctctccgcgtttcgaagaactctacgaaccatcatcgtggcacggaggaaatggagtcacacgttaaaaacaacgctcgcgttctgcttgcccatccgacttcagtaaagcgagcaatttcgcagtcaggctgctcttctcaatgcatgcagcaaaaagtttcaccgacagatgatatcggcaaaggtgttacagaaagtagggaaatgctttttgtgcacgccgcaagcgtatctagaggaattgccgattgataggttgtaataaaggggtgacatacgaaaatggagaaccacattacacctcttccgtgccccaaacgaaggtgttcgaagcactgtatgaaatatccttcgcaggagcgttagttcacagatacttgaagattcgtttcccggaaaggtctgctctaaacactcatcgatgacacagcttgcgcactgcacgtgatttccaggcagggcaccgaatgtcttgtggtacttcgagattccgtgcaggttgcaaggttaatcatcgtaagctctcgcttttacccaatacaaagaaatgcggaacttatctgcctttgtagctcctgggggagtccaggctcatggcttgccctatagatgcaaacacaattctgatggcgcatgtgaagtgcggtgcttccacctcgatggcagaaaaggtggtgacaacgatgaagaagtcattttccgttgacctgtccacgttagtatgtcggacgttgtcgtgctagtagtatgaatgcgacattttgttcccgaaggtgtctcttgcccatccaggaagtgtcacgggaaacatcgtca

SEQ ID NO: 1129 - DNA, 1909 bp, Toxoplasma gondii
gagtgtttcctgctcgtttcctgtgaccggttgctctgcatacaagcgtcggagcgcctaactcaacaagttgtgtcagcggagccgccggtgggcgtggcgagatacctgcatccgaacaagctacggtgcgtccggatttgtttgtttgtggatgactatgtgttggcaaaagtgaggggtgatctcagtgacaccagacaatatgtttagaacagcagtagaaacatttgccttgtgggctaggacgcccgatttcggtcctagagccaaaatggtctggcgggatcgttctagaattcccatgagcaacaaaggcgaccgtcactgcctcatctgatctggccgcacgaaactgtcggctttgcacttttaacaacttcatgcgctcagctggatggtaataaagaggagaacagaacgaagataggaaatgatgagatgtaaaccaagggatgaaaactgcgggcatccttacttaacatctggctcaactgcgaagagacgttttccatggaagaacaccctcgaccgtagatggcgtttggttggtctaagcacgacaacccttgggcaagggcgtcgttttcttatggaccaaagacagtttggcaaccaattgaattgatttcttcagtgttaccccccggagtcagcgagtaaccaggcttgttcctgggcaagctctagctacaaagacatgttccatatttccttgtgcaggtctcctcggagccgcctcacagcgtccgttcactggatgacacgcactaacaaaccaccggctttacaaagttttatggtgatctgttgatccactcgggttcgccggcctccgcttggattgccgtaacgtaaagaaagccgcaagaatacttgacggtagcactcaaggtacacttcgcagcatggcatttgttctgcgttgtagctagcctgtatctctcctgcatctaaatagagaaggttctcccaaacgggaatacgtgtggaagttcccgctggtgttacagtgctcaaatgtctgtgtgccactcccatcagtacgaatccttaaagcatgcgtaatagtaggccagagtgtgttgcgatctgtataatgagaaccgcaatttcagaaaaatctacattcggcaaaagactgtggcacttcgtaagggtgttcctatttaaaacagcggctcagtttgacccgcgagatcatcgccataaacgcgcgttacaatatgagcagcctagcgggacatacctgatttcacgcgggaaccccgcagtggtcgtcgcttttcttccacgttcgaacccgcgagtatcgcaaggagttagccaaccaaacaggcgagaaagttccctccccatgctgcttccgaatcagagcgtgtctcaagcagagaaacaggcgggcatttgtctttatcttgtgtttacatgacgcttggaagtggcttcgtagctctctcgttataaatgtctggacaggcacctgtttggggctccagcggtacctttccagtggccacctctcgctttgcaccgttgaccgtgaacgcgtcgatgtgctacggcggcttggtggggcttgttgggcaagtctaccaaaatgttttctcgtgaatcttgttctttttctttttttgagacgaggaaggagacaacgaacaactctgctcattcgtgtcccctgtcacatttttcgatggttttttgcctttccttattgtccagctgtcttacagaatgagtgtgctcgccgcgtgcctagatcgtgtctggcttgttcagtagctatcttctcgcgtctggtctcccctcgactcgtacttttcccggttttcttgcactgtcgactgttcccttgcttccgcttcaccgtctcaacctcccgtctcgtggcgattctcttctgaaa

SEQ ID NO: 1130 - DNA, 2599 bp, Toxoplasma gondii
tattgtaggagggaaactgtagatggaggaaaagctcagatatcaaccatctttccttgtggagtggtgttaacagtagctggcccggtgtacacaagtcccaattttttgttccactaccgagttacaaactgattttccagatattcaggaaagtacccgaagggcaaataaccagaggtacgctaagaaggtcccccaagtgagaggcaaaagagagaaactgcatgcataaaaaatgcactagagactgaccctgagccggaagcgacgagcgagactcgaccgacagaagagaagtaggctgttctcggggagaagagaaggaaccgggagaaggtcgatgggcgcagggcttcagaccagggagagggttaacagtggaggaagcggcggaaacagaccgaggttgccaaggtaggtgaggaagggatgttaagcgacgaggacggctctcgaatgcgagagaacgcgttccgtccctcagagggaagagagccagtgggcgaaacagctgctgggacaaggaacgaggaaaagacgtcctggttgccatcgttcggatgggggcaaggatcacacacacgggccgacggaagcgaggacagaaaagaatgcgtggaagaaaggagaagaaaacggttaggagaaaggaaaacaaagacggaaacagaaggtgatgagaatcgtccgcttcttgtcacccggaaatggacggagtcaaacaggtgagacgtgggattacgagaggccttccagtggcgcagatgccgtcgaagaagtacaacagaagacgagaaaaaagagacactaaggaacaactacagatttgctgcgcggcaaactgttgtgttgagtaggatggcaatgacgtctccacacgtcaaagaggccgaacgcgtgggcgtaccgagcctgcgtccgcatgcattccttttcgcctatgtatggatgcgtaagtgcgaatgcgactgccgaaaaagttaatgtgcaacgaaggcgctccgcagcactgccaagagacagaagaaaccgcgtctcgggaccgcggttgagagtcgatactccagcgacggtgaaacataggatgcggcaccagctgcgcgtcccccatgtagaggaacttcatatccgcctagacgaaagcttcttgttggtgaaaaatatgccaggctctcggaaggagcaggcgggtcccacgttgtagcctcgtcttcgatgccgcgtactacgctgtgtcttcgattccttttgcccagaaagctgcatgcgcatgcagatttcgtttgccgccttctccactggcattttcgcttcgctgtggacgaagctctacacaagacacaaactgaggctcgttgacagatcgcctgcaactgccctgtacggggggaaacgcccgcgaaccaccgaaaatctcgacgggaaagacgcggcgacgatgcggtagcaccttcgcttctcaccgaggaatctgggcagactttggctgaggtagcaaatcgcgtgacgtgctctgtgtagggctgcagagggaaagccaagtgacacagagttgcccgttcctcgtcgtcgaagttgacaagcgaaattcgactcgcattacggtgtctagaagcctcaggcgttctggaggcgcgctttcgcgtggagtggaattcttcaaatgcttgactccacggggtatctgcgccttgcatctggcctggctgcccggcgacttccgggcatggtgggcgcgagagggaccattctcggtcaagctcgcgagaggactgaattcttttaccgtcatcttcggctgtcttcacacttgtcgaagcaacacattgagcacacgacggcaagctttcagatgtggacccgtccgtaggagagcgaggttaccaacgggaagcagaatatgagatgggggggccgcgcgctccggcagctgcgtaatgccatgaatggggttaccgcaagacacaccctccagaacaggccgccgttccttcctgtccgtttcaccggactcttttttccatttgccatcggtcgttttctggatttttcctcgtttcttctctccggttcccgcttcaaacggacactgcgttttcaccggtgccaagagcgctcgtctgagctccagggcaacggacgacgccagcagatttttcgccagcgacgtgcgagtgtgttgccgcccaccgcggtttttctccacattttgaagaagcagcgaacaagcgaagcgcctcaggggaatttgagtttgcgttttctgcgatttctccgcgattcgaatcagagcgcgcatgctcgagttgtccgagctctgtactccggcccatccctcgagtcaaaatgcgacagttcgaccagggaaattcacgaagaatatgagacaagtgggcgcctcgcaaattctttgtccttcatgcgttttacccgcactgccactcaacgccctgtcctccggagctatgaagtgtctggccagaagccccgtgaagcgcgcgagaaaggcgacttcctcactgtctgctggttggtcgtttcttcggcggcttccacctttagcttgcaacccgctcgccaaaaacagacagcccta

SEQ ID NO: 1131 - DNA, 849 bp, Toxoplasma gondii
acggtgttgacacaggatttagctagcgagcgatggtggaccgtcccggggaaaacacgtacggtcggttccgcatgtcgagagtccgtctgttctttttgagaattgggccatcatctttcatttaaaactgtgtaaggaagcacaaaaagcacagaactactccgcgcaggcgcacaaaaccgtcaggatgtgccaccggatgcggaacagagaaaaggggagaaaaagagacgacgaagacacatgctttggcccttttgagagcttcagggagcatacctgttgaacggcgaactggcgtcgaactttgtccgctttgacaagccgtctaaggagatggatcagccaaagaagaagcaggatgccggcaaggacgcagagagtgttgtgcaagcctggtgagatttccgaggccgctagcagagagcgatgcgacacaacaggcgccctgacgctgtcgtgccatatcggttctcttcgcttcccttcgtcgaccaaagagaaagaagaaagtagtgaggctgagaaagccgcgtctgccatcttggagaccacacgcgacggaagaagacggagtggacctgtacttatttcctgttctttccagcaattatcgttttccctgaatctcatgcagttcccttctccaacgacgcctttttcttctccttcttcctttctgccatccgcccaacctctctcgccgcccctcctacttcttcctctgccctgacgtgtgacttcctccttgatttgtctgttggaagcaaggaccgaagcgggagagacgaaaaggagatccacaactttacgagacaggaaaggaaatcgaaaacagaggggaaa

SEQ ID NO: 1132 - DNA, 2894 bp, Toxoplasma gondii
gtttctccggacgctctccgcgtacttcgtttctcgttcatcagagtcgacctccttctcgccatccgtcggccctctcgctgcggctctcggggaagtgcaggcctcctctccatcccccccctctccatctcggctcgagcgccatggagccgaacactccccattccgtcggccgtcagaagacgctgaggaccgcggcgcagagatctcgaccccagaggcaagagaggcttcacacgagccaggcgttgacgtcgagggagaggtgagagacctcaggttctccgtcgagctctcgcgcgctttcgaggctgccgtcttctcttggtggcgctgcagagcctggcggaagatggtggagactctgcaggggtcgaagctcgcgagttgggcagcaaaggcattcgccgccgagggaggaagttgagagagacagtcgacaacgtgaccttgctgagctgaggtgtaccgctgccgaagagtcgctaaagacaaagggaggtcaggtgcacggtgggaggcgaggttcgaggaaaggcgcccctcgctctcctcgactgggagagacgaacactgatctccgcgctgaagcaacatcttgagcgacagcgtggaggtcggaccgcgaaaaaagagacggcgaacagaggagaacgctttgagcgacgaaagggaacaggtgaagagcgagggcaaggaaggagacgccaggaacggtcagaacgctgaatcagaagaggcgaatgtgagagaagagcgaggaggagaactgaaaacgaggagacagacagggatgcagaggaaggctctggagcagaaaggcgaaaactcgagaaggaaacctttctctctcgtcgtctacttcggccgtcggaagacgaagacctgcgaagcaaacgagacagagacagagaaaaggtggggtaagcgccacgaagtgaaacggcgacagacacacacacacacatgcacatgcgcatgcaggcttcacatgaaacctactaggagtctcaggcaggagcgtggatgcaatcgaggtaaagagaaaagcgaaagagatcagaataccaaaggaaaggaacgggaaggtgaaagacctaggtgtctctgtaggctctgcagacaccgacttccgagaggagaataagagaagacctttctggcaagagcaaagacttcttctcactcggtgtgaggaacgaaagacactggagtccgtctcagataggaattcgatgcactgtatggcgtattttctggacctgtcaccttggaaatccttccgctttccggtcgtccggcagtcgctctttctcgcgttgcctgtctgtgtgtcaagcgccgcctgatgtctccactttcgaagaaggcgaagaaccaagaggagaacggagaggagagaaaagagactggggaagtcaccctccgatgttgggggtcctgggctaccgaattgagaagaaactcttcagcataggcagtgccgtctcgcctgaattacctcgcgagagcctcaatctgcagctacgccactacgccactcttgctcgctctcccttagttctgtttgtcgaattccttgtctcttggagaaaggacttcggattctcgaaaaagagttttcgtttctgccttcttcagcgagaaacggactccgcgttgagttcggtgtgtcttgcgtctgccttctgctggctttttatctcagatatcatcgcatgtcggaaagcggcagcggaaaagcatgcccgacgaggtcgagaatgagacagagttgagtctggtgcctctctggccttctcaaggcgtctgtcgactcccctcgggtcggtgtttccgttttaacgaagtctgtttttctcttgcgaacagccgcgcgcatgcacacaaaggcaggtgatcttgcacacagttgtgtcctctgtcgctccaagcctctttccatgtcgctcgaaggcgcgcaggttctggcagccattctcaccggaatttcttcttttctcgtgcctgtttgtttctttcgcgtttgcgttccttcctcgaacacacatgcactgcggcaaggtccgtcgctttcctggtgctcatgtggtgtgaaaaaaaacgaaaaaactaaggagaaagccggtttctccctcaaatccgggccatcctcccctctctcccgctgccagaagaactggcactgtcttcccgtctccttcttgcgttttcgttttttgttctctttgtcggaacaaattctttcgaagaacgcgctctcgagtttggttctccgcctttttcccagtcgcgtccccgtcggtcgcacacacagctcggcgtctcatccgcgttgtcttcctgtctcagtgtgcgtccgcttccagactccgcgacagtccattcttctctcgtttctgactgcgggctgccgtggaaaaaaggaacagacgagggagtagtgaatgttcactttcggggaacgcggacgctctcattcttcttcgcttacctctgtctgccagttgcatgtttccggcagctcacagagtcggaatcaaactctcaagagttcttcgcctctgacctgttttatttttcgcactctcctcatcctctcggaagctccaacgagaacgcaacgtctttctttgcgtgtcttccggtttttctcgtctctgtgtgcgcgtccctccccgttccaccccctcctttctctccagcctctctctgtctgcctgtttcacctgacatttcctccccctctgtctctgtcgtatttctcacggtgtttctcagcccccgccccccatcttttctgacctgtgtctccccgcgcttctctcctttctgcccgcgctcccgtctcttctgtggccttcgccagccgtctccgtctctccccacga

SEQ ID NO: 1133 - DNA, 2001 bp, Toxoplasma gondii
gtatcgattaaaaggcgaaagatacctgttgaagccttctgtcactcgggcggtaggtgagagtgtccgtggtcggagagagaggctcaaggaccgggaggtgactggaaaagtgacaagcatgcaaaatgaaactgcaatgaggaaccggggaagaaaggttcgtcgggccggggtgtgtcgcagctgcaacgcccggccgcatgtggggccagccggaaggctcaccatcgcccagatgccatttttatatgttgctcggattcacgacaagctgctgttccaggtgtcggcgggctgctgtgattatgccagggagaccggcattcgagttccttcctggagcgagaggagtagaggagagtaatggtatgtgtggaaatgggtacgctaggccacgaatttaggcacacacgccatgagaggaggcagactcaagccggtccagcgctattcccggagttgcatatgactgcaagttgcattgcgctttaggtcgtaacctggaacgccttttttttaagcctcgcaatgaaacaccacaggcaagagctgagggagtttcgtattcgcttccctggtgctgtggtctagtttgaaagcaacggacgcgctccgtcgctagcttttgtgttacgttgttgaattgctgaatgcctgagaattcttgcgggaggtggtacgacccgataaagacaaaaagtacgtctcatggcggcgttgtctagcggacgattcaacctgcagcaaggccgcagacggtcgcgtacgagcaaagaagtggaagagatctgtctgagacttacaaaaacatggacggaatgaaatgtctgcagggacaaactacgaaagccgtgtcaatgcatggaccgcaacgggtagaatctctcgcataccgatagagtctctggtcacacgtagcggacgacgagaggagaccccggtctccactcctcctggttgtcgccttgaaagaaaattcctcctcccatgagtactgtggccaagccaaccgctgcagaaatctgaaatcattgaaattcggacaccgctaacgcattcgcttccaaaacaagtagaaattttccagatagaccgtaacaacacacaatggtgtggcatgcgagctacttgctggaacactgctgaccaccgagtgcgagaggtgagctgtacatacattggaccgtggcactttattggtaaaatgcgtgcgatcactttcgttattttacgccggctggaataggaagtgtgtacggagttcactgttcttttcgacggctgccgtctctgcatgcaggtgaactgaatcgatgctagctttgccaggacatgcatgcggaaccagatgttcgagacctccctgatgtcggtcactgctgacagtccgattacgaagaattccgtcacaattcagtgctctaatgaacgcaggacggctacttagagggcatcttgtctttctgtgcatgcgggtcacattcgaatgagatctggacttccccttctcgcggccaaaggcatgctctcggtaaaagtctcgctccttgccaaccgctccaagccgtggcaacgcgtcgtcgacttggtttgcattttctgttcccttccactgtccagtttcttttgaacccttacaaagacaactgcggagcacgctggcgccgccgagcttcaactactggtggattcttggtcctctatgcacatgcgttcgaaactaccaacgcagtggccctgaaccagcatcgtccacgaggaatttgtccagattcggagttcattttctggattgatgttgcataaacggagcagggagagcaacacagcccctgttccgcgacagaaaggaccgctgcgccggcagctgcgtcgctctgctgggctggatcgagttcgggggctaggaacgacgaagaggttccaccctcgattgcttttcacagctgagcaacagacaatcctggaaaccccatctgcgtgcacacgtcggcaaca

SEQ ID NO: 1134 - DNA, 2384 bp, Toxoplasma gondii
agaaaagaaccatcaggagccgtttgcgtggaaggacacaaattgagagccgttgccaccattcacacgctacgcagttttttcctgtttggcggaaccagggagaaccgtttccggaggcgccattcgggtgtctgtacatgcacatgggatgtcaacacatgggagacggaccggagcggtggatacatagaattcgattggtgtcgaggctggaacaacatcatacacgcacgtagtttttgcttgcaagaggaaaggtaaaaaaaccaaagcccgcttctgttaacagctctggtgttaccacgacgtcgtcacgaggaagtgactcaacatcgaactccacaacgttctgccaagacgcatcccagttttccctcattatctttgtcgcctctacacgtagtgttcagctggatatctccagtaacaaacatctgaattaggctctgctgacatgaaaaagaacggtactggacttgagtcattggagcctgtcgaggcctggacgcgcagaaatcaagatcgtcttcatgtggattgaggtgaatacagcctgagttttcttctacgagaatccacagagctgcttctcggagcattcgaatgggttaaaatgttactttttccggctaaaaacaaacaaaatccttgaaggtctaaagccgtagtgggaactcggagtgcacaaccgtattaaggagcttctaaatcaacctgcctcagagattatgactctccataggatggcactgaatctgctgactgttgagtccttgttttcccgcgttgccggtacgaggaaccgcagtaatcaatatactacgcccaaaacatagcagacgtgaattaatcgtaaggccgcatgacggtgaacttcaacatctgtagttctagaacgtaaccgatacgtggacgttcttcaatgccgtggaatcttgaaatcgaacaccactatttgtggagctgcgacagagatctccgctcgtttttctgaagagcacgagacgaagcccaccgctgtcctgtctctctctgtcgctcccgtctctcttttctccccccaatgaggataagcgggactattgaaacaagaacgttgctttctactgtcaactggcaattcagaactctcaaaattgcgagaaacagtgtttaacaacaagaacttgagacagaacgtcaaattctttgcctggagacgtgctacgtttcgcgcaggtgcattctccaactctgtgcactgaaaaagagattgtgcattacatcgacgcgcgttctcggcgtttagatatacttacgaagcttcttgcgcatgtgctggcgttcaacatagctcgagaagcagcagcagccggtaaacggactgctgcagggttgttttggtcgtaaacaacgagacaaggcttccttgcgttgcgcgtttccttccattcgtttcagtttatcctccaatctcgagtcgaacaaagaagtaaagaggaagcttttccccaaaagggcgtatctacaagtctggttcaagagcacacgaagtctgcgagtgggcacagtgaaacagatgaggcgggggtttggcgcgttgaagaactcgcttgcagcttctggattttttgactacgaaccgtcctcctgttcgtcttcgctcatctttcggcgttgaagaaataccattttgcgtaaaggctccgagcatatcagtcttcttgtggcttcgggtcttcgattgtggacggtctcccgcggcggactggctcctcttctcgtgaaggtgacttttctcagccttcgcgggtgaccaaaagtgtgataggccggcgcgcgttttcccgagacgtcgtgccggccaacaccgcgactttttcttgctccttttccctattccttgcgggtgttcctcgtcacaagatcagccgaacacgagcggaaactggcttctccgtctgtcgtctcccgtctctcgcgcttctacgcggcttcatcgcgtttggcccgatggatgacccacttgacatctccaagagcgtacatctgcacatgtggatttcgacgtcctccccaagttctgcagcggccgtttgagtcacagacggcagagagctgcagacacaaatgtgcgttccggcgtatgcacactttgaattaattttttccctcgaagtccgtggcgtccagcgtccactttcgagggatctgcagccggttttggcttgcgttctttccctccttttcccgctcctctttttcgcatgaagcaagcgtcagatgccagagtgtagactgtgcagctcgtcgcgtttccaacatttccgtttttctgcgtttttttagatgccacaactccgactttgttgagacttctgccgccggcccacgagttcaga

SEQ ID NO: 1135 - DNA, 1918 bp, Toxoplasma gondii
cacagtgatgtgcagcatccgtcgacgcttctcgagaaaagaagaagaggaagctggaggagaagaagaggacgacgaagcgaacgaagaagaggaagctggaggagaagcgcgaggaggtcgagacgttgaagtgtctcctgttggtgggaaggaggcttgattcgcgtctctgcttcctggaggcctctgggacctcgagggcgcggctgtcgcgcgaaacggcgggtccttcatgaggattcggtctttgaagctccttctgctcgttttcgccttcagttcctcttgtcgagtgcctcgtccgtctctgcctctcttccttctccttctccttgtcttactccgagagagggggaggggcggtggaggaggggaggggcggtggaggaggggaggggcggtggaggaggcgaggcgcgagaagccgagcgagagaaaggcggcgacagcggagaaggctctgcctacacagaaactgacagcgcgacgcgtacgccgaggctctcgagtccaggcaattcctgcgcgagttcaggcctccaactcgttacgcggtggcgtcaggccgaggactccgcgcgcaaagcactcagaagagagcccgagaacagcgaggctgagacgcgctttgaggcgcgcgctgcgacagcagaagtctgcatagacagacgattgacgaggcagagagaaagaagaagcctcaagactcgactgcgcgagagtcccgattggacagcccgcgcgatgcagatggagaagaacggacggacggaacgccccgagaatggcgacgagagaaagacaccgaccggttgagaaagcagcgagaggagcgctcgaacgctggagaggaagccagagagaagacgagggagaacaagcctaacagacgattgacaccgtcgaggaaaaaagtcggccagggtcgtgcgaaaaacgcgcggaagcgcgacgcggcatttcgtcggcctgcaccttggagaagcaaatcccaaatccgcgcgacgcagaagaggaaaacgaaaaggaatcggattggcgaaggggataaacgatgacgaaaaacaggacgaagaaacatcgatagaaaagagtgtgcaggttccgcgcgtggtatccagctgtgcgcgactttgcgcggactgcatgccgacgcacagagtcgacagaggagtcaaagctcgtcaaggagaccttcaaatctacagagaagggggtctccgaaacctgtcttcttctgcggaacacaaataccctgaaggtttctttgccttcggtccttttcgcttccaccttttcttcgtctcgaccagaaactgtagacgacggagagacagtccccacagggcaccgcgagaagtgtctcgcgatttgacgcgaagacttttgagtaaaaaatcgaaaaaaaaatcgcaaaaaattaaataaattgtcctcgaccttgttgcttcctcgtcttttcgctcgcattatttcctgtggtctttgcgccgcgtaagtcgtttggaaactgtctgattcgtcctggggtgacaacaccgacggaggaggagaggcgctgtacaaagaactctctcgtctttccgtttcctctttactttgtttttctccaaccgtttctccgtaggtccacttgcctcttggcgctgtttgcgggtgagtcctgagaaaggactccacttcgtgtactcctctctccagtcttgcagcttccgagactcctctggaagttcctcttcccgttcttcactgctctctcctttctctgtctttcgtcttcctgtgcctctcctttctctgtctttcgtcttcctgtgtctctccttttgcgcgtcttttcgcgcggcgttcttccttgcctgtgagactcgtctttgtcttgcgccgtcaagtcttttcgccttcgccgccgaga

SEQ ID NO: 1136 - DNA, 2086 bp, Toxoplasma gondii
ccgctggtttgtgtctcgttctacgatgagacactttcagcattgttgtgggggaccaggaggtcggagagaaagtgcggtgtttagggtctggggcctttctgttcggcctggtttttgaaggcacacaactttgaacctctaagatacgctcggtgtggcctgcaaagcagaaagacatcaatgtttttctgttggcaatagtgacacagaaaacaagcgacctcacaggtactcttgggaccactcgttcagagtgtgcagttgttttcctgcgttatgtgagagagcgacgagtgaaagaggaatacagtggcctagagccgaaggggtagaaatccctaaaaggtatcggtatgatgtggtaagttgtttccaggtactttgcaaaaacgaaggaggaaagacactggctggctcactgcatttctgtatgttgggaggaaaccagcaggaacggccaggtactttctagtttcgatacgttttcctcatagcgtgaaccgttttcgtcaagtcgcatcacactgtcaccgtcaaagctaggctgcacggaaggcggacgaagagacacacctagagaaacaaatcagtgagatacgaaagtaaatgactgccggtggagacaagtaaagaccaagtatttagtcggattgggggaatatgtagtgacatggtgctttgtaaaggtggaaacgaagatagcaaactgcacagaggaaactttttcgtgggaataggttgtggaagcttgttttctgcacgaagtcgtgcaggaaatgactccgtaggttccagcgtcgtgctacctcagggtaactagaaatgtcatctggtacacatcccaggagttttagtgaacaagagagtgacggacagattctttgtgtgcagcacaacagggatgtttttgaaacttatgccaaagccctgaattgtagtggatgaaggaaacagaacgttttcatgcgtttcctttttcgtaggaatggacagtcgcagacaaaggactgtacaagagcttttgtgcattgagttatttagggaatagaaagagtgtgcagcagtgttgacttgcgaaggcgaagaaggcagatcgaggcgatagctacagcatcggtggcggaggctggtgaagggtgttgaatacgtagagtcgacatgccagtggaagaacacagagcaacacagcatgcatataagcatatacggtagacagcctagactgtcgaaaacgagaaacagagcttgtttggtgtccgaataccggcaggtaacagggaaaaagggaaaaatcaaaaacgagttgtccgtggggcaacacacacggtgattctgaggtagtaaagttgcggctgcagccccagccgtgcgcgttgccaaactttttcgttgtatgatctttatgactaagggatgtaatttccttcgccgtggggggtcttttgacttcaaggtccaaccatccagcacaccccagaaattgtaaatctcaagcagtggcattagccctcgcagccggcgattctcattcctcccaggtgtagagtgcaagatgggccaaagcgctctccgccgccgcactgtagcgaagcgctaacatcaagttgcacagcttgggggacaagcctgaccattcttgcacttggaaagcacggcgctcacgtggagtgtctcgagagcaatcaaatgtcacggtagagccgcagcgtagaagtaaaggggaggcgaggcatccatcaagagagataccattcattctgccaggggaggagggtagggagagagcgagagaactttacttgtcactacaagtggactggtgaataatctcgagatgcaaagaactgcggcgcggcgcagacgcgttttgacgtgttgatgacagaatacggttttcgcaagaagtggtcgtttccttttcgaatagaatgcgcaggcccccatgaccaaagaagagtgcctttgaggagtgctgcgttcgtttcctctattcttttttcgaacaagagcaagttcggatcacttcagcagaaatgctacagcagaagagcaacgcacgaccgtagcccttctgtcgggaaaa

SEQ ID NO: 1137 - DNA, 1740 bp, Toxoplasma gondii
caaacagagaccgatttccaaaaatgcatccctgttcgttgcgacgccctttcctctccggtccgcgggagcccccgagagatgtagacgcatgcagcggcgggagaaaagaagacatcgaggctctgggtcgactggaaaactcatcggaggaaacatgagaattcgcctctcgacacagactctcgagtgctgccagcaaatcccctggacgatgcacagctgtggcaacggaggagaacaggaccgacgaagaagaggaagaagaagaagaagagggagaagagggagaggaacggagagaagacgagaaagaagatgaagaagaagggaacggagagagaggagacagcccactccgcgcttggtccgttgttcctttttccgtgatccaagcagggcattctgcaaaggctacacactctggcgcggcatggactcgaacggcgacgccgcgagcgagagaggaaggaagaagcgcctgcgtccaccgaagtggagagagaggaagaacttccacatttctgcctgagaagcttctcaaccggactccagcgctgacctgaagagacctcaggtgcgagaagaagaggaagaagaaagaggagaagaagaaacaaatgccaaagccgtgtctccccattctgggcgaaaacagagccgcgcgcagagaagcgaacaaacgcagagactccctcacgatcaacgacgcatgcggcaaagttccgctcgtcaacagaagaagatttcaagtgttgtttttctctccgttttctgggccttcaagtcgaacgtctggaagcacaaatgaaggcgcccccatgttcaccgatattatccacctgcatacaacatgtatatgtacaagacgccaacagtctctgtgtcgacaccggcgtatgcatgcatcttgacatgtttgaactatgtaaacagacgcatacgtagaaggggagaggtgtactgttgctgtttgtgtgagttcccggctcttctgcggagcctaggcgtctctttttcatgcatgcgcagggagggcagggtgcgagagtggcggacgattgtttctcgggagcagaaagaagacagatgtggatctgttctcggaaaaaaaagtttccgttcaaggaacgacctgccttcggcgaaaggccgagtctcagacgctgagggtctctgagtcaccgctggacgcacgcgcatgcagtgaagaaaaaaagttggcaaggagagcgcagctcgagacagttctgccttctgcaactccccgtttctgtctgagtctgtcttcaaatgcttctctcatttgtgttggattccttgctttttctccgcgccggaatcttatggacaaggtcgacaagtcgaccgaactctcttgcagagaggccgcacgatggagacagcggaggcaaggggcattttggacgagtgaaaggcttttttcgtggtgagaattcgtggatttcttcttctctctctcagcctcacgcgcagagaattctgagtgtttgtacgaagcgtcttggacaacgattcgctgtgcgggtcagtgaaaaaaacccgctcccgaaaccgtccaggtttacggtttcgtcggggaaagagtgctactcttactccgctgtcgatttcttttttatatctttctctctcggtttctccttctttctcgccttgctgttgtctctgtctctgtgcatctgcttttcttcttcgcctcctctgccagggcgcgca

SEQ ID NO: 1138 - DNA, 1070 bp, Toxoplasma gondii
gaacgttatctcggacgttctgttacgaaacgctggtctcgcacggtgccaggtggcgaacgaatcgctgttcgaccaatagtggaatgcgttatcgcttcaacagaattggacatagtatttctatctgacaatcgttgatgttcggtgctatgtggaactagcacccgacagtgcaccgcgacattttcttgctgtggccatacaaagagtgcacgtcgaagcacccactgctactgtattttccgcagcgggaacttgccgcaggtatacttgcacaactcgtctgaggcggtgaaggggttagggaaactgacagattgtcaacattcgtgtggtctcccaaaaacgtttggcaaatatgaggaagtctgttaatggtacaggatgcaactcattcaccatatttgatgcagtcaattcttcagtgcaaggatttggcaaatgtccacagctggtcacgtgatacattcgtggagtgctcaagaggacgaacatatgacgcgtcgaattctactgggacagtcaaatcacgatatttcacgggggtcattatcttttgttgcttgcgctattagccagtgttaacaatacggttgagtaccctggtggcatgagcaatagtgcggaaaaatcgcctccaccacgacacgatacgcgattttactgacatccgatgccagtcacctcacttgcaaccggaagtcgtttaaggcgccggcgaggtggacaggcgaactcggcgcaagaatcgagcattcatcgccatgcgttggtaaactgtggctttttgcgcacgagctgcagacgggcacctctgtatcaggaagtgccaacagcgtcgcaacacgacaggcccttgtgtagtagacctcaaacgccagacgcgtgtggtgccctctccgtcttttcttcaagaagaactgattcagtcgctcaactgatgttgcactcgtcacattctttcagaggaggttgttgtgtcctattttcacaccgagtgcgatggctagcaacggcccacgccccgaggtctacacttggcagatagatcatcatagtcgtctata

SEQ ID NO: 1139 - DNA, 1801 bp, Toxoplasma gondii
ctcgtttttgctctccttgcgtcgccggtgctcgatgcgactgtgtttcgtttaccagcaaatcactggtagatacgttaaggaaacagttgcagacagaacagaccggattctggagtctcagacaaggaacttgcggagtggaggagaggaaacactgccgagaaattccgtccctctgtaccagcagaaaaagtgaaagcgacgagagagaagtggagaaaagagagcaggaaaagagaaaagactcagaggaatgcctcctgagcagccaagagcgagagaaagactgtgaaggagtgtgaaagcctcgtgcaatgaaggcgaaggagcttggtgacgggaaggtggaaagagcgagagcggagagaaaaggctctgattcagagaagaggaagacaaatgttaaccaagggagagagaaagctctcagtgtgtcgatgggaagcagagacgaagagtggaacaaacagaaagagggaaggacatcgcggaatgaaaagcacagcgagaccaccgaaggaagtgaaggatgtggaaaggcgaaggaaaacggtcgacgaagaagggcaaacaggaccaggctgacaaagaggcagggaacgtcacggcggaggaaatcgacacgagggcaacgcgggaaagccgcaacgagcccccttctcaggcagaagaagaatacctgctctcggaggagcacatggagtgagcgagcggggggaactgagcaaggcgtgaggcagagacagcacgggggaagaaacacagaaagagaggcttttcgatggggccagagacgctcgagaagatactcgcagaagaaaacggacaccagagtcgggagagctgggagagtgagaacagggaactgaaatttgaagacgaacacccagacaaatccctctctgtgcatgtgacgtttaaggaggggacaaggctgtacctcagtggtgaccgggcagggtgtcgggaagagaatcaggactcatgagaaaaagagcgaccggagtagatacaacacgagatgaggtggtgaaacaacggaaagaaaagtgatttgcctctgaaaaaagaaggaggatttgaccacgagaattaagaagcggtctcttgcccgccgaagaaaacatgctgctcgagtgaagattcacaggccttgcatgcgccgcgacgacagctgacctttcgaccggttttcatcgcatcccgcgcgtcaaattcattgttgttcggcgacaagcagagaggacgaaatttcctttcaacgacgccactatttgtcaacggaaaggaacaaggagagctgcatcgctctctgcagaaaatcccgtgtctgtttgcccgacgacgccgacaccgtcgggtgtatgtacacgggaacgctggtcggcatctcgttgtcgtggtcgggatttcgacgcaaacgaaggagccttctttccttctcttttctttgacaggctttgatatttcttctgttcgtcgttgagtcggcgtttcacctctgcacattccctccctggtcgaggaaactttgagactctctcctgttcgtttctcgacgactcgttcaaaggattcattgcccttttcgcggatttgctgtgtccattctcttcggcgttcttctccagggagacacgtgcgctcgagccggtttgctctggggccctctttggcttcaacttccccctcgactgggtctttcctgtctcgcggcagatctccaacctatcgcacatatcctttcgagaagcctcttgctctctgtcaacgtccggattctctggacgccaagtga

SEQ ID NO: 1140 - DNA, 2578 bp, Toxoplasma gondii
gagggttctgcggaacatgttttcaatgggtgaatgaatgcgttagcgctcaagtcccgaggtggtggcgttcatgtgttcgcaagcacttgcactgttgacggactgtttcttgaactgttctgggaagcgaactggtcggagatgtccttgtggcttctgccgaaaaaaaagttcatcgaaatccaaaagataaccctgtgaggggcggaacaacgggaagcctctatttttcgtactcaaaatacgtctctggtcaaaggatctgcgatccagaacgttggagcggacttccgtcactagattcttgaggaagatgttcacacggtgctgcatctctgctcggtgtcgtgcgcctttccccgtggcaaaaaggctacaaacgaagaacgcgctcacggcaacacacaccgaagaaacggctatccggttccttctccgtggctgtttccttcgagttctaccttgagaacgaaagaagggagatgggatttgcgttcgttggcgagagaaaatgaagtccacccgacaaaaggaaagacgcaatgcatttggaacgcagtagacatccgtgaaacacatgcgtggagcaaagtaccgcagggaaacagcgaaaacgcgtttcgttatcacgctcccctgtcgctacactgtatctaagcgtggtgcgcgctcgaatccaaatgtagttaggcggttttgcgttgaaaaaatgtgcgacaggactggacggcagaaaccgagagagttaaggaaacggctgcacgatgagcaaaaagaaatcaagaaatcaagccgctccgtgctcactgtacactcacgttccgccaatgttgtctgagacattgcttcgttgacacgagcgagttcacccgaacctgtggaggcgaatcaacacaaacagtttggtcactttgcatatcgagacgacagcagattcctgacaatacagagtctagttcgtggttgccgagattcatttctcatgagatttcgatagtaattctatagcggggccgcgggcattttctacgtagtatgcatgttttgttgctcggcgaagaaaatcagatatggccgttgcgactcgttcattctcaactcagtactgcaaggtggcgtgccgaaaactcatctccgtacacggtttgacatctaaaatgattagagtctttttctcggatcatgaaggggatttgagaaaacgatattcttcagacactcaatgctggccgcacacgctggtgtaagcaactgtcgagtacgactggagtacccaggtttgctctcacgatttccaaagagtgcgaatatgaggatacctctaacggcaacacgttccgtaaaaaggtcgcaaggtacttcaacgaagaagagtccttgaaactgcaacctgtcgtgaggctgatgtgaagagttcccctgtccgctgccagatgccgtcggcattcgagtttgtgaggctcgatgaatccagaaaccaaagtttctgtccagataatgcttgtcttccaacattcgtacattccccgttgtaggtaaaataaagtgggttttggggagcatcgggaagccatgatacagctgcaagacggacgggctaagaacactctttgaagccacgggtgatcgaaaaggttttacttgctttctcgagggtcgttttgtcgtggcatctcgatcatcacttgttcttcctcttgctgctcttcgcctttctccagtggaccatgcaacgctcattctcccttcaggtttccgcactctttcaagtctgacccggcttcctggcctgcgcacaggacccaactgtgatcccttcagttgacctgaaatgagtgtctcaacagtcaggcactttgagatcccagtgaagtgaagattcggcactgactgaaatgacgccgatggttctgtgctttgtttttctcgctgcgtctctttcgacatctcactttgaactctcatgatgtacatagtggtctgaccagccgacagcggctgtctgcgcgcatgcggagatcgaaacgtcaatgaccgctgttcggcttgcaagcattttcgtttcctgtcacgaacggcttggtcgtaactcttggaacgaatttctgcacagcaaggataccctggaaaacgcaggctttgtgcgtcggctaatctcaggtcgatagagcacagaattttctaacggcttctaggagtattcgtagtagcagtcatcgtgacaagccgaatggcttcatccgccgcggcttccgaacgactagatgtgaccggccatgtgtgcccatgaaggccttttgaagtgccccaggccgtttgaagaggtttgtccgctcttttcatcctcattttcgagaactagtgtctatcccgggaccttctgtagtggcttgtgcccctagaggtggctgtgcgcgtcttgaatctgtcgagatctttgtctcgttccttgacgacagtggtgggtcaatcaaaaaattgaaggttggcctggcggcaagggatcacttcatgaaggaactttggtcgcttttcgggaaaagacagtgacacgaagctcgcggatttttcacaa

SEQ ID NO: 1141 - DNA, 3696 bp, Toxoplasma gondii
aacgaagtatggttcttccgaaagagatgggcaacattgcgatgtggacaccacagtgtgcagtgctaatctactgtgtcccctgaggcgataggatggaagttgtcctcaccactatttctctgttgcggcagcagagagcctgcacgagcaaaggcaaggcgccttgctgaacacacagttgaacaggtattttccctgccgcagagaggacgacacgaatggaccttgtgcactgaagaaggagctcttcgttttccctctcaatgcaaggccactgatgtggggttgcacccccagaagattcgtgggcgtcgatcacatgaagcgatgacggtatctcgtcacaggtagcgctacactggtcagagttctgatttcgaatggggacaggcagaaacagtggactgggagaattcaaagaacgactcagtagagattgcatgaagtggagcaggcggccccagtcttcgggagatgctaacgctgccgggaggtctgatgctgaagcgtctgtagacagcgaacttgaagggcatgaagcagggcagtcgattgcgagcttctgacggaagaaacgagtgagctcctggagctcttcctcgacgaccgcgtcggttgagcgattggccccacaaaagacgctgcggcgtttctgcatgtggcagaatcctgtggacggctcccaaggagcctgattcgactccatggttctggaaaaaaactcgaaggtgcaccgagagaaacagatggattccgccgtccggagtggctctgccagtccggtctgccgcggcggtaaaatgtgtaccctgtctccggagcctactgggtatttctcgggaacaaggtgctgagcaaagaggatgacatttctcggagaagccagcaaaacatgcacgcgaaagttacacgccttatatctccattcgcggcttcggcgggtgatagctcgaccttcacttgaagggtcgaaggccaccgctaccacgtgtcaggagatccctgtttctctcgctcattgccaagaactcaagagagtatcatacacgaaacggtcaatcaccgcccacctggtgttcaagcagttgtcggaacggctctggaggcgaaatccgttggaactcttggtttatctttcctgcatgagaggatctgacgggaactagcgcatacgggcgacggacggatcggatcagggagttgaagtgcagcgctggggtgttacaatagatggacatccggtgcagctggcgtatgaaaagagacaaaagggtaagcattgagatatgaatgttcctgcattgttgttaaatggtaggggttcacatcaccgtggacgattgacatgggtttctctcggtaccggcgccgcccagggacggaccgaggcaccggggaaggagcggccgcttcaccgcagaaagtccaagcctggagtttaaaggatccccctctaatcaagccaggtaaaacgtgaccaattcgtcgcatatagacaaggaaagtcggtttaatgtaagtttggagtacagcagcgacgatggcgctcggcacagtttggtaagacatgcacaccacaggtggtacacggggccgacaagatagcccgcgacctctagaactgtgtgtggcatgttaagtgcctcttaggagcctgggtcagttgggaaacctgttgagtttccgctttaatgtgtaactgcttacagctagggcgttggaagaagagcaaggaaaatgagggtaaaacaggaaaagcaaatacgcgccgcgacacaattctgtcgaaccggtgtcgctgctgcatgcattcggaatcgagcctccgtgcccatctggggacgaggctaggggtgagaacggcggatgcaagaggacatggtggatactgggattatggagtgccgtggttcgcatcagtgtaggatttctagcggctatcacttcgactcatatttgtttattgcggagtgttcctacgttgcctttcagctgcttagtgagtctcctatcacgtgcaaaacaactcttcaagtacgtcgcttctgcataccaaagggagaagttattatacagcctcacattcggtgagcacatcaaagcgcattcccgaattcgctgactcagccttcctgccggatccagatgtggcactaaccaggcggatggtagccctactcggctaccagtgggacggggtcttctacaaaatggtgctctcttgtcacattgtggaactcaaagacctgtagggctgactatctaaatgaactgcggcgtcgattcatgttgacatcttcttgacctgtctataaggagagtataggtatctgcagaatcttggggatttctcgtgtatttacgtcgagttcgcacacgggacaacgaggtgtcgtggcgcgactgttacgctaccagttagatcaagtatcctgaagagtgccgtcctgacaccgaattgtttgggagttttgcgctccaatctacgaagggtaatagcaggatgacaaaggcgccagtcctgaagtagtggtgtttttagggaatcaactcccggaaaccgaaaccgccctttcctggatggtgtcatcccccgccggagggatttccaacgtatgccggaaaagcaaaacgctgttgatgcacaaatgaatggccttttaatccagaacactgcgtgtttctgtttttagtttttcttatttccacgttgttaggttcagcactggtcccgcttgcccctgccacaatgagcaatgcgtggtcatacgagtgcatagtgttttccgtagtagtttcttctactgcaagtcttttgtggcatgttcacacttgcccaatgctctggagcaaacaaatccgcgaagccaaggtgcggcgtttgcgtaacgaactaggcgcgtgtctaggtgccactgagtggcgtagctgcgcttggcacaactaaaattggggtgttctgggttgcagggctctgcctctgcgggttgcctcctttttggaaaatgtgctcatcgaaagcatatcactgttatctgggtgcctattgtctgtcgcagagagggtgaggcacattttctccccgtttcgtgcgaactagcacgtgggccgtcttttctcgggaacgcacttctgtcgacgacgctacgaaagcgcaaccaggcgcacagaagcactcgagatgaaaccgagaagaccgccacgagcgaacgtgaaacagcgtatgattatccgggaatgtacacatgtctctgaatggttgttccacgggcactggaatagcgtttctgttgagtccatcgcgatgttagactggccgcgtcaacactgctcatctgaatggctccaattctgcttcctcttcctcagtgggccgcttatgtttgggtcttttgacacccacgtttttcgatgtagcgggagaatttcaagatcggctgagagtttcagctcgaatgcagtgccgcatccgttaagcctgtattggcggtgaaacttccgttagacgtgttgcgtgaagcctttccgcagtttgcgaacggcacaaacgcctgcctgtacagattattttgtgcataccatgtcttcccaggtaataacaatggtagaacgtggtgagagtagcagttataatttagatagttagcaaataccgacggtacagactggtgtagagtatcaaccacagaacaa

SEQ ID NO: 1142 - DNA, 3871 bp, Toxoplasma gondii
tttgatggcatccagctgacagcacacataccaaccaacgcaggcaagccagcatcggtgcactgaaagggagacacggttcatgagcgttgctctttccagccagactgcaagcgaccccggcggtcagacgttcgactgaccccctctttgaagacctttggtgttccgcagtcgatttcgtcctggaagatggcccggccttgaagggtggtgttctccggagcgacaaagttctccgagaaagctcgaagttgatccgtgaagcgctctcccccgttcccgacttgcgcatatgcgggccactccgcgatgtacagcaccagcaacgcataccacgacttgatctgtccatcgccaacccgcaaaaaagggcacaactctgctcgaaacacatgcggattcaacacacctgaaggcagcggaaaaccacacacacaagtctcttcacacaccgactcgtcgcagtgactgtccaccgtcgagcgtcggtacaccactgtcctcaaccggaacaggcgccctaaacaaacacattctcaaaattacttctcccccgttcgacaaaatcagaggccggcaaagagcaggggtcaaacgagacaccgcgagacgaactaacgagcacctcgactttggactttccaccgttttatctgcccttacggacacaaaacaaatgaaacaagataaattgttgcgaactggaaaagtgcttgaatagccctgaacatcggccctcggctcctgacataacatttcgtgaatacgtcgtcgcggtgttcgaccagggacgaaacactgagggaagtctgacggagaagcaacttacgaagattgatattctccttctttctctgcggcaaaagctcgtttttcaggctggcattggaggccagcgtcctgtcggggttcacagcatctccggtcttgttttcaagcggtgcagcctggggcacgtccactgggggatcatcctgtgcagcactggacagtcttctgggttccatataaggcagagtgacgatgtagggatcttcttctcgctcgtaatcagacctatggagaaaagcttcgagcggtaggtccgccgctcggaggtacggagcagagctctcgctctgcaaaccagacacacagatgcggcggaaagatggtggacgaacctagacgtcacagaaagtggccgatcctgctaaacttgggagaaactgtggagaccaacttgactggcgctcagcaaaatgcgtcggattcacagagcgacgaacggaaacgcagtagattcgcagttttaaaaatcgtttgcagagcggcggtacggtcgtacccttcatacccgccggcaactcatttgaaaacacacctcccgacgaagagaagaatagccgtggattctcgaatctgaccaagtggctgcgggaaagtggtgaaatgttcggtgggaagtggaacgaactgtgcggccgcgacgaatacgaggtcacccggacagcaaggagtctacacacccaaattcaaaatatgtccgtatagaagtgacggcagtgattggttgcgccgacgctcatcaagccgtctacactatagttttgcgggttcgcatctcctgcggtcgacctgtgaaagtttcgccttgcgccttacctcgtccgaggcctccgagcgactcagcgcgcgcctttgtacatccgagagttcgttggacaaatgtgagcagagccagccggcaaggaaagtgacggcaagaatcagcgccttcgtgagagcaccgattcctgtggatgaattgctctgtatccgtttagccgtttccggctgcggtaactcggttgcagcgcaagggcaacgggaacaggtgggctcgttactgcaacagaaacgcgtttcctcggtttccataatgctccgcttgagaggagcagagtcagttcggtcctggcgagtaagagttccgccggtcgaactctgcaaaaagtcgagttccctgtggtcggcgctggcagagcgactgcctagtcgactggccagcaaaccgcgtgcctcctgggaaaaagaacgctggcgcgggcagccccagccattgaaaactgctccagattcgctgtctgtcttctcttggaggatcgaaactaccgggatcaaagtcgcaaatacaaacggcagcttctcggcgaaacccttggcagtctccgcactgattccaatcttgttctccgtccccgcctcccctgcttggtagtgaggctacgaggcatgttttagatctagaacgtgaccagccacgttgttcgcgtgcaccggacggagaagaaacgacgtttccgcaaagcgacgcttctcagaaccggacgaaaggcatggaaatcgttgctggccggaggaaatcacctgcaaagtcccaacgcgaaaaacacgaggtctcaatgcgaccgagcctggcgcgcgggacacaaggcgggctgggtgcggttgtgtctgtgcctcagtcctcagaaaagccaacctctgctgattttcgaaaatttccgtacactcgccgagtggcgcgcattaccgcggcacaaagtcttctcctctccgtgaagactttgccgcgtcgcagaaatccacgcggcgcgctgtgcgcctctctgttgggcttggtcttcaaaccccgccagtcaccgcagaccggcgcagtacgggcccgacccgtgggcagctcggccgtttccgacgttcctgcgaaagttgttcgcgcgctaaaagtgtgaaaagttcagctgtgggcgtcagaggcgtcgaaacggatcacgtctcgaccttttttgcaaaagggagtcctctcgaccgtccctatcgggcaagtattcgtccacccaggctcaaacacaccctcgccaacctagcattcccatcgcgccgacctcacaggaaagagcagctctcagcgcagacgcagtcaagtttaaccgtgttctctcacgctgtctcgatctttgcgatctttgactttgcgtccagattccagtctccagacttttcattcgtttctagagcaaaacggcctctttcctttggtgttcgcttttcaaagtcccccatctagaaccccactgccagccttaggacagagactgcgccagggataatcgtctttatcgtctgaatagctgccgactctgcttttcaacgtcgctgcgccgtactcacacactctccagctcaccagaaagcgcagagcgcgccgactgttgttcctctctgaatttgtctttaatttccgtcgcctcgttctgcgagcaccgttgttccgcctctccgggacccctctgcttttctccgcctctcgcctccccgctgctttttccgctgctttttcctcgactcacctgcgcgtcttcttcctctggaaagttgtagcgttgaaatgcggttctctcctcttttttcatctcgtctgcctcatcttgcttgccgctgccgacggtgcgtcctcttccgcttcgttgctgtctctccgcggtctactctgcagtgtctccgtcccggtgtcgcgtcgaggcttttctcccaccgcagatgcgcaagcgcatcctttgtccactctcgcaaaacgtctgtgcaccatcttctttcagagaacgctagacctgtcctctctctcttctgctgacagtctcccctgcttccgtttccccagttggctctcgcgctgtttgcgggtgtttcctttctccagcgttttagtcgtcgtagcttttccgtccttctttcctggcgttcttttctctctccctccttccttctctttctcgctatctctcctgcctacccttctgctaggtctgagagcaactgcatgcgtttcggagtctcttcgccgcga

SEQ ID NO: 1143 - DNA, 2120 bp, Toxoplasma gondii
ctttctacgatcctgaatgatggactcgagtttcgcgggacacacgaccgcgttcttcaaaactttacaccacctgatcacggggcacattcggcgcggcgatgatgacgcagcgccttgccgtctctgcgaatgtgtcgcttagcgaggcaatccaacagtggggaccaacttggacgaagtagatcgaggggaagctgcgcctgctgaagctacgtcagcatccccactcgaagtgtaaactccccagaaccagcttttgaataaacctgtctcagtgacaacgactttcggtgcgaacgcgtcgacgtcaggatgcgtgcttacctacagacctgggcagatgcggcgccttgaaagtttcatgtactggtagagatacagatcattctcacagtgtgtgcagacgagctctaatccgtacagaacgagtgcttccacggcaactcaggcaaacgggtgtgcatgcaaaagtgtggtctggagttcagacgcgaaaattcgcctttcttcggacttcggcacgacacacttttgcgtgttttccgtctaagttcgaatctgtcccctaaaacatattgcccacctttctctctttacaatgtaaacagaacagccggaaagtcagctcacggcctcggttttcgttgcaaccgttttcttatcaggaaatctaactgaggcttgagacgaaggtttctacgggggagggggggtgagagaaggggaagacagcgcccgtacagttcgtcgcgtggcgtccatgctgttttttattttacggggggtttcacaaaccagtttcaggttactttcttgtggctgaactggaaaacggcctgtcgccattcgacggaaaagaagtgatctgagactaaccgtggagtcggtgagtcacgccagctaaacatctgcttcgatctaacaagtttctacaatcaagtgtctgcgtactgcagactgcggctctatttttcgcatacgggaacgcgacatgcacgcgtcttttttcgagcgagatgtcctcttctgaaaaacacacacccggcgccttgatctaagatcgtgaacttgtgtgggagaggcgggggggaaacaaagtggcggccgagtggggagagtgagaggaagacacacgctgactgagagggactccagaggaaattactgttctcggttgccgtggcgacacccgagaggggaagaaaactcagcagccgcgaagacggaaggggagggcacaaagcagttcgacctgtcagtgtctcgagctcgaggtcccagggttcccgaaaagaaaagcagtattgccagcgcgcagacgaagaagacagacttcgacagagagacaggtgtaaaaaacgaaacacagaacgagtgactggggattttctcgggaaaatgcatgcactcgagtgtgctgtgccgcaaaggtggcgggagagcggcgggatttctgggggatctgtctggcgccagacggcgaggtgcgcgagaagcgttttgttttgtcgttcgttttttctccacgttttccccgttttctcgcagcctcccgtgtgtgtgtctcacctcgaccgcctctctccctggcgctgccctcatcacccttgtcgctgcccgctgggtttcacaccaaacgaggtaagttttcagcggtgtcgatacacccgaaacgcgcgccttttgcctccacttcgaggagagccgtttcccatttcgtatcctttgctcgccacagaccgcggaggaagtccgatttccgcggagacaagacacacccaatgccgccgcctcccgggatcgccgactgatggtgcgttgggagatagcaatactcgagaacctggagcgccgctctctgtagacctcgcagactctcttcttctgcgttctccgctctgctgtccgcgcagcttgctcgccagactctcgctctgctctccgtccgcgcctctcgtcgccagcctctgttgtgcaggcctctcttcctccgcgactgctgtctgctccgcgtcttgagcctcatataaaacttctctgcaccctccagtggtcggacgcgcgtccgccggttccccctcgctctcctcttccctcgctctggtgtacgtacacca

SEQ ID NO: 1144 - DNA, 4147 bp, Toxoplasma gondii
gccgcgaaacgagtgaaagggtacacacgttttcggctgttcaagaagcacgtgcatagcgtatcattcacgctgacagagaaagcgatgcaaggaacttgagaagcactagatgtacaccggcaacctcaccgcgatttccaaccagttgggacagaacggcagccaagtactcactgaacaaagaatatagggtcgatctgtgtaagtgacacggcgttaacggagacaaagaacttggcaagcagtgctagtgtataatggaaaagtgattgaacgttgagaggttatttctcaaaacttctttttccaacgcaccggtgaccctggggcgtcctcggaggaattttgtagacagtgacctctctgcagttgtagacgatgaattcgagagcctcgttatcatctttgttttcgactggaggggcagcgtcctcggcttctacgggtctggattttgcctcgggagcatctgtcgccatttgaggcatttcttgagaaggaataatttcttcggaagtacgcagaacagaacgaaattgagaactccagctgaatcgacagctacgcatccgtaccaccgtgtaaaacgagcgtgttaggatgcctacatcgggtgcatgcactggtctatatcggtttgttgacagctcgaaagagaggggaagcgaatctacgactgcgaaagcctgcaggccctagttgctcggatgagaatgttgcaggcacacagtagatagggagggaaacaacaagtcgtgcatgtacacgcgcagaatcagacgtctgcggtaagttgaagaaaaatggtgaggctcctcaccgagcaccgcgggtgcgatgtcttgtgacagttgagtgatttcgtccaggacttgtccaacacgaaagcaatctgcatgtaaatgaaggaagggagacgcgctgtcgcgagcaaaaaggaaaagacgagggaaaactggaacgcaatcgtcaaactgtgcccggaatcgacgcgcagccgtcttgacaactcgcgggttcgcgcagttgcagacaaaagaactgttttggcacgagtgtcgtcttaactcggcaagcaaatgaagagaggaagttcttcgtctcgagaattggagcttggaaatctagaaaatctccacttgaagaagcagtgtctcgcttgtccgtttttggaacgtgtgtcatgcgtggctcttcgagcgcggaaaagcaggagacgatatcgcggaggttacttacgatgagggtcgcaaaaaccaggataaacagcgagatgaaattcgtttttgatctggttctacgcggtggcccgcaggaaaagtggcaggccatttgactcattggaatgacctcatccaaatgttgcctggtcgagctgaaccgcgtggatgaaattatctgcatgcgctgaagaccgttgggaatcttccttgcaaacaatctcgatgcgaaggatacgttgaccacagaagaaagagacgatttccattctccggagagaggctagcactcgctcttgagcagaaatctctttgttttttccgctgccgtggcagttgccaactttcacgtacggggacatagaacatttcgtatgaacgtgcacgtggatataaacgagtgtctacaaacgcaaatagacgtgcacatttcctgcgcatttgcacctccagctgaatgcgctccggcagatatcagctcggagttagttctgaggacttcagtcctgatcaaccacagttcagcttggattgaggaggaagaccactatagaccgttccaagattcattatgtccctttgtggatgtaagttgcggacaaagttttagatcgtctcgggtcgacgattcagtggaaaacaaagagaggaagcctctttctagcgtgaaactaacgacggtgcaagctgcctcgtgtccgtaggaagagttcacaacgagttaaccactttggggagggcgtttctcctttcttaggatcggtatgaaagaaacgacagaaatctgaagcacttcgacacgactgaataggtcaaacattacgtgcactaaagtaaggcatcctcgagggtaaactccccttgcgtcggttattggattcccgtgttctacatgtgagattgtgttggcattgaggcgctacagtagaaccggacagagaattcctttcaatggaagtagcagactttcaccagctgcagatggtagcgttcatccttctttcgcttcttgcacaactcagataatgacagtcagaacgttttatttcgtagcgatggctgtccgccagcagtggtaaaaaacacgtcaacgttgcgactagttttcgcggtctacgaagatggtttgtttcatggcattacgtgacatctgtctcaatttagtctctgtctctctggagaacttgaatgggcacctgcagcattctgtttgctatattctgcaacatgcgcaaggagtggcgttccacttagcatgagtaaacaacgattgccctgagggaataacagacttccttccttcatgctgcacgtgggctgaagagacgcccggtgcaattctgaagaaaacggcttctgttacaacaggcttgcatacttcaacatgcgtccatgtgctgtcttcccacgcacgcagaaacaggtgaggaggcgcccgaactacaaacagcttaagaaaaggatttgtcagcaacgatcgaaacagataattttcaagaaattccagtgtttcttcccctcatctgtcgcgccttttcgccgccaccgccttgtgcaattccttcatggagagcgtctgcttcattctccgcgtctcacgcatatatatatatatatatatatatatatatatatatatatatagttttttcagatctgcagtggttcgctgtggaacacaactgacaacggaattgcggtattctcgtcttttttgtaggtaggagaatgcatcgtcaaacgtgccttgtccgtgcgttaatttgctggtaaactgctgtgcatatatgctggtcttcagacgatacaactcactgaccgcggttgtcagaactggctttcatgttgttgtatatgtctcagatggttaggcagtggtggataatcgaaccgcttttctcacgttttcgttgaatcatatccgctttgtctcttttgaagacgtgcaccggggaaaggacgaaccactatggtttgcaaaaaacaaacgacaaacagggcggcacttgttatttatttccacctagttgcagaggaagcttttccactcggccctcacgtccgctgagaacagttatgccatccggattggaaagaaaagtggaaaacacctgtttgtccgacttcgtgtccatctactctcaagcagacggagaggcagcgtgcggcgcttcttttcttgcatgctggatacttatgttgggaaaaaagacgatatttctgcgcctgacggatgaatctgaacgccactcaagcgccggtcttctgtttctgtgtgtttctcagtcgttcttaaagtgaagtctccctcgagccacccttttcccctcaccgcggtttgtgtcttgtgcacagtcgtcaacgccagcgacagcagccacggtgtgaatttttagtttctgccgatcgggcttccctgtccgtgagtctctcgaattgtctggaaggtcgttcgctttcatatttctcgtctttttcccgctttcccctgcacggagctcgcctcgcgaaacggggaacctcgaccgagacgctgcttcttaactcgcaacagcccttctgttgttttcgtctgctttcatccggccagaattcccaccacttcccctgcatcgagcgctgtcgtagagagccgtggagtttcttttccgaaatttcctcgcacgaactccgccgtccctccagccgacgcagtcgttgttagccgtgtccatggctgcaaattcgagaaaagataccaagaacagcgcagtcttctgagatccaactgcaagtccctctcatcacattcgactcagcgatcggactaacctcttgtacacacctcagccaccgaagacgccaagcttctgcggctcgcgtcacagggtgacggtcacgtgtccagaaagaaagacgcgttttttgtgagcactgtacgagaa

SEQ ID NO: 1145 - DNA, 3207 bp, Toxoplasma gondii
gggatcacgagggcgggcagaactttggagaaaactggatggaaggttgctggggatcgaatcggagggagcaagggggcggtgaacctgtgcaaactggcgagagaggcggggaacggagagttgtccagggagaacggcacgacttcctcggtggggagaatttcacttcaggaggaaacggacgcgagactcgccgcgggacggaaggctctcgtggtcaagcaggcgcgcgaggggcaggcgcgaaacgcggcgggaatcgacacaccggcaaaggaaagggaaaggggagacgaggaggtttgtgggacatgatggatgacgatatcatggatataaatacgtggactatgtgaggacagcagggatagaagagggtgccactgcatgcgtgtgccctggagaatcccgcgcatgtcgacgatttgggtgaccggagaagtggaaaactttccatctaggttgccaagagggatgcgaactcacggatgcacgattcggagatgtgtgtgtgtgttgttgactcttcaaacggcggaggtcgtcaggcgcctcggttgtgtttacgggctgcaaacgtcttctgtctttgcagaagaaatatacggggagttttctgaactttccctgtccagcctcggttgaaacacacaggatacggggcgcatagcttttgcccgtattcaagaaacggtgaaggcgtaccctttgagacgaatcatcgcgaggaaactgtcttttcggggaccggtggacgacgaactgagttgcgttttgcggttaattccagtggagttccagaacgtcaaacaagccggtccatacgctcggaaagaacaaagaattaaccagcgggagaggcgttctggtaaaaggtgccgaggacagaaatcgtgccggcgcggtacgcactaccgaacgtatttccgtgttccctgggagtggttgttcgtgggcatcattgtctaagaaggcacaaattgttcgtagctttccgtcgccaaaaagcggtactctcaacgccagaaactgtccaaatgacagccaggagatctacgtcagcagtgaggtagtttcacggcaactacgagtaatttggatgatattatgtcactcttatcggtaattctatgcgggtacaagtcgagaaaacctacggttgcaggtcgtttagggaggcaagactccgtcgcgattttgacctgactcgagtctgacctcagtgtgtccttttttcctttccctggctagtcgtttccgggttcgtatctgcaacgagaagatgtcatggaaacatttttatttttcttcaagggctgttcatcttatgtaattccacagcttcgagggagccgcgtttaggtccaaaaagtcgttgtgtcgccgagtaaaatgtgacgtgaggacgtaaaggggtaggccctgctgaattcccaaggttgtgggttgtgtgttacgtgtgcttgtccgtgtttggtgcgtttttgatacggcccctgaaaacccaattcatgcctcgattgcattgttcgggctggtgtgaacgggccgcgattccgaagaaagcaagcgcaagtctgtgaggaaaaaaacaggagatagagggttgcaccgcagtgaggagagttaatcggcttgctgcaatgcacatacaagtttgcacgtgtcttttgcgaacggattcgagtactaggtgtacgtgcttagacggagctagtgtgaattcgtaaaccgtattcggcttcttcaccagaaacagaaaaaggagatgtgcgctgcattcttggagggtgagtgtgcactctatgtgatttcacgattgcacgaaaacaccgttttcacatttctgcaacccctaaacgtctcgttgcgttacctgcagtgcaactagcagcgcgtttgtaggcctctcacacgatacagtcgttctgagcacgaaaaaaccgagggcttcgcgtatttccctcacctccgcgagacaccgcaccaggggtgaacggctcgtcaacgtcgcatagttgtttacgtccgacatattcttgatgtcaacggactgcatgaatgtcctgttccagtatgtttgaacgaaagtgtcgcacggcttggcttacggaaacggggtccagcaaaagattccggttgcacacgttatctacacaagacctgtagcatacgccaccacagagacttccctacaactcccgtaatgagtgatgcggtccacgggatgcgataaatagtgctgcgtggtcgaggctgttcgcaaggttcagcgaaaggcggggaagtgggaagagagtcaatcgtctctggttctgcacaggcacaatgcgagccgtagtgtggacctgttcttccgtacttcatcaaagtgacatagctgtctcaatgtgacaaattctgactaccttgtttatgagaattcgtgatatcgacaggttgtctcgtgtgagattcctgtaaatggctaataaaagagggtgtgacaacatcagtcacaaacacggcgactctaccgcgtcgcatccggtgagatgtcgctgttggcctactgcctcaaagcaaatcacttctgcgatccgacgtacgtaaacgaaggaaggagaaattcacagcgttgcgcatgttggtagcctgatactttggggacgctcgacggcggtttccacctccagtgagcgttcgaccgttgaagataacgcactcccgtcgaggcatcaactgaaaggaagacggcaacatattcgcgacgaattcggtgcatgccttctaactggttgtgtctctcctcccgttcgttaatacactatgcttgcctcggccgaatgttctcaatcccccgcggccgcagaactgtttcaaaatagagagacgagactagagctgcgcgtctctttttgaggccgacccggtgtcatttttttacaaggggattatgaagtcgtgattacagcctttttttgacaaagagctaaggtcgctgctatggtaataagaacgaaaaccgtgtaaagtgaccggcgtttcatcctccctcttgcgctgacacaaagtgacgcggtgatccagcttgattgagtgacctcttcttattgtgcctctctttcaattcatgcaaaagcgttcccacgtctgtacagccgtatctgcattctgtttttgtgtcccagcctgcttcaagccagtcagttgtgtaacggtaaa

SEQ ID NO: 1146 - DNA, 2599 bp, Toxoplasma gondii
acgaagctaagaggcgaaactccttgccttgagaaacgtatttttccttgcaatactctcacatccgatgatctaggggttttcgtgtggggatgatataagagcctaatcggacgtcgcagggcttggccacgactcctggcaccaggtgcacctatcctggggacgatgaagctgaagctgtgaagagggttgaaactactctgtcagcttttttgcatttgtggagggaagagggcgaagcgtgcagccaatcaccttcagtttccggaagtcatcgagaggatttggatgtttttcgttcacatgttgtcgtgtctatctgttctggaagtcaactggcggatgctctctgctagagcaaccgtgaatagacttacctgtgcgacttgttctgggaagcagatgaaacgcgtttttcaattacattcactcgcgcgtttcctgtgagtccggtttttgtttcccctattgccggtgaatctatatggaccaggtaactgacttcttgtcacgatggcatgcagttaggtagaaattctctgaagcgaaaaccccgggcgttgctggtaaacgctttgagcctccgcggggtcggggccttcaaatgttcatcttgcgttcaatcgtgtgtcttcaaaggcagtacgttctgtctgtcgtttggcctttcgtactctgggacttgcgcatgtattctcgttcttcgttaatcgaaacctcttctccggaaacgctgtactctgaagagttcatcagcgcatgccccgaactaccggcaataccaccatcacctttgctgccgcctatgcatcctgtgacatgcaacacgctccatagaaaaattggatcgaccgctgccgcctgagtacgtcccccattaaaatttcatttcctgggtagtggttcttcagaatcggagaagacgaaaaggtaaaagcgatggggtcctaggctgtgccgaggattcacggtcaacacctcgttttctgggaacatcgttcggtttcgcttcagatagaagtcaaagacagcctcgtgaaatctgatgcttcagaaatccgtcagcaatgattgagattcagagacaatgacgctagctgatacaattctaccagcagtggttcgatggtaaacaaccaggacgtgcctcctgaaatatcgtgtttaataggcgacatatcgacacaaagagtgcacaagcagtcgcagatccatttcttgccagcttcagacaggaggacgtcacacaccgacaaatgtgtagacagagtgtttaaatgcgtgtgtaccgcctcctcgttttgcgtcaactgctagttgcggttgttttaatagcgcgtagagcgcatttacggatgtcctctgttgaaggcattgttgtaggctttggatcataactggcgccgtactgtcgccgagacaggttatcctgtctgtgtcgtctacattgacacgaaatgtttcggcggttgaaactgtttcagtgacgtggtggcgcgtatatcatgtcactgaaatctcaggctgaaggtgaacagctgtggtagtacactgtcaccactccgtgcccatattgcgccgctggaactcagggcagcttgctccggacaaagctgaaaaacggtctcccttagttacccaacatgtcaacatcgcgtcgtccctgcagggtcagaatgttaatagccggacacacaggtgaaacagcctacaacattccatccttcccgtcgacaccgtcgacaacgctacgcggcggtggccaaaggccacagtggcgtgcccgacatcgctcccccactatttgctaaccgccgaaagcattatcaagattcctctaaacgaccctagcacggtggaatgctcaccggctgtacagagtcggcctttcgtggtttgttgaacgtcaagggttgcggcatcaaggcgaggactagcattatctgtcgacacgacacaaaatgagctcggacaagcgcttggtgctgcgaagacaactgatccttcagggtcccctgtaagcgttcaggtgcttcctcccctcggcagcagataacggtaacatggtttaagtgatgagaggtcgcgtgagtttccgtgacaagttccctcacagggcatatccattcaaattccgcttgaaagcaaatgaggggtgacgaatcctacagccatcgctggagttctttcctcaagtcacatggtgctctgcggggcgcgtgcttgtaatccaatagatgtagtcagtgtgggtctattcaaaaagcactagtttctctgtgttaacaaaggtgaaactggggagatcttcctcgtctcaggtccaactactcagcacccttgtgctaatccacttggcgacctcgcttgttcgttcttcagtgccaatctagtggccaagatcagcgacggtgcacagcgaccagctcgacccatattcaactagcgacgcgctagctcgagccagcggcacgtcctgttgtcgggaactgcaaacgccaagggagcacctttcccagtcagggtacgccttcggttttgtgtttacaccgcagcgggcagcatgagcagcaaacccgcttacggcacggtacga

SEQ ID NO: 1147 - DNA, 2649 bp, Toxoplasma gondii
cctgtgctcgcgcgtcgtgttcagtactgtgtgaaactcctttcctcggatccccgcggcgcgaacggaggagagaggagagacaaggtgcccgtcggggacagagggggtgagtgcaaagcagagttgccagaggcgttttcgacgtcttcagactcgagaagacaggagtctggaagtctgtttttggtgacagaggatgcggctgtagtcgtggacgcgctgaaggctcttgctggcacctccacagaccgctaggtgtcagccgaaaaacgcagattagtgcgcaggtttgggcgggggtttggaaaagctgtgcgcggcttctttcctcgatacagttaactagctagagcgcttgggagcgatggtcattcctgcgttgctccacaatttgatgttgacgggctcgcgcagtctgcgacacgtgctgtacgaagagtgtctctgttttccatcggaagagcgacgacgaattcatgctgaaggcgagacctgcggtgcccttcctggttcgttcgtagttctcaggatggacgaggcatagtcaggggggaagcgccgactttccacgttcctcccacgcctgaagcacgtagaaacgggtcgctacggatcaagacgagttgcaaagattttcactccgaaatcgacatgagtttccgcgacgccagttccgtgtgaagtgtctgcgtcacactcaacccggtcgaatattccgttagcgactcgatgagaccggagaagttctgctgcgttcacaaagctgaaacaacaactgaagaaagaaatcgactgaaccaacggaggaccatcccaaacgggtggtttgttagaatctgtgctacaagcaacatcttattggaaaccagtaacgaggaaactccctgaaaaatgtgttttttctacgttattgtgtgctgttgaaagcagcaccgccccaaatcaggggcaaacagcagagtcatgctacacaagtaatcatagtattgttccgacaccctcttgatcgaaccccactggaccgcgtactgcaccttctctggagagaactagtgaaaaagatctcatgtaacagccagtgtcctcagcagttcctgcagaaaaggaatctgaactacgaatcacttttaaaagaggaacatgaactaggaagtatccgcggcaaacgcaaatttacaaagaagtcgctgcgataagcgcacatgtcctaggtagtagccactttaaaagcacaagtactgagaggtaactccgacaaaggagcgtgctttgaggagcaagtgcgtctgcacggctccggcatgtggcgccttgcctgcttcgccgaaccaacatggcagattggaacctatctgagacgtccactcaagatgtgcggacaagtttgaactaagcaagtggacttgctggaggagggagccgtttaaccatccgtttcgcttttcctgcgtctttcggggagtcgcgttgtctcgacgtgccaggaatgcgcagatttcctcttttcagaagcctaaatgtgtctagcgctccctcctcaacagtgcggatgctgacaagcagaggacagacaagatccatgggtacatcgtcagatgaatttcaattgactgaatctcgtagtcccagcttggagcagcgacaccagggacgccgttgaattccttttgaggatcaaccatcgttgagtcatccgccaaccttcgctaccagtcttccatccatctccatgttcagtgtgtgttcgtccgtaagtttccctggaatgccaggaggagactccctggctctctggtgcagtgtgccggcggcgtctgcatgcaactagttgtctaatgtgcgacgctggtttgaagacatgtcgagtgtctgtatcttctcccttccctttcaagcgaaaacacaaaagatatggatttttcgattcgttgttttatactttgcacactccgtctcgacttccacgatttgaaatcttctctttaaccgagtcacggggatttttccctctagtctttgctctttcctcgctggggtgttgcgacaccgttttgcccttccatgaggtaaactctgaagtcacgagacacgcaattccagtccctgtgttgagtgctcagactgaaaatcaatatccgagattctccgcccagcttcacaaccacattctctccgccgcatggcagattttattcgcggccggctggcctcaagtcgctctgcgccttagagagtggaggaccttttaatttttcttccctccgaatttcctcgaaagctcagcaggtgttgaagcggaggacgcgggcacaccgcgctgtgactgtctgagcagtgtgggctggtgttgatttcgtcctgcaagggagttaaccattttcctttcttgttaggcgtttctaggaaagagaccgagagaggctgcatccgagagagctgcgcagagagagggacatgcgtcattatgtgtctagggacctttcacgtttctctagagacccaaatcctgtcggccgtcgtctcgatttccagtgttcctctgctccaaaaaacagttggaacgaagacagcacatactatcgcgtcaatgtccacctctctctgttccttgtatcgtttgcatccccgaaaggaatggagaggaga

SEQ ID NO: 1148 - DNA, 4012 bp, Toxoplasma gondii
ttgtgtgtcgactccacacatcgacgcatgtgcatgagatgtgcctgactccgaaggccggacagggaggggcatgctttctcgccttcgtcccgagtcgcactgcgtcaccgttcgttgtttctctgcgacgcgtccgaagacgaagcgcagagttctcgcgcagaaggaaccttctccgttgtttgccccagtccggaatctctctgcccttctacgccttgtgtttcttgtagtctccggcgaaggcgaatggacgggcgggtgtctcctgaggtccccttttgtctttgaagctggactgcgcgctggccgcagccgcgcctgctggtgtgaacttcttgtgccttcttttgccgtggcggcgcttgcagcacgggcagacgcacgcgaagaagcggcagaggacagttcggaaggcaaggagcgcgaggacgtaggtgacgatgacgaggaagagaagaagcgcgaggcggtctccaagtcctggcgggatgagagcctcgacgtcagggtgcgaagcgaacagcggggccagcgcagcgtccacgcggccgttgacactcggcagaaggtcgtcggaaagcgaggtgaccatctgaacacccttgcctgccgcagaagcggctacaggatacactgttgtctccagaaacagcttcgccttctccagagtcggtgcgacgggtgcaagcagtttcgcgttgaggacctcgaggtacggcgcagcgagagtctcgacttccagtttgactgttcccagcttctcagacacctcgcgcggaatgcatgcaaccacatgctctccaatcgccatgtacagtcgcccgatcgacaagagcgttccgcgcatctcttcaattgtgaaaatgtgatccgagctcttcctctcctcgccgaccttctccgacgcatgcttcaggtctctctccagtgcgcgaactcgagccgccagatctgctgcttccttctccttctctccaaggagcttcactttctcgccgagctcctgcgccttctgactgaggccgttcttcagcgcagcgacttcgcgttcgagtttttcgctcgttgcctcagaggcggcggcctgcttgtgctccagttccctcagtttcttctcgacatcggatttcgcgctttgcgatgcgttgtacatcgtccgcaggttttctgcctgctgctggcatgcgtccacttccttttgcttgcgctgcgtcgcctcggtgcatgcacgcacagacgtttcgtgaacctctctgaacttcttcaactccgcctcggcgttctccgctctctgctcggcatacttgagaagtcgcgcctccttgctctcgcctttctcggtctcggggacggtcgtcttcgcagagttctccgcttgccgctgctcgactggttttccggcgtccgcgcgcgtcggcgtctcggctgccgcagcgaagaggcacagcgagtcgccagagcggcgcgactcagcgagaggcgagactgtcgagggagcaaagaagtccgccgcgagacacaacaagagcgcagtggagaggaagaggggggggagccggggaaccgaggccgccatttctggagagcgcaggcagacactttgggggaacaggtgacagaatttacaagaggaagaggccagaagaacgaagaaggcgaagaaggacgagagcagaaaaggctctttacgcgccgagacagaaggtcgagatgcgaagggcaaaccagcaggcggcgagaggttccggcgcgcagagagtcgctttgagagggtggaaaatcggacgttgcttgtgtctgacgaagatgcatgcacgtcacttttttcgccttcagagcgactcaggagcaagacttgttccgccgcagctctgccgtgtcgcgctgtgcgggtcgtcgtctgtttgctctgctagagaaacgcagaaaagcaggagtgcatccggagagaacttccgcgaaatccgagatacaagcgacttcgcctgaagaaacacagcagagaacgagactgcaacactctgtccgtcttttcagggaaacgggcagaagacagacgaaaaacggccaccggagcgtgagagacagatatggagaatcctctagagacacacacacacactcacaccggctggagagcaaccttccgggaggaaagagaaacacaaagaagaaaagagaatcaagcacgcagcgaacagcaaatccacttttgggccgcgatagaaaaccaggttttctcacggaaaaaaagggtgcactctcgcctcgcggcaacacaccagaggccggtcagtcctccccccgcgcccccgacgccaccagcgtctctctcgaattgccgcgttcttctctcactaccagaaaaaggtttttctttcgaatttctgaaagaaaacaggaaacgcgaaggccaagcaatgcatttctctccaagaaagaagacaaatagacaagtgcaacacacatatgtgcagacagagacagccgcccgacttccctatatataaatatatataatatctgtaatatctatttatatataatatcctatatatatatatagatagatagatatatataatatgcgtatgtacttgtgtcgattgccaatttcatacaatacaacgcttcctttatacgcatagattcgttcgcttagagcagctcgtgtatgtgagtatgcctatgcgtatccatgtgcgcaggaggaaagtagcagtgagcactgacaactatacgcatgtgtatatatatacctacatctctgagaatgggccgtctctgtactccaacacatacgcatttccggcttatgcatacagatgcagagacacctttagctcgatgcttcaagtgcagatgcatgcagagaagaacactcgcttctctttcaagaaaacaagttcgtggatccgcgagaagaatgaacgttgtctctctgtcagacgcagagcgaggaattgcagaagagaaacgcctcccgttctctcagaaaaaagaaaggcgaggaaggacaagagtcgaacaaagaaacctgaacgagttatcgtgagctggaagagttggagtgaaactcagacagactcagtttgacatcttttatttgatttaagaagaacctttttgctcttcctctttctacttctctcctctcttcttcctctcagtttcgcttctcgccattagtctgtctctcaccttcctccgcctttctctcctctcttccccactgtctccatcgcgtaaaaggtaaagcatctacagtacctcgtgcgaataccttttctctctccaccaccgtgcggtgttgacgccacctgaggtcgtgttgcctaagtgaaggaaccgctctccttaagagcggttcctcacgtccaggccaagaacttgatgcaactctcgtgcatcgtctgacagtgcttgttcagaacaagcatagaacgtatccggtaacaaaggaaagtcagtatctaagcgaataaggaagagagcaaatttggtggaataatactgcttgcaggagtcgagaagtacacgcctagacgctgaaaatgacgaacaaagtctgtatctaaaccggttccacagattcttgtgacaattgtcgcgcggttctgcatcactttctgacgctctctgactgtgtactgtttctgtcacacaatggaagcaaagagaaaaacgtctctgcgccttcgtagaaacacaggtccctccatgaagctcggaaaaacacacgtttgttttgcactcttaactgactgtttggtgtcttgtatcttcggagattgctatctgtacgttttgtggtctcaggggcgccttttcgctgcgtcttgttgtgtagaggacgctggtctgtgcacggcgacgccagactgtccaggaactggaaaccgggcgaagttgccggagcagtgaacgctttttcgcaattcaggccgtggaggagcagtgaaagacgaacgtgcgggttcgaaaaggatctcggagcgaaaggaaa

SEQ ID NO: 1149 - DNA, 4333 bp, Toxoplasma gondii
acgggaaaacgcgaaagtcggttggagtctttacatgtcgttcaagactttcatcttgagctaccttgactaaaaatcgagattagaccctgagccgacgtattgcctgtgcgaccttgggagtcgttcatcgccacagtggcactcaactgtctcaccatatggttcggaagctgtttctcgtgtcgtggttgagactttgaatttgtatcagcttgcaaatgtcgtttccagatccgtagccttgcccccagtgtgacagcaaggaagagacaagaaggtgcgagaacccggggagaaaaaaaactttcctttcgccgtggtctgttgtgttttcggaacgcagcacgtgcgtctctccagctgccgcccgaggaactcgtggagtgtgcagacacgtcaagccaaaaacccagagggctccacgtctggttttctcaaagaaaaagtggggagggattggagaaagcggcatcacgagctttatgcactctatacggactgtcgaaaaagagaggaatcagagagaaaatctgactttctgtcgagtggctcatgccacatgttcacggaacgtggagcagcgaactttcgaagcgaaacaaaaattcggtttcttgcgcgactcaagtgcgacattcatcgacacgctcctccgcagcgtggagaaggcatggcaacaaagaatcaaagaaccatatgtgtgacacgtagaacacaaccgatgtcctgtataggcttgctgtcgcaggacgttgaaatccaccagctttttaccggtcttatgccgtccagggcggtggacagcagtcacaaaggactgggtagtctgtactttttcgaaccatctggagtcaggtcaactggagactccttcccccagtcaaaagtctttcttggccaatcctcaaaagtcaaaaaaacgggacgggtgacttgcagacttgcagagcttgcttcagtgcccttcctcttggtgccgtgttgttgaacttggccactgagtaagctgaagatggtattcgtctggaatgcaacaaagccactccttagaaacgcgacagcgatgtccagagcaattaaaaactcctgtcggctttgccctcacgcccgttcctcgttcccggtgtggtgtatttcaacaagcacacctacgctgtagctaaaagcgactgcggacagatcacccagttacggtgcttagttgttgaatccacctgcatcgttgtgctccgttcactagtgaacctcgaactgacagctgaaaacataccagacgtctccaaagataaaaaagaagtttgagtaattggagcgctcgtggcgggacttgacccaacatgtcacgacacgagctgacgacatccacacttttcctgtgattcttttaacattgatagtttcgctatttgaacctagtatagctgaggtctggcaacgcttgtcactgttcgactcatttgattcatgaacttcgcgcaatagcagctgagaacacaatggaccaagcacagaaccatggcgatgaacgtctgcatcacaagtctgagttcatatcgtatacctgacaggtagtatttctcgaacggtttcatggactgttgaagataacaccatgacaaatcgagagctgctaggtttgatatttcccgaaccagccggcctgaatcgatctcgcgcacggttgcggcgaaactcgtggaagcaatgagtgaaagagacctccgaaaagaagtgtattaaagaggcaatttcgtgtcatgacttctaccccttcttccttactgttacctacacacagatacacacggaaacacatggacatacacatgaatgtatatatatacatctatagatagatatatagatatatatttgcagatatatgtgtttattcaggtgaagaattgttttctgcatatagagaggtgccagatgttgcatttgattggatagaaagtattgtctcgcagcataaactgttttcatgtgatgcatttcgtagaacaactagcacaggcgcgtgatctcgtcgaccacaccgcggcgatgagcttcagggtgagtgagtctgctcaacatagaaaggcaacctaataactgcgctacgttccgaacacgttttcaaaagaattgtattcttcacccttttatgaagcgaaaaatcctagctttttcgacaagagctatgagctgcgaactggacgaggtctctccattttcgaaaaactcggaccactgattgacgacgtgcatcagcacttgagttgtgtttcaccgtttcgctcttgttcgccggtttttgataggccttcttcctccttttttcaacagcataaatctacgtacacatcatagaccctgatacctgtacatgatcgcaacctagatgcatatttatagagaagaagcaagttccatattgactacacaggaagtgcccacgccgctgtgtgttagaattgatgagtaaatcctctttctctttgtggtaaccactgattaacatcagcgaaaaactgtatcgtcggaagagagaaagcacgaaatatgctaaaaacagaagctgactgaattatcctcgtgtttcgctttttacatttctcaccgccaaagaacaacggaggaactccactttcactttttctcttttctccgctttttctctcttctccgttatttcatatcgaagactctctctgtttttcttgctccgttggtctctgttgtagcttctctcggacgtctatccttctccggcaagagctcgtgtctacatttcctacggtagaggaaacggacttccgccgaaatcctgcgacagaagaactttttcgttgtctttcgttcctcttctctcttttacacttctctgttgtctgctgtcgtcttcgttagctgagagaagcagaataagccaaggtcgttgccctcgattctcaacagagtgcgtatctcctctttctgtctgtggtgtgttcagccgcctttgcacagacacacatcggcgtagcctgaaagaagcagctctttgaagccttctacgcatttgtctccgttgattcacattacgtttcgcagtgtctatttcgcattcatcggcgctcttcacactctcaaccgagatacctctctgccgattccagcgtttctccagagagaaacgttgcacagcctcctcctagtcgcctttctctttccatcgcgaggccgttttgatatctcgctctctcgttttttcagacactttcccccaaagaaacagagctgaaccactcttctcgctcttcttctctctttcctctccttctccgcttcctcgcctggagaactcttctgtcttgcgtcggcgggaacgcctcctcctcgctgcacgcgtcgtcttgtccgctaactttttttttggtcggaaaccccttccttcttcactcgacaaagactcagctcctcttcgtctttcttctcttcttcctccaccttgctctcctgaagtcgctcgtcttcttctctctctctggcgagaaaaccggtgtgtcgctttcaccgctgcgcggaggcaacgacccaactgacccttgggctctcatgcgtctcttggatttttcggcattcttcttctcgtctcctgcgaagcttctccgtctccagactctgcctttttcccttcgacttttctttcgccgtcttcgctccctcgtcggtctctcacagtcttcacatgcgcgaaaaacggtctcttcttctgcccccccgaaacaggaaccggtgtggatatccacgctttctgttctggactctcaggtgtacgtacacctggacaaccgtctgtttcccgcttcttgtctctccaggcgttttccgtaccgccaaccgcgcacctccagggccgaggccgggcgtcggaccagaacgcgtcgccctgtaatacgtcgtttttgctttgcctgcgttctttcttcttctgtctccacactgagtcaccctggagccttctggtgattcttctggtgtttccggtcttccccatctacgccaccaggttccgtctcttccacacgcagtcttcctctccacttccccatcaaaggatctctccgagtctcctttactcccccaaatctgctctttctgtctcctccttcgcgtctgctctccgtcgcctcccgcaccgttctctctccctgctcctcccgtttacaccttcaccctctgtcttcggcgcgtctcgagtcggctctgagaggcgccggttctccccggcttcgctctttcgacgaggactggccctctttgcctcgggtgtagaaaagactgacggatacacttcccaaaa

SEQ ID NO: 1150 - DNA, 3923 bp, Toxoplasma gondii
tgttaatacaaaagatctgggtagagatggtgaaggatttgttcctccgagagctagaggtggagaaagtctcgtaatgaaggcaaaatttagactcgaattttcttgaggatgcgtcatctttcgaaagcgaaaatacccgcagataatcaagtcatgtacggttgcttctacaccatttccctccctcgggtggtcaaaaaataaagcgctgaactgccttattcgatcggcaaaagtttttccctggaagctaaaggtattgcccctgttggtgcggtcgaagcctagacccagtgtggctctacggaagaagagagcagctaatctcacggccccgtgacccatccaccctcgccaaagttacttattgagcacatatatatgcgacacttgagagacttggatcgccgagctcgaacgcaaactgatcatgcgtctactacgccagtctggaaacctagcccttgaaacgaactggcaatgagcaagccccccagtcgcccttttgcaaggcaaatgctcgaaaaacacaacgaacgcaaagcacgcacactgggcatcggccgggtgaaggccgcggttatgatggtggcatcaagagtgaggtagccgacgtaggcggtccagtccgttttcacaccgacggagctgagcagattttggctttgaaggatttcttggcttctccaggcgtatttctgcctcaggaattttagcaacttctcggcctctgtcgagcgctgctctctgcggctttgcctccaactcagcgaatctcctccgagtttcgtacgcttggctgcggggcgctctccaaaagaccgagtgtgtgaggtgtctcgacagtcggagccagccgctttgtcgctcgccgcctcctgggcttcgctctcagtctttccagaacgaatccgcgtcgcagataaccctcgttttcgggtctccactctcgaggtctcttcttgctgccactccacctgcctcgaatccacggccgctgtccacgcactccgttcctcgcatgattgcgtcaaactcgaggttcctctctcgggtcccgtctcttggggggccttagccggagcgttcgcctttccttgtccttctgtatgcgacgacagatcgaagtttgtctcttgcgtgcgggtctctggagtctctccatcgctcgtgtcgtcttcaagaagaatcggcgaggacggattcgcagcctcacccgaaccgggtgttgaggcccgcgaagccctgcccggcttcctccaggcggagacaggagtgaagagggaggaggtttgcacggactctatgctcgcagaatctggagccctagacgggaagccccgcgactgtggcggggactgggagaagaagaggtcgacggctgcattcagatcccagctcgtcgtgcgcaagagcgagagagcgacctcctcggaagcccccaggagactcgtcacttgccccacaagcgtcttctgtgagcgcgacagctttccaagacggctgagcacctgacgagacccgctgtccattatgaggaaacagaggaaccaacggcctctcgcctcggagagacaaaccgcgagcagcgacacgagactcactggctagaagaaaagaggctgaaagaggacaagaggatggagaggaagaaggtggaagaaaagaagatggagaaagcagatgagagatgcgacatgaaaaagtgcacacaaatgggcttcatagatacgcatagcgacacggtgaggcaagagttgaccagaaaggacaggagttcggagggtgcacgcaggcagcccgaatcgacacctcagctgtaagtaccgcagctgagagatgggggcttcgggaagagcacagtgccaaccagaaatacgaagggagaggctagcagaccaggtagaaaacaacggacaagaagggcggaatcatggaatgagaacggaaagagacgttttcgggtgcagagagtcacacacgaaaacctcccacctgtgctggttatgggtcaaaaaaaaaatcggaagagaaccggttgtcgcttcagtcctcagcgtggcgatagaagtacagagccaaccagacggggaagcgaggaagtgtaggaagcccttgaaaagaaagagagggtttctgagagcagagaaaggagcggaaaggatttggagtgtcgtgtcgccgtgtacttgaagtttcactgggagcaaattagttgacacaccctgtacagtttcgcggctgaggagatgaaacaaattctgtgtttttggaagtagaacgaaaagagtcaaacaaacgggggacacggtgcgaagatggacggacgaaaacagatcgtactctgcagataaacgatcatcgattcagggactacgcttcaggtcacgaattgttcacgaattaacattggggccctcaacgttcgaacctcagagagatagaggaagagaaggtaagaccccaggggaaacaacgggggcggggcacaagaaccattgagggaaagaagggatacacatgcacctgtaagaggcaggcggaggagcagtcagaagaaacagcagacactcttccattttacgtggcatctgaactaaacaagaaaggaaagaaactttttttcgggtcttggtgaggtgttgacgtgaatcgagacggacgaccttcagggagtcggagagagacacgcacactgggaaggcgaaactagtgagactgaagagcagtatttccagaaggagaaagacaactacctggaaaaaaggcgacagagtgcggccgtacggctgcagaatgcaatccttcacgtgaactctcagaaagtggagacaagacgcgaccctccacgcgttcaccttgggccgacaggaagaagagttggctggcatcgaggaaagatgccgcatatctcagaaaaaattgagaaagggaggggaacgtggatggaagaagagtgctttcctccgtcttcatggcccgcaatccgataaggcaaactcatattttgacgatcaatttaaagcatcaagtcaccgcaggttcaatttcgcgttggggggtgctttgccctgctcgaaagcgctggccagcccagaagggaaactttgcaaccccacctggggaaaagcgggctgaagcttgcatgtcaatctcggccgatggctagttaaactttaagggaaacgaaggtctggaaacccgctcgacaagggaaaagaaaaaaaggagtccacgatggaaacatagtcactcgagtgtctgtcgcagcggcagctctgctagaagccttccctgcgtcgaacatgaggaaaaccatcctcaccaaaaagagggcttgatacaggccagaaaactttgatttttttaggcagaagcaaataaagagatacgattggcatatcagcaagagatcgtcccattttgttgggcttttccagtccgactatcaacctagaagccaggcagtgtgcgtgactgcatgtgccagcttgagcaccgcagcgatttgccgctaggcaggtcatcagccttccgtgttccttagaaagagccgagtttccttcaaatagtcagtcgactgctttaaaatcctttgctcaacctttactcaagagtgagtgaatcaaggatgtaactgtctgtcttccgttgtcttgaaacccgattaccgtgacccagttgttactcaggtgagcacgcctgtttcatttcctccgatacaggcgcggcctgctcgcatattcgtgccctatgccgtcttgcctgaaatccgaaaacactggaactatcgacaggtcgcctcgattttgcctttccgggaacccttgctcgaacattcgagcagattcacgaccgcaggtttctttcggaaaagtcatcttcccgttggaaagggattgcaccgctggttatcacga

SEQ ID NO: 1151 - DNA, 3585 bp, Toxoplasma gondii
taaactgacggcaaggtggacacctgagaaagggtaaaaacacacacatagatacatctatgcgtatatttcctatatatatatatatatatatatatatgctcttgcgtccagagtctctctgcagcgagttgcaggttcagtcagccgccagaagtagcccctgtgaagcgtacgcatgcagccgacagagcacctcccgcttcgtttcaatgctgacatctcccagcccccttcgcttcttcacgcaactctctctccacgtagatgcctacatgcaaacatgcatgcccacatacgcacgcgcatgcatacatatttacatacaggcggatgtgtaggtacatatagctgtatacagacaggcgcatgcagaggcagcctgacatagaacctgtgtacgcagatttttgcagaccgatacgcaaacttttgcgaatatacgcgcgtatggatgtgcaagtgtcgagggcctgtcgttgtgtcgcattttttcagtcctcaagtgtggaactgtttgcattcgtttggagtgcgaacgggggagaaactgaagcatttgcagtgtctttcgcaactgaccagtgggcgctgaagtagacgccgatgacacccgagtcgatcgaggcggtaggtacctggcggtctcctctcccgataagcgtcgggccgagaagtcgctctagcgccgacatgtttggaggaaagagaagagaaaagaagcagaagagacggaggacagacgcagaatggccaagacgaaacaggggaagctgcggagagacggcgagcaaggcgggcggagcgagacagcgcagaccgagaccgagagctcggttagtcggtagaggaggcgctgcaggagatggcgtagaagggtgattggaggagaggacaggtagaagacagagaaacaaggacgagaaacaagaaggaaacgagcgggaaaggacgaccaacacagagaagggacagcggcagctgatggagcgaaaaagtgtcacagctatcggtgttgcattcgagagctgtacaaggcaacggagacgaagaaggttttggaggccgcttttccctcctccctttgaattttgcacgcttgacagaaataaaacatatgctttctccccgagagacggacctctcgcgtgtcttgttgtcttctgcgcagaggtgtgcatgctttgaatgtcagcaggacactttctgagcgaagcgcggctcccagatgtaacaaaaaacgttccgattctttgtccaaaagaggagtctggactgtaaaccggaattcctcagtgttttgcatgcatgtgtggaagcactaatgaagatctggaacgatgcgctgggacagatcggcagtcctcgacggcgggcacagtggatgtacaggcggacacagttcaacaaacgtgcggatctaggcaggtaacgagcgtttttccgacacagacaaaaaaagtgcctttctctccgtaaaatccgctccggctgcatgtgtcttctgtacagtgtctccgccgttccgttcgcaaagcccggcgcatttatgcagttcgaagtgagcagttcttagatggaatgtgatgacgcagtgcgcggaaccacggcaagggagtagaccatgcggaaacactgttgcctcaaactgagaaaccgacttgcaaacattatcccttgtacggacaggtcgagcggttcctttctgtggtcccttgctcacgagcgccgctctccctgtaccgggaggtctgttgcctcgtatcctggtagtattctgcaagctcaggtttcttcgaagaagactacagagagacacctgtgaaactgcagtctctgaggaagcgtgtgtgacactacgaaaggggcgccgcgatgcgaaacgaaagcgatcacttggatatccctatctcatgactggagtcacactcagtagcgtggacactatagtgtctctgtttattcgattcgagttacacagttcctgatgatgagggctgatcactggtgcaaagacaacatcgacttaaaatgcgataaaaacagcgcatggttgagcgatgatctttacgtttgtagtgatgcaatgtgcgccacagccttagcgccacgaaaagccgctacagtcgtgtggattactacacagaacgtcggtgggagcgctttcgagtggctcgatccgttctaagtttccttgaaaggcagttggacacatagaatccagtcgaggatctatagagtcccttcctttgacggagctcgtggttagtcgcttctcagccagaagagtggctgtacggctttcctgtctaacgaactcagcagaacccctcgaaaagaaagggtcgttttcgttcgtttgaacggtacgacagtttacctcccattcgtcgagctgactatgcaacggacttggcttcctcacgcccgcacgagccgggtgcctcggctgttctgtgacgcatgttgcctcgttccgattttgacacccttgtcatctttgtccttaatggatctgttcattctgacgtgtgccagcaacccagaaactctcacgttccttacttcctttcagtatccagccagatgcacgcctgcccctcactttgagtggctttttctcgcgcgtggtacgccacgtagaaaaacgcctgcaaaaacggacttcctcgagttttttgtagacttgacattttgttcactttctgcccccattcttatcactcctcggcagtgaaaatgtagaaaacacaccttctgatcgcacatattgttccccttttacgttcaaaatgggcatcgtgtgccgttttctgcggcatcgatcgcctgcttgctgctgtaaattttagtcgcaaagcagcccccgaacctgctttttatgttttcacttcagtcccgttgccagttcccgttccatcaaggaactacccgttacggaggcagcggctctccgaacaaagtcgttttttgtccgctgtaaggatgtgcagcgtagaacacagacgttttcgttgtttatggcaacttccagttgcattcacgttcccagcgtctatagcggagggtgtctgctttttcgtctttgttcgtacgagcgagagcctattctaaagacgttctcggtagattctcctaaggcagacgtgtttgtcgcgtctagagaaccacgcgtcaaagaggcaatttagaagtcttttctcgacgtttgtgtgtgctaaaccacgcctaaagattctgctttgtgcctcatacgagtaagcatccaaaaccattttcctcgaaatccattaggtcttgagccatctcagagccggttcttttcaataagggcttcgatgtcatcgcttctcgaggccgtttcgcgacttctttgaaccaatttacgggcgaagtaaacattttcattcaagtctaagctaaactgatgccacagactcgattctgtgtgtcgttttccgtttttttggcacgtccccaccgctgtcttgaggtcccccgaggctccgttgcctcctcccgataagtctgccctctgtagcgcgcggcagtttctaaaatgtttgtttcccttttggtggaaaa

SEQ ID NO: 1152 - DNA, 3549 bp, Toxoplasma gondii
cgtcgctgtcgctggaagacacctcagttttcctttcctgctttccctcgctgctcgtgcctcggcgccctgcagagcctgccgcggtcccgctggcttgactcggcgtctggcgcgcctggccagcggggaggggcgttgctggctttcgactcccgccgtcgtcccgcgtcttcttcggatcgtgcagtactcggggagccgcgttcagctttcgcttctctgcaggggacaaaggatccctcttccagcaactcgtcggggctgcagagcccggcgcttcctcgtcagaagaagacgaagaagaggtggaactctcgtcgctggagagggccgccaccgcggcccgcttcggcccaggtgtacatacacccgaggcagggcctctcccgctggcctctcgcgctgcagccttcgagggcctcccaggcgtcgacggcatacgctggagctttcctctcctctgaaaaggttttcggggaacttcctcttcggattcttcgctgctctcctcttcgctgctctcctcttcgctgctctcctcctcgctgctgtcctcctcgctgcttttctcgtccagggcgtcgccggcactcagcgccttgcatcccttcttcacgtggttggctggacgtccacccgagcttcgggggtctggcgctgaagaccgctcgcgttttcttgcgcccgcggctgttgcgggcagcagcgagtgtctctgggcctcagcagagccgcggagaaggcccggcgactcagctgtctgtgcaggcactggagtgtacagacacaccgtcacgacgtcgtctttgtccaggaggtcgatgggctggttgtcgggaaggaggaagttttcgaggcgcagcatgaggtcgacaggcttgccgagcgcgacctctgcggctcgagaactcgctgcgaagcaggaggcgttgacatttcggctgtcttcacacgcagaaagagcgagaagacacgagggagtctttggaaagcggccctgagcgaggtcagcgagaagcgctgctttcagctggccaatcgtccgtacgctgcgacgatccacaaacacacagctgtcctcaaagactgcaaaggagattccagagacgcatccacttctctgcagagactggagagaagaacacaagcacgcagaggacgaggaagaagcaaaggttgaggagggagaggaggaagagttcccagacgaggaggatcggatcgaccggggggcagtggaggaccctggaggggcttgacatgcgtcccctgcatgcacaggctcgcactcatttgaacctgttccttgacacgaggcacacaccaggccaagcgggtgaggggcatgcgcacccgccgcttctctcccagggagaaagtgggagcagaaacgcagtttaattcgcatcttgaaagtagttcagccgcgctgtataaacatgcacatatatatatatatagttgtatatatttgtatatatgtatgtatatgtatgtatgtatgtatgtgcttgtgtgcatgtagattacccgatgaaaacaggtaaagtttcaagtgaacaccagagagaactcgatctctcagactaccgattctgtacgggggatcgcaaggtgccgtttgaaacggcgcgactccgtccgtcgcgggctctgcacgctcgaccgcggtttcggggaagaaagaataagtcgtctcgagcttggaaaatgcaacatcaacggctcgacgccagcgaaaaagaaggagggaaacggagcgaaagagagggggcgagagaagggaagagagaaaaacggggcgacaccgagagagaatggaagacaaagatcaagggaggaaacagaggcgaaatggagaagaagtggaacggaagagaagatgcccgtttttttcagaggagccacggaggcagaaagcagcgtgtctatgttttttcgcgcaaggcgaatcctgttcgcagagattcgccgtagaagagaaagaacttcacagcaaagtggaaggagacggagaaacaagtctgaggttttccagagagtctctgttttctcaggacaaaagacaatttgcatcttttcgtcgagagatatgcatgtatcgattgtgctgttgcaagtgggagcgctcgtcgctcctcgctcctcgcctcgagcgagtccttccctttcgacctttccgctcctcgaatccgaagaagtgcaattccaccttctctctgccacacgtactgaagaaaaacgtcctctgccgagagcgccaagctcttcgcctggcggggcgcgaattcgaagcatctgcatgtcgtcctggacagttttttctctctctcggctgtccgcgagggaaatgtggggtggcaaggaaacctgacggcgcgagtgtaggcttctcttctgcaacacaagacgggcaaactgaatccttcaatggagagcgaaaagcatcaatgcctactcacacatccatagaattcgcgtccaagtgaattggcgcaggcgcgtctgcagctctgcggcgatgcacagctgacgttcctgagcagaggagagggtgagggtgtcgagacagccgggctcgagtcgccatttcggggatttttgtcggtggttcgcgcttcgctttcgaggacgccagttcttctcggaacgtgtcaagagtcgagcccgatcctttctttctctttgctccggagaaaaaggcgcaaagtgcctccgagtcgacagccgcagacgcggcgaggcgatgtgcacacagagcgagacgcaaagacactcaaaaaatatttccctctcaagcatctgccgacagggagccttcgacgcagtcacaactgagccttgaaacattcgccgccattgtttttgaggagacatcacctttagaagagaattcacgtacgtgtgtatgtttgttcgtttctgcgaatgaaaacaagtttgcgtggtactggtgagagacagaaaaagtggatggttaaaatgcattcgggagtctctgtgtgtcgaggacagcgagcaggagtgtttcaagtttttcacttcaaccaggcaattcctatgttcacattttcaaagggaacgatacttttcttcctggttttgctctcaaagctcctcgacagacctgcgcatctctcgcctacttcaaacgcttctttttgccgtgaaaaaagctcgacttggtctttcgttcctcttttctccagcgtcttccctcgcatgttccggttttaatcccctttcgtcttttcgcggctctcgcttgcgtcttcctccatatttacgtcagtgcccctcctctttcttcgcctctcgtctccaaagcgtcctctctacaaccttttcccccttccgctctctcctacactatctgtcgctctcttgtgctgctcttctcctctccgttttttgtcggattctctgtcttcttctctgtcgcgcctctgtctctcttccgtctctctttcttccgtctcttcgcttctcgctcgctgctgccttccagcgtgctccggcttgcctttcctctcgtgggcgtggaga

SEQ ID NO: 1153 - DNA, 1515 bp, Toxoplasma gondii
tcatcaagtcctttgagaagccttctctccctggtatctcacagtttttttagaccctttttgtagttctcattgctctcttcctctttttgtcttcctctcccttctttccttctctgcacctgtcgccttctctgcctgtctctctttccttctttttcgctctggagtacatgggcgatcggagatgcgaagaagcgcaggcacctcagaactcgactctgcaccgccatgttcttcttagaagaagcaatcgaggagcatgacgaattgcaacttttgatgatttgccgtgtgtaccagcgagagaaacagcgtttattacgcgccggtatcgtccctaggatccggatatgtgtgtgtctattagccgaatctactcggttctttgtattgaccttactgctagagacagggcaaatgggagactgctgtacatcttgttgatttgcatgttcgcttgaagtatttcatcctgttggggaagagcagctgggctctccggcaatctcttgtcttctcgggggttgcgaaggaggcgctttttccagtttctctcttttcagggcatgcagtcggcgagcttcgtttcggttcttgtgatgaatacagctcgacaaacgtaaattgatatctaatgaatgcccgctgcttcttattgaaaataccagcaatgcaacgttttagtgaagggctacaagggtggcgtttctgtcgaaggaagcgaaaaaaggagctagcgtgtagacgctaagaaagtccttctcgagcgtgaaggccccgcctgtgagaagtcaatccagttgagtgcaacagacacccagcatccgtcattaacgaatgcagatcaaaagcaaccttaagcgcgcgttttctgtcttttgaggcagctgtacatacaccgcacatccgccgtcgacgctggctgcgtggagtgcgcagattttcaggtcgaactcttctttgagtcctcgcgtcgttcctgttttgacaggaaagttgagggagaagatacaagaagggaatgaaggagaactccatcgagacactcgagagcagcggcagctcactttcttgcatgcagtttgcggacagcgactctcgagacgacggagatcaaacagacagccgtaaacacgttttcctcagaaacgactcgtttgttttcttctatctgttttctttccaaacgtagaagccgagctaagacttctcagcaacgcgcgtccgtcttctctcctctctgttctcgttttttccgttttcgtcttgtcttgttcttcctcgtttgtccttctctctcgcctgtgtttctcgtcagcagttttgcgtctcctttctcgagcagtctccccctttttcttctctctacctccttctctttctcttctcttcttcgtcttctggtcttcgttctctcgcctttgcctcctccctttccttcacttcttcccttcccccttcctctcgtctctcctctgctctgactctccttcgtcgccacttgtcgccgaa

SEQ ID NO: 1154 - DNA, 4355 bp, Toxoplasma gondii
tcaaattcttgacataaagcctgtggcagtgaatgaagaacacgatgcctttactgaaagaaggattgccactcgcggcagaccagtctcgatggcctcatagtcttgctctctattactggagactgtcgtcaatcacaataacaaaaaggcacaaaagcgaaaggagccgccgcgcagcaccctggtccagtcacaacgccggaccacccaagacggaagcgagcgacccgtcgctgttaagcagttgcaacagcgctacgcccgagaaacaacccacacaaacagtacacgagttgtgcctagtgacagggcactacagtattatttccactactatggagttaccggcggcaacgaacacaaaacgcatagtttgggcctttcgcccagtcggacaccatacaaatgagcatcagatgaagcctctcgttactacactgttgcacgttattatgtagttacattgacccgcaggaaattttctgactgccttgttaacgctagcgaacacgctaaagcaacagacacgcggactgagcagtccgaatatactgcgacctagtgttagggcacctgaacgcggaatataagttcattcagagctcaaaatcatgagaacgacgaggcaaccatacattcagcgtgtttgcagactctgtatgttgttgttgttgctacgaatgcgacttgatgtccctcccaggcacgcgatataacgccgttccgttctcttggccagtgagcaccagagcgcgggtgcggaggtgcgatctggaagtggccgaagttggatggaagtaggtatatttcacaagggaaggttcatagagatccgattcgctgcaaagcgtttcggccgcagatgtatcaaagacgtcagatacagaacaggcagactggcaaacaagccttagccggcattcagtgtgctcgatctccggagcacagaaggtcccacaaaggcggcgacaccaaaacaggcagacgctccttattagaccaaagtcgcttttctgtgtccggcaaccaacatagaaattgttgaactccactggattcctccggagtcggcacgtttttgccgcatgcagttgcgaacacctaccgaaagcataacggggtcatctaaggggccctgcctcaaactcgtgcaaccagacgtaaactcacgttcagcagtatcgagataccaaacatccagagaaccttaggaggttagaaaagaaccaaatcgtcgtcgcaaccacaagttgtccagaaggcctattctatttagcgaggatcgtgctcggtgtgtcacgttcgctgtttccatgcgtcgcatagccatagcattggtcagcaccgggccgaatcaatcctgacgtcttcggcacgcgtcttagggaagcagggggcagaaacggcttatcagttggcgtcgatatctttgttggacacataacaggcaatgaataacaccacatgcgaattttcctttaatctgttttctgctagctattcggctgttctccttctcttttggcaccagttgcggccacctctacaagaaggggggtcaaagagcggcctctacttggcccgtctccgtcttcctagtccctgtgttcttccgcactttatcacactacccgtcgaagttgtcccggcacctgcaacactttgtatgcagaaggtatctttctgccataatatcgacataggtttagtgctgtatctgatggcaacgacggttttgaactgttactcagagcagagcaatcgtaaacacctgtttgtcgcagcactggtgctgccgtcgacacaggcgtaatacgaggacaattgtgtgaacaatgttctctaaactcgacggctcgtggtttatgcttttttgcgccgtagaagtctccacatcaacgagctggggcaaaaggtaaggggaaatgagatgcgagctccataaaaaaaattgtgttcagcactcggcaggtacgtagttgttaattgaaataatatcaacgtccacggtgtttcctcgtgatgactgtgtctcttacgtgtttccagctctcctcctcaaagcggcacctagaccgggtgaactctgcggatgcgtccacgtgattaacggagcgacacaaacagtgcctagtacaatctagagtatacacttttcgtgattcaatatgtaacctgtcagaacgaagggaccagtatgtgccaagattgccagcgactgcacttggcatgacgtacataggcagtcgatttagtcatccgaggaacagagatgcagctttcatgaggtactccaccgagtcctggaccgtgcagcggggaattactctgggtcagtgttagtggcaccgtctgcgtggattaagttgcttcttactctaacgattcaggtggcgaagcttgttgaccggagtggctcacacttgcattaacttcgctgcagaataaacggtactgggaatcgaaactgatgcagatgtgctgcagacagtacgcagttcctttgggacaataacgctattacgtagaactgtaggggactagccagtctcgggacaagaacagtaggcagacgtttctgttggtcgctcggaacttgagaatcgactaaacttcgaaaagattcgagaaaggaaccccggcgcgcagaatccacgtatcagaagaacagtccgattcagaagctatgaaagctggcgctgaggtcgttgctaaccgttacgttgacgacggtggagtgtatccactccgaacagcgaagtgcaagtactgtagggaatgcagacacatttttttcgatccatgtgcaggctaacaaatccaaacccagactgtctgtaactgcagctaattcagatcaggcacgccaacgctctgatcaacttcagagcaaagaaaatgctgggtagacgctccctctgcgcgctgaggcatccgcaccgacagaggcacgcctgcatctactgcttacctcttacaacttatcaaatcacagggactccttccttcaataaggcatgctggcacgtcccctcattttacacactagcacattctgacaaagcggccttgaacgaattctaccacatgcagttcgacggtcaatggaggaatcacataccatcaagcgtactcagtggcggtctacgccgctatgccatttaatatcgtctactggtgattatcattcctgtggatgaaatgttactagaaccttgaggcgtcggaaggacaaacatagcaacgtgggtgataatcgccgagtgaactctcactgtagcgcacacctgtggttctccttggaataaagcgttacagccaattcctttcttaaaagacagtccactatatgagcgctgcactcacatcatcattttttccgcttaagggttagaaactgaaaacgttcacttgagagcagaagtgtttgcgcgccgcctggcacggactgcatcctgtgtagtccgtgcatgctggcctcggggttggttcccggaaacaactacccttttatatcaacgctgtcgtcacgtaagcaacagaccttgcaaaatccggcacttcctcaaattcactcgggaaaatcgtcttcaagggtctaaatgtgtgagaaactcgtaaaccggtctgttggtatgacgaactcgaatcggtggctcggttatttccccgtcgtttgcgaaccggcagtgagcacgccaccacaaggcggctggctggctcgtgttcacatccctcagaacggggatatttgcactcttcgaagaaccgattccctaccgcaactacatggattcccaagaaaaagagactgtatcctctgcttaaggctggtggcagtaaccgtcgagtgggtgggccgacgaaagctgcaaagacgctctcgcagcacagcaggtgggcggccttgctgtactgtacgtacacgccggctgagggcgcccggccgtcatcccgcttgttggtgccgccccttaccccaaagtggttccacgataatagcggttgttcgacgaaagtgggggggtggaaacagaatgagcggctaaaaacggtcggcgcagccgtcaatcgcaaagaacctgggtgacagtttgcttttctgtgtgtggctctgagtttttcatcctttctcacattctgtctcgtccaccattgtgtctctacacttgctgtttgcatgttgcgggtgtaagagttcatctagtaaggcgttcccccccatttcttcgagtccagttgcagttggtcgaaactctctagtttcttcgcagaatcaccgctgcacttgctgacttttcttgcagcagcgaccgacaccatatttttcgagttctttaactttgccgcaa

SEQ ID NO: 1155 - DNA, 1681 bp, Toxoplasma gondii
tccttgattcaacctgtggcgtcaagcgggtaaaaactttttctcaactgcttccactccgcgacaccctccactgaagccacagcacgaaaaaacttggatccggtaaacaaagactttccagatctaactcagtcgtccaactcgtagtccgtactcaccagaaaaaggtaatttatataaacctaggagcctcactttgcaatgcgtaacagagagtttagcttcagctataacgtggtgggtactgctggcgaggtatattacgactcttattaatgagagcacagttcgctgggtaaccagtccagagttccgccttgggcaggtgacccaagcagcatctcactccgcgaacagatcctaaatctccgtagttcttgcccttcttccacacagcttacccccaccccgcttacacgttgtcagtgtttaggccgccacaaccgttgttgcagaaagtgcctgcagtatagttggatcgaccgggacggagctcggaccaccaggcacgagacgacgtcgaacaacctgcaaatgtgccggggggaggtgctggggaatcgagtgacgcttcagtgaggaagtggcgacaacgagtgtaacagctggcgtcagacggtagtacggcgtcccagtattgtcggaggtcctgaaacgaaaagacaggaaaaagatccagaacgatgccatcgtcatttctctccaagtatgtgtacacccttcacgcgttcatcgtgaccagcagaaagttaaggcaatggaatctcagtctgctctgaatttctttagaggtgcaccctctgcagcggctctgtgtggaatttcttgcgcggcagcggaccttgagggtactggtaatccaacccatcgtagatgcagtggcgagcgaaaccgaggaggaaccagctgtgaattcaaatccggccaagacctgcaattcctgcgagtaagaaatcgattattgcctgacgaaatgctctcatttcactaccgagtgcccgatgcaggcttctgcatgcaacggcgcgagctgtcctgtcaacaggccgcctgacagatccagtgtgtcaccgcttcaaaacgtacagcattcccctgcaacatggctaacaccagaccagctgcagcgtgtaatagaaaggtagatatcaggaaaacgaaagagaaagtaccgcacaatcgccgacgatatcgtagacgcctcaagtcacattctaccatgacagacaacggcctaaacgaccagcgccacaacgcttgaggtcatttgcgcctgaatgttggaaaaacaaggaaacagaaaactcaactttctcctacgagtacggcgaatctccgtacttcttacttgtcccacaagtcttgtacttagcgctgtggacatgaagctaaaacgagctactcgacatcgacaatagtaacgtgtatgcatctaatacaggacagacgcgcatgcacatgcaatcgagaggcggcggtctctgcgcagatatggtttgggagacaacgaaaaatacccttattgtgagaaaaatgaataacttgtttccccttccctactcaaacatctctctttgctcgattgtggtgcatcagaactttcaactttcttcatcgcggcgtctgcgccagcgattgttttgtgacgctgagcgcgttccaaggatcttggtgtgaa

SEQ ID NO: 1156 - DNA, 3819 bp, Toxoplasma gondii
gaagaagcgtatcgatgccgtcttcggacatttcatggtggctgacttgaagggtccacgccgcgagggagccgtagtcagggccgagttccttggcggttcctggactttcgttctttagttccgcgccgtcctcatccgccgcgctcctaactcggtgcagaggcaccaggaggcggacgtcggggatgaaggagacacgaaactcccgcagaatgtcccagatggagtcctcctggtcagtgacttgtgcggcgcccgcgtcgacggctgcgaagaaggcgccgttcttctcggtcttgacgcgctggccgagccggtctgccaggcggcggtaggtaaccttgaagcggatgcagtgcggacagtgccgcgagaaaaacaggacgatgacgacgtcccccgccgtcagatgttgcgcgacgaattcgcggaaacctgacgcggacgtcgccatatggacggggcttgtgccgaacgggtgctcagaaatgaccgcagggacagcccggtgcgccgcgggggatagattcgcaggcgctccatcgacgcgggagagaagagaccacagcgaagcggagaaaagcagggagacgacgacgctcgcgcgacccgccattttgtgacgcctcaaaaagtgagaagaaaagagacctatcatacattgcgatccaccggggaaacccacgaccagccgcaccgagctgcctcgcgagcgaagcccagttttttgcctgtgcacagatctggctgcgtgagaaaaagcaaggattctccgccacaaggactacagaaactggacaacgcagaatgtaggccgcttccacggagcataaacagaacgcacctcacgtggagcacagaacgcacacacccgtagctcgcgcgcctttgcagtcttgtcccagtccagcgccgaaaaggcaggaaaaggaagaattgggcaggaaaggtcgggagaaacgtgtcaaaaaaagagcaacttcattctgtgcgataaccgcgcagaaggttgcacacctgcgaggccggggttttgtgcaccctcgcaggcacaaaggaaaaccgaggccgatatcgtgcgaaaaaaaacacagaaaagggaaaggatacaatggacagttcgcgggggcttgtcttttggctgcgcgctgggacgctcacgaaaaagagggaagaacgggagccgagtgactttggcgcgcggtgctttgcatggatgtttctccttttactcaggcagaaaacgcacgacgaaggcttgcgcgaacccgattctttcggttcgtgtggcagaggagcgtaaaaagggaaacaggatcgaagaagaaccggacacggacggacgccgcgcgagaaaggaggaaacaccagtgtacccgtttagccgaaacaaccatttctctgtacggcaaaagcttcataaaagaccgaatgcggaagattcaagagcggtacccaccaccctgagaaaagaagtagcctgtgtcgcattcccacgtaaagaaatcgcgcgcgacggcgcactccgcggggcatctgaagcggacgtggacgcaaatagttccttgcctctgtcgtgtcttcttcggggtgcctgcagagtttcctggcggagtgcttttcctgaaaacattccaaaaaacagacgcttctggcctttccaccgctcaaatctgggcaggggacgcagtccaacatccgatccacagtcaacgaagtagagtgcagcaaagaaaagatcttgcccagtgctaaacggcagccagttctgccggaaaaaactcccgtccggcaggccgtgagcaaaccaagcaccgcctttcgcgtgtgccgacggggaatctcaagaagagaaatgccggagggcctcaactgactcaccagacaaccaagtagggtttgcgcgtttcgtcgagaaagtgaaagcggggacgtccatggaacttcaagacagcaagaagagtgcaatgccggacaagtgaatgccgaggtgtagcagtacgggatcttgcacgcagtgctgaactgagacaaagtcgtgcgatatttaaaagaacctctctcagacgaaaaagccaaccagggccgccgttcgccacaccacttcagagagtcaacacgctacggacggtcgcgaaatcgttcatgttcactccggtaaaaaccaccttggaacccactacagatggcaaaacatcctcccacttttagcctcatatacacacgtacaaatgtgtatctgtatatatctatatgtaaatggtattattctatgatgtcgagagataggagcacttgagcgtcgtgaggttgcgacatcgttcccccgtgatcaagagtgataagggtcttacaaaagccatcggcaatcggacagatggaccgagctgtcgaatgtgcaccgtttgtgcagtgatacacttcactacacatgcgttgtctgcctcgagttcctcatcgagaaagaaacgacactacaaacaacgcaaatacgggtctatacggtcattgaacagcggggaatctgaggacctttgcagttaatatatatatatatatattcgtacatatataggtgtaggtatacataaatatgcataggtatttaaatgaatatctgtatatttttgtaagctatatatacatatatatctaggtatatatatatatatatatatataatagtaaatatgtgtacatatgtctaccaaaaacttctcagagacacagtttgtccacatgtactgatatttataagtaacttaacttcctgcatgtctgtggcggtatttagtttacttatgtgtacgtgaaaaacgacgagagatgcagcacacacgctaaccccccctatgcagattcttgagcctgttgtacacgaggtgcacagacgcatgaggctcgcttcccgaagaaaaacatattcttcgtggaacaaacgttactcgaattatcgaaaacgccggacgttttcgcttgactttgtggctatgtgccgatatgtttgtcacgacgttcactggatcggaatctctctgccgtacatacgaggcgtcgcccgactccattacatcgatgcaagcgcttcttaggagaatcgacttcacacctgcgcacaaatctatgtttctacataaatttcgacgcgtagatttccgcctcaaatacagttcagcctgcagccgcgaccccgctactcgtctgtgtcttcccgtgtgcagcacgatggcaaacctcttttccagattgcgttgacgatgcacagacttcctgccttgagaaagcagacaaaaaaagtccttctgacagagaaaatgtgccggtgggtttgacagaccctctgaaccacaggtgtgcgttttcattgaccgggtgcatgcagtgataaacatacacattggagaggcgttgtcacagctcgaaacgcgtcttctgaagcgccgtttactcattttaactgtttgagacttcgtaccgttttcgttctgcgttctcgagtctgaaaacgaagaactgtctttctttcgtatcgccagagagcggcgatctcgatgtcgagcgaaagtcgcgttgcccgctggcgcttgacccggcacaaaagagggacttcggcttttcgtcagtcgagaaagggacttctttgtttctcgatttaaactgagaagcgaaactcacagtcagtgccgactctacagcgaacacacggtcatttctcggcagtcggtccggcgctcgccgtctcctcacttccccgtgtatcgcttatttcttctttgagcctttcctctctgtgttgattacctccttctctctgta

SEQ ID NO: 1157 - DNA, 2348 bp, Toxoplasma gondii
gagacaaagacgcactgcgtcgacgtcctgtctccttcctatatctccacatttgcttgccgcaaaccaaagtggagaaaaaaaactcatctaccgacatccctttcaacacgcatcccaacacttgcatatagatgcatatatatatatatatatatatataagtatgtatatatataaggatgcacttgtatatataaatttatatatatatatatatatatatatacctatgtatttatgcgtgtacgtatgtctatgtaagtgtgtaggcatgtttaagcatatctgtggaaactttccagagcgactctttggcgctttttttccttttctgtctttggcgacacgctccgaaaagcgtaccatcgtggagaaagaaagaagaggacgtccactgcgtcgtcgtcaaagaggaaagcagagacagaggaagcgaaaaagacactgcgatactcggagagggacgaagagacagtgtcgaggcctgtcagagaagaaatctggtggttcgagtttcgcttcttaaactctcaggttcttgttcttcctcggtcgtctccctctttgaaggctgcgcagctccatggagtttcgtgctctcgtgctctgccttcgtctttttttctccttctctcggcaggtcttggatctcgttgttgccccgaaacaagaagccacacgtcgaagcgttgtccctcctctgccctctctctgtcccttgctgttcagcgggctgtacagacactgcaggtcgccccgttcgtcagcgaatggcccagtgcctcttgtctacccgttctcccctttttctttccagaaaaagacggcaagcacggcttttgtgtgcgaaaggcagagtcggcaacagagacgaagacgctccacgccagagaacgagtttcctcgcgaagacgcttggactctcggctgtctgtataaccgagcttctctcgcgatgctcctcgagtcgccagcgaagaagactgactgtccacgaagaacaccaccccggacgcgttttcaccgctgcatgcagccgccgacggggggagaaaaggcacacagagagtctgcggagagtcggggagctgaggcagaaatcgcggagaaaaccggactggaagagcgagaaaacgaaaacgcgttggaaaggcggaaggatggagagtcagattcgcctcgccttcgcgagcacacccgccgcgacagtgccagcaagagccgaaggagacacgacaccggcgacttctcttcgagcgaagctgcccggaatctcccctgccgctattgtcttttctgtttcctggaatccctcgcgacaaccttcttacagagaacctctccgatagcgccttgggagtctctgcgtgaggcgctctgcacctccgggaacgaagaccaggaatgtgagcgacacggacgactgcctactcagcagacagacgacggcaagcaaaagctgcgagtaaaaaacagaaaaaaagaggaaatgccgccagggagagtcgccacccgtctccccgttccgccccccagctcgagtgcgcgcgagagacctcgcgcaaaaccggcaaagaaatccgtgcagagcggcgcgaaaagggaccccgtctctctccgcagcgcccgttctctctgctgtggaaaggctacgtgaggcgctacacaaagaggtgcagattgacacctgtagacgcgaatgcgttttctctgtcgcctcgagagccgagacaccagccatcggaggcgtatgtacaccgcgtgctctctccccggggcgggtatcgctggatgtgcaaaggcgccgtgaagcgcgggggaatccggtaaaagcgaatttctgtggcttgtccttttctgctttcgttctcctgcacatctgccgtgaaggcgcagacaattcgccgcaagaaagcgacggaaaacgcgtcttggcgtctgctgtccgagcgagtcccttcgtcctgggaatcttcttcgggtgtggaacgagaagaacgcaatctcggcagaagactaccgcttcctctttgaggaatgcgtcagggagcaatctgtcgactgctgcgtggagacacaagagaacggggaagcgctctgtggtgacgtcgattttttcaggaaagaccctgtgctcctcctcgcggggtgtctgtcctgtctcgacggagaagaagcttcgttcgtgagtcgcgaaactctgaaagttccttttccttctctcctgtcggcctgcgtgtgacacccttccacttctctctgcgcgtcatcgctgttcgcgtcgggaacttaggaactctttctctccagtcttccctgtgtctttcgagaaaacgcggaaaaca

SEQ ID NO: 1158 - DNA, 1847 bp, Toxoplasma gondii
gtgggaccaatagagatgactgcgtctttctcgtactcctgaatgagtttcagggtacgctggtcgaaagatccgaaaacggtcttgtctacgcggttgtacttccgcacaaggtccagcgtcttggacacgctctgcgggtcggcttcggccttgatatccacgttcatagtggtgtctggaaactcagcaaaaacatcctccagccgaggaagtggctggggcgagaatttcacggggaaacccttgaaaccaggcacaaactccatgtggcagtccttcaggtggtccgagtcgagcacgggaggaagatccgcgtaattggtctcgctaatcagcatgttctgccccgtaacacgttcaatgttatcgtcgtgcgcaaccaccatcactttgtccttggtcatccagacgtccagttcaatcattctgcacttgcagtcgtttacggcgtacgaaaaagccaagatggtgttctctgctcgctcagcttgtcctcctctatgcgcgatgttccttggcgggttgctgaaaatgcgcttcgtctgccaaagaaggccaggccaccggttgaggacccagctcgcggcgacgaagcaagtgcacgcgctggcccccaccaagactttgggggagaccgacgacgcagtcgacagcaagtaatccatggttccttgcatcatatttcacttcagacactcttaaaacgcaagggaggaaagaagtgggagaaacacacgctggaaaatcctcctgtgtctgggcttgtgtttgaacgaggaacgctaaactggaggacaatccacgatgggagtctacccgtgaaagtggaaaaaaaagacttgaaatgtcctccaaccgttttctgtgcaatacttcgagaccgaatgacagaaaaagactttttttatatatacatacacaccaatgcctattttattggtgtgagcttgctagagacaactcgggaaaacgtaccttgggacagttgctcagactgatcgaccacgggagaagcagacgacaggaccatgaatgccgcttatgcacagtgagaattgatggttgaaaaatctgactgaagaaataacttccccttagtgagaagcactaagacgatagagtttaacaatagtaaggatatgctcgcattcttacggtatgcagagatacatccaccaagtccaaaagaatgtacacagtcacagcagtcacagccgtcacagccaccacgcgatggtggttagttctctcaaggagacaagtttccggagacgggaaagcagtgaatctgaggaagcgaggtattttatggcacgccgaggagaggtagacacaacccagctcaatcattacagtcagtgagggttgcggttcgcgctgccgcatgcatcgtactcgtatcgttctccgagtaagaacaatcgggcgccgactgttttcctatgacggtgaacatcaaacctggctttccctgtaataccgagacagggatgcggcaaacgcctacaacaatatgccgtcttgcccgtcaaatctgcgagactccttttctccatacgggactctcagcgcctcgatgctagtatcgacgtgagacttcgtgttctgctgagcagaactccaaatttcttcgcacgcgcatctgcatgctgtcatttgcgctaagaacgtatctctatccgtgagcatgtcttcgccggtggtgtcgcttgcccctggacagaaaggcggacacccagacagactagctgttttgatggttactcggagtgacaactgatcacccgacaaacaatggaaagctcccgtgtgtggcttgaaggaactccagttcttaggcagga

SEQ ID NO: 1159 - DNA, 2249 bp, Toxoplasma gondii
aagaagctgtgcagttctgatgatgtcgcagacctcagcctcaagacttcccgctgcatgcaaccctacaactgagctgagtttggtatctgattccgacgctttctcatcagcttcacccgcctcgtttgcagcgctaaaagcttcacgcaaaaacatagtattcttgcgcacagcgtctctgcattcacgattcgagagcatgtaatcatccaagtctgcacacgccctcaacagcctttgttctgagtcggggaccatcaccacagtttcatcgtacacattctgtaactgcttgatgtcgctcgactctcggttctcagcctgtacgcagcaaaagggattcagcacaagaaaaagatcacgggtggaaatatcaaacacggtaggaaacttcctacacgatttagtaaataacatatgcgaccaagacccccgaacagtccatagttattgggcactcagaagctctgccgatcaagaaccaggtagtgtcagataaattttatggcaggaacggacaccggatgtcgaaattactgctccgcagcgagagtcggggagactcctagagctgggggccaaatacctattcgaatacagaaggccactcttctgcgataccgacattccgtaggactcgcatagcaataaaaaccgcaagaggggcagaagaggcaagagctcttcaactgaattcggattgagtttgacggggaaacgctgtacgccattcactggaaggcgccgccaaaaagtaggttctcgacaagattcgcaagttccgacacgaaataggcagaatgaacactcactcttaccttcatccgaagaaccgtttgtcggtgctgctccacttccatctgatagtatttaacttccttcaacagacgctggacgactttgtgtttaattcgcaagaaccggagatactcgctgctcgacccagttgccattgtgtcgctgaagctaaagacgagtgctgttccaccggccgaacggtacgagtgctgttccaccggccgaacggtgaagttttggtgtattttcctcaactgtgctcaaacaacgccgcagagcgagcaggaaccgcaagacacctggtcggggttcagacagctgcaacaagcagaattgtgccccaacacgatgtgcacacctggatatttcgtcccaagacacggaggacagagagtgccgcgtctctagccgtgaaaaagcgggaacagactttctccggtgttgatcatgagcttggcagccaaacgacccattccgcaagtttacaatcgcgcacttggaaccaaaacttgggagacctttctcccctctggtaagcctcggtaagatggtcgacatatgagggtgtcacaagtgctcagttggaagaagagatttgctttgcactgcaccttttgtgtaataacttcgcgtgtcgggagcaccgtgtcctggctcgttgcctttcgggcaggacaacccgcccgcgcatgcatgcactctcgaatgcgttaaaaccacactcgattccatatcgtttcagtacagccgatccagataccaaagtacttgtcctcagaccacatctctcaagttgtcactctgtatgcttctcgaggctaccagagggctttttcaacgtcgatgtcggcccggatttcgtgtgaaactctcgctttccagccctggcattcaaattacccgtcgcactcaacgggtacttctttgcctttcgctgcgccgcaactcgcgctagattctatacataccgagtgagaacgtggcatctgtctcactccagcatcgtgtctgttgcatctatctaagtcctgtttaatcgtaagaactttctgaccgggacgcgtcggcgagaaacgcatgcactctgccacactttctgcccacactgccttcgagtccgccggcaggggacgtcgaccaaatgagagctcgtctgcgtgtcgctctgcgtcgagtctccagcttctttgcatgttgagcccatttctcctccatcgaacaaattcggatgcgctgtgcgtctgagtctctcagtgaagggaagttttctataccccagtcgttttgtctcagggacagctccctccaaccaaagagtgggtactcatcggcgtcaaactgataagagtgtgttctgcaatttcttgttggaccctgcaccgcaataacttcgtgcacaggcgagcgcaagaacgcctctttcacgtccacagcttcttgattcacaa

SEQ ID NO: 1160 - DNA, 1818 bp, Toxoplasma gondii
aaagaattctcgcaacttcgctgaatgaggctgtagtttctcgttgatgtatcttgtatacatcattgctagcgccgtcattccgaggagagcgaatgccatcagaatcatgaatactatgatttctctcccagacaggtcgagggcgggacggaggagtaacacgataaagaacgatataatcaggatggaaggggggagctcgaccattcccgtcagagtctcgccaaagcaatagctgatgtagtccgagaacgaaaactgtggatagccagtttctcgctcccgtggccttggaaccaacgggatcgaggggtaaataaatctttgacgaaggccccagtaaatcagagactcgctgacgtgctgctcgctaacatccgcagaagtctgcagcattgtgacgtcgtttcggaggtccgtttcagtcttggcgtcgaaatactcgtacttcctcagaaggcggtagcctactaaggtaaagactgcagcggcgagaatgaataggaacatgataatgaaaatgagaacatgtatctcctcaaagacctccgttaggtgggtcggcggtgacagagtttccccggcttctgttgcctcgcggagcgctgctgcttctgtttttgagacacctaaatacgtgtcgttgagtctctgcatttgcccgaggcgtacggtggcaaacgatgtaagactgatgaagcccaaaatggtcagttccttgtaggcacctcgtagcatctttaacagtgatgtcacgcctctgtatgtcaggaattcctccgtgctgtcgaaagccatctcaaagatcagagaacaagcgataatgaaaaggaagagaccaagggtgatccagttctctacattttcccgagtagactcttcggctggcgcttgtaaaaacgtttcctccagtgcctgtgacatcacacgaatcgttccaccttttcatttttcaattgagacaatgtgttcagcttacactaatagtcgtggcgcgactgactgccgatttgatgtcatatttattctgcagggcagggctataagggagcgcttcagcaaccgttgacaacaccgcgactcccatgagcagaacacctggcttgggaacccttgcccaggtcagcaaagccaggcaatttgtgaggagcctcatttgcctgactactactgctccagaaactgcttgaacaccaatcagacaacatggacaagttctcggtcgtctccttcacctacgtgacttgctttaattttctacgtttcgcggatctgacaacgggaagcgaaacagagtcacgtgtcgacagccagctgtgcgtacacctgattcacaggcatgcagcggcatgcagacacaccggcggtcgaagggcagtttctctgaaaaaggatcatggaattctgagtcttactaaattcatagtgaaaaaaaactgccgctttacctgtttcctgcacgttgcagcaaaatccactcgggcgaaaggtgtcgtttgtctggaaatccacctggcaggcgtgtcccggtttccctctggacacgctgcacactctgacgccgtccgagcgctacaaacggcagattgactagactgcggctgcaacggatgatgaagctgactctcagacggataatccgatacctttgtaatgagagttaggcaggatctgtcattccggggcggtcgtctccaccgacctgaccggaaacctgtgtgctctaggtgaaccgcacgcacgccagtatcggccgctgctccggtgtccgcctcacaaagattcttgccaatttacttctgtgattggcaacaa

SEQ ID NO: 1161 - DNA, 1717 bp, Toxoplasma gondii
tgtaatgcgtggcattccacgattcccacgttcagacgattcctaggacaaaacacgcttcttgcctcaaagattccaactctattgtcttcacagatcgttgacttaggtagcacctgcgaagagagcgccgcacagtctcggtggacagcgcaggtacttcagtgccgctggacctctagatatatttatttacacagtacttttgggtttagacgtatgcacgtgactatgggcaagagatagtaggttatttcactatgcgtccgtcagagacaacggccaaacctccatacctagctttctgtgtaggaagtcgtcctgaaagatgtcaacatttgctgcaaaaaccggaacctggtttgtctaaatgcaagagctgaagagagtctttaggacattccaacccaccttgagcgccgcgccagcggcaagccggcgcatgaaaactttctggagcacagggtcaagaagagcgaacccaagaaatataacgggctagactcccgctacaaggcaatcctacggctgagcatatcagcggtcagcagagagtcatgatagttgggaatagacggagctacatctgagatagggaaacgtttccttttgtggattcagacgcatttacgattgcaacacgaggacagttatcgcgaaaaggtgacactgttttcgtcagcaaatgcaacttgcgtcccgctgtccaatagtcacacggcttctcggagtcgtgctgagttttctggttaaagggagttttgctattctggaaatgtgcagttagcagagctgctaaaactatcagcgtagctgcaatgcacgcgtttccagtctcactgcttagccatttcacgtgaaaactcattgaatggctgcgggagaaaactttgcgtttctgcgttcattggtttttggcgccgccattctgtgttgttcatatatgatgttgcaactcgcgtgaaacgcttttgtgttgcaggttcagggggtgttctacatgtgctcttgtctgctggtctccacgccaagatggcgggtgcaaggcttgctgtgctttgtttcctctcaattctaagctgtactaatccacttggttgcgtgtcctcatttgaacttgatacggaacaagtcaacctttcttgtcagttttgcgatcttgccttgacgccgtctcgcgcttcttacttatcagctgccagaagcgatgaatcgaatggagggcttctcgctgcttctgttcaggaaaccaagacttctgatgttgcctctttaaaaactgtctcgtcggcgagtacttcctattttccaaatcgtgtgtttgctaaggagctaaatcctctcttctcttcctgcgcaggcgcttcctgtcacaggagagacacaagacactctatcaaaagcaaatcaacaaggcaaaagggcaaatctcagcttcctcaggccggaggcacagtgccattgctgtccgtaaaagaagagaagcgggaggttccaccgcctttccaatggctcttaccgccatacccgacatccagttatacaaattcatcttcggcttctgttcagccttcacatagccgcctttcgtctgattatatctctgtgtcctcgataggttcgtcacctttacttcccagcggcgttgcgtcgttttcttccgctgctccaggacatgccccgtcgtctcaccatccccagttaggcgctccttcaa

SEQ ID NO: 1162 - DNA, 3269 bp, Toxoplasma gondii
gtaagatggcgtttttgcacgactgcgccacgggaggaaaacaacagttggccaggaagcacggagttcgattgctctattcttgttttttctgtctttttttctcaccttggtctacctcttggcattcatcgcttttcgttgcacggagcaggtgatgggggactgagatccggtccaccaatctcctcccggggcttttgtgatcatttcttctttccatggtctgtcctcaacttggcaatgcgacgctggcttcgacttctcttctccgtctgaaaaagcgagaactctgaaccctgcttgagtctcccccgcggagtgcccccgtcgagccatccgaggagatgcgctccctgcaaggaagttggcgcttgccgcaaatttctctgtggttctccgcattagttgcttcccacacacggacttgcgttcggttacagaaacgagagttttgggggctctgtagaagacggttgatggacgtcgctgaccggagctacattcacaaaattcaacgaggatttgaacactagaccttcagaagcattcgaagccgactgccattgaagttgatcagacaagaaggtgcccatcgtctcgcttcagactttgttgccgccggggcttcttacttggagggacttagacataaaggtcgagtagtttactccttattcgcgcgcgcctttcttcgcgtgtgactttgattaactgtgagtttcccgcatgtcggcaagcacctcactggagagaagggcgattttctcggggatgtaacgcaccggttgaggtctgcctgttccagtacagtggtgattgcgaacaaaagattagtctactggcccctcagtttgaagtgaagacgatgcgataattaatcggaaagcacgatatcactgcttgccccagaacgccgtttccaacgtatttgctgcagtaaactagcggaatctgcgcgccagcaacctagggcaaaaagagatcgaattttgtcggcgctgcagccgctgccctcacacactgcaaaagggaaaacaaacggagcggcccaaaattccgagtgttcccggcgggttcatttgctgatcgtgatttaagttagcactccaaacactgctgtttgttcctcaacgcagaagcctgtgtcgcgggtcgacagtctgccggtgtaatgagaggtcgtgaagacagtcgattcttccctcattcgtcaatgcgttcagaattgatccatcgagacatgtacacgtaagatcgtacaaacactggcatgcccagcggtggctgatactgacagaatcgactacgaccgctgtacgtacgctccacctgacccagctgcttggaccgttcctggctttccgacatattgtatcgagcaacgagaggtaggtgactccgtcgttcagggttgaagggaacagcgactggtgtgctacggcggcaatggcttccgtatatctgtcggggggggagtggagcttgagtgcaggttttccgtccttccccgaatgcgtcgtcttgattgtgtcaggattctcaggattcagaagcatcgataatcagctgtgtcgatcagcaataagacttcagaacttgcgtaacttcgccgtcgtcaaaaatctcgcagagttttctcagcccggtaccctcacccactgtgtcgaaccccctgtttcccctatgcctcgcgatcgcggtgtccgccgctgtgacatttcctcctttgcccccaaatgaacccgccacttcaaaacgctgagtgtcttgtgtgttccgttactaagaaggttctgcccgataggttgcgagttacccaaacgagcataagaggtcgtttgccggcgcaaagggttccgcttggcgggagcgcaaccgccacgcggtttgtcctgagccgccgacatgcgtctaggggtcctttactcccgctgacaacccgtccgcagcccctatgctcctcccacaggagggtgccttgtgaagcgatgctagctctgcgagcgtgagcgatttgcacatttttccaagcgtttcaaaggtgcgtcttcgcaggctttttaggtcagtcttgaaaagaaacgctgacacaatcgttcggagcagcggcagtgccgcagatctgcagaccaactcgctctctccgccggtcactccgtctcaccgccaacaagttcctcggtgtgtcttgtcctagcactgcaaatctgtgtttcgcgatcacgtgtttttcgggacacacgctcgcattctcgtcatcccagacacgtctgcgtctggactgtgacgtctaaagtctctggacacttattgattcgcagccacgccaaactcttcttttcatgccgtgcatcccctggcgttgaaacagggcagcagcgtctcgagtttgacagagaaaaccagcggccgctgtgcctcgtgtttcgctggcttcccttccctttttttctatgtccagctatcttctggacaaaaacttcctcccgcaccatttgctatttcgctggcaggtgccttctcatttttcggtggcagcacagactccatcatctttggtcctgcgcgttggcgccgaccgacaaccgatgcgtccacaacgccgcagccattgcgtacgcgtctggtgtatcgggattccctcttcacgaaagtataagtaaaggaaagctaaaagcgaacctgtgagatacacctgggttccgtttagctatggaaatcaccctgctgaccaagacatcagtgtagcttgtgcgcggatcaagcaggcaccggtgctaggccttcgtgactttggcaactcgtgcgtttcggtattttgcattctccatttggaacgacgaaaaagtgtagcatcgcatacaaaaaacaaaagacaaagcaacagatccgcctcccgtgagtcatccggggccattttgcccatctctcggcactcacgcttatcgtccttacggagctatgagctacccacccgttaggggttgtcttcaatctgacctgcgaaactgcctgttgacccgattaggtctctcatctccttaaactttccgtgtcctggtttcgattatttgccggcggtgcctcgtggtggaaaaccctctacagatccgcaagaagacacacaagcctgaagtgagaatccacttcgctggatgcctgagttcttcgcggctgacgcctcagtctcagtttttttataggagactcaatacttttcacaggagagagatgcaagagggcagaggggcgaccacagacggaaa

SEQ ID NO: 1163 - DNA, 2080 bp, Toxoplasma gondii
gacactgcagctccgtctggccatcggcgctggtaaacgtcacaacgggaggtccctgggcttgtgtgtcgttgtcgccgcttcgcttctctgaagcttggctagatccggccgttgtcccttcgttcacgtcagccgccgttccctcgcgatctgccggtgtttcttgggtgtctttggaggagaaccacagatgtctcttcgtagaacatgcctcccactctctgctgggagtctccgaggggggagaactcacccgggtcgccgctgcggtgggagacgccactgcaggaggcgaggaagaagagagaaaaggagataaagcggaatagctggagagagcaaaccgcggagaaacacgagaggaagtacaagccgacaccgaagacggaatacacgggaaggaaccgacggaggagcctagagacatcccggcgttaacggactggaaagaaggccagcgccgaacatatttcgcaccacacgaagagcagaaagaagaacaaggctgagagagaaaaggcgacagcggtcgaaggtcagatgatgcacgcagagtcccgatggcacgaggactgagaatcgccgcaagaagtgcctttcgacaaacactgccgtcagcgagcagtgaggctccgccagcagaaagagactgcatttgtcccatcattctgggtccttggggagcagaaccagtcaaattccagagcacagagtggccaaaggaccggcaggcgtcgtccaagactcgcctcctgcgaaccgcgaacagaagtctccacttcgttaggaaacgacgggatgccacgacagtcgagaaaagggagacaaagcggaacgaagagacaacaactgaaaacagttctgctccttggcatacacaaagaaggcgacgatgggagacggttctgaggtgtgcatacacccgatgactcgcggacacggtggcagtgcggaagtacttcgcctccagatgccctcgacggtgcgacaactcggaaaacggcgtttttgcgcgacacagccgagacacaaagcagagaaagcttttgagttctggacgcgagtgtgaatcaaacagccgaaaaataccctgggatcgatacgtagcggtgttcccaacagaccacgagcgaggtgtatgtacacctgctggacgcagggacgccgtcggaccgcagaggggaccgacgtcgagtttacacgaagtaaaacagtttctgttttcactttcttctgcgtttcccgtcgaaaggttctcttctttgaagcagcacctcgttctggcacgaaaaaggtccgtggaagagcacgtcgctgtggtgcatgcaaatgcgctggcgaatacgagcaaggtcgctgcccggttgaatcagctgagggcagcgaatccgttctcctttctcttctttctttctcttcctaaggatcctttttttgcatctagatcgaaggctcttctttcctactcctcgtccctgcttggtttttcctgagctttttcgctctgcgctctggccccacgactcgacctgcgcatgcaaagccggcccggacgtcgattgcagactgttcttcgacaccggccgtctcctgtcttcgtttctcgactgcgcgtgagtcccagacgcgtggccggtcgtgtctatgccatcctggagtgcccagggaggcttctgtatctcctcggaggccgcttgattgctctccgctgccgcccaattcacggctctcctcgcgcgcctggaatcccgactggcgggctttgcctcgtctttctcgtggttgttgtctcgagttctttcgcgctttcttaaaggctcactcttgtcttccgtacccctcttgaccgtctgccaaccatcgttgaagcgccctgccggacctcctcaccgggtgtacgtacaccgcgggctccgcgctgcacgtctccttctcatctctctcctctgttaggctgcacatatcgctgtggtcctttgaagaggccgacacgcgttataacctcagtgtttttcttctctctctcgtgtttttctctcttcacgcttcagctgacggggctctttctcggacacca

SEQ ID NO: 1164 - DNA, 1806 bp, Toxoplasma gondii
ctgtagtgttccgttagagagaggcaccggactcgtgggtgaaaactgagaggggtcggtatggtctgttctggcggaaggcggagcatttgctttgcgcgccgggttggggaagtggttgagctgcgacgagtttcggcgtttcgtcggggcagagaccgtggcggtttttccttttacctagcggaaaaggcgcttcgatgggagaggaccatctagccgcgaatcgcagccgaaactgggaatgccagtgtttcccagaacatgcgtactgctgagtgtagtgagaagctattttcctgtccagaactcgggaaagctatgcagttctacggcagtgttttgatgtgatgaggaaaaagttctttcttggatttcctgggagccctgcgctcgaattcagcactcggtgctaagacttgtagaactcggtacgtgcaaggagatctaatggagtcataaccaatccactcgttgaagctgttctaccggcattagtcgcggggagacaagttccgaactcccgatgtaaattgttacgaaaaagcttaccacatcctccgcacgaaaacggattgcacgggaagagaaagttggattcagagagcaaacacaaggtcgtatgatctggtaaccccatctcgctcattccgaattccagtggaaaacgtgtcacttttccgtgcccacgcagaattcaattttctggcgaaggcagtgactagcctaagtacagacaacagtaaacttgacacgaaagcggtcatttcaatctacacacgataatgtatgtggtaagcgtctttttatctgaagatgcactgtagttttctttagtcgctgtcagtgtacatggacaccggacgttctggcagttgcttgtagtgcacacgccatacgtggcagtatgtcttgctgtctgctccacgcgccacaaagccttcccatccgttttctcccacatatgatggaatacaagatggaacgacgcaagaagaaggttgatttgatagtacaaatggtgctgcgttcgctggcgattcaggaagcccccgaaacccctgggggtggccactggctttccactcaatcactagctcctcctaatgagccacggacagcaaaaggcactcttcacagctacaaccagttaaaaggaacaacgtttccatgacgttcgtgttcggacgatgcgcgagttgagcaccattctctgcgggactgcggcacggtttacacaaaactttcaggacccatcttccgagtatccacgttctaaccttgaaagccggcaaatgtgtttccgagacacgtgaacaagaaggggaagagtaatggggttcctaagtggaaggaaagaagccaagcggccggacattccctttcaggacactctttgttgtcttgtgagtttgtccgcgcaaacaactagcggtttctaggcatgcactggcgcatgcgcggcatactgtcgacttcgaagttctatttctcatttctgtaggaaacatttcgccacggtgacgattcacgtttcaaaactcgagcgctgtgagtctcagcaggtttcaaaattagacaagtgcctgtaccccgggtgtaccggacccccagtctgcgtcgactttgtcagtgtgctgtgtgcgcgtgcccgtcgttcctccacccgccctcatattttcaaaaaatccacggttatctgcttttctctctgtaactgatgacgtcgcttcctccttttcgacagggtgggtgtgcggtccaagatttgtcatcttcgtgggcgtaccaccggtaccgcgtcaa

SEQ ID NO: 1165 - DNA, 2661 bp, Toxoplasma gondii
tccaaattggcattatgtttaggcggagacgtccgtcgttttccagtggtgtgatactctacgccatgagacgtgtacctgtgactagtgtgtcaaataagggggaaggaatatgttactttctctaatgacgagagcgagcgacgaggaggcgcaaaagagaactgtcggttttacatgtggtggtggcgtgagcggcgttcatcccgtgattcacagaaagtggagttccagaaaaagcctattccaatcgttttctagtggcagctgaggttcagtttttcatgtaacagataatggcgacacagaacagcagaacgtgtccctcagcgccatccactctttttcgttgggcaagcgggactgctctcttgcgttgatgctgtccttcagcactcttttggcggctttccttcagcgcggtattgcgtgactagcatatctgtatctgcgtggctctcaaaagccagtgcatatatccaggtgttcatgatgtagtgaatccgaagaacttcggctgggtaggcggcagtaagtagagatcacctacacatgtgttttcttgtggacggaatctctctgtaaaccatgagcagcaagactagttggtggagtaaatgtacatgaaataccaggaaaacatgggaacggttgtggtcgaaacaagctaaaccgtcttagtggcgaagggcttcacgaaggaagacagagtggggtctcagaaaacagagctctccatttagctggacgctggaactctagtcacgcttgcgagatgggctacgttgactaccgctgtcgaagaaaaaaacaacctacatcaagcggctacttccaactgagagagttttcgtacctcgtgttcaagtctgtatcaccactgcagcgctgcgacctcagctccgtaaacgccgatgcggcgttaaaagtcatcaccagaagttctcgctaggtagcaacagaggttgtcactgtgtccacggttgactgtgtaactacctacgtgagacgaaggggagaggggagggaagacgtgtgagaacgggtacagttgtgaagaaacattggagactatgagctggctggtctcgatcgccgcgatgtgaaaatggtcgaaacaaccggacaacaacaggcatgaactttgactgcgagaaatgctgaacgcgcgaaacaattacggaaatgagaatgtccctcttgccaagcgactttgcgacttgtgtcggacatgcagatgatcggttacctacagtccactgagttttcgtactatattctacatcccgcgtgacagtaacagcaacgcgcctcaagtctcggtcttcatccgattttggccggtttcgctgtgactcatttttatgttgtagcaggctgcctgtagtacacagcaaaacgccaaatctcttcttcccgcgttacggtaccaccacgaaggccatattaaaaggctgcctgtctgtccgtcttatttacacactcgtgtattattcgacggtgctgagagggacgatgagaagaacacgatggaacaaggggtatctcaataagtggcggcgagagcggaagcagcgatgccataccgcttcgctgatgtcaacgacaagcgcccgtggccagcaggctactctaccagtttctagcaactttcggcaactcctctcggcggatctagatgtctgctagctaaacgcgcagcgcgcgggaggatactcggccccgcagcaaaaaagcatcggcgaagtgacatggcctctcgagctgctaaacgtggtgcgcgcggaaaggtaccagaagacactttcgagtgctcgccgtgtttctctcgcagtttttttgtgccgcggaatttttggagatatcccggggaccttactgtaagcggacgatcttctcccttttccgtctgagataaaacaagaaagttcctgctttgtgcgtaccgcttccctactttttcgtgcctcgtctggtacaaatagcgctcgccgtcgtccagctgggcgcgtcgtccagaagcctccggtgccggcccttatttctggtttctcgagaaaaagggctggttgtttaactctttctgccactgatccagttcaagtaaacgtttctatctcaggtattcccttttttcacccaggtcgaaggtaaatctcgcacgaaagcagggtaggaaagggtcctctgtgatttctagtatacgccgcgatttccgtgctcagcggcgtcgtggctcggacgcacacgtcggccagccgcgcgcacatttgaaaagaaaatagatgtcggggtcgttgaactaagtttgccgttaaatttccccttctcgttcttgcttttttattggggggagggggggagggcgaagcatgggtaacaatggaaagtcgttccaaccgagaggcgtacacgagatagatgggtcccgaggatgaggcgaccgtcacttaaacgatcgggagaggtgacatgttgagctagatgcaggtaaacatagtttgctttccatttgttcctgacacatgggtctgatatgaactttgtatgttcctactgcacactccgagtcttcggaaaacgcggaccttcgatctatttccgagctcgtttgtgtccttgggtcgccaggttcctctttccttttccttcgcaacaaga

SEQ ID NO: 1166 - DNA, 1625 bp, Toxoplasma gondii
atggcagacaaatgcaacgcgctaataggatacggatgagttgccaccaagaagtcaaaacatctgtggatctccgcaggcacattccgcgaaccagaagctgctttcgctcctccctctccagtagtagccagttgtctagagacaatcacgctcgcaccgtagtctccgagctcctgatctcgtacgagagaagttaagtcatttctctgggtgtgattgggtgtccgcgaggccacaagttcacggaatacatctcgaccgacaagtcgaatgtccaaatctgtcagcagcaaatcgcagtaaccacaccggcggacgggcacgatgttaggccttgagcaacgcgggcactccttcttgtagtaccggttcgtatagaagcgttggagctgtgacgagtgatgcatgcacttctgctggacttcaaagaacggaggattcggcgtgctcctcggcagtgcattctctagagtagaccgacaggaaaccaaggagcaattcggcgaaagtccgaagacatttcgcacaaggataggcatgctgaagcaaagacggaaatcgaagacagttcattcgcatattctgtgccgctgacaggcgaatacacgcgaaagcgcatgtggcaaggaatgatacaaaagtgacagaatcatgactcggatcagacgtggtggcagagacggcaaacgaggggttcttcgacctttcctcagaggcagtttctctgcccagaatacctctgagctgttgtgacgagaagatggtaaacttccgaaaagtgcgagaggggccttcaattgtgcagatcagcctggatgtactgccatagctgcagctgtctggaaggagcttctgttcccgcacgggatgatgcctatgctgtttgactgggaaaagaaggacctcgtattatccgtgttggtgaagaaaaacatctttcgctcgcacttccgtcactcgcggccaatgaaggtaactcgctgatcacgcttctgcaagctaccttcgcatcaacgagaactccaaggagttctccaaggagttctcggtgttgacggcgacatttacgagattgcgctgtcagggtgacagaagaaacagaattttcaaaataatgcaggcaggtgttgggtcaccggaagtgaaaacaatttttttcaaccgcttctctcaaccgaatagctcctccagatggatgtattcgcctagacatgcttttctacagatgagtggcaacgctcgatttcagcacactttattttaaaaagtgaaggaaacgcttcacgatctttcgaatataggacatctcgagcgaagcgcatgcatgtggaaagcgaagtctccacgggtacacatcgtgtttctgttttacggagtggcagtgcgcatttcgacctcatttaaagaaaaaagcacgtctcgtgtcgcgtaccttgctgagtggcgttgaaaccagtgtttccaattccgcaccgccaagaataaatcagtctgtgattgtctcaccaaaaaacccgcgcatgtgttagaccggtcgtttggggagtggggggtcgggcctaaatcggagacgcacgcgacctgcgctgcgcagttcgcacggggtggttgtctacataaaa

SEQ ID NO: 1167 - DNA, 629 bp, Toxoplasma gondii
gagaaggatagaacgagagaaaagtagaaagagagaaggatagacagagagaaaggtagaaagagagaaggatagacagagagaaaggtagaaagagagaaggatagagagaaaggtagaaagagagaaggatagacagagagaaaggtagaaagagagaaaggtagaaagagagaaaggtcgaaagaggggagcagctgcggcccgaggtcacagctgcttttctttttcacttcttgtccagacgttccacgacagacagtcctggagagagagaaggcctctctcgaggtttcaccgaaactgaggggagaaaaaaagagggggagagagaggaagaacagagacaagaacggatggtcacgagagaagagaactgaaggagacacgctgtcttctgctgcaagacgaagggaaagtcgcaaaaacgagagaagcgttgtcgtctattataaagttttcgtcgacagagacacagtgagttccagtcactctgcacctctaggcgacaaggaaacaccgccccctcgaccgtgaggagaaggggaagaagacgaggaggagaaaggagaaaaacgaaaggaaaacgaaggagaacgaaacgaaaacgaaggagaacgaaaaaaaca

SEQ ID NO: 1168 - DNA, 1977 bp, Toxoplasma gondii
ggaatcaagggatcaacagacgtgggagataataatttgtgtaccacggcagcaaagcatttttaggaaatacagagtctttgtgatggggaacatgcagttctttctcagctcgacttactatggctaatacgctccaaactgctgagctgcgaacatgccgtgacttgcattctcacgcccgactgatacacaaaaagcttcgtgcggcggctatcatacgctcagaagtgagtcatctcagtgtttgctaacacaaagacacttccacgttcctgggtggtcccaaccttgaatatggcctgttttacaaattctccaggcgacactgtgtaggatgcccactgaggaaagcgtgcaaactttcaggcggattggattctcgttggcctgacgcctgtttaggaactagtggaacgctttttacgcctgtctagaaccgcagcacagggggaaagaaaggtaacgaagactgataatttttgtgagaaaaaatctctaaagagttgcttcatatgtagaactacctcttttaaatgaagaccacgacgataacagaagagcagccgttgccgccgaagctggtagccttgattaaccattcgctcaaagatgtttcaagatgactcttcgcactgccgtctgtagcctttgccagctctgcactgtgtggctagacgccaatcaactcgtgacttgataaatgctgttgttaaccgagacaggctcatgcgctcgcttggatcagacccgcggtcaatactttctccaggagttgctccacttgaatcattgatgctttcagcaacgcagcagcaaagctgtggaatccccagggcacgcggaagtcctgaacaaaagacctacactgttgcaaccgtaacggcacacatattccatagacagcacaaaacccagaagcccgcctacacacgtgagatacagacggagtctgtatggggtgtatacgcgaagacaaccctgcttgcacgcaatctcccgtttgattgctgtgacgtgcagctgtttgccggagtgtggcagcgattaaaatctgtattttacagggaaccatcaggctatcgttggcgctagagcatgcgcttgggggctgaagtccctttccacgccacggacagctgtacgactctagggaaatcgccttgattcgtatgagacaaggcactttacggagaactgtctctgtgcactggttgctgaagtgctagtcatatgcacttttttggtactgtaatgtctttttctgtgtactcgatttgaattataccgatatgaaggtcgaggaacagaaggaagaaaaattcatcaggtcgactgcatgcgtgtggcgggtgtagcaccgcggcgaaatagcggcgtggccaaaacgagcattctgtattcggtccttccttcccttttttgctggcatcattgagtggagattcgtccggcacgaagattttgagacagtttacatcaataccaaccgggctgggtggcatccaatgcattggatcttcttcgaactcagcttttcaaggcctagagggtgcatccgcgttcgccggatgtcgatggtcttgtttgtgtttccatattgaccagtacatttcagggttaattctccgcatttgttcattttgtcacagatacagacctcattaccacgctgatcagcttcctccagttgacattttccgtcaccgggaatagtggctggccaggccagcggccatgtctccgaagaaatggatcagactcacacgctacggacccgcgtgatgctccactttgccttcttatcttgaaaatctgtgacgctcagcctctctgtaacggcttcatcgccgtcgtgtgtttctgcttcagtgcggaggtcactgggacctctggtgatgatgccgacacgcatttgaataaggggtttgggagctgcgctttacagccctcacgtggtgcctcaactcggactga

SEQ ID NO: 1169 - DNA, 1742 bp, Toxoplasma gondii
tgtgtacagatgtgtgcgtatgcatgtgacttacatgtgcgaaaggcagcatgcgcatgagggggtgtttcttgaaaagaagcacatgcaagagcataatatatatatatatatatatttacatttatatatatatatatatatacatttatttatatatatatatatatatataaagagacagaggggctaggaacaggagagttacgatacgcgagaaaatggctgttggagcgcgtaaagctgcagatttatgcatgtgtatggatgtgtatgtatatgcaggcatacacagactcgcgagagaagaaaggaggaaagagaaacaaagtagaagtggaaggaacctgcagacgaacagggccgaagagagacagagttcacaatccctcttctcttgccttcgacatttgagaagaatcaacgtcttaaaatataaaattctgttctttgacactgagccggcagctgctcataactgtcatgttgttaccagacatgtcgaggtcttttgtgtcactacctacgcgaagaggagagcgttgagtttcagctcttcaagagacgcagaaaaggccgtcgactcgtgagcggctgaagacgcgagttgtcctacagcgacgaaccggttctgtcgtgaagagaagaatcgcgagaaaacgggaaaaagattgcctctgcggtgtcgagtctgcgactgggtctgccgttcctctcgccgatgctcttggaggaaatctcggttcgagagaccttgtagaaagcagaacgaggggagaagtcctcacggcattggagagagagaaaggttctgcctctccgcaagcatgtggaaaaaaacagaacatctagacacggagagggagagacgcgcctacaagacagcctgagagccacagagcgagacaggaaaacgacgagaaggaagtcgcaacttcctgctctttctcccttcgttgttccgtcctctttgcaggtgcagcttcccaagacatctcggcaaaaacgacttctgaatccttgttggcgtagagaagaaatcgaaacgcgtcggccgaatgtcggagggtaaatcgttgccacctgaggtgtacatacacctggccagggaaaccgacagtttcagggagctctgtcgccgcactttttcctcgttttcagagactttcgcggcaagaaaagcagaatttctccttctcgcgtgtctctttcctggaggtgggctcttcgtttcctgccgcgagcttctcgctgcatgcagagagaaaaccggccgcgtcgacgcgtggaaaaacgcgtttctctgcgacagtgctcaaacggaaaaaagtgagtgtgcatgcctccttggcagcgagagagtggagaaagggagaaaactcttctgtttgatttgaggcagacgaaggactcgaagaaacaaaggcagtcttcgtctctcctgtgtccaggaccttctcttgcagtgtgctccgcgtgtgaacatcgaggaaacgcatgctgcagagaaacagtggagtccttccgtctctgctttcagaaaaggcttctttttcgtctcttcgtcgtcttctttctttcttgccgcgcgttcttcgcctgtctcggtcctctttcggcgaccgtctctaccaagactctgccggcgaaaacgatgcaggcggaagcggagacagcggaaaacagagcagaagagaagtgaaaaccagacaagaaccacgaagaaagaactcaaggaaaca

SEQ ID NO: 1170 - DNA, 4194 bp, Toxoplasma gondii
cgtagagactccggcgttctccttccacgtggaaatcctctaaatcgtgacaccggtggcggttactcggttcgaacctccacagacagagttttttgcctacctcttgacgctagaagcagatcaaaggaaacatggacacagatcttcgttagtgaaggtgcgaagcgaacatacaaatcggtgttctgctgtttctgtgtgttgccccctaccctgcagaggaacagctggacgctgcgctaaaggacctagaagaagcagccgaaatcatcgaacatgcaggctttgtggccctcgcttgctagggaaacgcaagatggcacaagaagagtgaggaggcagaggacccagggaatgaaatatgtatacctaagtggaggcatgcgtctgtgcgtgaggcgagggaataaaaacggagtccagcagagacattgaatggcctctcttggccggaaaacgaagagaaaagacgggtggcggaagctctgaaaatccgcagagagagggcgaactaaagcagagagtatatctaagaagagatagggtgcaaaagcaggtcgggcgggtgtacaaaaggaaacaaggcacctagtatcgcgcgaggacagacaacagcgtaaacgcgctcggtgtgagcaggcaaaaacacaatgcagtgagagaaagcgaagatcgaggctacgagacgcggcaatgcaaccacaggctttaagggatctgtgtgttttgcgcgttataactcggtacgcagagttctgtcgtccgttgtcgtttcctggagaacgctgctgcgccggcatgcgacgggagagacgaccagcccaacaagacaccgcgtgatggaatacatgtgcgagtgtctgctgcatacataaacgaaatgaatctttgcctctgcgaaaagggcggtggtatcgggcccctcctttcgtcgcaacagttactccaaaacagtcccatgatgtgtgtggcgagcgcgaaaatacggcaaacgggagtcttcaaggccgtgctgttctcgtagggaggtcggacttggctcatggctggttgcttgtgttttagcgtttcgtctttgctttgccatttttgcctcgggagcccgcgtgggaaaccagttaccaacacatcgctttctgcaaggctactttaattttcaatttcattctccacggtgtgcaaaaaacgccatgctcagctgtcttctcgtgcatgcgcctgcggcctaaagtcatgcaaccctatcagagaacaggcgcagtgcaggaaagaaggctgcttacaaaaatagaaaaggctgatgtgtatagccaaaagaatgagaacccctgacatggtcgcactggtcgctgtgcacggtcaacactcatgcgtaaagatgccatctcgctggaaactggaaaatttcagctctgcttcggtgaataagtggaatgggggagtgatcatcgctaggatacgtatcgcatatggcaagactctcaagagaaggaaacaggttgtttttgtagcgaccggtctgctgcctggcaagccgggtttcagcactaccgcgacaatgaacggagaagaaacaagaatggtttggaatcaggaaatacttttccattgttgaagccagaacaggtcaagcaggatgacatgcacaacataggtgccagaatacagttccagatgcgtacctgtacgtagaaatatgtcaaagcattcatttagagaggtaccgatatgtgtctatgccttgctgtggtcaacaatcgaatggtcccttctgcgcatcttcgcgaagctaattatgtttgaagcagtctagtagaacagtagttttcaaagtcgaaacattgtgaagggctctatatgccttcgaacgcattaaagaatctgtgaatgccgctttgtgtgcaaaaaacagactcaagagagaattttgcttctcgatggtgctggttacttggcacagtgcccaaacacaacagcatgagaaccgcttgatgcagaagtaaaaacctctgagtgtttcttataaaacagaagctagtcgtcattgacgggtttgaccagcttctctcgaagacacatggaagtatttctgagattggaaaaaactgctcaacctgctgttcccaaaagaagacgcacttcacattttcttccacagcatcacggactcatgccgcacgcctttccagtggacttttatgaagcgttctctaaggaagatacttgtcttctttcagattctaagtcgccctgatgaaagtccccatcggacagaacacactcgccttctttcgctgctgagcttgtgacaaacaaccattcgcctgagtcatacttcagctgatttctacaacggtgacgagcccatttttgacacacaaacgtacggtgggtggtacggtgttctgtgcgcccgaataaccccccaatttttgcgcgcagatgcatttgaagcattccggccgactgtgccccataccggtgtctcagaggagctcgtggaaagtgttctgtgcaggtggaagtctgttccggaggaagtgtgcctttctgtattaccaatgggcaccgatcgtacatctgaaagtaccaaaggacgggcctgactctagttcaagaaacagacaagccccttgtcggttgccctcctccaatggatccatgatgcattgtgcttctaccattgtgaataattagatcatcgaatgccagtctttctgaagcccagactaccggagaacaccggtgttgacaatgacctaactaagatgacagtcagcagagaaggaggctgcccttttcttgtttgtgagacaaggacggtaacgaggaggaactcccagtcttgcgcttcgagaatagcaccaaacagacgatcttgtcagaacaaaaaaagtcgcatgcgaattatttgcctcgctgggaaccggatagggaaaacaaattataagaaagcttcgttttccgcgccgtcactatccagggtacgcttgcttgttcctgggacctctgttccatggacaagctatcctatctgttcgctcttgacgctccgaaactttaaagcttgcgtcgtgcattttcagcgtttcttgcgagaaacaaaacaaccgaacgccgttgtctgctctggaggccgtctgagcgcccagagggacggctagtctctcggcgcatgccacgatatggaaaagaatgacagggttgctagagaaggtcaactgcctgcacattttcgcccattctttttctacgcaccgaccggctgatgatgctaaatatattttcgggtcgtctctagacagctgcttgtcgctttttgtttctccgccgtctgcaaattccctgactctgtgcttctaagtttcagtaagaaagtcacctgcctccaccttccgactttgtcttcccagcgctgcgtctttaccctccatcccgtcccaccaaagtacacatccttttttcaaaaaggcatatgcacgagctctcactccctttgacagcggagccctttccactttcacagtttcttccccgtgcccgtttcagcgtcgggcggctttgtctccagcgatttccaacggcagagttgcaaaagggttgtgcctgatttctcaagaaaaacactagctgtgcagatactggaaaacgcgcgtttcgcaggttatttaggggtgtgtgagatcctcgtaggttcgtggcgcgcgacaggacacactagatgcacaaaagcatgttcttatgtacctctgtgttgagctgccaacttggacaggtgcagctgcttttctccgttgcattttccttcttcaagcgtatgttcacggtcccaggtgccagaacgccgttggttgcaggggggctttgcattcgcaacggttcggttgcaagtttcgagcgcctcgccccgatggaggaatgatacaaactgcccgaagggacggtttcttcattttcttcaacctttccagttttccgcgagaccagatttgctcagctttttacagcgtttgttcgagcggccctgactcgatttgtttgggcttgctttcacgcctttcccccttgtctactttgagacaagttctcgaggacgctgcctctgtgcagcagccatagagtctcgaactgggacaaagcgtcagggaagagggaattggttcttcggggctttctcgagaaacttgacaa

SEQ ID NO: 1171 - DNA, 2142 bp, Toxoplasma gondii
ttaaggatacccagggttattacttggagcttgcgatcgtcaggagcaagaaagagaggtcagtaatagatccgggagtctagagaaagttatctgggacccgcgcacgagaatccatgagttgatgaaagtcttttttaaccgacagtttgtgataaaataggttgttacattcacgtggggtttccgcttcagcaggatgatccatcagctgttctaccttgactcgtatgctctttttaggggcagagcagctaagacaggagaaagggaaagatcccgtcgaatatttgatgaagaacacatattccaacaaaacgcaccagggaaatatagaagcctgccaaattcagatctgtcactaaaactctaaagaaaaaggcgtccgcatgataaccgaaaaaccttcgcacaacgaggattgcactgggtgagaagtctggaccatatccgcggcttccctcaaagcatcctttcgagaggtgttgagagcagtgtatatgcgctcccgtgttgcaaagcctcccgtaggaactgaaaagtgatttaagcatttacccagtcagtgacgctggcgcgctcgtcacagcaaagacacgatgggaacctacgctttgacatgttccggatcacaattgcaaatataacagcaggctgaagaaccgtgaagtgtctggccgtcccgagcaagccagttctttgtcctttcaatctttcccatcatgccgtcggtcaccgcgtgtgacgtatatcaccgtcggtagggaaaaaaagtgtagttgagtttacctccaatttcatgcggatgtggaagatgcgagctgccgggaaactattacagcaagggctatccccaagttatactgtttgcaacactgaaaaattcctctttcgttcgtcagaatcagtgcgattgagtgccaggttcccttatggtggaacatgaatgatcatgaaaagagtgccagcgttacatcagaaacagcttcaaagcactttcactaggagttactgcactagagtggtgagaattgaaacggcgcagattgtggtcgcgataccttgacatattccacgaaaaaaaggggtcgtgtgagcatgcaggaacaaagcttgacaaacatacgtgtgatgtactaccatgtcaatatgaaaacacacacagacagaccgttattcccctttatatgcctcacagcttgccaagatttccgacaagttatttttttggcctctaaatttcatgttgattagatgcggtgcgtgtcgtcaaccatacagtaattcgtggttcatctttacagagttgtactccatccttcgttgctgaaggcgcaggtgcattcagtgtctttttttttcggcaactgtattaggcatcacgcggcgttaccaatagcatgacggaaaacagtgaaagaaaaaatggaacaactgcgttcttcagctccgctacacactttcaggttctacaatgtctccttatatgtgcactcgtcatccgccatactttacagctcggattctcattgtgccctggtactgacaagaagacgaccaccgtgaatttccgcaaggcaacgtgactggcagagcagggcaaaagctaaagacacgcttcagtcgcttcagaagagttcctatcgcggagcgcagaacaactagcagcttgcaactgggcctgcacacactgtcagtgcacatgctgatgggtgctcgacatcgcatgcagagcagcacacctgatgtgaaatgattgacgacgatcatccgaatgcttttctttctaactcgtgacacattaaaatttggcatgttcagatgttcccagcgttttctcttctttcacctcatgtttctacgcctccctgcatgtatggaaagcaatcgctcttttttcgtcccctcacgagaacgttgatgctgtaatggaaatttcatctgcatgtgtaacggcttcttcacagcttgttgaatagaaacttttctgcgatccatatcgcccgtgtccatggccagcattcttgtgagctcttgtcaacgcctgtgccaacagctattcacacacacgcgtgtcgtgcccaggctccagatagtcttctctggaatccaggttcgattctatagttgacgtctctttca

SEQ ID NO: 1172 - DNA, 2660 bp, Toxoplasma gondii
cgcgagctctgttttcaagagggtgcgagagtgaagtgctaagaggcttttgacgccacaagagtcttgtcgcctctttcgtaaaattccccggaaggtgacatcgtctttgtgcttcatatttccgcgttttctttgcgattcgggattcgcggttctttcttgcttcgtctgctcagagaggtccctcccccacttcgcttcttcgttcctaagcaaagcaccgaacggcagacagtagacttaaacattgaggtgaaaaacctgtctttacttgaaaagaatcgcgaggatatctacgcgtcgttcagaaaaagagagatccccgtagacgtgctaagtctgtgccatctgatccaaagtggaaatgcgtggcactcatgcggagacacaaagaacagaaacgagtcgctgcgggtttgaaggtggtgaatgaaccagtgctcgcctttatctcgcaagcgcttcgacacgcactgtgcaagactcgcaacgcactggagaaaacctcgactgttttctggaaagctcagaggaaaaagtgcagcagacggtctgtggatctgcgtctcaaagaataccaaaggaaagagggattaaagaagaggaaaaaatcagaaagggacaaaggaagcgagggagacagcaagaaaagggggagtgtgcctctgcgtcttgtgaagggaagaaaaaggggtatgaaaacaacgaggaaacaaagagagagtgtgtgtgtatctgtgtctacgaagaaagcaggaaatgtcgtgacctatgccactgaggtgcacagactgaacaagattgacattctggaaaggcaagaagccacactctctcccttctcgtttttcctccgagatttgtgcgatatgtcatcaggagcccctctgccttgagaacgctacacacagagaatagagaagaaaaatgcgtcgagtccggcttctccatgcctttctttggaacacttctcccgaagaaatctgtttctcctatcgcaagcttctcccgcggccgctcacttggtgtgatgcattttgcgcgacacgaggaactctttgtaaaagaactagaggcacgtccgcattcgtttcactgccacgagctctttcagatggcagagacgagaaagcagacacttccaccggggaagaatttgctgtgtgttcatcctgcccaagcctggctttcctcccctgatcattagcctcttctcccctccccttggtttgccgttaaggcgagaaacgaacgagagattcacagaaaggcggcacccacgtgttttgtggagtgtacatacaccccatgtgtttgtcaggcttcggtgagctgtcagttgttgcctctttcctcgcgatttgctggaactttctggccacacgagacctcggggaaaagcgactccggagaaacttcgtcgcctggcccgatcgcgcctccgctggctaacaacttctttcgtttccgcattcttagtttctttcatggattcgagagctcgaaactggcacctgccaagcacggagttgcggtgtatatacaccgcaaatcatgtgcaagtttgtcgcttttggcgcgttgaagggcgcagctcgcacacctggggctggacaggttagaagtcttgagagaggctgcctggaagcctgttttctggaattttgttttctcgaaagtcttcttttctgtcgcgttcgcgcgtttctctgttcttgggctgctagcggtatttttcagcggctctggggatcgcaagtcgctcgctgttttctcggcggcacctttctcgcggctctccccggggggagggggagacgcgtgtgcgctgtctttgctttttttctgcagtttttccccttttttttgtctgccgcagtcgtcgcgaatctttccttttccgggacttcgcagccgaggttccactgctttctgccgcattcagacggtgcgtcaagcacttctttccctcctcagagagaagcttgtctttctgtgcaagcgagggcacgcgggcgcacggtctcgaagagtcagttgtcggaaaagcggagactcgctctgttttcttctcatctgtcgccagcgaagacattcctttcccttcgtcctccacggcgcctgtcttcgctcttcgccgcgcctcgctgtctgcaccgccgggcgcagggaggatcggcgagactcccgtccttggctattccctctcttcacacaaaactcctttcggactctcctaccttctcggatcgccgctctctcgtgcgcgacgccgcgtctgtctttgccggactctacacacactcgcaacccccacacgggacgcgttttcgtaacacaggagactcctaggtcttgcatgccagtctgccttttccacgccgtagaccaccggtttctgcgtcttcgtccctccctgagccgtcgcccgcgtttctcggatttcggccgatttccagacgcacactgtctcccttcgccgctctcgttttctcagcgaagcaaaggactccgttcttgtcgccggtctctcagctgaagcagctgcctcgagaagagacgcaccaggagagacagcgaaactgagagaagaagggacaagcttctcgaatctagcgaacgcacaggcttcgcggcgcgcccagtcttctggtgta

SEQ ID NO: 1173 - DNA, 3582 bp, Toxoplasma gondii
ataatgaagcagacagaactggcaacgcgggagacgaggcaaagcagacttcctctgacagaagagttcgccagacgcagcgagcgctctacctcttgcgagtcgccgtcgcacgagaagccgtccatgagcttgtctccggaaaagttaagccttatcgatcaacgcgtttcatggactccgccggccgccagctccacgacgaggcttacaggagcctcctagaggtaaacggcgtggtgcccctgtgaaggaggcgagggaacgaaggagaaagacgtcctgtgttgtctattgcagcttcgatggtctttttcctcgctcaagaggtccaggctgacacctgtggagtgcggagacagagggcgaaggtggatcttgcaaaggagcagggacgcgcgttttccgacctcttcgctcgcgcggagttgtctgtcatgaagacgccacacccgctattgttctgctttgtgtagctgttcgtcctcggcgtgactctcccaaatcccccgtctctctcagccctgtcaggtgctagaacctcagaactggcgaagcctcttctctggtttcgcgtgtcactttcatttaccgcagggtctgcgaacgtatgcggcagttgttagagtttacctgggcgctggctcgcatctgcgacaaaaaagtcatccatctgcatgtatacgcgcatgcagcgacacagcgattcacgtcgtgcgtagtcacacgcatttacgtggtaccgtgcgatctacagagtagacctggacgctatggacctcagcgttctgcaaagtggagtccgcgagcgaagcagacgcatttcagcgagttcagttttgtgtcaagtctaggtgaaatcgtgcagggactatctgcaagtgaaatgagtcggcagcaagaaataaataagcgttttgctccagccaatctgaactcgtgacgtctttgatgtgcatctgtccatgctggttaggtttcttgtgtccatcagtttctcactgcgtactaacgaacagaccagaaggggtctgtgtagtaagcgtccttcaacaaaagggtcgcgtaggttcttggagaaacaacggatttgtaaaaacacgacaccggttcgcacacaagtgtttttctctcgggcgaaaaccacatttttcggaccaccgcttgaaaatttgggataggtgaagcgattccagaacataatacacaaccatctgaaaagtgacacagatcttcgtttcgtggaccgtcagagaatgcgaagaaaccttttctgtcgtgctgaacttttctaagcaacaccctatctcgcttcgtcttctctctcggtcgacacgcacggcaaagcaaatggggagtcgcccgcagatcgaggcacaaagccaaagagcgcagagctcgacgcggcgcagtgaccctcgactactccagccaagactggaaagcaaagaggaaggcaggcttcgcagaatttcagataaaggcatgtcagttcctcctctcgtctctggctctgcaagtcgccacacgtgaaatcgtaccaccgatgcacaaacttcctctcgaggaaccccacaggcctgtgaacggcgtttcgtagggacacgagagaaacggccagcggagaagagctctgcagaaaacatacgcttctttgactttaaaagaactccgcagaaagcatgcacttcttctactttcccttggttcgccggattcgggaggaagcccatacaggtggcttctggacaaatccggtggaaaacacagcgttcgccagacgcacaagcacgctcgcagcttgctgttgcctgcacctggaagaagggtggcaaacgcactgcagggagtagtctagttttcggactgctgttccggtgtcatgaacacaggctaggaatggcggtggcgtagggcctcgtcaaagacgacaacagcaactttccagcgaatcgccgctctctcggtcgcaatccctccctctatccagccgatccacctcgacttggtttatcatggaaatctggcacgtcgctcgacctgaagtgcgccgccttttcggaactcgcaagaaacgcactcaaacaggaaaatccgtgaaagcaaggcttaagcggtggcagacttgccgcgaaactctctttccccgactctccagatcttcgtctctcttttctctggacattttcgcctcttttacatctggagaagcgtcgcgtcggcaatccagcctggaacgtcgacaagtgaagagccgcgccgttgccccagagacgacattttcatttatttcaatacgtgcagaagaggagagacccgagccggaagatccgcatgttcttatccgtaaatgatgcctggaacacgacgacctggcatctgtccaaagctggcattgagagcatgcggatctacgggttcaacgaacaccatcacatcgtgagaacaccaggattcacagctgcgattcttgttaccacgcaaatttcggaggcacagcaatcgtccttgtcgcgatcgctaacaaatagctaaagacacaattagtatcttgcggactacgaccttgaatagtggaggttatgcgatgcgtaacgcaacgtacgtcttattacacggtagatcagcggcgacacaccgcggtgtctctgtgccccgcagaaaacatgcactaagaacggttcagagttctctctttcttccatttctcgatgttcatgcttattttccttttgcttgtccctccacttttctgcctttctttcgatggcctgaacgttctgcttttcccctcgtccctggtgcactttctttctgcactaacgaaaacaaacactgtaaagaaattcttttccccctgaactcaaacgttgcgatggtaaatgtccctttttcacgattagcacacgaaacgctgcaaggaaaaaaaacttgtattcctttcctcgcattctagatcgtgtgccgctgtctgtgcttctgcagagcgtttctcgtggatctccgcccgacacggagacgatgtttttcgttttccgacgctccagttcgactcgaagttttcctcagtttcattgtgtcgttgcgttgtctgtttttctctttttctgttttttttctcggaaggacgctgcaaagatctctcgcagcacaccgggaactctcgtcgtccaccacgtacgcatgcggttcggaaaaaaattcgtgactccagcttgtctccctcctgccctccagagatttttccatcttcttcttgctcttctttctccgctgttccttctcccctgttctttctcccctgttccttctccctttcctttcgctgggctctcccggtcttcctttctttctgcgccggattcgctttcgcgagagtgtgcgcgtgtctcgccccgcgcttgagtcaactcatcacggccttcctcccgcctcctgccttggtcctcccgtccacctttctctttcctggcatctctgctcctcgttcctcctcgcttcctcctccgcgcctgcttcgctcctccttctgtccggaacgcgtttctctccccatctcctcctcaccttctgccgcaccca

SEQ ID NO: 1174 - DNA, 1134 bp, Toxoplasma gondii
actcgagctcaagagcttgagtttcagacggaaactcgaagagggaagtcctgcggatgtccagcgatgggtgggctgtacaaacagcacgcggcccagggatgaagggcttcacagagtctcagacgccgcaagctgcgcgtgtcctggttgtaaccgacacactgtcgcagattcacatagtgagaatcttcaagctagcttccgcagaagaccggagatttggtttccacgaatctgaatttggccttggggaaaaaagcagactgggagttcgcgtgcagcagcgacctttccgtctccgaaacggcgaggtgagtgtcaaggctgtcgaggcgacgcgcggcgcgaatctagcgcgagcaaagaggaaatacaaacagaagaaacgcagaaaacgacttggaccggcaggcgacagggccggagctgtcgccgccatttctgcaaagacgctcaagggcgaaggtgagaggcgggttgctcccgcctgggtgcatggaaatctgccaagtgggtcgaagctgcagttgttttcaagccagaaaacctctccatattgatcaggagcccgaaacagattcaaaatacagaattttctgaaataccgggggaaacaaaacagagacgactggccactccaatgagatcacggccgcagcacacttcggactggaaactaattctcacgtgggaaaggtagggtggcaaaggaccgacggcgaaaggctgtctggaaacggaagagaagcgccggggcgtgagaaggatgaaggcgagcaacttcagcagtcgctgtttccggagacactcgtcctggtggataagcgggacgagaccgccgagagccatgtgctaattaaaagcgaggaaagagccgccgcaaaacgagaacgggtagacacagtgaacccgaaaagaacagaagggcgacggcagatcctcgtgtcgctgcgccgcgcgaacataacggacggtcgtgaaacgtcacgaggcaactgacgaaaatgagccagaaagattatccagaagaaagcacacgactaccgatccgcagacggaaccctgcgggttgcttttagcgaagaaactcgtgcgtcgaggctttttgaagtggtaagcgcagaagggaca

SEQ ID NO: 1175 - DNA, 1427 bp, Toxoplasma gondii
ctggctgaataagtcacagtgtgacaaggacgttagcatccaacacatatatgcatatagaccgaaagtgcgatagataaatgcatcttggctagatgttaaaggctagcaaatgcccaagatgtttcggaagtatacatctagacgatcgcttgatacctgtaattatctgatgtacaaatgtcactagcccaatgaacactttttacgcctgggttggtgcgcgttatggagtggatgtcgggagtacaaatgagcagtcaacacttgtcaacaagtagagcaaaagaacggctgtgctcagggattgagtctttttgctgatgagatttaggtgtctaaaactgtgaaggctggaaacagacgctggaatgcgtagtagaatttagttcatttcgtgcgctgtgacatccgaagggctgaggaagtggataatcttgattacgattcgaagtgttattccacatgcaccagagaccttacatggaaaagtagctactatcttacaccttgctacccattcagcctaaaggcgcttgccttttctcacctataatgtacccggccacagttccatctggtgcgtcagcgacaatgcacagctcgggccagttggagaggtagcggagataaaagctttggagaaacgtctcagtgaacccatccagattgacggcgttgaatctgaaaagatctcctgcagtcataggtcggaagcaactcatttttttggcccagttgcagtgcgagccgtggagtcggcggttctggctttgtaaatccaaaaaagcgtgggtttcaggcagctgcgtctctacccaagggagacttgagtcaacagactgctgtgcggggctagcgtatccagttaagtgccgctgccgccgttaaatccgacggatacgaacaagcacgagggtcacgctgcaagaaaaggaatcttgcccacgaaacacagaaccacaatatctcattgcactccggacataccaacggcatcgccgagaaaaaacaacgttcggacgtgactcatacaaacaccctggttttagaggtgctgcttctcacctgttgtcgttctctcttcctaagcatggcacaaaaaagatcttgccgcagacaggctgacatctgaaacacacagtgataaagtatcgatacctggatttctagatgcgtaaagtagatgcgcatgtgcaactcgatgctcaaattacctcgcaaaaagtggggttgggatgggtggtgtctatcccgtgccgcgcgacgaaacctgctcactgtcttgtctggatgtgcaggagacttgagcgctgacggccgagactctctcaaattcagaaagtccttgcttaccacgagagtcttctcgaccaaccttctgtttcggcaatctgcagcggccaggtcttatcttgtaaaccaca

SEQ ID NO: 1176 - DNA, 4132 bp, Toxoplasma gondii
tggtacgagcttaacacgccgtagttgcatttaagtcgtcaaagtcacgcgggtggatgcgaccatcgcacgcgtattgcaccgaacaactgatgctcttgaggctgctccaagcgtcgcttcaccacgagaatgtacaaccacgaaacgtaggagtatctggtctgtcagacacaaccacgaccagcagtgtccgtttcttctggagaaaccgtgtcagcgtaaaaacgatgcaggtcaagagacagaagtctgcacaagtgagcaatgggagttgcacggggcgtacctctcgacctaaatccataaagtcctcggctattcccttcccaatttgagagaccgtgtccgccgttctgtttagcttttccatgacttgcttgtgtctgttccacggatggttgcaattacacacccacggagagtcgaacttgttgcaggaacaagaggttctgccgaagtaggcaaccggacacaagtgcacattgtgcaggatatacgagctctgtcagctcccatgtaagtcgtaaatacatcccaaggagaggaaccagtcgaataaacatgtacaaatagccacaactctcgcgcttagtgcgaaaggacgggcgcagcatagcattctcgtcaaagcactacactttctgtacatgtccgatggtgaaatgaagtaacattcccttggagcgctacccacacctacgcagcacaaacctgttatcgaacataaatcgaggagcaaagacgaggtaaaccgagctatctcaaacatctgtgttagctagcggtttaagtaagaaggagataagttttaggagagtctgtgtcgggagagagtgtattcaccacaggggtgatttcgtttccaacatgcttaccgtgtacacttgaaggtgactggatcatgttcgatgtgtttgtgtttgcacctgcacctgttcacaagaccacccccaaaatctgtcttaagaagtggtatgcctttagctattgcagggctgtcagtggccacggtgctggcagacacgaaacacctgtcggcaaactgaattcggcgccacggaacacggcagtcagtcaagctacatcaagaacgacacctgcattcaagaaacaacgcgacacaggaaatcgacgtacagcaggggaaatgttaaatcgcgcgggcgagccctcccaggatcacaaaagaggcatgcttttcttgtctgtcttcaaagaagtcctctcctcccgcatgttctaaggatctccaacagcaaagcgacgaattctcagatgtttttacacgatcaggatgtaaatagaccgccgcaaacagatttcatttctgcaatcgccacacgcgtttttggattgttgctgatgctgcgtctgcatgtgatatatacctgcagccgtgcgctgcctgtttccgccagtatatccacgtgaatgtcgcaccgagatctccgatccattctcagccaattccgtcacgtcaactactccccgcgtcgcctaccttaaaatccacgcaccctctgcaacaatatagaagaagtcgcgacatttgcactttctattggtgcatccaaacgggtgtggacgatcgacacccttggcaagaccctttgtgtgttctttcaggcggtgaccgcacaaacaccggcactcctcacgaatgacaatgcacgctttgtcacattcttcgcagatccagcgccctttgagactcagaggtggtactgtagaagagagacgacaacctgcatttcccccttttgtttttttgctgagtgtatctttctggcaattttcgtccgctctttcatggcgctcgggtgtgctggctaatgaagcaacagtcgcaggtgtggcgccgcaaaaaccacttgaagttgcaggtggaatccttttctccatcggtattgctgaaagcgtgtggacgttcgaaagttgcgttttgtctatacagtcgggtgaaatcggttgcacctggtaaatgctgtgaatggtttttatcctgcaataatttcttgtggccttgcatgaacatgcctggaccgcggagctgccctccggccagttgcccagagaaaaacatcagaacaaagcaaaggagccccggaactccttctctacaagcccccgttgtgtatgatatgctatgaaacgactcgcgatcgtgtaattgagccctgacagtgacggacagatcgttttgcgaccggaggggagctgacacctcatcagttggtgaagctgaaaaacactcacgcaaacttcggacgggtattcagataactgataaaaacgcgaatacaagcaactaacgtcacacataaaaatgctataaagtaaaggcttctggggtgcagtcatgggaatgcgcagttcactagacaacagttcattaatcgatggggcactgctccaagccatgcagccgagcacgaggagccactgccctgtaaaggacagactctaacaccgactgggttgaaatcaatcgctgttcccgctttgagatgtaacgcacattaaatccagtgctttttccggggaaatgacagaggactttcccggatattatgtcttcctagggcaccaggaggatctgtgttcacagacacgcgcacacagtggcacaagacactcgggtcactgccggcgtgctagcacttgtcgtgtctaatgccgcgaacaattatgcctgatttttgccgagttattgcattgaaaacctcagccagttttgcttcttgggaaaagttgcctgttggggatgcacgtggggcggcaagcgtctctcaagctgcatgttcttgccttgacattcgatgcaacaggcgggaagcatgtcttcactgagttaagtcagtagggacaggccaaaataccaccgccaagaaactagctccgtctgtgtcaaaacatggaacaggtaatgctgcacatttgtatggaattaaagattgtacaggagttaagcgaggcgaaaactcaaactcctggcttgtgtggaggtgcaggaagctcacagacactgttaaataccgaagagggaaccgcctagccgcttccttgtctgagaaacccagagtcacacaaaccgggcacgcaacacacggcttcacctgcgataggagttgttgaatccggtgaagccgtgtcatgcatgcttcgctctgtctgacagctcttgcatgattcttatacgccgatattttattaatttagttccaatgacttctcggaaagaatggcgagtgaggagccacaactgccgagtgtcgctgctgcctaagtgagttttcctctttagtacctcgctgagattgaaagattctttgctaaggggaaatcaacggttgtatacttctgacgggtcataacctcattctgcctaagtatcggaaactggcaaatgtgaagagaggccgtccgtcgtgtaaagaagtcactttaacacgctcatgaggcatggcttcactatgtgtatatttttggagtcaccgatgttttaagggcgcagttctgttcgtgcctagatccggcaagaaaggtgaaaggctggtgacgtaggcatcgtcggccgcgacaacattttgggggggcttgcaaaaagtatggtaaatgcggatcctttggagagacagaatttcatctactgaggtggtctttcgtgctccatgaaagtgccattgcatccgccatcgacaaaaacatgtgatgagacaggcttccaggtactcagcgatatcctgtggaaagtaggggctgcagcgatctgctgcgtcttaacggccgttgctgctcgtcggcctggagctgggaccgttttcattttgaggttgttgcttggcaggacctcggcaatgataagtgatcatcacacgagaacagaactagtttctctcttcgtatcaccagaaataggaggtgtccctacttttccccttggggaacatactgttgcatccgtcgttgactcgactcttggtggctgtccgcttcagaccaacacgagcactaccgcatattccttgcatgctcagaactatgatttcatgttcttctttgtattgctggtccacaaaacgaagaagtcttgaatgaacgggtggcagatgttaactgtgggcaaaaa

SEQ ID NO: 1177 - DNA, 3758 bp, Toxoplasma gondii
taaaatgccgcatcccacctcagactggcgtgtaccattttagagaccagagctcttgagtcacagaccactgcgaccgcaaggaagtctgacatcggtttttccaatctggatgaccatgtctcagctactgatagcgttttgtcgtcgttttagatgcgtcagtggaggtcgtgttcgaagagctacgccgtgttctgttactcgtattcatttggtggccgcgtacccggtgtgttgagcggtacaagagcggatcacacggggatatattttgtatcataacgccatatttgcgcatgcatgccagggacacatggagccgccacaggtttgcgagtgtaataacagatggtgaattttcgatgtatgttttacacgaagaaaatttttcctccataactttctgtgttttctggtgtcctggtggacacctggttttgtgttcttgacgcagaaggcttttttgtcggagacaggaaaatacgaactacaggtgctatttttttaaagtgttgttgatttacgcagagccaaagttcatatgcgcatcagcataccagcgttagataggaggaggctaatcgaacatcgaagaattgggggagattccaaggaggagagacgcagcaaaaaaagacagctcttggaagacacgtggtggaacctctagaatcatgagacgacaaaggagcacaatagcagggtcatgggtgggtcagatgtgttacttctttgcgtagaatgggtctgctatgcagattgagtggtggccgcaccgaactgtcccctgggtagtattttcgtccatgggatgaggaaagcagcgataagtacgcacaatatgttgtcttactcaggaaccggagacgaaaccgcgaatggggttttccatagaggcgagtactcgggtatgtgattgagaagacggtgatgtgtgttgcagtggttgctgcacggtgtgaggagtcgctcactcagttagcctgtccgcgcgaggagcgtagtagtcaaacgatggtatgtttgtgattttgttgctggtgcgtgtggagccgcttccaccatgtggtcgaggcgaggtcacaccctttttgtaccaagctgccactctctgtcggaaggagtgcttgtgcttcagcaacccctcattcatacaacgtgctgtgcggatgatggggggacaaggcggcatcctgtccaagcggaacgtgagacggcggctttgtagggtcctcgactgacaggggagggaccaacctgcgatgtcattacatgaaatattacgttcgtttcctgaaaaatgggttgattcatacactcagtcggtagtaggtgttcaactatggcgttagtgagcaacgaagcgacttacctggtgttctgctcgcacgtcaggacaccaccaccatctcgatttccgtgtctgatctagtcagtcaggattatccatcagcagccaagttgcatgatctgctctcgccattagcaggagcggtggatgaaaagatataggcagaactataagtgacgagaaacgttgtatgttacaggaaacagtagccttgattcactggggcgatggaatacagccgtcttccactgcagactcaacttcgcctggtcccttcgtattgctccacgttcgctgcttcctcaccctcgagcgcttagggtccttcacgtggtcgtgttccagcgtcgttgtcgggatgttgttcgttacataaattgaactagtcaagcgttaaattagcccgtttgcgctctcaatcaacgtctccgtgtctagcgtgcaaacggttgctgctttgaaatgagtattcgtcaccataaagacaatgtaaaaaatagtagagattataagtccgtcagtgtacctggggagttatccggagaccacaggaggacaaacgtcatcgctattgggctgttaaggactgcgaaccgcagctagagataacgatcgtacatgggactagtttttccaatgaaatacacgtcccatgttttgggtagtagatcttcaacgaaataacttgatttcgcgcgacgatgttcctcaagtccccagcatctttgtgtttgtccctatactgcatctacatcagtttggccgccgaagcatatatcgccactgaattggggtttcgaagagtgaagcatggtgaacaatatagcttcttcgcgctcctgtcgaatgggtaaacgcacctgacacgcaatgtgaacgccggtaagatcctgaattacccaactactggcggccagaagaaaccggttcgcgtagccggtagcccttgcacaaccgaagaaagcgcactgcgagcgccccagtttgcataatacgtatgcgccgcgaggttttgtatgtgatataaaataaatgtgccactcacacagttccacatactacgcgcagcaccgttaatctgcttccacaagttgttctttccttcacagcaacggataggtaccaagactagagctgccgctgtgtggcgcgttgctctttcgaatctgcaccgcggtgtcttgagtgacggcagaaagtgtcaccagaatttcatttggttcctatacatctgctgcaccgttatttttcccttccagtcgaagtgaggatacgcaaagtcgaggataaatcgtcttttggtgctcgcccgccgaaaaagaattgcaaggtttttctggatgggcgaggacgacggtttgctgtataccgaggaggggttgcgccgtacctccctgtctgcattccagagtacgtttcgtggaccgacgccaagctgttgtccagtccttcgttggagatgccccaggatggtttatcttttactatatggaaacgtcaaagcgggcctccaattgaagtaaggaagcaatccagctgagaggacggtggagttgcctgccaccctcacctttggagtctccgatgtctcccgcatttcggtcgccctctcgttctccagatttcctgtccagtgcgcgtctccctcaaggagtacttgttcacatgtgccgcgtgaaatctttctttgtggcatcttggacctgtttaaaacattgtgtcgtcttcgaattggatctgttttggctattgatgttttgtgtatgggatagtagactctgcttgccgccacgcgttccgcaagttttccctctcgcaacctgcttggccatcagccgttagaaacctgctggcaactgagataagcgaataaatctctagagttactaacggtcagcattgctgcatgcgttgtttgcgtggagtgtccgcagtctttcggtttttttcgctttccaacgccgttcttcggtaacttccggctgcccgggtggctgtgccacgttttcgatgcgtgtttcttcttggtccccatcgatgaaatcctcagtgtacgacctcagccacgcttcgcaagcgaatctgctgagctgtgtgaaattttgttccggcagaaagctccacggcacttgacgagttttttggcacatgagcgcagtgtagtcaccccgcctttcttaaggaaagctgtagcacagctaagaagcggtagtacgacgtattcttccattgtggcgttcttggcagggctggttcttctagtagtgctagctggttcactgttgccataacctctcgcaaggctgttctactcggtcacgctaggtgattattcatatacgtctggttttggttttttggactttattgcgcccacgtaactgaatcctctctgccgtcacca

SEQ ID NO: 1178 - DNA, 2668 bp, Toxoplasma gondii
ctgctcacattgcaaaagatattagaagggagaaatgggtacggcattacgccggccattaacgggggtcagaaatacgttgggtctacctctagttgcgctatcccatttgacagaacgctgagaaccttgaataaaggccactcttcagcaatttccggaagatcccgggtcagttcacggagactggtacactctagaccgcgcaatttgcaataatcatgagtctgcttgtcgatcaacaccactgcatcctccatggcttcattcaggggcatgcccgcgtcgacgaacttcttcaaggcgatgaacagctgattcgtcgcattctcattcacagacccaacaccaaatgcaccaccactgctgggctgtgaatacccatattcagccaacggtcgagtgggcgggatagacccagagccttgctgtggcggttcctgtaggtgggtcaagtgtggcgctatagcaccgagcattgaacagtggatatcggagaaccacttctggtggtcttcgtttgcgtggtgaagcagcgacataatatgtgtcttgtccgaagacgctcgtcctgtctcgagcgtagcctgagagtaccgcggcataccgctgagcaaatatggtaaagcggcaagtaagcatggaggctgctccactggcaatgtcccaccggggaggcggctctgaatgtttcgatacagtgtggtcaggtggccggggacgagagagtcagagagtgtattggggccagtattttcgtcgcccgtagggccactgcggtaaatatgagagggactcatactttggggcaatatcaaaaaactgccctccctgcgtactccggtccatggcattttgccttctccgagaggatgacgagccagcacgggcagcatcgtggattgcagttcattgctccatgtggtttcttgaagcgagacaggattggaaggcacatacgctgaccaaacatggtccgaaaaagcaaaccccgggtgcacatcgcgagatgccctcatggatgatgctgtgcatgtggcgaacgagctcgagaccattaaaacgatgagcacgatattcagccagaccgctggtgtagatgtccttgcccgtgtacgatgttcggaatccgcaggtgtcattttgcggacaccacctctgaatgaagagtgggagacggcaagcttgcaaggctggatgcggtttagaagtcatttactgagccatggtgtgaataaccgatggactgcagttcatagtctgcaggtgtgccagtcagtcaaaacaaaaagcccgagctgcggaggccggatacgttcatctcagtagactttacgcccactgttttcccctgacagatactgtacaaagaaagaatggtgatatttatgtgattgaaatgacgactgaccacaaattacaagcaacaggctcaacggtctggcgcagcaggggcacacacagctccgcaggtgaccacgaaaagaaccgttaaaatggtgccactggtgactcacggtggtcttacgattttcttataacagctgtacaattccctccaaataacgtgcaacagggcagcagagacaaaggaaacttcgtcgtcacgaacatgaacatgtggaaacaaaggaacacaaatgccgggtgcactgcagcaggttcctgtcgagtgatccaggatactggctagcggcggcggccggccccaaacgtccagctcgcactgtttacggggtaggatgggcaaaactcgggagctctagcgttagtaaggaagaagtcacattatctgttaagcgcgcgcagagctgacctccacctcctcatctgtgaacacagtggaaaaagaacaagtcagggatagcggtaatcggcttgcagagacatatcgcctgtgactctgtaaagcagtgaacacacagtcacctcattcgcgcagtgtccaacgatggccaccttacataaatcgacgctccccccccgacagccgttgcgggcagactgttgctgagacgtccgtgcggtcaatttgattgctctcgggtatgacttgacgagaaccagccacaggactcgaatttcaactctcagatgcatggcgacctgaggctttcctgttgcagttttttacttttttgtgtccccgttgacttaccaagctgccaaaagtcatgaagagattgttttagttcaaaaatcagtttgtcgcgcgacatcgtcgcgatgaactagaatcctgccctactcatcatctggcaccacatttgaatcagatcatgatccttccactgcgtggagaaatgtgacgtggtgaggtagctgccagtaagttcggtaagcttcatcgttcttcgacgcagatgtatgctaactcttcggaaacacatatcatgccaaccctgcgttacgtcagtgttttctccatcaggaagtctttttgcctctggctaatcctaaccgacacctcagcagcgcgcacaacacatccctgagaaggtcgtgcgtgtcccgacgctgctcggagtccgtcccgtttgtttctggtgcacactgtgttgtgcctgaggggttgactgcctcactgcagaacaacacacctttttccaggtctaaatatcttcaagttgaccagttccgcttcgcgggccctcgtgtgtgtccatca

SEQ ID NO: 1179 - DNA, 4915 bp, Toxoplasma gondii
atagtcgtagagaaagatgcaaaagaaaaggagagaagaggcggcagaactggggacggagaaaagagttatgacgtacatggtgttttccggggaagattgtctccaccacatcgttaaaagggagaagcgaaagagccggaaggctggtcactaggtggggaaggctgcaggctcaggactgctggtcacaagaggcagttcgagaagccaggcgaagtccggcttcctgtcctcctgcagagcggccgagacagcgaagaaaaagaggaaaaccccaagaaagtgaaactaaagaagctgtcggaagagagaaataggtcaccatgtcggaagcaagccgaaaccatatggcgggaagtgcgtcgagcttgcacagagtggaccgggtgtgtgtggtgtcgctgtgcctggttgccttctccatcagaaaatcgacaaacgaactttactcgctccttcccgccaaagaggtggcgagccaccagagcgttggtcgcagtttcatcttccgtgtctccaattttttcaggctgtatagagaaaagcaagcctgggccagaccgagaatgcggtacaagccccgaccgcggttgtgggacgatgaggaacctcgggtacgagccaaggacacgaaaaaagtcgctgcagcttggttgtttaagtcaaagaagcaattgtgttaaaggaacccgaaaggaactgttagcacggcgaaatttgagagttctgcgccggcagtgaatccaggtgaggctaccgctagatgcggagggggcgggaaaaaaaccaggtaggcgtcggcaggacaaacagaagcaaagcccttgtaacggggatgatctccggcgcgtatcgacggaaacgaggaaggaagacgaaacttcagagagaagctcaaaattaacgaaacgagcgtccagcgcacagcagctccgataccgccgatccagaaccgagtcgaagcgtgtgaggcggccggggaaactcgctctgtgatcggagcttaccggcgctcgcgtatcgagttttggatgacgcggagaaggacaaaatctgtgcaacttggtcaactcgtcgatggcggagattttggagaaaagatcgacagaatcgcgatccagaagcggcgcgcaaacgggaacagaagccggtccgcggcggtgcatgcgcagaaccacgcgaaaagccgccatcccagaaggacgccacagagaagcagcgacggtctgtcaaacgcaaatgacagcaagtttctgaatcttcgatatcgagcagacgtgctcttttctcaaaaggctgttcgagggaacttcccctgcggaagtccgtcggagttcacagcctgttgggtgaggcacaccatactcacggtctcgacgggagagtctacacagttttctcaggtcaaatacggggagacgctgagagaggcttcagcacgccgacccagctttgtcgcttctctcaaatcaaggaattcgcggttgatttcaaaagggaaaactcggcccggaaagctccatgatatctcgtggatgcggtgcggtcggtggccccgtttcgtccgcgaggtcactttcttgagacacaactgtctacagcgagagacctttggattctttccgttcggctctgcttcatagaataacttttttccagtgaacagcaagaagttcatccgtgttttctcctgcccagaaggcaagaattctctctctttatgccagacagcccggcagttgcaagaactaaaaacgcttggattggtgaccaaccgtccagaacggaagcttccgtttgtcgctggttaggttagcctcgtctgaatgccttccgagataaaaaaaatgtgtggcgcgcctcgtacgctcaaagttgccgtttatccttgcatttgaatgtcagagagggttttgcctgcaatcatttggagtgcgaaggtcatcccggtttcgggtggaactactttcaacatcgcagtttttttattagtgaaacgcagagatacaaaacagaaaacgagagcactttactgggaccatttaaggccacgatgtctttttgtcgttgacggtatcagaaaaaccagagctcttccatctctggaggaggccggctctagtgaatttccccaggggaggaacatttcagtccgttcgctgcggttcagcactcgcactcggtctaatgcattctcggggaccgatcacagtagaattcgtgaggaacttcccttctggtgaaacagagcactaaactactttctttgcttgagaaaaagggccattgtgaagttcagggctctctattacctgccatgaggggcgcttctgctgctctcgcaccttcgtgttcgacagagagcatgatccatgataaaaggtgcttttgtaaaacgaagaaagtgttcgttctgtacagacaagactatggtattgacgtcgtttagaaggctgccacccggggtataacctcttccgcgacgatgtccgcactaacgactcgacagatatccagatgttatttctgtgaagatcccacaagtgtctatggccgtgcaaacggcttctgctgttgatttcagaaaccaacatgctctgtagagcctgtgtacctttcgagttctctgacaaagggaagtaaatcctacagaaaagcgggcgtctctagtggaacaacagaaaaccctgcggtgtattcccgtggctacatggtttgggacacgaaatccgccagtcccgatgcatctaactgtcgggagccgccaagatcacggaaaaaggccggtgcattcccagtcccttcttgttttatctcgcgttctcgtcgatactcgtttgttactcgctctaccccctctgtcggcgtttccaggccaggtctacggacttcagtctgtgtcgcacacttccatggaaaccttttcccgtgagtctatcgacgcttccttctgcgagcgcccttctgtgaagttcgtactcgtgccgcctcgcgtgtctgctcgttctccctcagtcgcggcaggaaggtcactcctggcccattcgcgttccttcgtcagaagattcactgccgtgagggtccttgcatgttcgacccttcgcgcggatgacacgcatggcttcgccttctggacgcgaatgttccatgaagttgaacttccgccggagagtaccccttctctgccacggggctgctttggagtttcctcgcgacgcgggagctcctcttcgtgagctgtcttttccacggcggttgcgcactaggaaacgaaagcgcactgttctggttgctgcgttctccagcccgtcagcgagttcttcagagtcgactgcgattttcttgagcgagcgtcttttcccctccttttcgcgtccggcgtccacatgccgcagcacttcgtcaacgctgacgagttctgtcgcggttgacgtggctcgcgccttcatgtgagagtctttgtgtcgaattcgaaggagtctcctctcaagcgcagccggacactgagcgcggcgacgagaaaaaaactcgagtttttttcgtcatccgtcttcgcaagggggcgactcctcggttgccgccagcacgggggaggtggctgcgttgtaagcagacgcagacagcctctggctgcgtgtttctccttcgtgagtcgtttgtttccttgccttctcgtcgagttgttcacgcttctttggtcgaggaccttccgcgggtgtcaaatgctctctcttctgtctgagtctccctccctttttggcgtgactcgcgcgtgtcgaggccgcggcctcgcagggggacccaacgacgcgcccggcgctgcttttcgcagaaaagcaatagcgaacgcgagattttcattgttcttgtgaacgcgcgctccagcactcctgctcgaaaaagtcaagggaggatctcgtcgaggcgcgcccgggttgtcggccagttcgagctcctcagagacacggcaagtgactctcgaaatcgcgccccttctgccgctctcaccacctctcctgcaaacgctgtccagtcaaacactgtctaaaagaaaaggcaaaacacagagcgagaccccttccgatttgcttttttaccaccgactacagccgtcgtctctgggtctgcatttatcctgggtcgcagacctgctccgataaaaccgcgcgaatcctggaagaaacagctgagtgcgttctctcggatttcccgtggctctttctcgctgccgaaggttcctctttgcaagatttgacttttgtttcgttggaggaaaccccaattcgacttccgcgctcccactctacaagacaccgtacgggagggtgtggcggtcaatttttcaaactttcagggagtcgtccactcatgtcaaacatttgttaaccagttttttcccctccgtctcttattttccccgagcccctttgagttcttttggcatctttccacgcgtcgctctcctccgtcgttcgttttctgctgcgctgccgcaggtttatcccgccctcgcgtgtctgccctttcggctgactcacctgcctctctttccacgttctcctccctctctttcgtatctctactttctttgcgtctcctcgttgctctccgcagaccgcttcttcccttccgagagagaccatcccttctcgattttcaggctctgctggcctcccgcaactcgttgctcccccatcccttctgctcagtctgtttctttcagaccctcacttccttctccttctgcgtctgcttctcctcttcgtcgcttccccttcttcctgtctccttcttcgtcttcgcttactctgcctcctctcttcttcgtttcgtttcctgtctccaacgtttttctctctctctcactctctgcgttcgtccaccttcgcggtttccctctctgcttatccaa

SEQ ID NO: 1180 - DNA, 2454 bp, Toxoplasma gondii
ctcaacttggatctggccaccatctcctgtggctcggccactcgctgaagcgtcgctggtcgctctgccgacccccgtctgggtcgtttgccgaaccagctgctgatacacagccggctgcgtgggattcccccgccgcggagcctgcgaacgccgtcgagctgcgtcctcgtacatttgccctttgcccacgtgagtgttgttcgcttgatggttgtcagtgaggtggacctgctgtgaaggcgctccagtattttgaggcaggacaaggccgtggaggtggtggccgcctgaagctgagatggacccacgcagacccggaaatgcatgatgtagcgccacggactgctgttgactggcaagcagccgctgctgctcgtagaagtactgctgctccggcgtcggctgggcctggtcccgacggtaggcacccgttgcaggccgtctgtcgatttcccgccccgagaccacctcctggtgtccaaggagcgtcccctgacacatctggaaagcagggtccgcaccgggagtcacgtgctgcctagactctggttgcgctcggccagaagccgccgtggcctcgtgcagagcccccctagcaaacagatcaacaggcccatggggaaggtagtggggattctgcggcaacagattcggattctgcagaggcgcctctggctgctggccgtgcgccgcctcgtcagagtggagtgaacgatagggaccttgctgcatcgggaccatgtggccggggccatcggtacgatgcatagcagaagctgccggctttcatgtgcggaccgcgccggctcctgaactgaagactgctgtttgaatgtcgggctctttcggaccaccggcggcggagtcgtgctatggatgcccacttgcaatgggggcgcacgctgtacgaggagacgtgtaaattgctttcagtcaccacgctagaacgtagccagaaaagagaaatgttcaggtggctggcatcagcctcacattacagtcggcgtcatgaagaggaagcagtgccacagcggcggtgtcgaacgccgtaaggcagttcttgttgctggactcagaggcgaatgtagtgaagagaaggagacaccggcactctgttgaagtgcgataaaaaatcaagcacagacaggaaaaagctccatgagaacacaggaaatttggttaaggtactgtggccacacgacgtcctagctcataccgaagcgtacgccctccgtggcacttcatttagggggttcctttgaaaggcatgcacgaaagaagaagcagagaagcagataattcagaaacgtgaaacggtggccggaattgccgagatcgcctgttacatgcgcacaagcgcctgaggtgtcgcactagaacggtccatcggacacaatctaaagcacaaagacagatttttgaagctttacaacgtcaggaaaaccagtcagggactaaatacacttctaacccattaacaagaaatagccttgtcgagactgtggttcgagattcccgccactactgcacgcgtttgcaacaggcacaccaaaactgaatttctcgctaccgcagacaatcacggataggcatgcaaggtagaacacgaccacgcaaccactttgaatgactgattagcccgcgcactgtgcggcattcgaaaagaacaatattctatgatgggtattctcattccatgaaaaagcgaaattgacgggccgttccggcacgctggtgtaagctgacggggaaggtcgcatgcgcggagccacttcatgtcatccaacgatgtggccaggcaagcagcgtagccattaggtaaaaggataagctgaatgaaatcagtgcgtagtgcgtctcttcggaaatatccaatatcattttcctgtgtatcggccgcgtgacaatcagtcttgcaactgcgcgtgttcgcaattctgtgcgcactgctcttctgcttttggtatgagctgctccaggccttcctttgtgccgagccagcgaactgcaaagctggacgtcgacatcggctctctgtcttactacagatacaaccgtgttttgtacagttccaattacatgaggtttttcgtgttcgctgctttcatcttcaagcgctattacgctttcggattcgacgagtgaccctgcgataggtcgacgcgtttgctacggccggctccctgtctaggctgggaatgaaaaaggctgtagcatattcgcccgtgtatgttgcggcctgccggatccggatggagaaatggcaggccaaacgcatagtttcctctctacgcggaaacctgagcctgacacgttttgcccgttagggggaagcgcagttctcaggtccgcaagatcatactctttttacagttaggatcggactttcagcatgacatgtgatcgtgtaaactcaggagaaacgttggtagacagtcctgtctggcaaaa

SEQ ID NO: 1181 - DNA, 2444 bp, Toxoplasma gondii
ccgaaacgagacacacgagaagcactgtcgaggtcgggacaagagcctgcccgcctcagcggtccgtactgcatttcttcttctccctctcgagactgcaagcctgcgagcacagccccctcctcaggtgtgtagctctcgcggtggatctcaacgcttccgtaggctcttatttccccccagatgctcttcttccccttcgccttcctcttcggtgcatctctcggcagagccctgcgattcacgagttctgtcggttcgtgctctcctctgtcacctggctggaccctcgcactgcctccgcatctcctttcgatcgagctaatttcctcctctgctctctcatctgcttccacgttcgccgatgtcccccactgctttccttctcctgcctgcgactcttctctgtctcgctcttctgtgtctctctcctcttctctccctgtctctctctgttctccctcccgctgttcgttatcttctcctccttcgccttcctctttgtcgggagacgtgggcaggcgagcccgaggggaagacgcagattcctgcatttcttctgtttccctttctgcgtcaatcgcccgttcgcggcttgtcctccctgcttgaaaggaaacagtgacgcctcacaacgggagacacgctggcgcctttcgcacatcgacggggcgcgcggtgggcagcaggccagacgaatgaaaggacagagaagcgcagaagaaggaagagaactcgttcgagtgctggcgcctcttcacacacagggtcttgctggacggatgcatgcaaggacaaggtcggaataagtcaggaacatgcagtcaagccgacggagaaacgatgagagggggttgccgaggaagaagacaacgacgctcatgaaggaaccgaacagcgagagaagagaggaattcagcacagcgaaagaggaagaaggggacaaagaggacttgaaaacagcggggaattagcgcgtaacagatgttgagagcgatgaggggaagcaggctcgctacgccatgtaactcaaaatagaaacgaacttctgaaaaagttccgcactgtttgctctgggcgcggctgttccatcgtaaagttctcaactgcggccgcatcccatcccgagcgtcgcgtaggtgtgagcattcggacaaccacttggtgtatttccatagacggcgggagaaagcgaaaaaaaccatgcagcttttcttcttgacccttctctccccgttttgacgagagtctacagccttcgagcggtgctcgtgttgacgtcgtccgggcgcggcgaggcggggctgcggcagcttcccctctaaagtcggacagacggaatcgtttttccggttgagcagaggattctggaaccccgaaaaagattgggggaaacggatcgcctctcgcgatcagctgccgtggagacgtaccgaagttagcagagcgctcgtcgcactccgctgctcgagagacaaccaagcttgagaaaagcggattgggaaacgaggtcctgcctggtgtttctgcagagggcgctgaacgcggaacaagaattgtccacgcacgaaagaaattcaaaaaaatcggccgcagttccgcggtcgagagatttcctggagaacctcgcgttctggggatcctatacatttcccagctgctctgctagccttccctttcacgcgcttctctcaacaggggagactccaccgcagcgttgacgtcgcctgcagacagaaaggatctggatcgacgtgttttctcagcgtcccgctgcgtctccccgttgacttctctcctcactcgaaattgcggcaactgccccgcacaattgtcctttttggctctttctgcgcggaaacgccttccgcgctcgtcttccccaactgagtgttttcctcgcctcccactcggccggctggtagaggcgggcacagacaaaggcacaaacggcgaaacggcgtgcgcatgcacactctttttcgtggcttcttgcttttgcactcttttcgaaacctcgcaatcactcgtctgatttccttccgcggcataatgcctgacgttcccctgcagcgcctaacgcaacgcactgcctttttcccgtcggaaactgacaggtccatttgaacagaacagagacgtttgcatccgcgtagcgtttcatcgctctccggcgtttcgcatttcctgcagcttcgcaaaccgttctgccggcttcctcgtgacttgcctttgctggaacggcgtttcagcccacacccccgttccgctgcttctcggcgctccgccgggtgtatgtacaccacacgctttcgcttcgtgtccagtggccactgctgctcccaaggtggcgtttctcccccattttctgcgttcttcgcgtttttttctgagcatgctaaggatgggtgcacccaggcggctcagatagacagcggcgaaaa

SEQ ID NO: 1182 - DNA, 1516 bp, Toxoplasma gondii
atagacggaggcacagtgctcgccctgtgacagtctgagctaggaactccagagggagacgcgcaagaagtggaagcagctgcctgcgagtccggtgacgtcgaggtcgaagccggcgccgcaatcgcagcaccgtcggccacagaacctcctggagaactcaccggatgcgccagaaagcttaacattgcgggacgggctggcctgtacagcgatgcctcccagaattccagtccgttggcgcggacaggaaagcgaggaggctagcaatcgagaggcgtgtgtctggcaaagcaacaagcacacacaaagtgaagcgtctggcaaagagcgaaaaatcgacaacgagaaacagatatacgtcgacaatgtggtctgcacgcagtgtgcaaagcagtcaaggtcgctggacaccggacgcccgtcccagttagcgtgaatatagtttggacaccgcgacacagtaaatgatatacgcggatgaaacgagttgttgactgtgctggacagccgtcaaaaagaagttctcccgcccccggctgtctgcgagaagccaaagttgtgcgttccaatcgctgtgtcacaccggaattctgaagacgcatgtgcaggacgaaactacaatgaccgcactactacttcgggtggcttcgataactagaagaggatgaaattcagaaggaacgttcaggaaaggagtaccaccagtgcacacgcatgctcccacaggaggacgacggcgtacccgccggattccatcttcgacggggcacgaacgagaagaaaaatcagagacggcgaggcgacacacatgcgatggacaggagaacgccagccaaacaggcaaaaggcagctgcgacggaaaagatcgaacatgcacccctagtacacccgtcacacgaatggtgccgcaatgcgtcggtccgtacagttcaccgcttctccgtggtcagaaaaagtgtcacggatagaagtggaacgcacaaagaaaaaatgcaactgtgaacgccaatgcgcttatttctttgctacacagtcgaaaaaaaccgaggccgccttcggcaaaacacaaaacgtgacgaaactgccggggagcacgcaaacggcggttccgtcaccccgaaaaacttccgtcgctgcaaacgtcttaccgaataaagacgccgttggccaattccgaaacccgctgtgttccttggcgaagcaccccgagttgcattgcatgccaaaagaacttttttctaaaatccggagtgcatgaaaaagcatgcggggatattgcgttccgaactcatgcagcgcctgtcgcactgcagacttcgccatgcattccgccgagaacacgctcagagccgttggtggccgcaggttgccgccatccacatttgtttggaatcggagtaatccaaaagtacttgtgggaaaatatttggaaaagattaggaacacttgcagaagagtccttcacacgggcgggcatgcgcactgcaggcgcgccctaatcccggaggcaca

SEQ ID NO: 1183 - DNA, 2162 bp, Toxoplasma gondii
tgttttctctcttttgtccctcagccgttttctcctcgatctgtcttcttctctcttctcccttcctctcggtgctctgctcctcgccaggcttctcctccctccgcctcactgccttcctcctctccgtcaatcctcctctcccccctgttgctgctgctcacctgcgagcttccctccgcgttggcgagtcggttgaggaggcgaacttgctcgttctggtcgacatggtcggagtagtatccactgctggttgcgctgagcgccttcgcagtctccttaggctctagcatctgacctctctccatcctcactgcgcgaagaaggcaggcgggaggagccgcgggtggcggacgcgcgcgaaagaaaagcgcagaagaagaaagggcaccggagggaacggcgaagtgaagcggcacagagaagctggagctcccgctttccttcgtcgatcgacactggcgtccttccgtctgaaaacgatgaagtcgcaccggcgagcaaagcgcgcggaccgcccacttgcgacgaaggaaggagcgcgacaaacagactgtaggttcagggagaaaggcgcagaagggatacaccctctggggcagcgagaggagagagctcagacacacctttagagaagcaaagaggaaagagggacgcagcctcacagaacagagagacagaggcagaaacctctcttcactcctctccctgaccaggcgacgtacacaaaaagatattcacctaaacctacatataatatatatatgtattttcagatgggggaaggtcatttagcatcgatggggggaagaaaagaaggaaaacgcttgaaaaggctgcacgctgttgcgagagggcgagaggctcgtacgagagcgagagagacaggtgaaacaaacgaaaagagagacggagaaaatccccgtcgtccccgcaagatgaaaagaagacgtcaagagaaccgaagacgacccgagtttccggagagccttttcccccgtttcgagttttcagttgacgagaggcacaacgctcgcgtcttcgccgtcacaaattcttctattgaccgcagccacacaactcagaaataggttcgccagacgcccgttctccatctcgcctctctctctgcgtcctccttctccgacgaacaagggaaagggaaggcagaactatcttctgaaaagagctgaaacgtgatgctggcgtcgctgcctcctcgcgatgtcgagagcggccgagccgcaaccgccgcggaaaaagcttgcctctccgttgaaagaatctgccgcagagagaagcgacctcactccgcttcgctttgtcctgttctcagctttcgcggcactcgggagcagcagattgacgctctgaacaaaaaacaggcacatgcctctcagatgcaaagacgacgacggcgaatttacctgagaaagaagagaaggcagcaggtctgcagcgctgccagcgctctgtcggcatatatacaagaacaggagggagggtggaaaaacttttggccgcgacagccgtcgcgtctcgcgttttcactgtcttctgcctcctttttctccaagtttctcttcgtttcttcctctcgtcttcttccggcactgccgctgtgtgccggcttgcttgtgaggctttttttcatctccctctcgcttcgccttctagcatccgcgcctgcgcgcgctagcactctccttcggcgggtggtgtgtgtggagttttgcagaggaacgccgcgaacacaggggggcgctgatgaagacaagcgctgctcgctctgaggaggaaacaacagcagccgctgcgccttctctcttgcgtactttgtcggctgaagttcctgcaggttcgcgcgaaagcgagacaactccgaagcgagagctgcaggcgatcaagaggaaaacggagaggctgacctcctcgcgggcagctctgcgaccgcacacaccacacactgtgtccagcatgttctctcagcggggggggagagagaagcaaagcaagcgacccagtagaggaaagagaagaaacgcgagtcgagggaaatcctctacacacaatcaaagagcgaaggtcgccggtgtcgctgctcgtcaaacggcgtgcatgtcttgcagagcatcttcgacgcaagccatcgcgagagctga

SEQ ID NO: 1184 - DNA, 2352 bp, Toxoplasma gondii
gaagagcttgcaagacgcttcgcctcctctgcagctcttcgttttctctgccttctcgcctgtcgtctcgacagaacaggggaaggcgcgagggcctttgtccccatcgattttgtggagtggactgaaggcgtacgtttaggtgaaggcggcgtctcaagagacgccgagaagaagcggaagtcaccagaggcacttggcagaacaggggacctttccggttctagctcaaggggagcgacaggcggttggcccacagaaggaaaggaaacgaagagaggcgatttcctgttttctgcttgtgcgtgcagggggaaatccgctcgtttcccagtgtgagaagtcgagtacgggcgaggagctgccggagaaacagaaccgcgcagaagctgcagagaccgccacagtcgctcacccaagagtgctggggagggagacggagagaaggcgacccacgggaaagacctcagatgtctgccgtcgatctgagcacagcctctttgctgcgacgacaaagcaagacttggagtgaaatactcgtacctaggagacgggcacacacacgaccgtgaagacgaagaagacctttgactcaccagctcggttgcaatgtcttgcgcttttccgggtgtcttgtcttccagaagatcggcagagagtgaccgatcgccgcgctctgcagcataggccgggaagtccctcctcctgcgtggtccgcctcttggtgccttttctcgctctttgtccgcctctcgcgttcgctcggtcggcgtttccctgtcgccttctctcgctgcggcgggggtggacgcacggctttccacgagcgcagaagagaagaagagcggcagtcctgagaggtgggccaggacctcaagaaacgcgttgtcaacttgagatacagagagagaaagaggcacttctttcggagctccgctgtcgtcttggcaaaacgggcaggcagccatcgtgggacttctcttcagcgggaagttgcggaacgaggggctagcgggactggaacagccgacgaatggcgcgccgcctctccatcctcgccttcgacgaggcggttctcacttctctcctttcgcgtagatgtctgggtggtccttttccaagtttcacgcttcaggtccaaccgaatagacatgggagacgactgcgggaggcgttttttctgtcgcgcggagaaactcgtggacaggcgggaaacacttacagggagggagaaactgaggagctgcagacgatccgtgaggggagggaaccgatcgcgaaaaagacgagacgtgagagaggagacacaaagaaccgaggttttcagggaaacagagacgcatcgagcaaaagtgaggacgatcgatgcaagcatgcgtccgcgatcgcacgtgcaggaagactcgagcggtgttgtccccgccgcagtcgactcagacagatcacgctaaatgagggaacagacgcctttttcttctttgcttcaatcaaacaacatatcccctgagcaatctacgcacatcatctgcacacgctttgaagaggggggctgctcgagacggcctcaagaggcgccctagagacgcacaatctcttaacaggagttgcactggagctgcagagcaagtccacgagtctaggtcttttcgtagtgtgctctggtgggaatcgcggaagaatttcagcaaggcaaccttcagagcaatgcctgcgattcagacgagttcgaacttttaagcgcactgtctgcttgaggggaataggacttttttcggtcgggtaggcgactggcaattttttgcatgcgtctgggcgttaacagcgaatgcttcacgtggcattcggtctacacattttcttgtccggcgttttaagacgcatccagagtttcgcgggcatccttctacctcggatatcgaactcgtggaccgacgacgcgagcgcctgcggcgctgcgagagctaggccattgtgccggccctcgacgcacttttcctttcgttccgtttctcacttgttcgcaatagataccacaaagcattccttaaaacgcggaaatggcgcctcgtggatggagagtcgccacacggtgcatgtaggttggagtcgtgtcgcacaatgcgttttttgtagctttacaggcaggcctggtgtgtcagcttcgtttttcaggacgtactgcaaagaatatgaagaccctaaaatacctaaataagagctgacgtgaattctaacaagtacatcgagtcgttcttctggacgtccatggcacttcgcaaatcgtccagcgagactgagtcgcacctgcgtcggctttaaagttttctgaggggtttccgaaaaaacgaagaa

SEQ ID NO: 1185 - DNA, 1678 bp, Toxoplasma gondii
atctgactgatctccttgaagcagctgagctcgcgacgaagatgccactgtacggtgttccctgttgaagaccgcatgaggtgaagtcgcgaagctccctgaagaggcttgatggacggcgaacgtagaaggaatacacggcgccggaacgcgtaaggatgatggcacgccaaagaaataacgcgcaccagaatcgggcactgacggccgaggaacccagcagcaagaggaagtgcggggttgaaccgcctcccgttcgtgtttgaagattttcctagcatgcatcgttctgaatgccggcgctgagaaaggttggtccaccattggaaggcaccacggcaagcttctatcggaataaagcgcgaatttcgtcgagaattcgttgatttctgggtttaactcggtagaactgacaagacgctcctcgattgtctggtcatgtgcagagccaaacttgccagtcaaaggcgtcgcagttcccgcgtacctccaccggaaatgtgccacagcatctatcccgtcttctgcctcaacggcggcaaaaggtgctggtatcatccgcgttcggcgtcgaaaaagcgtccatttccgcgaatctcgacttttctgcctcgccttcctgaggttgccttgcgtgcgcgcttgtcggtcccgcagtgaggcaagcgagcgaagctgctggagaccactccaagcgctggggccctttctcggcggactggccgcagttggcgtgcacgtagctctgaaattcatcgctggaacagaatcgccaaccccgggagtaaaaagcgccagtccgcaggcagaacgattaagtctgcaggattcatcctattgtgcgcaaaaatgcgtcggaactggagaaagtaagtggttggctccagaagtcggcacgagcggacctcacggaagccgaaaactttcgggtgtatgtacacgcagacttccacttgcatccagtgctgccagcgaggttgtccaaaatatttgttcttgccgcagttattagcgtttcaacgaggacatgaatggttcgtggcgtgcagaacacaggaagaagggcgcgccgataccgatgagctgccgcgtaggcgaccatgcacatggttatttccagctgacgtttgaaaaaaacgcacgaaatgagcgtcctgagaagggttgtacgcaatgaaagaagatgcaagaccgggataagagaaaggaggaagagaaagctggttgaaacgtcaaaacaaaaggtcacaatgcgtcagatgttcgatgcgctgtctgacatttccgcgagcgtgacctgcccggagttttcctgtccgtgcagcttgtctgaaaatggatcaggatgggaaattcagacaagacggacaatgacacagtcaatgacagtggttttggccacacccggcgaaaatcgaagcagatttttgttgagtcgacctcgacggtcgactggggctgcatgcacgctgcatgcatgttgcttagaaaacacggcagttgccacacgcacaaaccaagtggtgaaagcatgtagcatttagcagaactccatgggtaagatttttgaatgttactgcagcaggcactctctgaaccgtcgaagtctcctcttctcgggtagggagcctgtagcgtgtcgccctccgtccgcgagtgagttccggtactacttgaa

SEQ ID NO: 1186 - DNA, 1603 bp, Toxoplasma gondii
aactctggaggccgcttctcgcagcagttcgcttctttctttcatggggagtccggccgcgaaggcgccttccgatcccgaggagggaccctgcgaggaacaggacggcgggaggtaccagcgcgaaagccggaccttgccctgtctcgacaccaagaggagaaagtgaatcattttcctggagaacgcgcagacgcatgcgaagggaagaaggcgcgaaactgcgcctccagcgacggggacagcctgtgtgtgatgaggcgaacaagaagtctccgttggaaaccggagaccaagaagatgggggaagccgaggcaaagatgaaaaacttggcagccgtcagcgcagtcgcttctcttgccgagcgagcggcagacacaggagaggcagatgaagaccagcgggatggggaggcagtacacagatcatgtgagaacagttgtcgagaggaaaactctcctccggggacagcgcgcgcgaggccggaggacagggaaccgttggttcctctctcaaagagtggagagacacacagtgacgaagcgaaaagacgaagtcaggcttggagactcctcgcgcgtcgaggagacgcggcgcatcccgagaacgcgaagcagagaaagaagtcgcagaaggaagaagtccgagacctgtctgtgcacccgatttggtggaaaggcctcccaacctcgaacggaagcgcgcgaaagccccagacgccgacgcggcgttgaacgttctctgaagaagattttcgctgaggaaaactcgcagtttttcaaccgaacgacgtcacctgcctacgcgactcacacacaccgcatggccggccgaccagacagccagctgcacagccagctccggctcgagaacgagactgtgcgacacctgggcttttccagccgcatgcgaaaagaggttttggacgcaggattcgttttgcgaagcagcaaaattcgctactttcctgaatgcggaagaagacaaagacgcccggaaccgcacagtcccggcggtgtgacaaagggagagagggaagccaggcaagacgccgaaccggcatctgcggcaagaagcgaagcgagctagaatggaagcctgaaaggttcgttttttcgacaaacacaagcgctttctctgcgggtctgcaccgaaggcgacaacggagctgagggtctctctagcggtgctgctgcgcttacagaccgcggcaggaaaaacgacgaacgacgccgtcagtctcacgacgattaacagcgagccagctcagaggcacagaacgatcatctttgcagtgtgtgaacctaactttgttctgtgttcagagctggagagtctttcgttgagacagctgggcgcgtgaccggagcaggccgttggactcgccgaccttcttcgcgttcgagagaaacctctcgcttgttttccggaaaaaagccgagaagacaccgcgaggagagccggattcggacctcgacgaacagggaattaccctgagcagatgagaaaaaacagacgaagccctgcaaagaagccgcggcggaagaagacaggcggcgcacgagggaggagggggggctgttgacaacacagaccaacgca

SEQ ID NO: 1187 - DNA, 2878 bp, Toxoplasma gondii
gatttgggtctgtttttcagtcgcagccactgtacatgacttccgacgcatccacggcgacctcccatccgggcgggtacgcgccgaacatgcactttgtctcgccggtgaactcaaccaagacgcctccttctccggcagaattttcgggttcgacttctttgaagcccagagagcagctgccgctgcacgtgtaccaaggggatgttcaggatttctcggacctaaaggcgagtaatgggcagcagttcttctcgtacccaatctccgcagccacccaggcggtgtatgtacagagtgctgccggcaacggtgccttctaggtcagcccgacgatgtgggtaagatggttttcgagtttagttttaaaggggggagaagagaagcacgaacagggaagtcacagagaatgcaaacacctgcgtcgttacctcatctaatctacgagccctgtttccttgagacggataagtggttttcgttggcggacacaaacgccgtatggagcggcgaagcgtgcaggttttgggaaaggaagcaggtcaatacagtaggcatttacgctttctcatctgctgttttttgttttcgttttggaagagtaaatgacacaactgtggggaggagaaacgctacgcgcctatttcatcgccgacaaaaacgcacgatgagctttagacatctttcgtgaccaaccgtcgcggtctctgtgtgcctgcctaagctcgtctaaagtggggtggacatgcgttgcttgaatggcattctgtgtcaggagttttctcctcacggtcgccaacgccgcattttacgtaaatttttcgaactttctggtcctccgtgctccggtacccccacccctccaagtgaatacaacatgaagagattccaaaaacaaagagggcgagaccgaacaagggcacacgccgccccgcattcgggacgggcaccttcgtagttgaagccatgcctttctgtgtttcttaccataaaatgtggtaaacaacttgcggttcgtttcttccggcgcaagatgtcccagctgtgagtatttcactttgttgccgtctcaaggtggctgcgtgcacactaagttttttcccctttgttgtctccctcgtcaaaccgagggggagttgtccttggcatctgtgctacttcttgcctcttgcgcttttcggggaaaagtcagatctgctgtccgtttcatgttgcattaccctgtgtgacacgcacgcttctcaggctagggatgacaagtgtgctggcaaagatctttcactttacccttttctgatgtttgaaaaatcattccccccggctggggttttcatcggcagacaagcttgagcaactctattcatacttctcatgaatgcgaccggccgttcactacaaaccacatcttcccacaatacacacatacggatgttgttgtgcgggtggccgctgcaaactacgcagtttcaggttactgagagaacaccgtactccacaccatggggaagaataaacacaaatgtctgttcgatatgccgcgtgttaccctggaataatgtgtgacaagcacctaacacagatggccatcagcatgaaagcatgtaatcagttctgttgcggcaccgcacacgatgtatttgtgtaacttacgcatcccatgtgattcaaaaaaactgagggacgaacgactccgaaacgggcaggtggtcttcacattcaagtcttgctaggaagctatagcccacctcggcaacggcactttcgcaccgggaaaaacacgccagcgaaggcatgcctcaaagggattcaggcaagcagacacgcagtcctccttgcctctccggctcagaaaacctcatctgttcagttaacacgacaggcttgtcaagcccaagacacaaaagtcatctccagtgccgaaaaaggataaatttgcttacgccagagattcagcaacctccgacggcagtatctactttgtagtacagcagaaggcagatggtctagctacgatctccatgttcttattgaccccagaggatttggtaacttcttcaaaccattctatgttgggggtggagcatacaactgtaaacgcagtcgcctctacttcctcatctgtcacgtcgccgatgtgccagacttcccggataagctggaacgggtgaatctttgttggcgttttcgctgcagcacgcagtctctccagccgaccttagtgtcggtgaagcttggctagtgataaaccggtaccggatcgccgttgtgaaaccgtgccagtgacttcgttcgagcgcaaggttgttcgtttgcgattgcggcgtttctctctggcgacgtcatcaggcggttgacatttcaaactaaagtgtcaaaacgaagcttccagcaagcgacgatcagggtagccgaggaacaccggcaaactgggcgggtaagttcgataccgtgcttgcgtcgcaacactaaccgagtttggagggcgtggtgtgggggttttgaatttgcgttcagaacaactttctcgtttgcattctttttggcaatattgatcaatgcaagctaacatcgtggtgaactcggaccgaaacgttcgctgtgtctcgttccctagtgtgggcctcggggagttcggtgttggaaggaggttgcggctggtcgcccgacccgaatccctcggcattgttttggttgtggagtaggataaaaagttgcgacgagcttcttttcggtacaattttccacagagtaacgttttgtagcgttgacgtttttcgcttattttcgagtgaagtgagtgtggttaacacctcgggaggcgtctgtttgctctctccagatcttgccgtttcaacagcactcaacgtggtggcaacga

SEQ ID NO: 1188 - DNA, 3579 bp, Toxoplasma gondii
ttcgattttgcatgtgtctctcctttgcagagcgaagcggcgcaagcccctgcacaggtgtcctcggatgccgccaaaggtgccccgacgaactgaacgggtgtgtggagactggggaaagtgggccgcatataagccgaaagcaacacatagagtcgtctgtggaagagactgttcgtccacgtggattcgcgcgaggtggttttcgcggcggaacgtagtgtcgagcattttaaattgggtagacttcgactctgttctgcgctcctgaagcaaatgtagtgtttgagtggggcggtcctgcgccaggcacacgacaaaagtccgtttaacagtctgtttgctgccgtagtcacagattgctctcaaacacgcagacataatgtgtgagtgtacactacagaagtgcacacacacacctatgtgcagttgtatagaataggcatgtacgcataggtgtacacatcagaaaaaccttgcccgaggcggcgctgtccagaaagacagacaggatgcagaaaaggtcaggcggtggtaacaattatctagtatcctctcttgtctcaagcgaacttttgattcgtttcctgttgagacccaaacaaggcgagtacggaaatgtgcgcgtttctgaaagaacgggaaccggcggtcatcgcgtgcgtccggttttttgagatttcgcgaaatgtgccaggcaaacagagctagcccgtgaagccgttgttggaactttaaactgtcaacttgctgtcgagtgcgcattgtgtgagcatcgatacttcctagctggaacggaacgctatcgcgtacggcatgccgggacatcagaacatccgagaaacgaggtgtcgctgcaggacggttgcatacttgattcagtttttctattcgaaagaaaccctgtcgaacaaaacttgcaaaattttccgtcccaccgaaacagcacgcgaactgcacacaggaaataaccttcgtctttaaaacgtgcgccgaaaatcgcagttcctcttaaaaactgacacggattatgcacacagaaaagctcaaactgcccatactcagacaagttccgtgagacgaactcggtcactggtcaacccgaaacaaatgccgagtgtagtaaaggagttcgtcgatgctttcatgtatgtcttcgagtgcgcggtggttggccgccttcttgaccagtggcaactcgggtttccaccgcatcgcgagttcctttatggtggacacatcgattattcggtagctgagatgtgctatgagtcggggcatctgtttcacgagaaactgcctgtctacgtgcacgctgttcccacctagcggggcgacgcgcgtcgtcgcgacgtgtttctgtacgaattccagaatttgctcctcagcatctgcgagagtcagagtcgacttccggcaggctgcagttagccctgactccccgtgggtctttttgcaccattcatccattccatctagaagttcgtcactggcgtgcacaattaggttcggtccaacgatgcgttttttgcactggccgtccgtcacaatgaccgcgatttcgattatttggtctgtttccacgtccagtccagtcatctcacagtcaacccaaacgatgggagcctgcagggtctcctcatcttcagttatcgtaacagctgttcggatgggggctatgcggtttgcatcctcgctcgagacgctcttgaagcgcgcgggtgcctccatcatgccctccatctctgctgaagcgaactgtgaatgaagtgagtgaaagtggaggtcgcacccggtcaacaaggaaagccccaatttgtcgactcttcgtgaatgggcgccgctgctcgcagtgaggagtgcgggagtgttttggtgatagttcactcgtctcccgtggcagggatcgtgaaactctgttctggtggaaacgctcttgagcgacgcttggtagagaacaggcttttcctcgaaggtggtaaaaaacacaccgccgcagcgtttgctccactgcgaccaattcacttgaaacgaattcgtcctacgcggtccagacaagcagcgccctaactcacccgcgacgcagtcttgtgagcggatgctccgactgtcccacgcacacaatggatgctttaacagcaccgttgatgtcttgctcaaaggtgggtgggaaaatctggggaacaaacgcattccaagctatctcggggaagaccagtgactgcgaagcactgtgtgcaagtctcccccaagcaacttgcatggaaagctgaagccagtggaagtttcagcctttgctggggctcttttttgggacaatatccgatccttacgggtgaaccgtgttttagccgcccgcgaggtcggacacactgcgagaaacaacacccactttcaggacatgatgcaagaactgtagctgcccttagcgtgttttcatcccttctgaaaaccacaccagtccacgacaggagagatgcgacgctacacacggacaagtggcgacgcacacactcgacaagttccaaatgcgaagaatcgtgtgcgcggacaaagagccgaaagttgactgctgtttctgctgcagttagcacgaagtcgaaaacagaagcaagggatacacacacttgaactcgagaagacctgtcaaattttctcggagtttctcaaccctgcaaacttgcgtggggccgggtcgttagattcccccgctgtgcaacactgcgtgcacccgcagtcgacaaaattccagaacgcgcagaaatccagtttcactatcactctccctccaaacggcaaatacgacaatgtccattcatggtgacaatcgaggggaggagagtggtcgtcgagtgccaccgttgattcaacagccggcgctgcatgcgtattccttgaatccctggaaattgagatacacccggggtgacctggcctcggtgaattcccaattcggcttggtcacacgtggctcctaaaatttttcgctacccttcgcttcatagcataagtcagctcttctctgcgggatactgcatccttgtgtttgcactagcataactgctgatgtcctctgcacgacgattcgaagttggaatcattcctgaatgtgtcgagaattcccgcctatgcagaccctgtttgtaatttcctaaagcgaagtaaagtgtagacgaacggactccgttgttttgtgatttgtatccttgagaaactgtcaagagcggagagagtcggggagacggtgacacttgttcccaagtttccgttccagcatgacaactctgtggaaagtgcttttcaactaccgcatcctttacttggggtgcagccggtgcaattgataaaggtactccgcatttgctgaggaagcatctgtagttcctgtcgatctcagaatatggcgtgctgcacagcggtgtgtcttctcattacattgttttcttgggggttgggaaacgcgtcttcatgtgtttagagggaaccccccccccagcaatcaactagcgagtggcacatacccaagcgatcgatccgaacacgggaccgcgtctgcttcttagcaaagacggcccacca

SEQ ID NO: 1189 - DNA, 3628 bp, Toxoplasma gondii
agactcacgactattcctttcgcagaaacgtagctttcctcagtctggacagctgacgtggaagcctgtgtcgacctgctcctttctgcttccaggtgcctacgctctttcgcagtttgcagccaccaaactgcatgagaaggcgctagcggttcgcacttcgcttgcacaggctctttctcgggtgatcgatgagtctgaggttctcctttgggttccgcctgccaagcaaagtgctcggactgaagaagtccggcatgcgtcttcagaacctgcccctcacgcgaaccccatggggactgttggcaggccggaaaccgaaccaccaaacaggacacccgccgcttacctcggcgaaatgtggatgtacactgctgcagacctgctgggtctacctttgcttcaactcccctgtggcgtcacgctgctggggcctgctggaaccgaccgagagttgcttgaggtgagtgcaagcgggtggatcgccaagggcaccttttgggcctgggatgaagtgttggagcgtgcgattcagtgagtcggcggttccaagcgtatagacagtaggcagggcctcggataatgtcgcacagttgggtagaaacgaaatgaagtggggactcctgccaagcttcgtcacgtagcccagaggccgtccgcagtcgtcttggacgcccagatggcgtctgcgtggcctggcgaaagcgaatgaccatacagagatctagacaagagatattttacatcagatctcttcatttgcgtcatttcaagtgcccgagaaagattgcacacgagttggatgccacaacatgacgcgagaacccgtaaaaactgggtgtctctggtagactctaacttcactgacgcgctagtatcactcttcttttcaggtggcacagaaactgacgagccctctcacggaagctcgtcggatgaatttctggtcggtatgactcgaccaagaggtgtaacggaggcggccttctgattcagcagcaggaccagcctcccgtgggcggcaatagccgctggtaactagagtggagacggaaaactccaagaagctttcgtgcgactgtggtacgctgccacttgatggtctttgctacctgtctctgctgtccatattcgtgtttacgaaaagaaaactgttcgttcgcgtaggagtttctagtgtttcaagtagctgccacaggatgatgacgcaacaaccattctgtttctgtgcgccagttttgctccgaggtacggcagcaggaaagtgtcattggagcagggaaacgaaatgtcgacacaggcagcctttctgtgtgaagacactgcaggagcttttgggttcgtcactcaatgatatcacgagggcttcgatgtccaaaggccactaattcgtcgatacatgcgccaccgttaattattgcagaccaggagttccttatcactggaagtttcccgtgtgtgaagaggaaaagtgctcagcgaagtggaacaagagacgggcacatggtgcgtgacacttttcgcggtacttgtaaagttgacggcccggtaactaagaagacatttgtcccgccagctgtaggccgtaatagggaagtgccatgtggcgcctgtgggtttcgcagtgaagtcaacgagttagcaagcaattgatttcgagccacgtgggcgagttctggcccacatggtacgcagtcgcattggctgcacttcaagtactgacaagcttcaggtaatgatgtacatcagggattgacaaacttcagagatcctctctggataatcctttccttaatgccgcaccagggtgacgcggcgtgtgggaccgcagtccctccctcttgtttcctcactcaaggctggacagacacttcttgatcgcccttgacgttttccactactgtactgccctgcccagctttctcaaatggatgtagatatcccagtccgctgtatacatgggctgcggtctttctaaaatgaggagtctcaaaatgccagcaactagcattttctaaaactcctgagattcgttaccgccacttgccataacacagccctcacagccactgcttgactactgcagttgagtgccgcttcaaatggatggtacttgaaactgtgcggcaaaaaagaccaaatcgcgtcgatgtcttcccgctcctcttccagggttcgaacctgcagggaagaagtgatatgcacaacagagtaaccctgtgccacacgatcttcgggttgtcacactgcgaaggcgcacctctaatttacagcaccagcgctaattgtaagtccaattatggcggcagcgttcgggcacactagactgtaccccgggcaatcgtttaacaacgtggcgcccacgtataacgtatccagggacatgcatccgttaagtttcacgaaacccacgagcgtgtgcccctgacggattagcaaggcacgacgttgctgcttgacgatatgcgacactctcgaggcttcaacctcgtcctccggtgtgcttccgttccgaaaccacacctgctgctaaagctactcgacctagcaactcgcgatgaagcacgatgtacgagtatacgtcttaatccagcgacagcctcaagatttcgcatttgactagttgctcacccctggtacacttaatgttgaccttcgactgctgtcgaagttggggccgccgaggtcgcccactggtcaacttgctttgctggttgcgggcaagagtactgaatgggcttgtcgccggttctctctatcaggattctgacagttttgccggcggcacggaaagcgtagtaggctgcctgcggcgggtcaagttcgtacccagcaggttgcaccgacagattgacgaccggaccctcaacgatgtattgccgcgacaacggcttagtcacatgcttttccatttttggtgtggaaggcggggtaaacaggaaggttactgcacacgctgccgtggatactcgtgaagcacttcggctttgtgctgacactggcagtcgcaaggcacactcgccgaaactcgccgatgaccgagtgaactgtttcacacaactcgaggagttcccgtccgactacacacttctgtagcaacgaaaaccacgaacaataccaggagaggtcgggccgtgatgaaggatgaaatgaagagatgacagaagctaaccgtcatgttaccgtaacgcgaaaacggtttttccgggaaagcctgagcacaggctgcaagctatgcgacgcccggcatgtgcagcccggttgtgtcgcgaaagatgcgtcgatggagacaaccgacacacgcttcgctcgtcccgtccctgaaggaattccgattctctcccgcgcacgggaggcaaaagccagcagagcctgcctgcacgagtcctctgcctcctgttggcacaggagtgctgtgttggcacacttcatttttcctttcagcacgtttcttccttcattccagaagtccctactactgcaaggatttcttttgttttccccccaaaggtatataggttatcggtcatcttgaccgctgcaaggcacaaatcgacgccagtgctacagcttgctcgcttgcacgcgtgtggctagcccctccagatccccactcgtctttccacaa

SEQ ID NO: 1190 - DNA, 863 bp, Toxoplasma gondii
cgtcgagagggataaactatccttatgaggtcctgtcacgattgtcttccatctcgctgggcatggccgaacacatctcatgtggagatatttttctcctggtactgccacccatacagcgactgacccacaatcacggtgccccagaaggcattgaatgaagccgatcaactggttttctccgcatgctgactcacacttgaacatgaagggcataaatgtatgtgaactgttccgcctttgcacatgcaacttcaactgacaacagatatgcggcagtcatactaatcctactaacgcccgaaacgaacagtatgcaagcaacacgaacgaaccacttgggggcgcacaacacatgtaccttcagcgtcctgaaatctacaattgcccctcgaaaagtgtacagtcgacacattatgagcgtgggcagccataaacaatcaacactggtgcatcagcgtcattttttccgcccttcaacccgtgggctgcctgtatgctcgcgacggcaacctttctgcactccctgaacgatgaagaataaagggccccgcagaatggttaggcattccgtgtctattaactctccatcaactcattcctgtccgccgctgcacatttcaagacatggcatgcccgctggtgccgcgacgccgatgagggtcagcagcggagaacagacgaaagccacaccatcccgacccacgcaagacgtacagcagatttcccaccatctacttcgacaaaatgcttgagaaaggtacatcaaggcgccgaaatcatttgtccaatgaaagcaggggaaaaacaaggaagctcaaggagaaccactcagcaatcgtgaacccccaattaacttgaga

SEQ ID NO: 1191 - DNA, 2123 bp, Toxoplasma gondii
ttctgtgctgcactgtgtcagttgctggatagtcgcatgaagtggatgtgaagggtaaatggaagttccgttgctgatattcgcaatatgaagactgcgtctctcgtctttcctctttgctcactgaagatatatagcgtttgggtacgatgcgtgtgcggatggtggatgttttcgtggaatcctcggaagaaacacctcattgggtgttaggtgatactgaggtgtactttttcaagcccttcaaaatctactctatcaacctgcacggacttgtttccgagcgtcagcttttttatgacgcttctgaagtcattgccacagagaacgaaatcgcagtacgctttaaaatggaaggttccccttctcacttcgtcgacggaacccatcacatcgtcgcacctgaaagcattttcttagacccgcttgattgtagggagtgaagattcacaaggtgaaacgtagacatggacaacccgcgttcgtgtggaaccaagcacggcttgctatgaacggtacgctaaggctgtagccggggccgctactcgtgcttgcccagcaatggcgagatggcgagcgttttttatgtcctgaaaagggaactgaggcccctttcaggatcccatatcttcttcctaattctgcagggggtgtatgatgtgtacgcagtaagacagtgccacagagtcgtattcaaaactgttctgagtaatcggaaccgctggaagtctgccgctacaacggaaatcgaacatgcgaagaaagctgcttgattaacgtccatatggaccacacggaccgcgtgcagtactgttgtaaccagagtcgaagtggctgttccgcgatgctgcgtcgcaggcactctgtgatccgacttaccttggtttccgtcttctaccccttcgtcccaacttcgcatttcctagtttaagccgccagccctttagtagcaagcttttgaaacagcgaaagccttcaagaacgtctgtctctcccataaaaacatgccaaggttccaagaccgcgctcaaccgagacaacgtggcacactcaaagcttcaacagtgtgttatgcaaataggagccacacttcaaccatcccgagcaggacatgacatctgcgaggatcgagcttacgcccagaatcaaatgtgaccagatgaaaaagccggtaggcattgttatcaactgaatgctaacgccgttggctgcttggtcgagcagacagccacctacaaaaggcatttggcgtttagctcttcaattggcacttgtctgcgctggaagtttcatctttctcagctttctctgcctcaatgtcggttcgactatagagctttttaaaggtttccaaagaaaataagggttttctgtacgttttctcacagctctcgagggctgccacgcaactcgcacagcacatgcgcatgcagccctacaggaaggacgctgtcgtatctacggaagtgaccaacagcagtttttcccggcatgcgtcgattcggcagctgcagttgacctgtctccctttttcgccattctttttgcttacagttcgaacactgacttctagtctagcgttctgccacagaagcgctttttcagtacctaattgcgtcatgtctacactcgccgccaacgggtaacaatttgttccgtctcctggcaccgaaattctatgctcctcggtctgagtcgctttgcagtcccagtagcatgtcacgtctgccaccgaacgacggcaactcagtgctgcacatgactcggatatgttgacactgtctgagcgatttgccggcgaacatcccggtgtagtcaaacaagaaaacgccgtccctcgtctcgcgctgcctcagaaacattctctgtgttcggtcttgaaatgaccggtctctcagtccgcacaaagcgtggatgcgttcgaccaagctgcgaaagcactgttgggtgtggggtgaccaactgggaactgtcaactttccgtgccactgcacgtgcgctgttcagtgccaaaggggaatgccgcgagcctttgccgacgtttcgctgattggtggagcggctcggggtaactccgtcctgccttttcgcctattcgtgttgcgtcgctgccctcgctcaaa

SEQ ID NO: 1192 - DNA, 3833 bp, Toxoplasma gondii
agccggcggagaaccagtctttcgctgtttcgtgggcaaggaagtctccccaggagaagctgtgcggcctctctgatctcccgagctctctgctttcggcgaaagatccgctcttctctctcccgacgccttcttcccgagtctctctcgcgacgctccgccctctgttccccgcgcggcgctctctctcgctagaaacctggcgccgtcgccgggttgcgccgcgtctctctcttcgcgcgtctcctctcgcctccgcgcgagttcgtccttcaggccccgcgcctcctccgtccctgcttccccgccctcgatgcctcgcttgactgcattcaccacatccgcggcggcgccggcgacggaggccgcgagtccgggagcgaccgagacgacatgcatgagagagcgcgctgtgaaggagagttgctcgagaacgactgaggccgtgatgttccccaaagcgcgacctttctcctccacgctcagcgggacgcctgcagcgggaggcccaaacgggatgggccgccctcgggaagcgagctcggcgccgactgccagagacgaaggggagacgggagacaccgtggactgggggaacggagacggcgcaaacgcgagcgacggacctacgcgcgaaacgccctccggaacgcctgcagcgctcggccaaaggagagagagctctccagagagagctgctgcggcggtcgcggcgccaggattttgcagacggctcgcgaggtgcgggtcgagttcgcggccaccggagagagaccgagagaactcagattcgtcgccactcgaacacgcgcctcccctctccgacggcgcgcgagagctgaacgccgaggcgccccgcatccgtggactggaagatcgagacgcctctgagtgactctcgatgatgcggtccaccacgccttccataaatcctccaatcgcgccgacgaccgctgctccagcgttggcggcggccgcacccgcgctctccgagaagctccgcttgacgcccttcgctttgtcctttttcttctgcctccgccgcctcggctgccccgcggtcgcggcgaagcgccccgcgcccgagactcccggcgaacgcccgcgctcggggccagaggcccgccgcgagtccctggccgggaggtactggcgcgagggcgacagggcgagtggcgaggcggcagagacagcttgggcgccgggaacgggtgaaggccccgcgaatggcgaggccttgaaactgccggagcctgggatatacacctggccgtcgctgaggatccgtgggctggctacagtcggctggagacatctcgagttgggactgtccgccgcaaaaaccgtctgcggccactgctcgccggccctcgggtgtgtgtacatccgggcatctggcgatgtcgcagttgcaggtctctccgagaaggcggagaaaaacgaggagacgatcgagggactcgcgcgagtcggcctcgcctccgcgtcagaccgagagcccgcctcctctccaagagtctcctcggtctcttcgcggtcgctgtcgctttctctgctctcgtagaaggcctgaagctcctcgccccaccggccaccccacaggcgcttcttcctgcccctgctgcggccttcacggcgcccggagaacacaggaggcgccgccgagccggcagtcggatggagacgcgcgcctcgttctctcactgccccctcgcctccgcgcgtgtacggaccgccgttcgccgcggccgacacacgggagacaggcacccccaggcgattcgcctgccccagcgacggcgagaaagagcagggcgagtaggacgagggagagcaacgcgtgggtagcaaccgagtacacttttgcgggcacagtgggcggagagaagcagccggtgggaggggagaagcagccggtgggaggggagaagcaggtggagcatgggaaacccccagggggaggcccggtgaggcgacagaccggggcagatagccctgtgtctccgaccagagctgctgctgagagcgggattcggatgcgggcactgccctcgtgtagagaggggtgggggtagagagcgagggcgccgcagaaaagacaactgagggagccggtaatcctccctgtgacgtgaaagtctggctggagtcgacatgcgagaagccgactgtactggggacgtagaggaacttgggctcggattcctggcgggcgtcgccctgaccgagagcctggacgcgcggctgcgtctggcggcggagagcgtcctctctgagccgctggtgcgtctgcagcagctcctcctgctcccgcgacagcgtctcgccacgaggtgcgagaggcctttcttcctctctgtctccagcaccgggcgagtgcgaaggagagcgtcctgcaggggggttctgaacggacgccgcgagagactcagacggctttgctccgtgcgcagcggtggcgtggagcgcagagatgttgtcttgtctgcatgcgctctgcaagtcctggaacgctggcgaggcgccctcgacggagtgtcgccgcgagaagcagggcgaagaagcgccggcgccgtccatggggcgggcatggaggaagagcagagaccgtttgtccggcagcgacgcgtcggagagagaagaggtgaggacaggaaacaagtccaggttggaggaagagtcggtcttcgacaggggagaagaacctggagggtgcagcgtcttcgcagcgagacgggcgcctcgctctctccctggccgctccatttttcgtttcttctgaagcagcggaagagcgaaactcgcgcgagacgccagcacgagccctccgacggtctgcgtacgtcgcgcggctcggcagtctcgagcggcggcagaggcaggaaagctcgagcggaggtcggagtcttcgtcgagaagggagaagagaggaaggagaaaggtggttggaaaggcgcgccagggtgtccgcgagagagaaggaagacacgagagtcgtcagcgcgctgcggcaaagcgaagcgggagaaaaaagggtggcgagaaacttctcgggtgtatgtacacctcgcgtcaaggtgcggctttttcaacaaggcagaggagagcgcagagaaccaccggggagtcttccaaagcagccgcagtgcgcggtcgcggcttggccagtggcgaacgcgacgaaaaacctgaagtgaagttgcccaaatgcccgtggagtgtggagaatggcgagtctcttctcctttcggcgtttcctctcggcgccccgctgccgaacacaagttcgctgcacaagacacgctcgcgcgtgaaggggggcgctgtcgggcaagggcagcggggcgcgacacagaagccgaggagaggagacgaggagaagtcaaggatttgaagaagagcgcgctctttcgcgcagagaaacgcctgagcagagggagaggtgagatggcctcgccgaagcggccttgggggaacgggggcggacccggcgtgcgagagaaaagcgaagaaggtgaggagggagatggagagaaaccggggtgcttggcaagaaaaaattcggagccaagacgcaactgagagaaaagagtgtgcgtttgtcgaaggagaaacaactgccgcgaagcgagaaatgcgaggcctcgcaggcgcgcgccgcctctgccaaaaacgcgaagacggaggggagtggccagctgcgagcgagcccccgagaacggcgcggcgattgacgctgcgcagagcgccggatcctcgagcgcatgtctttatcgtcctttcttgctggaatccctgaaaaaaaacgacgagccgcgcagagagacggcata

SEQ ID NO: 1193 - DNA, 1392 bp, Toxoplasma gondii
gctcctgaacaacttacatctctggcgaaggctgtcaggacgttctgcgtcaccaaaatcgccctctgtatatttctttcctccattcgctccgtaagcctgcgagtgatcagcacagatgcaagcgaatatgcctggaaagcatgatactggcgactacacggtatcgaagtagacacgtagtgcgctcagccactagtgttcactcatcatatgcactgcgatccaaaagtcccgaccgaacacttcagcaaatccgcggtgccaactgttgggttaggacctactctctgatcggcttcacaccggtcttctttgtctcatcggcaaagtagacaataacccgattgtcaggatctactttgtgtgatgcgattaaaagcattcgcgaacggctgtagacagtcagacagggaaaatcacaagaaaacaacgccgttcaattcctaaacagcatgacagctgcgaacccatatacgccacacaggccgtcttcacgcagctcggctcttccttggcggcagtcaaaaaagagactacattcaacagatacgtttactcttcgattgattcttcgttgctccgtcttacttgcactcattctctttgaatctctgcagaaaatcattccacgattcattcttctcctgtgcggacacgatgtagccgcggtcctggagcatgtcacagcacgtcttccgtgctcgaaatagtcttcttgtgctgtcctccatcttctttctcaaaggcagtcaagtgtcgaagggtcagtccaatttcctgttcgtcacaggacaccctactgctgttagtaccgcctcatcatccagcctccccacaagttaaaccatgcccactgaatcctcagcctccgcacggcagagttgctcctccgtaccagacagattggttcttagaagtggtatcgacaactctgttgaattcaaaacattctggcattcattagaatgaccagcaagactgaacgttctactcgggtatcgatctgtggtgtacccacgcgccacgcaggaatcaatatcgccacggtggatagtttgcaccgaaaaagcgacacgcaaaatggcacttcgataaattaccgcaaaaaccagtagaagaaactaaatttgagcccgttaagtttgcggcgttcgcccttcgacgttcaacgactgttcgcggaaccgacggtgaacgctgaattgtcgttacaggtcttcggctggcgcacgcgactttgcatgcagaagctatgcgacaacggccgtcctgtctccagacacgtctcctcgtcgcccgtgggaagaaactcaaagcaaaaggtgtctccgcagcaatgaaggcactgcatatttgacataggcgagacgctgttttcaacggattgga

SEQ ID NO: 1194 - DNA, 2444 bp, Toxoplasma gondii
ccactggcagatgaagggaggcagtgaaacgcaagatagtctagcaagggcctctcaccctgcacaggacagttcatctgaagctcccagaaaccgcgtctttctccgctcacaggagcctgttgcgtttacgtgtctgagtcttcgtgcctcgggtcctctcacacttacagagaagacgcacttagacacagcctcagtttctcttcaggttgtgtcagagaatgagtcaaaagtccagttaaggtgatcggcggcggctctccgccggggctcgacagccgtctgcgaaaaccgcgacagcatgcggctgaaaatggcaacttttccagactcaaatcgacatctgtgtctctcccttcgagtcgagttgcacatgctgcttcgcgaatcctttgtatagagaacaagtgaatggcgcggcccgctccggccgcgggggtgtccagacactccgacagggccgcgtgcgacgcagcaatttctggctgagacgcctgaggcgttgtttgccatctcgaacttttcggatccctgcgaagggcacgcagatcgcagctgaagcaagtgttgccgctgtcgcgtgtggagtcgaccgtgtctgcgtacaaaggattcaccgtcccgcgcggtcgaaccgtttaaaatttgcctctaaaggcagcggaactcaggcggttgtgtggaggcggcgggagcgagccttcgctgcccatcgggatgcgtcgacaaagttgacatgtaagactgtgaaggctccgaaaggaccttacacaggtcgccttgctaactaaagttcaacagtttagtgataagagcatgtgactcgagagccgcggaaacagcgacagaaaggaattccggcgacagtggcagtcgtatcgactgccgtcttcgttctcccacaaaagtgcgcgagtgtgtgtgaaacccggcgcatgtgtagccgtgagtggacaaggaacagctcaagctccgcggcagatgcccgaggagccagcccacagaggcgctacgagagaacgctcaattcccccgcggtctctacacctcactccttacagatccgagtgtatcggtgtcctgcaggctgtgagggtgcctctgttctgcgctggctcggtaccttcaaaaggcctgtcgcttctcaggaagctctttcaactcagcgcactcggggacgtgtgtcaagttgcatgcgatcgtctgtcgctttgcttttcgagcaagcagttcagtctggagtgtcgagacagcaaggaaggcagcgtgtgttcgaacattcgaggcgtctcgaagagagaactctttagcacacttggcacaccgaagagacgctgagttctccagcgaaggcattctcatgagattctccagaaaacggagaaaagcagaaaggctcttttgcggaaggaagctgtctcgggcgatcgccgctgacattcgcggggctcgagtctcgaccgtttctcccagagcatctgcgcggcgcatgcggggtcgcttgtcttcgtctctccccggtgtgtgtccgtgcatgcgcgaacagaggtcgtttagagatcgcgaccgcgagaaaaggggacaaggctcagcaccggcagaagagtggaaagcagaacaagtgaaaaacggcgaggaaaatcagcgaagcctcgaacttctcctctagtcgaggagaaagggaggccgcgtatgccgcacgctctcccggtgcccagcacaaaagtgtgtgactttgacctcgtagaaaagacctcgcgttctcgcctcttctttacgacctttcgtctcttttcaccatgctctttctcctgtcttgggtacctgaagtcttcgtcggacctcagtccccgtccgctgtctgcggctgcatgctcttctgccctgcaaggagaagccgcctttgccgccactccggaaatccgtgctcctcgcagaacgaaaaacggagttgagctgtttgtctctccaagacctttcacctcccggtcacctccttcctcgaccttcgaggctgccttcgtaattctctcgacgagagagagaagaagcttctgcgtcgtcttctctctctgtgtcgcgtttttctcttgcttcttcccgtcatacacttctttccaccagacagcggaaaccgttaggaccctgtctgttgctttcctgccgattttgtttccttcatctctcgaacgcgtttgcctctcccctcaactccgtttccagaccctctcttcctgtctcttctctctcctccctcaccgccgaatctcatctccgagctcattacccttccaaatacagaaccatatcgagtcgcggacaggcttcgcagagacgccggggtgcgcgctctctcctgccccttcgggtactctcaagagactccgtcgcgcgaattagcctgccgagttccgatttcgtctcgcttcttcggtgaacca

SEQ ID NO: 1195 - DNA, 1934 bp, Toxoplasma gondii
acagtcttgcataatgattgacatcttctaagctacagacaaatctattagcatgtatatgcgtttcgttatttagtctagttctgggacgaccgcttggttttgaggtgtgccgggtttttttggaaaagtgttctaggggaactcgtgcataaatgccgagttctcagttggcgctcatttatttcctgctgaggagtagccggaatatcgtttggggatgctgcagaccatatgagctctaagtgcattaaaaacatgggacctgaacataactcaaaagcatcctcatggagtgacccggtgcttcttacttttttcatgtctcaaaaaccgtagagtgagagatactcatgtttcggtacttctgcaactttcgtcggactttccttgtttaaagccatccaataatcgtagatgtgttgcttgatactttttgtgaaggccgtatctgcccgcagactttgctgtgtgcattagtcaaacaattcgcttaatagcagtattcattcgttcgtattggtactttcaccgagtacgtgcacaacactggaaccacaaacacagaggccgagtggcctcaaagcgacaatggtttatcgtgccagcttcaagcagtctagggcatttacgaaatggcagtcatattcacggttttggatgtgcgctgaaaatagtacagatgcacgcaaagcataaactgacatttccaaatgcgcaagcatctggtttcacgaaaacgattgtttatttcagcatacgttgttcaaaactgttttcgctttatgtaggaagcgaatgtgctgcccacgagagacgcgcacaagttcgcacggcatctactgtgtcacttcagaacatactgtggaccaaatccggtctacatgcgtaatatgacagtcagacacatgcaggtacctaggcagtagcaatttttaaagtatagcacttagtcttcacctcctgacaacacattcaccgaagcagtcacgcagccagacactgacgaaaactgcatgtatgcagtactcgaggcatcgcagtaatctgaccagacatggaaacacttccccaccggcgaacaaactacacatgagatcctagaccaggggtgacggaacgggtcgtaaaccacctgcgtcgcctgtcttgtagagacgaattttaggaacgtagtcatagaatgattcagacagtgcgcaaaagccaaggtcttttcttcagtacgagagttcctttcattgtcagtggaaatgaagataacttcgactttattggttcgaaatcgtgggctacaaacctttgtcttgtggctgacaagacccatgacgcgggaacggaactcttctaagagagtatggatagtactcgctgtcgcggcgttcagggggtcgcttgcacatgttgtgcaggtgcgacagtgtgactcaaacttctgggggagggagagctttataagagacttgtgggtctgcacagccccacagttattagctgtcgcaacaacgggctgaaaacagcgtgtccgcgacgtgaaatggaaccagaattttgttgcgtgtttggcctcaaacatcgcgccggaagtcgtgaagagtcttgcagcctcttagcaaggttacgatgcatatcaatatgatcaaataatcgcctcgttgatctgctggaagcgacggcttctgagttttaggaacactccttacagtgggctttccaaggagagccgtgaagacatggacaaccccctgcctcaagtcttgcgctgctgccctctgcagtgtttccccgtctcgaggaacggcagagccccgggtgagggagcctttctcggcagccctcaaaaaaccagccgcctttcaatgatagatttctcgtcttggagtgacgccagcttttcggttcgtgtgcaggagtcgcgccaagagcaactatca

SEQ ID NO: 1196 - DNA, 2395 bp, Toxoplasma gondii
atgaagagaaggaacaggaagaggaccaagactggaagagacgaaaccgagaaggaaacgggtgacgcgaggagcgggaagcgcgcgcaggtcgcttcaggcctctccccgaagccgtcaggtgtacattcttctgagggaaggcgaggccttgactggaataagatcggcgctggctgacatgccgagggtggacgcctgaggctggcaaagcaaacccaacgcgggtctgctggagaaggcagagagcaggaagagaactcacacgaggggcgcggacgacgccgaaacagaggaaaaggctgatctggaaaacgggtggaggacgaactggtagaacgcttcgacaaagcgcgggccggcgaagagatgcagctacatgttgacagtgtgccttgcggttcagatgagagagagtcagagcacgctgcaatggggacagctgtcgcagttgaagaagaggacgaagatggagaagaggaaaactcagatgacgagaaagttgcaggtgagaaaacacatgagcagacagcgcgagttcccgctacccgcgaaagaaaccgcttgcctgctgccattgcatgcgagaagccaaaagaaaagctacgttccctacggtgcatgcgttttgacaaactcctcagattcaaagtcacgagcggccacagccctgagtttgtacacctgctgaacaaccgagcaggcgctgttcgagacctttgctcgcagtggatacggaaaacgactgcggatggcagaaaacggtggtggggattcacaatggaagtcaaatgcgcttgatgtggctaagaacaaaggtcctggcggacaggatctgagaccctactgtagtgtcagacaccacaggacacgcgcaagtcgagcggttccggttggagtgagagggtcttctttgcaacatctggaacatgaaaagcgacgaaacgaggagatccagggaacagaccgacggaaaactgttattccaggttattggctagacacgaaaccgcttctctgcaagccaggctctcctgtcaggagcagcgcactggaaaagaacgccatatcgcgagacggccgaacagcttttcacggcccgatttgtggcggtggaatcggaagcaagtggagaacccagaatctcgggaacgcagaaaactaccgcctggagaaattggcccagaaactcgctcgaagaatcagctcgtgcagacgttcctgcgttttcaggaatcggcgatgaatgtccaggcagagccactcgcgctgaagtgcatacatacacacagcatggtctgctgtcacgacgaggttcctgcagtgctgtggcgtcacgcaaagcgcgaatcggctttgtactgctcttgccctaatcctggagattgttcttccaacctcgtttcttcttacgctccggaaaacgttctgttggatctctcagctgcaacgtgtctccagggaagcgcatgcagcctgcacattgttcgcaaaagggggcagcgaacggacggctttgctcttcgctcctctgcagtctgcgtcttactgccctcgctattcaccgttagaatccctctcctcttcgatttcggaccccggttgattctgctgtgtcttttctgccttgtggcaacaaaacgaaatcgagaacccgcgagtccaggcgctttcttccgccttcccgccgttgaggctcagccccaaacagcgcggagaccggccgggcgactttgcactgctcgagtgtgttccgtgcacctcgattttctctccatcgtcaaaggcaagtgccttgtcaccttctgaatcgagtgctactgttgtttttctgtcttcttcttaagagggggacccaacccatgctttctcatctaatacccgtcgctgcgaagcaccgcgtttcttcgcgcgcggcctctcctgcgctatttcattcgcttctcttgactgtcgattgacttttcctcttcgtgaacaagtgcacatacaacgttccaagtggcatgcatgcgaaaatagtcactccatcgtgtttgaactctctcacctacagcgtcgacctgcctcgcattattttctcctccacccgcttcatctactatgttgatacgttcaccgaagagctttcatcgttactgatatttcactgaatgtatcttcagtctttctacgcctcttgttctgttgtttcctctttcgcctcgtggcatcgccggcttttccacttcgtgtggcgtccccaacctccccacccattcttcaagtcttgcagcactacgttcacccccgcgttttttcagagtctgtccaccattaagttcctttctagttgtttccacctccattttttctgtccttctgttcccccattccctcactagcgtctccccca

SEQ ID NO: 1197 - DNA, 1572 bp, Toxoplasma gondii
aaatttttagttgaatactcctcatcggcgcaggaggaaacacactgctttctctatgttgtgcgtagatcgtttttggttctcttttttttgttggctgctcttccggtggaacgcacgtccttgcacgacgctcaacataacagaagcgcgaaatgtttcgcccagagtagtgagtttcgcataaaagtgaaagagggagtgtagcaagaaatcgtttcgaagccagaggagccaaaactgagaacgaagtgcaagccagtgagagaggaagagcataacacgacgcacacagataggaggaaggtcgtgataaggttggtacacaagacagcggagagtctgtacttcgatgggaagcaatggcatggtacggagacaaagtcattctgttgcgtgtattgaaaacgaaaaggcgaaaatattgtagtgcaagagaatggtaataactccagcaagaaacgaaaaaaatagctgcaccaacatggaggacaagcaaacggtgaatgctctcagtgctgaaaatgaaacgggggtgcaacaattatacatctcacgggtgtgaacagttgccttcttccatatgcgtgtaatttgaggaacaaatgtgaataatacctcatatcaagcttctcagaccctctgtgtgccaccgtccacgtgtcattccagccaccgccgctctcgtaggtgtttttaaccggaaaagcaattacaggtcaaagccatgccgctgccactgacgtaggcagctaggtgattgttattttggcagatcctttaaaacatatgttctcttgaaaaatgtaattcgagtggcggagaatccagcatgtgtgttgcctcgacaagtaatttgtagacgtcatcgtagtctgttcgccgtgtcccgcgccgacccctgtaagcgagttgtgtgcctattgccagaaacgcaggttcaggattttttcaaaatcgattctgcagttcatactgcaatgacacacacgttcttcagtcggcaacgtgatggaagttctatagcatagcatctttccggaactgagaatggagttgtcttcattgactgggacctttgttgcacacgaagcatcagacactacaggatgcaaagctgcttcttccttgcaaatttaaaagtgttgtgtcttcctcctttatgacgtcttcctattccgtggttacgttctgtaacctgtcgtcatcgacatcacactgtgtgtttcgaagacattttccacaatgcgagattgacgcacgcaagcatgctggtgcagttcgcaccccgcggtgtttttgtttcgcgtccaataaagaacccagtttcgtacgtcaaatggaagagtatctacacatgcgcatgtaggtgtaacgatctcacgtccacatttatacaggtacatgcatacactcacgcatacgtacgctgtcggtaaaaggtagaaagtccgagacgccgcgcattttggcacgcccctttgctattctcgggtttatacaccatcaaggctcgtacagtgcgccaaaataccgccggaagacagggtaacgaacgagagcgcaaaacga

SEQ ID NO: 1198 - DNA, 2543 bp, Toxoplasma gondii
tgtataggtatatttgtatgtcggcgtatttaccagagatgtcttcgtctgcactcacgcacagtggcctctggagccatgtttcgttgtgcagcgcggactgaagctggggaacaagaagttgaactttaacttttgcaaaaccagcgaagagctcacgggatttgtctacaacgcagtgacaccgtttgcggccaagacagacgttcccgtgatcgtcgattctgcgctcctggcgctcgacccaccgctcgtctggctcggaggcggagaagtcgatttgaaactcagagtctccgtggcggatcttctccgcgttttcgagccgctcgtcggatcggtctgtttcgaggcagaagcgcccacgatcggagaagaagcggaggaacaggagtagccggaaccgtcagacaaagcgaggatgtcgcgacgtcttctgccggcttctgcacaaaccgagagagagacgccgcagctcgtgaggtcgctctttctcgctcctttcctcgcccactcgacggccggtgtcctcgtttttggaaagtctgttcgcgcaagagcagagtgaaaaaaggaacgcgaccctcttctcttttcctttttgccgcgctgtggaggtgccttgcgtccgaagccgagatgcagagacaacagggaagagaggaaacgcatcgaaacttggaacgcgaagaaggacgaatggccgcgtctcgacaacagtcgcgaaacgggcagattcgagtaccttccctctctcccaccgactccggattcgcttctcagtatagatgcatttctttgagagcctgagtcttctctcgcgaacactggagaacctgcaatccttgacatgaaagactctctgcagcttttctcacgaaaaacacagagctccgttgtctacgcaactcttctttccacgaggaaaccatttcttcttaccacctctcttttttgtcactgaacgctgaagaaagaaatcggaaatctctctgaaacgctgaaacgcctacaggtcgacaacgctctgatcgacgaagcattcctcgtcgtctgccccagtctccgatttctcgagcaccttgcatttctttcgaaggaggctctacgagcaactcttcccgacgttaaaaaacagtctttctgcgagtccagcacacgcaccccagtgaattcctccaagttttgtgttactacctgtaaaaacatatatatatacgcatatatatatacatatatatatatatgtataaatgggcattgaaacagatatctgtatgtttatacgcgtacatttatatatccaggcatgctcattacatccacagacgccacgaataatatacagaagcacctgtacgtgtatagatctgtatacgcatctgcatgtgtacgtatgctaacggcaatacgtactttcatacatatagaaatctacatatgtacgcagtttgcgactgcacagttccagttttccgattctcttgctttggttcagttttttttttcaagatgcaggatctttttctcagtcggtctgcagctactgcagctaccgtggagacgacaagcaggattttcataacgcttcctagaattctaggatttttatttcgcatgcctcgaggagtgtcatgcagtagcagtacaacgacctcttttctttgtgtactttttttcaagcggctcgacgactgcagcacaaaagcgatggtcacaagcatcgattctcttccccctgtgcgctcggcctccgctggcatccagttcgcccactgcagtgccaacgaaagaaaggctccggttcgtctcgctgtcgcagttttttcttttgcctcctattcttgttgtgtgaaaaaggtagaaaaaaaagaaaggagagaaaagggggacaaggtccggaggaaactgaggttctgctccgcacaggtttctgtgtctcctcagtgtctccaagcgttcagcaccctctctctcccccttttgtcttcttgggcgtcgataagctttgctcgtcgttttctccggacttgaaaaggcgtggaagcagacaaagtacctctctgcttcttcctcttgtttcatgtctttatctctgtcttgtcgggggagggggggagggtggggacagcatcgtctcctgtctcttctcctgtctcttctcgtgtctctgtctcttcaggtattttgggggctctcggtttcgcttcattctttttccagaagcttcttctctcgttttctcccgcatcttcctctctgtttcttgcccccgctgtcttcttcgcggccaccgatctgtctcggttgctctcctgatcgtccgtctctttcttttctctgtttcgtccctcgttttctttcctctctcttctttcctccatgcgtttgtgcctctcttttcgtcttgttcttttgtccgatctccgtgtgtctgttgcccttgcgtcctttcttgacgaactttccctgaactctagaacgacatccttttctcctcgtgcttccttctgttcttctcgtctctccgcgtctgaagaaaa

SEQ ID NO: 1199 - DNA, 2094 bp, Toxoplasma gondii
aacaagccatccattaaactctgctacatttttgttcgttcctcactggtgaagaagcttcgttgcgcctccaaacacaaccgaagaacacgcatgagaaaccctacaatgacacccattccaaaagcctgatgagttcacggtaacaattgtctgcttctttttaccccaccaaaattgcgtttttagccgtttccaggatactggtatagtgcctggtttccggccccgccgcgaacaaaagcacgcgccaacgggcatagaaattcaaaatggaggtgacgctaagtttcacattctggcaagtatataactacaatgctgtacgaaccaagagtaacaaatcccaggatagcagagacgacaacatgtgcagcaagaggtctcactgtctgcgtgtttctctttgctggagcccattcacattttcacattccatcgatggcacgcacagagcaggtgagtccgaaaattttcctccatttcctctgttttttcttgcttatgcaagtgcgtgcctttaacaagattcatgtgaaacacacaaatggcggtgtgacgtataaagtgtggagtagagggacgacttactattcgatcaacagggagtagagttccagattcttttcaatgatatcccggtcagttgtgacagtctcgccgtcttcgtcaacaccagctaggatgcgaaacggtatgggaattacagttctctgcaagcgacggacatcgatttgtccggtcgatggatgagcagccatgctttcgctgacgaagagtcgactcttgccgatgtcctcaattttcaccgctgacggcatcgaagtcacggagctctcagctgtagccatcgtgaccaaccagttttcttggaagacgaaagggcgaaagcggttgccttcggcggacgggcaagaccctgcctttcctgtggcgtctccccttttctggcgtgaagaatatatttaggcgaagaagagaactaaaaaacgtcgtgcctgtcccgcatggcacgacagtctccaaaacccagtagtgagaggacgttgaatacacaggatgagcggcttttccttgcaacaatcaaatccgctaggatactagtgactcgctactccgacagcattcagcagaagccgtttgcggcagcgttaaaaaaacttcgtacctaagctacacgcgccagatgtacatctaacaacttacaggcacatgcctttcctctgttgaagagtacgcgtgacagacagctagaaaagagcgtatacagtgggttaggtgagacaaacaattttacaaacgatgagcgcggctgcctgacgagaacaagctagacgatgtttgcacgacgaggatctaacgagttactaacgagttacacatattcctggtagtgtcatcgaaggaatggagcgacgagaaagttcagttcgagaatagaggctcattcgatgcagtttccttccttgttgaggatccatactagcttttcatggctcactctcgcgaaaaacgacacggcagcgcgttgcgtttcatgcgcaacatcggattgctcgcaacgcatgcagccgttcaggcagaggcctagcggaacggacgaagggcaggcaagaagtccgcgctcttgaaacatggggagaaacactcttttgcttatcgaatggaaatccgtcagaggatttgcttcactcctcgtcgttctctgtctcgtttccttctcaaagcttgtgttccagaaacaggggacgggcatgcaagctgacgctggaaaacgaagcgtctgtaattcaactaccgacaacgtctcagtcctctagatgtgttttaatacaacaaagactatccagaaccgtggaattgacaccaggaaactctccggaaacaagaagagttgagttttcttggctccaccacttccacttaccaactttttctctgagaaccacgtgctgacgcctgtgcacagggcgggcaagcagagaccctcggagtccgtagaatctgagactctgttcaacaatcctggcgaatcgaagactcgtcaggagcttatctagtggaaatggaacctgactgaataagaaacagtca

SEQ ID NO: 1200 - DNA, 2624 bp, Toxoplasma gondii
tgctgtggcgatcaatttgcatctgtagacaagaccctgagtctgtgtgactgtcgacaggggcgcgttttttccgtgtgcatatgagcgtgctggagcatgcgtctgcatgcatgaatgcgatgcgcgagaaaatccattttcagcggcgcgggctctgacgacctaacggaaggagcggttttgtattttcatgttgctgctgcagaggtgctcccgcagtcgtttatgtcatccgaggccgagaaaaacgcggttgttgcttccgataggtgacggaaagcagagggcgtttttgcggccagccatctcccagtcggagacccgtgtgtacattcttgtctatttttccttcacacttttatcgccgacggagagcatttttcccattttctccgtcacttgcaggcgaacaaatgcggttcatctagtccagacgcagacacggcgtttttcagagacctgcgcctctcgtgtacatttctttcaatcaggtttccaatccaccgctcctagcaaccacgtgtacatacacatcgtgcaagtgcgtgtgtggggggaacatctgcgtgcatgtgcgtggtttcctcccggcaatgtacgatatttcctgtataggccatttgtaagcgttttccgcagtcgttaaacctcgtttttgcaacgtctgagagaaacagctacttgccgacgccattcacctggtccgtgtttatatcaggacagagagacatgcacacaggagcacgaggcaggccgcgaagtcctgaaactagctacaaacgcaacgcctaaaaaagtgattataagtatgcagtgagctacatatgccggccgtttgtctacatcgttttcttttctcggcaaagtcgagatgtcaaatgcgacagaaaatccagcagcaaaggaggaaagcacgtgaaaaaatattagtgtttctcacaagagaaatgcagcacgcatcaacaatttcggtctgcattccacgaccagaagtacaccaagcacgagctgtcagaatctccagtcatgcgtttttactgattcctttgtgtctatgtttaaaaagagggacttccagaactgaagatgacagcttcgtgttccccagagagagatacgtgtgcagtacacgacgcaacagaacaaatcgcggatcggcgaaaacgggtctttctcagttggtgagaatgttggaataccgcaggtcaccaacaccaaagacaaatccaccgacagtgaagtttacctcaaggggctccttcgttacttagctgtatttatttttgggatgcctgtatttgcagtgtcaagtatgttgttgtgccagggcattttccttggcacttgcgattcttgccagacgtaactgcttaagatacgtctttctgcaatgtctgtcgcaaacggagcggcggggcatgtctttcttccgcagacgagtgagttttctcccaggatgccattgagcttggcatttgaatgcgttggtttctcatggggttgcgctgatgatttgcctttacatgtcgatctttctcagagtgtaactttcctgctgccctttggatgatgctggatgtagaagtttttgtgcagcggttttccgcgttttagaatctggaaatctcattatcagcgttcttttctgtcgtttggtctttcagggaggaagacgagacgctttattgcgcaacttctgactccgcgcgtcacgcgcgagaaaagatgctcacttctagagcaggatcgttggacacacgcttttgcagtcgaaatcggagttcctcgaactgtaaagtttcaaccccattttcgttaccaccatctttttcagtcgtttacttttcactttccgttgaattcctcaaaaaattttcttacacagcgacctttcatctcctagagccttcagcacgagcagcgaatgcagagaaagaacaccgccgcgcttctgtgtctgtgtctcttttgcctcgacggaaaattgtccagaatcttgttccacagtacccaagtcttctcttttcctctttattttctcggttcgatttctttttttacctggcttcctcccgtccttttcgtctgactctctctccccgtgtctcacgacaggtgacgcaggcctttcttgcgtattcgctcccattctcccgttttttctcccttttccctttcttcttcctcttcgtttttgcgtgctttcaacgccacccggcgtctttcgtgtgtggggaagacgctctctttccaaccctacggggcgtaggtcagcgtgctgttcggccagcaccgggcgtctggcttggtggcgcagttcctctcgtatttcctgctcctggtccaaaggagtccatttttcaccgtcctttgtcgagtctttcattctgtgttgtctgcgactccgcgtctccaccatttctccctccggtacgtgttaaggccgtcgatcctcgtgtctgtcggcatttcttccggactttttcttctttcgattttcgttccttcttctcttggagttctttgcgttcctgcgtcttcctgccttctgccgcccctctcaccccgcttcgtccttcgtctattccccacgcgtgtcttctcttccctcttcgcgacca

SEQ ID NO: 1201 - DNA, 4477 bp, Toxoplasma gondii
gtgtctcttgtcattaaagagaatacagtcagtacgactggagagcgagcgaccctcgaattctctcccctgcgaagacgcctacaattctccctcaacctccccctcttcccgcccagaactcatcacttcctccctctgcacagctgttctacgacatagagagatcctgttttgcaaatatggaaaaaagcatgcaaggcacccgacaaatgctccttttaagagccccgactacgtgcagacagcggcacatgcaagcgcgacacacacagttataatacacacaactctacattatagtatacatatatatatatatatgaatatatatgaatatacatattgatatatagatgtatagatataaatagatatgtgtctgcattatatggcgaggaactgtgcgtcgtgcatgcatcgctctaaaaatgtgccgagagctcttgaaaggtttctatgggcatcagagttcggtatctcttgtccgcagcgtgcctttctgccttcgtccggcttcttcgatttccatgcagctcccaacgaaacgccggcggcgtcttcctgatctctgtctcctacgtccctcctgagttttttctcgcttcctggagtctccccactgttccttccgcccacccccctccccccaacccctctgatccccatgttttttctgctgagttttctcgagagaaagctggttttcccgcgtctttgcttcctcaccggagagcgctctgggcaccggggccaggggtcttgctgcgtgtgcctccggcagcgcggaccttgacgtggacagcagagattccaagttccttgcatcgcgcagcaacgtcggcagcagccatcatcgccgcatacggagagctttcgtcgcggtcggccttgactttcatgccgccagtcacgcggaccagagtttctctcccactcaagtcagtgacgtggatgaaagtgtcgttgaaggaggcgtaaatatgtgcgacgccaaacacgatttccccgtcgcgggtcgccggacccagaccggaaccctgagcttcgccttcctcgccagtggcggctttcgcagacttcttcggtgccatggtgacgaggagttttgcgggcgcgagggaagcgcgaaacgcgcgagaaaagcgcgaaaagtacggtctcagggaagggaaggacggcgccgggggcggaacctgcctcggcgaaaagcgggaaagtccggactgaaaaaaggagagaatgtcaggggattcgagccgcagaaaaaccagcaaagcaaagggacagcgacagagaaaggccgcagccacgcgcggggggaaaagagcgacaaggagaggtggggaaaaacgcgagaagtcagacactgtggggggccgagcgcgactgtgccggactcgcgtttttactcgaatataagccgatccagcgaaacgatggaaagatccacgaaaaacgctgaaaggaaagcagacgaattttcttttcagttccacgtgcgctttccgttccaaaccgttccagtaaattcccggtgagggctggaggccccagctggaaaggtgccaccaacacagggcggcggatgccagtctccctggaaacgggacggttggagagcctcccttcggagtcaactttgtcgcatgtaaaaaacgcgtgagagtgcgctgttggaacctaaagcgtctgcacactcttgcccttccatttaaaaaattttaaaggcgacagtgaatatgtactgcgcgtgaacaactcgagtagaaaagacttgcttacccgaatacctgtttagggagaaaagcttctgtgtcgagcagctgtcaaacttttttcggccggggtggtttgtacgtttttcaccggctattcacaatcggaacgcggcttccctcagtaagttgcagagttcttgtactcgacagacatcgatggaacatcagtcatcgaagttgtgatcgtagatgcgaggcggggttcgtcagacacccacggatcgtcgctgaagagctcacaaaacgctgtcgaggatgccggtgatagaaaataacacacgtttacacaattaggaaacgctgtgaccattgtatctgattcgcgcggcaaacatgctcgcagaccctggctgtatcgatgatggagagttgtgaaaatggcgaggcgggcactgaaaaaggaggggcgacttcagtttctgcgactcctccgccttccctgcatgtgtcatcctcgtggtgaccaagtggaactttgccgtttcccttcgtaggagtgtgtgtccgtcacgatactatgagttttcgtggggagcgaaagatgattactctagcatatggactagtcaacaacgggcttccttgaagtctgttggaggatccacctgcgcgcatgtggttagctgcttcatcagtgtctgctgttttcattgcagatcaagaaggcaggcaaaaaaatacaaaggaaagtctcacgaaaagcctctgagccaactacgctactctagcagcagcgccaaagcctcaactcccagaaaccatttccctgcaagaacgactcgtgtcgtacaccctgcaatcttcctaccagagtctcgcattcgaaaaagacgagtcccgacatctgaatttcccgcgtcttatatgtagagagtatgttttgtggggaaggctgcattccacaatgactcctttgtcgagggaaatgccctggtcgatcttcaatcaagacgaacggcggggaactgttctgcaaaaaacgtcttgtaacgtacagcagcgggtggattcgtgatgattctactggatttgcgtgtaaatacacactttcaagggaagagaaaaaaccctctgggctttgcgttttttggcgaggtccggatgcggcggcttctactttcgcttaaaccgaagctttagcttcacgaaaaagaatatcctgcacggacacggtgttacccggctccccgtgctggcagactcttcctgctgaaaagcaacgactctctggagccagtgtgaaatgcgagacagctcgtgtgacaccacttacagtgaagacagcagtagccacatttacgaaaggtgttctctcaggctttaaccgaaaagaaagtctctttgtcatgtccccaaaatccccgaaaagacagctgccgccgactgcacgcttctctcctgccgaggatgctccgcgacagggccctgaccccgaagacatgcacagacgcgctcgtctctctttctggtccacgtattcacagcaaagggtgacttctttatggggacgggaaaaccttaaacgctgtgtcgcgccacacaatcagcgcggaacctgctcacaacaggagttaccactccgaacggcgtgcgcctccagttccttggtaacgcgtgtagtaccgacgaccattcacagtaacgcagcaaactagaggacttttgccagtaggaaagcagtggactctgcggcatgaagtgaaaattacagcgaggagcaaccccggtgaccaacgcgggttcagcggctccagcgatgacggaatacgtcagcccgtgtatcgctaagaaaccgcaacatatctgtcagctgactcgcgttttctgcaataccctgcgaatgagttacgaagtggcctctgactcgatttccaccgtcaaataggacggcatttgcggcgaggcgacttccgcgggagcccgcgtcgcgtggtacgacgcggccgccgatatcaaacaagcggcgtagggtcgagacacgcgcttgctggtctcgaggagacggcggctggaatgcagcaccgacgaggaagaaagatgtgagcaggagcggcgtttcagaaagcgaaagcacgaacttttcacaaatgtgttgacactcgcgggaaagccgccagaaaggaacttgcagatcgagcgaccactcactgggtgtatgtacacctcaaattctcagtgtcgagggcagctgctcgacgttcgtctgcttcactttcttccggtgagcttccaccgtcttctccacgcttgatttctgcgtctctcttttcttgccctaacacctgtagaaaaactctttctctgttgcagaagcctcgttgtttgctttcatgtctccggtctccgccgacggggcgcctcgcgaaagttgcacgtaggggtgtcgtccgtgtgcgaaaaggcgcgctcgctcttcccttgtccggcagcggtttcttttcctcctcattcttcggcgtttctctgtctcttttccgccatctttccgggagtttctgctatctccacggagagccagacacaccgtttcgcagactacgcgacgctcccggtgtaccgctcgcgtgtgaggcacccgcgacagagacgagggcagttttacacgttgcagggaacggctttcctcagtttctcaaaaacttgaaattcaaacgccgtcggcctgggcaactttctgtgtggatcctcaccgcaca

SEQ ID NO: 1202 - DNA, 4866 bp, Toxoplasma gondii
agaagaagcaacagccacaggcaaaacgtcagatgaagaagacgaagaagacgaagaatcggaggaagaagaagacgaagaagacgaagaagcggaggaagaaaacgaggaagaagcagaggcagaggtgttttggagaaaggcatggctctgtggatgtggggcttcctcgccgtcgaaaggtactgtctgtacacttgaagctgggtttcccgcgatcgtcgagagtcccgcgttcggggggtcggttgaagcagcgattctcgaagaaatctgagacattttctgttgtgaaaaatcagaagaagtatcgccttttctctcctcgtgctcttcaggttcggcaaaaggggagggagttgcaccccaagcgctgcgggaagcggcgcctctcgtcggctgaaaccctggaggcatctttccacaaaaaagacgagtttaagacgcagaaatgcatgcactcatacttcaacaaaagaaggcatactcgcaaccatcgacgaagaaggaaacgatatacatgtcatgtttttgtctgtgtgtcatgaccaggttgcagtagaaacggaaaccagtggaagagggcgggggagatatatggaatttgtggaatttgtctgtttctttgttcgaaacgtctggcggtcgtctcgttagaaaagaagcctgagagaaggaggcgtgggaagaagcgaacgaaagccgcgaagtgtgcctgcccttcttgagctccgttgccgttgctcttctgttccgctgtcatgaacatggagctcgaccgaggagacaaatcttaaactttttcttggccaacctcggcggcaaagccccgcgactctgtgcttgagaaaaggtgctgctaggaatcgagttccgatagtcgtatcggacttttcccgcgtagaaagtctccgaaaaagcgacacttagagcatggggagacgcaagaaatataatagaagagaacaaagaagaaaacgtttctacagcgcagaaaacggcccagaaaaagaggacctgctggggttgggcggcctccgtgagcgcctgcgtgataaccggatgagcttttgacccagattcgcgggagaaaacacgaaaaattggtgagaagtggcgatgtgtgtggatggaaaagaacaggaatcagtgaaactgtgaaaaaaacaagttgccgggtgaaattttcttgttggggtcgcaaagaagcagcgcgcatatgcgtcgcacttggtgtctggcaacaatgaaggactttgcatgtgtgcatagacgcaagcctggggaggaatgaattctcttccgatgaactcgtggtgcagccctgcaatcaacaagtggaaacgcctttgcatttggacagcaaaagaatccgcagattgcttagacagtcttcttctattcaacatgtgacacatggtccggtttcgaagataggatttttcttttaccgtaggaagatatccttcgtgattgtcagaggcatttcacaagccacttgcagcttctttatgtcataaaccgtttcaagtctttcttgagcacgcagcaaaggtgcgatatcctccgtacacagctgtggggaactgtcgacgtcgacttacactggatagttcgatactaatactggcgagtcaaggctggtgaatcgaaggagaggcacagaaggaaaaccagaatcgtctgacaacaatgaagatacacagaattgtcttcagacatgtcagatgaaaaaaggagtactttctccgataatttagtacgcacccatactcaaaccaggatgccagtacacagagacagaatatatctatatatatatatatatatatatatatataaatatatgcatatatagtatgtaacttgatgtttacatgcacgcatgtagatatgtgtgtgtttgaatgtgtatttaaagggttgcatacttgtttgtcgtaaagttcttctccctcgaggactttctcctggtgcggctgcagtcctgcggactcaacagaagaatttgaccttccagtgtgttttctctgacacaggcagaacggacggtggctagtcagtctgttcgcagcactgctttatatcgttccgtagtggagtctggcgcattatgccatgctgaaatgggtcccaccctatcttttttttacgacggtttgtgggtggtcgtgtcacctctttctgatctgggcttgctgagactcgatccccagatctgcaaagcgttacatcgtttttttccaggacagggacgaaggaccgttcttgacaaaaatgcgaacatctcaactgaaatctgaagaatccatgcggaggcagaatgctccaaaacacggacgggggcttcctcttagagtttcgttgctctctacgaatctctggcgcattcacaggccacaccgtgatacatttcctagtatttcggaaaccagatcatatatctatcctcgaatagaacggatactccgagaaaaagagagaaatgtgcaaggcgcaagcgtatccaacagcgttcaaagaacccatcgccggaattggtcctcggggagttctcagatactgcagacttctggacacacaatcacagaaatactggcttcgacgagggtagaaagacatttgttgaactgtaaaggaaaggtgtggcagatccgtcaaaccaagagactcttgcacggaggctgatccaagtagatctggtaggcattttgcaccgtcggaggacgagagacaacagtgttaacctcagtccatatcctacgcgtgaaacataacagatattgagtatcctacgttacgcacgcatctttgaaagccttttttccgcatcgtgtgaacccttcatccggcgcaagtgttaaagaaacacagcagtacgcgcatgcgcctctcgctgtttaggttattctgaattttgacacgttgctaccatcacgaaaggagtgaaacaggcaagcgaggaaagactttctgtaaagagagcgagcgtgtcgcctccctgcaacggtagacatgcattcgcagttactctccataacaaaggcaaagcagagtaatcgcggtgatccaccggctttttcgccctctatcatttagctaacctatggaaccaagatcttccccaaaaactctgcgaagagaaacgccattgacacgttccttcaaacctctagtgtacacctgttatccacttaccgacaattgtttatcgaaatatacactacatatgtgtaaatatgtacctgtttcaaatgaagaatgtctatccgtgcgcagtggtgagaatttcttattacgtcctcactgggcactagagtctagaaaacttcacttaagcacagcatcaccgcgtacaaacgcttggagagcgtagaactctatgagtccgctgtctccacgatatgcgcctgttcaacagctgcgtgttacactctttcactggacgcttccaaggtcctctcatacatttcgttttctagagatggacttggtattgctgctaatgatttcaatttgctactggccctgaattcaatcttcctgttcaagtccctcctagtcgggcgcctctgttgtaaagaaactgtttgagtttcctttttcacagaagcactgcaactgtatttctgcttgacaacgttcgcatcactttcctctttccgtcgtttcgtcttgctttatttcactctacggatcttcgcaagagctctccgattgacaggcacttgtcacacgcagaaacctgtaaccgatctgacgatcagcgacggcgcctccgggatacttgagggttttttgccgatatcgcgttcttcagccaagcagaaatgcctttttctcgtcttcctggtcgccgagacgtcgaaaagaagagtagcgctccaaacacccttgatctgtcgacaaacgctctccggcaaagagtggcggtcagcgggagaagcggctcaggcgggttgcttacgcagttaggtttccgctttttgtgcattttcatttcaagcatgtagcacttgccaccagcatgttacatcatcctgtgcgtgtggaggaaatcgggtgatgaaaacaagaacatgttgatcacacgttctacaaatcctaaaaatgccgccgggatctgccgcatgattgaacgagcgtgtgagggctgctttccctgttgctgcgaatctaggaatgggtacatcgtttgcttttgttccaattcttcgattatttccgtgcttcacgcgtgtctcactctttttgcatacagggggttcgtttgtttttgtgaaaatggacaggaaacgaaatcgccattcattttgtctgccactgcacaggcaggcgccgccaggttttcactcgtttacttagtcgcttttactcatccctctccatggtttgcagaaggattctacgcgtggttttcctgcgctctgaaagtacattttcgcaggaacccctgttcgatgactgctctgtgtctgtagagtccaatcggaacagttccgttttggattcgggcgttgtcaacttccagacctcaaacaagagcctggtgtagttttccttccagaatacccgtccctcagtgatgaacgttttcccgggttgttcctcgcgttttacttttttccccttcttcgtggagctcgcctcgttcgactggctttcgtacggccccggcttcggttttgctctttttcgcacctcgaccgtcttttccgtcgaccttttgtgttcgggctctgcttttgatcccgaagttcagaatacttgcgtcgatccctgcactcagcgttaccttcgcctgcttccccacttcccacgcgttttctcccgtttttgtttgtcattgtctcctcccccgaacga

SEQ ID NO: 1203 - DNA, 4929 bp, Toxoplasma gondii
gctacgcgttcctgtgaatctgtcagttctcgcagcgaatctaaagtgacgccgacatcggtatctgccatctggtcactctgtattttgtctaaggaagttgcagaactcgaattcgcggaccggagcaaggcagttctcatgacatccagcactggccccaactcccgtgagacagacggctgtgtccacacacccgccgctgcattctcgttcgctgcttcagcggacgctgagatcgggagaccggcggacgcaagaaggagcaacgcaacagtagtacagatgaaagagaggttagagaagaaacggcgcacgccggcactttgttccattgtcccgagaatatgtcctagaaaacaaagacggcaggacgcgctacgcagctgggggcagacaaggcctcgtacagggcttcaataactggacatagatgctttctctgcaatacaaagcataaacagggcggcgacgtgacaggggaagcagcgaaaagagagaggattgaatcggatcttggaggaccaaaaacagcgagacgcctgtggttgctcttcgctgattaagcagttttcattacagcgccaagaagctgatccttgtggagggacacttggtgagagcacatgctggacaggacaagaaaacggtctatgctgtgccaggtgtagcttcacgtggaaacatgcgtgcagcagagagggctactcgcgtgttgaatcgaagaggcaagattaggaggaaatgcgccaactccactgagagtgaggaagtacaccggaagtggatcctgactgcatcgtccctgaaggccaatttcaagaagtctgacgcggataacgataactgtgcactgaacaaaagagacactcccgctgttcaaacatgcatggacatatgcggaggtatatctgaacgaaatcgaaagattcgctctgaattaaaatacggtggcgcaagaactcgctgttttcctgactatgccaggagtcaaacatgggcatgctttgggaggaagcaaaaagaatcaggaaagtacgacctatttcctggccactgttaaaaaacacacgcttcgctaaaagattgggaagctagagagtccgtacaagcgtgtgccgtgaactggctgttgacctcggtgtctcaataagaacacccgttgccccgtagtgggtccgccaccttctctaagtaaaccgaacgcgagggtaggactttacacgtgaagaaacaccatttccagaagaaaggtcctaggcccgtcgcacacagtcttgccctgttttatgtttttcaaaaggttgactgtggagaaagccggacaccgtctctgttacaagaagcgttaagtacaaagacgcccggcacaatcggcagtgcacgaagaaaaaatgaaaacgccctctctgtgcgagcagaaggaaaaccgtaggtacagcgtaccgtgcaggcaaaaaccccatacagtttttaggccccgatttgggctgttcccagatgagtctaactatgagacacaaatggacccgcgtctcgctccctcggcagacaacgggacggagcgagacgagatgtcgcggatgtggaactctcttgtacgacatcctacaacatctctgcaaaaacaggtaatgtcaactgaaaatataatagagatgcaggggaaaacaaagtggaccccgaggtaatgcgatcgcacgaccttctgtgacagtgggcaaaacggactagccacctgcggcgttcccctctttccttgcgcgagagtatggagtaagtagggggaaactcgctgactctacagagatatacagcgtactctgttgacgcatagtcaccaattacgcatcgggtatcaacgcgtctgtgatgttttgtcgttcaaagtctcagactcgattctttttgaaactgcggatctgcagaataaatcaaagaagctggtttagttcactttttacttgctcattgcgtactggcgactacagggtgtgacatacgttcgattcacggaagccaacacaattcttttctggagagcattcgtcctgcgtccgcgcaacatcgcagacttgcgagtgacagcataccgtcacatggtgtaggcgaggaggccgccagtctttgtgtcacaaggcataggtacgtaaacgtaaccgtttaacgaaagcgcgagcaagtcccttgtttcgattatgaacagcggatggagctgcgacaaagattcagcagtaagacacgatccagcccctggcagatacacagttggcagcgtgacagggtggaaccgacgattcaccggagaataggtcggcgagtacagagtgtgccagtgccaaactcgtttcgatgatagcaacacacgctggattctgctggcttaccgccctcaagaaatctggggtgatgcaccaaggctcggggggggggctgaatcagcgttgttgaccccggtggcgcctttcgttcctgtacaccatcgtttcaactgtatccaacacaacatcaaagaaattatcgctcacgatttagaacattggttcttctttctgcttcgactctacattttgtccattcctcgaacagcgctgggatagtgtacaatgagggctgaccctggggcgcgagaagggaacgctgccacttagaggtacggattttcgccgttctctgacggggtggaagacggttgagaagaatattcctcaaggagcgaaccaggaaagattcctgcagttccatcaagggcgatgtttcctctgtcctcattctttcaagaagaatccgccggtgacctggcacagagtgaggcaccagggtaaccgcttagaagcgatttccacacgccagctgacgaactcgagggagatgctctcgattgagtcgggcgtaccaccctagctgaagtttttaggcagtgcgtgactttggttcagtggcatcagttgctctccctacagctctcgttcgcctcaaacatgaatcgcgcatggggaaatggggagcagttatccgtcggcaattcagacgctcactctattggtatacgaggcctacggcgaattcgtgggtgccagtgtcttctctcgaaaccacttctaactttgtgtttttatttggtcgtccaatgaagaacgcgatcttgtgatgaatgctaggctcggccacacaccctaaatgcgttcacaccaaggaatcgtgggcagaaaacaacgcacgtgagagcccatctgtttctacatttctcttgatccaaagtggtttgcattcggaagagagcgaccgaaaggaccatcgtcccatgtaactatacacgtgcagctcattcagagaacatgcccctcggcgtacttaaacacattccgagaagcggcaaagcaacagcagagggactacctgtttttgcccgacgctgtgactgcccataccctgtagaactctgcttgttttaaattagcacagccacatcaaactggacacagggtgaagctccagagaccaacgcgcgactctatttcctctgcgtgctgcccagagtcacctcatgttgcatatgattctcgtcacaaccattgttctatgcaggcgacagcaactcgcgaagctgcaagaccaatcggggaagtagcacacagaatcaagaagctcagtgtagcctcacgaccgcaagctcggtactctttgctccacagccgcagaatcccagatttacgcgtgtcacgcaaagttgattgaatgagagaggaaacgtaaacaatctcgaaggaaacgtgtgtcggattatcccccaaatgcccgttctagcacccctaggtgacacgcacagatcgtctgccctaaactgcctggttgcttcagcgagctttccgagccgagaccttgcacttcaaatgggctccgtaccgagtaaaagacgatttctgagagtggtcccagaggagataacaccaacttgaagcaacaccttgtaaactcagcggaaacaccgtggcgaaaccccacctaatcttcgctttagtcagcgtttgtcgacagcaaagcatctcagccaattcaacgcgtagagacactttgcgggcgcctccgacttttgcgctgaggacagggcagggcgagtggcagttcgcttttctgagcgcgcgtaccttttctcactgcttttccctcggcttttctttgcggcaggaccaatacagagtgcaggacgggacggaatcgcgtaggcagccgcaatatttgctttgagtcgtctggagtcgctgtgaaaacgcaacgccaccttctggaggacagaacttctctttaagggaacacgcgggagacaacctccacgttccagcgcgtgtctccagcttctgttgtttcagatccttcttcgacgtttgcgttctcctgctccggttttctctgtgtttcttctcggcttcaccctcatatcgtccgctttgtttctcttcgcctcctcccgctgacttgcgggctgtctctccttttcctctcccatctccccgtcgcgcgacgtgtaggttcgtttctcctgaactccggacatccacccggtttctcgtatcctgcatctccgatagacaagaaactcgaagagtcttgcctccagatcgccgaactgcttgtccccttcggaaacacccacagaacaagcttgcactgcggccgctgcacccctcttcttgttttgatgctcctcaattcttccacagactcgtgtgcgcttctgttctcttttctcgcccgtctccatcccctttcttctctccaaagagcacctgccgcatctcactctgccccttcccctctgcatccttcctgccgatcctccttcactcctccgacttctccaccttgagcgtcgtgctccaccgttcttctctccaccagacagtctcccttcgtcgctccaaaacaaca

SEQ ID NO: 1204 - DNA, 1765 bp, Toxoplasma gondii
agaactgacgtctctacgtctccatagagcggaacttttgttctcgacttttttgcgcttgtgatgaatgtttgagacttcgtttctcctcagcttctccgcgcgcgccgcgagctctgcgagcagcgcctaagactgaaaagtcacagaaatttctttctttttactctcttccctctcgcctctgtcaacttgaagcgtcgccgccggtgactttctgtcgtggtcgatcagagtttcgggagtccttttctccgttgcgacttggctttcgaacttcatggaacagcatccgtgtgaggcttttctcttcgtttttcgagcaaaggcgccttcgatttgcgcaaatacgccttctgtcgtgaagcgaagcgacaagttctgaggcgctcaccctgtgtgccgcgccttgttggggcaggtgactttctttcgtctgcaaagacgcgatcaactggaagagagacacacacattccgcacataccggacttctgccgtcttcatcacgacaagaaagagacaaaacggcacaggcagacacagaaagaactctgcttagggttttcgccattctgcatgctctccacacatctaccggcacagatttaaataaacgttctcacacgtttcttcaatcatagatatacatatacatatatacatacatatatgtatatatgtatatgtctttgtatgcatatatatatatatatatataatctgtacatggggtgaataagcgtcaggagtttaggtgtacattgatgggggcatcatcgcacctaacggtgcggtctgttccggtgtgagatctgaactgagaagaagagttcatgttgaaaactcttcatggggaatccgtcagtctgtcagatcaggtccgtccgctccccctggtttttccttcctctttttcagttcagcgtcgttgcttccgtggagaacgggtccgaaagcgaactttcggccttcctctcgtttttcagggacgatctggaaggctcggttcgcttcctcgttttgctttcgttcctttctttacgactcggcgaagtccccttcttttcgccgcgcgcccgttctcgtcggatgtgtctacacgagcgtcggctagcaagctgtacagggctggtctttttttttgcgaaattccctcctctcctctttctgtccactgcacctcgaaggtggctgcctctcgcggtccttgtcctgaagttaaattcagcggcaagcaagacttccgcgactttgcaaagtctccgctgctttcgctctcaggttcctagcacgagccgtcggccctggggggcccgcgcgccagctcgacaagacgggtgcccgtgtcttcagatttcagcggcgaacctgcccgacaaagagtcgagcggaactttttttctttgtgttcttttctccgaactgttactcgacttctccccgtcttcatatagcgtttttctcgcttctccagtctgtcccccgacgcgtactcactagccggcctccgtgcacccgctggacggccgctttcttctggagaatttcctggagaggcattcgcccttctcgagaaaagttctccgtttctacgaagtcgactgaatcgattttctctgcaaaggtcgccgctccgtccactgctgcgccttctctccaagacgcacggaacctggagccccagcgacgccggtagacaagcgtcgagcgcgcggcgaaaagttctccgcgatggattcaggctggtgctcgaggctgaagaa

SEQ ID NO: 1205 - DNA, 2160 bp, Toxoplasma gondii
catctatgtccatatctctatcgggttcagtgtagaggttccgtggagaggggaaacagtagtagattcttgcgttattgcgaaggcctacgcacgaatgggatgcccgaaggacttacggataattcggacggggatccagtggtgaagttgtgcatagacataaagcataaacaggtgcctgttcgctgtgaaagggaattgcccgtatcaagtgatagcagtgtttgtaacgatcggttgccggagaactatcagcttccctaaaattcgcagagtcgacggatcgtcctgctgagggactgtttccgacccgagccctgtgactcaccttgatttttcgtcttgtacgtcgcattgagaaagttctcttcgtgtggtagttgaaatcttcgtcatggtacaacccggtctgtgacgcggctgacggttccctgccgtacgccttcacagggatcggaggaatgacttgccacttcttgaaacctcggcgggcaccgcggcccaccagccgcaggtacttcccccacaagttaagattcttcggcatcttgctggtgcatcttcactttctgacttccgccaaaattccaagcgacaaaggggcttttggaagacttgaacgggccagggcgttccaagcctagtctcatgtcacagcacgataactctcggctgcggaattgctcgttgcactgcctgctgttcacaggcaaccttcgttgccttcgctgggtgcgccggcgcgaagtgactataaagccgctggaggggtcagctttacaggaaacccacaccctccagacatagtcgggttgtttttaggaataaacgaagatggatggtgtcaaacagagcaaacgaggggcaggatcgcttagacgatcacttagactgcgcaggttctccgctgtataggtagacagaaacattgagcacggagtctatagacatatgcggcgactgcggtgcgtgcacattctgactaagggcaccttctatgaagcgaaaaaaacaggttaggggcgcgccagaggcgacgaacatccgcatctgaaccccgttaaaaacttttctgtgtatataccatgaagtgtgaaaaagaaaggcgccaacacacttgaaaaaaacacctcgcagaaccttgagcgcacgtttggacttcaagagtcaaagtcaagtgatctaccgcagatggtcacgttgtctaacgttaaacgcatagagtggagcgaagaaccggaaggccatgttttacgcgttgatgtggctgaagaccagcggatttttggggggactgcatgcagggagaaacgtggcacttccgctgcatgagggaggcacgccaacgcacatgcaacccttttctccgctatacctatttgctttatgagggaaacagaatgagtcttgcccctctgcaaagactgtgcctcgaggtgccctcatctcacctgcagaacagcttgtttttgtagctttacctggtgtgcagtggttcctgagaaccgtcgccgccgcgtcgacctgcatgcgtcgaggctcctagcgattcgttcgagttcctgtctctgagttccaacagtatagaaccgctgtttgtcacttcaagcgcgtcacgtctcacgtgggcgtctgaagcgcttcttggaagacgcaacgaagatacccctggatcttcttctgtctggacacacactctcgaggaaaagcgaatccttgaagcgatctttctgccccggcatcaaaggtggaagtttccttgctgtttcgacgttggtgctggtctgtatgccttggcatgccacctgggcgacttctgcttcctcagcttcgtttccgacgtttcgccgtcctttgtgtgcgctgaacatccaacgcaagctcagttctcttctggccgcttggctgtcgccttcccccctgcgtcttctcgccaccagtcagcgtcgccttcctgtcagcctgcactctcatccacttacgttccttccttctacatacaaaagccggtttctgcgtgtcgtcgaagccgccgctgctccacagacgtcgtgccccagacgactcgcgggtcgcctgcgcttgctcgccgggaaaactcgggtggaagtgaaagaaatcgcggagtcaaatccaggacctctccatccgactcga

SEQ ID NO: 1206 - DNA, 4935 bp, Toxoplasma gondii
taagaaaagtagtttcaagtacactttgagatggtccacaagttcctgaggtgcggagtccagtggcacatcctccgtcaggaagtctgcctcccgaagagctcgcaagagtacctctcgaattcccttgcggcaaaggctccccgctacacaggccatgtttacgagtatcgagagaaacggatgtttcaaaaccatcgacagcagcattgctgcctgggttgtgacgaacatgaaaggttggtagaacgtttgtctctccggcgtaagtcccatgaatcgaatgacagccgcagccgccctcccagctctgcttggctcctctctggcgctcctgccgaaatcctccgagcatcgatttacctttctagtgaattcttcgctcttgaacacgtccgaagagaccaacccaatgtatactggcagggagagagctgcgcatcccggaattctatccaggagatgtttgagcttgaccgtgaggcgcaaatctgttgcatcgaggactggaaatgacaaacgtcgagggtccctattgacgaaaatggagaaacttatgacagttgtgtgaagagccccaaacgactgcttccccaggatttcttggaccgtcgacctgcagtcatcaggttccgggctgcccttgcagagattctccaaatccacgagttgttcacggaattgttgaagacaacggtcaaggagtctccgttgtgatggaaatgaagttgctggatcaccgtcaccatcgggatcgggtgcactcggagtgagtgcagagcgtcgactggctttcctctgttcccactcttcttgacgctttttgtgttcctcccgtcgagccgccactcttcgctgcaggtcgctgccttcgtatttccaacctgggggccgggatgtcggtgggtttgtctcgttggtgccttcagtgaaagacagtgactgagcagggaaagtgctcctaccgagctccacatccgaattgaggggagacgacaagaacgaggacgcgtccaggtggccgaggctccgctcaaagctcttcgccactgcatttggtgaggtaaaagcaaacgcaccaacagccacgagggctgcgatacaaagctctgttctcttcatcctaagcgaagaacgagacagcgggggtacactgagcaaagaccgcgttgggcgccaggcaacttccggagagtacgccgctaaaaaagctgtcaccgcgacggcagaagttgctaaacatctatgcaagggtaggcaaaaaatcttttttgctgaaaagaaattggtcaagagtcacgcggccttccgctggaaggcggcgaaacagctagctgattttattgcgatagaccgcggtgccgccgttggagggcccccccgcacaaagaaagcatgtctaagtcgaagattgagtcaagatgacacgctcgcagaaccagttgcggctcttgcgagaaatgaaatgtgaaacaaccttgtgtcaaacgtggacgtgactgtgaactcaacgcgcctgtctggatctgcgcaagacagctcggctcgcgtagcatgtggggagggcgacaccctcttcgtcgcttcgtattctcagctttaccaggcgtgatgcacgtttctatcaactatgaacatttcaagacgcagacacaatcactcagctcgctggcgaaatacatatcgcggcccagctttgcgtctctcgatcgtctgaatgaacgtgaccgccatgatgcgtagacaccgctagcaacgacggaaagtgatctacctacggacagcttcctacgactttttcccagcgtcctagatcttgcttttgtgagagcggctatagcgatgagaaagcgccacttgagatgagaccgtcggcggcgatcgaacagcgctagatgaaagctcatctccgctaggtttactgcctgtcgttcattcgtgcagtgattatctgcgaacttcgcgcggctacgttgccgatgctctttcctgctcactgatgttctttctgttgcgtgtctcttgccatccaacttctcgcttctggtgccattctgccatgttcaacacggagagagcttacagccgtcatcattgtatgcggtacgaagaagccgcactgtgaccatttgagtattcttgccgcagagtcgggctgcgcccttgcgaacaaatgccagcaagatccagtcagaatgttcatgacagacttgatattcctaggggagtcaaaaaagggtggagggattcttgttgttttcctgtgtgtcgcactttgggcgtcgacagccggagtcacgcgttggagtcgccttgtcctttcccattaaaggagctcagaagaggcgtgatatacaactaagtagactgcaagtagacatgttgtcgcacctggtcgctcttgtgcatgcgttttctaggtctgctgccctgctgcggccagttgtgccgtctcgctgtgtttcgtggtttttctcgcttttttctggattgcgatgccgtcttgtcgatcgattctgctctggataaacaggacgggcaatagtgaagtaacgggctgcaccctgtctactgcccgtagtggcgtggaacacactgcgcttcctactatgctattttttcttcaattggacatggagcagaaagaagaaagtagcgagtctgtacgtttggtatcctgcaggacacactcgtctacacaattcatttacttttcgtttccgagtccgactcgttttttgagctcttgctgcaaaataaagggtctctggcttgccggaagaaacaccaacacagagcagcaggaatcttttcagagcagtgaaagttaaagtagatcttgggagcatatcgtcaagtagcaaaacagtaggttcatcgattttatctctggaaggtaaccgtcgactctcctgaaaccacacagcgctccaggggtagagtatcctgtagacgcagacactcacgatctaaaccagcaatcctgtgctttctccatcctcctcaggaaaaacggaggagacgggcgaaaatgtaattcttttcatcgaaataatcgaagtcagcaggccttttttcagcgcctaaaaccccactttactagcaacgctagcgctactgtcaactggatatttgcccggcgtcgagctctacggttgccctgctcgcaccaccggagaattcagatcatcttgcgatacttagtggcttcactgcacctttgctcttttgaagggaaacaaatggaaacgaagtgctcaaaggaagccgacatcagagatctgcgatgctgtgtggagtcttccttggagcggggcagctacatgcgggctactcctacgattgaccgttccgtttgtgggttctttccgactgatccttttctttctgaaagccccgaggaaacaaaaaaatacgctgacagtactcagaacgggaaatcgtgcttgtcgacggaagaacgctaccggctgacaggtatacgttgctacctgccctttatagacttccctctatttacggcagtcagtggcttcagacagtaattcttttgtaagtcatcctaaagacgagcagaacagaatttcaagacgtcctttcctcttggagcttagctgtgggtcactctcgaccgaccgtgcgacacacagaacgcccgcctttcgggggttttcttgaaagacggacgcatgcgctcggtgtcgacagtttctctctttgaacgagggatgtttatgaagtttcgccttcggtttcctcgcacgtctccgttcttcagctgtctcgtttttcacttgaactcttcacgcgcttctgtctcaacgggtgtcttcgttttgtccgttctgccccaaagcgcctgcttagctgacggtgctcatcgcagacgggaagaagttcgagcttgtcgacttcagagggtttcaattcagagtatgcagcattctacttgaaagtgtttctgcttttaggcgccacggattcctgcgttttcgtctttctctttttctcgggtggcttttgcgacttcttcaccgccgtggcgcgtgccgacttttccgtctccgtttttccaggagctttttgctgaatgaacacaacgccacatggccggttatttcttagagacgaactgtacgaccagcctgtgttttatgtatgtcgtttcagcagtcttcttcaggctagacgccatcagatattcgtcgaagtctccgtcattcattagactgcatgcagtcgacacgggcgtttcccgcgtcgattttccgtgtttttgttgaaattagaaggaaaaaccttttaattcgacgaccgttttttctcatgttcgattttcccttgtccaccgtaacaaagaaagccatctcgtcgctttcctctgtaaacagaagaccatggcagactccccggtgagacgttgacgccgagcgtctcgtctttgctcctgtctcaggtttccggtttctccccggtcttttctttttgactgtaaagactccaacagtacgcaccctttccgcttcgatcgttgagacgcatgttttcgctgtcccccgtagacggtgaactcggtgttttttctacgcaggtttccggactctccgttggttctcggcttcttccctttgccgacagagtccatcgctgaacgcagcgattaacgtcttggtaccaccggttcttggcagttcggaagccgtttcttcaaaagttacactcgatatctttcaggaacttggaacttaccgcttcgtttttcccttctgggtctgctcctacctactcaccgtccgacattccagtaaatgttttgcttcaataatctgacgattcgagcgtctgtgagtctcgacgcaccctgttttctccgtcactgggggtcagactctcgtttccctttattcctttttcgtaaaccacacgcttgagaaa

SEQ ID NO: 1207 - DNA, 2620 bp, Toxoplasma gondii
aaactgacgtcatccattcaccagctgaacaatggccgaaaaggtcgctttccctgtaaaaaatcagggttttctcaattacttgtccaattttgtagtcatcagaaggactctccccgtcgattatggagcgtgatatgaagggtgatggagctgactgatttatcaccgtgagattcgatactttgcagttctgaatctctggtgcgcgttaacgtttccactttaaaaagaacaagccagctatcgactgtgtggtcaacacgcggacacaccactagagacgcatgctgtataacaaaagtgaatcttcacacttacgtacatcacactgtcttacgtacaagatacttactattttaagctatagtggaagatcctgcaaggcggtagaaaatgttggtctaggcggcgcggtgaggaggtctccaagaacaagcgaaggctattgcgagaagacgggaatcatggcaacaccccgatgtggccagctgcggtagacttatgtcttgctagaaaagcgactcaacctcctggtgaacactgccgtttgcagtgaggttcgcataaaagtacattgtcgtttaccaacagctttgagacgcagtgaattcagtatagggttacagaggttgttttacaggttgtctggtttgtccttgcagtctgttgcttgagtgacagtaacctgccccgcctcatgtgtcatcggaaggcttcatcaacgagtttcactgctttgaggttttgtttgtttccgcgaccacgctcccccttcacggcgaacgcttatcttttcagcacattcttctgcagacatagatgaagtctcaaagccgccgtcgacaatgacagaaggatgtcccaacgctgaaccgatcttgtctgccagacggttcttttcgtcgtggagttgatgagtcagtcctgcaattaggtgtggaccctcctccttcctgccactgtgtcagaatgcggttagcgcggtgcgaaaatgacatgaagttcggcattatcatgcataatgcatgtatgcagaatctctaaagttctgagtcgcctaccattcttcagtttcagatgatgattattcggagcagttgacatccttggagggcggacctctgtaacaagcgccaagccttttttttcttgccgccgttgcctgaggcgttgtcgaactcgaaacgcgctgtttttagcagtagtcacagacctggctgtttcggtggaaagtgtatcttctggatgtttgatactgacaaaggcaaaaatgcattcgtaacttagcattgcatcggactcttctggttctgcagctatacaaagatacggtctttctgctgccctcttccctggtaaaagaagaatccaactcctagtacgacggtactcatcagactagcatctgagtagtagttttctctcggaccagtaacaccagtgtggacattgcgtcgcagagtgacagaatgacccaggggcaaggcacaacactcgagaacgcttcaactgacgcaaggcgggtccccgctcagtgtgaaaagctcccatcacatggagatggtttcccgtgctaacacgcaataagttgttaactgaagctgctgctgtgccacgaaccaacgaccactcatagcgcggcacgctgttgacaacatatcgattgatatgtaaacgagtattagtgctcctgttccgagcagctgcgacttgatgggttcgaactgagagtactccactcgcttctcatggtgtcacgtcgctcgactgctaccttacacgctagccaaaaggtgtgcggcacctaactaaaaccattggctacagaattgtcgtctgttgcaagcgtcaagttcaccatcgatctctgcaccgacaatggcagtttttgccggcaaaaatccaaactccagcgatgggccaccgctcactcttttgtgccctcatgtgtggtaggcaacatgtcttggatctgccaacccactaaaggagtgaagcgcgacttcgcgttcggcggcagtgaaaatccgtcctagcaacgcggtaatgggccagaaaactatcgtgaatgccacttcctgacatcgaaatctcttcttgggttgctgtggcgaacagcacagtcgttcaccgtgtcactgacatggtaaggagggtggtctatcaggcagtggtatcgcggcggttcggccttcgtatagaagcagggggggcacgggacggttcaccagctggctgtcgctccacgttgccgtcctatctcatccgggacagcgttgtgtagcttgcgtcccagtcgcacacactgaccgctgtgacccgcggcttctcgccagaaaatgcactggagaacgtcgggtagccgattgccaccttgaccggtgaacacagttggatcgtttggcactccaaagaccaataggctgtgcggcacgtatagttatagccgtagatccgattttctccgtggtttgcggattctgtttacatgacaccgttcgacggtttcgtgggaaacaagtgcatcatattctcccgctttgacgccagcgtccgtgcagctgtcttactcaggggtttttttggcgctgcagcgcacacccggaagaaacgaaaa

SEQ ID NO: 1208 - DNA, 1561 bp, Toxoplasma gondii
ctctaggaatcatcatgcagagcgagactcacggatgccgcccgactcgctccggcacaactctctggaacaacaaccgttgtcactgatttagaagcgaacgcgctttcctgaatctgcataactcaaatcgaggaggagcaagaggctccagttgtttgaatagcgctccggaactgcgttcgcttcactctgagtaaacgattgacctggtcctcgcgtttcaaagcaagagcttctggggagatggaagcgaccatcgagaagcggaactctaaatttactccgagagaaaacagatcccttgcatcagtgtgttctttcctgtggtccgttctgaaggagcaccgcggaacgctcagagcctgagcaaaacaaaaacagttcatgcgattcagtgtagacgccttgacctgcgcccacggctcgctggaaacaccggagaacagtcaatccggaagaaagacagacgagatgagaaaacggcggaggaacggagggccttcaagagtcagacgaagaaaagcaaaggaagctgacagagctcgacgagacagggggtctcaatagagagacctaatacggcacagcaagagagaaattgagataacatgggagaacaaagagtggagaacaggacgtctgaaggagaagacacacgacagacagaggacggagagacgagagcagagaagaggcaaagcagcgaaaaaagaagctccgtaacttcgacaacactgaacacagagagcgcagaactgcacgccagacaaggcagacaagagagtgacgaaacagcggcgagagagcggcgagagaagaagagacgagtaaaagagaggacaatggaagatcgagaaaaaagaacatgtgaggagggagaggaaagaatctgtttcagagccacaggcaaactttgcatgcacactggctgcgcatgcaccaggggacagcagctggctactcgtttgtctcaaaaaagtcttcgcggctcctctttgaccgttcttgtcttttgtctctgtctctgtccttctcgcggttgcctctggctttttccttcctctcttttcttcgcctgtctgctttcttcgcgcttcaaggtgtctctgtctctcggctcaaagaaatattcgcgttttatcctgtgacagatgccggggagccatgcgcgcgcgcgcgtctcgaacgggaacttcttgtgtcggtttttctcttttctcctggagtttttcaactgacttgtcaactagggatgcatacacactcattagtagctttcttggctcttctgcctcacttgtcgaggaacgccatgcagcagctctccccgtctcgccgtatacctgcgtctccacctcgaattatgcgcgtttcctttctgctggcgctgttgtctcttctctgtgtttcgtcctcgacggctgccgcctctccttctccttcctcttcgacttgcctttgtgcttctccttctctgcggtgtctacccgacctgagttaacgaggcgttcggttacagcttgcacagctgcatgcaagagcagagcgctatagtcga

SEQ ID NO: 1209 - DNA, 3934 bp, Toxoplasma gondii
ctttgcgccggcatcttcatgtttagcatggtcgctatgagaagtcggccgactgtccaagttaaccgtttttaagaaatggggaccgccactacccacgctttcgcaacttgcctcgactcttgctttgagtatcgagggcctcgcgtgtgtttctagagtcgattcgtcggcgaagtagccgtctggtctatttttaacagacgaaacggcgccctgggagaatcgagtggtttctcgtgaggcagcgccaaccaatacgagctcctcacgagtctgagatgcggcagggtgcgcggagagacggctgaggcatctgcagtcctgagctctcaccgatgcacgagaggcttcgagtgccaaggctcggccacttctctcaaaacatcttggtgcgacgctcttccagggaagacgaacactttgcatcttgaaacacggatgagataccttatcacacctcgcagaaaacccctccaaagacacgacccctttcacgttcccaccctcttcccctgtatccactgtaggtacgaggagtgaaaaacaggcacaaaacgcgtggcagttttaacagaaccccagcagaaacgcattccacgaataactgtcattaagaacaaactaccgtgtccttgagtgatgatgctgagaagacccattcagaatggtaccgaatagccacagtggtcggaagaaggacagcgagcgtggttgatgacacaaaagttcgcctgcagcaaccgacagaagcccgactatagaaataatgacaagacgccatcaggaaatgaacacaaaacactttcctctggtagcgcaacggtggcgcacactgcaagaagcccttaagaccggcatctcgtccaaatgcccaccaggttttatacatcaaggaactgcttgtgtgttcaggagagacaggacagaagtccacggtgacgcgacggcgatcggcagcttgcttgcctcaaatacactgtcttccgcaaccacgttgctccaaactacgcgagatgcgacactacttggtgaagttacactacgcagaatcgcaactgccacagcaattcgggaaatgttgccttctgatttaaggaaacgaccaatgctgcgtctcaacgtctctcgtacggccacacaactcatttacggaactgcacgaaaaccagggcacatgagccgcggtttttgccgaaaggaacgtgtcgaaacaaagccgtttctccaatttcatgaacagtaaatcaacactggggtcagaaacgaacatggacgaagaattttggtaattcccaaagatgcgaatgaccctcgtgaatcgacacgcatacgcaggtgcatgcttcgtgcatgcagcacacagagactagcaaggatctcggtagcatcgacctggggactcagagttatactaaaggaaaacggtgcttttacaaaatcagtgttgtgtgatagaggatcgacgctcgaataccgtctgtaggatgaaacaagagctccacccaccaatgtcgttgaggactctcgccggtctatccagctgtggacatgctgtcgagttgggttggctctgcttctgatccctcgcgttacaggctagtccttcacattcagcggttgcgcacttttgcttcattcgcatatcttccctttaatccttctggtgcactgttgacccttgttacgtgttctgcagttccgtctcatacctcaaggttgtgtggcgtaggggggtcaccacggtcccaattggcaatctgatccgtgttaccctgctggcccagctagttgtgttctttagcaacagtgtacgtcagtgcgtttcttttcgccaacgtatgtctgctgactagagagccgattctactggttgccttctcgtaggctgtagctgtgggtggaaagcgcttcgacaggattctgctgttttaccgttatgtgtcaaacactcaggggaacctcacggctttaactctgtaaaattagataacgagtgctgaatgactcctgtcaggtagatatcagcaagtgtagaactcccatgtggacgcgtggtggttcacaacagaaacaaaaggctcgctccataccagaggtaaacacatgcacggcgtggttcccttctgacatgttgtgaggccattcccgtactatttgcctcatttgccatcgccaccatctttctagtcttttgaggctgcgtgggtggtgaatgatcgtaggctttgattcactgacaatacgtgggttgcctccgcaaaggctgttgtggaagaactgtaacacagattagtataaaggaagccatcacatttaatgctattgaccagaatatggcagaacggtggcacatgcgtattccctttccaaggacaccaggcgtcatctaacgcactatgaaccccggttttaccggttggcacggttactggcggcgtggccgcctacttcattggttgtccagtgtctgcaagcaagggggatcggaaacactgttcgtgaagagtggcccagagttccggtatccagtttggtaaaacggtggtgcgcttttgccagatactttaatgtttttccggggctccgttttccatgccctcatctttgtcaaccgcattacgttgcaagccatagtttgctgtcagtagtgtcgacgtccatgcatcccgtggtgggagctctacggtgctgcagcgcagaaaacaaacttaccgtgcaagagaaaacgagcatggttcccccggtacttcgcgtggcaaatttgcaggccagtgctggtgaagtttctggcggcagatctttgatgaaccatgcgttcatgctgcctcggcgttgtcaataacccttgagatttgcccaaggttggcttcccattatgggctgactttcttaccaattagtgtcctatctgcgtgaggattgtgatcggcttcgcttcgaagcgtcagctgcgctacatggctacatcgcttccttacctgtattacaggtcaggcctcactcgacacacctcagtgttcaatcagggcattctccggtagtgaaattgatctcctgtaatgtgcgaacttctcgaacacagctaattgtccaaaggtggacgtgccggtctctgggccccgtggcacggcactgtccgtcgtaatgctgttcataactattcatcagtgtgtctttcaatacctataatctcgaaatatcgacgttccttcccgacggtgcgtcaatgaagacaagtaaaacagttaacgtcggcaactcgcgttgtatccaaaggcatgtttgggtcttgcgcacctggttgcaatgtcacatcaatttgcccgtctctaaacaagcgagcgctgattggatgcaaatgacttgcgggtgcatatgtgatggaggaactctcgttttcactgcgtacaaaggcattacacaagattggtgggggccagaaaagacgtggtaaagagaggagaatacttgaggcctccacactgacataggtgcttttagagcgccgtttgacacaccatcaacgcgcccggcgtttcttttcacacgcagcgcgatggtctcctcacaagcgcagtcgactgcgggcgcgtgctgcggagacctcgtcgttcttcgcgcggggctgtgctgtttcccaccgagacgaagttttcttctgtttgtttcaagagtcgcagtattcgccttgaactcccatccccatgcttttcctgttcatgttgccacgtggcgggccaggtcactaacacagttccaacctgtttgtctggtgcgtttcagcgttccgcaggacgcttccgtcgtttttctctacattttctcagtcgttgtgcatcaattgaatccttactcttttcgtgctccgaattgttccgttggacgtcgcgacccgttctctgtccaggccattagcttgcgaaatccgcaa

SEQ ID NO: 1210 - DNA, 3118 bp, Toxoplasma gondii
agagaagaaagacaactcgcttcgtcgcgtgctaagcgagccatgcgacggtggagcctcgacctcgcctcccgccttcctggagccgtcgaggccgtacagcctctggggtctgtgccgctcctgctcgctcaggcgctcggcgtcgtcgtccctcggactgccggaccgctagttgggctcgggcgccacagccccctgggctgtggcgcccattctctctccgcgagacacggccgcggcgaggcgacccagcggccggactcggcggaccgcagtgaagaggtcacagaccgcggctccaagagactgttctgggcttgcaggagctgggaggggctggagtgtctagtccatgcagaggaacgcgaaaactaagaggcggcgtctgtggcgctagtgtcgccaaatgcgacgggaagagcacggagacaactgactcgctgttgtgtgtgcgcgttccttcgggaattcgttgggaggctggggaggcgggggggagagggcgaggctccaccgtcgcagactttccgcgggatgagaagttccgttgtcatttcggtctgatcgggactttcaggagagactttcgagtcgggtggaacggagaagtgaagaagagcagcgtcggtggggcagcgctggagagcgaaaggtggaaaggccagaaggcgaccacgaagaccgaagaagaggggcagaacccgggggcaacgaaaaacgctcacggacgactggcaagacacagaatggagttcctgcatcaggcaggcatgggttcctcggctgcttgataacggctgcacctcttggcttccacagcgttgttcgtttctgttcgggactctccgctcgcgtggtgaggctcacacctggagtttgaggaacagaaatgcgtcgtgcagaggcgtccttcattatgagaaacgtacaagaacgcaaaagcagatatgtctggatgtcggcgggaggcaacggagacgcgaggaccgcagcgagcagctgccaagtcaaggttttttgcgcagaagcggccgagtcagttgtcactttcggaagtaaaggggagccaggatatgcaatggaaaaagacgtatttcttgcgagtctctcgagacactctgcgcacactcccgacgcatgttgacagatgtcgacacagagatagacacggcgatgtttactcagacgcttgtgccatggtactgtgtcaaagccactgacacagctgatggctgcagaggtagacacttttgtactgatacacaaatacatacatgcatacatatatgcatatatacacagaaacgaatatatttaaactggagggcgcaggcagaaatacgtatctgttggtgaacagagaggtgtaccgaagaggtgacacttccgtccgtggtggctcgtgtcggtttcgaaaagttcctctggaatctgtcctcgtgtatgcgctcgagtcgcgacggtgtttgttgcttcgctgcgtcctgaaattcccattcgcttagtctttttctgacagctctccacaccaggggaattgcctcagcttcgtctgcgtgccgagcatcacgagacgagtttgttctaaacagttcgcggtgtcctctgccgcgtttttaatccagtgctgcggatccgcgtcagaggggggtttgtttcacccttcacagctcgaagaagccacccattcgcgtttcttgtaaaaaactgtgcggggaactcctggctgctaacgctctgattttcgatttttagtgcccgctgcgatcccctaaactgcccattccacacaaaagactctggtgcccgcgacgaccagggccgccaaacgatcccccttgtgttgggcagtcccctggaggatcctttttatgcggaacgcgtccgacctgtggtgcccgggcaaaccacgaacagtgggatggcgtatttaaatacatcttgcgggggtcgtgaccagtgggggcttcaggttcgcacgaacaagcgaggacgagtgagactacactcagagagcgcgaagcttgcttgcaggctctcgtcgaactgttacgctttttataaccgtgtccgcgtggcaaacgccatagcaaagcctagcgactcttacataatttgcctccggatatggatacctctttcacagagacacccacaagaagtccttgtcaaggtctacgctttcggttcccgtacttgtctgtggtaaactgccccccaccatacattttccactgatctgtcggttgcgctattttcacatgattcacacgtatatccttttcctttcttcacggttgcgtccgggcaacctttgctcgacagtgtaacgcgctgctcagccagccgtaggcgcgacgctagacagaagcactggtatcgaacgatcttcagctgcgttagcaggctctgtctactctgactcatggaaggtgtcctatgcactgacgcagcacgctgcttgtcttttcgaattcagatgcgtcacctatgtctgtcgtctcgcatcgggagctcaaccagcgctgactctccactcgatccgttgttgacaccgctataaacgcctgtagagcgtcccgtcgaaaatgatagaacgacacgcgaccggcctgtgacactgacgtcagctcgaaaacccgcggttttcggttcgcacgccgaagctcgtgtggaaacgcgtcatcacgatgccgccgcggcggttcaggtatttcccggcacttcgttttgcgcgtctccattcgcagatcgcagtcatgtatcggaaaggaagtcgaacacagatcatttagcagccgggtaaacgcctctcgatgttcgcggcaaacgcgtctcttttattaagagccaagcaacgttgcacggtgaccctccaatcggcatcagcgcgtctcaatagcgtgttcgacgaggtgacagttcgttccggatttgcacggttgtttgaagaacacaggtaacgcaaactccgctgttcagagctgcaacgtttgccgacgaacaccgctgtctgctttttcggcttcttcgaggctgtccccgccgcagttactctaccggtgaaggcacgtgacgagaggacccagttctgtgggccgtggaagcccggaaa

SEQ ID NO: 1211 - DNA, 2935 bp, Toxoplasma gondii
atcagaagggagaagtacaaacagtgacaacaaactctcggcggtttcgctcgcccagacatcctggagaggaactgcggagcgtgagttctgcatgtctgtcgaaagcttctctccttctgaggaccggggggaaagtcgtctcaggggacgcgagagaggacaggcgagttttttttctgcttccagtgcgaagagcctgcgtcctcagcgtcgaccgactgagatccgcgagtctcatagagtccatgcctagatgcttatcaacaccgggagagcacaggcgtctcctcagagagggacagagagaagcaaagggtgtgccgtagcgcgtaccgacgaggacaacttgagagtagccgccgatcatcaccgcgaggtagacgatttggacgatcggattgttggtgtgaaagacgtagaagcaagcgcgctcgacgccccgacggacgcgagtcccgcagacgcgctcgagcaagtggaggaagcgcgcgggcagcgcgagaaagacgactcggtgtaaagtcgagaagggggaggagccgtcgggcgtcgagaaaaaccacagcagcgccagacagacgagaagcaaaagaaacacacacgcgccgagaagaaacattgtgcaaacgaacgatggagcgaagaagagagagaagagagagaagaaagagaagagagacagacaggagagagggagaagaagagagagaagagagtgaagaaagagaagagagacagacaggagagagggagaagaagagagagaagagagtgaagagagacagacaggagagagggagaagaagagagagaacagagagaagagagtgaagagagacagacaggagagagggagaagaagagagagaagagagtgaagagagacagacaggagagagggagaagaagagaaagaagagagagaagcagggaaaggagatggggacggcgacggcgtccgaaggtgacgagaggaagacgacgaggaaaggacgaagcagtgaagaactgtttccgggagaggctccgcctgagattcgcctctcaaggaaaagatttacatttgttcgcacttttgtttcctcgcaggacccccgggtcactgcggtttctttccaccttcagcgcgtcgtctgactcaggcgccctccttctcatctgttttttttctctctccttgacctctgcttgatcttcgtccagctgactgctgcgtgtcttcttcctcccgtcgctcttgtttttctgagagagacggcgggagggagacaggcgcggagggagagagagacctggagtcctcgagactggaggaaccaggcgaaacgagccgcaaggaagttccatacaggtgagggccggacgacctcactgaagagatgaaagaagagagggaacagagaacagacggggtaggagaaggatcgagagtcgacgccgctgcacacaccgcgagatggagatcacgcaggggcgtttctgcgaggttttcagggcagtgacgcgcttccacgcgcgagaagctcaagacgctgctctacgtcttccaccagtgtttatcgacaacaacaaagaacgaggaagacgcgagaaacgcaggaggtagagaagctagcgcagaagaccagaagaaaagatgcacggagaccaacgggcggtcgcacaccgaaaaccagaagatctcgcggtgcccttgacagccggcctaaagttcaaaaaacggtttcggtggtctctgggtgtcgatgttctctcggagtttcgcgagaagaaagttgcttttgtagaaacacagaacagcgcgtctcgtatgtctacaaaacaatgcgcgctgaagcgtctctcgaaagctcttcctcgcgcctttggttgtgcgctcaggcagaatggggaaaagatcggaaaatgcgtttttctccatgtgctaaagcaacagtttgaagaaatttgacaacgcagaggacgaaaccaatccgtttagggaacgcagtgtggcgtctaggattttcggcggcgccgtcttctcctccagccgtcggaaatccttttctgttcctcgttgcccatatctgctctcgcctttgcgtggaacctgaggttcttctttctgcgacgttgtgtgcgtccagtgcccttttttctctttctttcctttgtgcatgcgtcttcggctctgttttctcttgcgtttctgtctctcatcctttctagggagagagacaggtgcagagttcctccccggtgaccctcgcggagaggaggcgtctcgcgccgagagagatcgcgtgtcacatgaaaaagactccttcgctctcagacctttttgaagggagaaggaaaactccaactcgcgttctacgccgtcgcgctccggtcccctccccacctccccctcgcggtgtctttctctttttttctcccattctgttgcccgcgagcaggattggcgccgtcactctctgtcagttcttgtcttctttctagaagaggaacgacgcgtgtgtgtcaggaaagaggcaggcgcttttctcgtctcttctctgtttcgcaggcagccgctctctctcgtcggtcatcctcttctcacaagaagcttctctgaagaacatcggcattgcttctcgcctgtgtctccgcggctttttgcggcatcctgccttctcgcctcgccatccctgcaaaaaagagcctctgctctcaacctttcttcttttccactggtgccctgtgcgtctctcgccgcgttcctccaaacctttggcaaacttcagcttccttggcgatctccccaccgctccctttttgtcaaccgaccgtcttctcctcgccgagttcctcttctctcgttccgtctctcttctcttctctctcctctgccgctgcgccgcttgctgacgcgaccgtctctcgtcccccgcgcttcctgccacca

SEQ ID NO: 1212 - DNA, 2692 bp, Toxoplasma gondii
atgtacatgatgcacacagctgcgaacagatacctgtgaggatacctgtgtgtagaactgggtacgactagacgcagttggaaggttgagatcgggagacatcgagagcgggtgacatggtggctgactttgagcaccggatgcttaacgcccgtggacgggaaatctgatcttcgaggtcggagattctccgcggtactgtcggtcctcggtggtcagagtaaaagaggaccgcagtcaatttcactgtaagtttcaagctttgcttgaaaaagtttagctccgagtctctcacgtttttcgtatttgagtttgtttcgtttggcaaactcgagtggcctttggaaaagccgtccgcagttcaaaactcgagtcccgggccttgcaggtcttttctttgtgtttgccttggatatgtgtatcgattcgaacgcgcaacttttctaattgcacccgtgcgcacaagttattggttgccaccggcgaacaggaagcggtggtactcagttgttgaggtgagttcggagcttacgagctcaatgaaacgcgagagtttgcgttgaatgtgtactggaaattgattttgcatctgtacgcgtttgagaggacaatccagatgatgctctcccttgaacaatatgtggttttgcttcagacaagctcacaagcaggggaaaactccagaagtgtgattttagcaggagaaacactgtcgcttttcacttttgctgcttgatcggataagcaatgctaccgtccatcgtttacgcgtctctagagaaaccggatctgcggatcggtgaacctccgatgataatcactctccgggtccgtagaaacaatcgcaaccctgaaactcagcttcgttctgcactatcgaagcagggaactgtgtgcacttctgaagcgatgagaagtcacagacccttctgtgtgtttcgcgggatgcctcgcgtggcgagaccaggtaaacttcccgaaaaaaagagatgtctggtgcttctcctgtggccagaagcgtctttctgaagcaagagctgtcgtttttcctgaagttctcccgacctcagccgtttctcaacggtgagagaagcgcgcgacgggctttgccacttactacaaaatggtcctcgaagttgacggtcatgccttttctatgcaagcgaaactggcgtaatttcggaggaagtgcgtcgagtcggctctacccggggatgggcaggaacgtcgaacacgggggcaagaccgaataaatcaaatatgcatatatatatatatatatatgcacgataatcataccatctgtccccctttctctgtctccgataacgaagcatctatcctagcttgcaagtatgtacgctgatcttatccatcctgcgatccaaccactcgtcacctaccaatatcatggcaaatgcgatgcgctggatgcgctgccttcgttgttggcagtgtcttgcaagctgggaggagcgatggcgtagagggggggcgttctgaagagaagcttctacggaaagacagaaatatgaggaatggaaaagacaagggaggggaaagagtaaaaagagctgcataaagatgacgcgttgtttgattctcatttccacgtcgcgctcgcactattcccgacctccttctcggctcctttccttctccagttgcatgcacaacctcgctacttcacttttctctcgtttcggaaaaaaggcttgcattgactggcgtgtcactctctctcctcgacattgttttatgcgcagagacgtcgtcttttttccaggcacagacgtggatgcagttccagcggggttttcagtgttttcttcttcctcacgtctctgtggtgtcattgatttttctctgtctcgcgctgtgtttccttcctctctctctctctctctctcgtttttttctctccgtccttagctcttcccccctctccctttatccttgtctctctcctcgtcgttctctcctcttcgccgacggccgtcgctccctcctttcctgcgtcgcgcctctctgccgtcctccctttcgaagccgtcctcaactacctcagccagttcagccaccagcgtggagcgtcgtcgctctctgtcgctccggtgaaagaagagagcctgatgttctttccttggttcccttcctgtgccgtatccagttccttcgattgcccgtagacccccgagcacaccttggctcatgtggacaggagggatctacctcgctcctccttcccttctctctgtgtctgtgctgaggctcgaagtcaacggcctgtctcctcgcttctcccgcatttgcttcaggcccaatgggtgtctgcagccctgttgtcgaggttttctgcggcgacggtccgagacacagcacccagagaaaagcctctgagggccttcgactaccctccccggttccgcaagtgtgtcggcttcctccacattcttgcctcttctcagcttgacgctttctcttcgtcctcgccttcccctgcttcgtctgaaaaaaaagcgagagcctgtctcctctcgtggcttcgagcgccgctcggcggggcgcagatgtgagagtcagcgtagaacgcgggcgtttgcttccccgagagtccggagcttccccgcggccgcgttcgtttgtcctttcttcactgtcctctgtctccaggctctcttagccggtcgca

SEQ ID NO: 1213 - DNA, 1742 bp, Toxoplasma gondii
gaccgcagcagcgacaacatgcttttaaggaaacctgactagttcagtttgaatgagacacgggcgcgtgcaatcgagtacgagcttgtgttttcgggggttacctcgtccagttgactggaactgaatcggttttcggcggctggcagtatcatgcaggtagaagtattctcgatgcatacgcgatgtttacagagacctaatgccagcgacatccgtatttaaacaaagactgacgctggtagcaaaggcccggaagtagatctcgcgagagtaacgctggtagacggcatttcctcgcctgtttctgctaatgcctacattccatttggtgatccgctttcattcgcatcggaagctgtccggtttccgatgccgtccctctaaggatgatccgaaaacctccaagaaaagcctgaccgttacgacaatacttagaaaagtgaagaatacccaggaagctgtatcaaactatacaggcttacaaacggcgttgggtgcacgttcgcgctacttcaactggtagacacgtgaaaggatctcgagggtttgtctcccaatgtcttagggcagagagttgtcattcagcagggggttacgccttttcagcatgccgcctgatacacagattttaaactgtgagattctttatagaagcacgtctccattaaagaagcattcgcaggagtcccaatgagtactcaattattccatattcgcgtcttaccttttccagtatatatgtatatatatacacacatatttatatatacgtgtataatcggaagacatcacaaacaagcacaccaaaagttatccacgcctcaggacatctcataagcatgaaacattgagcaaaggtgactgcaaagatattttcgattcaatatgttgcagcgtagtttgatggttttccaccacattgaacgactgctttatcttgacgtaggcggggcagtgtcgaagctatagcatgctgaatacctttcatgcacgtctcgcaccactctcgcctgctcgaaggaaaaaaatatgtgaaatggagtgtttcctcttcaaccacgaatgtgttttttctggctcgagagaattatagtgaaacggaacaacgatgttgcttctctcagggtcatcgtgcatgctcctcaatcatgctagattgcatgctttagataaggagttctccgccctccgtcgcagtttccacttcatccttgagtgggatcttggctttctgtttcttatcttcaagatttttttctgagatatagaggggaaccggagcagagacgtttttcagaggtggccaggccactgtgctaccgcggtcaacggaactacgaataacagaaaaggagattttcatcccaattcatgaggacttgttgactccaaatgtgcttgcgagtacctattcaaaaaaaaacgtttcttttattgcggaatcagaaacacgtctacgccggaccatttgtcgccgaaattctgattatgcaagggcgctgccagcgtttccataccacaaagtggaacaggcgttggaaaatccaagaaagaagtgttgcgtccgaagcgcttggagtttgtcccgattgccagtttttatttatacttcgacattgaagagctgattgcaattgatcgttttaagtagagtagcttatgcgacgatgctcttgtgatccccgtgaccccgttagcgcctaggtgttcccctccttccgtcccgccgatcttcttca

SEQ ID NO: 1214 - DNA, 3165 bp, Toxoplasma gondii
ttttccacgccgttttccgcctttccacgagggttgtcttgtcaaccatttgggctgtgcctttgtttccctttttttcactctgtgtgtctgagtgtgcgtgtctcttgcgtgaagggtacgaagacgcacaagatgactggtgtatgtttgtagacgctgatctccagacgtctgagcgtaggtgtatgtctgtagagatgtaaacgtgagatgtatacatttctgcatatctgtagagtgccacaaatgcagccggtggcaaggaacggaggccaaggtctatgttcggcgcaagtcgcctccgtgtgaagtctcagcttttgagacaaaacggttcgacgcctccttccccagcaaagtggtgtcgggcctcgagtccctcactgtcgattttgagaaggcaaaaaaacatcgcaaatgaagccaagttttctcacctaaaacctcgaagccatgtccgcaaagatgcggcgcgcgagcttgcatcgcccagaaacgcaaagcacagtcgccgatttgttcttgctgctttgtagctcctctgtctggtcagcacctttctaagagggaaggtcggcggtcatcctgttttgacagtcaagcggagtcgatacttgacgtttcctgtccattcgtccaagctagagtgcccacaaagcttttccttgcctcccagaaacacgttccccagagaaatgcctcgcaaagacggccgttcacactttcaaccggggccgtgggaaaatgccgagtcggcacgatccgttggtgaaaaatggttctctgctccagttgccggacccatcaagcggaccgtccagagcaaatagcagatcccaagccatcgtgaggaatgcgtatatcctgtttgcacgatgaatgcgtcgtaaggcaacaacgccaatgctcacttcaacaacactttgttgcgaagaacaattgcagaatcataagtctcacagaagccttaaatagcggatggaaacaggaatacaggcgacacacaaatgaaaacagatctagaaacagtttcttcactcgatgtgcagcgcttctcaatgccgcggtccgacttcaaaacagaggagaacgtgattattctctgtttccctgccgaagggataagagtaaagcagttttgtgagaattatagacagcacattgttttttcgggcgttgcatccttcatgagaagtctgtctatcgcatcgagtctacgggtatcaagcgtattttccagaaactgccatttgcgggcgagaattacattgtgaacttcagtctggtagtccccctgctgatgtacatccatacggaatgcaccgttcggattactgttgaccgacctcgtgttgagggcccaggttatatacaccatacctctacagtgaactattagaatctggacctagaaagtcccgacgcgtcttgcaactttgcgccttttatttgtggataacctgaacgtttttagaatgtagccgctacttggaactgggtgacctcacgatatgctagaaaataccaatcaggtacgatatgaagtggcgttgcgaaccaattgtctggcagtgagttacgtgggtgttctagttccatcaaactagaagccgtttgtacatttctgctcccagtgttgttcctattagcaagaggatagaatttttgatgacgtgagagaactgtctgcaggacagtgcgatagcgaaggtccacacatgtttgagcaaactcctaaggtgctcgaagtgcgaagatttctccttctgcgtgactggagcagctgaggtgtcgaagaccactggaattttaccgacacaaaatcgatgtgaagagctgcgggcaaggaacgatctccgcgatcatgactaacaacccctagcgccagtcattacgcggtacattccagctgcctagttgaacgttctgcgtgccgaggcgccagactggttccttcgaggacctgcggttgctggtatcagtcgcgttctagttctgttgacttccttgtgatatgtgtttttagggtatcttctacaggaggtagacacttcatttctatgttgttcggtctctcacatctcgatttgcaggcctagtggtttcagcgtctcgcctctatttcagtccgcagaggaagcgatggcaacgccgctcacagagacaagcgcttcgttttgttccccgcattcttaaatcatccagcgtcaatcccattcccactgtaccgctattaacctgcaaagcgtgtctgactgtaaagcatctgtaacctgtgcctcaaaacgtgtcaccttgtggacgacaacgtggtgcgttgcggattcagttaatagcgggttgttggtcgcatcaaaggttcgtccttctttttgatacactatggcatttccacagatcccctctttgttgcaatattacaagataaaccctcatgaacacgacctcgtctgctttctgacagtactcgaacatcggcaacagcacacctttgccatgctcaagtgcccttgtcggcagcaaatgggatactgaagttggttcaacgcacttcgaagaattcatttaccctagcgatgtgagacaagaagttgtaaggagcctttgcctgcaacggctgcataaattctgcggaacacgaatagtggagagaagtaagtgagtgcagatcaagccgggataagaaagcctgaacatgcccgtgagaacaaggggatatgtgctggagagtgaactcactgcgtgccgaggaactacgaggtccctgacaaaaaagtcgtccccgaagctggaaaatgtgcaaagaaggcctggtggctcaagagggggggcactgcatccagctctgcccgtcagatgccaagaggaagactgacttggatgtcagtgacggtcaaacaatgttcatccccgcgtggtcggttttcagaaagcttttttctcctcgaaagaacccgaggcaatagctctgctccttctgctgtgctccatgtgatactgaggcaccccgatttcgagtcgagaacgttggtgcgagccacgagggtagggtgaaatttgcgtggctgtcgttttttctgaaattgactcgtggtcctccgttttcggaggttcttcctgcgtggaagctttttcttctgaaagaaattgctcagaactcga

SEQ ID NO: 1215 - DNA, 2572 bp, Toxoplasma gondii
ctatcctaatctgtgctgacgctactgctgcctacgagcggctcttgtttgttgccaaaatctaatcaatttggataggcatgatttgtgccgtttccattggccttttcgatacgatatacctccaattacaaactaacactgcagagcagaaagctatgtctcacagatgattgtagcgtttttctgttcgaggcttccactagtgccttgcagaaacctttagactgctagaacagattctccaaggggagccttttcgtccactcaacatttccatttacttcgatgtgccgaatgcaaactcagctaatctgcaccacgaaataaacgcccaaacagtaatcatgcagacaccgttggtcgacgtgactcaaacgaatgatgagcagccgtctcaaaattgaattgacaagacagtacgtccttgagaaataaagcaagtcctgacgagtttattcctgatggctgcttgccaatgcaaaagacccatggctacggccactcaggtagcgaagactatcgaaacaaaatgcataatccgtttttcagactcattccaaaatggatgcttccggaatcatgcgaatatgctttgtttcatgacgcagtgttatcagtttcttatggtaagaaccgtcttacacataatcgcgcgaaaactcagaaacagtgcagccaggcaaacgacaacatgagtggcgtcattaaaagcaggagagcaaatctggctgagctgctgtacacatacctttgacaaatgcagataatgatgacctacgaagaggcagacttcaaatggtggaggcaaaagggagaatggcaccaaccagacaccagcaaaacaaaactgtacgtcttttctagaacagaaaatttgacttctatcgtagatcccggtggaagctcgaacgcacgatgacaactgaagcgtgaaccagaatacagaggcaccggtgatgacgcagacacactccggcaaataaaataaaggtaaattcggagaagcctacgcactttgccgaattcactgactaccattacgttgtctgcttgagggtgtagacggtctctggtcgttagcacggtcgacatgaggaataaaccgaaaaattcttgcatgacagagaacggtgcgagttccgggggtgatagagctgtttttctttcaaccgaactgtaccgcgacagcacatgcgggacccacgggagttcccctcgaatatatccagctgaccttagcagttaacttgtcgaacgccaaggaacaacctagtttgttaccgtatgcacacgtcttctgtgaacttgaaaggtaggcactgatactgatgacgccgcaacctaagcaacgtggcatttgtcgaagctcctagaccctgtgaaactcaagctgtgatagcatcggcttcttagtgaaatagcaaattcgcaaacctaaaaattcgttggtgatccctctgtagatgcttcgttcgcatcggtaagcaacttgagaagactgccagagcgctgcacacattggagccatctgcgcatctacccccatcaatcaggacaacgtaaagaactcgttccatctggaagtggatttcttgtttggcagacagtcatatttatgcgataattgaaggtttatggtttaacaccccccttgtccccctccaccacccctcccccgcagcccgcccaatgttgccacatgcaaattttcctgtccgtgtaccctcggacagcgtcgacgacttcttgggacgacgagggacctgttcggtgcatcgattgttgtgttggcactcgggacagttcagctagcgacaagactctggacaagtggtaaatttagatagactagcggcatgtgatgcggggaaaattcttcgctgaattctgcgaagaacaaagaatcagacgcgttttacctttaattggcatgcaggcttgtgcatgtttctggtgcctgctgtgagagattacaacgatctgcttgttgcgctgaggcacgcccttcgcacacgctaggctacaaaatacggcgtctctgcgtgagaaaatgtccacaggtatttttttgactgcgaacactcgaatctaacgacaggcgttttttgcgcggttcggcttgcaaatctatggtgtatgacaacggcaggcaggttaggcacatgatacgctagcgacgtcctcgtttatccttgccgcactgccaccgctcagaacatgacaaaatcggctttgtcactgttcatagagacttgaagtggctgcgtgtcacttttgtcttaaataacaaattcacagcgggtgtggctatgtagactggtacggtttttgatttgtgggcaagtattgaaggcaagcccccccagaagttcttccccgtggcccaggagagtccccaagtctcgcgggaaggggaagagtttattagatccgtgaacactagttgattcctcgttagttctgtcaagtccggttgcccgagctgctcccggacatgccgcaggttgggtgttaccatcctcatcttccgctcgggcggctttcggacaggggcggaaacacggcatta

SEQ ID NO: 1216 - DNA, 2854 bp, Toxoplasma gondii
aaggtgacgaattccttgccgtttgtcgtcgtgacaagttggatttttttcttctccatcaatttgacgacaatgtcgacgcatgcgcgctccgaaagcatctgcgtcggcgccgcctcctggacagccatgaactgcctctgcagttcctcgagcgacaccatcttggagaagaagagagaaaaggaagagatggctggaaagacaacgaaaacggatttagcgcaggagacgcagcggcgcggagaacgagacacgaatgaatcgatgcggagtcgcgcgaaaagtgaagattattgcttgaaaagcggagaagagaagtgagagcaaagagaagagaggaagcagacgagagagggatacgcgagaaaatccgatggacagaagaaagtgacaaaagaacagagagaagagagaagaagcagaggagcagagaagaaagacgagaagcgacagaaggatggagaagagacaaagaaatgcatgaaggggagacagatacagaaaagaagagtaaacagcggggacccgtcggaagctcagaggaaaagagaagaaaccaacacgcgagaactggggaagacaagagaccgcctcggagctggcaggggactggtcgtggagtctttcgaacttcttcctcgcgagtaaaaatcacggagaaacaagacaaagaaagaaggagacgaatcgcgctgcctctcccggactggcggaagagggggctcgcggggacggcgaagacgacactggggagacgaaggaaaagttcttctttcacaggacaggcgaaagaagtgaacaccagagtgttcttgggggaaaccgcaagaagagagaaaagagagaggagaacgagaagagcgaaacgaagaacaaggcaaaagacggtagcggcgagagagtttttcgtgtgcaggaaaacccaggccgcaaagaaacgacggtgcaccttcctgtttctaagcgaacagaaaaagagaaagagcgcgtcgagaggaactgatgctcgggtgtatgtacactcgtttttctcgcgttcgaaaacgaagctgcgcttcttcgctggctgacgcaaagaagaacgaagtttcttttatctgcttcgcgcgagtcagccagagtcgtcgcccctgtctcgttcgttccactcaaacagcacagaggtggactgggagaaacaacagcctcttccatggaaacggaagccggatgcatcgttctgaactaaagtaaatactcactgcaactcctccctcctcagctcgctttctcgtctcgcagcgcacacagcagccgagccccgcgttcctcaccgacgcttcaaagagtggcttcttgtccctctcctccagataaaagagcgtttccggaactctccctgcatcatctgtttctgctctacgcaacttctccgtggctgtctgcttctctcgcgacgacctgcagagaggccggtgtttcctgtcgccttcccgtctgtgccgcctcggctgttggtttcctgtcggtctgcgcgttcgccggcaagacatcacagtgctcgtttgtccaggccgcccgacctgcgcctttctcgtccagagcttttcggactgagtgaccgagctcagtcacggatgaaggaactgagagtcttggggaagttcgccgcttggaaatccagagttttcagagagcatcgacgccgtatgtggctggaggcctcgcgctgtcgtcgctcgcggaactcgcgcgcgtttcgcgcgggcggagctgccgggtcatgcgggcgttcttggtggggaatcgtcatttgttgcgggtcctctttcgcttttctcgacaagggaggcgacgaagtcttcgataaaagtacaagcggacggctacggtgaaaaccgagaaaaaacgcgcaaaacgcgcaccaaagcgactcgacaacttcgcctctggacgacgcagcgagctggcgctcagctgtctgtacacccgagagttgaggcgctcggacgtttgctaaaacacccgcgagcgttttctgtgtctgtgtgtggcattttaatgcgcgtctttttctgtaattcgcgttttcttttcctcgcgtccacttcgtcctctcctcaacaggggactccgtccaacttcctccgcgcctcctctgccgcggtttcccggacaggcagccactcgaagagagggtgtctcgcgcatccgaggcaacggggacctacctcgcgcgtcaagagccagtaaaacgcactctttttcctttcgcttcacggaaaagcggactggagtccgtctgtttttctgcgaagtttttcctgttggcgtacctctccttttgcagtcttttccctctggggcctcggccagccgtacatggcgcgtccacgcgacgaagactggcaaccgacaggtcgagttctgcatcttgagacttgttgacgttcaccgagcttctgttgaggagactttgagcttctgctcaaaagtcagctgctcgacacctccgcgtcgcctcccggcgttgccgccccgcgcggcgtctgccgccgcttcgtcgtatctttctcgtcacaggatccttggcctcgttctccgttttccgcgtgcttctcctctttttcgttcccttctttctctctcttgacctcgcgactgtcgcccactttggtcgcgctcaccctccccaaccactctcgtttttctcgccgttacgccttcttcgctttcctctcttctgacgcgatcaggctcctacggggctgttgtgttcctgcgcttcccgctgctctcccttctttgtctcggccttctgcgtcgctgacttcctccgagttttcttcttcggactgctcaagctccagca

SEQ ID NO: 1217 - DNA, 2118 bp, Toxoplasma gondii
cttcctcggcttggttattctccgtctctccttgcagagcgaagacggcaagcgcctgtctcgcactctcgggaaggcggtgctcccatcgcgcctgcagaggaacggcggccgcgataccgtctcggaagcgtccttctttctcctcagcttccgcctcttcttctgcctcacttggcgcgtccggaacttctgcggctttctggggagtgcggcgcgagcgacgtccgaagccggggagctgtctgggggccttgggagtccccaaccgccgggccgtgtccgcggggcaactgacccaccacgcaggccccgcggagagcgaccagggaagccaccacggagccacagaagcggcagagggagaagcagaaggagaagaagaggaggtctctgcaggagcggaagcggggagtgcgaggagagaatctgagctgccgagggagaagaaggggagaagcggatggacaagagagagagaagtagggagagaagaagatggcgaaggcgcaaccacggtctgcgggaaggggagacgaagaaggagaagcagagcgactccgatggagaaaaacagagcaaacaggaccttgcggagaggagaggccgaggcgaggaacgagtcacgagcagacaggcaggatggcgaacgcatgcgggcctcctgcaagggagaagcagcagctggggtcccccccatcttcgccgttgctcccgacgagagtgcgggacgagaaggcagtgcagaagagcgcgtgggagacagaaggagaagaaccgctggagaaaaaggagacgcgaagaggaaggcgaaaggaaacacgacagggagtcgagagcgcggggaaaagaggattcaaggaccaaagacagggccgccgtgagaaggagcaaaacaggaccggagagctttacctggttcgccctctccgatgcaactcagggtcaagggggattttagggcatttagcgctccttgctcttcgatgcgttcctgcgcctcagaaagaccaggaagctggccttcctcgaaatgtagtcgaagtacgaaacctgccttttcgcctcatgacgcaggtgaagagaagtgaatacactcggaaggccttcagggttcacgggaagcgaggcatgcgaaacagacgtaaggagaccgtggacggataggggcgtacacgcatggaaaagacgatggagagagaacagataggtctccctttgagggaataccgcggatggagcatgggacaggaataagaagcgaggaaacgagaggtagagcaagaagagagagaagagaagctgtgcacacgcaggagaggaagggagaagaacagcgaacccgagagagacagagatgactcacgagtctcgccccggtgcgcctcgcgaggaggcccaggagagagaccagctgctggtatagacacagctgcaggagacctgggtgtaaaaatggggaccccagcacacataggaaggaggactgaaagaaagagaagaagaaggcgagagcgcccaagagaaacaacggtggacagggagaaacataagagatctaaagatagaagattgacgctctcgattctcgcctgtgcccctgtctgcagtgtgtgtcttctctcgatctcccgacttttcgaaagcgtcgatagtgcggctgtcgatccatcgccccgcggaaaaaaaaagttcgcgtttctgggtccccacttcgtcgctttgtttgcttttcttcttttgcccgctgattcgcttctggctctcactgtctccttctggaccccacaggaggcgaaccagtggcgcgagagactctgaaatccgccctggttcaatgctctccgtccggtctccctgcacaggttttcgcagctcgaccgcgggcaacagcaaagccgactctttcccttcttccgatttcgttttctgtgtgtcttccgttctccccttgtctccttgttctctgcagcgtctccattcggctcagggtctctcctcgccgttcgcgtcccgccctctgtcttcccttcgtcacccgtgccttgccccttggccctgtcctattctcgtcgttggaagaaagaacgttttatcttcataagaaacgagagacca

SEQ ID NO: 1218 - DNA, 2851 bp, Toxoplasma gondii
gatctctggactcggacgagaaagaatcggtttctgcagagattgaaacggcggagtttcgcgagggggaaactccattgcatccttgacagcctgcctttgcccgagatggacaagcaaactggcgtaggtcaccagacgaatcgagattctgttccgtcgacggggaagacgcggcgatgttttgttgagcagacatttccgcggcgtggttcttcttcgtccacgtctttgccggatccggatgctcccctcctacggcgctgtcaacgaatccttttctgccggcttttctcatggctgcgtcctcaatgcttatgcaggtgctctcctgcttcctggacggagttgagccctttgtgaaatgttacgacgcacttgacgcaccgacggtaaaaaggtggaaggcagatgcgaagctcttcggggagtgaaagcagaacttcgatggctagacgagaactttaggatgggggtggagtacagacgcccatgagaaacggaaatgtccgtggacggatcaaaggagaaggcaaggcggagaagagagggaaggaaggaaacatttcgcaacttgcctggtcgcttccacttggagtgtgcggcacttcttggggtcgatttttgagggaagccgagactcgtcgcagttggcttttgggaagcaaagcctcagagagtcgcgagccgcttgccatgcgccccctggacctgaggcgacaggtacggagcaacagaggaagcaaacggtacgagggaaacggtgggcgaagctggcgagacgggtttgcttttggaggcgcagattgccaccgctgcgccaccgcctgtgtggtgtacacgaagttgagttgtcttaccttgacagagaagttcgaacgcgccgagttcttcctctagaaagacacgttcgcttttcatggactcactacacagcagtgtcggagaaagaggagttgccaggcagctgagttcgtcaggctgacgtctttcagagtccagcgccgccaagtgtcactggtttcacaaagacctcccgtgtagggacgaaagaggaaaacgaacagccgttctgaaccggagagaatagagggtctacgaggcacctgaatcgagctccagaggctcaacaacctactcttcgctcagtggagaaagcatctttacacgatcaagacgataaagtgcgctggaaaggtgtgcacggggccgcgaaaatccccacccctgtgaggaaccgtacgtgcaccgcacactatcgctgagatccgcgtgaagtccagatttgcctcaagatgcctgtttcaagaaatggcgccacgacggacacgcaacgtgacaagaaatatgcagtagattctctccagtgtgtctctggagacgagaacaaaagtgctgggactgaaacggcgccgactgttcggtgtgcaactgtgcagcaagtgggtttggtcgggacaaaagtcggggtgaccgtgacgaatcgaaaacacgcatttacaaagatgtacgacagcgttcagtccttgattcaacggatggtagaggatacatgttccgacaaaagttgtcgacatggagagaagacgccttctcgagcacggcgggatgagcagcaagcactcgagtggagcctgggtgccggtgtctcgccattttgcgtgtggcgtctgtgtcagcggaagactcggcgctgcatctgagagagcacatccgacagatcgagtcctgaatttcgcacaggaaccgtccaaacgcctgcatgtgtcacatcgtgggcgaattatcccaaacaagactgtggagaggcagctctcagttgtcgtacggagaaaccgccgcaagacaccttttctcagaagcggagggacaggggcagggagacgaggatagaagagcctgttctaaaggttcttgcacaatgagttgcttgcttgcgatccttttctgtgtgtacctcccgtttccttacacaagtcccgtgtgtaggcttttcactggtccgacgccaccgaaagtatgccacagacgccctctcgccgtccgcgctttgtcttcacgctttctcgcctaggtgcctccagcaacagaggtcgtttttcgtgaaagtatattccgtctggtaaatgagcgtcgtttagaacattcgccacattcccagttttcgcgtttgcgacgaaaccgaagtcttcggtgcactgacgatccccagccgtctctttccgggtcgtcagtgctcgtgcaaaccgtcattctcgctttgtctagccgtcagttcctcttccgttccttctctcgtcaacatcttcaccaccgtttgtctcctcgcttctctgcgcgacctcgaattgtccaaaaccccgctgatcctgtcaccagcatgccctgcaccagcgagcacaccgaccatccgtcgttcacaccgagaataatggtcgttgaaaaacgaagccactcgcccgtcagtttcgctccaccttgcccgagtgtgcgaaagtctttccttcttgagacggggaatgcttccgcggccttgctgtatgctagacgtagcaagagtatgtagaacacggttttctgggaaagaccccagagagtcactcactggatcccacgcagccaggcaaccctttgttccccgtcctgcaagtgtcgccgaccattcatctacagctactccaactcttgtgtgtaaatgccggttagcttctcctcttcctttctcagtgtcttttcttcaccacgcgtgcttctgtagagctaaaggagcagctgttttttttttgagtgtcgcatcgcctctggccttccccctcgtcgccgcctcactgagaccggcgctgcctcccaa

SEQ ID NO: 1219 - DNA, 2008 bp, Toxoplasma gondii
atgtaagcctacttcagctcatttttatgggacgctcctgggcgagcgatactttcgcgaccgccaatccatcggcactaacaggtagaaagcgaatgcacaaacgctagatatgcgtgttcacctgaaactctcaacggtagctgctgtgctccaggtgccgaaatcccgacaaccgctcgtctgactgttgttccagaacttgacaaagcgagtagtctgtgaccgaaactggtgcatgtcttcttcaagggaagcaaacgtggcattcatcctgaagtcgtgctaaaggctgccagaaagctgacgatttcttctgttcttctttatgatttctactggttccccgtcgctgggtcctcactccctctattcctgtctctcgttcacttcccctccctcttgtctcgaagttccttttcccgacgtctatcatcctcgctgacttcaaaccgtccctctctggcttctcatggtttgcttgcccttcctctttgctgcctgtttccttaccccttgcagtttgattcccctcgctccatgttctcagttttctctcgctcccttttactcctttctgtcgcttttcatttatttgtttctgattcttcgtcctgcttcagacaggcgtttcataaatgccgagaatgaaaagggtgtcttgaaattgtgcagaacagactggcagcgacacctcccaagactgaattctttcctcgatttcaaacccgcccgtgtcgccatcctttctctcaggccattgcggttctgtgcacgtgtgttctccactaaccagctgaatgcttgtacgacagctctatcacatgcactaccaatgaaggtgtgtcgcagtttttctaatgggccgtaacatcacagccaacgatgtatatcatacttcaacggtactttctagcctatatccggtgttaaaagcggtcctattcgaagcagatgatttgtcagtgactacccggtctttacaagcgcttttttccgtaacacaaagtccactttccgctgctatctggtggtcattgttcagatatccaatctttgaccctctctcagaggcggtcagcaacggaggccgacgggtacctgccgctacaattccagaattttcgcggaagcccaaacctctacgaaatagtctccagagactctgtgatttcgtgccgagtttgccgaatcccgaaattctccattctgaagaagtgtgtaaagtgccatgtaccggcaactagccgcagcgagccggaagtcttttttcctgtgcatgcatgcaggtgtcctggaaaagtcggtccttccaagcgtccgtcctcgaccacccgaatccgggcatttcgtcactctcctgggaagttcttgtcttgtacacaccgagatgaagacatcgcatgcgttttttccgtcttctgctgtcgcgtatcggcacagtccagaggtgtgcggagtaagacccatgaccaggctggagacgcgaaaaaagcgacccttgacttatctcggtttcataccagccgttttaaagtctctccacgggctagagaccgccaccttcctcgtttttccggcggatccgctttccaggaatcgaccctccagtgtcttctgtatcctgtggcttcttcgtgtgcactgatgtcccagtgttgcacgctgcctggcggcaactggcttttttaaataaataagttctgttccacttcgcatcgtccatattcctggacacatgcttctcttcagcacggtgtctctctgtgccttctgaagcgttccagacatcccttcgactctgctcgattctgcacaggtcgaaatgcgccttctctgagcttttccagtggcacgaacttgtggctcgcctcttattctctacatctgcagtctccatcctctcctcgtgtcgttttctttatcgtctgtctctgtctcttgtctgtcgctcgtgactgtccgtcggcgagagtgccccgcaaaacctcgccggggcctggggcaa

SEQ ID NO: 1220 - DNA, 2522 bp, Toxoplasma gondii
gcatgtgaggtggaaggcagctatcacatgaagaaggcaaaccgataagcgacagggctgcagagctgggggttcgaaataagcctttctcttttcatgtgtttacccatgcacctaagtccgtgcacagtaggtttgccgacggatccaagaaaccgtatgtctgcattggcaagtaaggtagtgaccgcgcatagatgagtctctcttttatctacggcgcgtgggttgttcctcctttttcgaggacattttctttccacatgtttctctttcgcacattcgttgtttccgctgcttctgtattttgttgtcgactgtacaggatccctcgactgcacagtcaagctctggagctgcaatcgcgctcagcagaaggaactcgccgagaaacagttgaagaaaagtgaaggacctgcatgacgagatgtccactgtcttcgccttgagtttcccagtcaaatttgcccgttcccgttgccatttctgttcagcttctattcgtttcgctggacttacctagtttctggaccctgcatcgtcgctcactcaccgtacttttcctttgttcctccgacctcctctgttttggggtcgggagaggcatcccgaagcaaacaagttcacacaagttttcagagaagcacggggcgtccacagcggtcgtcatgctggtgcatacaagtgcatgcgtatgctttcaaaaatggatgcaagcacaccaatgtgtggacttgcgaggtatgcatacgacttaccccccgtgtgtacggcatctgctgacacccatggtcacatcggttgttgtctagtcgatgtggttctcggaggaaacaaatcttttgtctccgaaacagctggaaggtaaatccttgagaagcgcggctcataggagtcgaaacggacggagtttagcagacccccccgagtgagggcgcaggaccgagaagtctagtcttctcttcttccgtacttttccctgcatttcacacccctggtatgactccacaccgcgtgtaaatgtcccttaggtgacacccgcagcagcgcgtaggaggaagtagatgtcagtgtagacgtttttgagatgagagacgataacgtaaaatgccgccgataacttctgcattatacacactctctctccacgcctaggatgacaggtacggcggcacacggaggaaagtgggggggggggggggggcgaacagaaaggtcacatggaaggccgctcgactctccactcacgaagtgaaggcttcgtcccgttttgctggacaacgaatgcgaacttcttcactcgcttgtgacacacacaactccagaggcacagagatgtgaagcagaagagtggcgtgtgcgtcgcttctgtcggcggcaagccccgctccgtctctttggtggcgattctggtgtgcaccgtgtgccaagaagttgcgtgtcacgcgacttttggaaatgcatcaggttcagagtcgttatgttgcgattcaggctctcggcagagaatcatttccctgtaagctagttgaactcgcctttttaaaagcggcagcagtgcccttgtggaaggcctcactgtgcctactttcctcgtcctgagtttttccgccttcggcctcattttttgctcaccaaaatcgtgtcctaccgtcaagttttgccatagactcctacgggaaaaaacaagccggtcgacacggacgacgcccgcagggaagcgtcccctccgcagaaatcgggagacaactgtcgttgacggtgctgcgcgaaaggtcacagagtttccagtgtgttcatcagacctcactgtgcactgttagcggccgctgtcccgcctggtcaacaagtatcacaccctcgtccccgccattggcacggagctcgatgagctgcagtgtcgcttttaggggagtcgtgcaatcacgccgcaacacaggcgtgattcgatcttcaattgctaggtaaccactcgtgcttggtagctctgcaatggctcgagcgacgggggtgatgcaacatgctgctaaaaactcgacagacgtgtcaccggaacccacctaaataggagaccacgggtctctggtgtgtcgcgtcgcattctcgcgtcgcattctcgcgtcgcaatgaccggccagttgctcgacgtcgccagccgggactgaagagcgttcatcgagtcagcagcattgcgtccccttgctcggtgaaaaaagactctctggtcgagtctagctcgtgtcacttctgtttctaacctccttcgttcaccggtacacctccgatgtgacttttggtacacttgccctgtcgcacgacgcacgctgtcactcaacttgctgctagcgcaatcgataggttccctcgaaccagccatcacacacacaccttttccgggaagacgtttgcgggcggtgggtcgcagctcgtcgagagtgcgtttctgtgcatttctgtgggcagtgcagcgcgtttgcgcgccttactctgtgtgtaacttccttgtccaacactggtaaaaa

SEQ ID NO: 1221 - DNA, 2050 bp, Toxoplasma gondii
agcgaggcctactcctccgtctctgtacatgacagcgagtaagtccttggcaagttcctttgtctctttcgcctgccagtctgcctcgggatgcgcaggaagacgcaagagcgtatgtggcgccgccaagacgtccagtgttacatcgcgtgaggcttctctcggttgaaaagaggagttgctgcttgccgcctctctccgctgtttgccgcgttcctctctccctcgccgttccttctcatctcctctgaaaaaagccggcagcgcgccagaggcgctccagctgcgaaagcggtggagagctgaggcagaagaggcagccgaagaagaaaaccacggggaagcagacagagaagagaccgaagacgaagaagatgaagaaaagaagggatacgaggaaggaaaaggagaaaaaaaggatggggaggaggaagaggaagaagagggagaggaagcagagatagaaggtactcgccgtggtggcgtgaaagaggacggtgagacaaaggcaagaggaaagggagacaggagagacgagtgagattggacagaaggtgcattctgctcgagaagaagtcttcccttgaagtctccacgaacagacagacaagcagagggaaaaacttgggcggagagaccaaaggccagacacagctgaagcactgcaaacgacggcctgactgcattcatgtctgcacaaaaaaaagtgagaatccagaacaacgaaagtccgaaagaaaggaaatccgaaaaaattcggaaaaaatccaagatataagtctgacagaggtgaaaatcgggagaaaatgaagttccaaaaaaaccgaaagaaatgaagatcggcacaaggccgagaaagcgaagagaacgggactctggggtctctctctctctcgggggttcctggctgtctccggttgcgctggatttccaaacgcgagcagacatgcatcaacgcgacctcgaaagtaccacggaaaataaggtgaagtgaaagcggagaaaaaagcaaggaagcgagggaaagaggatttctcagaagacaccgacaagagcagaggccctgtactgcagcggcctccctgtgtgttgagagaagaacacagagtcacattttctctgctctctgacttctctgcggcaacatctgaggagagaaaacaacttgttgtacgaaatgtgaagaagagatccctctgggttccaaggagacactctcgggcatgcagaatgtgcatgcaactgctcggaggacagcgagacaagacgccacgagaccgcaggctacgagttcgacaaatagtcactttcctctctttctgcccgtcttttattgaaagagcctttacacacaaatccttcaaaacagagtgcgtccacgtcgcgtttttggcttggtctttctcgtttttcccctccctctccaattcgctcctagacggcggccgagctgtccgtgtgtgtcttcgtcgagaccccgccctgtgtctgctttcttctttcacttgctctctttctctcttttctttcttctctttttcctgctttctttctcggttcgtttctgtgctggccgttcctctcagaggcctcggactgcaagcagccgacgcgatacggcagttcccagtgcctctcctgggcttgtcttctttctaggttctcttgcttcctctctcccttttctttctgttttcttcctctttccatttgtctgtcctcgtttctttttttctcttctccttcctcctccgttccgcctcccttccctcccgtcgctgtgcgcgtcgcggggcagacggaagagacagagacaacgcgtcttcgaaaaacacggcttttgcgctccctttctctcttttcctcgcggtcgcgtttttccacttcatttctctcttctccgcttctctgcgcgtctccgtgacttcttggccttcgccgtgtgcctccgaaagcgcggactccgtctcccggttctcgttttctctttgcagtccgcgcgcctctgtcttccttcgcgtcgctctgctggaaggccggaagccgaaga

SEQ ID NO: 1222 - DNA, 2421 bp, Toxoplasma gondii
ctcatcatgcgccaggtagatatataaaagtacccattaatacacgcatagaattgccacattgcgatgaatgtacatgtatacatatacgtatacatggatgtatgaatacagatgcacgaatgttgctctatgtggttttttaagagaagcaaatgcagatgtgtgttgtttcgcttgactgtctgaaagcgtttcggggacgtactgaggagcaacgaaggctctggcctcggagggaagaggcttccaaaggctgccccacggtctgcttcggctgctgacccctgcattgtcttgaatctttgaaattctagatgaataatctcctctcaggaggatatcagaaccgtttctctttcttccgaattctcctccaagtgtcgcatctcggcggcgcccggctctgcctcagagataaaggatatacaagaaaagcagagagtaccgtaagtagtgaggagagagaaaaggaagtagagtgtaagatgtgagtagacctcgatacaaacctcaccaatagtcaacagaggttaagagagagagatgctcgtggctcgtcagcaattgacaaagtcacccacaaaaaaaagccatagaggaaattcccgcgacggacgttttcaggactgcactgctgcaacacgtaccgagatatatctacacagatctgcgtcagtccacatgccaaggacttcccggctcgttcggagaggaaagaaccgtaaaataacgcccaacaactgacgctgtagtaacacacgcaagcacacacataatatatgaatgtatgtagattgctagatctagagtaagatgcacgtgtgctgagccatgaggcatcgctgcgcatgaaaacgtctctattcgtagttgctgatgaagtctcagtctcccatttggctcgaagcgccacagaatcttttgaagtgcgcactgtcgccagtacaggtcgagggtgtgtgtgtgtcgggtcttacactgagaaagttgggcctccacttcttgggaacgcagcagccgcgaaaatagatttgtgtcagaatatcctctggcacctactcagtggtctccgctgccagcctcagagtcgagacggactctgaagattgcttcgcttgggggtcaacttcgaaagccacgcgcaggtagctccttaaacagtcgagaggcaagacgcaggcgaaagagagacgtcggggatctgcagttcgttcaaaagtccttggtaagaaaaaatgtcttagaaaacgagttgccgcgttagacggaatcgagcacaggcaacggtaatttgtctgcaaattttacgacgttatgccagcgcttttaatccttttaactgactgcatgtgaaaagccgcaaggggggcgacgctacctggctgtctctgtgtgcaaagacgagagctccgaagcgattcttggtcacaaatccgcatccgtctccgttttccgaggcacaccaaaaaagcgaagcgtctgcctcgtgcttcggaaccaagttgcgtcggcacactcgtaactcggatgggctcttcttttttctcgaggtctttcggaagcaatgtctcggctgcggcgcaaatcgcagtcgccgtttccgattgcctctaacaagacacatctgagcacatggtggagagttgcaggctactcaggcgactcacttcgagtgtacatacacgcgaggagtgttgaacagtggcctcggcttgcatcctttgacacagcaatcgagcgtgagcccgggtcggaaatgtggatcaagacacgaacgacgcgacaaatgcgtaaaagaaactgtgggcctgttcctctcgatgaacgcacattgcaaattcgtggcctcacctacacattctacgcactttggtgtatacaggcttcccattgtgcctgtgatgctcggcgtttccgcgcgtgtgtgtgtgtggtgaaaaaggcacctggtatctcggaacctgtcgtttttcgccatttctttcggaataggtcgctacggcgcttggtatgtgccagccaactaacccgcaagtttctcttccagtttctgtttttcgctggtcctcgtctcccattgtttccggagtaaaccgctgtcccgtctaggtaatcggcctccacgcgttctgtcgatttccgtaaataatgcctctcgtttccacgcttccgaagcctcttttctgccaatttcccccgtctcaatctgtttcccgcttcgttgttcccccttcgcgcattcaccgtcttgttatgcctccggggttccagccgctgctgccgggccgcccttccttgtttcccctggccttcccacggcctcgtcccgcgtttgccccgacaacgaagtgactgtctaaacaaactcagtccgtctggcatgcttcttactctccttcgtttccttgctcgaagcca

SEQ ID NO: 1223 - DNA, 1689 bp, Toxoplasma gondii
ttcctttctttcgtggcttcttcagttggtcgtcctccgagtcgttgccggagtcagaggacagtccatcggaagagtcagacgacccactgtctgaagaagacaaggagctgttagaccggccagagctgctgctgtcgctgctgctgtcgctgtcacttgaacctgaagaaacataaaacggagaatacgtgggcggatagacagcggttgtttttgcgtcgtcaaaatccgggaatacataatctaaggcgctgctgagacaacgcatcttctcaactagtacgaagaagtgccttactgtcagagaggtctccatcgcgccccgttgagcctgcaagtgtggcggtcctggcacgttgtctgggaggacccgacgacgtgccattcggaggtctccgctgagaggagtctgtgggctgagacgtcagaggagacctggatggtttcacaggcgcgtcatcatcgctgtccgagagcaatttgcttttagcagctgatctcggctttatcggtgaatcgtcatcgctctccgtctgcttcgggcatgcggacgcttgggtcgcctgagattcactggcctgcgacaaggtcacgctgctcgcagacaccgaggaaggaggcgcagctggtaccagcggtgcaacaggtgcggcagtcgacagaacttcgctcttcaccgccggcaaagagcctgcagacggagcgccctgtaggccaattaaacgcatcaacatcgcggaagagacgcagttttacaactgacatagaggtagcggttcgcgagtagaagcaatcacgacggtcgttagctaacaaggtgctcaagccacgataactgggttggttaataataatgcaaccagatgcgagaccacattcattaggtaacacctgccgtgaaggaactgtcaaccaccgacgctcacctccatgggtggatcaagcccgaaattgaaagagaagcagatggggagagaaaaaagagcgcgggcacaaagcgacgatagatcctagttcgtttagtgcctacgtgacaaaattgactttatttcattccttctcgtgacaaggctgaggcactgtcttacacggacctcctgccggtctgcagtggatgcagctagaaacccagcagacagatcctgtttctgacaaaagttatctgcgactattttgcaaagactatgctttgggttttcagtaaacaggcagtcatatgaggaaactggggagctgaagcatggacatcagacgaagacgtacaatgggtgcatgcatcacttcaccaccgacaacaacatacgaaggacgtctccagcgctgccagtcacgtgccaacaccatgatacagagttacttgatgatcaatcgtagatgcacttgttcaagaggtcgcacagattcattcagtttttccactgcggccaacttgtctgcccaggcacagacatcatccgctttggctagtgggcagaagggtcgtgtttccgggtgcatgcacactacactatcgagggtgagcatgaggacaaacgcagcacgcaaacattgtaacacggctcgacaccgctgctggacctctgcatgataggttcatgactcaacggagacacaccggccacttcattgaagaaaacgactaatcttaaaaacagtgaaacttcaagagtgccgtgcagatcgaaa

SEQ ID NO: 1224 - DNA, 2227 bp, Toxoplasma gondii
agaaaagacagcggaacgaatacccaagacaatcgccaagaaaggaaggaaaggctgcttttcccccatgctagaaatggcgtctttaacatagatttctcgacgctgaaactgtgttcagcgtgccaccggatgcatctgtggtgacagagttgacgaagaaaggagaggccgaggaagacgacagaaaaactgacacggcggagagaggacgagattcactccgatatttctttccaccgaaggtttacagtttgagttcttactttaaggagcagaggccatttactcgtatcaatggggggagaggagctgttgggctcaatggcgtagttgtctgttttcttctttttcttccctccctcggtgcctgctgaggccaccagaccggggtcgctggtcgcctccttcatggcggatacacgagacgagcgagcggaagacggagaggcagacgcagagggtgccggcttgtgctttcgactttggagagaaagtcgagaactttgtgtaaaaacgcagagaaagaggcaagcgaaacaagaccttcagggagaaagaactgtgcgacagcggaaaggaacagcgcggggagttccccgagagatggtcgcggggtcaaacggatttcttcacgtgtctgtacaccgcgccttcgtcactttcagacgaagcggaaaaaacggggactttggggaatttgcgcgacagacaaggtttccgaagaagtcgacgaaaagccccgagaaaaaggacgcatcaaaagagtaggagggcggggacaatcgacggaggcggagacgcttttcatgaggagacacggggagaacgagagaaattcacgacagcaaaaaagcggagacaacgcggaagaagcggcaacaaagcaatttcgtcgcagcgaaaacgatgacaaaagagcgtcgcgaaaagcacgattctcgagaggacggaacccccgcaaaaggcgtccaggttgtctgccgaactctgttcctggcctgaaaggaaggctagatcgcgaggcccaacgcgcaggcaaatacattagaaaagttctcggtagaaagccccgagagaaaacctgcgactgatgatgacaaggacggcagagcacggaaaagccagcgctgtgtggggcttgtctctcctctctgcgaagcctgggcacaccaccggctggaacgcgaatgcgcgaaaaatagcggtttttgcgggaagttgcccagtcggaacttccggttgcttgcgggatcgaccgagtctgagttttacagctcctttcctggacttcttcggcgtctcctcgacagaaaactactccttctctgtcgacgaaggccgtaaacacgctcttggcgcgcaactgacctcaccgctgctctccccggtcgctccgaaaaccttgcgaatctgttccttccggactgcggggattttcgctcagtcgtttgttcagtgcgagtcgcgaagttacttgcacagttcacgcgtttcccaggaactcttcccgggagcttgcgaccactcgaaaatcccggaagcccggtggactgctctcgccgctcatcgtgacacacttcaacaaggcatgcgagttgctgaaaaagagtttaacgggttttcccgttgttctttcgcgggtcgtgtggaggaaagaaagggagcggaacgcagaactcgtctccagggcgaacaagtttggccgtgcagaggggtaaaccagaggtacgaagaagctgtggcatgtttgggggatatccgttccagtgctgtgtggtgcgtttctcgaggaaacgatgcgcagtgataagttcaaatgaacacgagccagctgttgtagagttccttgtcttgaaagaaatcacattttctaggcgagtcgtaggtaaccagcgagacgcgctcgaggtgcactgttcgcaccacgatcttcgtgtagttcgatgccttgtccctctatatcagtatagagaaagcggcacaaagaagttagttgcaactccgtacaaggcagacaggaaggacacgccgatccgatctcgaccgtgtattttaactgcgtcagtttggggagacagtgcctttcttgctttcgcggttcgtgtgtcggccgccgagcaggtgagcgcgagtgtgacaaagcaaaccgagaacgtcaacctgttggaaagggagatgttttgcttcggtcctgacttcgcacaaacacagttaatccgacgaa

SEQ ID NO: 1225 - DNA, 1103 bp, Toxoplasma gondii
agctctgagaaacagtaaacgccagctgcagttttaaaccgaggggaactcatcttctttgagcgacttggcagccagaagtctcgagttcatgtgcaaagagaggcacagagagcgaggcagagagtcatgtagagagagagacacaagtggagacagagaaagacctgttttgtgtttacggctcctcgacgcgaagttcttcagcaatgtacgtgaaggaaacccgaattgtatctgcgtacttggatcgagctatcgttagagtcctacggacttgaagagttcccgtggaagcgagagatcctcggtcgacgcacaaagacccagagagacgtccacaggacggcgacagtaggaacttaaaaaagagaggtcgcaacgcatgagggaaatgaggaactgagacttcgaatctgagcgtctttctgaagcgcaacggcggcgtatttgattaccctgttacgagagctgcagataactcataggcaagcggggaaggcctaaacgacaaaaaacagggagaacggctttctgttgtctacctgaacgagtctcagcacagaatcttttttttgatgtgattaaacctaaaattacgatcaacaatggtgtgcttagtccttcaaaacctaaagttctattctgacaatactctggaggaaactgtcgagaacaaagagaaagcttgccgaagagaaaagagaccgaggttgaacagggcgcagactcgccgcggaaagagagacgaaagggagacagtgcgggagaggaggcagagaaacgaaaccagaggacaagaaaaggagacagaaggaaagcaggaagagacgctgagaggaaaagattaaaagaggagagaaagcaagaaaaacacagagaacagggagagaaagcgtttagggtataaaaacgacaccgagagaggaaagagaaaggcgaaaaggcatgcagtgaaagaagatcgagaagagaagagaaagttgtccgcgcgattgaaaaagagatctctgttgccggtcgagtcaggagtttcgtgtaagaaaaaaggatgctgggaatgcactgaggcaaacaagtctccgaacagctctctgtatgca

SEQ ID NO: 1226 - DNA, 1339 bp, Toxoplasma gondii
gtcggcctgcattacgtggaatcgttaagcgtttcctcagtccgtctccgtacagccttgcaatgagaaggaaggttgagtttttctgggacctttttagcaacgtgtttttccgatgatatgaagttttccaaaaatcgctcttgcaatgaagtccacaatagactccaggagaggcgcgccctctggatgcctcgttttgtgtcatttaggcttgtcgtcaacccaaaggtggggtcaacttactttgcaaaggctagaatgtgtatgtttcaacgcgtgcacatgcaactccctatctgtcgagagcggtgccaccggccaagcagttgtgtatagtatcgcgcatttgagctattgttgcgcactgcagttccttaatgaggaagccttaaaacacccaaaaacgtgacatgcggggttgacgcaaaaagtcgtcagagctacagcaggagctgccttaaacgataactcacacggtacatacctaaaatcagaaagcccacccgtcgttgcatggagaccggagataactgacgtcgcggccagggacaagacagtgtgccgtccgaggaaagatgctatcatccttacacattgtacggggttcgagcggtactcagttcgtatctctctccaccagcgagcgtctccaccagcacagactcgtcgagatgtaccatggagacggacatcgtgcggaaggcgggcattctacaagaccgagttctgcccactatagccatgctgaaaacaatcgaaatttcgccgcacaaggcgcgtctgtcagacagagcattcacacctagtttgggagatttcaactccgttgtgctattgccattcccgtgtgtgaaatgtttgcccgtattgttcttgagtgaacggttgctgtgcgtctacggaaccgcacaggatactctggaagcagcagggtgaaaaaacataatagctgcattttgcactgaggatgagagattgtccgtacctgccttgtgcctcttagagcgattattggctgttcgatgttgaactgtgaggaaggacagcccacgacaggatcgccaaaaacatacagaaaaaattttaaatcatgcagtgctgtggttagagcggccgattttcaagagacattctccttctacctggtttcgtcttttccgtgcgatccacagaaacccgtaaacattctgggtcgcaagagggaggctcttaacctgcttattgcatgttgtgtgatcgaccactcgagcatgtgagggacccctcacaggtggggcttcgatatctattggaggaagtttcctctgacaggcagtcagcgtggcgactgaatcga

SEQ ID NO: 1227 - DNA, 3524 bp, Toxoplasma gondii
ttaaatcaattctatgtttgcatttggcagcagcccgttcctcactacggtattttgtatgaacacccgaccaaccccttcgtcaaacgacggcccgtatcctgtctgagatgacacatctcccagttccagggcacagagcctggtagtacgtgagaaagacgcctaaaaccaatgtggaacagtctcgatcaagaacgttttagactgaaatacagcacttctatccgtcttcagcagtcgaaacatgcggtggtagacagcaatcataaagcacttgaggcagttggatgcccggaacccgtagccgtttcaagatcagcgacatcagagtcatcccaccttcatagtctctaactcgcagccccagtcacattcagtaattttcaaaaacagaccaactacttgtctgcaccccaacggtggagccataatacattccgtaacaatgaaaacctccacccgaacgtcacagagcaaagaggcacccgatcacattccgcatacgtctcaccgattgttcgagatgggttcaatgctgtagtacgcgaagaggcagcacgccgcaatggaccatacgaacggtacagtgagtttgaagatatctcggtaggtcaggtccatccccctggagggcccccgacagagtcttttgctcagacagtcacacattttacagaaaatgaaggcaactgttcctgaaaacagactgaatattgcagtcttgacgaaaaaaggtacccaacaactacggagctgaacggagtcgaaaatcgaaaccacagcgaagccaaagtggtacaaaggccgaacttatttgatgcgcgcacacgcccacgacagactccaggactggagatccacgcgcataattgcaaaaagcgatttcgtactcgcgtggttcggtgtgaatacgaactagaatgggatacgagcaacttgctgcagctaggcttctgcacaggacggcgcgaggaccgatgccggagaggcccaagagatactgagactcaaaagaaaaacaactggggtgaccgaggtgaacgcctggtttaacatgaggaaaagaaacatacctcagacggaaaaaacaaggaaaacataatcgaagaactgcacgagaagctatatcgtgactgtcgcaaaaacggaggcgctacgttggagcggagccacgtatgctcctcgagttcgaacaggtccgtcgaaatttcccgagacaactacggaatccatttaaccggaaagacaacttcacagtttcggatgaggaatgccgcataaagaccacggaacagaaaaagcacagcttcactggctctcacgaagcccgtcgagttgtccgcgcaactcggaaagcagctcgcctgtgaagtgcggcgcagcaagtccgagggagtcccggcagaaaaaagtcgaaggacgaacacgaaaatacccctttccccgttaggagaatagacacggacgggcacgtgcgaaaagaccggcgacgctgaactttgtgtgcctcaaggaaaacgtgtgtccacgatgcccctacgagattttgggccaccgcactccggacgaaaccgagtgaagcgacgcagaaaacgagaactttccccgtttctgtacgttaacgcgactagaaacgcgtcgtccacctgagatgacgaaagaaaggacaaacgctccggtcggtcttgtcgacagagtcaactatacaggggactgttcgctctaaacaggcgcgaggatcagcagctttctaaagaaccggtcgcttctccaattaccataccactcatcgtggatctcgtcacgtgcttcttctcctgaagggaacttcgagaagcccgccagaaaacctccgaaaaagccttcgcgcacgccggcacaccacaaagaggtggcttcctactaacgacgagagttgcagcccattattgacaccgttgttaagacgcgtgtctttcggcttttataccgttcgctccattcgaagtgggtgacttgggcgggagctatatcgggcggctcggagcagcatgccacccgtgatgtaaagtggttcttgctgcctctgttcacagggaatcacatttttgacctttcggcatgttcgtcaaacttccacaggaagataccacagtgcagaaccctgcgcctccctcctttcaccctcccccttccgccccccaacagacgtacggctagccaagagtgttcatggcaccctgtcacgccacctgctttgttcgtagaaaaaaaagctggtggaccacactttctttcgatacttgtgtatagtatcaggtctcctgcagactcttttaagcaaaacgccagggtgtcctgtaacaccgatatgcaaagcatgcctccacccgagacggtggacttcttacggatccagtgtttcgagtgtcgattgccatcggtgcgcgagttagcgagatactgcgcgctgaaagctggcaggtctcctagaaacttgcgtgttctgtgtccaaggattcttcaatcacactgtaattcctctgtgtgagaaccccgttttttgtaaagggcgctgcacctggagcactcggccgtgaccaccgcgatatcgagaggcatccgcgtctcaatgctcgtgtgaacggtcttagaggacagtcttcgttttgttgcaaactttcattcaagtcttcagtccgttttgccggagcttggatttctggcgtccgacggctttgcagctgtcacccgtgtctccccagtctcttccccgtaagtctttccgacgtttcccgccagccacgttaaggagagcaccggtgcctgggagtttttaaaaaacgagaacccgtaactttcgcacaatgaacagcaagtggctcacgtaaaagcgtcattaggtggcgttgcttgggcattgtttcggcttctttgcccattctgcagtgcggattcatctgttccacccgatttagtggatagactctaacagatagtaggggaggggggactgccgttgattatctcctgtcagcctctcctcagacaagacatctcgacaagattgagatgcgcataaccggtaattttttggagaggcactcttcttggcattcagttgtaagtacacccggtgatccgcacgccgttttatccgaactgacacgacgttatgggttcacggggctgccgccaccgattgtttcaaattatagccttgccttttcgtcaaagttatttctcatccatttcgctatcttgacttaactgatgtctttttcagcgcagcgggtcccacggactgaagcgttagttcgtttttctagcgcaccggcgatcttctgcgagggcctcttcacgagcagaatgagtgatttctcccgtcgtcagctctactgtgatcggtctttccctccgtgtgtctccatgcaaaagacacagattacggataatatgcaacgaagccggcggtagaagcgtttctccaacgttaactgcgaagcggtgcgacgtcaagcgcgcgagtgtggatgctcgca

SEQ ID NO: 1228 - DNA, 3563 bp, Toxoplasma gondii
tcgactggaacgtccacagtgctaaaactgtccaccgggtgtgtccgccttcctgtgcttgaatccgttctcagctttcgagatttccccgccattgggtacggtagcggtctcccctgggacacaggttctgccggaaggtccgcgggtgcactggcgtctttgggtggcgtacaggcactgcacttggacgcctgtgccaacgaagacttctccctaaatgttgttttgagctggtgaacttcaggcagccagggctcctcgttcatctggccgttgccttggtcggtttgcctcgatctctctggtgtcgcagcctttgatccaggacggaccagcccttcgtctacgtcttcccccgctgatgctcctcctccctcctcactcacgtttctgatcagacaagaaagcccacctgagctgacaccgactggacctgcctgcctccggcgccgtttaccaccctgtccagaggccgtcaacgtcctattgcaggaatcttcagaaagcacacggtggtctgcgctctccatcgcatccgagacaatagggtcctccgctggtttcgaagatgtgtcttgaggtggagagctttgtcctcccgaagaggagtgcaggttcgccaccgacggagttctcaccagatctacagacgatacacggccagactccagtgtatccacatctgcaatattgggaaaatttatttcttgagcattgctacttttgttcgcgtcaccgtcacgcatgttagccggagaggcagaaggtggacggcgtaaatcggagcgggcgctgtccccatgctgggtcccagtacgcaatttgcatgcatggatcgaggtcacttggcaattgtgaccgggtatttccggtggtccttccttaaccagagcctctggttgtatttttatacattcagtgtcgccctgatagggtgttttcaatgccgacacgagccagctttcgttcgttaggcatggcaaataaagtgcctcctcgacatcgcctcccttgttgcttcggatttcatttggagcagacccggaaaatcttggcaacacctccttcactgcatcagaaccagaaagggttgccatagcgcttcttcaagatttcgtagagaacactgaagccttcaagttcagcgaggatagaggggaagctttgggagcatcgacgccaatattcacacgtgcctatccaatgccagtgttcaggtaacccggaaaggcctgaagactctgggtgcgcctcttctggctacgaaggtgagtgaataccacccaggaatgaattgttcgcagaaccaaagaattgaaaagagtgcttcaaagacagggcgagagcagtcatctttcagtcactctgaaaggggcccttctatgcgagtgctcagctaaggcggacgaaggtatacgatggaactgggaatcacgcaacggaaggctgaacaatgatacaggtgagctagaacgggagaaaactgtgaagggcttcatcgtgtcattatctccggacggggcagctgctttacagacgttatcacggtatatatcgagtatcccattcgaagcttacaccaagttgaacttagaagaatagcaagcgcaggaacgactcacatggaaaacggcatatcgtgtacgtgaaacggagtacaaccgaaccgactctcccactgcatcacaccttcttccgccacaatgtgtctcgaaaaacttaggtagacagggtcccgtcgaagacggagataacatgcaagcaatttggttatgctacaatatgtaccgaaacagcgtcggaagtcttcggacgaaggcccagagggagtagcccagcagaggatgaagacgcgagtaaatctgctgggtgaaaataatggttctctcacgatcaacaatgagatcaatgaaaacgatatgtgaaattcagagggacagaactgatcagctgcgtctgataacattcacatacatgagtgaattcgcgcgagatgcttccagaagactgcagacgcacctctacgagcatcgacagcaggtacgtgcggactgccagtaatgaatcgactatacactcgcttggaacggaacgaaatggtgcaaggcgtcctaccagttgcatcaaataccgcggcgcatcttggaaatgacccaaaggcagtgaagcccaggtgacgtgtgcgcggtggtctccggtggagcaaggaaatacgactttccggtactttcccctcccttcacccgtatgacagcggttccgtaactcatgcaatgagttgaaatcatcaggaagaagtttattgcaatcattcacgaaaactctacgaatttccccaatgctgcggcaccgcgccgccaactgtcgatattctctgtggctgacccgcgcttacaccacacctaccgagagggagattgaggcgggtggaggggttaaccaaagaaatcaaagaagcagtgcgattggaaagttccccagtctctctccggagtgcacaagtgaaccagttagcaagagaaaattcgccgtaaaagggtaccacctggtgtcgcgaaatgagtctgcggagacacctggggctaattcagcgctgcagtgttcgtccgctcgaaaaacaggagacacaactgccacataacgacggattgcgcgcgccactctttccgcggaccggccaactggggaaacacgactctgaccccagtttctgagtctcacctgatgatggttgtcgcgacccccgcccatcgttcgcggccgaggacggtgtcgtcgggcgcactcactgcaacgacgctcaacaccagacggcgcagcacttgtacagtaattctacgggactatctgtcgacgaaaagaaaaacaaacagaaaagaaaacagtgcctcctcgtattctgctctaggacgaggaagacagtatggcctgcaagcggaacctgcgtatgcagcgcaagtgtagtattgactactgtgtagagagccgtgtcgaacttgactcacctggcagtgtaagtacagccgctctcgccgatgtgatttctcgtttaactcaaaactgctatgtgtatgtgcattgcgaaggatctcaaaaagaggattcagctggggccacggcagaactagagctgcgatcgttccttctaaccgtagggtagattaaccctcgaacccctttaggctgcagccccgtccgacagtgatgattgtcttggataaacttaggcggtatgcgccacagaagtgaactgaaaacgacaaagattccagaagatagaccgtctattgtgttacaccagtatgtggttgatcgctgataggaggacctccggaacatccggttcggtgtcgtcatcccgtttaccccggttactcgcgtctctcggtctctccttgtgccactcttcgggtgtgcgtcgcttcgtttgacaacgtaggaacaaaatggggatctgtagcttgtgccaccacgcataggccatcacttgtgttttacggggattttgttcgtttttcgtgccactgagttagtaacttttcttgcagttgcgtgtaaaa

SEQ ID NO: 1229 - DNA, 1696 bp, Toxoplasma gondii
taaacatagattcataaacatgaaaatagggataggcagtctttctggcacatgcgctacgatttctttgagagtacggattcgtcatcacctggagtacagacaccggcttttcggatctcgatgattcgaagattcttcgatttttttcgaagaacggctctgccacgcggagccaaaagtcaccgctttcagctccccatgcgtttgaaaccaaactccgccgactcttctccgaaatattcgtttttcaaaagtattgcaaaggccttctctctatagatatatgcatctgcttgcgtaaatatttatcctcttatcgccacagacacagatatatatagttgtatacatacatacaaatatatatatatatataaacatatttaaacatatataaataaatatatctctctatatagctataagcatatatatatatatatatatatatatatatatatttgtatgtatacgagtagaaactgtttggacggacatggaaggatggaagctgtttcgtaagttgcccctttcgtttcctttgtactgtgtgtagttcacacattcgctgaacgtgctctgcaactcgacattcagtccgtgtttgagtttgtagtgtgtacgttgccatcacggttgatcccgcataccctgcttttctcgatttttccctacaaagatttcctgcaggagctctcgtctttcgaacttgagacaaggcacgaaggcgcgcgtttcgtcagacactgtggcgttagttgactctgaaggttgttcgacctgtgttttttcgtgagaagctcaattcctttctgaaatcgaaaaaaaaaccgaggctcctgcgcccacagagacacatttctcaggacgtctcctgcctccttgagagccaggatggagccttaaccagttgttcgagtcagataaaggtcacttgacgatggaagaagtgactttttctctctctcttccgtagagaagccaaaaacgcgttcccagcgcgttcccagtctccgccaccgctgtcgagctgcatgtacagcagacgctgcattttctcaaaagacaccagggtttctgtccttcaaaagccgacacagtcaagcttcttcgctccacggcacgtagcttttttctttcggggaaaactcgaaggtttttctgggcaagaaaaacagacccaaacctgcgctgtttgtacacccgccacgaaaaggggccctcgcactgtagagtgcggaattcgcggtttttctttctcgttcgaaaatttcacttttgctttgactctgaggagtctttccttcatcgtcacgcccttttgagggcgcagaaatacacagacagctggaaaccgtcgccgtttcctccagagactgagactccgctgacgacagctgggcttctacgcgagcctctgtctccatgaatgagatgctgcagcttctgtctctgcgcacgggctctccttttcccctctcgtggctcttgtgtgccaactctcaacaccaagcaaaacacagacacagaaagagagatgtggagatacgcgcatctgcatggacgtcgagttcattctagaagctcggaactttcagctgtgaattcacacgtaaactttaactttatcggtctactttccgactcagtaccctttttctgcccaggtccctcccctctccagtctcgaaaa

SEQ ID NO: 1230 - DNA, 4233 bp, Toxoplasma gondii
cttctgattcagtcttttctccattttcttccctcaaaggcactttccggggccgaccccgtcctctctttggaaccgtaggattccatacacctggaacctctgctgcagtcggttcctccccctgtggtatctcatccactttcacttttcgaggccgaccccgtcctctctttggaaccgtaggattccatacacctggagcctctgctccagtcggttcctccccctgtgacatttcatccactttcacttttcgaggccgaccccgtcctctctttggaaccgtaggattccatacacctggagcctctgctccagtcggttcctccccctgtgacatttcatccactttcacttttcgaggccgaccccgtcctctctttggaaccgtaggattccatacacctggagcctctgctccagtcggttcctccccctgtgacatttcatccactttcacttttcgaggccgaccccgtcctctctttggaaccgtaggattccatacacctggagcctctgctccagtcggttcctccccctgtgacatttcatccactttcacttttcgaggccgaccccgtcctctctttggaaccgtaggattccatacacctggagcctctgctgctgtcggttcctccccctgcgacatttcatccactttcacttttcgaggccgaccccgtcctctctttggaaccgtaggattccatacacctggagcctctgctccagtcggttcctccccctgtggtatctcatccactttcacttttcgaggccgaccccgtcctctctttggaaccgtaggattccatacacctggagcctctgctccagtcggttcctccccctgtggtatctcatccactttcacttttcgaggccgaccccgtcctctctttggaaccgtaggattccatacacctggagcctctgctccagtcggttcctccccctgtggtatctcatccactttcacttttcgaggccgacctcgtcctctctttggaaccgtaggattccatacaacagagtcttttgtcggtgccttgcgcggtcttcctctcccgcgcttgatgggtgcaaaaggtgtcaataggcccatttccggttcggcgttttcgtctgccgtttcgttccacgatgcggtgtcgtcaccgccactatgcccgccttggatttcttctgctgttctctttcgtcgactgggttcgagagggccggttggcggctcgtctcgcccacggacggttgcggcgtccgtttggcctggtgacgaagatgcggtcggctcaacaccggccgcatcgaccttcgagtcgacttttctctggatcttgtggagcgtttcgcacgccggggtgccaccgctgtcgtccggtttcctgcgttgctcgtgggggacttctccgcaaaagcggggtaccgacggcgttttcggccgagcggcattcgacgaagaagcgggagaaacgcatgtttcatcgtctccctcgctgccaagtgcccgactgcgactggtgtcccgctcgcgccaagacctcgacgtcgcgtcactcgactctcctgtcgctccatgatgtggagagtcctccgagggaagagaatgcggcagtgccgggggaaacggtccgttggactccttgtcgcggcctcgcgctggcaacgccgaaattggtcgcgtgggatcggcgcctcgagtaaagcggcggaagaagttgaagctcgtttccatcgcgtgacatgaacggaagccgagtcggactcaacgaaactgtgttgtcggggacctcgcacacctcctttctaacccccttccccccttcaccactttcctcgcgcttctccggcttcccgccaggtcacttggcctctctgtctagagcagggaagggttttgggcagtcttcccgtttggcttcttcccctggctcaaaaaaatctcaagctgtgttcggggactcgcgtcgttgtcggtttcggggaaaggcgagaaaggagaacgtagaagacagccgggttcacacgctggtgtttctaagggaggcgccttcgacgggaagtgtcttttgaccggggacgcttttcgaaatggacattttttcaagtcgaggctccctaaatagagcgccaaaacccgcagttcgtacaggacgtgccgtctctcttttctgtgcctcagtcggcaaagccaatgaacacaggaaaaagcacagaggagctagatcgtgaggcatgtcacctctccacattgaagacagcagggataaacgggaaaaagcggaccgcgacaccgaaagacggccaacacgcgaaaacatcacacgtcgagggaaaagctcgatttttttgccgctgcgttttttctttctaagcagcgaacctgtagcgtcgaaaagcaggactagtggcattcacgttctggagaaccaacggggttcgtctcatcgtccccccaaacgagacattgaggtgttggctgaccccgcgttgtgcgtagccgaaaggcggtcaagagagacgggagactcgaactgcaacgggaggccgtcgcggaggaacggtctctcagtgcagcgctaaaaggaaggaaaactggaacagggatgtctacggggaagcaaatggtggcataaaagaatatagtgacggcgacggctggggggttcttcgagaactgggagccttcaatgcgtgcactcgaagacacgacgcggaccgtttattctctgtgggaaggaaaaaacagaactgtggttctttgctcgctcgctttgaatcctagatgcttcctagtatattttttacatgtggacggcatgcatctccatctgacatccgggatgaggacactcgcacatcagcagaaacaacgaaataacctgatgaacactgcggtccagaaagcctccaaaagacgcgattctgaagaaccaaggaaagtcggtgatgcgttgaagtgggattatacagtcatggtagatgcactacgaatggtgcttctgtggccaggaaacacagaaaagaaccgccgctaatcacagccatggtcgtcaactaacaatttaggtcacatccttcgtagtcatggtaacggccgtctctcgcgtctgatcgctttcagcctcttgtacgtttctttgccttcttaagaacacattagtcgtcactggaacccggctgtgagctgctctcagcggacgtgcaacttcggttccccttcttgcaaaagatgcaaaagtgtgtctacagcgccgacgaagtctacaactttcgcttcttctccaacgtcggagcctttaatctggctctgcgttacatgacggtcaacgtaatgcctgcgccaggagcctttcactcgccgctagccgagcgccttgcgctggagtgtccagtcgactcctttgagggcagacttcttgttatcgttggccacctggtgtcaccacgtctgttttcgtttcggctgagaaccgtcagttgggccctgccaccctccaagcgaggtcgattaatgaccgctggacgctctagagccacggcttttccaacttctcgttcttctgccggtcttggttctcacgttcgcgggtctctttatctccttcttcgccgctgcgttgccggtttctttgctttctactctcgcgcgcctggtgttccagtggaggcaactcttggcatgcctcactccccagctgctccaggtacgtgacatgcgccgtgtgtttcggaaaagcacctgtgctgttggtcaactgacccctttcctctattcgcttggccttgagtgggcgtttttccagtcgaaacagctccaaaagtgcacagacctagtgaacgcggggcgagagtttttgccttcgtttcgtatcccctctggtctttctctcccaactcgctgcttgcggggagacgcctgctgttgttcccagaaaaatgccaacgcttccaaccgccttgcctcacttatcgcctcttctatctcttgcatgcacttggcggacatccctgcgcgaacaaccagtaatgcagctacgagacttcagcgggcgacgtcgccggactgaccaagggagccgtcggggcctctcagggctgctggagagacacccgcaggttctggcggccttgtgagaagaccctctttgcggtggaagtttaaaaacttcacgttaacttcgtttttgctgacaaaagtggacagagttgttcgggagcgga

SEQ ID NO: 1231 - DNA, 1960 bp, Toxoplasma gondii
cccaataagagcgtcatactggttccgtcgtttgttttctgtttgatccacgtgccatgactcgccgtgctagccccctgaatcgctacatactccttacctccagcgggcgtccgggttgctcttgtcgtatatacattaaaatgttatcagcgttcaatcccgttaacgatgatggcccaagtcggttgatcaaatcctccttgagactctcaacctgcagatacggatcattttttgcggtggcttcaggtcatgtctgcccagtcgtagtcgggagagacatcacaacttcacacagatactctttgcttcgcttacggtgagaaatgagatgtcgagatgaaaattgtacttggcatcgtcacctttcctgtgtactcgaacgcttatatgcttcattatctgctcgtgagtttggagctttttgataatgtctaaacgaacaaaacagggaagaatgacagggtacaggacactggaccaatttagtgctataaaagcagcatgctaactgcttcaatgctggaaagaaataggcatccaaactcacctttaaagaaagaatcgtcaaagtctataggtgccttgcccgtgtacatctttacctccacaacatgtactccatcgcctgcgtgggaaatttgacaatgacaaccagacgactcattacgtaagtcgagacattagactgaactgtggttcaagactgggagttcctgaattgttgtcatcacgctgatcggtgcttactgtcgtcaggcgggacccggtcttccgccttcgcttttttccgcagctgatctgctggcatcgagtcttcaatcagctgaactccgagatagtaatgctgctctgattcaaggatgccagtcttctgctcgatctgaaaacgagaagaatgcgactagcaggcgacaaattagcatcgcttgggtacaaggttctatagacggtccactaggggaacacgaaagattactcgagacagtcccgccgctctgtgtgccgccgtctagtgcctacattgagagccctgttttaattttccaagagcccctgagcgtacggcattcgacatgtcgctcccgtctgctgttgtagtgagtcgatagctcagcgttaaaggctgtgtggcggaggcttccgaacgccacaaaaaaacgtcctgcagttcccttccagcttgttgtacagcattcacacggtttacattgacgcagtcgcacaaatagtaccggccccctctttccgatcacctaccagattcttgacagttttcaccgtctcccatgactctactgtgaccgtctgtttgctatcgtcctcaaggttgatgacccgtacatcaagcttcattgtgaaaaatccgcgagcttcgtgtcactgtcttttcccgaaaagcgaccaaagttccttcatgaagtgatcccttgccgccaggccaaccttcaattttttgattgacccaccactgtcgtcaaggaacgagacaaagatctcgacagattcaagacgcgcacagccacctctaggggcacaagccactacagaaggtcccgggatagacactagttctcgaaaatgaggatgaaaagagcggacaaacctcttcaaacggcctggggcacttcaaaaggccttcatgggcacacatggccggtcacatctagtcgttcggaagccgcggcggatgaagccattcggcttgtcacgatgactgctactacgaatactcctagaagccgttagaaaattctgtgctctatcgacctgagattagccgacgcacaaagcctgcgttttccagggtatccttgctgtgcagaaattcgttccaagagttacgaccaagccgttcgtgacaggaaacgaaaatgcttgcaagccgaacagcggtcattgacgtttcgatctccgcatgcgcgcagacagccgctgtcggctggtcagaccacta

SEQ ID NO: 1232 - DNA, 3506 bp, Toxoplasma gondii
cttctgtggtctcgaacactgctgggttgtgcgcgatgctcagtggaagcgacacaggaagtttagccggttcccgtgtcaaataaaacgtgatttgtctcctccagtgggcaggactctctctctctctcggctgtttctgcgtcgtcttgcgcctttacaacatgtgtgtttaatactcctgtgcttctcttcagacgacttttccccggagcaaagggaagatctttccgtgggtctgcggcttctgcacgcctccctgcagcgccagtcgccgtccccgcgagcgcgaccccgagggtcctcggcaccctcgtcgctcgtgaggctccagagccgagaggtccgcatccgcgaggaaggtgctcagaggcagagtggcggtgggggcgagatgcaagacagaggcaagcgcgcagaaacgacgcacaaggcgagcaaattggtgctgtctggccagcaggaagattcacaagaaattgtttttttctcttgcagggatgcacgcaacatgcgtgcgcaggtttccggggcagaatggggaaacggaagtgggatcgaggtgcgggcaggagacgcagcgacggaaagagaagatgattacaagcaagtgattgcatttcttgaaaggatacaggaacacaaaatcttggagaggaaacatcgttccctcatttcctggagtaatcgcaggtggtagtcgagctggtggcgcaaccggtcgcgagacatgcaaaaaccctagagtaaccgtttatgggcaaagcatttgcacacgcctgctcgccgatatccttgctaaaggttcaagcgcctgtgaaaaagaacgcgactgccagtgacgaaatcgctcgtttgcattagaaaaagacgcgattcaccccatctatcgacgtacacgttcccgcccgcccccccgccggtttagcgtaccctcggcgtttgttgtggcggaaagttgggtcacttttcaatagtagcgttggcattccgcgaacgtgtggttgtaacttctctacagcttcttggtcccggcagacgacactaacaatcgcatctctgtgttttgcatgtgtcttttcaaatggttgcttccttcatccttcaaacggaaaagcagaatacaaccgcgtcgctggtgaatgcgttttttccaatctgtcacacaggtggtcgcaaaggctggaacactcacttaaatgatagacatagggcgaaacggggagttcagtgcagaaaaaacgagaagtcccaagtcgctggaagcgatccgtcagtccttcgtataatatcagagtactagaggccctaccatctgtatcgcataacggggtatcagaccgaacctgcgatagatcaatatagtttggatgactgtagattggagatcagaatcgttgaagacgcctcgatctttttgagttttcgcgcgcgagccatccattagatcataagaaaatgaggagtaggtcgtgttgtgggtaccaagagctgtcaagaatgccgacagactcaaaacatgcgatagaaagcaggcaaagctggaggagcagaagctgcacacaaggctgctagaagtcagcttcatttttttcgctgctttaatgccacagtcatctgattcatctaaagcttgtctatacagcaagcgcaaacgggacgtaacgcccgcagttttatctcccgctgtggccttttgaaaattctgacatggtcttgaaacctgtgttgccgcagtacccaggaaaactgaacggaaatcacagtcgagtgccactgagtaatggaaatgttttcggtttccacagtcgaagttagcacaagacttcctctccacgtatccgtaacttcttcattaattccacgtaactaggtgtcatccctgctttagagaaactggtttgattacctgtagcgtgcgtacacgagaccctacggcgggtgcaagtcacttcctaagttacgcgccctctctcactgtttcatccgatatacagccgaaaaaagagaacagctgacttgcgtgtgtcgttgcttgctgtgtactcttttctttgatctctgcaaagacaatcaaacccgcttttcaactcgcacccagtatccgcgagtgtccgccctgtcatgcctttttcattttcttaaaaaacgctacagtcttttctatcgatgcctttcgagtgtcattccccctccctcccgttcccctgcctaatgtctcactccgtaccatttctgttttcgttgtctgataaaggtatcttccaattcatccgttcaactctctgtcctttggcaggggctcgtcctaactgtgagtccaatgaatcgtaagaaacggatttcgaggataaaaaaggagaactacactgcgcgtatcctggattactcgtagtaaacacaaacttttagacataactgaaggtgtgaacggaagcagttaacttttgcaacacaatcgtgtgcagcaacgtagagtaaccttgcctcactgaggctgccagtacgatcaagcgacacgcacgccggaggaggggttgtttctttttttgatgttctccgcgtattacccggccatgaactcgcatgtgttttgtcgctctgcaactgcgactcggtatccagctgtgcaattcacgaacggcctcgcttagcgttttcttccgacgcgcctttcgagcagaccgcgtcgagatcctaagcgacctccggatttgcttctcacgtcaagcggctatacagtgatctagccgttgcggaaaagagttttttcagatcctctgcagcctgttcagtgtactaaacaagggagttcccttcggaagtgtagctcgtttcttgaattggagacgcagcaggacttgcacggagctctctgggtttctcgggtctagtctcgtttttttcttcgctaaaaacaaagccgttgcttgcgagttttgcaagattttccaggaggcttcgagaaccagggaaactcgggatctttgtcgctgcgcttggatccggtgtgccttgttcgccaactccgtccgtcgtggcgctaccgtgtacacatgcaagaagtcgaaagtctctctttcacttccggcttcttgcttcctgagacaccgcttttctgctgttcgttttctcccgtgaacttcgcacctgctggcgtgtctctgccgcttctttttcgagtaccatgggcatctcgctcttctcgggacgtggctggccgtggcgcgcctccgcgcagtggcttttctcgtgagtgtcaggccgaaaaaaaacgtcctccccgtccaatttggagtttttctcacctgcacaaaatgccgctgcgccatagagaggaaccgctcgcgggaaagttattcgaacccacatgtccctcacctgtcgatccacctccgactacgtcggtgctccagaccctgaaactcgtagaaggtcctcgtcctgctggactcgtccttttcatgtctaagtcttcaagttccacttgttcgtttctcgcagaa

SEQ ID NO: 1233 - DNA, 2345 bp, Toxoplasma gondii
ggacttgaacctgtcattcaggtatttcatagacggtgtttcgaattttgatgctgtttctgtggtgaatttcggtgcggcttctcctgttattgtgttgtttgccacagcggaatgctcgcgtccaatccggcgcagcgactttctctagaggctgttcgcgggcatccatggcttacggggaactctttgcgttttcgccggtgttttgacacctcggaagcctcgtgacatccaagggcggctcgcgctttgaatcgtcaaatgacatttttgctgtagtgcggacgcggtgacgaacgctgacacgagccttcatttgggtgctcctctgtcacaaatcgaggccggaaaataactttgttccaggtgtaaaagcgagctgagattcgatgcagtcgttttagacacaaaacgtacactctctagggaaaaggcgcattgtttcatgccctgcggcatagcgctgtctcggaccaaatacttgattaactaataacatagcttggtcagttttctctgtttgaagggggcaaactctccattcgggcaatctccagcaatttccgaaacttggagcttacgaaaaagagtggagtttctgcagatgcccctccactgtattttgcgatacggacacagaagcgattggattgtgagcacctgcctttggtgttcctgtgaggatatggctttgttcatgggcgaaatacgatttgtgtgacaaaccaacatactgcgttattgatggaatgctgacacgattcttttgactttaccttgttttctataggctgtacgaagtagttccatacgcagagtcccgatattctcatcgacaaggtattccgcatttgggtgctgctatattgcaaacagtggcgaagatgaaagatttacaccggaaatgtcgccgaaaaaggaaaaagaactttttctgtctctgtgcactacgcactggcttcgtaccgtccacgttttaggcatttgtgcctgttcggcaaaaagtgtgtcttgttctgcgtggaaaaaaacatagactgagtaacacattgacgtctcggtctgtctctcgttttgtgctcggaatatagacaaactgggatggaaattagctttgctgtctacacctcgtcctacagagacggacgtcggaaaaagtgtcgcgttcgttttcccgtgtcgctttaaactcgggtgaggtaatcatagcagtttttgaacagacacaggcatctcagttgtcactaacgacgcgaaaggcattgtgtttcaaggaataggggtgttttgacaggagctagcatctaaagacgtgtaaccgagtaccacctttgatgtacaaatgacatcattagtccgtgtgcggtttgcacccactggactcctcagttgaaacggaaccggagtctgtcgggacgtcagtcagtgcaattaatcaaaaggtttgttcagcccttctatcaaactgtagaccaagtgaatctggaaagaacgcggatgccggaattagctggggaagaagaaactgaactgaagtttgttttttggttttcttggcagcgaaaacggcactccgtttgtcagagtccgtatcgatttgctgcaactcgccagcgttcggataagtcgaagctttcgcttttctccaaagcagacgaactgtctgtttcacatcggggtgatctttctgaatctactctcaactgttctacgtcacatgcgtgacatcgctgttccgccggatgtgcttggctagctgccctcacccgcctctgttccgacagagcgtgcatgcgcgtttgcctgcgtcaactggacagacaatttacctgagccaatacaaccactgtttttatattactcggaaagtgcctgtacatagtgggttctcatggtagttcggatttgtgcatttccgaaaaggctggaggagggatcttcccagaaatgtgcagcacgcgtcggcgccagcggagctgaatttgcagtcgtcccccgtccgctttttttcccgtgttgcatcatccaaaagtgtaattcggacacacacgttcctcatacaagcggtctgcaatttcgtgttccgttggaagtgacctttggcctcacctcgtcgaccgctcggtcgccaccttttcacggattctggggaagtgaaacttccccgtagtcacagacagtcaaaaactcggcgtttactggaaaagttcgcatcggacccaggtagaaccgatcccttccttcgatacaaagatcccttttggtttttgcggcgcggctctaaagtttttgggtcgccgaatcccactttttcttccgaccacttgaaccctttctgtcga

SEQ ID NO: 1234 - DNA, 2387 bp, Toxoplasma gondii
atttgaaacacattgtttgattttcgatgggaggccttagcatcaggagtaccatgtaatcagtcacaggtcacgaagctagtggtcgcttccaatttggggaggaaagccttgtgactgccgccatcatcagcaagagcctcttcgtgtgattggtcatattgaacgcattatttcatgctgttgccattgttagcctctttcacatgcatccgactgtcgctttcgtttcttctgtcttgctgccgatgtggcgcctgttactggtttcaaattatatcaggcttgaactgaagagcgatcagtcatattctcctactccgcccgttaccggcgttggggacgctgtggaacagtctacagcgctttcgttccagctttctgcgtagcatagcaatctgtgtgcagaggtatcaacactttgctagtttctgcaaagcaccgactgcaatagccgattattttcccagtcatttccaccgaaatcgagcaatcgcatgtcacagcctctgaactgttcagcatccgagtcaggcgcattgttataaataaagcgaagcgaacgagcagcgtaatggacgcgatggactgccatgcaagccgcatagcccgcgtaatccccaactagagtgaccgactaggtacatatccgcgagttgcattacagacgttgcagaaatgccttctgacttgttataaaagtgatgggtgtagaagcaaattcaagtgatacttacttgtcacacacaaggtcattatctacgggaaccaaattctgttgtgtaagcagagcacagtggacatcgggaatattttagaaagagaaccaactgaacacaatctattaggagagcaaaaacaatcgcggtggtatgggatccctctcctcttcttgaagtacacttccgggggggaaggcgtagaattcgcatgtttgataggcacatgtcattcgtctctgggatagcctgctcggcacacagggacaagtcgaggaacaactacgatagcagccccaagccagacgcataactcctttgtttaacacgtgatccggttagtctattgcaatggataactaggaactgcgagctgttctgtcttccgtgcccgctttcggactggaacccctcagtcagcatgtgaatcccgagtcactctactcagagtttccccaatttttctctcggtagaactccattccggatgacatatcaaaaactgtatctatgttttatctaatgacggaaaaatggaggccgcggaagaattattgccatcctgtggtgtcgctcatttaaagtggaactgggctaacagctgaagtggcaccagcagtgccagttcgcaggcggcacaccatgaaattataggtgactccagtccaaatgatcaattcatggactttcgtaatcgtttcgatcagaggaatcgttggtaaatcagagatattcccgagcgtaagatgcgtataacgaactggctcacaaaactagcgagacgatgagcagacgtcaagtcactagcagttgacgcttcccgctccatctgattcccttttctgagcatcacgtggccgtgtgactcgacatgccaccccattaatttatgtattggttccaaggacccaggcgtgctggtcatcttgtgtcaacctcgcccgacagtcgacagaatgtttgagtctgacccccaaccacagcacggtcttcacatttcattcacatgactattttatctatctacggaccaattgcgacaccagttcatccgatttctgcttatcttacaggtggcctaaaaagcggtttagggaggtctcgactaagtcactttgcaggagacggccccaattatcaactccacggtagtccaaaacatcggcagaaattaagacacggttgtcatgtgcgcaggcgccgagtggcccagaaaaaccgtgccttctatactcgaaggcggtgatccctctagtcattgccgatgaagctgtttatgccgtctgtctacactacactatcagcacgaggaatccagccgacctgccgagcatggatggccatatgaagacacgggcagctgttctctgaaacgaactccaccgtcagacctcacacgattctcgtcttaaacgttctacttcacatctgtagccatgaaatgttggctgtgtaagaatttgtagcattttttagctcacaggttgaatttgttttctcgcactgaggaaggctatttcaaaacgattcctctgcgattcggcagacagccgcggaggaagctggggtgaatcgatggcctattcgataccccaccaacatcatccgttgtacagagcttttacatctgtcaacctcggcgcagggaaaaatttgtaccaataaaaa

SEQ ID NO: 1235 - DNA, 2170 bp, Toxoplasma gondii
ctctttgagcttcaaggacgtccggtgcagctgagtgccgatttccgccgcggaggcattgaaggagttgtcggcgtgtcggactgtcctactgcggagttctcgggcctgggagatagctcctggactggcgcgctccgcgaacgccaggaaatccgccgttctgtcgcacggcatttttttgagaagctagaaaccgctgcacgcgagtttggagctacccatgaagggtagagcgaggaagagcggacgaccaacgaaacatctgttcgcggatccactatgagaaaacaaaagacttcaagacaaggatgggttgaaaaaagcagggttccaccaccagttgtttcgcgtcatcgaaggacccttattcacaaaaaggaaagatgcgacaggaaataaccactggatatttctgagagggagtgctgtgtacagatgagagggaaggaacgaccgaaaccagcgtgcctttatcactttttgccgcaacggatcgttacccgtgaacttgtcctgggaaaggcctacggaaacaataagtgtgtagagaaacggggaaaaatggatgcacgacaacaaccacagtggcaaaggaggcctagtgaccgcagaagaaagtggcaggggcacgccaaagataattgtggcggggtcacctctatgggtgtctttctgagacaacacagacagaaccagcttgaaagaataaacatctcatccttttgaccgagccactacctcatcgacctacgtagtgagacaaggcatcaaacgagtcgaaaagaaactatctcttttcttacaagagccaagcaacgagcaaagaaaaccccggaggtaaagagggacgatggaagaagagagaaacgaggtcagcttgtcttgcgatactgctgaacggcgctctgagtgactagcggaaataaactgccgctgatactcccgaaacataacggagactggaaaaagtcggaaaatgagaagaaatgacgaaacggacgtggtcttgcggactcgaacaagtcatgtatagctgagcgcatgcagaactgagcagagggttcccgcggaagcgaaacgcgtaggattgaaaggcgcaaacgaacacgtacgaaaaaacccaacgtaataccgtggtgaagaattgacagccttgattgatggttcaccggggagaaatgttgctctttccctcttctctgactcgcagaaactgacaccgggcaagggcgcgttctggtcttccgaagaggatgataatgatattcacgaaagcttccatagacacacgatctccgctccacgtttacaggagcgtgctctgtctatcttcacaggtctctaaggtggagtttagtgaggaaagttagtaccagtgcgattcggtgtagaccagtcttttcatcagtatgccctaccctgaagacagaacgagtctagctgtcgcagtcgcgcttcgacgtgaaaatacgcaccgcatgtacactcgctcacggatgcgtttgcccgtttggttgttctattcatccgatgatgagaccaagaagtcagcgagaaactgtgggcggttgctgacacttctacagtttgaaaaagacgttcgcagttcgaaggaagaatgcttgacacagagtgccggttgaatatcgcagcggcgcataccgtaattgcggcgcactttctacttgtgcctgtcaaaggagtaagggtcaaaatttcgtcctgtcctttttgcggacatgcaccagcatgcgtaagatgcagccgaaactggtgtgccaagaccaaaactgcagaccctggaagcgaagcgcatttgtagtctctgtagatttgcccctcttccggcactgaacgctgcccaccagaggagccgtctttcgagattgtgcctgtgcctatgcggctgcgcattgatgtgctgcgtgctctcgacggactatcgaagttgaaacatgccataagtgtctcgagttgcagaaagatttcttgctgtacttggttgcgggccaccagcatccttggctccaccctaaaagtcacacaaagctgttcaacatttgccggtgagggaggaggaaccaagcatttgcatttcaggagaaagttaggcagcctccagtttttaaatctgtggaacatgtagcgcgtggctgctctttccaga

SEQ ID NO: 1236 - DNA, 2421 bp, Toxoplasma gondii
ctagctacatcctcacctgcaaagatatcccaagcagccaagcagagaagaaggaatgtcgtgggcgtcgacggcgattctgggctatatttggcaccgaaatgaagcaggagaagttggagggtgaaggcggcggcgcttgaagtggccaccaagaattgacttcggattcggaggggggctagccagagaagagcaaacgccccacccacgcagaggttccagagagcgatgagtacgagcacggtgtcgagctgcggagcaaccgacagactggagacgccatctttcaggtggctcgtggaaaaaacggagtgtgatacgaaagccagcagactgttttgctcagttgcaacgagaacacccccatcgtctccgttcgtttcttgacggaaaacgggggccttgcctgcgggaaaggcgacgttctgtgtcaccgcgcctgccttaggctgcaaatacctgcatgcaaacaaatagaccgctcctccgcaaccggcaacgaggctgaaggcggccgaggaagccattaggtaatagagaagtcgatgccatccccagcggatcgcgagagccagaccaaaggtgaggacggcgacgtagaggagcgcgtcgagacccagttcgaagaagtgcgagacaaactccccgtgaacgagactgaagaggcggcgcactgtacagacggctcgagaaacgtctcggacgaaactacgcgagcgccggagcgaagacgcaggagacgaggagagagacacgctgcctccctcagaaggtgcgtctgccgtagaggacgacgagacacatgaaggaggagagtcaggagagggaaaacaaggagggggagcggtgggaagactgggaggggagggagaggtcaaaagcaaggacatgagcgttgcagtgagcatgcagatgactacaggacgaagcagacccgttacaagaagcgtcgccacttggtttgcctccctccggatggcgctcacaagttggcagtgcatgcgttcaagcctctgaagcctctccagagttcgacctcttccgtccgtctcgaacgcgctctcgggggcaagcgcgggccgcgaagagcgcggggtgggaggcaggcgctgatgtccgtcactcctctcgccctcagtctgagggacgccacgaacctcccgcatcctgctgaagacagtgttcctctcatggagtcaagcgaaacctcaacatgcccgcaagcaaatgaataccttgcgctagctgaactcgctttgtttcaggaggcaggcgctacacgcaccacagtccccctaaagggacatgcatacagacatggacacaaacatatatatgcaagtgaaaacccgtgtagcatacctacaccgagaggtcatgaaggcactatgtatacaggcacgtacgatttacagatacgcgcgttcacgcacccagaggcgtataccgctactgacgaatgcgtgtgtcttctgaaggagaaacgctatggaaaaaaataggaggttgggcggaggtccgcgatggcaataatagaggcgctcaaagatgccatattccgtgtccacgtgtgcttgttcggcggtcaaagcgtcgtccttccaacagtcgaactttccaagcgaaaagcacactgcgcgtttgttgagaatctgccgtcagctgaaggtcgcttacagcgtcgctggcataccttacggaagtggatggcaaaaacgtcattttagaaactcgacgatctaaagcgtgtcttctttcctcatccatacacacgttctcctctggctcgtggctagcggtaggtgtgcgtacgtcaggctgtaccacgggagcgagacgcgtccgtggaactttacgatgcgtcggacgtagtaatgccgtcactacacgcacacgtcgacgagagaaacgaaagaaactttgaacgagaccataagtgttccataacagcaggcaaaggtgcttagagtacctcgtaagtccttcggacagacgatgagaaacgcgtgtcgcgacagagggcgatacgcgcgtcgatttgtggtttgcccttctcgcgctcaccgcctgtttttcttgcttgacctcccgtgtgtctgcgtaaaagaaaagtgtccttgcgccttataggatcgattttctgcatgcatgcactgtggcacagacccggctttggcagcgccttcatctgccccgtgcagtacagcgcgtgctgaacagggtctgccccactcgcctaggtggggagaagaagcacagaaattcgtgggggttttcccgggaacggaggaaaatccgccatttctgaacagatgccgaagcccacccacctcgggtgaaaagctgtcttttgcttttttcggtgtttttcttttctgtatttctcgagtctcccgcaccggaaaaagcaaatcaaaa

SEQ ID NO: 1237 - DNA, 4914 bp, Toxoplasma gondii
attgaggctgacgtcgtatcgagctgcagcatcggccgcttcatcttcagccttcttgggagacgtttgtcgccctgaagcgaatgccacggggcgacagttgctccagagggcagcgaggctccagcccccgccagtcgttgtgcgttgttctgcgtctccaaaactgtctgtccccttcgctctgtcagaggacggcgcagtcaagacctcttcgccctcgagtctccgcgacctcgtgtcatcgagactgaggcgagctgccttgagcgtcttgccgtctgcgccttgcgtcaactcctcaaaccccggatcccacttcctcgacaatcctttcttcgcttgcccgccggtcccgtcgggctcactgctgccgtcttgtgcgcgtgagcgctgaagtcgagaaggcgaactcgcttcccctgaggaagcagctcttggagaaatgggcgacgcgtcgtggaagaggcccgactctgacgtgcgactgcggctccgagaattcgccagaaccccgagatggacctccgcggacgcctcaggtcctccctgctcaggatgttctgtgtcttcggagtcgacgttcctcctcgcctgtttccacgtggacaaaagaggcatatctgtctgcggagtggcacaggttcgcgcgcatgtgtcgtcagtctcgtgtgaccgccagcaggtgccgggtactgggtcagcagcgcccgctcgacgactctgggcaactgggtaggagcatgcggctgaaggcgacgtcccaggcgcctctctgcggtcggacctttttggaaaacccgaaggtgaactcgcgaaaaggggggcggctccttgtcgatcacacacaaccgtggctgcacggttagtcggcggcggattctggggtacacagtcaagaagaggtgatacactgatgccagagttggcagaaggagtgttcaaaggaaacttacttgaaaaagacaaacgatcagtgaaccgagactggacatctgacgaggaccgacatgcaccatcaagagctttggtggggcacggcatgatggacagccgagggcacgctccgagacagccgcttaacacacgcctcgagacaagacgagtccaggaggacgccaacggcgcacaccccgaaagtggccggcagacgactcctgactgctacaaaggtaaagacgattcggtcaggcttgcacagcgacccaccagaaaaaagtcggtggtgacggtcgagaaaccctcggacgaagaccgcctcaagtccgcagagaagacactgaatcgagtctctggagatttcgtactgaataacaaaaaaacactacctgccagatgttgtgttcatggcctgacaaggggcatctgagtcagctgcacgctgtctacccgtcagcaagcccccagtagaaacgacggtcactcgaaaacccgggtcctgcgcaggaggccagagaaagccgccgactgctgcaaggcgtgccaatgcgagctaaatctgacctcagagttggacgttccgagctggcaatcagaaactatccacactcacaacaggtagagtgccaagccgtggaccggtgctggtgtacagacaccgcgtcgatccgtgcccggcagcgagttttcctggaaccgcgacaacgtgcacagaatggcgggtatttgttaatcacggcgcctgaaacgggagtcgtgcaccatcgagacagaaattgtccgggcaagcttgtggtaatcatacagccatgctgtcgctatcttcgtggcagatgtgcctccctccatttgcgaaaagcgcgctccgtagttgccccgcgtctgatgcaacaagaagcaagggggtggcttcttccccccttccaaggggtggcggacacacaaaccgatcacctccattgaccacaaaactcatctcgcagctcttcttcccgtcacttcctgctggtaagacagcagtgaacacacccccttagaaagcggttgtcttgtgtttgcaaatttgacaggatcttcggtcttcacgtcgaaaatcagattccgttagggaaactaaaatttcggccggcacggtaacggtccccaacaagcaccgagaaagatccaccaacagtgggggtagcaactcggcaatgcagcggttgccacaaatgttgctgaagcctaactcggttgctgccacataagtagcactatggtgtgcccatgcaaaaagtttacttagcccgttccatttcgacccttgaaagtcatgacagcaactagttcggtgcactagacggcacaaccgccgccagacgttatgtcttcccggagggtgtgcatatcgcaagacttggatgcataataacggaaatgtgcaacacaccgaagtggaggcctcatgcacagacgagtgcattcaccttcgatgtcttcaaatggtgcttacaaaacataggttgtcgcgagagacttccgtgcatagctttccctgtaatcctttgtggtctggagacaccctgaccgggtgtgccgaagcgggtcgtgtatacgaggggcaggaccaacacgctgcacaggggaacaagttttcctgcctctatctggtttacattctcgcatgaagttcttctctcgagtgcacttgaagcaataataagatgagcccgtggaatacagttggccgccgggcacatccccctgatagccaagtacagccatgcttactgtcaggctgacccagcagttgtggtacaaaagaagaccaagatctcgtataaatagacaaaacagatcgtggtgttagaattagcatgtcattgtatgtggtcgtcattcaggtcgaggtgcaccgcccgttcttaccgacaggccgccgatcccccttcctggcggccggcgaggtaatcttgagctcttgactggcagtgtctcagccaccttcagattttccacgcttcgactaataatgttccaccacctctattgcctaagaagtgcttgatacatcgaagtggacagtccctcgtgtctgcacgaatggacctacaccttgttctacgagtcggctctacgccgacggcacgccagtctgtagaacagattcttgacatgcctgatgtgcttggaactatgcacaagacacccacgcttggcagaggaccttgaggcaccacaaggcacagcctagcttcatgatggtagccacatgctcccattgaaacaccctgttgttcgacttgtcttgtgagtaaccggaacagaaacctacatacgaaacacgtaaaaacaggatgaaacagctcaggtggcgcggcatccgctgtgtcactgaggcagcaactaacaccaaaattttatcgaggaacctggacgcgtttgcatgtgccgttggtccaatgtaccactttccacgtgtcttgtgggagcagacagttccggggaaatgcgtcggtgcattacatgacactgcgtccgttagaaacgtggtcgcagccacctgttacgcaacacgtacgtgcttagccaccagaaaacgcaggctgtgacggaagggtgacactccagtaggagaggaaatcctttgtaattgtctatgaaatagagaaggccaatacgttgcggtgtcaaacttccattccgtctctttacatcgtcaggtgtgtggactggcggtagccatcagatcttgtgtcttgcatttgcggctcgtatctgcgtctgtgtgtcctaccgccttcacggcaggtcgctttggaggcgggaccgttcaaacgggacctcagtctcctctgtaagactttccccatactcgaacgatttctcgtgactttgtcaccagctcagcgtttcctggagactccttcattcaggtagcattgcttaacagtaacaaacgttccttccatctttcttctggttttgggacttcaccgcagaggtcgtttctatcaaagcttgtgttcaaacccaggcacgcgccaggcgagccgcttgccgctcacgcgcacacgcacacgccctgcacactgtgtcgaggttccggatttacggtgcggatcagtcagaaaaaaccttcattctccctcgtgtggaaaaccgagtgctgcagacaatcgacggcattggatccacacttctttgatgcatagaatggacgtctttttccgggaaactcggccgcgaaccagccatccaccttgccggcccttccaacgtggtgcatgcgctagaacagaaatattcagctgagtccggaacagctattgacgcgggaaaaagaagcacacgtgaagggtccatgaagattcgtgtttgtctaccttcatagaaaacgccgttggacggaagaaaacaattcttctgagctgggcgtgttgtcgcggcgaccttgcatgaggtttcggtggcgtggaagagtcgattgcggtcccgactacgacgcaacgtccgctaattcgttccttccttcccaactcaactgtcactgcgactccttggacaaaagagaagccagacgcctgctggacaaggtgtaactcgtgtctcccggctggacgctgtcttgcttgctgctgcaatctttggccgccacgcgttcgccacacgcgcttctcacgtgtattgacaccggcctctgtcgtacttcggggttgccttgaactgtgtctcatgtgaggagccgtcattcccgcgtacttatcgcgggactgcaccacctggtctggtccatttccgtatgtattgatacacgcctaacacgaagtgcgtcctttgtttttactcgcacaacaaatagccatcggcagaccgcggtcgatgtgtgcgcaggcccttcgcagcccgttggaagtgagccttcacgcgcacctttctgttcgcagaacaggcgatttggcgtctatctcgccgcttacctcccggcaggcagga

SEQ ID NO: 1238 - DNA, 1465 bp, Toxoplasma gondii
ttccgcctcctaatcgagactctccgcatagatctgtcttgttctctccttcgctcctttttcttgtatcgtcctttactatttctccctcgttatccactcccttctactcgagttcccctccttttctctttttcccgcgtttctctcacctgcagcaaaggaagtgactgcggggtgctggcggctcttccgccgcactctgtcggaagctccatcttgaggaactcgggtgtatgtacaccgcaagagggctgctggcccagggcgaaaagaaggtacgatcctccagaaacgcttctccctccacaagcatgcgcacgcagacacctaccactttacaaggaccagcaccaattaaacatatatatacatatatacatatatagatatatgtatatatatatatatatctacgtttgagatgtttcgacttgagcgacgactcgaggggggcgacgcttagggacgctagaaagcagagcgcggtctttgaaagagaagcaggcgacgcgaaagatctcgaagaaaggaaaaagactgaacacagacgagtgaaaaatcaatttctttctcatcacctttcgctgtcagccgcacatgaagtttctccggagtttccctccctttcgagttccgaaatttttactgacgtcgaacgggggaataaacgaggcggggaaaggaaagaaaaacaggagaaacagaaaagaaaaggaggagaaaaggaggagaaaaggagaagaaaaggagaagaaaaggagcagagggagaaaagaaagcacaagagtcaactttttcgcgagcaggtgagggacggagacactcaaaccccacacaactagctgtctccttcacctcatctcttccttcctcccttgacaccggcacgagagaagaagaacaagaagacaaaggggagaacaaggagagaaggaagtgagagaagcggaggtcttttcgctcgagaaaatcgccctttccagctgcttctgggtctgtgcatgcagcgaaaaagaacgcatgcggggcaggcttgttgagggcgcgatattcgcggaaactcgcttgtttcacctcgaaaaagtcgtttttctgtttctgaaaagaaatgcggaaaaaagaacacgagcccttgggaggctaattcttcgtcgatttgtcacttctctgcatgcgtcatcgtctcgtgtctctgtctctcttcgccccagcgttcaaagttcttcgctgtcttttttcttcttcccctttctctttctttctctcctccttttcctctttttcttttctctccctcctctcttgttcgcattttctctcttttttttgtccgtctcggtcctatcctcgtcctttgtctctcccgcctttgggctcgccttcctcttcctcctctcttcctctgatttcttataaaacagtcgaagcccctcccggcatctcgtcttcttcgtttccaaga

SEQ ID NO: 1239 - DNA, 1348 bp, Toxoplasma gondii
agacgcccagggtgttaaaacgctcgtgggcgtagaaatttcagaagggggggttcacgtagtcgcccccgtgggagacatctacgcagtagatagtgcacgtgtgtgcacaaaaaaccacaacagcaaacgcccggaatccagcgcttcaaagcaacaatggcagcgccttcccgtcagaggtcgaatttccgcatgtcctcgagatcgggtggtctgaagatttttgtagtctacatgatgtagtgactgtgtacagtagatcaaaaagaactaacatgccacatcgtctgtcgacctcgtccgcagacactccgaagctctgcttcataaattgccctgaacgcaagtaaagttattcaaaaatgttcgtaactctatagtcacatggcccttactgaggcaacagatattatcagtccatcggacaagcgcgtcccgtgcgtacgcgttctcctgtatcatcgtctggatcttctctggatcgttagctaccgcctcagacacctgtcgtttgagttcggagagctgccgcaatatcttttctgctcgaaggacttcttcctgtacaccaggacagtcgatcgagatccgcggggcgaactgctacaaacacttactggagacacgcttttcgtatcagcaaaggttttcctcagagagtttaaggcactctccaaattcgttttctgtttcctggacgcactagtaagatgctgatggtaaggtcagaaattgtcttggcgctaacatcagtttctccaaggtcaacagcctttgcgccgtagcttcgctcttcagctccctgacccgtttaagtgttagatctgattgcacggtggctgagaagaagctgaccaaaaaacggaggatgatcctattttgtctgttttgaccatgttttcgtcaagcaactcttttatagcgtctgtaggagacgagtgacgtatgagaaccacataagcgcctgtagaagggagtaccttttgcttgcattgctctgtagcctgctttctcggccatcttttccaattctttcgagccaaaaaaggactgagactccagaacagcctcatggaatttgcggagacggtcctccgcagtctgtttagacttggccattagcaagttttacacacgaacgctgggcggaaaaagaacagaatttgccaaggttgaatgggcttgttgttcgtgtcagccatcatctgggttttgtctgccagtaaagcattgttgtcagtggcaatataaatagcagatagtttcaaaacattggctgtacatacagcgtgtttgccaacacgaactggcgttcgctcagccgaacgcgcccactaattttcta

SEQ ID NO: 1240 - DNA, 3865 bp, Toxoplasma gondii
accacagattgacgcctaaattttaagaaccgaccatgtttcctctcattctcagttgcggattcaacaggttccgacggcactgtccgtacgccttccgcaacgtgatgcagtgcgccgtcacttgccgagggtcttcgctgtggcggcactgctcaaaggtgaattcgccgctctgcatgcacggagacttctgcaggcagcaattcaaatgaatgcagaaaacggaaatcgtgggtggaggaaaagggaatgaagggagacagcagataggacctgggggaaccgatggattttttcggccactttgagcttttccgtgagagagcgagtactcggaaaaccactgaaattctcaatctgaacttgaaatactcaaagggaaaatcctacgaaccagaaacgtcagttcgcgaaatacacggtacacggccctcgcgtgtctatctccgtgactcaatgaaaagccgacatgtgtgctagacaagcaagaggatctccacgatgggagtctcctgcctgatgctcgtctgtgcagaagactcggattcttgctgttctggcacctgttgagtaactggatagtcgctttctactgaacaatcccttaggcccagacgaaaatgaaagcagaaacgagacaagtagaagtgagacgcaaacggttcccgcagaggcgacagaggccaggaaaaggtaaagcaggtaaacagcccttgagacggaaaaggaagaatacctgatagcatgcgatcatttcctcgtacaggcgcttgcaagagttcgaggcctgtctgtacggtttgtcttcgctcacgggcagcgacattttttagccagttgactcagagaccccggcaaaagtagaaccactcgcgggaaaagggagaagcatggagatggggagacgctaggcagacatgcgaaataattttggaagggcagtgggcagcgaaggaagaaaagcagccttttacgaacgtttactcacactgcggactgcaacggcacaactggaacgggacagagagcatctcggagacaccgcaaacaactacgtgaatcggaggtaagcgtaggaagctccgacgcgagagtatgcagcagtaaacggaagaagaagaagaccttgaagaagaaagaagcataaactacacggtttcgaacgggatcgggagccacagacaaccagcagagatgcaggtagcggatgcatgcgaatattgaggacgagtctacttcacccgggacgcccatttgggaacacgcgtcgaaaatgggagatcccggaaacctcacagggaaaagaggaaagaggaatgcagacgctacggaggtgcgaatttgccaagcgaacagccactggacaagtcatgccttgtttttaggaggatgcatgcgcggaccagggaaagacgacgcgcgagacttggattcttctgaaacgccgaaaacacgagtgagaaaatgcaaggctctatcgagataaaaaaccaattgctgctctgtattgaggcgtttgttttatttttgaagactgtacatgcatatgctttcaaggaaggtggccttgaaggcacaccgcgagtatcgatcgggtctcctgaacctaaggaaagacactttggaaataacaagatggcgttcgaatgacgactcacgtttttctttctcataccgcactagagagcacattttacaagccaggagctggaccatatacacgctgcattaacgcatgatcctgtacatataaccacgcgcaagcagtctatcttcaccatacaataacaatttctccttgccttaatataggtgaggcgcaggtcaggggggaagccaacaaggagcaatgctcgcgttcagttaccggtcaggaaatagttatgtccacgactccctcaagctgcaaaactgcagagcagtcactttcgtcaagttgcaataatggttgaaaagccagaaacgcaaatagacggtaatgctcactctttgttccccgaggtttgaactttttagctgcaacgactagcccgacagaaatgcagcagggtggcatggacagtagggtagaactccagagacagcattcgttcgtttctgtgctattgccgctgcgcaagttttttccaccttgtgtggttagagagggaaacccttgacagcaatatattgctcagaatagcttgaatagcatctgttgggagttgctcagtctcatttctaatgcacgaacaaatccacgggatctaccggtctttttgtgaaatacacaaccacacaccagttgaacaaaagcgacttcgattttgaatgtgtccttgtcttccggatccaatttgtattgtgctgttcatgaccatcgtgttacattacaacagtgttaggaggatcaggggttttgagggcaccaaacgtctttatttcaggtgcaagaaaagtaactcgaggaacgaccgagcattaacctccaggaaatcagagtgagctcaacaagcccttcggattggtctcagagatatgcaaaatgtcagaggaacctgcgcttccagcattgcccattaacgatttttctactagctgccagagctgggaacccgagagaaaacggcagtgattggcgtatagattgttggtggtgaagtgcctcgtgatctgcctatcacggtgcagacttttctcgatgatgttctttagtacaacttgtgcgtctgtggtacatgatattcggcgtagaatggaatctccacggtacgggggacctttgtttcgtaacactttgacacaggtgaacactgccagagggaatcgccgctgacgcatgtcctcagaaggcaggggtcaactgtctctcccctcgttttcttatagcgagcgatctcagtgaaatgtagtgtgtgagttcgcctctccgtttgtaacagtcccgaaggagttacttacacaaacggtgttagtacacaacgaaacaatttattttggtggtgaagcgcgtgcgaacttgcgccaaaaatgtagctgcgtgtatattgaacccatggactccttcaagtggtcggttcttccgcttcgctgtgctgtctggttttgagtcgctatggcagctgaagtgctggtttcccttctctctgtattggcaatcggtcttcagcatctgtgctcttctacagtcaatgacgcactcaaaattccaggccagcggataactgtatcagtgtgcttgtgtgagtgtgcatgtatggttctgtgttttggctgtgaaatcgtggtgaccgtcagctgcaggctttttgccctgtcaagatcattccggcggatacacgcattcagtcataattgcaggaatctattgacggtgatttccgtgtttgcaaagtgattcagatgttgttggcacacagaacgtcgttcaaattcaagataaggacggccgctcctccttcagacaggcccagcctggttcatcgtccacctagcctgttgcacaacacctgcttagtccatttgtctttcacatacccgccatgagcgcttccttctgctctcgtaagagcggtcgacgcccgtagttcccatgtttctctagttggttccacattgcctccacggctggctgccaccacagcagtttttgactcgaagttcccaaggaaagtgtttttcgcctctcgctgttccacaggtctcacacccggagccgggcgttttttcatagctgacattaccgtcgcagctccactgtttgtttttcctttcctttgagtgcctctgcttcgaccgccacccaggctgagctaaaacgaactgttccgcatgtgcctctcgttgcttctgaaaaacgctcgccatttctcccgtataaaga

SEQ ID NO: 1241 - DNA, 1369 bp, Toxoplasma gondii
ttcctgatcttggagctgcctgtcgcctggctgccatgtttatatctaccacaccatgtcaggagtattacgttttacgagcgctaaagaagagtcagtcgtgccttgtaaaactgagacagtgaagccgcttcgtgcgcgtttgtcttgtttacgggcctcccttttctgatatatatatatatatatatatatatgcatattcatgcgtacatccatgtacacagactagccggctgccatttgctctgtctgtcgctgctgaaaatttttggaaggactaacaacagtctagcctttccccagcctttgagtgtctgttcttgagatacctgaaggttctcaaattcatatgaacatcgagggtgcaggaactgcctgtcccatgacagtcgcattgtttccggcaccgctatggatgtgctttactcaagaattccacgtggtctgtctttattagacgtcacagaccccgtcgtttagacgccagttcttctccatagtcctcagcttacttactcctagcttcccacctacatggtcaaagctgtgagtttctcggtgggttgtgatcctctgcagtttcatgtccacggcgctgctgatttgaagcctgtgccatctcttgccaaaatgggtagacgcttctgcatgcgatctttcgaactgacggagatctccgccaagatagaattgaggatctcaaatcacacaattctgaggcaggatagatacgccttcgctgattttcaatagcagaaccccgttctttttacataaccctctgaacttgtctgcatgcatcgtcgatgcggcgtcgtgcatgcgtttccggtccccgattaaataggtccagtaactccgtaatcaggagtaccggtatccgcgggaacttcagggtcagaggtgtgttttttgagttgcatcactttcagaagtacacgagaaaatctggaagttgcggcttacctgataaggaacttgtacgcgcgtttttgtgcatgatttcgtcgaggtcgaagcgacatctgcgaattctactcgaaccatccagtctacacattctgttgcggctttcccttgtcggaacgatttcacgagacaatcctagactgtaagtctgtccaatacaaaattcagacggggctacgaatcactgtggtttcctctcaccggggaggaagcaaacgctgccgcctacgcaggcaattgaaagctgcgcacgttcaccagtccgaggcctcaagagagggtgaaaggaaacaacaagcaagacgaagagtaactgaaagtgtgacatatgcaactcttcgatttgtgtgtttctgggtgacgatccatggcacaggtgattgctcgaggagcacga

SEQ ID NO: 1242 - DNA, 3123 bp, Toxoplasma gondii
tctttttgggtacaggcttcgtcgactttgagacatgcctctttcactcggcagacccctgctgctgcggctttgttttttcagccaacgaaagcaaagaagacgcgctcgcgcagaaagaagggatcaggaccggcgtctggcgaagggggcggccctacgacgtcgtagtcctttttcgttgtcaagagaacatcaggacctctctgaattcaagatgaggagtctttacagaggttctaagaccagaatgcttctcatgtgtctcatcgaaatgaggaagcttcttcagagactaggcaacggcgaacaagctggatgtacacacagttcaagctcgtttctctttttccgttgactgtatgtatatatgtgtccatataaaaactctataagtaaacatatatatctatatatctatatagtctgtgtatgtctttaccggccggtttatacggctgtcgacagtcatgcaggcataagcagtctgtgcatgcacgctcgctcgtatctcgctacatgcagtttttttggctgctatgcaggcgtccgtaaatttacggtagacgtttcaaactgtggttgcacaggttcggtggagggagggcattcgtgaacttaagaatctggcattcggttgattcacttttccgcattggctgtcggaaaaagtgagagttcggggctccccaaaccggcactctcgggagtccttgaaacgcgaaatcatagaacgggcggcgcagcttcaaactgactgtcaaccgacgacagaccacccgagtactttctacgagttcgactactggcctgcttcttaaaagtctctgtttaccgaatccgagttctattgtgctaggccttcgtagatgttggagaacgacagaaaggcgtcatgatttcatggcggttcaggaagctccgaaagtgaaccttctggcccctcgaaagacaattgcgagaggcattaggtcgagtctctcacgtctcacccgtcttcctgtgccttgtcatttgacccattggaacacagccaacgaaaagcactgcacgttttactggggcgccactgtacaccagatagctggcagagagtccgatttcatcgagaagacggaattgatacatgcatttgacgagcctacatgtcgctgtctctctacggagtgaccgagtttaagttgtgtacgcttaggaggtgagtgtagtcttgtgaacgaggcaagagatcgagcccgtgagactgcatgagcgtttatgcggagatatccttcaagggagaggcgttttcttttcgtaatccgcgcggctctgacagacagggatgccgaggagtaggcgtttgagccaaaaaagtgtacagagcgtagcgcttcctggaggtatccaccgcgaacaagtcggccgtagttggcaggcgcttgacttggtcactttttccatgctacctcctccaagcattcccaatctagcgccagacccatagaaaacacaatcgacagcagagaaccatggtgatcaccacgaagcttctcgtgttgggaagtcgataaatacagcgagaaaaacagatgaaagaaagagcctactgccggagtcgaaccgacgaccttccgcttactaggcggatgctctaccaactaagctaagcaggctggagaacaccgcatttccccccggtatctgaagttgctccaaattgggagggaagcgtttccctttcagagcaagatggaagggacggtaaagagtggtgtggttgtgtcagaaaaatcaaaagtctgaaatttcattggatagtgagatgacgccagcacacgctcggctggaatgagtgacggcagcagcgatagtggctggatcggaatcaggacagggggggcgatctgggagccttgcgtggaagtattttattacggagaaaaggattcgtttcttgttgtcttttgttgaagcatgaaaactgaatttctttcggtgtttccaagagaaaggatcaagaagacagcgcgttcgcctaccctctgggactggttggttctcctccgtacactctttccccgcgtttggaacagtctgcacactcgcattgctcgatatctcgcaaccgctctattgccgaacttcagcgatttccgcgcttttgtaacttcctcgcaaggcaattctctccttcacaaccaacaagatactggggaagggagtctagggagaaaataagtctgtaaagcggggctgtcttcaaggacacaatcccttttcgcagctgacctcggcttgacggtccgcgtcgttcttccgagtctcgagttcttatcggttatgtcttcttcgtgagtctgtatgtcctcgatacacgcatttgcttctccagttcaacttactcttcacctttccttctagctcgaacctgttcacacatcgcctcggttacccgccgtgtccagtgagtcgggcttcttgtccggcattctcttcgatgctcgagcgcctacactgtcttgtttcttagtcttgtttcttgcctctttccttcgtgagctgccgagacttagtttttcgagtcgccaagtcgtttctctgggctgctttcaactttctgcctctaggcggcgggtcgtgaccccattatcgcgttttgacaatttccgagagcggctcggtttcggcgcctctatcctcctgacgcttctcgaaggcagttttgggacggaaggaagcttgtcttgttttttcatggccttttcttctgtcgtccccgccttatcaaagagggcgactccatccggactcctttgtgagctgcgtaagacgacgtctctgctgtccaaaatgtaggagcgacctcaaacgcagttcacccacccccgtctgtcctgcgagtctccaccatgtgacttctcttcccgtttctcttgtgcgccttccacttttcatctggagcgcctccctcgacaaccgagtacagagatgcgcagatcctgcgtcgcctgcgcgctctgcatccccatttcccctctctttttctgtgtcgacttgccctcttctctgctcccccactcgtcgttcggcgccttccccactgatcgtcttgattgttctcacgcttcccgagctgcaaga

SEQ ID NO: 1243 - DNA, 1716 bp, Toxoplasma gondii
ctaacgatctaactcgctctgcacagccattgatttaaaccatcgtcagaccatcttgctggatatatgagtctctctaactcttcacatctcggcacatctccctctataaatcctttcttgatatatctgtacatatatatatctatatatatgtatttatatataagaagataaattggtacctgatacgtatatatatatatatatatatacataatatgtaaatgtgtaaatatatgtatatttgcacgtataaatgtacatgtacatatataggtggatacttagaatgcggtgtatggtgtgtgcttagagacaggcatctgagtcgagggagtcaggcctgctctctgaacagcgacgactacctctctgtaaagaagctgcgaacatggtttttcttcaggataaaaacgccgaatctccgtggtggcaacggaaaatgccaaggcatttgcgaagaaactcgaagcatctgtgagtgctcttgcccgtttgtgcagcgttttcggtgttggggtcgagcctccaggagacactcctctggaaaagagaagtccccgtcccctcgcgaaagtggaaagccaggatgacgcgctcgaatcgaatttgtcgctaccgtcaccgtacaataaacatggactgagaagaagagagagagaagacagcagcgagaaagagagagggagagagaagcgaacagagacaatggaagggaggaacaaaagaagaaaacggagggaatgtaagagagaaacttatcgacgaaagagaaaaaaggacaaagcggggggaaacaaaccgagaaactgtgcgagaaggggagagggagaaatgatggcagtggcgagtctgtctgttgtaaagctgtgtcaccacaggcctgtcggaggaagctgtctcctgccggcgaggagacacacggccatggaaacgaggagacagaacagcttgacaaagatgttctcacttttttttcctggtcaaaacaaagaccttgccgtctaggaggggaaggccaagggagaacttcgcagaatccccttgggttcaagacagccgtcagctacctgcgtgcacaaggcggtcgagaatttctttttctcggattttctcgtcaccaaaaagatctcctttcttctctctcgatgttcttttcttcgttgggctcgcttcacttgcccctcccgtttctccgccttcaaaaccgttttttcccccagaagaaaaccgaaactctcgcaggtctccaatcgagcggatcgattgttctctaggtcaccgtcttcgcctgtggtatttctcgccgttcgccttcttctccttgaatgtgcctgcctggttgatttgctgcgcctctttctcttttcgttgcatcctctctctctccttactctccaacaacctcgttctctctgtcttgcctcctgtctccccgtctcgtcctcagcgcgtctcgctgccatcctctcgcctccattcttcttcttttctcccctctttctttcttctctccttcctcacacacctcgttctcttcgtcctggcatcctcgcctgtctgattcctctccgttttccatcctctctctccttcctcgctgtcttctcggtctccgtttccccttgcaccttttctccgctcgcttcttccccttttcttctccttttgttcttcctcctcctaagtttttcactgctccgcacaggaaga

SEQ ID NO: 1244 - DNA, 4490 bp, Toxoplasma gondii
gtccaggaagacaagccacggaaactgcacacagagagacttctcagtgtgtctccaggcttccagctcctctcccaggtctcctcccctgtcgaagaagagacgagaagaaggaagaagaaaagaggagagaagaaggaagaagaaaagaggagagaagaaggaagaagaaaagaggagagaagaaggaagaagaaaggaggagagcagcggagacgggggagagggagaatgcgaggtgtaagagaaggaaaagagtcagagctctggagactcaccccctcgcactctcgaggttcttgatcaggcgcttgatcttccattgttcgatgttggtgtcgacatccccgtcactcgccatctttaaaaggcgtgaggaaacaaagaagaggcaaagcgtatctcgaggaagcgccgagagcagagagaagcggtccggggtggaactgagacagaaacaaggcggacgttcgcgagcgtccagcctcgaacgtgcatgcgcggaagcagagaacggacgacgcagcgaggaaggagtacgactgacaaggcgactgaagatgcgtcgagggatcgaatgccgcgacgaggcgacggactggcgagaaagcagagactccaacagacagtgtgaagcgccgctgacttggagggaagctccggaagcgcgaatccaacgtaccacagtgggctgcagagactcggaccaacgtcgaactccagcagaggcgagagaaaagtagacaggtgcagcgaagtcgaacaagacacagagcgaaggaacgaaagaagggcagttgagaggagatacggaacacagaccgagtggcgatgaagaaacgccggtccggatgttttcctttgcagtgctgcctttcctcgctctccctacttcgacactctggcttccagagaggggatccccggagaaacgtccctcgtctttccgctgtgcactgcagctctcggagtccgcctgtccgtcgaatcgcagaaacgacgggtcgacgaaaagccacaaaaggcgcgaacgccggtgtttgccgccgaaacgtttttgactcaacagcgaaatcacacggcctcctcgaggagggcggagagacaccgacgggcaggggaaaaagtcagttgataccgcacaagacaaaaccgagggcgagagcgtcgccgggaggaaagagtctggaaaagaacttggagaacacaaagcgtcggaaaaactcgcgtacgcttccgttcttgtgcatgcggctttctctgtttctaccggagaagaatcgcaagtggggaaaggcgtatctagtggaggggagcatgccgcgaggcaccagcgacttttcttcgcgcgaaccggcaaaggttgcttccttctcgccagaagctctcgcttctcgccaccagttacctcctgtttgtcgtatccgtgtgtggcgctaagttcccgaaaaagaagtaaaggaaaacgaactctcaggcgccggcgggaccccccgtccacacttccccacatagcctgcaaacagccattcccatgtccacggtggtgaactcgcctctgcaaggaaagaaaaaggtgaaacgcgtagcagaggaactcaactttctcgatttccttcgcagacgcctttcttgattttctcccgtgtaaaccaggaggatcctcgatgagaaactccacgccatctctgacaaacggaaacgcaccgcttcatcagagacacgtaacggctgtctgtttgctctaccgttagtgtgtgtgtgtgtgtggtgtaaactcaaaggtgcagaggaaccactgcgttttctaaatgcatcgaagaaacctgtagtcaacgcatagaaaaagttcaatggatagccgctgcgctccactgttgcacaacctgcgggacatggattggaatcgatagccccactgaactatttgtagacaaaagatacttcaaagaaacaaagctgtttcgcgacggggtaagggtatgtgtctttgtggagaggagtaatacagcgcccactacagctaggtagagactgagtctgagttgagtttcctctcgtcgggagaccgacggcgcagaagcaaaactcacactttcgacggggcattctcactatacaaattgggttaaattaattcgactcaaaagccgctcgtggtgtatgtctgatgaatgagaaactcaaactgccttgcttagcctcgctcctgaagttcacgcagggacgttcaaagaagtagccccggcgcctagacgtcatgcagctgcctctactccataccctctttctccgtagccacaaaaaacacagcgcatgccggagattttccaccggagtagagtcgacctgggttccttgtatgtaaatcaaggaaagagctgagccgtcccagcagatgcctgtatatatgccggcggtgctcactgggtgaatccagacagcaccacagtggaagctgcatcaccagccttttcggattctcccttcttctatcagacgctcggcagaagtgactctgcaggaaagagctttgcccgtcaactggcaagtcgcggtgtttatcccgtcagccagtcctctggagactcagagatgctgacgtcctcctcggaggctaagggtgcgtcttagaacgttctcctcatgtctggcgcattcagactacacaggaatccctcagtctgtacatgacccaggactggatccgcatttcaagtaccggaagcgttggtaccctccttgaggacgctcatctgcaagcacctctacgtagaagcatgcaagacagctacgagatacacgagaaaatggataaagctgcctttgttatcacgtggaagtccatcacttgggttacggaaacaagcgcttcctgacagggtcagcgtattgatgagactgtagaagatatcgtgaattcgtggaaagggcatgcgtggaagacagccggttgacggtgcgcagaattacggaagcgagtctgtagagtgacacaccaacggcctaaacggtgcactccggacaccgttcagcgcattttgcgtgcatcacatatcgcttgtaagttcgacattcccattgaaagagcaattgcgtcagttgaggacttctcgtcggacgtagacgcggtctactggccgttgcccgaagggcggcgctaggtgtcttccccatcagccgagcgagtttctctcaggcactcgagacgtttcatgctacacctttatctatcggccaataacattctcgctgcttgctgtgcttcctgattcgaggttggaaggcaaagagagtgacgaaagaatcgcatctgcccacgagcttcctccaactgagtttaagttgggattgtcccatggtatttcgcagcagcgatgccagacaaaagccgactcccatgccgcgatgagtgcgtcatgtttctttgagcaagcctctcattgtttcatctcacggcgttgagggaattctctggaaaaccatggctagccggttaccgtccttgtgtagaccaccctcgacattaaggcaaattcctgagccagttgtcatcatgttgaaccctttatcaatacgaagcacatcccgcgcatgtttccttcgtgcgtctaaggtctccccattatgaaactctttcttccatcgcgttcctccctctctaggcctttgttctttccaagttgttgaaaaggcaaatccgaaccgtttcatccagaccatcggtactccaggctcaacacaaacaactaagtcgctgtgcgtaaacaaaataccgagaacagttcaatcaccttacaagcacacttctctctgagaagaaggttagcgtttagcgcgtattcgtttttcggggtctgcgatcgtcttgtcgaaataacgcatgcacggcgattttgccagcacaagtacggcatgcgagtgagtcggcgtatcgcggtcaaaatgcagccagtcctgcaaaaatagagaatctctagcagagaaactattttttcctagtgcatttaaaaagtaaccccaagagtttgagacatgcaagaacagacgcagggttcggcgagttcctcggtctccccggcctcctatacgctgtcgcgtttcgtcactgcgctggccccgcacaaacgggacacaagcccgagtcaaggcccaagttccgttcctttcttcatcgtctatttctcgttttttttcacacgtttccctccttttttagctatgccctcacccccgtaactctgttcgtcgtcgtcgcgggcctttcttgacttcgagaaacaagtcgagctgctagcgcagcggcgaccctgctgcatctggttcctctcgtgctctctcttgtccggtttccgtacttactttcgcctccatgctctcttcactgttctctcgtttcagcgtgtcacattcgactcacggggaaggctctatccccgactctctgtccgccgttgcgttttttgcgtcttcttaattcgtcgcagcta

SEQ ID NO: 1245 - DNA, 811 bp, Toxoplasma gondii
ccaggaaacctgcttttccgttcgcttcctgcttcgcgtcgacgtgaagcccaccctccgcacctccctcggatgcatgtacaccccaggggcctgcggtgtctctacaccctggaattctccccctggccgggccggcgtcctccgtgcatctgccttcccgcgtgagagttgcagcggctctagaggtgtcttcgatgcttctttctttcacggacacggcagtaagccgccttttgggggaattctgcaaagattcgcctggcacctcctccctcacttcctccgcgaaaggcgaggagggagagaaagacagacccgagagaccgcaagatagaagccgcttcgcactcacgtggtcgggaacctctcgaggaccttcagcgcgagaagcagagacacccgaagcagatgcggcagagggagaggcagaaggcacagctggaggagaagaagaaatcgacatcgatgaggagaaggtcgggggataggagtgccgagcagacggcggcagagacgatgcggcagacgcagggacagatgcgggagtagaggagcctggagaaaaggggaagacagggtgaagactggcgttcgcagatgcagagttagaacagagagaagacgagacgggagacacggaagaggaagggtggctagctgcagcagacaatgacgccgagagactgtctgccgcagcgtaggcgaagccgctagcggctggcgtggcggcgcctgcttccatttttagattgagagaaacatatgaaagcctgagggagaagcatgtgtcaaggccctgaattttaaa

SEQ ID NO: 1246 - DNA, 4564 bp, Toxoplasma gondii
cggagtataccggcgagttgtgcttcgagaattcgctgagaacgtgctgcgacgtcgacatcagctcgacggcgaaaggacagtctccccgggagacctcaaccatgtaaggcgacgcagagcgtgcagatgggaagcagtgcggactttgcctgctcagatcgcaccgtcggcggtcggcgctgcaggaggcagacacagctgccgtgctgtggacgtcgttcgtgtcgttcggacaagacgcgggatccagatcgatgtcgcgaaaccagaggctcggctcaaggccctgcggatggggcgccgagtacggcatcaacgggacgcagtgctccagcttccactcgccgaggaacggcgcagagccgaccacgcccagctgagcgttgggcggcacgaatgcagtaacgctgaagcggacgcgcattttggaagacagcaacgggaatgcgccacgcgagaactcccagctgccccttctacgcacgagcagggagacgcgcagaaaagagacgaagtagaggaccgcgctctctcagcgttttacggacctcgccagcagagcctccacgagcgaagtgagaagaatgggagggagagagagctatgcagcaagcgtctctctcccgtgaagcgcggtgcgtatctcggtttcaatggtgaaggcgaacagtttcttcgatccatgcgtctgaggaatgccagacccgctgctgcaccgaacgaggcacgagccttccaggggtacagacacattggacggcagacaatgaagaacgggagagcgcgaaaaacaagttctgtatgcaaaccgcgccgaactcacgctctcacgacacggctccacacggcatctcctcaagcccgcttcgctccagaatgtaggacggctgccagttcacgctgaagtttctacacgaaagggtggccatcagagggagcaacgaactacccaggtgaacgtcgaaaataggctgcagctcgtgccgtgtgaagttaagaaaaaagttgactatgtgaatgcgttagacctctccgagcatcaggtggcggctgtggtagaggcgctgcagcctagccgagaaggattgacaaccacgccattcgtctgtaggaaaccttcctgtgttttttctcgtgcgaggtattctctttgagttcagcctacagaagaaacaagtcccgagttcgtttgcattcgccagcttctcgatgactccgcactgtgtccgacgccagcccacccagcaaagtctctcaactatcgctacccaaccaaatatcaccactcgatgcacctggacgatcacgttccttgtccagtgccacaaagtatctcttttgactcagaaagaaatgtggggcgctccaaaaaccatggcgcacccgcttcacggacagctggaatgtccagcggcgaagacaaagtgggtggcacaagactagccatagacgtttatgagcagcaaagactgcgaaataaaaacatagcactaaaggcccgcagtagttcacgtaatttaaagtttcacatttccttcgggcgacgccgcacgctgccaaacaaaactactgcacaagcgtgtcaggcatgttggggataagggacccgaacacgctctgtacgtactcgaggtgcggagcaacaggaactgcgcgacgctcttggaaaacagacggaaaatatatcattcttggcgccgcagaatcgcagcaggccatccttcctaatacaggaggacgacacacagagcaggagcgaaaggaaggaagtcaagctcaaaaaaagcatgcgcgtggaagcggaaactggaggtgccgcacagctaggggagcggatgggcaacacacaaacggatttcggattcacatcaagcagggcactattccaccatcttagctgatcttatcaactgcgtcctgtcacttcttgttacttggccttatagaaaagcgacgaacaaagagtttctgcctgtatgggcagcacgagtcgtcgcaatagccgaaacccttcacaaatacacaggtatcggggttttactaggttagccacaaccgaccggtatgcccccctgaggtataatccgtgagagaagatgtgtgatccaaagaatccagtgtaaatactattgcttcacaaaacagtgaaaaaacattctcggaagctatgctcttcagggacgcggactgaaaacgagggctcacgcgcgactagactgtcgatagcaataacgcagttgactgggcggctgattcgatcctggacaactactgcgtcgtttgtcccgttgctgctgcagggcagccgtttccaagccactttcgctgatgaccaccatacacaaatgcgactcccgccgatgggaggaccgcgactcgctcacggcaagtacaacaatcaagaacgaatgaatcttcgcacaagtcattggcggagaatttcacttgcgctcaaacactcggatagtctcgtgcaacatcgcctgccgtcacctcacatcaaaaagccctctgcagtgcagctgacctgagatcagttggatcatattctgtctgaacctacctcagatagtcaagtgaacgctcctagaaaatgccttcaagcggttggttgccatgcctggcagctagagtctgctcgtcgttgtctctgtacacaattttaccggagagcttcctccagcacgtacttacagcaggtgaatgggctaaacggcttgccttgaccactccaacgaagccggacgccaagtgacatgagatgcatgttgcacacggagaagtggatggcacgcgtgtatgctcctattccgtagagcggccacttgcaggcagcccaattcgccgccgccaggccacggtcccagcttgtttcgtatccaaaggagaaatcaaataggctcatgcgatggatttctcaaagacgacgtcgcttccgggacgctcactcgtctcccttttctcagctcctttgttggagagtcgtcacaaatatcggtctgctacatcgcttgcagcttaggctgcggaaccctgatctcgccgtgtgtgactcgatattgaccttcgcccctctgctgctgactgtgaatacggcgttgctgtagatggactttcaccttaaaatcgtcagctctcgaggtgaaaccttcgtagatacggtcctcgaacacgcctttcaaactgttggtttacaactagagactctgctcgagagagtttttgttgcctaacggacggagccaggccgttactgggggccaccatgcctacacagatcagactccgttgacgcttttttctgtaagctgctgcgttcttcactctcggcgacaacaccgctgacttaggaaaccccatacctacttttactctttccccagacatctccattctgttccttttaaagctcctcgttcctgtgattttgaggacgctacttgacgttctacacagtaggaccccccgagcgctagtggagccattgcaacttaccagttccgccgggggttcggcggccctgcttcagatgaatgttctacaaaaacttgttcgagcccgcaccagagaaatggacaagtatgtgtcctgtttgagaccgctaggccgctcgcctttgtgtctttttcgttttgtaattgaagcacacgttcgaaggcaactgcacggtcactagggaacccagctgcagttgctgctgcttggagttcaccgatcccgcgcacatgcttctgttgaagttctctgaaaataattgcatgaaaaagccactcttttttccgggttgttgcattcacagcttttaagaggagcagacattcatgaaggtgtattagggcgagacacgcatgatgagacggggggtcagaatttagttcagggcttcacctctctgctttctgctgactgcgttcagggtgagttagggtactcagagaagcctaagctcgctgtcatgtatcagacgacagtcgaccgcagaatttccgcattatttttttagagtcttggacgaacaaagcgacctctggtccctcttcggatccaagaggcgataaggttttcctactgtccagcacccgaagggcgggcacacgttcttagccaaaaacaaggtctcacgttttggaacacccagtccaaaccccgtgcgtctcgaatgtgtcttcgttcgctagcaaagaagggttcttttttgccacaggaattcgacgcaggcacctcctgaacggtttgcttcctcggcttctccgttccatttgttttgtcccacgttatccacggttaccaggtgccactctggctgactgcagtgccgcttctgtattgttattccaagagttttttaaagtgccgtcgcaaaaacaggaggggagaagaggcgtaacccgcgaccttttcgtcgtttttctcacatcccgttggctttcaagataagacaggcaagaccttgcgtacatttctttttcgtgttttccggtgcacgttcagagactgctcttgcttgccctcattccgtgatttttctcttgtgacagtccaagtggaaatagcaacacga

SEQ ID NO: 1247 - DNA, 2887 bp, Toxoplasma gondii
ggacaaggacggagggatagtcctcttcaaggactttccggaagacgtcgtactctcgcctgactgccgccacggctgcatgcgcggcggcctgggcagcgcgcgctcgcgccgccttctttccctcgccagggtcctcacactcgttcggccgagtgcctcgctccggagctccatccccacgcaccccgtctccgaagtgtctcctttcttcctccgtgtgggccctggctgcagccgctgcggcctcgaacgcggggaagggagaagcggaaatcgcgatcgccgcgaggatttgtcggtgcatgtgcaggtctgcccaatcgctgagtacgaactgtggcgtctggaacgagcagtggatgcagcaagccgcggcagccagctgctgcgacgccgagggggccttggagccctggggcgcggggcccggggcgtctggccccgcgacggttcgcgccgagagaaatggttggaggtaggggtcatgcggcgagaggggcagggaggcgagagagacggaggcgaaggcggccatgagggccgcggcctcgcgggcaaatacctcgggcggagttccatctgtcggcaaaagaagaatgcggacgcgagagtaatctgccagatctgtgtccggcggcaacagagacatcgtggagacacgccgagcgaggagacaccggagacggagagaagcaaggaagaagcgagacgcgacgaaccgcgccgagagaggaagacagggcacacaggggaacacaacggggcctagggagacagaagaagagcacacgagacgagcaagaacgggagcaacgtcgttggtcagacagtccgcgagagaaattccagaaggactgacgaggaccctgcttgtttcgaagcagtcggcttgccgtacaaccctgagcaagcgaaaagcggaagagcatggagacaaaaggacagtcaaaagtcgagccccaaagcactccgtctggagaagatcccgcagcttcactgtctctgaagccccgactggggtcgcgcgcctctatacatctttcggagaagaacatttctctcttgcatttgtttcgccgacagccgcagagagtccagcgctcctttttttgtcctgcttcgtcgcgagcacacgcgtcggcgcagggctcttgcagaggagtcgaagcggtgagcagcggtgagcagcggtgagcagcgaggatgggagacccacggagaccggcaggcgcgagaatccgatggaaaagccgcagggacgatggccaccctgggccgaccggctcggggcctcgcgcagaggagaaagggagaaggacagagagcgaggtagggcgtcgtcgcgccagctttgtttggcctcgaaggacgagtccgagaacgaaagcacgagaatcttccgttttatgacagactaggaacttccagaaggtggtgtcgatcgagaactcccaagaaggcaaagtcccgaaaaaaaaagagtggagaaactcttgcggtccggagaaggcccggcggggacgaggggagcgacagacgaaaaaaggctggcgacttcattgagacggagcactgaagactgggtctggcttttagacactcgacagaagagtgccggaactgtaagcacagcgtttctgtctcccgggacttccgcgttcgacttcctataggggaagaaagcagactgcagagaaggacacaacccttttcgcgctaggtcacttctctcccgtgcggagagcgcggcgccgcgatcttccggagagaaaaaacgcgagacaccgagtcctagaagaacagacacacagacaccacgcggtgtgtacatacacctgaagcgactttcgctcagaggcggagagtcctcggcgccatcgtccggtttctctacaggacaggaacagggcgagaaccagcgaccgaggggaagcagagagaatccgagctgggtggaagcgacgaggccaggcgcttggagggtatttctccgaggaaggaaaagacttcaagttctcaaacactctccctgtctcgttcagctcttgctcacgaagccggcacaaaaagcagaaatagacagcggcggacagccggcactgctgcgtttcttctcccccctttcttttctcacatgcgctggcccggccgccttctgagcaacgaaagcgggctttgtcttgtttccagagctgaagttgttgatcctgaggaagctcgggagagtcgaggctctctccgtctctcttcgcgcagctctcgaatttttcgtggagagcttgcggaaaaaaacagcaagctgaactttttaacagcaagagcaaatcttcgggagcgtgacccgacacagagagttcgagagcgatcggcagcgccgtttgtcttcaaacgaggaggcgtggagttctcagatgaaacatcacatgcctgtttgcgtctctctccgtaaagattctggcgctcacaacactcctgcctcctacagtcccggtcgctctttctcgttggcggggagtttttctctgtcgagtccttttctccccgagtccgtcttgacgtctcctcctcttttctgtttccgcttcaggttctcacctttcaccggaaggcacaagcgcctacatcggattcactgatgttcctttcgcctttcctccccctccccagaacctctggggtgtctgtacatgcacgcgagcgaagaatcacagtccccttgatcaggcgccgaggcactgatgacttgaggaatcggacgaagagtcgagctgaattcgcctgacgacttttaacgtctgcgacggagaagagttcaacgacttccgaatccatggtgtgccctgcttctagagagcagactggaagcggagcaggtcaaccagca

SEQ ID NO: 1248 - DNA, 1170 bp, Toxoplasma gondii
gagtaaatgtattgtatttagtggactgagtggttcgcaaagcaagagatatcgcttcctgttccaaaacgggttgcggaatgtcggacctacctgttttcacgttaattaaaatgtgcatcgtcggcctgaaacaacatggatgcaactgaactgaaacgaaagagacaagcgagtggagatgaagtactcgcttgttccattccaaaaccggtcatgaatgcgcggctaccgaagtgcagagatgctctagttcctacttttctagcgtcccgttttcccggaaaaccttccagtccgctctcgtttggtccttcctttttctggaaacaattgataaccattttatcaggtttctgcattggaatggatgcacgagaaaacattgacgtgcttctgtaagactcgagtgtggtggacaggtctccgttgtgactctttctagtctctgtcttcacgtctgtatagatacctttatcgtcttctaatctccctcttacgtcttcctccttgcagataagaggccatatcttttttctttccttctttcttccttgttctgctatgcctcagcgtttgtcatctctgtttcgccggggcgcccgcctcaaagaccctctggtgttgctctcatgtccatctgtttccaactcgggagccttctcaacatcgttatgttcttcctagtcccgctctcgtgtttgcggcgtctctacgacatttctctgttggctttcaccagttcatgctgagtgacaatctcatgtcctcgcgttcgccggggtaactttgcccatacctaagcgagtgctcagctgtgtccctgtgttacctcgtctccgtagatgtggaaaggcgaaaatccttgatcccttccacccccatagttggaaggctttctatgacgtcttctgaacgatgttcacagcagtgaggaacgcgagattcacacgtgttttttctctcgcgtgcatgcatgcattcgtggcgcagaaaagcggtccttcctaaggacacaggaatcgcctatttctatcttgtcgaggccttccagcggcgcatctttttgaatcgtgaatatgttctatcgaaagtctaaagttgtcaacttggtgatgagtatcacaggtcgttgaggagatagcgacctctgaaaagtgttgtgggtga

SEQ ID NO: 1249 - DNA, 4662 bp, Toxoplasma gondii
tgtatcccgcgtattaccgcggcctcaggatgtgacgagccgacatcgaggtgccaaacctccccgtcaatatggactatctggagagatcagccagcattgcatcctattaatagagaactgcataggttttccatgagatctatttggaagaagaggctcggatttccactgtcaaatactctttgtcagctacttccaaaggaccagtcttcggccgaaactgactgctgttgcgtgcttgttttcgttttattggccctacaccggatgatggccacagaccgcatgatctatccgtacctacgccgtcctaggtagtctgttcgttgaaactcactaaggcaagcatcaagaagattcaggccctacttttgcccgcaacaaaggtatttgtgctgtcactggactctttcagtgacacgcggggggaaggctacagcccgaaagcatatgtttttgttggaaatccacacgaaaaggcaatggcgattgccgtttttacccactgaactgaagtgtttcgtgtatttgcatactctcttcttcgtgttatttagtgtagggaccatcgttgctcgtctccaacccgtcaagacggacagaaccggatagttggtctgcgaagttcccactagttcgtacgtatacgtaacccaagaaacgaggttggcatggaaaaatgcacacaccttcaactgatgccacgcagcggcgctgcacccctaaagtgtaactcatcgctgtaagtgaatggacgttcagacaactgaggtacggggaccgctccgtccctgcagcgtgcatgcaccgattccagacaaacgtatgcacactcacataccttgcggctgcgtggaaacccagtgcgtccccactggaaggtggcatctctaggcagtccttctctaataactggtcgctggtaaagagctattcacgcttgctgtacaaattgttatccatgcgcctacattccataggtttgagacacatgccttttggcagcacgttcggcgccgtcagacgcagcgcctgtgttcggttggaaaaacgtcttcccgtgaaaatcgttacttactcgaaggggctgcagcctcgagccactaagcgtgcaagtttgtctgcgtacttgaacactgatctgttgttgacagaatcatcctgtgttgagaccatccgtggaaatggctcgtgtctgcagagtagcggtgggcgtcaggcaacagctcgctgcatccgtcgtcgctggcctgctcgtcacacttctcactgacgtagatgcctctcctgttaatgcgctgccgcctgatccagctgagtccacagtgccaacgtgcgatgaaggtcaggagatgaccataactttgtcgcccgagaaaaacgcagccagtttcatgtgtggtacagccatagggaacatttcaccgccactacgtccagcaaaagaaggtttcgaggcctttgttgatgaagcggcgactacagtagtccggtttcactctccagatgtccagctaattgaggaaaataatgtgtacacagttaccgcaggcatctttcctcctgttggcggcacgtggtatcttttctgtttggagccggggatcggcagcgctgcagtcaacaccgtcaaaaagaagtgccgcgtagaggtcgtcatcaagggaacatctataatccgtaagtgcatgcgaaatacggccttgttaaacgaataacgaaaggcagttgcgataggagcaatcgcgccgataacaccacacctgcagcaaactgaaaacagtgagcagcggagaagagacgggacaagacatactgtcgcgttctgctacaccctttgtttctattggccgtaccatcgatgtttttggtttcccgccagcgttttcttaagttggagtcatcattgtcaacaaacccagctgcgttagatccgaaggactctatctaatcggcagtagctgagtcatgccaatgcggattgttgcacgaagtttacaaagacgacaggtagctaacaacgctcaatctcatatgggttcgtgtgtgtgtgtgtgtgtgtatctttgtcttgctgggaatctgctgtcacgccttgcttgtcggggtgactctgcgcctatcactccagctcaacagtgtaccactgtgggaggctcagttgatcttcgcattcgtggtcccggatatgcagtaacatttgggtgcggtctgagcttcccgcagcttgaccctccactgagcggaaaggaggtatacgtcggccgggaatgctcagaaaagcagcagttgtcagcgctagttccgagtgcagcgctcgaagtgggacctgccggtcaactatatactctgtttgttgataaactccctcctgtggggcgattgttgtgttacaaatgtgtaaatgacttaaccgctgcatgcaaggcgttaatcgtagtcccgccgtctgccgaagaagtcgctactacggtcgccagcacttcaacattcggaccgtcctcagacgctacaatcgcgctgcactcatccagttcttatctgttgatcgcagttgtctttctgcttcgactgatgtagttggatgtgctggagcagaaacgtggaattttgggacgcggcatcatccgtgctataatgtacttccatgcactcatccactgtggctgcgtgttcgggaggaagccgaccacgagcgtttgaagagggctcggcgtaccaatgcttcaacattagcgcgcatcatatgcaaataaggtaatatggatttcacttgtctggtttcttcaaatttctaggctcttccattcagcatctgtgtatgcggctgttactcccatcgagggggggaacttttctccggtacgaaacgaattcgtttcagcggctgagaaagacacagtcatttgacctgtgggttagtacatgttggtttattacttacgtcagccggtgtccacgtttcttaatcgactcccctcacttagtcagtccgacgctgccttcgagaggtatttagggtagaatctggcgatgcttcgctgaaaatcaatgaatctttcctccgttcagtcgtgacgagtatctatgttctcatggtagaactctctaggagttgtgaatgttcatgtgaagcggcaaatgaatggatgctgagaagtgaggccaatgcctactggacagctaaggtccccgtcagatcatcctgtgcctcttaaagaccttgttcttttcaaacaccaataacaacatagtaaaacgcttttgcctcatattcttcttacgagtttacatcaccatctctgacttgagcactcctctgctccttataaactttatcgccagggaagcacaaaacctaatctctgacggctccatcgctggtgacggccttcggctatgcagacacataattcttagacagaggtttccctcttcaattctgtctggtgtagctgcgtaaataagatcgtcaatggagtagtagaaactctggaagtgggtagactcgaaggtgctggcgtgcttcttcgagacttctttccaccccagaagcaacgaagcgtggtgctgtggtagaaaacgtgttgttcctaaccgcacaagtcacaataattcgataggtggaagtcgcttcacgaacttcagctgcttcccagcccctttcatttgtgcatgtgcctcgatgtgacccgtgccttgctacaggtcagcttttcccgtagtcgggaggcaagctgcatagcttgtaatggtcacattcagcgtgaccagatcccagtccattgaccctttcactcttcagtaaaagcccctttttatagacttttttcattcccaatcggcaatcgtccttccccatttttcgaacactgctcgggaaaacaatattgcgctcgtcggtgtgctgacatgcacgagcagtagtggcgggcgattcacagcgaggcaagcggcttctgatgccgcaagaccaatccgaattctgagctcgcagaaataaaggacgttgctgtttcatgcaaaaagcaactgtcgtcgtgtaaaagtttggactttccgtcgtttcgccgagggagggacttcgttgcttgcgtgaactactcctttcagtaaactcgggaaaagtctgaagcacacgtcgaggggggtctggcaaagcagcggcctgcccgtaagaccgtggttatccgcgataaatctggaaacaacgagaacgacagaaacgattacaagaagcagtggtcctcctcgtcctttccgtctgtgtatcaagtgaatttttttcgaatttcaagaatgttaagcgagaggctgtgtcttcgtcagcggcaagacccaccgccgcgtgtctctcgcggctactttggggttgcaaccgaccttctgaaaatgtttatcaagagaagtcccatgtgtacacttagcgatatcggcttgcatgcttgaacgcctgtctcggctgagcggttctatcttcacatccatcgccggcctgcgttgtaatccgactcgcacacttgttccctgccctctgcgttctgaatcgtttcttcgcggagctcttcccacttcaaaagagaaccttagggcctctcttcgtgcgtaccctctacgcttcggcgccgcatgtatctgcaagcagctcggttcccgcaa

SEQ ID NO: 1250 - DNA, 2118 bp, Toxoplasma gondii
ccgttcccttcactcaagcctcggcaggagtcaggcagcgtatacactcgcgtgggagtgtgaaggttaagctggaaacacatgcacagcacatgtgcacgcaattgcatacccatctccgcgaagtcgctgtttgtaagtttgttccctctccaaggagaaaatgtcggcgcgtagagatactacttgtggacactacaggggagtctggcattacgcacacaacagatgagctatgcgcctcatacgcacagaaatctggggcacgcatacagttgattcacccgtagattccggtacgctctgctcgagcaaaagctactgcatcttcagcacctaaaatgtccactgcaacatgaaaatcctcttgcaccgatccagttcacgcgggacactacgctgccctcgcccagcagtaacgtcacgactgacagaggggaaacaaattctgaaaggagaaatgggtgctcaggtgagaaatggagtcttcatgtatgggacatgcgcatttcgaaatcaggcagggacaacccaacagcgtcgctatcacctatcatcagccttggcggcaggaaattcgcgcccccggcaaaaacaaacgtcagtgaccgcagctgctggcacgcaatgacttacccctatctccttcaaaacgtgagcctttgcatcgtaaaaaaaggcgctattcagcctgccatcgccgtttgccataccaagaggcaagtacggtcccgattcattgtctccatgtagtaggcaaaacaccggaaggccatccaaagacttttgcgaagatccagttgccttcgcagccagcggggcggtagagcccgactgtcgttgggccgtcatcgcaggcgtcgtatcagacgttcttctagcggcgacgacaggctcacaattgatagattcctttcctgctgctgcctcgtttcagcaagcgctgcgagccgtttcgaacttgacccgcttgtaagtgcaacccaggttcgttgctgtctgctgcatccagtagcgaagagacagtctataactggccgttgattgtctctttgaacataacgttcagccaatgcgaccgttgacgcagaatccatacctcgctctgatagaataggttctggccagaacaccggaggccacagcgtgcctcgcagcacagcacaaatcacttgagtcttccaatttctgagtcatcaatgaatacagtaccaaatgatattgccccaggacgaatttatggaagttcgtttcctccccccacatgggctggctcaacgacctcaaatgctttccatacgcatgcatgcatgcatgcctgcattcgaagttcgcagaacgggacagcgctgcccattgctaccagagcatgtgcagtttacgtcaaaaacaaacttagctcgaaacacaaatattaattgctaagaaattctgtgaacagatgaggacggggttcgtacgcttccacattttgaggtatcgttggcagaagtatcgcttatgtatgcttagatgacgtccatagtgatggtggcggacgctctccccccccctcattaaggtaggcaatgtcaaaacgatttccaacacactgcaatggtaaagaaatgtaatacacagaactgagcttcaagtattcacagtgcgttggagtaaaaattgatcggtatcagcagcctggaaagttaatgaagctgttccgggcctgttgactgagcgattggtgagacgttggagacagtccttttgttgaataggtagatgtctgcgtctccgcatcaactgacagcctgcagtatttgaacggcgaatctcttccatgatgcaaacgtatgtcagtagcagcgctttgcgcgtggtgtctcttcacaagcttcacagctaaccatgcgtaactggcgcagcagttcgttatatcttgtgctctccggagaacgctttccatgctactggcagttgaccaatcagtggcttgcctgcctttttcagcagcctttctgcgcactcgcggctgtagggacaccaggtgaggtggtggtgcaggcgccgctgctgcagaaagcttattgtcacgaatttaactctctatactgcacaaacggccaacgcaaagcaaaa

SEQ ID NO: 1251 - DNA, 4615 bp, Toxoplasma gondii
aagtgcactggattggcagagcacagatggagtgggctgtcttcttctggactgcaatcgcttggccgcacagagggaacaaagatcatcagggcaacggggaaccttgcgcggcaccgcgctttgagtacagccggacgcagcaagtagggaatctttggcaggagaagacgagttctgcaccttcgctcgcagtgaaaagcaggagaacgagacaggcactcgaaagctggaggagaaggggaagggaggcggtgacacgcgctgttggtgtcagcagagaaaaagacttttgaatggatgtaggcgtgtgtaacgcctttccctgaaagtcacggtgggcgtcaagttagatggggagaatgcagaaagagacttcgcctctgcggaaacgcgcaggagaagaaagagtggatctcacacgacgtaacgcagagaaaaagactcgtcttaacacgagaactctaccgttggatggccgcagttcttctcgctggtgagaaggaacgcaacttagacgaatgcgggtataacaccgcatgcgacggactggagtccgcaaaacaaccaagaacgaaaagatctgtggcggacacaagccgctaaaatcgcttactgcaaccgaaggcaaacgagaaagaagggcggcgaagaaacgtgtgtccgcgtacgaaagacgcagaccgcaggacttcacagaaaacagaacgtgaccgtttctagcgcaccaatcagagagtggtagattcaaaagaaaacttccttgttgagtggatctcggttccttcagagagatggtagtctgacaatttagatccacaacgaaaagggggctgagaatttccggaacgcccttcccaagctcaaaaggaaacagacgaaattctgcgtctgcgaatcgctcaggcactcctttgtgttgttccttcttcggaagaaagcgtgcttcgatggtaagtgagggcttcctcgcgcttttatcgcggcatgtccacagaaatgcggggggaaaactagcgtcagttcagtcgggaacggaaacgccacgccttccaatcgaaagttggagtgcgtgaaaaaaagggagtttgccactgcaatccagagcgtttcgaatttccctggtcagcaaggagcaggagtttctcggcggcatgcatggggagggagactgaggacgataaaaagtaagaagttccctccacgttacacctttctcgagacagaaaactgtgtgaccgccgaactactttgctttagtgaaacaaacggtaagacatggtgtctgagtggtccacaaacgctgaaagtcgtggtaaaatcccagcagggttttttcgttggggatgtgcatgcgtgcaagcagaagcggtgtgccgtctcgaagctgctcaaccgccaacgcatctttgcagaagcaagggcttgtaggaaaatggaggaggtgcatttctgtgaaatgggtatctacacgaagtcaagactgaaaggaaggaactgtattcgggcgtggcgtgtgcttctcctatgaggcgtctacgagttggggtaataaggccttctgttgacaaccctgcaggggtatagatactgcgcttaaagctggcttcgatttgcatatggtaacgacaaacgttaaatgtctatcgaccttagttggatcccttttacaggcggcgtttagttctatggtacgataacaccagggaatggtgtgcctcattcgctgtgctcctttctcgcgccatcttcaaatgggcacgtttttgacactgttccttgccggattcgagatacacatggaacaacgaacgccacgctctgcaggtgccacatttacatccttttccaaacgaagaacacagcttctgcaaaatgtcttttgcttccagcttgcagcctgggattcaggtgtaaatgttcgatggcaacgacggaaaacgactactccgatgatagtaccagcagcaccatcgtaatgcgagtaataatctctgagaaaggattatttctaagcgctttatggggaatagtaatacgagttggaataggagtttccaagcaggcatgaatgtcaatagggcattgggcggtgcctgcgtgtttgacggtatttccaaggaaggtgcatctcttgtggttcgagagctctctgtatgaatcaaaagttcatctggctgctcgtctgtgcacagtgccgattgttgaagcctcacttgtgcgcggtttttgtcattgactctccatctcttgggtctcgagagagaatgaacacgatattttttgagaacggggtgtggacttaagcatcagccctgaaagtttgagactgctcctgcagcagatcgtcatatggtgtacgcccatcctttttctggtagtcgtgcagcatgctcagctgcaaacagatagaaattcacgtctgaccttggtaaaagaactgagtctacgcaaggttccacatggcttgtcggtcgcagtcgcgcagtatgatagacgctcagatcaggggaccttcgggacgttgacggtagtgggaattagacgttttccatctcacgcgttcagcatttgcattccagatgcattacagagggttccgtgaaaatcgaacttaaaagtaggcatcgtctccgtacagatgatccgagatccggaacttgataatcggataaacagaggcactgtagtagagggagggcaagtctcgctatccggaactctcgacatgctgtccagtagccattggagaatggcgctcgcgaacgaccaaccctagcaaatgggcgtagtccaatgagtgcatggcgtctgtgggataccacatgacatgcttcctttactgagatcgcaggctctgacggtgacgaatcgatgacctttttgactactttaggattccagcagctgaggttaaatgctccacgtaatgcccttgcatgcattttaaagtgcccgctgaagcaggcaggaagcgtttttccgctgcaaggaatgcaaatcaagcacgctgtggcacgactgtggaatcaacgtatcaataagcggagaagaggggcagtgcatcaggaaatatttctcgagctccgatatccgcacagtgggcgaaactccgcctgttgcatgggtaatatatggaaaacacagggtgcattcgcttctctcggccttcgacgagctagagcaggacagcaatttataagctcatatccttgataaagaaatcggtgttgtcttactcttcgcagcttccgtctggcgcatcgcagagcctcttgggcttgtttttcattctcaaaaaacgtcagcatgctcttccagttacactttcgactagagcacctctcaaagctgttttgtttctcccacaggaacattactgagacaacgaccggagcgtgcttcaccgcgaaactgaccattacgtgcaagctctttccttggcctttcggactgaacggtagcattcgtgttccacgcgaattacccttggcaatcctgtggattctcgtctcaggtagcctcggaatcgtgatataacaaaaaaaccgccattcgcgcacggctccttgggaccttatcggtcatgctgcatgttcctctgtgcacacctgtttcctcgtcatgttgcaaggttatagcgcacccttgtctgctacgaacaagaaacaggaatatatcttcctcatttccagccttttcccctttacaaaaacaacacacagcgggactactggggaatgggaacagacaatcattgattttcgttgagttgcttgaggtactccggagacggtcgcggcataccactttgagtcaaccgcgagaaaccacgcttcggtgtacggaatactaccgaatttgcagttgttctgacgaaatatgattgctcctcatcataccttgaggtcagtccgtaatacggagtgaggcatccgttgactaaacggaggcgttacccactgctgaaaacccttgtttcccaaaaattgcccgttggaatgtgtctcgtgactacaacacaaaccgacacacgatttctgtagtagcactccttcacactgtcaacccatttcttccagttctgcttgtcgctcgagacctctccactgttctgctacccgtttgtcattcaaagttccggttaggtgcgttcgctcataccggagatgcagtgagaagtattcagcgcgtgtctttttgcgacagttgctttgttgactctcaagctgccaagcgacacgggcgcacgttggaggctgtttcatttgacgcgtcgcgcatgtgaccgatgcctcgtgtgacacgagcggtttccagccgtccgcatcacgcgactctgtggcttgcctgtcgattgtcgagccgatgctgggtccaccatattgatgccacttcttttccggatttttgcttacattttcttcaccgagggtactcccctgctcgttatttcatgcgtaagtcatttctgcagccaggaagaacgaagttggcacagaaaagacagaccgactcccgttgcaatttttgcggacctcacaagtgcagtgttgcaggcggtgcgcagcttggcacccgacgtcgtggcctttatcgcgtcgtgaccttgtca

SEQ ID NO: 1252 - DNA, 2362 bp, Toxoplasma gondii
aaaaagaacactgtggaacggttgatgttttgcgttgcttgctgtcagtccacggtcctcttaatggcgtggccactcatcaatcgcaagggaatcttgagtctccgagccgcagcacgtcaaaaccgggaagcacggtggggacagaagagtgtccgtttttgtgtcggcgtatcaccgccccgaagagccacggcagttccccgaaagcaagtgtgcaaccgttttgacattttcttatcctccgctggtgtctgccttcgtctcgtcgcttgtcgggcttctccgcgcaagagaacgttcccagacaaaatggagaatttgagatccgcaggatgttttccgacgcagtgcggctatggtgtaagggtgcccaagacatcatatgccattttgtcaaagacggtgcggacaagcgcagtgttttttttcaaaagaagtttacatgtccccagtaaactccagtttttctacagaggcaacgggaaatggtgcccgtgaggggtgccaacgcgtctgatcgtcttctttcaaggtgcgtgtctttattttcttttcttttgagtgcttccgtttggccgcatcacgcttgtctttttgtagatgcgcatctccaatttactaaaagattgttaccaccggtttctatcgatgtattgtgccgagagagaatagtgcgctgaagcttgcataacgcgaatccccgtagcgcagagacggtgcgaacatttgcttttatcctcctgcgtacgtgaagtagaaaatggggaacggtgaacctttattcccaagaaaaaagtagcaactctacgagagctctcataagaaaaacgcgtcagtatcgaactacttggtcggcgtcagccgttatctaactgggcacgtcttggccgtctgtagcggagaagctgcgcaagtaggccataaacagcaactgatcggtcgctgatcttctgttcagaaatcggcaagtatgtattcagattcgtcttgtacaattacctctgttaactctacagacacaagaacgtctgcgcagcagcaagttccacgtagaatctgctactcgtcagatgctaggctgagatacgctcggccactgtttcgcggttgatccttaaatcgccgcatggtgtaagaaaggagtcccaaaagcaaggagtcctcctcgcttacggttggtcacaagctccccaaggcgctgaaggaccgccgacttcagccaaagaaaacgtgagacgccatggccgttagaagagagcacctctccgtgtggcgagcacggagaatgggaagttgtctggtcaggcgcccccagcgacttcgaactacagaactcttgcattgaacagatatagaagtcgatgttgcctttgtgaacgcgtgctcctctggcacgatgtgtaacgagggcccctcactcttgaacgtccgacccctcggggggggggaccgtttgtgtagcgtcgctttactaaaaagacgacgtatgtcaggcatcgtcagtaacgcatccactgcattaacaattccaacatctctttgctctaggaaacagcgaggaagtttatcctttgtcacatcccgattctttgttctaaacaacgatgcggctgcggcatcgtacgcttatcgccttggtcaggttccaggagacgacgacagcgtcctttatatgtcttgtctttaaggcaaacgaagcagtgtgtcgacactctaaattcaaatttctgccttctgaacgattcttggcaagtgagtttctgtgacctttttttaagaccacgcatgtttgcacgatggagcgcttggcggtgggcatgcttcgcgatcctgtgaccgccaccgacgtacacgcattcacatgcatagattttccaggatgttcttcgtcgaaacgttctccgtgaaatccctttctcggccgatggaggcgcttctttcttgtcactatgtggcatcactgcttgctgttcggccaccgccataggactcgtttttctgtcctctgacagtctgcgacagatccgcaggaagccgaggaactgtctgtggctgtgtcgagcgaagagttcaaaggcacgttcttcttttttcggccctctggaggtagacagcgcttgtgtgtggaaagcgatagggtattttggtggtcactgcgggcaagaggaaaagtcgtgtctcgtcccccgccgtaaacagcaacccagtggaagttcgttttgctgaaacgtgtgacgagtgtgccgagtctttctcatctggttcccaagacatttttgcgggttgtcaactctctgtgcctcgttggagggacttgacctagttttcgcgggctacgtctcgcaaccaccgggaagaa

SEQ ID NO: 1253 - DNA, 4611 bp, Toxoplasma gondii
gttgctcttgtttcccgtgccaccactacaagaacagaaaagcacactgtaggtccaggagtgccgccgtacttgtgtggctgcattcatgaaattcggtccatacaagttcaaacacttaaaagtgacacattgttgcattcgataggccacgctccatcttaccatacacgtttctactgtggttccgggcgaattcaataagtcaaagcgccaacaaacgagacgatcgcagcgcgtattcacaagtgcccctcccgagacattaaatacatcccaagcttgctgtgaccgttcattctgcagacgcatcaatgactttctcacttgtcctaatggcagcatcactccgttatgtggtgaggtgattcggtttgcacagcgtgtgtcttgccgtaagaaatttcccaagagttcactgcttgtttcttctattttgacgggacatagtagcagcaccccagcgtctattcaagtcgacagaccccttgtccgaaagctgtggcagtcatggagagcctcattcgacggcgacgcctgctcagcgcctgaaaactcaccgagggcactgatgtttccatctggaccgcaccctaccatctcacaatcaagtgaaacagcgggtgcgggtggtctcacgatagagggccccccctggatccttcgggttcggctgtggttaaagagctgtcgcagttgctggttagagtgaccgtctccacggccttgagaacgatgaatacttccgccccgctttgccaaaccactgtgtgaatgggactctgtcaccatcgttgaatcgggacggcgagcggcaaggttcaggcagaacttagctactcgaaataaagttagtttaggactacggtcgctcgaggccccgtactaacgtcggataaaaatgtcctagtcacggacatgcatctacgaagaagtcagtgaaagatccggcgttgggtgggcttctcatgcggaagaccgccaggggccgacgcgtgtggtagatgatgaccaggtctgagcatccggttcagtgtccataaaaggagagaaccgtggcatgaggcgccccacaaagtcactcgcatgtacgatattttcaatctgctcagttcaagcggctacatacaggctgaaaaatccagcttactccggcactcatgctgcagtctcgccgacgcaagggaacgcgtatgaaccggcaagcagcgccgcgcggaagagtctcacaccagggattttctcgttctgctcacgccacccgttttttcacgccctgcgggtcccgttaaaattaaatcaaagcagttctgcttcccgttgagggcatcgcatgacgctgcctgtcggtcaactagtttaacgatgcatgcacatgcaacgtttgaacagtgtccggcaggaggctcgctgttacaggcagcaggatcgcagcgatacctcttagcttcatcgcccagttgcatttttgctttccgaaaaatgttctggcacacacctttggtgtacgttgctttcatgaagccagagggaaaagtggcgtgcgacaccagggagctaccagagggagataataatccttctaaagagaccaaatttcttactaactacgtgtacagcgatttgcaaccaacacgggaacttgcttgccttccaacaagggaacggagaagaactcagatctatcgctgagacacgcaatgaacggtgttcttgtttcgcaatctcctaccccaggattcaccgtgcgaagcagcttcgggagaaaccctttcggaatggaatatgggaggggctaacaatgcagatgacctgcctcgtctctcgaacgtctgaattgtatttcaggtatatggttgtatacagcagatgggcatcgtgtcaccagtgcggataaataagcctgcattcgtacttccaaacccagcgacatgttttgtctagtcgacaaatgtgcccgatagaattaatccgatgtattcactttttatgtagtacatgcctaggatattacttcaacgaagttcactgtgaagcacgcacatttcaacgttgcaattctgcacaggaaaactccacaaaaggtagctgtcagagaaacaatgctcgcccctgctgtagaccatccttgatgaagattctcgtgagcaaagagttacttcaacaggagtacaccgaaaaacaggcatatgaatgcgtgtaatgtcacagcgaggccttgccgaacatgcacagcaaatgctgcgatcgctccccgttcacaaatatggttgtaaaacgtctgaagacccggttacctgtaatccgaatactgccttttaagaaaattgctcccagatgaagcagtatatttgctactccactacgatcgtgccagtattctctagggaatcaatatagcggaaggaacatacaattctggagcaagcaacaaggaaaaacctagaggaccatccgtcgaccagttgttgtgctctatgacacgaatactgactggtagattattcagagtccgtaaggtctagtggggatatactgacttccaccagtgttgcacgtgttatttgcgggtgttttttcaataatgctcccgaaacaatgccaacggccaatattgcaaaggtcgttaacctgtcatgttagcttgttgtgtccatgcaaagatatttcagaaataaaatgtggatccgcatcctagtagatttattcttcagacgttgcggccgggagccgcacatcaccatttgattgcagcctttagaccctcatcgaacggtgtgtcacaggcgactgtgtcgcaccgaagtgagagctggcggacttgacacaataaaccccgacaattagtccaggtttcaccaagtgcgcaaaacgtttccctctggcactgctcggtcaccatatcccggatgctggttcgcgcaaaaacgttaggggtaacaggcctcagggacttgacaagcagcttaatcgcattcgtatcacttagcaaaactcctggtttcgcagcagttctcccagaaaaacgcacattcacagagacagcaggtgttaactacgacagaaaaagtgccggagaagaaaaaccccccatcctgtgtcgctttagtggcacagccttgcaatggtgacttgaggttcgctgcttcacagcagtctctgctctcccagtgtcctctactgccactgcaatgcattctggcgggggtggcgtagtgcacttccacgtgggctgtcatttctggcactatattatgaaacgaggatgtttacaaggctttcagtacgcccgtttacttaccatactttcaatacgccaaaacagcgtgcttcgtaggattttcaaagggggcatgcatacttaggaacaattttggggccggcctgccatggaccagacgggtttcaggggagtctttcagggatgtggccaccagttttataaagaggagagtaatatgccgtagagaagcacaactgtatgtgactcaactgttcttcgccgccaccgagatgtaatgcactccacttgccaggattcttgcggataccaccggagagagcaagcaaaatgaccccttcgcatgagaaaccaactgagacagcatttggatacttcctactttaatatacatgcgaaacgttctgccttttggatcccgaaatacaagacctgctcgtcgctgccgatgctgctgtctagacgactggcatttctcgatggaattatgcctcgctgacagaagtgcttgaaacgatccgcaaggctcttctataattagcgaactggtatttgctttttcatgcctacttcggttcaccaattcattatcattttccgggttacccgacttctgttgaccctcgtatgccacgcgaacactctcacagagacctgtctctacaggctagccagtgcttgcatacaaggggtatcaaggagaaagatgaaaaacaacaatgtatgagacagacaaccgcctctcactcctacccgcgatatcgttttttgaggagcgattggcctagagatctcatcttccgcagtcagaaagaatttctgttcatctgcggctgtggcatttttttgtggccggacaacaggtgtgtcgtgcatgcaggctcatgcgcaaaatactgaggagccgttttacttcgcagaaacctctgtaaaacataaccgtaggtcagaattgttctgttgttcccatttttggaaccggcgtatcactttggcactcgacgatcatgtctttccttttgtattccggtattttatagcactagaggggtgaacgcgagttgcaagctcttagcattcgcgatcaagttgccacgtcatagaacagccagtcaatccattccgcttctcttcggtcgcctcaattcctgtggaaatacatatggaatgctaggctaattctactgcgcgtctgcttctctacgcgtgtacgcatgtgcagttatttacaaccacagtacgacttgttggttcgtgtagatgcgctcgagatatgtatctttctatatttccgtgtaactacacatgagaacccggccgctttctctaggtctctttcgacctttgatgcttggacagttacgcaaaga

SEQ ID NO: 1254 - DNA, 1793 bp, Toxoplasma gondii
ccgaagtgaatatgatatttgtgcagcttgtatataaatgctggttcttcgaatatactctggacaaagtgttcacattagtataactcaaatcgaataatcagagacattatagtgcctaggatactgaatatgactccggtgatgagctacagacaaccacgttcttttataacgatgggtcgtagcataaaaatatgagtatataggtacgcatatatatgcaggcatatgcatgtatatggatgtatatatatatatatatatatatatatatatatgtatatgaatgcatctagatctctctgcgtttgcttttgtatcggttaccgaaagtcttgtgaatgtttgcgaagaatacgtgaaacgcatgcgggtttctaatatttgcaggtgcgtttcgagacgtgtcacaagagctgtctctaaggctatgtcggcgaagagctcggtttcccgcgtttttctctctgcggctctcgtcgcaaaaagtagaggtggaaggcggtctctcctctcggcgggtgtcgcgcttgtctcttctctcagcgcacagaggagaagaaaacggaaggcacgggtgtatctcgggcgttttttaccaagctcagcgggggcgttttcccagcagatctcccagctatatacacgtcgcactcggccgtcgccggcgtcttttgagagtcgttgacgcagaaaaagtcgattttctcgtcgcgtgcggagaacctttttgtctgtgtgtcagttggagcctttcacgagaaaccttgtccaagggccgaccgcagttacttcttttcgtcgggttcgccgccgcttttctcagatgcgcccgcgcccgcttcacggtgtctgtacacacactgccggggggaaaaagacagttttcgagtgctgtgcgacttttcgcgtggctttttctccatccttccttcctttctctctcttcttcaaacacgaggaggaacttgcgcctttcgagactcggacaccctctgcgtcatgcgtcagaaaatccccgtttctgctgcttcggcgcgcgccgagtcgagggcggcacaggcctgcgaggcggttttgagtgttggtcaagaaaagtcttcttccattcactctgcttctgcatcttagtttcttccagtgcgtcttcaatccgtcctcctcgattcgtctttcccccctttctctgcgctctcccctccttttcgcctcgcctcacctctcccgcctctcccgcgtgtcttgaccttctctgcctgcgttttctcttggctgtcttcgcgctgcggccttccgccttcgtcgggtcctgcgttcgtctgcgttcgtcttgcctccgtttcctttcgcttcttttccctcctcgtctctctcctggcgaggagactcccagaagcgaagtctcgacggcgccgaggttgcggagactgctctccgtgttcttctagccgcccgcgtccccctgctcgcgttcagctctgggacgccttccctccaccttgtagcacagggttttttctcgacgaatttttgccgcgcaaagagtctcagcgcctcgtcagctccaggcttcgtcgggcggcgtccgggcagcgcctctctgtcttcgcctctctctgccgtttccaccatccagcgctttttcgtccgtcagaactatgcacaaggactcgcaacgtcgcgggcgtctcttcctccctacgcaccatttcctcaggtggacgtacaccgcatcctctcggaatccgattgcgtctccaaactctgtgtccgcgttctcgtccgctcga

SEQ ID NO: 1255 - DNA, 2040 bp, Toxoplasma gondii
tttatttgtagcggcagcggaggcgcagaggagttgaagcttgaagtcctggttgcagagcatgacgctgttgggaggcaagaaggcgaggaaatgtgagcattgttcgtctgtccaaaagtcctggaacgcatgcacagaagcggagaagcgacagctggcgcgccgaaaggcaggccttccgacatggcggggaggaggagaccgacgcagagggagagagcaaagcggagcgcatggaggcgagaagctgaaactggagacagtgcagaaataacgaaaatttcctttttcttaccttcaagtggagctcgcgactcggcgcaaggccgtccagagaaggccctttcagctttcctcgaagaagcaacagtctgtgttcgctccctttcatctcccactgttcgtcagtcgtctcctctgtcctctcgtcttgcctgtctcctcgccctgcctcgccctgcgttccacctctttctcctttccgcggacttccgctttcttctcctggctgaagaaggcagggagaggtctgcctccgccgtcgccagatgcgcgccaagaccgtcgcctcacgccccatagaggaggaagaagagaaaggaggggaggcagaagaagagaaagaagaggcagaagaggcagaagaggcagaagaggcagaagaggaagaagaggtactatctctgctttcgagacttgttttccacggacggaagtctccgctgtcctcagcaggaccgaggacgatgaagtcgtcgctgacttcacccatcttgaaagaaacaagacaagaaaggagacacacagagagaggacggagaagagaggaaaaaacgaggggagagcaagaaggcgcggagagagaaggcagtgcagaagggaggaaactgtggaacaaacggtgaaaagagcaggggggaagaagcgctggagaaagtaaaaaagaagaagagagagaagaggcggaggaggagaggagacaggcgagagagcaagggcagacaaaggagacgcgagaaaacgagacagaggaaataaaaaaagatatagaaggtggagagcaagacagaggaaaagcgatcgaggagagggaaaaacaccgagtaaaattagcgaagaaacgagataagaaacaaagaagaggagaagaaaggcggtcttgcaagacaactcccggaagcccgccacaccaatcacgacaagcgcctgctttggggagtcctgcggtggagaaaagaagaaccggaggagctccgaagattccgaagcgacgatatttgaagaaaggacccacagagaaaaagatgcagcatccaccagaaaaaacaaagacgacgtatgaccttgacaaacgcaaagagcgcgtttcccgacctggaaaaacgaagacaagggtgtcctgaggtgaggaccatctcccgcggaccagaaaagccacaattcaagacttgttcctcaacttttcttttattttctctcatctgcctgcagacgaggttcgaaagaaaggaggtcgtctgtgctgaatgagaaaggtgtgtgccaggacatagcagtcacccgcttcgctcgcgatcgacagctgagacgtttctcctgtatcttgtctctcgacttctttttcttcagcgaaattccgcctgcaatcgttcgaccagacggtcttcctcgagtttttgagaaaagaactcaccagctgaactttctttgcggagacacccgagtgcagtcaccgccgggcgcgatcttcgctgtgctcctcaccgcccccgtctcccggtttcctttcttgttctccgtatctttcttgtgctttgtcttcttgctctgttctgtcttcctccgtctcgtcctcctcgtctttcttgtcctcctgcaactgtccttctcatcccacggtggcgtatgtagagagcagacagagggccgtcgaacacaagggcggttaacagcggagaggcttctcgaaaggacgcgtgtctctctcaggtgaactcttcgactgcaacttttccagctttctcccctctgcaaaca

SEQ ID NO: 1256 - DNA, 1341 bp, Toxoplasma gondii
ggaagaggaagatgacattcgcttgcgactgctagagtacgattcggacttctcatttgcgcttccgccgctgcgcctcgtgtctccgcctcgatcgcggcgagacgaagaagacgaagcgctttctctctctcgacttctccgacgctctgaccagccttcgcggccagagtaggacgcctccgtcccccccctgctcgaagaggtgccagagcggctgttgcgagacatcatttcaccctagagatacacgcgcgaagccgcacatggaaatcaagagaactttcaccgattgtatttgtgaaacgtgattagttttcctagccaacaccatccagttgcttgagaaccagtccctaaatatgagagagacaattcggatactgggcagtctccacgggaggcacagaggacaaatgcctagcagactgggaggcccggcgctagtgagggctccggagaaaaagaaacaacgcagcgacagggaagaacagaaggtaggaagctaaccgacgtgtccaatgacgcaggtgagggaagtaagtccgaaaccgcgagggaggacgaagcgtatgacaagtaacgcagttgacgagagaagccggctccgcaaagtgatacggggaaggcttcacaagagcaacacagaagagtcagaaggggtaaaggcacaggattgcgaggggagatctgacggacataggcgatataatgagagaaaagcggtctgtggcacacgtggaaagagagatactgggttaacagttgtaagaaagcgctgtgagaaaactccagaacaccccaaacagatggaccgccgcgtggaacacgagacagggagaaaagggaagcgcccgccacacacagaaaggcagcgaaatacagatgaaccccttatctgcggttctaaccaaaaaacgagggctaatgtagaaggaagagacggcggccgacgaagctgttcgacagtaaaggggggtgagaatcctgctggcgacttggggagaggtgcacgaaggacgggaaaacggagagaaatcaaaattcatgtgggagcggaaaaacaagggggaagggaaacggaatgcaagcgcagagactgatattttgagaaaaaaagttccggaaaaaagcagatggaccactaaaggcatgtagactcagctcgcgcatcgcatccactctccagcagaggccgcattcgaggcgccccagggggtgtacgtacaccgggattctccgccgactgaaaagccgtttttcttgtcttctcggtttccacagaaaacggagaacatggaagaggaaggcggcgaaagcattttgtcttcaaacgcaaga

SEQ ID NO: 1257 - DNA, 3922 bp, Toxoplasma gondii
ggaatggcagtggcagtggtgataatggaggaatcgctttgcttttccatgggagagcgtgaaccgtggggacacgtgctcgtagaggttcggctgttgccttgtacctcgtaaactgttggatctcgtgagaatttctctcacgttcagactctcttgatcgttttgttagaacagtacgctgcacttgactgccaagagtttgtaggcgcggttggcaccctacaggtgtactgtggcgttgccgactagcgcacggaggcagggggtcacccttgttggtaacctctggtgacggttttgacctgcagagaagctgcagataataatgcggcggtgttgtgggaccaatagaccttcgctggcacatacgagatacaggagttgttcggctgcggcggagccgaagaataacttagatacagtccacagagatgaccattttcaagtccagactagaatatgtgcaccgcattctgcatcatgctcagagtgcaacagagtatgcgctggtgtagcacacgaaaagattttacttctgtgggatgtggtcgtcagctgccctcaaacatgttcggggctttcggagtaaaggagaccgccgtgcccgcgcctttcactgcgcttccgaactacctgtcccatccgtcgaccactgcggggctactttatcagtacgggctttccacagcggtagggtgatgatgaattcaattcctatcaggttcaccagttcatcacctattcacttccggagaaagtggtatattgcggttctagaaaaaaatactctggtctttttcgcggtgcttctcattcgcgcaggggtcctgcgacacgccttcacctgcctccaatcgcatgtgaaatgctttgcttcatactgcttgctgacagactaatgtggttccaactgtaaagaacgtctcttgaaatagtgttctgggaagcccgcggggcgggtggttttgtctggtctttttttgacaaggtgccttcctgttttgtgacaaaacgcctgaaccgcgtcttaccgcgcactcgcccagactgtttttgcttgggtgtttctcttttagtttagcgctatccctgaaccactgtagacggacacagcagtcctgactgccactgcgataagcctcgtgccccggagaccgatgattccgagatcagcttgagcattgaacttcgttttctgaatacttacttcgtgatggcggcgtacccactgatatgttcaactgtgtcttcggttcgccctttgcatacgcttgtaggacacttcttcgtgattcatgttcgtcccaagtcaagcagtgcctgattgatagggaaccagagcacccacttctccgtctttaccgtactatctgtcccaaggcgatcggtacaggagacacgccaacacatgcgccactccgcagtgcctcgtgaatgaagtcggaaggaagcttggctttaccctgcaacaattctgtgtagctatgtgtgcttctacatgacggctatcgttgtagaagagcaagggcgtaacaacgaacaaaatgccgcagaactcgacgatcacctctgccgttttcttttgcccgtggtggcgaggctgcaagaaaaagagggacgagcgttagtacgatagagacatgcgcagttcaagcaatcgataacgagtagccgcacgttgccttgccatgcttgcacttcactgaaactttgcgagtgtttttgtagataatgtattccggcagagatgcgaccaaccacctaaagtgatgttcatctctcaggggagcgcgtcacgcttcactacggctcagcaactgcttgccattgacgcgtgccccctcttcggactgtgatctcaaaccactctttcttcgtggacggtgggttctggtattttcctccgactttttgcttgcacttgatggcattttccagagcggctctaattgcaaagaacaccaagggaagcgcacgcatggcgaagacctcgatggaacagtttctggttttacttttcaatacgtgcactcgaaaccgctgccgtgtgtggcagacccattgtttggaatcatcaaacaatcgccgttcttgcgcgcagatagcattcgcgttcgtgaaagtatagtttcactttctcttgcagattctcatcggctctgcactttggtgcacaaagaagagctgatttgtttatctcggaacagccgtttgacgggttaagtactatgcgcttattttgcagcccgccttgtatcgtaccacgaccccagacaaagttgtgctcatcccatgccggtccccgcgccacttcgagtagaagagcacccagcgcagctgaattcgcgtggccaccactgtcaagcttggtgtggcaggtgcttgcagcatttttaattcattcaaacggggtattcactgcactatatcatatgcgttgccgctatgaaagggaccagtcatatatgtggatgcgatttctcaacaacccagccatgaataaattactggcatcacaaccagcaagccggtgtgcagtccctcgtgcatgaagggtctctgccctagataccgggacaacgtgacattcacatcagcatctgttaaaaggaaatttcaggtcgttcagctattgtgaagcagttttcctgtggtgcaagcagcccgacttccagtgatttcactccacagtgccgtgccagcgcgcacaactcggctctagggggggatactgtgaagggtacggctaggcaaccaaggaactgcgcgagttttccttccgtcgtcctccacgtgacagtcttcacagtgcctgatatgaagcgccagccctacctgaaaacttcgtcgagtctgtttcgggggttttagctattccgcaacagctgaagtgcaaatgcaccgtgtgatccgagcgctcggcaaagtttatcgtcgcgtttctgtgcgtacactctggcagcattctccagaaattgaagacgcgctggcttgggcgagtctccagttgattgagataaatgagtgcagcaaaccggattgcctgtgcaaagacaatttcataacagatacgcgttacgacggactcaagcgcttttgacctacaaccgacagggatctatcagacaacgcgtaggcaagtcagcatctgggtgtgtccatctgcaaactcccgcggagccgataaaagaagctgtggacttctgaaccatgaagagaacttccagagtcggactctagtcagccactgcttgttggaacttaggacagtgtctgcggccgtaccgcacgcgctgggcatacggtcttggaaggtatccgcccagtcatggtgttatctgttctgccacacagttatgccatcaattcacccacacgtttaagagccggaccccatcagaggagactgagaaaacgtgcaaccatgagacagacctggaaatcaggtgcgatttcgagaaggacaaagcaactcgcattctgatgtagttgctgctcatcctgttcatacacagtcacgagccttgcacccacgaaagagtcgccgcctgtgggttcagatggacagccagccttctgaacagacctcgcagtcgaaactggctctttactgaccagtcctcttctgtactcttccgctgcacctttgctgaagaacccgcatacacgaagagagctgcagagttgttcaaaccgaagtacggattgcaagcatgcaatgcgaccagtgcagttttagaggaaaagtcgggaagctgtggcttttgagaagggccgccacaggaggttatcgacaccctccaaggttcaaacagctcagcgcatgccaaagtctctaaaggaggttgaatgacgcagttacttagcttctgaatttcgacttcctccagtttttgtagacttcagtctgcaaacacga

SEQ ID NO: 1258 - DNA, 1454 bp, Toxoplasma gondii
accctttggtggctcagtaaatcagccacaaacaacccacaaaactcacaagccggttcgaagaaaacaaaaaacgctctttaccagaaccgaaagaaatacgtatacatatatatatatatatatatatataggcatgtctctctctatgtttttctctatgttaatctatctatgtagagttatgcatagataaatatatacatgtgaacatatttgtatatgcctgcacaaagcaataactgaatatatgtacatgtctgtttatttcttgccactgcagtgtctttagagtgtgcgcagactgtgccgagccttctggagagccgacaggcggcgaacgaggagagaaaactggagaaactcgttctcgcaagtctcgaaatccccaaggcaacgcgactcgcgagcaaagaagacgagcggcgcgcaacgctgaaacgccgaaggcgtcgggtgtagatacactcaaactcgtctccccgcgacacagtgtctccgaatcacccagggcgcctgcttgcctctgcaagagagagagaagatacgtctggacgcctggagaaacgtctcaagtcgttgcagccaagaaagtcttcctttcaccttccctgaggctgtcgaaggtcgtctcagtcagtggtggacaagaactctggaagacgctttcctgtttcctgacacccttgcgtgagactgtgctcgcagaactcgaggagaaccgccagatcaccagaagtccccccttttcttcacactgcgacacgagaggcggcggcctgcttcgagcggaaaaaaaacgggcagaaagctggcaaagagcggagagagcgtccgagctgtacgtacagttgagacggcactcgctcggttacggcagaccgaccgcctctcgctctccgttcaccctcttttggcggccgatcgtttctttcctccccttgtcaacgtctctagacaactgttcgcttctctcaccgaactttctttcttggcgtgcagctgagatggctaactcgagcgatgaacgacgacgggcgttgaaacgggagagcgaagaagagaaggagtttcgttggccgcaaaagagtcgcacagaaacagccgagacgcttctcaggtcttcctgggacttgaaccttcttttctttcgcgccttgccatgtcgtcgctcgtcgaaaacctttgcggagtctttttctcggcgcatgcacgcactcttgtctcgcacaccactggtcgtcgagcttggacgaatttttccatggaaccctgacggtgtttcctctcacgaaacgcggcgtttctgctgcattgtttccattttcggagaaacagtggaactgctgctggagaaaagtctcaagtctcgactcggcgacggcgaggaagcgttccggaaaatcgagatcgctgtcccgacaaagaactcaacctcatttgcggtttcttta

SEQ ID NO: 1259 - DNA, 3998 bp, Toxoplasma gondii
ggaccctgcttctccgtccatagacagctcatctgcctctttattgccagcgtctgccggcgatgcacaaagaaaatcttcaaaaatgccttggagcatgtcccccattcggctacactctcccaatacagtttttgcttcttccagtgttagcgccaccttctctgtgggaacttgaggaaaccattttccggaagttgatcgttcggcttcgtttccacaaaaagatgctcttcggtttgtttgtacaaagaaggtatcaccttcctgagcgaccggtgcatgcagcagttctgccgtaacgggcacctcagaaatcccatttccagatgttgttaaatgtgagaactcggggatattttgacgttgtttcgcgttcccattcagtccttggtcatggtggtttcttgaaagggggttagaatttaggtgtctcacccccttcttcacttgtttttgagctggtctcattttttacgtgttgcagttccacaggcatctgctcaaccaacgaatcccccggaaaatccgactgccaatcaaacgttggaaaccctcttagacagagaacaaatcacataaaagtcatcacagcccggagcagttgccctttttcagagaaaccaagagaactgaatcgttttccttctagcatgcagcactcggtctacaaggatcgctcggttttcatcgaaatgcttacctacgtagacctgctaaatcgcatgcgtgtttcagctctataaacaacatatccgtggacctgagttaaacattcgcttttcaacgaccgtctgttggatcctcaacaccggtacatccgcctttcccgcgtcaaacagatcacgtgcgatggacagtatacacaaaaaattggaataacagagatagtcaagccgctgttacggggcctgagtttaacacatttgatggaggaaacacaatatgaaacaaataaccgtgaaaggcctggttgcgtccgcctgtccactgcacagccaagaatgcataccggatctacacgcttgcagcaggaatactctgccttggtagttctttgtgtttttctaccgcgaagacattcgttcgcctagaagaaataggcagcccgttgtcagctgtcttctctggaaacatccgatatgcatcgcgaaaacattaaccatgtggccggtcttccgatcggcgaaatgcaactttcgtctccgcatgcggtaaggaaagtgcgctgcaagtgtgggttcgcgtaaaactttgggtagctgactcgacgagaagctgccatcgtgcctcaagcacagaactgtgaacttttcagatccaaatgattacgtactggtgacatgggtaggacacgagacgctctgtgacagattagaaacaatgtgttgatttactatctctgcagtgtacggaacaaatggtgtccctggtgaaactggtccttctatctgtgcctagtcacctcaaaggcccacgaaacgtattagagagcctcacgtctcttctcgtaatcaatagcatgaagggaccctcgataagtttttcacgtgtcagctaaacctattcgctacatttccactgaccaataatcgtcagttgttttctaacaggccgtctcgataccctaccgggtcacacctactgcgtattcactcctctcgcgattggcctgcgtgtcaagaaaagctatgctcgtctaacactgaataaaagaaagcctatgcttcagactatgctactctaacgctcaaaccatgttgactgtccatttcccttgtccctagttaatccagggacacctggataccgaatcgaagcttgttgcgccagaagaaaatacatcattgagttgccttgtccgaatgactcgacatttgcaggttcgcgagttcagtggacctctaagaaagacgaggcaggctacaagtcgcgtctgccactagccctgagccaacaagccatgcggatagttagaaacgcatcacatgcagttctcctgatacttgctcagatgactagagtcgataaggaacgtgctaatacctattgccacagactctttgagaagccgttgggtagtgtcccgtaaaacaggagcgaaacattcgggaataaacgtattgtccctcctactttttctccttatggagccatccttcagtaaaggaggcaactgcacacgaggaacaaacagcggctcacagacgaatccagctctatggtgctgcaaagagtgtttgtggttcactccaactgcagccactttgtctgagtcaacaacctcggagtacacttgtctgacacttgtgaattatccgactgtaggaaggaacaaaacgaatcacatagataggcagtcacccctcacacatgacgctgatgaacaacgacttattcacttgccaggacttgaaacagagtatttgtctagtcaggtctgcggggaagcggacgtgggaaacgcgaacttctccacaagaaaaacccactgaaatagcgagttgtatcatggctgcacgaacgacaagcgttcctgtgtgtttttatcctgttcacattcatcagtgcgatgtctcaatgattctggaaaaggttatgctggcgcacccactgccgatatcagacggccgcacacctcaacggacagaatgccccgttcgttaccgggtgttctcatacgcccgcgcagacaaaccagattttctaacacactctgggatgctggtcacttctatcctcgatcgttgttgaggccattccccgtttttcctactcttttgtaagagcctccaaaacataaatgtgtaccaccgactaggcgccatgcatgtgtctcgtcaacacgccccagtttcagaaaaaaatgacggccgggaactcgttgaaacgagtgcgacctttttgaaggcatttattacacttcgtgctggtcttcttcagagagagggaagcccgccgaaagtcacctctattccgtgatgatcgccgagacatgctaacaaaccgtggttcatagaacattgagagtggcaagcttcacaggaaaacgaccttcctcgtttcctctaaaacggcgtgtgccgcagcagagaggaaagcgtcagacataatggtttcgtcttgagtatcggttgaagctcgtctcctgttttttacccttccttcacagcgtatatatttttatctctcaagctgtcgattttcacttgccgtttttctcagtagtgcctagcatgcgctttcttgttggttcttttgctccaccaaccgcccccccatatatcccaggctccaaggagggcggcttcggggtcctctgtcttgcgcagacaccctcgagatctccacaaaattgccccacctctggttctttttcttagtattttgtcgctttgtttctccactgaactctgaaggaacactgagccaaagttcgtgttcgctggcggaaataaaccccgtgctccgcgtttttcaccgccgggacgaacggaggaatgacgtatcttgcatgcgggtgaaaagctttcacgactttctcggaagcacaatatgcacacctgtcatttttcttctgttttgattctttctggtgccttgataatttgtaccgaagcgtctcatgttccgatgcttttctgcggagggagaactgtatgacgacaagagggtacaccgcaaatgcaccgcctcactcacaagattctccgtgtgcatgtgtgtaaacaagtaatacagtcctgccacttgtttttccgcctcagcagattggcatttatctgaaacccgcaacataaacacatgcgtctctacgcgtatagttaccggcgagttcccagtctcgacccggtcgcagctctagttcgtgacaccttgtttctttgagtcggtttgccgtgaagtcatcgatgtgtttaaaagagacagaattttcaagaagtgtgtacgacgtcgatggccaacacagtttgcatcttttcccgtcgaaagtaaaa

SEQ ID NO: 1260 - DNA, 3709 bp, Toxoplasma gondii
acaaacggaacgcgcgcaacgttttcttcgactccaagaaggcctatccagatatttccactcacgcatacacacacacatatatgtatacacttacatgtgcatggacatatatatatatatatatatatacgtatataggtatataggtatatttacatggatacgtatgtatatatatatatatatattgatatgtgcatggatgtgcgttatgtctgcgtctccatgtctagatatgtgcatttgtattggtgtagagatgtatctcatgtttgtatgaaaatgcaagtgacgagacgggagtctcgaacatacgcgcttccagaggttcacgacagctgtacctggcgcttaagctctcgaggtgatctcttgactttttcgcgcgtacctgcccctctctgacggatccatctccaaggtggatgttgacgatttcattgtacatggggaacttgacatcatcgagaatgacaagcgggccttccacacctgcgaccgttcgatagtcgaggcgaggagccactcggtagtcgcgagaagctgccgctgcatgcgcgagcgcagcgtcggccttggctgcctgagccgccattcttgggtcccaggaaagagctttgagaatgagaaaggcgattgtcagactggaacgacagagaatggaagacgtcggatgaatcccgatagatcggaagagccagctgaacggttacgagagaacacagagaaaagcgagcgtggaagaaccaggaggattctagagacgtttttacagttcgaagggaaatttggagacgccgaggagaggagacgtaagaagctctctgcgatccgagaaacgagactacgtaacagaggcgtcgcgaggcagacgcagaacagtgaggagagatatcgagggcacagggtctcccgacggatctgacaacgcaggacgagaggtcttgcaagagtacggcaaaagattcgcaaatgaggggaacaagtccacgcagacaggcgtgtgtaacggtctgccgagaaaccgcggatcggagcatgcagacgtcactacaccccgttttctagcagttgggtacggtcttcctgggcgctgcgcacggcagtgtgaggcagagaagtggtttctggccgtcgatccagagtgttttttccaaagttctacgaaatgtcgagaatgcaaggggaacccgcgcgctccaaacgctccggcgcgcagcgactcgcgaacccagcagtttgcagtgccaaaaaaagaaaacgggaaaagaccgcagcggttcagtcagaccctgcgatgagagcgagaagaagcacacagggcgaacgaaagagcgcgagggggcgcgaggaaaaggagcgcagctcaggaaaagggggaaaaaacagaggcgccgttctcgctaaagaaccccctgtttgtgcgcttccttgtgtccggaggggaagagttcgcgcaggtcactaaaactcgcattttctgtagttacaaatccggtcgccagggaaaaaacgagcttcggagaccttcgagcgctgacaagtgaaaatcctcgcacgcgacagagcgggagcgtgctttgccggtagaccaccaacacacacacgcgccggggcggctgtgtcgccggtcgcgcatccccaactccttgaaagaggcgctctttctcaagaagagcttcccgttccttcggaaaagcctataaacatcggacataacctcttattttgcaacaattaacacacagatgtgtgtgcctgcggagatagcaaactggatctcgctatcgctctctccacgtgacacagagacggctcatacgcctcaaagcgccgcgttcgaacgtttcggcttatcttggaagaaaacgcgctggtgagacccaacaagttgcatggtacgccacatacagcgatgggtagatgtagatagttttacagaagccgagaaggaaccccgacacatgaaacggggtctgaacaggcagaaacggcgaggcgagggcgtcctgggttgcaggcgtccctgtttgtcgtcaccttgcagctttaccggtgcatacttcgtgaacgtcacccacgaaaaacatatttttctgcaaggtcacaggctgtgaggaggcgcagaaccatacgtatttgtagaagatgctgagggatgaaaagggacattcgagttgcagatcgctttggacaacttcgttgagtcagctcgggaatcctgtgtttcgtggaagtggcattgacatggaagtgaacgggaagatgcatcatttagaagtgaatgggggaagtgtgcgcggagacacgcacaatgcagatactatgacgagcatgattcgtccgctaaaagggccaaagagagtgtcctccatacgacgcagcgtcaggtgtatattttcagcgggcaaccccgatggctcaaagccatgagtttggtggtcacccaactttggaaacgaaaaccgtcggcatgctcctcgtcggtcccgtatgaatacgccgttacggcaccgctgacgggcgacgcacgtctgcttctacgtttcacacacatttttctacgcagttccgtgcacacgtgtcacacacttaccttcgcatccctcgctgcgcacccccctccgtacaaatactgaacaagtgaatagacgcttggcaataagggtgtgaacaccggaccgacgaggagcatgccgacggttttcgtttccaaagttggatgaccaccaaactcatggctttgagccatcggggttgcccgctgaaaatatacacctgacgctgcgtcgtatggaggacactctctttggcccttttagcggacgaatcatgctcgtcatagtatctgcattgtgcgtgtctcctagtcaaagcggatgtgtttccgcttttcgtgcccgtgtgccacgagtcccggttttgcttggtaggcgaacgagcgccggcttcctgcgactggaacagaaccagaggcatttgccctttttcccaacttgacgacacaggcaccgaatatgcgtcctcgagttttttcggggaactgttctcagcaaggccagttccgtgtgagtcgttggtgtgtgtgtatgtgtgtgtgtgtgtgtctggatgacttaaactccccccgacgctcctcgcggtaagcgtggctgtggcatcgatcagcgtagcgcgtttcgcagcccccgaaatttcggcaatcccgaggctacttgaatggtgaatatgggcgagtctcgcggatggtgccggattgtttgacagatccagtttgcgtttgccctttcttcgaggtgaagacggttttgtttctcgagtcacggccgagtcgtggaggaaaaagccttgtagctgcgggtcaaacctgtacgcggccgctgtccgcgcgtaacgcgaaacctgagagggcggctgcacacggtcaccgataagggtttccccccccccccaatcttttggttgtgcacgacccattgcgtcaaatatcgagtttttcacattctgtttcgttgtatttcttgtggaccgactcaaaggcactcgaatacgtcgcgagggtcgcgcctcaacgcgccgcgctgccgtggcagagacgtgccagactcttgcgcgcgggggctgtcgccgttgcttgtgcaagcattctgtgcgtcgcgttttttcgaagcaagcccgtgttttctggcgctcacttcttgtcgca

SEQ ID NO: 1261 - DNA, 4734 bp, Toxoplasma gondii
caagcgtcggtcctctccaaacagttgtttcatcttctcgcctttctgtcgagcctcccctgtctgcgggagaaaaagagaggcgcctgcgacataccggacctgcagcgcctctgctagccactccaagacacgacgtccccacgagtctccgctagctggtccgccagtgtctctgcagctagccggtgtccttatgtctccgcagcagccaggctctgcggcgtctacgctcagagcgctagcttgggcttccctgtctacgccaccagaggcggcaggagagacaccctgagctggaaagacagagggaagagaggaggtgacagcggaggaaggaagcggggtggttgtgttgacaagtcgaacatccggttcagctgttcctgtattgtctgaagacgcccatggaggaaagagctgcaacgcgccaagagacgaagacggagaaaagaatgcagcaaggaggttcgcatgaccgccagagtcgtgagaagaagaagcagaagaaggacgcagggaagcggcaggggagagaggcgcgagagtcgttccagagcctgagagactagatgaggcgtctgacaggggtaacgcagtctctgttacaagagcgttttgtgtgtggagtgcttcgggaaggaccgagtgaggcgcggattggtcagcagcatcttgacgagaacctgtctccgacagcaaccgatcgacaccgccgagtcgcccaacgtggcctggaagcgcggtggtgttcccctcaaagaacaccgacagcgaagatggtgttgtcgcggacgcgcaaccagctttttccaggtctacgcggagcgtctcgttggggtcgaggtacggcactccgaacgagattcctgcagacacaagagtgaggagaaaaagaagaactccgcaaaccccggcgcgcttgaggaagaagtcagggtgttcaacgatgtaaaaggcgacgcggtcgccgagacgggacagccacacattcaggcgtcgcgacggccaggcgcactctgagtgggtcttcaaggtgcagaagaagacgcgtcttcgaatgcgcttcagacagctgcagaaaccgcgaagcggagagggaaaaggagaagaagacgacggatgtgacgcattcccaccgagagtggacatccgaggagacgcgagctgcgggcgagtccagacgaccgaagaaaagtccaagtcgctccagtttccacacgacgcaacatacgagcttcgcggttgctgagatgtatgtacacccgaggcgtccgcctgggtggggcctcgggctggggatgcgctcggcactgctgtctgctgagaaaagaggcatgcgtcgctttgctccgcaggtagtgaacgatagaagcgcctcataacactgctgtctgcagctcttctttcctgtggagacggagaagcgaaagcagcctggcgagagtgacctcgaatccctgaagagtcgctacctccgacaccgtcggcgtcggatgcggcggccatcctggcgaccaagcgagcacatgagacacggcagagagacggggaagaaggggaaaatcagagaaatccgaagaggggaggacgagatatttcacaagatgtacgcagagttcgcaaagaacaaaactgaagacacaaacagaggctttcttctttcctcagtctctttgacagtgctccagctgtgtggcaacaaggtacgtgtggtcagaccgagcgaaggaactgatacaaaactggaggatttctcgcatctttctcaaggtgagaaattcgaaattgagcgggtgagatgctgaaaaattctttcttctcaactggtcgagattcctcaaaattgtgcaggaaggccaacggtgtctccacatctcagcgctggtgtgtggctgccgacttgctcaccaccaagggccaaagcgagagacctacgaggaggagaaatagcgtccaggttttttctttggcttagcaacgaaggcaaaatacgccttgattgtctagaaaaacctgtcgtttcttggcactgcactttccagcctttataggtgctcgcagagagacagggagacgagacagttgagacccgtgtgtgtggatccgagcgttcagcgcgaagtgttttaacagtttttcctcttttttctcccaacaattgcacggaggataagtcaactctcttgaaatatagagtccatggaagacctaaaattcgcaggggccatgcggtacatttaggatgacagctgaagctagtgccgctctaaacggattttgaaacagcttcctcggtttctaaaaccgacttttttctccgaagtctaacctacgcgttcgactacccatccaaattttgaagggctttgttagcgaatcgggtgtttcctttctctgcaagctccatgataaagaagggtttaaagacgcaaagtcacctgctctttcctcgtgtggctttaggatatttggaacccggagataccggtggaacagcgcatggctttgcaaccttccctccactcgattcaagagcagatttggagagcttgtctctccttccaaacagcaaggattgttattctcattcaactttccaagctcgcctatctctgcgttctttccaagttgtcggtcggagcgagcacctggtcttggtggagagtgaggcacatacggaaaaaagggaacagcagcgttcaatcatctgtcctcgaagactttacggccaacagaaataggtatctttacccgattcacaatgcactatttcctcgttaaatcccggaactgttgtggggaacggtgaaaggtgggactgctacctaccgagtcacagcatagcgaatacggaggaaaaacaaaaccggagacgtctgcccggcaaaaaatcaaacatcgcaaaccatcgagaagaaggatgtttgcggctaagcaaacaatatgtctcggatagttatttaatgcggaatgcccactattcagcaaaggcaacaatttctccctgctgctgactcaacatttcgagtgaactgtccaggaagtatcgccgcccatatctgtgtccacacaaaaagacatctatctataatatggagagatgtgcgggttgtcttctgtgggccatttacagctgctagaacacgaagagtcggcatctcgtgtggggaaaagaaggaatttcacgattcgccgagacacaacgcaaagtgaattccgttttttcttgcagtggatcgatcctgggtcagccccatggcaggtacagagagtcagagcaaccactaccatttgcggagatgcttttgcgatttttcctcattgttgcgacgaacggtatcttaaacgcgtggaaattgtcagtgaacgcggtcgttaagccggggtgtatcttcgcggcagacgatccagagaaggaagtgttcggtgtaggataacgaacttttgaaatacaaagcagcaccccagaagtcccctgccctcacagaagcgatatttcccgtcttcgttcgtgaaagaactgcatgaaccaaggaaatggaacatgtgtaccgcttgttctcccggaagttctgcaaactttggacaagtaagggttctgtgtggttaaaacgtttctacatatgcggaaacgacaaaaagcacctttcgcccgtatcgacaagcataggtagtaaaatacaggtttctgttatctgtatataggggatttggcattcgtcgcttgacacaccatcggtttcaaaggtgctgggcaggtagaaagagaggaagagggacaaaagggggaagcagatccctgaggggcttttctcttttgttttgaagtgccaaggagagtgtcttgcatgattggctgtgcctcagttcccaacactcctaggatgaagcgtttggcaagtgtcaaagaaccaaaaattaaagagaatcaactcgtttctctctccacgcatgtgactgcccgcacttccctgtgttttccctaaaaggcgagaaatcttgcattaggtcgcaacgcggcagaggcgtcggtttcgtcctgcctcccagcggtgtctttgttccaaaggatctgtgcaaaactccctgttcgggttacgtcaaccaatttctttcccttggtctccgaacagaaggcaattcgactgcctctcctcctgttacatcaaagtggaaaattaatgtccttcctccctgggagcacatactccataggtgggaggtgtgagttgggccgctctcccaatcgcatttttgcttggggaaaggatgatatttctggtcaccacttaacacagcttcatgtgttgcgttcgttcctaatgctaccagcatcggcaaacttccccagtccctcctgcgtttttcgagatgcaagttggtgttgttgtaacagcgcctttttggggttccagctgcaagatcagggtctgcgattgaggcaaacaggtgtttagcctacgcttgttctatcgtcaactttgtgttccgaataagagccgacgctgagtggggtttggccataacccgtcgcggtgtagggtcctgcagacgtggggggaccgcgcatgcagacgccgcgaaacgaaaattgcggggtgatcgtggatcccgtgatttttcctctccgcacgaccgcctcgacggactttttcagaacattcttctgaaagagggaggggctggactctacagaacctcaagttcttggttttttctgggtaaaaaaga

SEQ ID NO: 1262 - DNA, 2146 bp, Toxoplasma gondii
aaatcggagacgttcattctcgaggaccctgtcttcccagtactaacgcctccatcgcgtcgcctatcgaagcaacacggtgcatgctctctacgaagaaaacatgcggccagtttcatatgcatgtgtacataaactaatatgtacctgtatatataaacaaatacatatatatatatatatatgtatatgtatataataggtgtatttgtcccgacgtacctgctggagggtgtgttttcctaggcaagccagagggtggaggtagtaacgcagccgtattaacagcgtgagaaaacggcacatgtgatcgattttctcgttcctctgatcaggaaggaaagatgctacaaacatagcaacccccacaatctttcctgtagaacaacgaccatgtgcatcgcacttctcaagagagaaacgcgttgaacctgcatgtagaccgaaagccttttcctgcgatagtgtgtgacggggcaagcgttcgacgacagcagatcgcgctgtctgccgctgataaatcttggtatatcgctgaaggaatgtactgtctgaaggtcgacagaatggaaactcggaaggtcgtttgaaagagaaagtccatttcaaggatggaaagtcttcaggaaagaaccaagacaaagtataacgcttgcaggtcgacagggcgtgtctctgagtagcaaaggaaatccaggtcacttctggcatcgcagggactccacactgtaccttttctttctctcccgggacctctcttccacgcagaggccatcctaaagaaacctgcagagagtatcctccaacgctggttcatccgttgctgaacgtctctgttcggaattcgtttttctgcggcgactccagtttcatagctctgggtatcaactaaacgataaggtgaaagtgagtttctttctttttctcgcggccaatgctgtcctgcagagcctcgtcctgcgtgacgtagttcacctgctgctcacgtcttctccgcatttgcttttcttttgtggctctgtagacgaacttcttttcacacagcaagaaaacagagcacttttctttgcttcacgtgaggccccagaccatgggagcaacgatgatcaactttgtgaaactccgttaaaggcaatcaaaaaagttctctctgattgttcctacgaaacgctggtagtgcacctggtgaccacgaatctttgtttgggaactcttcagaggagagttcgtaaaaaagctcgcctcggagaagacgtctctggtagggcggcctggactcgcatctgagaagtcagtcgttttctctcgccgtcaacatacgtgtgtggcgaaggtgatccacgaagagacccctcgacgaaatcgtcgttttccggaagcagaaagccatgtagaaccggaggttcctgtgcagggactccacgcagttctttgtttccggatctgcccagaaagatgcgggcactgagtcgctcgcgatttttttgtggcgtcaacagatctgggttaaactctgtggaccggttttgtgtcttgacatggttctgagaaccaaagcgttcaactgaagctgcattttcttttcgcgctttcttgtgttttcagatctgtggatttcgcggcactgcggcgatcggcttgcgtttcgatccagctcatatctcggcggtttttttttcgcgcgtcattcggctcccaaacgaagcggggggaagccccgacgcgagaccgcatgtgtgtctccgttttccttcactgaaagaagtcgcgtaggagaactcactgactcgcatttttccgaggactcgcaacatccgaaagtctgtctccgacttcgtctcttccgtttcgcgtttgccaggaaatgctggagaaaagaaacgcgaacgcctctcggagttccctataaagaccgcacgcgctcaaggaaagacagaagagagagacagcgaccatctctccttctctcgcgcacccgcagatccccctccttcccctctttttgagcgcccgggcgcgagtttggactctgcacgagcgaagctggcggcgtccagacctttcctccattgtgtgtctcttcgttctttctgtttctcgcgtctgagagtgcaagtctgcttccttcccctccctctccacaaaa

SEQ ID NO: 1263 - DNA, 1955 bp, Toxoplasma gondii
gctacctcagtcaggacatttccttcttccgtgtctctgcagcgttccccagtttgttgagaaccgcactcttctgaagagtgcttcccattcgctacgtccctctgtctttgaggaattcgcttctgatgagcaaatccgacgagaaagacgagacaagaccgcactagcgacaggagaaactgaaagaacgcggacgtcctacggttgactatggagtaagacactcatgactgtctttggagatccagcaggacctgtgccgtcggattctctctgcagggaaagttacagatacgccgtgcgttgctgtggaaatacagctgaaatgttccattgaaaccgaaacgagacctcttgcttcggtctccacgtttcagagcaggacagagggcgttaatatgcggacgctgcttcagataagaagttaatagagtgcggagtaagacagaaaggaaggtagttcacgaagaatactatagaacaaacccattacaatgtagtggacaacgacgcatgccagaaaaaatatgaacgatgctcatcgcaccacgcgctcctgtccgagccagccgccgtggcatagaacccccgaaaaaaacggagacaaaggaaaggggcgcaaacacaggagcaagtaaagatgtgtttgatggaaagaaaaatacgcaattgaaacacttgtggatgcgctgaacgaactccgggattccgacagaggaagacgacacctgcaggtgactctgcacgtttcggggtgaagagggaggtttgtcggaaaggtcgtcggctagagtagaatcactcttagtctgcctgcagtgatggtctgccgaattaggaaagaagcttttcgggtgaaaagcgagaaaatccaccaggtgaggagggcgcgtctacgaggcagagaaggcacggaacgcgacgctccacgtttcgtctgttagaagcaggccagaagcgggctagagcaccgttccctagtcaaaaaaagcagactatagcttcagcataaccagaaagtagtagtaagcgccaaaaggcgtgagctcgtggcacggtaagcatcttttcgaggatttcaaacggcacacacattacggcgtggctgcacatgcgatctgcatgcgctcagcagctttagaccaaacacaggaaacacgacggatgtgagggtcaatccgcgccgcagaatctcatttggacgcgtttctggagttccttttctccagatgaaataccgaccgaaagctctgtggttcaaaggaaaggagacgcccatgctccctgaaatacctaccaaaaagtgacgacttctctggatgacgcagtggggcaaactccgcaagcgagacataacatcgggagacgcccaccgcttgtctgagtttcattcccatggcttttttcttgtctccgattccccgaagaagagacttctcgaaacgcgtccagattctggctacaacttcgtttccgctgtgagttcccgcctcagatggtgggtttgttccgccgctttttcccgcgaacacttcacttttctcgtggagcttcagagcctcctgtttcactgcttggcatttctgcgccatgctaagtgcagcaagtataaccgtatccggcacattcaccttcaggggcaggcccgcgtaaaacaaagttgcttacgaagcgcggtggtggaaagcctggctcgaaagggcctgcaactgcagaaatgcctacgcggtctaagggaacagaacgtggccttacattccgtaatttgttccagactattagttcaagaaatgtgtctacggaatacatgcttcctaccacgtctgtcgcgccgttggtacgggtcttcccaccttttggctaaacacttcaatcaacgcagtgctttttgagcagcggacccgaggtcggcgtacctttttctttcgaaaagtaaatagaccaagaggata

SEQ ID NO: 1264 - DNA, 1688 bp, Toxoplasma gondii
ttgtcgaagagagcaggcgcccatgtggagaagaggtatagaaacgggcatggagacctggcaaagagaaccgggaagagaaccacggaagccgagcgagagttgcccttgtcgcacccgcgttgtggcgtctgatcgttcttcttgctggtaaccagagaaggttgtcgtggagcgcgtcttgcggggacaagacagattcgctccttgaagggccagacacacatgacgaagcattcgcggtgtcccttacggcgccacagcgcgtgtgacagggggaaagccgcggggtggaacagagcgagggagcagccgagagagacaccaaacgtaagcgagctctgtctggttgtgtggaccggcttgtgacgctctcccgagaaagcgcggagccaatagagaccccggtgggagcctgagatttcgccggcacatcggaaggaccccgactggcccgcaagatgtctcgcggacagaaaataaacagccgggaatctggagacacgaagcgggaaatgacatcacaaggggggtccgcgttcatgactggtcgacagacagctcgttgctgcaaggagagaggagttagcgaagagacagaatcagaggcactttgcgactgtcggaggctaaggcagaggggtcccgtagaccgtatcagcccgcaggatctgtgccgacggaccccagcaagctggcccgaggacacccggccaagtggccccatgctgtcttctcactgtgatgttctctgttcttgtggttgcctttaatgtcgctttgtttcgagtttttgaggagccgcaacaaaagcgaaccgaggcagggcggtacaagataccactcgccacggcgctgaggcagaggccagaaaagggagaaagagtcgagttgttgaaaggcaaaaggtatggagtcctcgtgtcacaaatctctttcttgaatttgttcaggagaactaagagaggacgcacaacgtgagttgcatgtgacgggaacggagacttctggaaaatacctccagaagagagacaggtatacttcttcggacacttctggttgccctctgcacaccgcgcttcttgagacaggatcacgggaagatatggtgcgaggtcgagaaagaggaaggaactttcaagatgcgtctacccgtcggcgcgatggtttttcacggcctcagtaaatccagtgcgaaaaggcgggaacgcgactattgagagaaaaacgtcagtggcgaggatgaatccgcttctctgccagcctacatgacagaaatccccggcggctgcacggccacccgcttgttttggatgcttcagttacatggcgctcagggatcactatactcggaacaagcctttcgaggcttcagagagacactgctgaaaatcgtcaggcaggagacacacgcatcttcccgccttttctcaagctacggaagacacagtgttgaaaaccgttcattagccgatatgcatgccagcgatttttcccctcccgctccgcatgcgctttgcacgcgagagagggacagaaccaacgtgtcgcgtattttcgagagtcgggaggcataaaacggggtgcgtgaaaactgtgtggcggcgcctcatcttttcctcttgcacccgtttgcttttgttgtttttctgcgtttgtggagatttctaggagcagggccgacaaga

SEQ ID NO: 1265 - DNA, 2868 bp, Toxoplasma gondii
cagctgaacggtacacctttggcgaaagatcttcaagcgctctacgtgggccgcccgtgcaggcagcgctgtctcttcctctgtcttctgcgaagtcaccagcgttgggccggtgctgcgggtggtggcagtacaacaatctgtgcgccctgtctggatcgttgcagatgcccttccgtttgaagtcaatgcagacgatgcacagtcccttccggtggagaacgtcaagagcaaacaggggactgcgggtatcgctgtgctcttcttcgtggcagtttcggcactctcctccatttctgcatctcccgacagcatagaacacacaagggtggcaagtgcccctgttgtggttttctgccacaagcggccgccgcagtgaatctgaggcgtcacgcgccggatgggaatatgcagacccgtgaaatggatccttcgacgagtatctctcgccctccaaaagtcgctgagacgggcccacaggcaagcctcctccattagacgaatagcccacgggtcccgcgtactcgcgcccaccagatctctcctggactcttcggtcgggtgaatagctgggacctctcatgtgcatgcgcccgcccgatggtgtgtaatctccggatcgcgaggctgcatgctgccgccggtcgaaatcgtcactgtttcctcgctctctccgataccactcaccgtcatcgggccgtcccacccacccgcgctgcgacgcgtggtgcgagaatcccccttcgtttctactgtctagccccatttcttcttccagcagatttcgccgatcgccgcgcgcgtggggcttcccgtcggtacaggaaaggaaatgcatgcatgcacatgcacacgttcgactcagacgctccccaacccctgcctcgtaacagcggctttccacgctcagccacctttttctggaaccgctgaatccgatgtttctgacctgcacgcaaaccgtgaatgtggccgtcagggtggcacctggtctcagagcgcgactccgctgccgcgctaaggtgtgaaggtgtcgctgctcggcctgcctcgctcacaggcaaaaacacctgagaagcccgcgctcgcagtcagacttgtgcttcagatatcgcaggtagtgaggcgggaggaaaaaaagacactaccggcactcacgagagggctgggattgatcgacacacacacagtgctcgctctcgagaagtgtaggaattcgaggtgacacgaggtgtgcctggcacagctgcagatttgtttgctggaactgctgtccgctgggtacgaaagacaacgcaggtggtggcacagaaatggacacctgcatctcgccccaaattcctttcctgcaagcgcgctgactggccaaacgcaaagatcacagaataagggacaaatccgtgcacgccacgtctcgaactctgccaaacacgaagcattcactggaaatccggcagatacaatgcgtggacagagagctcctcaaacgatcgcatcactgtggaagaactcggagtgagaaacagtacgggaatggaaaggcggcgtacgtaagacggacccgatacgcaagaaatcagatgtctcggaacagaacggcatgccaaccacgcgttccacttcagttcgttttaccaacaaacatgaaggcagcgcagacagcgtccaaacgcacagcacgtgtcaagcgtgtgtgtgtgtgtatgcgtgttctctgtgcagcacacgaagacacaatttcacgcacaactgctaatcgagatatatattcgggacgcttcgtggctaccatgctttctgctacccttcagcgcagcatctcagggaaaaaccgcgcaacaaaccaattttaggctttcgatcactcccgaagagtcacaattttccaacgggtcacatttgtgctgatataacagcataaatctgtgcgttccctctgcggcaacgaaaaaaataacgcaggtagagcccgcactttgtaccaggaacgccgtacacacacgagtccgctactaacgccgttcacctgaccccatcattggaacagggaaagacaaccatgtgaatttacaccgatcacttctttcgagttctgctgctgaggcccaaaaaagattgagacagtgtgagaaatcgacgctgtcaaccccaacacctccatgaagtggtgcgtaatcgggaaaaccggaaaaaaacaagaggtggacgggggggggggataatctatcactggtaggaacacacaatcgctcgcgggcgcttgatagttcgccgaaacgaaacaggcgcagaacgttgttacctgtcgacaaaaaagaaagatagaggcacaaacatcctgggacacaaaagtaccccagcgaggctcgcctctctgtctctccctgcctccggctccctgtctcacccctcacgacaaagacttcttccgaatgtcctgcacactatcgagtctctgacgcgtcctctcgtatgaaaacgaagtctgtcccacacagccttaagacgcagatggccgcacagccggggtctgccaacgcctcgttcagacgtaagcatccatccagccttgaaaactgcatgccgttttacgccactcacattccagccaccgcctccacgtggttacccttcaccactcctgagcgccaccccgaccgcaacggaagaagatgcgggagagttgcagactagaaatgccagccgaaaaaatatcccgctcacatcataaagccaccacaacgatgatctaggaaccgagaaacaacgctatttcgcattgttcgaggacttacccaacttgtgataagtttttggcttgccttcatcattccttaggcgcgcagttagcaagcggctgaacttcag

SEQ ID NO: 1266 - DNA, 2047 bp, Toxoplasma gondii
ggctgcatcacattgctcatgtgcctgatacgtccgtcgtcggacacggaggcaaccgtgacgtagttgttcctcacagatgggttcgcaggaagggtaacgattattctcaatttttgtaactcaaagtcctaagtctgaagaacgactctgtgcagtaacttgcgatgcgtggagcatctgtttaatcctccgctgatctttttgtgactgccgccatctgcatcaacaagcggcattctctacacgtttatctgcggtggacagaacttgatcatgttcgtgcccctgaataagatgagttacgcaacgaatgcagctggattcgttcgaaagcagcaaccagaaaagccgtggagcaagcaacagcatcacacatgttttactgacaaacgttgctgcaggacgccggcattactggagccaaacacagaaaaggtgctgcgttgcatcattttgtctgcgtcctacaagctcgtcacatgcaaaggggcgtttatttacggacgacagacgtgtattggatacagacaaagactacagaggtcgttcttttgccagcggcacatacattctgagaatgaagagttctgttctagcctccctctaccacttaccacggtcgtatatgaaatcccaccatttctagcgaaacgctaagcggagaagcagggtcccgtcgcgactggtttcctacgcttgcctcgctctgctcagtatgttggtgagattgaggaaagaagccaatacgcgcactgccttgtgctagcagctgcacagttatcgaagcactttctcggcactgagtcagtgacgcgaagtagaaactgctgcaacttcagagtgcgcggacaatttaggatagggtgcggccgtatataaaaagactgttctagtatctgcatcaagtatctacagaacctatttgcagctctatcgtgtcactgactcggtaaaagccttgaacgagttcgaaagctgtgacatacggtgggtgagttgctttgtcgttttgctgaagcgacacgcaaaacatgcaagtaaacctggctgctgcttccaggcggcggcggtgccggcaggataagtgaaaggtactggtggagacagcacaccgagcaagagcgagcattgctttacacctggtgatgaacagagtttttgggctgtttcagcacggctagttccacattttgtgtgccttccgcgcctggagtcaggtgagtgcgtcacgtgaaacctggtgtatgattgagaaaagctggcagtcgagggcagatccccagccaacgaaagagcagtttcgaaatccggaatcgaactaagccacagggtcttgcagaagtaggcgtgagttttgaataccctctctgatgttggtgaatcagtttgcatgcgtgcgcgttgtacaggacacgcttcagcttggggggtgtcgccataccccaagacaaatggtacgcatgcatctcaagagaacggcgctgcgatcgctggggatgctgtgaagtgtggagaacgcaacggttggaggaatgatgagtcttcccaaatgaatggtgcctcgttttctcttggcttaagtcaaccacaaagttcgccactacactctctcgcgctcgcaacggttcttgccagttgcagctccagctggaaaccagcctcgaaaccgttcgtcgtattaccgcgtcagagtaaaaacgtctcctacctaactaggctgaattatcttttgtgcatgtgtctgctcaagatcgccgcctcgtttccgccagagcagctccccgtgatgtaaccggattccgcagttaaactagaaccgtcttcaatcatcgagaaacttgatcacgatgccacgcgcctcgataaacggctaccaacacggacatctgcgtccgtgtgtgtgtacatttgtacgcccgtgcctataggacgccaacctgaatcttcttgcgccagcggcgcggtgtggttgttacaggggatttttcgccggttgttgagtgccatgcagggaggcaaaataaaaggctttagttgcataaaa

SEQ ID NO: 1267 - DNA, 2219 bp, Toxoplasma gondii
gacgttcgatggcacacatactgtctgtaactcttgttttggacacagaaaaccattattgtcagatttgttcgccagtttcactgtataggcgtgatataataccggtagcgcttcagactggagaatgttggtgcatatcgtctctgcgagcgtcgcagaattttgctttttcgcgtttgcaggcacgtagctcgagtgacacgctgacaggttcaggaggtactgctcttggaaaactccgccttgcagcaaagctgcctagtgtggacactgtgcatctgagcgcaaagtgcttcgaagctagaaactgaaatccactgagtacagtgcgcgagtatgctctggttttccagggcgttcgtctagaattgtttatcagttcacgaatgcttgcacataccaggtagccatgtgtatcaaaagatgatttaagcaggcctccaggcgagttagcgcggtggtttctcccggagtaccagaagccatgtgatcaacatagtttaatgggaaattaaacggaacctgcgatggaaaatacttgcatcaaggagccctgagtcaagcgtgcaccctcctgaaactcgacggtttcttttggggcagcaaattatgttggtctccaactctgtgtggcatgaaggagaacaacaatcattgctcttactgcgacgtctttatgtctgttccactgtcttccagttcactcgtgggtattcttgtcgctccatgcgctacccatggacagcataggtgtcagtccaaatgtggattcccaccaccaaagaggaaatcggcatccaaacacgttctagtgtctgtaattttaagaggcgggaacgcaggccagcgcggccaatcaaacacccttgacgcctcagttgaatgacacagactctgtttaatgaatacctacagtggcgtctgagtcgtcaccacaagatcaaagtgaaattgagacggggtcatcagacggtgctgcgttcagtgctgtatccagagaagtaatgttgggtgaggcatctgcacgattggccggctacgaatcccttgatattcacacagctgtagtgcagaaagaaaaaaagctagattctaccaaacattttactgaaatacacagaatgatactatttgcccttttttgccttacttccccagctcaatggacacccgacagtttcatagcgattgcataggcgcgaattcaaatgcaagactgattcttgatctttgtaagctcagtgtagctgccttgggaacaaccttgtatgcgcacaggaacaagatatgtacctatccatttgaacggcattctaagtcaatgctttcgtttatattgctgtaggccatcgctgtggtctttgaagcatcatcggatggagtacgtatgactgcgtaacagcacagtgacttcgctcattttcagccctgcgagatatcgcacgtgtacctctcagacagacgggacgggatgtcgcgtctcttcactacaaaggtcaccgacggtggcgactgttcgccttttgcttacgaatagacagctactttctttccataaaaacacaatttgtccattctcgtttccccacggttgccatatttacagaatgtgaaggcaagaacccgagtcagtgttgttttcaaggtttccttttcaagtagcggagtcacacagcgaagtggcttttcccgccgctgcttacccacctcgttcgcagttttttcggtttctcgttgcgagaggagaagggccggaaggcattttacgtcgtattctcggggcccgagtggaaaaagcgagacgagggacccttgttcgagtggaaggtggtgagagatcttctaccgtctcgaagcagcgaatggaacacgacatacacagctgttgacgagcggcgctcaaatgcgtagtggcggctatcgtaggccgcacatagttttgcgcccgtctttatccactgagagactttcccatgtttgtggtcaatggtttcatttggaaaaactatgtggtcccttgacatcagccagctaaaaaaaacaggtcagcagcaagtgtgcctcaacttcatggttcttgattttgcccatccgcatgagtgtgtggcccttcagtgctgattgcttggtccctctcgtcattttccagtacgttgcgtcagcagtcatatgttacgtttcgtcctgtgtcgattagcctctgcatctttttttca

SEQ ID NO: 1268 - DNA, 1307 bp, Toxoplasma gondii
tgctcctcaatccagacttcactacacaaatctacacttagatagatagccatccatacagaggtggaggctgcgccccacaaagatgcatatatatatatatatgtgcaaacgtgaggacgaaagaggagcgacttcgcctcctgtttgtctgatgcgtgagatgggagaagtcgttttcgtttttcatgtcttgcggtttttttgccgtccagcaaggaagacggacatgtggtttgttgtcttcctggccgtcgttctcattcgttgtctcctgtgcttttttctcctgtgttcgtttgctatctcattctgtccatttgcggtttcatgctctttcgcctggctttgctaaactgttcactttcttcctcgaccgctttctttctctctgttgcatcctgtctttctcgttcgccccttcagttccccgcggcgtcttcaccttccctttccctgcagtatcggatcagttggcgttgacgcgcaaaacgtcgcccagtctcgctctgttgcaagcgtccgaggaggcgcagacgaacggagaacctgcgagcgaaactccgcgagagagtttctttcagtcctcttctggggactctcccgaggcaggctctgctctaacaggttcgacctggcgcgtcggccgccagattccagtgcccttcctctgtggtgactcttcgagagaaagaagaggagcaggaaggcgcgcaagagctcaagggcaggaggactcacacaaagaggcgaagagcagctaaacgagagacatgcaggatcgagagtgaaagacaggagagaagcagagagaccgagagaggcagggagagctagcaaggtgaatacggctgaaagaggcagagatgaagatttggaagaagagcaacgagagatctgcaaacatccatgccaccgaaaaaaagttgagagcagagaagagagaaaggaccggcgaacgaaagctgagtgcgcccgcgggcatttttcgcgcttgccaggttgcatgcaaaacagaaactgcgcctgaagcgcatgcacgcggcgacatgaattgagttgattttcttctctttcgctcccttttcgcggaagaaaaacgttccagttcagtgaattgtctcttctttcctctcgcgccttcgggaggcgtcgcgttctctgcatctttctgccggtgaccttgttccgtctctcccgttgttgcgttctgctccgtcgcagttcgcagactcatcttctttccttttaggcggtctatgtctcttattttctcctccgcagttccttttcttcgaacgcttcta

SEQ ID NO: 1269 - DNA, 2208 bp, Toxoplasma gondii
tttgtagaaattccgtaggtttccgatacagccagcactgcacagccacacttcgcagccaccagtgacagtttcattgcagcacgcacagtgtactgtcctgtgggggcacgtcttcatgtggacctcaagctcgacggcctttatgtatgtctggcaaccgtcgtagacgcacgggactattctctgggtgcagtgggacgctaagtgctgcggaaactcgcctagtggaataacctcttcacatccatcattgctgcacaccattggagttccctccagaatacgaatgaacgatttgttggggtcagagaaaagccatgtatccacagctctgccgtcgtcgtctttcttcccgctggaaccgtatgtttgcttgttgcaaagagggcacgtctgaatgccagacttcataagattttcacagcacgacctgcaaaaatggtggtcgcagggggttgccagcgggttgtccaggagatcttggcacacggggcatattagatgttccaccgcccttggtccgtagttcgtgttcaaagcacattgatcgaccggaaaacggctaccagtgattttcgccatggcttcgtcggtactctgcaaaagtgtgaaagatgaacaaaacaagctacaccctcttcagagacttcatacagttctccagtaacgttgtggcaaaacaccaaccagagctccaattcaagtgacatgatctcgaacgacattaaacaactttccggagtgtacgtacacccatacttcaaacacggcgttactattgtgatgccaggaaactgaaggccgaaagaatcacgaatccccacatatgaataagaggttttgagcgctgacttttttgagttcatccatgctgacgcgcatgaccttccgtttttggtgttatcctggtcgagaccgctccacgttagtttcattccggtgaaccacatttgctaaatttcatatctgactctaatcagtccccgcctgtatctaatacttttatcaggttcaagcaataacgtacgctgctcgcaacttctctgtcgaatgtggaaaacggtagtgccgcgtcaatgaacctgtggtagtaccaggctacctcgacggctgcgccacccagtagcttcagcatttcgcaccttctttatgtcgatttccttccaggtggcgctgctgtcacaatttcctcctagtagagactctaatacacaaagtggcgatgaacgcgagtggttgccaagcgtttccccgaatgacacgacggcgaccaatctccacttatgaagagcaccaacagcccacacagttgacagttgtagacgctttctgtgatgaccaaattagttagccgcaagttctaccgcccaaaatctatcttgaggtgtctgagtgaggaagccccgaatattttgatgcaccgcgatgcgtccaaccacggcctgttgcaggcttccctaaaacgtgtgacatcattggacaccacaaccgtaaagaaaaagtgtcaatggccgtcgaactacagtgcatgtgtcaacaaactatgcgtcgcaatgacgcacggcggcacctctgctattttcgaagtctttcaaccgcagcatgctgtagtcactgcatgcgaggcatcaaaacggtcgcacacggtggtctgcacgcacggcagccatggtgccaccaaccatttacctgaatttctgttcttcaaacagtcccggtcttctctgcatttatttcaggcggttctaagggcatgaagagtctcggaagcgggggataggcggtttcacacggaaggtagcccgcctgcaggccccttgatggtagcgtgtgtccaccaagacatctttcgcatgtgtaaaaagatagcaagcatagggagattcgcaagggatggaaaagagccgcgaaattccattcttttgcactgtcctgagttagtcatgtagcattcggggcgcggtggtacgtcggtttcacgctggcgaggagctgactctgcatgcagctggttcagtccgtcggccgctgttacctggcccggatcgagtcttggtccctcgaacgaaattctcgtctgtacactttgccttcctcctgaagctgagactgtgcacgtgtgtgtttgttttttcggtactgtcttgctgatctgcgctgtccaggagtttctcccctgtggcttgcaaccgggctgtgtcaaga

SEQ ID NO: 1270 - DNA, 1926 bp, Toxoplasma gondii
ctgtttgcgcctttgttctccctcttcacatctgttttgcgttctccgttgagttctgcgtcggcggcttccgcttggtgccttcggcgactttgctgcatgcagtcgacgagcgagtccgactcatttgcgccgtggagaggcgcgatgtggtgaccacagcctctgcagacgagcgctgcggacgcgtcgagcctatcctcctcctccaggagcggcagcagatcgtcagcgacagtgacggaccggccgcagttcaggcatccgagagcaagcagccagtcgtacgagacgccctgcgagcaagcaacccccacgaggcttcgagcgtctgctggacggcgtctcggctgcgcgctttcatcctctctttcgctcgcctcgggggcacccgaaggtgagagggaggcgcggcggaagccagtgccttggtagataaacttagcaggtccagcgacggtttctgcgtcgtcgcctagacggtgcagcagagcaaagtactcgaccgagtcgtccagagactgcgcagactggtgcagcaaccgctgacacggagaagactccggaggcagcagagaggaaagcgcggagtccgcgccaagcggcacaaccagcgaggacgccgcctgcgcaagcagcagcgcgtccgacgaaagggagcgcgaagaagggcgaggaggaggcatggtgagagaacaagacgcagacggcgacagaggcgcaagtgaagaggcgagaagagagcacagcgaagaagagaagaagagagaaggaccgaactgctagaggaacgagggaagaggacgagcacccaagagaggaagtgaaagagcgcggagaaaattgtgggcgaggagagagaagagtcaagaggatccccgagaacagtttccccgttttcgctttgccagccgcagaggggggcggggggaaggatgagaagtttgcgcgccaggcaacgaaggaaaaatagtggaataaaacgaaaacggggaaacacacgaagaaggacgtgtgagtctctgcgctcgaaaatgtcagcgactcaacgcagatgcagcggcagacgctggaaaagaaatcgacgcctggaagaaggggatccgatgagaggagacaccggtcacggaagacgaaaaataagaagaacgagaaaacagtcacgatcggatggcgaagtttcaagactttgagagcgcttccgatttttttcgcgcaatgcatgcagagagagaacggggctgcttcgctcttctttgcggatcaaaggaacaagctgcggagtttctccttttctgtgtactttctttgtgaagcggatctcaattgagtcaaaagatgctgagagaaacaagggtgaattcactcctgtttctgtgcgttcctccagaatatctcgatgcatgcgacgagctctcgggagcgggagtcctgaaacagctgtctcgtctgtctctcagcaacgcagccgacgttatatacacagtgtgcctctctctcatgcacgagaaaggcgtcttttttttctttctttgtttgtttgctttcttcgttggtttctttctttgtctgtttgctttctttgctttctctctttgtcttctttcttcctgtcttctgctttcttgcttgcagctccctgtataccctcttgcctcacttctctcgagtgtgttttcgtctgcttttcgagtcttcccactgccccgggtgtctgtacacctcagcgcgttcggccttctccggaggctggaggtcgagacgctcgcgttccgagaaggagaggttttctctcgtcctccagtcagtcttcacaatgaggacgcagaagcgtttctcgttgagtcagtgctttcgcgtttctccccagtcgaacagaacgcctgaatctctcggggagcctctgccttctgcagaaatcggaga

SEQ ID NO: 1271 - DNA, 3409 bp, Toxoplasma gondii
gtcaccacttgtaaattaaccgtgcaggatcggtgggtgcgtagacaccggccgactgcgaagactcgtttgccagccatgcgaggacaggaacttcgcagtttgctgcaagtgagtaacagaaacgaagtgggtagtcacaaaaagttgaacggcgcctgccgtttttcataggcgacggcttgcggtgctggacaggtttgcagaaagactgtcaaaaagaagcggggaatcagatttgccagtccatagaggaaatccgcaaacgtggacggcaggtcgcgtgtccgttgcggtgtatatccaccacgagcttttgcatttttgcctcttggcaatgtggagggtcgaatgggtttcgtgtgaggacaaagtgcagagccgcgaaacgtgtccaacggtatcgccgctcgagtcccttgtactttacatacgatgcgagacgcgcaagcgaccggttcagtgcgtagatgatacaacacacagagaaggattcgttacgagatctgctttttttcggtatctgtgccgccgtagacatttcggggtggcagaatggaacgaagctgcgtgggtgcacggaatggtcggtaagaagtcctcgcctgtgcttgccacggggtgagtacgcggtggcagcaaggcgcttttgtgcggaacctttggccccttgctggaagattgaccgagaacggttcaacgaaataatatgaggcgggaaatgtcacgcaggcggggtaaaatgaaacgatgatgagtgcctttagacagaggcgttgcgcgtaagacacccagagaaaaatacgtaatgaagaaggcacgcagaatcgattttcgtgctgattgtccatcctcgccttcgaatccggggacggaatggcggatcgctggtgaaccgcgcaacgctttcggaagtgacaagatcccctggctgccgcaacttgtatcacagttggattaccgcatgtggtggtcagtagcactttctttcctgatttaagttgcgcgatggttagtctgctcgggcagtggtcgaagacatttatctgccctatttaggttttgttcttttggtgaatctcctaacgatgtggtttcatccaaacacacgcctgtcacatgcattcaattttttacacagctggaccatcgagtacggatgcattcaggacacaacgaagagacgacttcaccggagattcttttctcacgaggccaggcttcatacggcaaaaactctgccctttcttgggagtggtagccgtcttgccgctgttcgacgcatgcgcccaaatcatttgctctggtgccgtttggcagaaggaaaaccgatgaagagatctgcgtaaaaggagatcacgctggcatgtgagacttgcgtcaccgaatatcgtgccagatccgctctagcggatgacccttgcagacccatggggaattttggcacacatcaacacgacaggttttagggcttagttagagttcctatgaaacgacgttcaatcacttcagcggagaactgtttcaacaatccggcggccgtggtacgaaaacttcgccgcggtgatagtgtgtcacgtgcatcagcgtggaaaggtaggtaacatcgtcaaagtgcgaagacagagaaatacatttctcatttccttctttataccatcgctacaatgtatcgctgtctcagtggtttcgtaactgcagaggagttctgacaagcttcgtctttctttgcaactttgtcggggtggcaagtgcaaatgtaacctaaacaccccctggcccagtcttggatcgtttgccatgtgtcgcgccatgatcggaaccgcgttctacttgaaagaatacctcgtctgcagtcaaaacggtccactcaaagagaagcgcagcgtgtgtggcatctttttagaagtgctactcagaggtacgggagagccacgtataactgcaagacgttgtggcgttgtgaaagcgcaaatacatttagcgactagatttcgcagtaacggtccctttttgcttttccgaagcaacttatttccacatcagacatggacatattcggtgtcagttcagcaagagcgggggatcattttatcgccttttgctaaagtcgggtgcttccttggcttctttgtaaagatctcatgacgaagcagttgccccgtgtcttgccgttgccgagttaacgcacatagcttgcacgaatgcacttgttgcgctggctgaagtgcgatcgcttttttgacaggtagcgctggcttgaagtccgctgtcctgggcagcagcctcgaactatggcgatacaggatgcatcccgttactcaaacgtcaaaccgtggttgtatgcaaggtaagtggctgtcgtacatgcatctccgacacagtgattgaatcgtcgcgtccttctgactgaacttccaccgtgctgttgacatcatttttgtgaaacacactattatgtcctaaagggatatcgtgttcactgttatctgagaaaggaacgggtgagagtgacggtgtcaacggacgagacacacagaaagacagcgagacgcttccgagccccccccccgcccccacgctcacactgtgatctcaagttggcctttcacgctcaagctccaggggaggaaaaatgctcacccgagaaagacccgttttatcacaaaatcgacaaaatctgctacacataggccaccagttgggcttcctgtcgaacgaattgtggttggaacgcacgcgtgtgtcacacgtactccgacaagaaaccgtggtttagcggccgctttgccaactcatccaacaattgtgactcaccggcgaagaatcatttggctttcttgtgatcgtctccagtttcacttctcttcggcggtgtgaaagccgtttttcgcccctgtggcattcgtgctgtgccctgtgtgtcgtttcgccatcgcatgcaatcgcccgaagatcatttcgccagcacatctgcggagtttctcccggcggatgctttcttttctcccgccagtcgtgagacagacacacactcactgcgtcgtttgaaaactgcttgcatctttgcatccacttccacctctccaatgtgtcgtagtagaagctacacagcgagctcagttgacgaccaagagacagtctcgttgttccacgatccttcaggtgttaccacacctcatgcaacctgccagtgttcttgtccgcgtgaaccactcgtgccagtttcttcagttttcctcttttcccttgctgcctcagaattttccacgaaacacgccgtgcctttcgccctttccagttcgccgccgttctggtgagcctgcctgggcggtgtaaaccaaacagcgctgcttcgtttcttgtcgcaggccgcggaaggtcagccgcccccgtcccggtgtccaca

SEQ ID NO: 1272 - DNA, 1762 bp, Toxoplasma gondii
cagacacaaaaagattcaaagattgcaaccagcacagaatgtggaactccaccttacatatacatatacgcatatatatatatatatatatagagagagagagagagagaggtatacgagcgtagctgttgtgcctccgttcctacattgatgcttttggggtccaggatatcaaattgaggtccagttgccctgttgccgaggaagcgtgtctgtatggaaaggcaggagggggaggccgctgggtttctagtgaggatgctgcatcgtgagaaaggacctgcgcctgcgaacgagaaaggcgctcccgaagtgagagagacggcgctggggcaggcgagacggccagaaaggaatcgacgcgagacgagttgagcgcgggtggcggccggcggggaggccatcgccgcgagaccggaaaaagccatggcgccccgaaggttccagaaggtaaatgggggggggaaggcagaaaaggcgggaaagcgaacgaaggcgaagagaaaaagccgggtcgaaagtcagacaaaggcgatttcgcgcctctccgttcgcagctgcccaacgcaagcaccggaggcgcgcaggtctgagcagtacatacacccgggagacgccgcaagtgcgcgtggccgccaaatgtggaccgttgactccgtcagttcaacacttgtagatgcattccgagaggaagaacccagggtttttcccaggctgtctcttctggctaataggattcttcgccttcctacacgggcgtctttcgcggtggaacgcccagagttcgggcgaggatgtcggcgaacccccttcttgcaaacgtctgtctcacagactgcctccaggaatcggttttcccgggtaattgcactgtttcgctccgcgaaggacgcggatctgtcgagagatgccgaagtcactccagaaggccggacatactttccgggccgacggtgaactcccgcggttccgttgcccctcgcgtgtgacagccgcttctcgtgggtcgtcgtcagtttggccagaatgccgcttttcgagagaagatgccagtgagaacccgtttttcggtaaccatgactccagcctttctttcctaggtccgccatagtgagaatttctctcctgcacggattccggagcgtttcctccagcagcgtttttcgcaaagccgccaagttccccgtgaaaagactctgcccgcctgccccttgcagaaaatgccgccagacttcgccggcggcgcctgaaaagaagccgcgcacgttgtctctgagggactccgtttgagctcgttctttttgggcgaaagtctggaactttgtttgcggcgagaagccacgcgctcggcgtctcgaggcagcgaggcaccattttctgtcaaggtgtgtatgtacggcgccccgtctctttttttcccgctaggtttcagctactcttttccatagtcacggcggcgcagcttgcccggcatttaaaaaccaggaaacgcgtccctctgtcagtcttccgtcacggaatctctcggcttctcttctcgtcgactctcgacactctgtgtttggctgcctcctttcgcgtggcatcgcaaactctgcgctttctccgccgccaagttccccctccctttttccaacacccctggctagtccccacttcctgatctcgactcccctacgcgttccgccacgttctgctgttacctgcctccttcgcggtttccccggctggctcagacttgttcgtcctctgctcggcacga

SEQ ID NO: 1273 - DNA, 1764 bp, Toxoplasma gondii
gcgattctgaacgtgggcctctgcatttcaaaccaaaatgttttcacatgaacagaaacatatactcacacacatgtgtgcttgtgtgtgcatatggtcgacgctcctttgtcgtgtggtcctgatttcccgatcacttttgcatctttagcataactcgtccagacagggaaaattgttaatctcatgttgctgttttacggaaagaacaatgtcgctcttcgagtgtgcatgtccgatccaaagactaatgcgccctttgtgatccacgaagagacacgtgaacgattcgttggtccagcggcaactgctggaatacttgtacagcggtttttaacaaagataactgagagctcccaattcgaatagcaacgatgatgggaactagcaatagcggtgcttgtgtgtccttcccgttccaccagcaacggaacttccattctctccccctgacaaaatcacagtagctaccgtctcagtgacagaaagctctcttgcaggcagtgcgtgggagacacgatcggaagtcctacagtttcgaattttccacttcctcgattaccgccagtgaaacgagcttttgcgtatggcgcttgcccgtgagtggcaagcagcagactgacatccgactggcgacactccagcgcttgatgaattcccagcagcttattgctcgttccgacccgtggtcacgttctttgtttgcgaccttgccgctcaggggtcgttcctgttatacttacatgacgcatactttcgtgacggaaacccacgcgaaaggttcttgcgttgatagttatcgcttcagccttcagctgtagaaatagaaattacggaatactttgcaaaacagttccaatcctcatcctgtagaccgacacccgagtcctccctaggtggtccgctaccgggacacagtccggaaagcacagcagcgtcaggggtatgctcagacacttactgtaggttaaatcggcacattagtgtggactcgacaggaaaggagtccttacgcgttcttccggaacgaactgcccgaactgtcgtaacattcaacgcaacaccgctccagcggtgacgtcgttcagcagtttccctctaggggaatggacgttgaccggtcatctagggtagacgcagttccttaaacgcaccactttgatatgaacgtgattctttcccttcgaattagttgctcgaggatatcaggtgggcaaggccaagtggagtgactttttccagagtcacgccatccgtggaggacatgtgtgcactattcaaatgaggctgaggacagatctccagcgggcatcgcggtcggtgcccattggctagctttcagtcagctcaggggaacgggtcgcgttctggtttgctgctatcgctaggagggacgtctggtgaaatccacatgtcacaacccgcggtaacagtggccaaggagaatgccgaatgccaaacgagatctccgtgtttcacgcaaacacccttacaatctcccgtctcgtgggttgtacaagccttgctcgagctaccggttctattccatcgaaaccttgtataatttctgtcagggttccaaatgcttaccttattgctggaacctttgcagctttttttcttcctgtgtgcaagcttgtaaggcttgcagtttaaccctcgtggcatttgctcctctttcgcgtgcgttcgctgtttgctgtcacgtaacggcgcgtcgcacgactgcgttctcacgctcgccgtctggttgagtttctccca

SEQ ID NO: 1274 - DNA, 2072 bp, Toxoplasma gondii
acaaacacgagacagagtgaaaaagcgatacgctttctgaagggtggaaaaacgagaactgacaaggttgggcgccaggtctcacccgtagctgcaggggactgcgaatgctggagatttccccgcaagacacggcgtatttatttagtgtgtaggaacgccttctactgaccgacaaagcagcggggaatcagagcagcttgcgtttttcctctggggtacacgacaactaggtgtgtcactcccgacatgcgtttttcactttgtttctgcaaggccggtttccgattgcaagttccactctcagccttgaaaagaacacaaagctttcgttggatttccaaactagactggagacttgctcccgtgtgcagtcttcttctgccaagaaggcgctaaaaaggcctagagaggtccggccatcttgcgagttgtcactgtgtaaacggcaactccgaggcctctgtagcgacaggctcgccagacaggaggcacctcagccagaatggacactggaggtcgtagatgtcaagcagctccgggggctttctggaaaaaaaaccaacgaaactgagatacgcactcgagagcgttggaagctctcctcggtagccgaccaagcgcggcatttccacagcctcgccgtggaagttcgacaaaagcgcagagggaagctgaaacgcaggacaagattactaccgcgcctctttttcgtggaagatcctggggaaagccgacgaatgactctgctcgtgtgttctcactcctcgctcgatggggctggaaacagtacatcgagcagtgagagaaaaagagatcacgaaaaacttgcttccaccaaacgctccggccagtggtgcactctgtattctgaaatggctgtagaattcgaaatggaagttcgctgagctcatgcggaccatcggcgacttgctttctctcaacgctggatgtactcatatatatcctgcaacttgcagacagccgtaagccacacgaggcgccttatggatctttttcgtatccactcggcaaagacgcggaaaggagtaacccaaagaaaaactggaaaacgcggctttgctcctcattctccgcttacttccccaatgtctcgggatccgcagaaaaacgcttctgaactcgagaggttcgtactcaccccaggtaagagtgctcaaattccttttaagaaagcaagaacagggaccgtccgcatcccagaggtgtcaaaagagtccgttttcactgtgcgaaaaaaactgttctggaccgccagccccagcctgtcttcttggccgccagcaggggcctctcgagtttggtcaagacttctcgattcctgttttctgatttctctgcaaagtctgtttctcaggccttgcccctctttcgaagcgaagcatggagttcgttgagcgcgaaacgcagcgacgaaaatagatcttgctttgtgtctctactcctaacgccgacgctgcctggcggcgttttttttttgccgggtctctctggagtctctcgggggtgtctctctgttgttgaggctatgcatgcagacgacgcggcgaaaacaggttggaaacaagagggcagatggaatgaatgtgcgcgagagaggagttcaaagccgagaaactcccatgttttccttcgccgttttccccgttttctgcagcttttttttccaacctttctgggcgccgtccacagctgcgctcgctcttccggctgtcgatgcatgcgatgtgtgtcgggagccaatcgatttttctttgaggcgaggagaaaggacagagatgaaagaggaacgccagaatctctgtaaaacttgttttttcacctgtggagaccgggggtccccggtgttcggacgcctcgacaagcacctggaaagaaacaaggctgcagcgtttttgagtcgcgagaaactagcgaggagagaagaagaaacctgcgtcctcgggtatctggctttgtgaaaactgtcgcgaatggaacttctccttttctcggcctctcactggactcgacgccttctcttctccgctgctctttccccctgttcgtga

SEQ ID NO: 1275 - DNA, 2370 bp, Toxoplasma gondii
aagagcacacaataaaaggaggaacggcggactgcttcccttcaaaggcgaggcgctgcccgtccaccatcttggagacaccgcagcctgcgcgtttcgcgcagaggagaaacgccaaggtgttcgacgtggaagaactccagagaggagaggagcagagagagctgcgcgagggagagaactcgagagtccaaactcccagggcgcgcgtacgggcgcgaaggagatatagacagaaagcacgtcctcaagagaggagaagcgcgagcggaggcaacaacgtgagcacaagctctcagaggcgatcaagacaaacgactcgaggaccagtgaacgaaggcagtttctttcgatgacaacagagacaggtcaccgcaagcagacgcgccttcgaggcttgtcagcagttgtagacaaaagaaataacaacgacggactgggtgttcacgggactctgtggcattcgcgcgctgggccatctctctccgtccattcgcttggctccctaacaagccataggcctcttgtctacggagcagatgagctcgatgcatgcagttcattgtccagagaagacaggaagcagacgcagaggaggaaacaaaggagttccgcactcgctgtcgcacttcgctgctcctcaagaagttgctcttactcttctcgagctcaagattactcgttttcctccttcctctgaattcagaaagcagtcctcaggttagacacgacccactttacgcccagcaattttgggaaaaccgggagaagcagaacgatgaggacagcagacacgagagcgcgaggacaagacacagctgtcgcgtctgcggcctatctctggctgttcctaccttcttccgagaaagaaccgagaaacggcagccgaggactcccgaggaagcccagaaacagagggcgacggagaagaagctgcatcttccgtgcgagacgcggcttggcccttggttcgtttgtcgaagtgagaagagaaaagctggcaggaaacaggtgaggcaccttctctgtgtccggccactttacgcgaggaatgccgacagtgaaattctccgctgggatgatgaaacagcgctgcctttgcgcaagccagacaaaagtccccgagtgagaacggggcagaagcagcctctttcgtgtcctgtcgaaggtgtccgtttgtgccagaaaaaagtaagtgagggactaaaaactcggagagatcatcgtcgctttctggacatcccatctcttccgcacttccgttccgtagatgcccaccgtgcgtgaaagtcgcacacgaagaagcagtctctcgtcccgtctcccgtcctgaaatccgcagagctacatgtctgccccatcccgggatcctctttcactttgtgcactgcttactgtcttgtacatgttcagagttttgtctttgtcagcgaacgctgtccgtttcgcctctatgtcgtcgtccgtcgttcactgcttcggagggtgccaagtctagctgctggtgtgccacaaaaaagcaatttgttgactgttttgtagctttgacgaactgaaacatcgaaaaaacatttcaagcattgcacttcttcgaatgtgattgccgcgacctgtcaaattcccgttttcacgccggtttcgtgcgttgagcccgcaagaggcgagtcttggtttcccgcatattttcgctacactgtagagagggttctgccagcgtcagaatggcggtgaacgatgaggattttggaagagatgcgaggagcccagtcatgccttttcttttccctcgacttccttatgtttcgccttgtctttcagcagaatctccccgtgcttccgcctcatctagattcctgtggcggagcggaggaagtgtcaccagtttgcacagcgtggagcccttgaatccaagtgtatgtccacctggaattcgttcccctccaaacgccgaagggggtctttacgcgttttctaccgtttcaactctattttctaggccttctttctctcttttccgtccacctgtcttgcccctgtttcccccgtcctctggtctcgcgctctgctcgtctgaaccggcaaacatccttccgaaagagagtgtttctgcctgtccgcgagcgaatcctggcacctgcccagttgcgagtcccgccgccacctcgggtcaggggtgtcctttcggtcacggaaaatcaggacaccctgtgtcagatctcctcccttctagcccctcctttctttccttcgaagcttcctctgataccgccaatgtgcctccttcggcgtccagcgccggatgttcgatcaaacatggatctgctgcttccttttccgacagttccgcggagctgccggacgaatgtccca

SEQ ID NO: 1276 - DNA, 3550 bp, Toxoplasma gondii
actcgacgctggaagacgacatgcgaggaacgactcgcaagagtttcgtcagcgcgctggagcaccggctctgccgcctcctcgacagaggccagcggaactgtctccagtgtccttgtttgcagcagagacgccgagaaagaagaaggcggagacggctgttctccgacgcctcctgcggtccgaagcgcttccccgttctccctctgccggccgacacgaaggctagagccatggggagttgccgccacacacaggaactgtgcagcctctcgagaggccgacgcagacgacgtggtgagaccgaaggtgcctctgagaggcggtgacatgtctccccccttcaagctcgcagagccagacggaacagaggccgctccccctgcgtcccgaacgggcgtcttcgcgacggcgcctctctcgtctgcatgaagagcggcgggagaagaaccgcactccgtcgccatcgttgccgactcactactcactgccaggctcacaggcgaaggcgagcccctgtggagataagacactggcgacagttttctcgctccgtcagagacgcccgacagacgcggcgcagtcaggactccctgcgacataggagtagacgtagacgacgaagaggaagaacaggaagaagaagaagagggagaagaggagaacaaagctggagaaccgtatacgaaggtgcttggaacgatgccaacagcatatgttggcgggtcgctcggggtgttgacaatcgccatggttgattctcgaaagaaacgcagattgacggacgacggacgagataagcgagaggagtgtgaggcttctatcccacgacacagagaggttgggacgtagaaatcgaattgcggacgagttgaggagagagaggcaaagcggggagacgaagcgcggagctgcgtgggctcgcgaagcaccagaatggagcaaatcagaaaattaagagatgcagagaggatagagaacggagaaggcgacagaggcgattgtcgacacagagatacacgcgagaggaacgtgagtgggttcgacagaaccgtctaaccggtgaggccgcaagtttccaccactgacactgtctcctggatttcttccgaaagacggactggagcaaatccaacagagggggcagtcatcatcgagtgaggagacggcgaggcaagaacgcccgcgacgtgctcgaagcgctcgaaatcgcctcgtgaagtggaggagcgccgaagaaatccagcgttccctctgggaacagccgcctcgatacgaaaccctcagtggttgctttgtctgtgtggttgctaccgaggtgcgccgctgaacggggaaaaagagaagcctgacaagcttggaaggccgcgctctacaagacgagcgctgtgcacttggtcttcggtgcctccttacgccgattagagctggctgtggatgaattgcgagagaagagctgcgaacccaaccggaatcggaggcacttctcctcggtcgcaaacagccacaggtctggcatgaacaagaaccttgtcgcggactgcttatcaggcgagctcgttcctgcgattcggcgtgcaagtcatcgccttccccggttatcccaagtgaagctcggtaaagaaatacaggtgttttcgccgaggaaaagcccaaaaaactgcgagcaaaaagccgggtcactttgacagggacgcgcgccgagagcactggctaagctgcgaaaagcggacagggcacccggcatttgaggccgggagaacttcctctcgcgcgcaactgattaaaacaaacgaaattggcttcgcatttgcctcaagttcgttttctccatcgctctttttatacgagaagatgccagatcgacactcgcatggcaagggccgcgcaccggcccttgctgacggctgtttgcaaggtgtgtgcccgcggaaacgggagtgtgccggcttttgcgctttcgttggctctccggttctgtgttccgtgactgctccttctaatttatctcacacacaggaaacgaaagccttccagaaatttccttctcaccagttgagggagttgggcgaacgagcctcacaggggagagggctctgcgtttctgcggcggcacccttgacctctttgaggcaacgggaccgcgagggagaactcggcttatattcgggggtcgcccgttcaaaagagcaggataccacaaatcgacgggaaaacagacaaaaacaccacacaaccacaagccggaattcatgacgatagatcgtagccctgaagtgtctgattatagttccgtttgggagaaaaagcagaaatacccagcgtcgacgccgccatcgcgtctctcgacagaaggacactgagagaagacgcgccacaacctcagaaaaggcggaagttctggggctcaaggagagtcctggctagaaggtcacgcggcacatgaactgcgaactcgcgaatcttgagaggtagggcaggaaaagcccagacgagaaaaagagccgacgggaaagccaaggcaaaagcaatcatgtcttcgtgcatatttctctactgctctcgaagctcagtgaaacgctgtgtgccctcccgtcgcttgctgctcctccttcgagaaagaacccttcgctcgttagagggcacagagcaaacgacagaaacgcgcgaaaatgaacaaggcagaagaaaaggtgcccctttgtttaattcgctaccgttcaagaggactcctcgagaaccgcgacagagagcatcgaggaagtcgagcaaagtctccagacatcgacaatgcgtgggtgtgtggctgggaagtggagagagcgagacccagactcgacctcgaggaccgcgtctgctgtctgcccctcttgctttttctttcttttctttttttctcatggagttctccagacgacccgcagaaggcgccgaaaacagtctgcggcggtgtaacggccgtcagcctgaattgtttttacgcttctacctttggtcgcgtggcgtgcacacgaggaagcggtcgcttcaattgcggatctgtctgactagcgggatttttagagaaaatgccactacctgaatctcacgaagaaacgaaaaacaaaggcgtttcccgctgcagcgagggctgttccggtgtgcgtctgagcgagcgtggagagttgagacgagagagacgtcttgggtctcttttttttcagtttcattttagacataaaaaagcctacaatgttgcccccggcttccattaaatgcttctccccgacgccacgctccgcgtttccccgctgtcttctcacccggcaggttctccccgagacagcttacgccgatgttgtctgaaactcgattctcttgtgttcggtcccgatccctcctttctggagattgttttttctgcctttcggcgacctcgatatcgcccgcttctccctctgctctagtagctgtccagcacagacctgccgtcgagacgccattctcgctctttcgtcgttaagtctcttccgcagctctgtctcactcgtctgcttggcgccagccacta

SEQ ID NO: 1277 - DNA, 1440 bp, Toxoplasma gondii
gaggagacgagtccgaatcagagcggccaagttgaacaggaaggagagaagagaagacgaacgagaaggtcatcccaacgaaataaacgaaggaggtgatttggaaatgagcaggacggggcagttctccgacatggcaaaaaacaaggaggaagatagcgaaaggagcagagcatccaatcgaaaaatcgatgagccggggacaagagaaacagcgagttcttgtgcgagagcccagacagagagagggaatctcagctggtggacgtcgtcggtctgctcgaagagaagcagaactcagagaagggcaaacaccgcagagagaatcttcatgcgctcacctttcagcttcttcctctcatggtaagaataaaaggcggcgctggtggcgttcttgctgtgtcgggccggcatggttgaaacgggaagtcgagggaagttggaagaactaaaaaaaacgtcaagaaatcagacggattctcttgaaaagcaaaagcggggtcgagcgcctgcgtgaaacatgcaaagtgcctgagttcgagaagaagaaaagagtctctgcggagggaagaagaaaagaagcaaagaaaaaaagagaaccgaagcgaagcaggaaaaggacgaaatacgaagatgaggggcggacaccggacaaagcctcgaggtgatgagagcggcgaaagaaaactggaaaaagggaggagcgagctgcgagagaagaaagcgaagaagagaaaacatagaaaaaacggaagaggaattacgaaaaagaaacagaaggcgacggcacttgcaaggaggaaggacgaggatgaaacacccactgaggagacaaaagggagagaggcgcgtattttctttttcgcggccttctgttgcggctttgctgcgcatgaacaaaaaaagacagagctgcagaaggtggaggaccgagggagccagagaaaccgacttgcctgtcaggcttttaaaaatcggccaaagaacttgactgtaagttcagtctcgcttccatcgctgcgagcatgcgacgagtcggcaaagactgtgcatgcaaggcagcaagcgacgacgacgcacaaggtcaccccagcagcagctgagcctcgatggaggaacttcttgtgtttgaaaagtctccggaaagtcttcttttctttcagccaaacaggttcttctccactccagaaaggaccgaggtgaagcgggacatacagcgacggcgactggctcgggtgctctctgtctgctgcgttcgcttgagtcttccacggaagtcaactggtctttcttcgtctcactctcgtccgcatttgtcgtctccttcggtctcgattgcttcaccctccttcgtccgccgtcttctgcctcccgcgttctccctccgtcaccttcatccctcctctctcctctcccgcgttctccatccttctctcctca

SEQ ID NO: 1278 - DNA, 3766 bp, Toxoplasma gondii
gcaaagaaaagccttcatcggtcgcacgtggaggtcctttagtgttcgagcagggcaggccttcgtttcagagtgaggaacacagcttttgtggcagtcagggggcaagccttagagatgacaagtgttttcgagtatgtccttctaccacctacgaatgtaggcaacggaatgtgtagtttagagaggggcaagatcttaccgtagcggccctctgcatccgagtgaaaagacaatagtttcagtgaaagcaggtttgttctagcgtgtcgtaccaccagaaaaaactgcaggtagtggacataggatgtgttaaactgtccccaaagcttatcctggtggttctctacattcgaggggtaacgctatagttttactgacggaacggctatcccaatgtgtcatgctaccagcaaatgtaggtaatggagtccgggtgtgttggagaaaacaccaaaacctaccctagcggctctctgaatccggaagaaaacacgataattccaattctgcaaaagcttttctcatgcgtccttgcatcacccgcaactggaggtaattgagtcagttggaggtgatgaagaaacgccaaagcctatcctggcgggtcactaaagcagatcgagaacacgataattttatagtgacggaaggcccttcctggtctgtacttggatcacctgcaaatgcagatcatgggatataagcgtatcgctacgcaaacggcaaaagctatcctagaggttttctgtgtccacaagaaaacacaatagtttcagtgatagaagacattcctattgtacacttggaccacatgcaaacgtaggggacggagtcactgcgtgctagagagacgccaaggcccatcgtaaaggttctctgcattcaaatgagaacacgatagtttcactggggggaagtctcttctaactatccctgtaccactcatcaatgcaggtaatgaagtccaaatgtggcgggagaaacactcaagtctattcaagcagttctctgtaaccgaatgaaaacaagatagtttcagggaatggaagtcttttgtaatatgtcactgctacaccctacgtagcaattttcccactggttgaaacacttgcagtgaactttgacaaactttatctgttgggaataccttctgaacagccaggaaggaacaaaaataagacattggtgaatggaggagtgtatattcgaggttacccccatactcgtttatttatctatacatagtgttattaaagctccttgacgtcagagctatccaagagtctcgttggcaacacgaccttcaaacacccgctaaagtgttaccgaatcctccgtacagagacagaatctactgtcaatgtgataccacacagttgtcgattcaacgttagaagtaccgtatacggcactaccacacgtgagtgagtatgacagctaacggtgtaatatcaagcagaactgtagcttatcgagactaaattcgggctcgcgagggtcatccagtaactagccaccttctgtagctttagttgttaccttatttattttccgtgttcgtttgaaccttttctcccggcaacaaaaaacgtgttgtcacaaagtagaactggcaatactatcagtacctaatatatacgagactgttggctgtttgaccatgtgcaatgcatccagcacctggcgttccttcgtcatgcgaaaagcgtgttgcacaaaactttgaaacggtggttcgggtatcctgtatttgcttccactcgcattcccagttcattttgccatgcatccctggtagtgttaggcacctaccagtggaatcaagcaaatggtggcaacccggaaataatcacccagagtgtaccccgactgcacaagcaataatatctccagaagcaaagcacgtttcatctcagagtgtgccggatctgctgttcccgctctacaggcgttttacaggactctcgcctccgcgacacagagccagaaaccgatacaatttattcaagtatgctgcactcatgtgttgcccccatgtggcgcttatattgtcttaattccaaaggcagacggctgcagatcgttccatctctcaaacggcgtctgttgccttctagtgctcgagctagcaagaatcagcgtttgcccctgtggttaatttcatgtgtcaaaacgttgtagaggcgtttcgcccgtctgcagctctacggtggggacgaaggggggttaacacacagtagttggtgctttctgtccgacttataattcggttacctggctaccagcctcactgtcacagagcatgaacaacttcgggtttttctcttgtactcatagaatcggcactaacgaaaagaggctgcccgtactctcagtgcaacaatagccgtccgggaaatctgcgcattcggaatagcggtggccacgaaggactgctaccgtacactccatgctgcgtgagaggtctggtgagtttctctcgccaagacacggagcccttccgtgcccgtgcacactcgtgtgtccgacagatagccaaatcagaaacatgtttgtcgtaggcgaacgagcatggcgacagagagcatactcatcctgactatctagactgtatagcttcttgggagggtgtgctcggcgggtgcatgggtaatctctgctcattggtcgcgtccacggtaggcacctggtatgacctcagcaccgcgggcaaaagaagccatctgacctttctaaagacaaaggtatctacgagctcgcacttggcgaatttcagtgaactgtagcccagaaaattttataaatataacctttgaggtgtgagcgtacagggaaaagacagccgtcatccagagaacgacgactcgtttaggagccgctaaaagacttgtttttggaagcgctgaagtactcccagaggactggaaggcactcgcacagcgacttgcgcacacaacaaggactgccctttagaacaaagggcattgagcagaagaatctgttgctgttcaggagcatttcaaggcttcaaagacagagagacgaaatctgtctttaggtaaatccattcgcttcccaaatttgcgtctctacctcaataattgctctactcgggggagatggcgcctaccaacgagagtgtgtaagtcagctagcacgccgactcttcctttacaagtcctcgcgaagatgcttttctttaacaacctcttattttcctttccatccgggagtgaccgtctctgcagctctttaacagaagaaggggttacgtcaattgtcaaacaactttccgcccctgtacttctttcaagctctacccacctcgcgacccccctgtctgactcatcttaagaggcaaatacgaggacgtccgccatctcagtctgaacagtttctaattcccgggaatccgcttttcaccgtcgttttcgcgttcgcttcgccatctcccttccaagctggtacgggccattctgtgcaaccccggcgtcgacacctctccatcgaacgggaccatgaggtcaagcgtctttcaacatcgccgagcgctgcaatgatgcctcgcctgaggcggaatggaattcgaggaacagaagacgcgcacacataccagaccaacagcagacatggactactggtgtagcgtaaatcaaacaagatccttcgagttagacaagagacctgtctgatgctccgcatggagagacgcactctaccgtcgctgaagcaagaactggcggcagcgggggcggtgtcacaa

SEQ ID NO: 1279 - DNA, 3132 bp, Toxoplasma gondii
taattggcctcctcgtatcacgctttcaaatgtgcacctgttcgtttctctcaacattttgaggacctctcggaggggacagggtgcccggaatttaggtaacaggtgacattgcagcaagttagttacgctttcacgaaaagctcaagtacgcatcttgctacgtttttgagggatttgtcagatgcgcgtggaactgcccctgtgtcaaatcaccataatagcgtccgaaaaatgacgttcacaaggcactgtgatagaaacgcttgtcataacggttccagggggagggacagtcgacagcaccaccatgcccagaacgaccagcgggtgcacacgcgcctttttgtctccgatgtatgtggagtattttgaaaagggtagggatagggttgggagatagcgttttcgtgcaagtatcgaagtgcgtacctcccctgtggcaatgggattcttgaactgtgcgtgcaaacaatgtgccgaccaacaacgacgaggaataataatttgtgcagttgctttggagacacactgttgcgggcatcaggcgttgagtgtagttgcggaacgtcgtttctaaccgatcgtcgaacgaaagagagctacccctctgcacacaccgtactttcatcatgtcactcctgtcgcctagtgtttgtagccagatagtaatgattttcagattgtcatacgacacggatgttcggtgatttttgtccgaggactagactggcgtagtctatttcttctatatcagcgtcgcattcttcacctgtactgtctagtgcggcagcaaagaaagcagttcttcaccaggctagtcacagcgatctgcgcagatgttcacccattgatgtcttcataagctcgtgtgatagatgacaccactcgcacgtcgtctccgcctgtggatgtcccaaaggcagagtagaatttctttatgtcaccggagtgcatctcgctgcgactggggcgatccgtgaatattggcggtaccacggatggttcaggatactcgatgctgcgttggatttcgttgatgcatatactcaattggctgtctggtctgcatgcttttgctgatccaggatcagtgagcaacgtggcatgttttgatcgcctgaattcgcggcaccgcctgatgggtagtgtgtcctttctcccgcaagacgagggtaccgacgcgacacgtgagctttcggtgaaattgctttttacactgttccccagaagggctctggctgtcagtttcatcaaagcggctgaatctagccagtgtctcataaggcaggggtttcatcgtccgtgtgtccgttgtttacgagcgttttgatagttagcaagttgaagacgtttagatctccttgatccttatacagtagccagttcacagcgcagaaaaaaaggggtatctgtagctctctagttccatgcttaccagtaaactgtatagaacttcgtgtaaatgcgaagttatactatgtaagatcttctcggaaccatttacattcttttacctacatttcgtcaaagcactgtggataataacccacgtgacctctgcacaagaaacatcataaatgcagagctgcacgagaagaaatacggctaactcttacaacacatccattgaaattttaggcggaaacagaaacaggataagagaatagataagatgcgtcagccgggactcgaacccgggtcgcaaccttgggagggttgcatcctacccctggactactgacgcgtcgaagggtcatggggctagacaaggtgactgtgggagtgcaactgcctacaaaatcgtattttttgactgtcagcatgagctggtttgctgcactgcattacccgatcttcaattgactcatacatacgcattctattcgtgcgttttcatgcccactattttaccagcttccacgaggagtaggtgtgcagttcctgccgatgttctgttggaatgtagcgctgcggtgggtaccgctggcggttgctatttccatgtgtcgtataggtagaagctgatgcttcatttcttttcacaggttgtcagccacgttgacagcatcgagaatccttgccacagaaggactaccttctctccggattctgctgtccttttatggactttctggaaccggagctccccggagatatgtaatgttgccaagttgtcctccggaaggaaatgcagaacaaaatccaggttatttcgtctgctcttttcctgtgttcgttgtttatcactcatagattctttgatatcacgtcatagatgcatgcacatggcggttggagccgtcggcgtagtgtacagcggggaagcacacgccgtataccgcttttctgatccgatgtcatgcatgtcccgacagctctgttaatgcttgagaggagtggaccacgaatatttcctttcttgttactgaagaaacgacgctataactgctttctcgtgtctcgtcaggagccgaacactgccgccctccacacacactacaacacacagctttttcgtccgttctgggggttgaatagtgattttcaggcgggcggccgtgtgcgacccggattttcttcccgcgcttttcgcgctttccttagtgtgtcgttttccagtattgtcaaggtgtagacgccccctgtgtagccgtccgtcatgtgcgtgccgcagtcaaacacgtgaccctttgtcgccagtttcccggtgacaagacacgaaaattctccaggtcccggggacagggaacgctggtaagcatcttccagctacaagtgactcttgtctctggaaaaaacgcggctatccttttcccttcaactatttgccgccattttgccaactagagaaatgccgcacacagtggacagcagctgccactgcgctctccactgatgcaagcaccgggtccctaggggactaggaaacactgtcacggggagaaagccatgtagaactgctgtcggtgcctgtttgtggggagaaaacctctgtttcttcgacctcttcgacaacagcagtattggttctgggtcgtcagtatgtgtcaccgagtgaactgaacggagtcggtcgattcctttgtgcgccacttccgcgtctctcttctctttctcattgcttgacaa

SEQ ID NO: 1280 - DNA, 3750 bp, Toxoplasma gondii
cagtcttcaggccgatttgccctttgcttgaaaggaaaaacccagtcgcgcctcaaagcggacctcttctcttctgtgaagcagagggggcgctgaagctgctccgccgcctcgaaatcacagccccttgagcagacggaaaggtcgtgtacttgacttcacgtccgtcatggaaggcacaggagatcttgaatcccacagttgaggctttcgagatctacccctggagttcaactcagagcgcacatagtccccataagaaaatgtttctctcttccctctgtccgcctctgctttcgacttggaccggggaagccacagacacttctgatctatcccagaagcccccgatggggttacgctgttcgcaaacacgagaaatcgttgaccaattcaccaagactttcgtggtccacccccccccccccccggagcccccactggcctgtggccgtccacgcgaccttcaaccgtatttgttcatcaactcggcacggtactgtggatcgaagaacatgcgggagctgacttgcgcgacatagagagcaagatgtcgtggcgtctgccggagacgcaggtccgccgctttccccgcagcgacagcaagagcgccgcttgctgctcgggcgacgaacgcctcagcctcttccaacagcgaggcccgttttgactcggaaaacgccggctttgtcgtgaagcatccacgcgtccagacgcaccagaatggacacgcgtctccgtcaccctgatcgccgcagctgaaactgctctcagacagaggaggtttggggtgagcctcctgggttttgctctcctccctcggcgccacaagtggacgccggacatcgctgtcgagaaaccccaactctggattctgttgaaaatctggacgtcgctgcggagctccgctcttcgctgcctgctgaaacgccagcgaaggagccacgccagccgcggactcgtcgggaccggaggtgtccgaacaccccagaccacgggtggatgcttcgcccgcgggttgagaagagcagacgccgcctggcccgccagtctccggaaaggttctcccccgcgaattctccagatcgcgagatggacccactgcatcgactttggcttgcacgtctgccaactgagaaggatccagcgagtctgagggactcgctgcgccggcgacactctgcttcactccccgatctggcgagcatgctgatgttgtgaaatcaggtttttctccgtctctggggtttagacctgcactagccgaggaggcactcgacgctgctgcgaatgccaagtcctcctcataaagctgacaggcaaggctagcgtctccccagtctctctgctctgacaaacaccacgttccaccgacctgtggctgttcagactgcgtttttgaccttctgtcgcgtctctcgagccttccctccggcccaactgcatgcgcctcgtcttggctgaaaaaaagagaggactcgccttcgcgtggaagcaagtgacgcaagagaaaactcgaaaccgacggatcagaggtgttggcttctctgcgagacgacaacgaactccactctggaagagaagcgcctgaagatggaaatcctctccccaactctcctgaggaaacagccccccgaaggtgcagggcatcatctctcgtctccgcgaggaactccgaatataggccgaaagagaccaacatttttatcgtggatggccttcgacgacgaggcagagaccggagagatttgagcgaatcagaaaaacacagaaaaaggaaaacttcaaagtgaagacacgccacggcatacccgtgcttacatctccctcgtgacggacatgcatggacatgcttgtacatttccattacaccagtccacacttcgaccgagagagctttcagattcgccgttggacccgactccgggagtttcagtcttttcggagaaggacggcgggcggcaggctttataggcaattgagagagagaaagaaaggaaaagaaatcgcgcaagagcagtgaacacggagatacctcagagcacaaaacacagtccttgaagaactggcgtctcccgtgggtggtgtggtgcaggaattagcaaactgagacaggcaatgtggctacaagtaaagaaaggaagccgtagggaaaacggtcggaaaagactttctgaaagaagccccagaatctctcagcttcgatcgaatttcagaaaaaacgccctctctgcttgcgcgccatggcctttcaccaccgtcaaacgtttcggaccccctcaaagagccctgtgactgatccgttcgttttcttctctgtggaatgctgggggaaaagatctttcggcgacaagagaaccagtggaaagtcatgcacatctggacaaaagaaggagggccatcaactcaagaaggacaggagacaacacacacacatactgccacataaaccactgctcaaacaagatatatatatatatatatatacatacatacataaatgtaaatggatacttgtataggcaataaagctgttatccttgaggagagtcttggcagaggagacgaggagccgtgactctttgtgtgatttgaaaggtgtgaaagccgtttttcacgtgagtgaaaactgtctgaaaacaaaggcgagacgtcgatgtccacgtgcggagttgggtggactcctgggttgtgttgtgtgatctttgtgagaccaggtgagcatttcggcggtagaaaagagaagaaaagagacgaagaagcgttttgcgtcccttgctgcctccacatagagttagaaaaacacagtttcttccttctgttcacgcccgcttgcgcccaaatcttcgtggcgttctctgtctcgcgtcgcacccgccagtcagaaactctcggagaaaaactccattccacacgaaaaacgtgaaagaaacatcacaagtctgagtcttctcaagggactggaaaggagggaagcgcggcggagttgcagaggcgaacaatccagagatgccaccgaaggacgcgagacagcaaataggcttttcgccccgcgcagacagcgacatgcagaagcgagcgcgtgtagatacactcgaaaaaaactgcatgcgtttctgtcttgcgttcttccggcgtcgcgacctcatgtgtttgtgtgtgtgtgtgtgtctttctttctctgtgtctgcacttttccatcggatttttgcggcctctcagtctgactcgcctagtcgcgtgctgtgcatccgacctctgcacggagggggagaggacttcttttgcggtctgaaggcgctcttctccggatgggaagtttcgtttttgacttacctctgtctccgtcgagaacagcgcttcgcttctgccacaattttctcgctggaaactgccttctgctctgtcaaaagaggcctacacaccccccacggttgcagagatatcaaacgcggctgtatagagaagctctcgtttggcgcattggcctctcctttctctctgctttgacacggagttttcttgtctttgacgtggcttttcgctgctttgacactggctgttgctctccgcactccgtctcgatgccgggtgctttaccgcgtcttgacggggcctgcaaagaccgcgaggcctcttgactcggagatcctgtcgttttggtgtcttctttccgttctgtctcttcttcttcgtctctcgctttccctgcttttcttgtctctctcccctcgcgttcacgaggaacca

SEQ ID NO: 1281 - DNA, 3580 bp, Toxoplasma gondii
acctttgttctttgtcgggaaactaggacgggaaatgactctcgaggaagccgcggaatttcaactggaaatgacagctgaggaacatgaggtgagctacgtcggccagtcgcccgttcctggcgaggcgccggcacacgccggccggagaaggaagggcaagcttctgtaatgaacacagaaggggcgttacgaaagaatagcgttcgactgtgtgaggggctgaacaagtgaaggcgagtaagcaatgccgtctagccacaacgcttgcgtggggtgtctagacagcggaatgcggctgcggggctcatgagttttttttgttcctgttgcaggtgatgattgttcggttttctgcgtccgtttgtttgcagcggttcatggagcttcaggctgtgtatctcgatgacatctaagggcgacaccggtacaaagaatcagctcgctgcgttgactgttggcttgcttcaagaaatagaatgccataaatgtgcgcctcgcagtcagggcggagaactggggaggatctgtcgcttgtcattcgcgaagaaacggtcatattgctgtgttctgtccacgccaaggaaacacacaccgctttttttattgcgctgtcgctggtatttgtcattgaaacggagctaggaacatgcacggctctatggcggacggcattctgcggagccgagaaacagatggctgcaatatttgcaaagatgatgcccaagcggcaatcggaacgcatttattttcatggtaaacgaagcgctcacagttagtggccgattcctggtagtttaatttccggacgcgacggttcgaaacacctatcgccattcgcagaaggcaaggaaacagatgttgctgccatgtagagtccgtacaatgtgcacggacatagaacgcccatttcacaaatagaagattagaaatcctccttcgacgtgctttcggatccatatcggcagacttatgagtgtctttcatgatagagccacatttcggagcaagtgtttggttttggaccgaacggacgtagcagattcgcaaagggcagcacctcttcagtgacgatctccttcaaggtccttgctttagagcaatactggcacaaatccttctccacaaccacatggcaactctacgcgactgtcctctggtgaacctagccggaccactgacatgactcagagactgtgctctggaggtccctgacttccaacaatgcatcggctatgattggttgaaacggccagccgggtcctcagtggtagaatcacgaagaggcaaccaacagaacacgattatttaaattgtctttgcagtgatatgcgttgtctcagagtgcctaatccagcagggttgttgcccagcgagaagcacgttaacaaggctcgtagaaacatcatgcgatctgagcaaccacactttggataacgaatctacgtgactacatgagagcacgatggtatgacagtttgcggctgtcacagtgatattgtgtagacactcgttcgaataccgcttgtcctgctctgcggaggataagcggcggtacagggccagactattgtatgtggtgcttaccactggatctgggaggccgtctactcggccgctgtgggcagaatcgacacacttaggaactgggtgaggatgagtgtttcaaccccgagagaaagactagttccagacagacaatcagagacaagacttcagtagtccgtatctttgcctgacaaggggttccgaggatgctcgactattcgtatgtttcgctgtgtggcgacactgcatggagcttttccgtattcgaccgcagccgttctcccgcagaaagggagttttttgaggctacaaaacgttcagtctatatatcagatagctgcctcttcagcagataatgcacatgctgcacagttgatcctgctagaagcgcttcactgtcatggtagctctcacgtcctcgcttccagcggacactttccggactgtcggccggttgcttagcacggcacaggaccggaacggggaaaacactgctttagttgaggaaacagcacatctagcatgggaaagagaagactcctggagagtagacgtgagcgctttccacccgagttcgtttggtaagctgtgcacgacgctaccgccaccccgaagtgcccctctctccatgtgcggcttctcagtagttgcccgtgctgttgtcctcccaagacacgcgctttcttcagcgcttttgagtgtttaccttctgcgagctccgcagggatgtccccttctctctttctgtggggattgacaaggaaatgaggaactccgccgttttcacgatgactgacgacttctgttggcggtttcgcacaccctttgtttggggtgcctagccagtgcgcggccgcagtcttcgcggggctgacttcgatgtgctctttgcgtctttgttttttgtggagaagttggccgctttgccatagagtttttgtctgcgtcggaggtgttttctcgcgcgtgcatgccactcacttcctcgcgagtttagctttgaagcgatccgaagcgccgaacttgaggccgagctatcaccagcacagcttttgccatggaactggccgttccgaggacagacaaatcccgttttctctgttacactctccgctctgtctagctgagtcagagttcctcattccaggatgaattttagactggaaggttgaagttggacacctgtgtagaccggattcacctccggcaagtcattcataaccacatgctcacctcgtccgtagttgtcttgtccaggccgacaaaaatcgcgctttgcacatcgtgcaccattcttaaccgtcttctctttgagacggtctttcttttaaatgaaggcgtcgacgcgagaattccctcgtttgtttctggaaagccagcggcggctctgcgctttgccaccccggcgaagttcccttctggccactgggagttagcgtttttctttcgcctgcgcgagcccgaacggatcgatccctctactctacgtcgagtctcgtggatcgtgtctacctcaacagacaagcgtctcgatttttgctgtgaatcttccgatcgtcttgttccactttcgtcacatagtgagtctcgatttccctgtccactcgcgtaacaagtgcctactcattcctttttgccttcctcgagttcccaaagtttgttctggaattccctttcgatccgcgtagcgagcaactgttaacccgttttctcatcaactgacacctaacaaaagattcttccctttacgtctaatccgccgttcctagcactgggttttccgcgttcctttctaactcgcaggccctctgtacctgtctgcctccaaagagaccccactccagaggactgcttgaggcaggcgaacgtgtaggaatcaaaagcctgccgacagtcgtggtcgcttggaggctacagtccgtaacggtgttagatgcatgaaaaaacgatacaccaatccagtggtacggtttaagatcgtggcgactctaccggttatctcgtctttctcctcacaggtgttttttcgcga

SEQ ID NO: 1282 - DNA, 4253 bp, Toxoplasma gondii
aacaccgcacgacactgatccctcacaaatggagaacggattcgcgtccacagacggcgacttgcggagcagtctcatacccgagctggcacagaaaccccttcctcgagtgaaacggtcaccaaaaaatccagtgtttgtagttcacgcaagtggacatacgatgcgaagacaccccagctcttagtctacaccctagtcttctagcgctgcgacgacgcaacgtccaacgaaatcagcactgttcctcaagagtcaaacagcgtcgtcaaacagattgaacacagactggacggtactgatcgacggtatttaggtcctcttcagaacgcagactttctagatccgagcgacaaacgcgggtgcaagggaagggatttctcgcaactttcgccgacatccaaaacgagtctcgtctctgcgtcctgaatctgcgcgacctgacagctcgacgatttaacaaaagtggaaggcgtaaagcaccctcctcgagaacatgcgacaattcgccctcgttacagacaccagtcagcagggggaaacactgtcatgcttcccgaacgcgaagacctggcttccttggagatacgtgaaattcaccttcaggaaatccctactggatgtggcggaagtggaagcaagtcggccctcctgaagttgtatttcttcccttgcgtacaagtagaacgtcttcttgtgatcttcgtacgatgctgcattgaaaacgacaagacgggctgctacggggcaccggttgtgacgagaatcttctcagtttgagggaagtccagtctcagcagatacgccagtcactctgttttaccccgtcgactccatttgtcgaggcgcgctcgtgcagcgacctttgaagatttctgctggaatgctccgcggaagccaagagtttcacgcgcagagccttctcacgtgttgcaggaggggaagtttgtcgagttgtcagcaccgtcgtttcgccggtaagctcttggacgaagacgtgcgtggatctctctgtcaaaaaatgaaatgcccgctgcgggaagctcccgtgccgtaggccaaagaagaaatatgtcggcaacacccagcacagcggactgagaattcggaagccggtgcttacagccccgacgtcttccaaaactgaagcagtgtagcgaaacgaccagtcgaaacggatgaaggaagagaagtgctttttcaaatgaaagagggtgcgtagcgtgccgcagaaatcaggaagggaacaaagccaccgtagaaaagtgacggttctaccccttgcatgcagaacagcgcagcaagacgttgtcgcggcgaattgtagaaaacagagagaaccaactcccggtcacggggaacttggcattccttcaacgccggaaaaatcaccattcggaaaagatccctagacaaaacatagacacacaggtggggaatactctggaagcggtactgcgacgcagatggtgtcctcttccggttcagcgctgtgttggcggccgtcggtttggtcaagattgcaatcggacagcacaggaacgcgaagcagtggtgaggctttttgttaagagacgttatttcccttctcagatcatgctgagaacacagacacagcagcagccttgtatttctgtggttttgtgtgcacagaggcacactaatactgccagttggcggggtacggggacgcactcaaccatcctcgggttgttgacaatgccgagtagctggagacaagaaaaaacgactccaaacccgcgtaacttcacgatggtgtccaccgtgaggcgttgtttatcccgccattctacccgggcagacccggggagcactcgacacgcacaagcacgcaacgggatggttgtaggattgattatcagctgttttggggtaggatcgtatgagttaaactactcgtttagatcttgaaggtccgtacactgtcgtctttgcttagtggctgccggtcaccctccgtggttgctgcgcggaacgaagcacgtggatgtgggcgtgtttcatgcggggtagtgttttgggcgctaccagggtgcaagtaggaaaaagtcaagaggagctctgtctgcagggaaacgctgtggtgtgttgagcattcccggagagcaaagaaggaggaaacgaatgagtaacagtcttttcggggacatgctcaacacttagtctctgactagatcgtccgaggcagcagagcgtatgactggaagattgtgctgaaaggcactgtgccccgctcttctccgtccttacgcgacaggtttttgcagtagctgtcctacttctccgtcggttcagaagagagggcaaaagggagcatgcagacaatggtcgcttcccttgacttcatttatcgttcgcaagaataaacggggtgaatgtacataaatgaacaaatggaatgtttacgtttgctgtgtattgtggagagggatacagatgagcagagtgaaacaactgtttttttcacggccacagggaagacacgcgcgcacccagaatgtcacatcgtagaaacagcagactaagaagtgcagtagactaatgtccagccggttctttccataaacgaaagacagctgcgttgcttctttgctggcgcctcgattcttcccttattgttgtcaagacgcagaagagaatcagtcccatacgtcccgaagatttttctgaatggtggtctgtttagatgtgtctgtggattaaaggaaaccaccaattgtacaaggcatgtacggtagtcacagccgcggtttcaaccacactgagtatctcctgtaaatcacaaatgcaagacaggcacagtcgactctttctgctctagagtaggcttcagctgtgtgctaggagtttatgcctctacggatgtcggaattatttatattgacgatgaaaacattgaaagcatatgcgttattgacagctttttggcacatgaatcaaagacccaggcgagaagattggaattgaagtccgacgttttaaattgctggagaaagtctaggtttcgcgttcgtaagaagacacagccatcctgacaatagcaaattcccaaataccaattgaaaacgtcttctgtggtcaattagatgagccgagggaggcaacatggaacagattgtctccagcgcttatgtggtggtgttaatcagtattctatcggagacaatgttgttaccggtggtatgactatataaacatggtcacagtctcctcaaacgcgcttatcggtggaagctcgcaaaggggtctttagttgtaaaagaaaacgttgacactggcattttctcgcaatgcaaaagatttcgctgaatgacggatggctctggcgctgcattgggactgtctgatcgacgtgaatcttgcgtagtcactttcctcatagctcattcttcccatggtcaatcagatcgtcccttctgcgagaacttttgcggaagagtggtgaacacatttgtatgcaaatgttctaaggtttaatgactagtgcggctttagatttcaaagacgaccgcaaaagccggtggatttcagcgtaaagtgacctaagggtgcgttctgtatacgcgccgtctacagcagtcgttctgaatgtgcgccgggtcacacaaaccggtgtactgtcggtcacgatcgctttcccatactgtcgagaaagcgctctaaaaaaggcgtggtcgctgtgcacgaactgtggggctgaacggtggacggggctcttgtctggggtaacgattgttcaatatcccaccgtgaaaaggtgccctatttggttctgtcttcgttgtcgattgctcgtttgcaggcgaagccgacaatctagaaatcctcttgacaactatggcacaccgtttcactgatcgcagagtagtcgacagatccatccaacacattttccgttccgacacagtgtggcaaactgaaacgccacgagcctaccgttcgtccggtgtggcgtctgaagagaagcagcactcctaccgctttttttaaagactggatggtgaccgttatttttgagaaggggaaccacccttataggagagcgagcaatgcagtagcgacacgttgtcagcgttaattcacacgaaccagttattttctgaggacgccgctgccaaccctggcagctgctgacgatgagaggaacaggagacatttttctctgcttgtcattccaccttttcactcacaccattgcatccgctcgccaaactggtagcctccctctgtaa

SEQ ID NO: 1283 - DNA, 2839 bp, Toxoplasma gondii
ggtagttgtcacacacacgttcgtgctctttggccgatgcgtcatcgccgccagggaagccgcgacatggcaaaagcagttgcactcgtcactcagggcacactatggtagtaaaggtgtcctgtccaccgcatgcggcctagcgaacgagaaagaaatagagttgtgcgtcgaaacgtttgctcgaagagaaggctcgcccgtgtagagaagcagcgatgccagaacgtgggagagcagtgtggcaggtagtaggccgcatgcgtggcaaccaggcctgctggcgcaatccagtgagtcaccaaaagaactcacgaagaggtgttgtcgacacaagagcaagcgttcgcgtctttgggtgtggcgcttcgatccacgtaccgccaacgcgagcaccagtgcagaataggaaactacgcgaagaagagcaatcgtggttacggaagtctgtaggcgaggaggcaggcagaggaacaaacatatggagttctcgactgatcggtggagacatctagggtcaggtcgcgactgttccctgcacacaggcgggtctagatcgatcggtttcgcagatcgatttggttaaagcaaagttctctacagtcatgaggaagaccggttgaccgttgacagaaatagatatgctaaacagatatagcgagtaccggtacacaacgtattgtcgatagacggaaacaaaggtagatgcattctggcatactggacgggcggtatcgcgaagtattgtcaggaggttcgatattcaacacgtattgtttgccgaatagccagaagctttcataacgtgtgaactgttttgaaaccaaaccatcatctctcgggaggcccaactcagctgctgttcgattccgcgttctcgacgcttcccaagcgcctccagcctccggcatcacagtggcgcctgtggcaaggctgctcaaggtacacaagtcgtacagtttcagacaatgcaaggagtgcagcacacacaacatgcgcttccaggctgaaaactccgaagggaatttcctctgccgggtagaaacggcacgaacacgttaggagtaaaatgcggagccacctttcctttcgtcgctggcgactggaatttgtgtagttcgagggcgtacgagacgttctagtgttacggcgtgtagtacggtataatgcacgtttccgcagagaaggatctgcttggagtggctttttactaggtgaattcttctctggaaatctcgaccagtcgaaaccccggtcacagctgcgtggtgcacgtgaactcgagtactgtccgcgagtgtttattcacttgctgccgctgttgacgtccgcttcaaatcctgaatccccttcgggagtaacagtgcttgtctacgtttccccatctgctttctttgtcttggttgactcggcttaaccagtccagcttatgcatattaagggcgcccaggagggtgctggcagcgtggtggtaacgaccctgctgctaggcggacgaacgtagggattcttttccctgcacactccttcgccttgtgcgttgacgccgatatgcgttctcaaaagctggtacacccgaccaaacctaacggtccaaagagaggctctggccgtgtgatccacctgaacagtaagaaccaggatacgtctagatacacacaattctaatgctctccataaaacggaatacaccgtagttatacctgaacacgtccacaggtaaaaatcctggcgttcttgactcaatcgcgacagtcttttcgtgatccagctgatatccatgcgtctggtctctctagacgagacgggcgccgtgatgaaggggggcagaaggtgaacagacatcggatatctcaggttggcgtctaggaggcgaaaatacgcgagaaagcatgtttggatccgtgaggttacactctttgccttcctttttgcatctctggagacacatgtccaattctttcctccgctcggtaggagtgcgaggcgtataccgcgtgtccgcgcgcgtcttttctctacacaaaaagaaacagcgctgcttcctggatacacatgaattccttgggacctgttctgtcggcttttccttccttgtcttccggatgcaccatttcctgtctgttttgccccttgccttcgttcctttcctgccttgtctgccctttctcgacactttccagtccccaggagagacggcctcctccctccggaacgttgcagaggcaaacggtggacgtgctcggtcgcgcctcttggacggctttccgacccgtttctcttcgccggtctttcctccgcctcctgaccattccatttgagttggagaacgagcttttctggggaacactgctccgccggctcagcagacagacgcaccgtccaaacttgcctcctctccttttcctcgccggcgcgcatgtcttctcggccgctgcgaggagagaaaagactcgagccgtctcgacagtctctccacacttaccggacacagcgatcttttcttcgctcgtttcctcgagatagaaggctcgtcttcaaacagctgtggcctcacgttccgcgatttcccgcaacgacctgacgcttcttcgtcccccagaagaaagcgctccggcctcgccttgagcgtgtcttctctctgggtcttcacgaaaaaaaacggacggcaaagccggactgcacacctggccgcctgcaggactgagatgcctcccttctgggtcgtgaagttcgtttcgaaactctctctcgcccccactctctgcctgcccgcgccgctcggtctagctagagtgtctacgtgtagctcctaaacctgcgcaaccgttcgcagaga

SEQ ID NO: 1284 - DNA, 3044 bp, Toxoplasma gondii
aaggttatgcgtttctacgtcttcgactcgcattctgcggtttgtggctaaacacacagcgacatgtatggagaacatttggacgcagcagtctggttagtatcaaggctgcatgcaagggtgaatcgcatacgcggatgaaatttgtaggatttttgtacccgcatggtgcttgcagtcgcgtgccttatagcggacaacggagcgacggggtatgtctcctttcgtcgcttggctttgctgtgcattccaggtggtacgacagggcccgtttaacgtcgcaagtggcgttagctgctgcgccgatcttgagttgcatctttatcttcctggtccctcgctgctgactgcggacacagggtctgcacgtgctttcaaagattacctcaggcaagcgcattcgaagttatgcgaaagagaaacaagctcttagtcttcgggacggagaggttgtggtaaagcttctctgttcgaaccgcgtacctctcgtcggtacctatcttccttacttgtaaggcaaccagctcctgacacgggctggatgcgtggtggtctcactcgtgaattacacatccttcgtgcaggacactgttcttcatatcttcagtcaagagcaggatgaccgcttacgtgctcgctctccgtcaataggtccttcaaactccactcgacaagccaggatttttattactggaacttttttttctaccggagagagtgtgcgtccttgaaaaacaagtcgtccagagtagagcagcccctccgccgggctgaagagatgtttcacgctcagctcctgccacatttgcctaatccggtgtacatgtacttttcgaggcttttttaagggtggaattgcgcaaagtgccctactgtgtgcagtcttttttgccggtgtgagaactcttctgaccatcttcgcgtgcggggagaatcttaacttggaaaccgaaccgagttacccttgaaccagtacgggtcgccttgagagtatggaggttttgtgactaacttggtttcgcactcgtgatacgtccagtgggcctcccagaaaaatgaaggaaagacgataaagggaaatggaacgacgatttttcgtttgtcctcaaaggaaggattctcatctacgtcacagcagggtactgcgacgttcattgtaaaaatacagtgtattgctgttcttcaaagtcttatgtgaagagccgctgaagagcgacatacgttactacacttttcgtccagggccctttgtgtgcctcacactctcagcctagacgactgatactagccccgaagacgaatgatggacttcagaatgcagttccttaccagcatttccgaaagcaagagagaccgtcctgtgaggaagtgtcttgaagggcgtcactgtctgtgcggcaacataagtcgcctgccgttcctggcaacacggtcataccgcatactagtcactcgctattgagtgaattccacggtttttccgagatcctttagtggttcggttggcatttagtaactgcataggataccaccttcctaagtggccgcgtctaccgcaattcaagtctcagccgagacctgcagctaattaggtcgtcggcgaccagtcgaggatgaaatcaaagattttttaaataatccagttgcacgcacggcctccagcgagcagacaaaggagattgcacttccgcttctgctctcctgttaccaatttcaactgatttttttccctattgcctgcttcagcagtgattggctgcccgtgcgccccggccccgatctagcacttgtatgggggcaaaacacttctcgtctggaggggtcgggaccaggctcctgtagactgaacggctgaccggtacttttccacatgaagacctttcggtataaaggtcgtccacgcgagtacggcatttatagaagcttgtgcagtttcgtaacccacggagctcaagtgaacagaagaggcgagcagttttctttaactttggatgactactttgtttctgtccgctcttcccttcgagggcatagacgtattgtacgttcgctgatctgttgctccctgttcgaggcattcccctgattcagcccagccggtacattcggtttcgatgtttcgtgaacgtcggaaattcagaggagagcggcactacgcgttgaccagtcagagaattcgccggcagatcctttcattcacagatgtagaatacctgcttcatcgtagacgaaatgcgctttcaacatgtttcccgtcacctgtcagtacgtgtcagatagtcgtgcttcgcatacttacagtgcctagaacacaactgtttgctgtcgtgggcgcacggctgtcagtgcctaattgagcgtttgtgtgtaactgcagaacccttaacgatcgacaatgtagaaactaaccgccttcggaaccataaagcgaggcacgcgaacaaccaaacgcctcctcgtctagcaccggcgcagagttgaggctgtcgtcagaatcagcccaataaaacactcgggtgatgtcgtgtgtaaacgcccgatttcgttcatgtggtcggtcacgcagaggtgtcgcacagttgcacaatctgaggtggtagccgtgctgtttgctgtggaagccgaacgtagagaggaaaagccctcggtctgtgccgagcggggaatgaagaaatgagaagacgacaacgaacgacgctctctaactgggtacaagcgaggcgacaaaccgcccctataagtcctttgtccattgttgcttttttacgcttgcagttgctttcccctccctccagacgaaaacacccacacactgtcacttgctacgtcagctgtggtgtctccagttcggcgtccccgtagttgtttgttgttcgcccctgctcccgttttcacttgactaatctcggcgcggcgcgagttgcttcgctgttcagactaaattcgaatttttacttctccccctttttttccgtttgcggtgttacacttattccctctctccgggaatcttagccgtttctgtgtactcaactccgacaaaa

SEQ ID NO: 1285 - DNA, 4963 bp, Toxoplasma gondii
tggactcaagctcggacactgcggagaagccagaactcaaaaagaagtcacagccagcagacgagaatggtccggagacagatgaggttgcaactgaggcgagtagcgacgaatgggcagtcatcgcaggaggcaaagaactggaagaaatatgtgatgcagtctattcagagtcattgaggctgcaggaactggtttcattttatgaagacttcgccgcagaatgcttgcaacgtcagggtttcgaactcggagctgcgcgtttccgagaaaacgaattgtgaccgcgctaaagggaaaacgtgctttcttcatgggttttcaaacactgtggaaagcgtgatcgtgggtcaaatctgtggagagctagtccattcctttccttgtcaatgttctgtacaaccacttcaggtcaagcgactttcagaggatgttctcgacacacatagtgcgctaatagtgtcacagccgtcatcaaccaatcagcgaccaacatatctcgtagcgtattgagacggtcggggcgtctcacatagtccagccgttgagagggacgctttcaacggcacatgcttcatatcgtagtaccgcaatggcgtgttttccctgttcgtagattgaaggagttcacaatagcgaagaggatctcgtatcaatgggattccgaccgtttgaaccgcctgccagagagagattttttttcttctagcaccttttaaacacatacccgatcgttgataggaaaacatcgcaatgacgtcccgtacgtggtacagacactgcagagtcgcgacctatgagcagacgtgtccgagcacgtctgttattagagaagtaggacgccagactcgaaatgtggctgtatttatatgaaagttccttagtagaatgcaaggcaaatgacatatcctgagtgctaacggactcagttcattgagttacccaggagtcgatatactatgtcacaaatgaaaggctggtttgcatccttcagattcgtgaataccctcgtaccctttggggacgctctgctccctgagatatgtgacgatcccgtttctgattgtttggaaacaacagtctacatctacagttctctgcggaactgaacaactccttttctagaagtagtgtcatgaatgttgaaattcaagtattgtggtggcagacgatgcagcgagcttttaaggttgacagatgaaagggtggaataagaggatacactaactcaagggacaaggaacctgctgattgagttgcaataagaggcgtagtttcgggaaaaggttgtacaggaagctctacacgcagggtaaatcggatttaccgggactcattgaccagtggaccatcgtagcacggtcaaagatgacagctgacgcaagagggataatggggcttcagtggaatacatacgcgcaggagcgacattggggcttgtttcacgttgccgaagtaccattaatctgtcataaaacaagaggcgaacgaatgtaaacagtcttcctcaagggattcaggggcctttttgcatgggtcactctttcgctctttcctagtccctcccacgagacaagtctcaccaagcactctccaacagacaacatatttctggtgttgtctcgagcgcgagagaacaagagacatcggtctgaaaaaactaccgaatacatatactttggacccaaatggtcgtccacttgaaaaggaggacaacttgagcgacatcaaactctgtcacatgatgcgatcaatttgtacgacgaagatccctgttttcttgggcatgcggccacatatgcaacgctcttgtatcgctcgaagcgtttagttatacgtcagtagcactctgtgaatttgctagcgttcaacacctgaatagagaagtagcagcagcatgggaatttaggttgttgcatttcaggcgtgttacgtttcctcttgcgttgatcataataacagtccgtagtcgagcagagcgctggtatgtccgtttacgttggttcatacgcagcatccggggggttctggtgtacgtctatatgcgtgtatatgtgtatagattggcacatccgaaggatgctattcctgtagagtcgttgtgatgcttaaccaatcgcgtaggtccctgctttttgggtcaataccgcatattgctcttcctggtttacgcaatgccatccgttggaaacgatcaataccgcaagcacgctctgtcttcgcgatatatccgtgagctgcatgttgcctaaagcgtgtgactatcacggtacagacgaaaaggggaaaatcaacagagtagaatgcagcacagatgagttcccatgttcgggaactccagaggcaccgagcgcatccgtacttcaagagatgctattcgagcactatggtgtaagtaaaaacgctggtatctgcgatggggtttccagaccaaccatgtcgcttcatcggacgagtccaaaggatttgtatcacgcacagtctcgtaagacattcgcgatcagcaagcttctattgaagactcaacacccctgggcggcccgcaatcccttcggtggccgtacgcgaaaccagccggcatttcctgtgatccgtaagttggcaagtccgacggcgttccgaaactcgtgtctttttgtggggagctcaagtacagtacatcactggggaaactgttagggcagaaaacaaatgccaggcaaacggcgtagcggctagcgccttactttcccagagctattaatcaacgaggctgcgagtttgttgctcaccggattgccagagtccctgccttactggggctgaacggcgacttcagtccggggtacgaggggcagttcccaattattcctgcttttgacttcttccgtgacgctcaacagtctcctatcacatctcgaccagagcgactgctagtatgaagacgaagagaaaaaaacgattccgtagcgcaacgaacgaaagccagatccacaaggtgagaaagcacccgtcaaccattcttctccttcccccgccagtaggcacagaatgttacgaaagacatctgtgagctgttttgtgtgcacctgcaaagacacacatctctatgcgtggaaagatgtacacatgccacgattgtgaaaaaccaggtgtgtggaatccttttttctacggtttctccttttttgcggagctcgacgaatccctcgtcgaaaataatcccttgcattttccacattcgatgcgacgggcgctggccgtaatagttcggcacaggagcttgcgtgtgtagtttcgggatggtgagatggctacccagctgaacagtggttgctcaacacaaaagagcggttagttctcataccggcacatcagtggttcagaaaaccacaaatcggcaatcgacagccagaggttgctgccgttaccgaggggggtggagggtgggggtttcctggtttgcaggaccaccgtccgactcctccacactcttgcaggactggaggggggaacccagatcgttttctcatttcgtgaggccttcgcccgaggtcctgtgagacacgcgacttccttttctcctaataacacacagaacgcaaggagactgttaggtttaccagatcttggacccctccttcatcgtcagttacactgtccttgttccctggtgagtgctttcttcagccgacccccgtcgcacattttacagtggctgccttgggtctcgccagctagatagaagtgtccgtgtgtggcgtgatggtttctgcgacgcgcttcgtttcttcgttctcgcagttttctaaagagtttgcaaaaatctgtgcacaccccgtcctggaggcggcgattcccggtacctgcaaatcaagactgggtttttcacctgcttttcgtagctagctgagcgcctatctgaatgaaagaccacagtgcgtcgggggcgtggtgaactggaggaactggctaccctggaaaagaagttggatactggggggtcggcacaacgaacgcatcttcttttcttcttcagattcccttctgggcgcacgagtgaaaacaaagacagggaactcttttgaaatcggggggctgagttgtcggctttttgtcgctctttcgcctcttcaccggaccaccctccaccgtgcacatagtttcactttgtgtcctcaccgacaggtcgcgtgccactggggggagtggaggctcgagtgtcgatcgacactcgcgcgagaagaaaatgtgttttcggaacaagctcgccaccggttcgtgttctgtgtttcacttctgaaccttgtcaaaacttgtttgttgtgccgtcccacgcacacgccaccctgttcttcccgcacggtggccgagtgtctggacaggcgtcttgtcaaaagctgttcatgaagaactcaacaagggaaaaaccttttttttctcttcgccaatcgaacgcgtttgggagtcttttctccgaatgagttcaaccgagtgaagctagtgccgcggactgtccaccggggtgtgtttcgcgagagtgtgtgtagcagggaagccgccttttggcggcgcttcggtcttgtgtaactttttcgctgtcattttcaccggcacatatttgccgggtaccaagaagcttcgatttttttatgacatcggtctgcttcacttgtcacgcgagctgtttgcatcggccgtaactcgcggacgcgtagcgtccttcgttgtagacccctttctccccttctctctaccttaccttcgcgccacttctcgtgttccccctcccagatttctctctgcctcggtgggctctctggttgtcagtcgtgtgtccttcgatgtcttcgcccccttctccgttcctcctatccagcacacctggtgacgcctctcaagtctgagcggcgtggcagcgaccaacaacgacagacacatgtcctcggccattcctgtgccctgccctatctgctatgctaga

SEQ ID NO: 1286 - DNA, 3984 bp, Toxoplasma gondii
tttaccgggttgcttggatttctgtccggctcgattcgctgtttccccagtgggcatgtccgtcacagggtcttctcgcgagagcgccaagagtcgcagagccggcactccgcgctgcgaacgccggcgctctgtctgagcgaggtgaggaaatagaatggcgctgcgcacccgtagtgatgcctgcgaaaatgtggacgccgaggacctcgctcgcatcaaggaagaaggctgaccggaaggatgtgagccgaaagagcaagaaggaaactttctcgggagcgcaggagcacggcgcctgcgagacaaactgcgaagaaacgcggatcgctggggagtcctcgcgaggcggcggcgacgtggttgtcgggacggacgaggcgaagacagcgaagaagccgagggggaagacggctcggcgggatggccatagagaagcgggaaccgtcgcggtgctcgcggtccattctcctttgcactgacgtcgctgtctcccgtttcgccagacgtggagtcgacactggtctcggaagattcggtcgtagcgtcactcgaggtgacagtggccgaagacgactgtgaggtgctttgactcctcgtggaagagtcgtctgcaggttctctgccgcgcgactgcgccttccactcgggggtctcgtggctgttccgacccgaagcgccacccggcggagtgcgtacttttcgcccaaacttcccaggtcgtccccccgatcgcctgcccgcgccgacgcgaatccgggagcgaaggtcgcttcgtgctgccggtctaaccggttcagagccgcgaaagtctgcgtcagagtcgtcggaagttcgcgtgtcagaaaacgaactggcctcacttgtttcactggatgagtccgcagccaaagagtctccctgaagatcgctctctgcgctgctctcgacgctgcgctcgggtgtatctacacctgaagtgtgctcggatagcgagctggattctgcagactcacccgacggactgctggaaagcgaggcagatgaggcagcgcttcctttcgcggattcagaggaatccgagtcgatgagagtccgccgtcttctctcttctgaagttttcctccgcgttcgttccgccgcctgcgccttgatgcgcgcaagcgctcgcacccgccccgcgggagctccggccgttccagcggacgaattcgaggaagaatgcgacaaaaaggtggcactggttgcagacataacagggaaagcataggcagactgtctcgagtccacgggcaattggaacggctgagcaaaagacggacttgcaccgttcgacaacgcctctgcgtcacgggctagagcggcggccgaacctaccgttctaggtttgggaataacgtgagtatctttctgtaaagtcgaggcgacagatgggttcaggttcgcggaagcatcgaaatgcatgatgtcttctgcggcagactgcagtgcatccgattcacagacaccgctgggagacggtgagctcaaacttttgtcactgacacgagcaataagcacaccggacccggaaggcggcgaagagccgcagcgcggctcgtgtgttaccatttctttaggcacactaggcaatgcagcgaatcgccttctttctttctaggaagactcagctgtggaaggaaggcaaagacgggacacagaaaatcgttttgatgtcgcatcagatgcgtacgaacctacaagtatccacattccaattttgaactgggaaaaagagggatgtaacgactgtcgagatgcctccaaacgcatgtgacaaaacaggctcgtcagacacaactcagcgtggacgcaagaagttcatggaactcagaatgctcattgcagcacgaacagcgagcgcttcgaccaacctttcagtagccgcttgaaaaccttccagctgctacttaatgccggacacattgtccagcgcagagcagggaatcagagcagatactttgtctacacagcagacagagtttgacgtcggcttgaactacgtcctatcaccatccgtccctccgcgttcgtgggtgaggagggcaacgaaagatgacacagcggaaaggacagcgacagtttagcagagaacttggtcactttttaaaaaggtaggcttgtttgtagaaacgggcaaccgatgtttcacgactcgactctcacagagcgctggatggcgcagccgtacgggttgtgacgaacccgccgcatttctctacaaaggaaggcgaaaaactctcccttcacgtggaggggagaagacggtgaaatgggaagaaaagatcgaacatactacggaggaggagcaaagaaaacggcctgaaatccccgcagtagaaccaaagcatgcgaaggaaactcggcgtcgcccgacagagaccatcagcaaggaagagctgtggtagagaaaacaaacagacaggatcatgaaaatccaacgagcaattttagcaaacctccaaaagcggaacaaaggaaactcgcgattgaatcgagaggcgaagaggcacgccgcacgcagaggagctagcgctagcaaaccagagtgaagtttagaggaataagcgggaatccgcatccaaaacgcaccgaatctgctgagagacaagtgtgaaactgcaagtgaaacgagcaaatattccagggaaaggcgagcaagtccgattcgggaaagtggagagcaccgcgtcgacagaaacgacggcagcatcccgttttgcagagacgacgtgtcgattcctttgacggagaaaaagacgagggcatgctacaatgccgacttgcagaggaacgagaaagacgaatctttcttcggagctacgctctttgagagtcgatcttgaaaactgcaattcgccatgcctttaggacgacatcagtgtacactggatctgaactcgcagacgaccacacgaggagcggaaaacctcaccgcctccgtgccacggaagttggacaaggaagtgaaaaggcgcttagaagactatgtctcttcttcgagttaacgcagtgaaaaatgattccacgagttctctggtttgtctgatttcctggggaaaaaagagacaactctctggctctgcctccaggtcaaaaggtctagagtcgtaagtcgatgagcacgggagcggggcggcaagaaatccttgttttccaaaagaaaatcttgctgaattgaaactaccctgtcattccgtcttctctctaacgattcgctctcagttttcgtgctcagtctggctccacgtcctggttatgccttttctgaggaaaaataggcgtagggcgagatgcagcttcaagatgggcggtttcaatttccatagaaagagacgccgtcaacgttgggcttgcattgtcgaatctcgcgcaaaactgcagtttcctcggcattctcgctgtggttttctggtcgctttttaccacgacagaggcgccagcgacgtcgagttctctcccttgccgccggtgttgagcttgaaagtcttttttctccgaattttctgcagcatgacgtgagagatacgctggagaagagaaagttatcttatgttcaaagcatgtgcttaacaaaggcgatactaattgcatctcgtctctgcttcggtgtccagccgcagctttcctgtttgtcgagaggggcaagaattagttgagaagcgactttaaaagaacgaggcaatgagtctaccgatcgaacgcaaaggactccttcttcctctccttggctgactgatctgcgactggcacctcgtgtaaatctattgtcgccaggtcttgaacacaagtcatgcagtaacttaagctaggctacctgtaacgcattatacagtgaggttcgcaggtttctacctttttctgccgagtatagtttacgaggtggacatctggcttagatctttcgaaggtctctgtctgtgaaggtgcgaactgacacacgtcagcgaggttttttcgtgccga

SEQ ID NO: 1287 - DNA, 2198 bp, Toxoplasma gondii
gagtaaagtgagtcggttgaggtgtcagccgcctagaaggttgtacgccgggggagaagggaggcgcgagtctaaagaaatctggagaaacgaaacctgatcgagaactgaaacactctggctgctgagcagcgccacccgagacgggtcggcctgtcaccccacaagaagaacctggaaaaggagacaggagagacacgaaaggagacagcggggaagcagacgcggcgcacaacgagggaaaggacccgtgggtgaggcgaggaaactgccgcgtctgggaaggaagaaatgccccgcacacagcgcccctacggatgggctccatccaccgtcgccagcttgaggtgtatgtacaacacagctgggcgcgctcgtgaagctttagccgatctctctgtcttgcgcgctgttctgcgccaagctgcgttgacgcctcgcgacaccaagaggaaaaaggacgccttttcgcagagacagcatcgccgccggacgcagagtcacagaaggccgcggaaggagcgagggaggaggggagtgagagggaagaaggaagcgagagagaagacgaaactgagagagacgacgcccatgggagagagagagaacgatgcgtcgagagagcgcccgactttcccgcagaccaaccgcgtctcagctccgctccccacggagccgagaggccgcgagctggttgcgttgaccaggcgacgatgacagtgagttgaaagaaaagaaaggagaagaaaggaagcgcagaccttgcatgcagccgaaggcgagacactctgttcgatgtctctcggttctttcgcatcgcgtctttggaccacaaactgaggtggaagtccttcgaacgcatgtgaaaagacttaaaagaaaggccttccttcgggtgcatcactgccggtggcttttcctagtttctcttcacctctcttcttctctgtctttttcctctcgcctctcctccctctcttctcttttatctcttttcccctctttctctctctctttccttctccctccactctgtcacttcttctctctctccttcctctttttctctccgtttcttccgtctctttccccttctgtcctctctttctgtgtctccttttctttaccttctccgctctcttctccctccctcgtgacctcggtgtgtgtggacggtgcctgggggcagagagacgaaggagtttctggcgcgctctacagacgctttctatcctttgaatattcagaagaaaaagaaaaaaaaaagaaaaggcatgcggcggggcgaaaagagtcttgcggaccgagaaatgttttcacacaccaacggcccggctgcatcatctgagagaaggcaggcactgccgcagcaagtctgcttcttgacgactctcggcgagggaaatgcctttaaaaaactggaggtcgtcgtctcagggagaaaaatgccatgttgcctcaaacagataacctcttcaagagaaagaaaagtcgcgaaaacgaatcgctgcagccgcatgcaggacatctgtctccatcgggactggactaagagctgagagagacgctgtattcttcctcctggagactgctgagaaccgcgcaaagaacacacgtaagaggcgccgagagaggacttttttcaggaatttccccgaaagaaactcttcgcttccagtttttcgaagaagaaagagtcacagtttttctcttcttgttcccaaacctcgggctacgctctccacacgagctcggggaatgttcgtgtctcttgagatgtaatccgtcagaggcgctgacgttggagcgtcttctgctcgttcttcttctccatcttcttctttttcctccacctctacgtcttactctcccttgtgttgcacctcgacttcttcgccatctcccatctcttcttctgcttcttcttctgcttctcgttcttcttctcctgcttctcgttcttcttctctttcttctccttcttctcttggtcgctcttccctcagttcttttctcagactgcgctcgttctctctgtgtcttcctccctccccttccgctcttttgtgcagtttattctcttcgcttgctcgcctctctgcgcctctttcttcgcgctcttcgctgtggttgcttcagcgtagcttctgcctctgtacagcacgcggttctgcgtcagagagaggccgacagagaga

SEQ ID NO: 1288 - DNA, 2646 bp, Toxoplasma gondii
tgcatgcagagtggaaatcacccggttcacgccatggcgcggaaacgcacactctgcgaggagcggggactttgcgcgcgagagacgaaggagacaaacgaggagggcatgggtgaggaagaaggacgagatgcagcacacgtacaggagtgggcaagacttcatttccacataggtcatccggggaagcagcgaagcaattggctcagaagaaaggccagaaatgggtgaggccgcgaggcttccagagtccgccgacggcgaggcaagctctgcaacgcccccaggagggacggagacaggtgcgccgccttccgtctccatggcgcggctctcaatcaggtttgaacaattcttacgggggaagaatcacgaagagaagtggagagagctctgaaaagatgctgcacagaggaaggaaaagggagaagagagttcccaaggattctcggattggataccgagatggatccgccagacaacagggggagggggggtgagggaagacggaggcaaagtgccgcacctgagaacaccctggatgtggtcacaacgtgcctacagaggcaggaagggtgagagtatctgcgacctgagaatccaagacagcgattgacagagaaacgagaccgacagcgggactgcagctatggaacagcgaaacgacgttcgacgcgaagcagcaagaagagaagacagagaggtacgcaccgcagagaagaggttccctatcgggtctgcgcctccctctcgctgtcactggaatcctgtttttttccaaacttccacgcgtgcataggatacgcagaaggcggaaaaacgcgccagggacttcctgcgtattttgattcacccaattcgaaaactacaacttgaagctgcagctcacacaatgccgctcgactgtctcgttctcttttatctctccttgttgtcgctgtcgaggccagcatctagacggaagaggtgtgccggtgccgaccttgcggcggcgcatgcagggtgaccgggagagaaaaaagacagagatccacctttatatacaaaacttcacacactgcatctgtgagtgaagtgccgttctcattagagaaaaacaacaacagaatccggactcaggagaaggccccgacgaacaagacagccaaaaaatccgtccggacacacgcagaagcaggggaagatccgaaaagccgggagaaacagacgccacagaataacgagaggcaacaaccaagtgacaggaacgggagccgagcaagaagaaggtggcagggaggagaagagaaggtggcgacaggttgcaggacctctgcgcgctaggcataggacatccgatatgtttaccggaacctgtagcgacaaacaacagaacagagcgcctcagaaaggtattttatgcagcagggaaagggaggatactccagaaaacaagctgacgaaagaagaagctgatccgagtttctttctctcatttctctatcggcgtgaaacgaacggagtgtcgcctgaacgacgcccaggaccgaccgcagcacgtagagaggggctgcgcagaagcatgcatgcgccaagaagagaggaaagaccagatggaaaatgttttaagagagtttggagcacctctttttcaggccgaaacgcggctgtggacgcgccacggtacgctcgcgcttctcgcgagaaaagggagacactgagaggagggccttctctggttggcgtcccggtcttcactgtgggattgcagaaaaaccaccttgtcttgtcactttttctttaaaaatcttcaccttccctccccgttatagattctcgacttttcaacacctttcctttcagaggcatttcctctctctaccctcctggtctcctgcctcgtgttttccctctttctgtcgcaaagtaggtggtttgtgggccttcgcgcgcggagccttcctttccctgtctttcgtgcaaaacttttcctttccccgcattctgctgggtttaagacccccctggtatctttgtctcttcgcaaactaaggcctcccgctggatttctctgccgccgcggcaggtgtcgcaaagtcgtcgctgcctaggcttcttcacacgaccagaagaatccgttttgctcgacggcagatctcccttgcttgcattttatcagcctttgttttcctttcgtattccatctcctcatcgaaggaaagatcgggacccggacctctggggctcttcagcttgccgaagaccaacacccttgggccgaagaccaacacccttcgttccgcgtccctgcgtctcccgtgtttttctcaactgcttcttctcttctcttcatctcgttttttccgcctctgcctcgctgctgacttattcaccatgcagcggtagcagcgccttgcacgcttctccagttctcccttgtctctgtcgcctccttcgtcccgtttgtctcttttgtctcgtctctttctcagtttttttgtctcctttttcgagacacaggcccccggcattgtagaggagacgaccggtggagcgagtaccgccatcagaccccactgcactatttctgccgaaacttcttaccgtcggccatctccttgtcttcttcgttgttcgctttgctgtttctgcgctttctgagaagga

SEQ ID NO: 1289 - DNA, 1931 bp, Toxoplasma gondii
aacaaatgcattaaccttcagggcacactacatgaaaccagcatctattgtggcgcgcatgttcaaaccacgacacgtaacagtttgaattacaaacatggcacgcgtttatcttaacagacattcctgttacgatgtctcagtcttgttgcggtgcatgcacttggaatcttatcaggaatacttcagtgcctctacaaaaacacaaatgggggtagaatgcgtagagacagcgtaaaattcgagagacgggggcttgtacataacgcacgaaattgaattctgtaacacaatcccgactgttacacgaccacagccagtctacatgatcggtacacttctacctggaatactgaacaacactacgaggacgtgtacgactctaacacaaggggccaggacaccgggaatcaccaaaagctactctacgagactaagctagatttacacacttgaaatctacgaagggtcaccagaaaacggtttcggatccacacgtgagacatgccacgcgtttttgtcttcactgaaaacacggtggtctcggttttggagtggccgttcagacaccagtggaccgggacttacaatgcgagcctgcgcagactgaaggcacttgaattcttcgatcataagatatttgcaagcatttttggggtcatcagcgtggactttcgcggcgaaatcattgacggcaagtcggatttcatctgccgtcttggtcgtcgagttgaacttttccggggaatagagaccgtggtggtaggccagcaggcgctcccagttcgaggaaaaacgaggtgcatcgctgaagccgccttcaggaaagctgtcgctaaccatgttggagtactgagtattgattcggtcggcttccgggttatcattgggatgaaatgttcgtgcatctgtcgaccacggatggcgaacagcctcgtggttccggttgtcgtagatcgaggagttcattcggctcccagttcgtctgttgacaggaattggctcgtttccccatttgtacttgttgaaatgtttgtcttcgtccatctgtggattcaacggcaccttgctcaacagttcgggaaacgcttccgcccccaagatcgaggctgcccccgactgccccccttcgcgagtctctgccatcttgactgtgcgggtaataggggagagaaaagccgctcctcgccaacacaaaaatgcgactcagcaaagacacctggcaacgtttccttaagaagaagaaaatggaaattctcagaaaacagtagattaacccaggccttttcctccgggggtctccctgtcgagcccgtttcgacgaaaccagacgtctctggccggcaggggtaagcgaaaaaagaggaaaagaatacactgggcagtggacgaggtgtgcatgctgaaacgaaaagtggcggtggaaaaccgagcgaaaaatgacgatcggaggataggctctgaatcactgcatgcagttgtgttttgcctcctcagcccttcgggccctcccgagaaaagggtacctcgaaggacgaaaagaagaacagaccagctggaaaccgcacaacaaaggacttgtctcgttcacatcgcgaccgcccgccctcttgccatctttcctcccagtccctgatgtctctcccccttggttttttctctgtgtctccctctcctcgtatgtctctggtctccaggtctccaggtgtgcagggcctcagaaaggcaagttgtgttgcttccttgctccctcactttccatggggagattttttcactaggcaccacatttcgtatgttatgttctcgaagggtgctagagcgggaaagaagcacgtcggcaacactctggtaactgtcgcattcgcttcactgagacacggcgcataagaatcttctgaattagcgaatctgcccaagaataccacgca

SEQ ID NO: 1290 - DNA, 1894 bp, Toxoplasma gondii
ctggactatcgagcagttttctcgaaatacatttgtcaggcgcctcgcaaccattccatcctgcgcctgcgaggcactggcgcatcacagaccccacatcctctccaagcatttggttgtctcccgggtctcctgcgttttcgtcttctcctctgtcgtctgaaattctgggactcaactggtggtgtaaaatccattctgtgcaaggcaacagtgaagcgcaagtcgggcgataaacgccggcgccggtcacaggagacgctcgctgacgacaggctcgtacgggtctctctcgccttgtctcagggcctcctctcttcggagacagtgtagcgttgaggtccaccatctgtgctcgtatttgtcgcggggaaccgaggcccaatgtgctcttcagatggacgcctgactcttttgcctcaatgcaattccatgacggccatggaaagcacagccgagctcggatccggcgaagtatattacattcaagacctaggaaggccctctcattcaaacagggtcggcagatagcactgtggagaggccgagcagagagagtctatacggaagacgagaagtcagctgagaggcaccagatcgagagacgggaaggaagcggtacaatgtacacacaagagtcgagcacggaaacaccggcttcctgagacattggtacacatgcatggaagagaaaagacgaggcttacgggagtttgtctctgcctttttgacgacgcaacagtgtgggtgtaacaggaccaaagaccaagcgcgagagaggagtctggagatacgccagcagcagccagggactacaggaaggtccgcctcgctggcagcgttccccgacagagactctccctggagttttttctagtcgacaaaggagtcacggcggcagtggaagcctgtgtggaagactcgatgaagcaaaagagaaaaaactcgacaccggcgcagcacacccacctacagctcttcttggtgcgtcggttgtcttctcttgggtgtcacacgaggatatgcaagcagcttcgctgcgtcctccaaggataatacaaacttccgacatcagaataagcgagtcgttggcagttccaaacacagacagaccgtgtgttccgcgctttcttggcgcagaaatccctccaatctggtgcctctcttgcgtctcctggcccaacggacccgccgtcgagaatcgcagacaagaatacacagttcaccctgtgtgtgacagcggcgaaactggcgaggcaagtcttctcgctacatcgcttcacttcgtctcttgttccttccctttccttgcaaaactcgacaccggagttgcttctgcttctcggccgtagagtgcacctgcctgcacactagagtctgccgtgcatgcagactggacagcatgcgcgcaaagccgcttctctcacggcggaagtctcgtctccttccgtgtcaatgtccgtttctttcgcgtcctcctctcttccccacgtgcctcgaaagattctgcggttggctgccggtctatgtgaatcttagtctcggcagagcttctgcactagtcagatcagcccgccgggacttcgaataacggccagagtcccggaccccatttcagagattctgttttgcatagtcactcatgcagcagatctcttcaagacacagaactcgggccagtgagcgagcatgggagagaataattgaatggggaatcctagagggggtgcattgtgggggagatcctctcgtcttcagcatctcgcgatgcctccgaatatctcagcgtgccaaatcgcctttactggacgaacaggagagcctcgacagcagacgcattggaaggcgtttttcttggggttttaaaagtggttgaatccccgcaggaagatca

SEQ ID NO: 1291 - DNA, 2339 bp, Toxoplasma gondii
gagcaaaactgtcacttactgggagtacagtgaacctgcggcgtcgtcgcatctgctgaggctcgatgtctgttttccgacggctggttccggtgagcccctccattactccggagactctctcgtcctccgtagtcgtttttgccttgtgcaggcgaatgccggggagcctctgcgtcctgatcttcccccaaggcacttgcgggcaaaaaggtttgacaggcgacgcagaaaagctgctgttgcttgttgcgcatcagcgggacgctcacacactgcaaaacgcacacgtccgtacagagaccgcactgcagatgtacacaaaaatactgatacagatttacccgccataatttttctcgtcgtcttccgcgcttgccgattcctacacatgcggaccactgcatgagtcgtgtgcattcgccgacccagaaaggccgatgatcgagtttgtgctgagcgcttggtttcatacacacatgcctctaagcatgcacggaggtgtccatacaccctgtgtagacaacacccctgcccaacacggatgtgcggcaccaattacatgtgttttccgttgacacatatggtctcatgtcgacatgcgtgcgagcagacaagacgcgaggccttgagcatgtgaaacatttcgaccgaggctcctggattcttctgtctcggtccctggtaaacaacgccttcccgaatctaggaggactgtgctgacttcctagtttgctctcgagcggcggtgcttctccgtgtttcgcatgtgcgtagaagcatttcggagcgcctattcgtacattttcttgcatgcaacttcgtgttcagcaaacacacagattccggtgtttcaccgttccaccgccgccaattcgaacacgcacctgagggcaagtgtcgccgagcatcgtccacccaagtagcagcttctcggcgagaccttcactcgctgttttcacttgaccctctcctgttttgccccgtctttgctctgcaagactgcttgcagccatccctccatgcgccgcagacgagaggccactcattttttcggtgacggtgcacagcaacggcaggacgagacagccgaacctcagaagaactgagtccgttaaaggcagcgaaaacggcgagcagcgactcaaatgaaggtggaacagacggcttcaaataacgtttttgaaaaaaaattgtggcagaatttcaaagaggccgataaaaaaagtcagttcgacgagctgtggatttgagcgttgtgtgtgtctccggcaggagaacattaacaagcagatacgcgcggcgagaagaaatgacaactctgcttatctgagacctctgtagtctacaaacaacagggaatcttagcaaaactggggcaaaattttccgtcaaagcgcgggtcgtacttccccgattcgcagtacaacgggttcgcgacgggtgaagaggatgcagaggatgcgctcaaatcggcttttttatgcgtcgccttgaaaagtagagggccctcaatctggtcggcagtgcactaaagatgggaagaaaccgcccgcgtccctgaaagagttgtggcagggaaacagcggaaagcaaaagcagcactaggcggatgaggcgtagagacacacagcacaagaagagtgggagaccactgctgtgcgcctactgttcgtgatcgtcaactgggatggacttgatccgctgaaactgttgctgtacctcctgacggcctttcagcttttttctttgtcaattttctttttttctggagtaaaagatcagcggagtattgccggccgagggacgcagaaagccgacggcgggccgcgattgctttccggggttgaaggacgctgcgggacagaacagaaagggtcgacactgtttttccccttgtgcctgaaaagcaggaaaggcacggaaacgtgttcactttctgagccatcaagcggttactagtctgtcgacccctttgctgtgtttctctcctccgtctcttgtctctcctgccgccgcgccgttcggactcccggcaacactcagtatgtgctgaccgagggaagaacgtttcttggggcgttttcgttctgtttcctggttcttcgtgtctgcatctgttttctttgggaacggaccaggcggcggtccgaaaaggaggtggagtcgagcactttgtctcgcaattcccctccccccctccaatccgtccgcgttttttgcagcccatttttgtcctcgtttccgttttctatttttcatcgcacgtgttgtttcctgttccacgttatcgctcttaggtggctctgtccgtctacgcctatcgcagacagtcaaga

SEQ ID NO: 1292 - DNA, 1807 bp, Toxoplasma gondii
cttttgtctctgtcgaagcagtggcattcttttctgtgtctgtctgttgcctgttctgtcagtgcatgcattttgcttcctccctatgtttgtcctttctcacctctgttcaaaagaatggggagcttccgaaacgtcgactagacagatgggagaaaatgtgggtgtggatgtctcttggggggcgccaccatcctgtgctaaatctcttccttttctgtctccttagtgtgtctgtctttcccccttcttgtccttttctctgcttttctttttcctgtctctcgtctttcttcatccccctccttgtcctctccaccctctccgtcatccgccggctgtctctgttggctattctccgcaggtacttcttctttccttcctcctgcgtctcccttttcgcgctcgtctcgattctctttctccccacttgctgattccctttcttctctcttcaacgttctctttcttctctcttctttctcccttctttttcgcgttcgtttctcccttctgtttcgtcgcttccgcgtagaagacctcagcagactgcgtgtctgcagaagcaccgtcgagaaacgtttccttttccgagagggaagcaagctgaaggcaggtttccgtgtgaagaggcgaagaacctggacagaactatcaaaagtttttgcgcagcaaaagctcttgaagaaactttctcccaagcgcatgacactctcctgcacaccgttgattcgcggcgatccttcagatggaggaacttcgcctccgttgcgatatcgaggggcgattcaaaaggcagcaaaccccgaaaagaagaaggagcaggtgggacgagaaagagacaatttgcgaaagaaacgccggagaaagggtgatacgttacacagcgatgtcttgcacggtgtgccgcgagcacacggggatctcaaacagagaaaaaaagtggaatgacgtgggcagaaagccgcgccttttagtttttgcaaacatgggagaagaagtgtcaaattttctcctggcttttcagaacaggaaagaaatgcggagcggcgtgtgctgccgagtttgcatgcaacgctcccggtcaagacacacaccgtggagagagcttgccgtgctcggaaaacgaaggaacgcgatccatttgcgaggcgaaaatggagacaacgacaagggagaattcatgtttttcgtggaacaaacaactgcctccggctatttgtttagccgtggcgagacttagaaaacggagtcaagagaaggaactgctttttcgtggaaaaccttttcttttgcttgtgcatgctctaaaaatggatgaagaacctctttcgtcatctagagaaagacagagagactttaagaggcgcgtttcgtccaagttgcggtttctcgctcagaacaccagcaatgtgaaatatcctcagtgcggcagcacagtgaactcctacacttttagcgctcgacagcgggctccacagccgagcacacgcaaggaaagcggaacagtggacgcttcctcgcaggcgctctcttcttttccttcttttctctgttcgcctcaaaggcaaagaaacgcccagcaggcctcaagagacgaggctctgaaaaggattgcaacgacatgagtcttgccggcaacagcggcgcggtggcgtcaacagagctcgagggaaagctgagaggtaaacgaacaagagaggtgagagagagcagacggggacctagttcttcagctgattctttttctgtgtcgcttccgaatgagtttttcttcgcatctgctcgttgtctgctgcgtgcaaga

SEQ ID NO: 1293 - DNA, 4026 bp, Toxoplasma gondii
agcagatatggatatgccctccagatatgtaacagtaatgtgatcccgcttgtgaagacccagtggtttgtggaatgcgcatcggttttgtcgcgcaggggcaatgacctgcttaactgcctttgactatttttcaattcattcttctgtcattctcccggggcaatcaaagtaggattgtattgtcgatgcgggtggggatagtgaacacctcgttttggataacaggaggggaacaatggtgattgtgtgtggtaccgggcgtttcaaggtccagtgactgaaaaagctgataccagagaattcaattcagcaggcgtatatggaaatacgacgtatttcctattctctcagcgcagttatacgctgatgcgggtagttattcgagaatagaaaagcaaacgaagtggccccaactccgcgatgttctagctggtgaaacacatttgcggcagtgaaacgacgtggaaagtggacaaccatttagaagaggggagtactaaccgcataggtcgtgtcagtagcattgcctttcggcgttgtatggtgttgatatttccagctgcgaagcgctgattccaaagtatgtgttctgagcgcgcacacctgctagagagtgcgctaatgtccctctggacgcccccggaggctccaccgctagttaggcagcacagtacaaagggtcaagtttgacggtgtccgttgacaaagaagcaccacaggtatacaggtgtgttagaattaggaaacgcttcgctcttttgcgctgttttatggcgggttcgagtatatcgttgaagaaacacgtgacgccgcgagcggggcgcgcagaccccggtacaattttgatctccatttcaatcgcaggaaacgcacgttgtcgccccggagctcgcttgccaatggtgaccgatcgaactttagcttttcacaaatcacgcctcgaaggttgcacggcatacctgagcgacggtctcacatttttgcctgttgccgcttccgactcctctttgctcgtatgcgcttcagtactctgtatgcaatcggcaatgcgggtaattggagacttcggcctgagttactatcacgtgaacttcaagggttgcgtctcacttgtccacatgccgattttcctgtttcctcgttgcttccatcgaggtttggcatccgtacagaatctccctgatagatctcagatttggattctgtgtgtctgcatatctgtgaccttctgagggccgtctggtcccattcaggagaggtggctttgtgccgcaagttcagacacattcgcgtctgtctcttctccggggatttttcttgaaggaatacattggcgctgctctaggttagtggaaatatgattcgaaatttgcgctgagaagtttggaaacttcgcagtcatcctaccaagcgaaatcccaggttcttcttcggcatacggccagcagcgttactcgacgttagttcagttgcatcactgtggagctgtgggttgaaagcgcaagccgaactagtgttgctcgctagacaagacagaactgaagtggacgtcataccgcaaaattttcgcgttgttctgcttcctcgattactctcgcggagatgagaatgcttatactatcaccgttagccttgttgtagccatagcgttatccatttgagtgagagaagcggtccgcctcacatgcacttgcgaaggctggcctcttccgccagaagcaacgttcttcacctgcactcgtagagttaaaaggtacatcaacagcgatcggttcaaaaagcacgtcaaccacgtactgatcgtagtctttcccgtaaaagagcttgcctgccgcacacaccatatgttagcccatacgcgttatgtgcgccacacacactgtatcactcttttaaccccaggttcaactgccgaaaagcacatttaacctggtgttccttctccaaagctttttcgtcaagttgtagagttttgagagagacgtctgctcttttctgctcgacctcagttatctcgtgttgcagcttcgacaggtctgcatagcgtgggtagcttcgcaggcaaaaaatcacgtagcaataaacgcctacgtgttcggactatttcccaccgttcctccatcgccttttctgcctgtatttcctggattcttttttccatctcttggagaagacactccaactcgaacataattttcaggttgccccatctgcccatacactcatgcaatgcgcattccatgtccgggcgcgttggcgcaaaagccgcatcatcatggagctcgatcgtttccgccatagcaaggaagaaatcagataagttgtgaaatgcttgtcgaactttgatctagctggttctccgcgaaatgtactgaggcgttgtactttgtgggtgagtaaatccgcaacacatcgaattcaaactcttgttcagcagccgcggcgccaacggtgccagctcctgtgtacagacggcgtaagcgttgagttgacatcatggcaacaaacgcttccagggggccatgctcaagtgcagcagaaacggtctctttttcgaggtgacgtttttgcctctatcgcttgtaccacactgatactcttgcgcgtcgccggtgctccgaaagaatgcctcgaccgactacccaacgatttttcatgttcctcgaccttatcgtgtactggtgcaagcatatacaacggctttgaggaaaaactcacattactctttccttacttcgaagtgactatatgagacatcactgctgtccactgtagtgcaaccccaaacggcgggttgccatcagctacacagatcgttcgttctttcgcttcagagctctgttgatacgttcccttcatctcattcctgtgtgcaccaccacctgacgtgccggaagcacgtagtcacgacattacaggcttccaccaaacggcatttgttgttcccgctgtgtaccacacgacaccggtctcaactccacgtcctggtgtccgaaacatcgcaaaagacggcaaatgcctccaacgggctttcgtcgtctggtgggaaccggaatctaccacacagaactctagaagttcatgccaaccccatccgtttccgcactaaccgaaatttctggttctctacacgttgcaataaaaagtacgtttcaaagtaactaaatgccagttgctgcaaagtgcccccctacatactcttcatacttcagtgatgcaatctatgtctgatgaacaccagtaattttacagcctgtaactctatgtggcggagtcttgggcgcatgtaccgcggcattcgtgctgactgccgcaacatcgcatatgaaaaaaacaatgcaaccccccctttcccacccccaccaggttttgggacgcactcaaacatgttacatgaaaaatcctggccttgcctccctgttcacggactggtgaaaaaactgtacaagttgctaacaaattccaagctgtgagaaactgatgctgctatatagaaggggaatttctgtctctcagccctgccaccaaacgacgttacatgtaacacgagacaaggtatccagccagtacttcaagatggaaccagtttccttaagccgccactacaactaagcaggatcaggctgccaccatccgcttgttccggcaagaaaggtgccgaaatgatgatacagtacgccatgcagcaatcatcgagacaggatttgggacgcatgactccctcaggtggttagcggagaaacctcagatccctcggcgcgcgacgcgtgccagagcgcgggacggggtggcaacgagacacgtttggataaaggtcctgccaggttgtggaatcagacgtgtgggctgttccgtgtcggtttggtttgtgcagagacgcactgacggttgacgtcgatcggcactcgatcctaccgtcagtcaattttattttggtttttgcagatatcatcgcgcgtgtgttcactctaactgtgtgtatggttcactgttttttattgcgattttcgtgaagtaacaaaa

SEQ ID NO: 1294 - DNA, 2994 bp, Toxoplasma gondii
gtggtagagaacccaaacagcttgaccaggagctgcgacagggatgtctgtcgaggccttccacgggcacagagaagaagacgcagaagcagactgcagcggagagagagcaggaaccgaagaatttttggagagacgcccggattccgctggagagaggcgcgctgaagaggagacgaaggcgggagggaagactggatacggcgaccgaggaggaggggcagggaaggaagcagctggaacgagtgtttgacctgagcgcagagcggagcggtcgacgcacacagtcaaaaggatttgcggatcagggagttgaaggcgcaaacatgcacttggttcttcttcgaggtctgaacgcgaaacgcgtccaccgctcgctcgacagaaaaagcgtcgcccacaaagcagaatgcaggtgcgcgccgagggaatcggcatcgcttttgcgcctgcgtagacacgcgtcattcaaaaggcgcagagtcaggaaaatgcccgaaggcagcgcaacctggactgcaagtgtcaatggagatgtgaagtgtctgtacagcgcctgcggagagagggtggagaagcgggggaggatccagacagaaggagaagacagacggcgactcctctgcctgtgcttgggtgaaagaggtcgtgagagctcgccagatgcatccttctatccgtacaccgtagagagggttggagtcattgcacagggacgctgtgtaagatctcctgagaaacagttgcaggcttttccctacaacacttggtcgaagagatgccgaaacaattctggtgggcaatgaagacacttacctgtgtgggggttgatcagaacgaggaggggctggagggcgtcgctgctcccttcgtcctccatggtgttatttgcgtctccttgtgccagccaaggcgagagttccacgacctgaaaaggtactggtcaccagttcaagagcaaataatgtgtgttcacggaagaaatgggcagagataaacgcaacgcgggtggaaaaagggaggagggcggagaagacggtgtgcgacagaccgcgcgacagacggtgaagaacggcgcgaaatacgcgtggagaggtgacgcaggagacaagaaggacacagggaaactgagagagggaaaggacagaataatcgagacgaaaaaagtgacagagaagcaaagagagacaaaaagagagacagtttgtcctgtgagaaaagacggagcaagctgccatccagttgcatgcgcagcgataatggagacacaaggatggcagactcgatgagcgagtctacggtgcttctctgaccatgtagaagtgaaaaccgagggagacacgcaaaaagaaagggtgaaaaagggcgtagccagagggaaacgccacacttcaggagaacggagaacatggaacctgctaatgtgcaatatgagcacgaacgaacacaggaaactggtcttggcgcccaccaaagtggctgggaggccgcgggcggccactgcgaagaatcacgagaagagcaagtgtgcaagaaactatacagtgctagcagcgatttaaatatatcagttttctccccctttctttccggacctcttaatcctcacttttctgacttttcgtccgatgtctcacccccctcccatttgccgcattcgctggctagcactctgccgttgatgtttgccgccgcgcacgcatccgggggatgggacgaagaagagacaaaagtaaatcaccaaaagagatgcagagtcgggtttcagtgagcaaaaagaccatctggggaaggaaactctatcgaaagggttctacggcacctcagtttgcggttttagaagtgcagagtaccgtggaatccacgggatcgacatacacactaactcgaagagctcttgggtcgcttggatgtctttcggccgcatgtaacacaggttatgtgaagtcggtggatccgatagtctctcgctctaggcaacgcctcgtctggcgtcgacaaagcaagagcaacgccccgaagctagttggagacacacaggtcgcaagtgctgcgtgagtggaaacggaaaatccagaaaactgtgggcgacagagagcgtgtgacccgaagaaagcactagttgcagcgagagtgagacgtctgggcaacaaatggtgggcgatgaatcgtggaacctccacgctctcgatagagctggttttgcctacagcccgggcaaagtccccaaggcgtggcatgtgtccggtggtaaattcacgaagatatctgatttcccttcctgattcacaaaacggctctggggtgaaatttccggttgagccgccatattgggatcggtgtcacatgcacttaccgccgtgtaccgcatactcttgtcggcaacgtccgctaaattgggtctgccgatctggccgtctcgctaggttggtgtgtggtaacaacctgcctttcgaggccgctgttcacgacaatcagtttcgtcacaagaacgatggaagctactgggcgctgcagaccaacgtaatgttcataggtcttctagtgtctagcttttcatcaacctgtgtgcacatttatagcccacgcttgcctgtgaaacagtagtgaggagaatttgcgcactcctttgatgtgtactttcgaacaccctttgcgctagctgtttgtgagctagctggtgtaccccaaaatcgtctgattgtgaccgcgtgtgctgaacaacaaaaaaaacagtttcacattcagcgaggtgcagacgctgcataacgatctagaaagttctactttatagctgtccatgcggtacagattcgtttgcaatgacacttttggtttataaggcgccgggaactatttccgcagatagaaagcatgcattttcggtcttcgtccgaccgactgcacactcgaaatcgtcagtgcgacgatgacactgctggcacacgcctcgactaccttttttttactacgttgattgcgacgcacccgtca

SEQ ID NO: 1295 - DNA, 3498 bp, Toxoplasma gondii
acagagatgcagaagcgaaggaagcgagagagaaacgcgtgaaaaaagtcggaaaatgaaggtcgaagcgcagacatggatctttcggggcggccgccacgtttgacgggtttctgtgtttcgtctttgaaagacacaaaagtgggttggggtgaaccgcgcgtttcggcttttcgtaatttggcttcttggacgttttttttttctagaggtcagaagctccgctgcgtcccctgatgaagccttttgttgatcccaatattgccttcccgtttgtgtggggaaattgtcaacctcttgcgattccatgtacaccccagcctaccgtttttcactgcgtttgtcaccacaatctcgtcgagaaaacgagacatttgaatcgaatatcatgcgagcagaaacgacgctgcaataggcaggaaagcgaaacgcttgcctgaaaagcaaagcgagagaagcaacaggctgccggtaaacgtgaaggcaaatccgcgcgctgcgtcgcgacgcttgtggcagtgacggcactcacaaaaagacagatatctgtgataagcagtcagacgcagccacagagagcttctgttttagaaaatttgaaaaatcacacattctgtacaaggttcgctcgttcttttctgctggacggcaacgatccacctagtttgtcgccgtaacgagggtggtctgttcagctctcggttactatcctatctatatgtatatatacattctttaatggagcagattctatcgtgactgtacagggagagatggtaagaaggcgtcgatagaagaagttaagggaggaaacatcactgtcgcttgctgtagacggaagggtccacgctagcgggaccgtgatagagcgttcctgtaaaaaagttttggtataagacactgaaactcctgatgggcctatccgcgggtcgcatcgctcgacagggtctcaagagattgatttccaattgtgagtggtttttcaaaaacaaaagtcaagtgtcgcggctcctctaatttgtacaacactcgggcgactcttgcaacaccttcagatagaagcaccgcgaggccttacgacgcctcttactttgaaccaagtggttttgacggcttttcaattgccagatcaggtggtaacacacaaaatcccgttttcttgtttcagtttaaccattcggtgcacggcgtcaagctgcggactcgttctgttacgtgccaacgacgcttccgctaggtgcaacagtgaaccaaaaactgcattccttcgtttctagagatgcagaatgaattctagcgttgccaactgctttgcagtgagagtagactcattctacttcctgcccactgcctcgcctcctgtgtcgacattcaccatatgacagcgggggcgtcgtgtacagcagtcatacagaacttggtgttctgtatcacatagatgggatcatccttagtatcctaggtgcgacggtgtgcgtctttcctcttttccttcgattagagttatccagtcctgaagcgcagatcagctgcacagaagcaacatctactgcaatgcgacaattacaatacagcatcccaggtcctccagtgtcctggtttattcgatttgagttctactcgatttaagttacaccgtcctggacagtagataatctgtacagaaacaatatgtagtaattacagtacagagtctataatgtggccattaccatttacggtcttgctgtcatgtttatgttctttgtgtcggctttgcccaggggatatcgctcacgtttcgacttctgcacacgtggggatgtgcgatcccctctgcagactgtagcgagaaatgcgcgacggcggcggggtggaacacgcaggccaaaactgtgcatcagtgaacttgcttttcctctttgctcttaagttctccccttcctgtgtgcgcaggtcccgttcatgctttgtagctctgcacccgaccgtgggcgaccgagacacgcgagagcgggtctccgccctctacgcgtgtttctcgatttcgttccgcttttctgcagcttcatttcacgagtttgagtgttcacgacaaacgctcaagtctattgccttcatgggaaccgggaaagggcaaagaatctacgcagtttcgccggttcagtactgagtgggccaagcaacggggagcttctttggcgccggctacgcgacacgcccgcgagcaaaaaacggagaaacgtgctacgtatcctcgcccacttaagcgaagaacatgccgctgtccggccaccatcgtttcgcgcgaaaaactccaactgaagagcgcgacaaaccttagctggaccgcggagaaccaccgaaccccctgattctcatctcggcgcggtgtacgtacaccgcagctgcgcctccccggttcgctgtccgggtttagaggccgagtcgtgtgcggcttaccgtatacggattttcttttcttccgtgcagacattcgtttttgtctttccgttgcgttgctgcattctccctcttcgctctggttattcgatccccgattttcgctgcgaaactcgttggtttatcgctcctgcgtccgctcccgttcgctggcgctagatggccacccctcgcgtttggcattgactctgcaagggaggttgagccagtttttgactctactcttctctgctttctgttttttcctccggaggaagccaactagcggagactttgcggggaattctctttgcggcgttgttggaagttcgtgcgcgctccagcactggcggtgagctggtttgtcgcttctgcgcgcatgcgccaggattcttctacagcggcgagaacccgcaacgactgctgtgcttttaccggagttaaacacgcagttgtcttacttcgcaccccctcccgatctcggttcttttcatttcgttccgtgaattcgcttccccccttgcagctcccgttccccgcctcctcgccggcgccgctgtgtagctccgctgcaccgcgcccgcttttctggtcattttctctcttcgtctattgcggcgtcttcactgttcgtctccgtcagggcgtttgtcctcgaggctgtcgacaacctgcgcttgtatcagggaaggggggcagagaaactcagaggaaagacccatttttcgacccgctgtcgtctcccgttggctgccacgctccttttctctacttcaagctcccaagttctactaagactcggttctcgtggcttgtcgtgaccttgcagtctctccgtcttgtttgtttctgtcttgcctgtgttccgtcaaagtcgtgtttttcccgaaccccctctcctctgccacttccgcgttcaagcatttacctctcgcctgcttctcaaactcgctgtaaccctgtgcgcttcgacctgggtgggtctcgttgcctccaacgagagtttcaggtctcattctttctttcaccctcgcctctcgtgtctcctaagcgacgtcccctactccccagtcacca

SEQ ID NO: 1296 - DNA, 2653 bp, Toxoplasma gondii
cagtatacggatacagacaagccgtttccctgtcgccaaacttacatttggggggttcttgctaaggataaaatttttgtagaagaaatgcccggaaaagactcctacgaatgcggagccgacgactgccatccacttcggtccgttcagggcgtacttgacaggcattaacctgctgtggaaaaccgcgcctgttcctgcaggctgcaggtacggacaccacatatgaaggacggcccgaaggtttcaatgaaaaagtgcccagatgaaaaaaattgaaggcagacacaggcgatgcgcgaaaggtgttcagtcgaaaacggagagcgacgttatcacgctgtattccacacacagtcgccccgtgttggaaggcgcaaacgagagcggggacaggtgagaccgagaccggaaagaacgaaaacaggttccagaggcacaaaggtcgggttgcctgttataatctcacgaaggaaaaatggacgtacttgttcgaagatgcgtcagaaggaaaaggtttcaactgtttgcgaaaaactcggaggcaacctgcacacgggggagacgacgacacgaagtgtagcttgccccagttgctgacagacaggtttttaaaaggactcaccgcagttggcaaaggagtggctgcatctagcagacgccttgaaatccgctacagacgaaagaaacacagaatcgcacggaaagaaagattcttttgtcccgcaagtgaaaccggctgtgcatcacccttcgccgaggaaccgcgcaggtgtcactgttcacgcgtgaagtcagccaccgcgcccgccgaggaaaagaagggccgagagacgaaaaactgtcacggaaagggacgacgcagacgagagaacagaagaaagaaaggcatgcagattcggaacacggccaacatcgatggccgtgtgttcaagagtctgaacctacgccgtgcgcaacggaacagagtaccacacatcacactcacggatgcggcagaaacacaggcgaataacagtatcgtgaagaaacagactcaaggaaatatcgaatgcaatcttcagtagaaaaagcacttgtgtgtgtattttctggagaactttgtgcaagtaggaccggccacagacggtgcctgttgtgaacctcaggcattagcaaatcaaaattttttacagaaacacctggaaattgattgcttccgcgtcattcagttctctgtactctaagcagctcgtgttcagacgaaagggattcctcatgcggaaaaacaatacatttctacaaatttgcgtcttgcggatctcttaccgcagccatgtttgccagacggtcatataacgtcgaggtttgttctccgtagcccaggtgtcggtcgaatgacgatgtaagcagcgacacttcgtcaacttccgcgccgaaagaaatctctcggaaagctctggagttttgcttcaagatgactgacggcgcatgcaaacggacaaccgcaagtctcctgctgggctgcttggcctcgcgctcgtttcgtccttccctcttgttcattccgttcaactcctgttccaaggtgcccgcctggtccccctcgcggtcgggttgtcgggttaccctttcgcttttccgggtgctcgcgcggctgcgtttgtctctcgcagaagccgttgcccggcggacccggtgccgaacacagtggttcgccttattttcggaatttcggattgtcgtgcttgtgcgcctcctgtctccgcagggcgacagtcgtcccttcctgtcgcttctgcgtccgcttctccaccttcgtccctcccacgtccgcgtcgtccccaagtaatgttcatggggtaaatgtcccgtcgagaatgcccaaggcgacgaatcatatttttctttcttcgctctcgccacagtcgcttggactacgacgcgccgtcgttccaagcaaactgcagtgtgcgctggtaccactctttcccagtcccgttttcgtttgaccccgtctgtggcaaagcaggacgcctgttctctcgacccaactccgtgcctctctgtcgattgcccttatcgcgggaggtaaagttccgcactccatggcccagtgattgtcgcgtgcatgtcaccgtccataagcattccattgcaccgaatcaagtctcgtcactatcccgatgtttccattttccccgctggaggggcactacacgcattcctcctgcctcattttttgtcccgactaggcactgcttggccacgcgcgtttgtactgaactcgatgtcattgtgtgccgaatgccttcgtaattccactggcggcgccgctatatctagttcgtccgtgtcgcaaatttccacacgcatagtaaacacatgcatgcatccgcttgcatggccttgtcgcggcacggaccatccgaggacactacagtatttgttacagcttctggctttacttctctctatatacataggtgtatacggactttggctcagagatacttcgtcctcgttcgtcggggagatataagtggccgtggttgtgtccaggtcgtgttgtccgttacccatgttgctgtaccagtggtgtttttgcgtggcttgttgtttccgtgcagaggttgcttaccgcctaccaacttttccctaacgtgaagcaaaa

SEQ ID NO: 1297 - DNA, 2776 bp, Toxoplasma gondii
cacactgttagtgggacttgatttgccactagatgcttgagcaaaccggggtcctcgaccgctgatgtgccgtggtcaattcgagctgcgtggttgtgcagcaaggcgtcgatgacgttctgggccggaccctcctctcctgggaaaagtgtgaaacacagagcaacaaatacatgtcgcgaactacgcagtttcgtgcaaggcgttagggcgagcgaatggacaaaaactttagcccggaacctcagaatcgcaagtttaatgtgtacaccgccgcggcatgtctccgtgaaacgttctcgtctccatgcagatatgaactggcccaccgacttcctgtttatgacagcgggaatgccagacacgttccctctggtcctgaggcggtgttccatgaaattgctaacctgcgtgtgcaacgcacggaaatcccttctgctttacgagatcgaacaccttgcggaatttgtagttttcatgcccaagttcagacgcggcgagaccgaaaccgtcgaacagcgacatgtacggcgtcacctatgcacgggacaagaaacacttgcatgcagggactgattacacagtcaccgaaacgcagaatacagcagaggggcagcaattgtctgaaggctgctaattggttctgagtgatgccaaaacctacacaccacgtgaccatctggaacttgagcaggagaaaagaaattcgacaggttacgagttaaagtacctctctgcagcttaccatctccacacattccaagtgtttcttcagagggaaactgcggataaaacaaaggatccgccgggatgttacaccccacctcttctccgcctcgagacaagcgtcatacataccctggcaagttaaggaacaatcacagcagcgcaaaatttccaagagcaaatagtcactttaatgtggggtgatgagaaagacactcaagaaagagttcgcaaagcaaactaaaaagccacaccagggagacaacctcgtgtaggagggccacgcgaggcacaccgacatggaggaatggacgcggagaactggtctagcacaggacgagaaaagtgtccgcaagcagatacgttgcagacaacggacagaagtcttctgttccacttacttgaagagcgtcccgtggcggggtttgcctgaatggagactggaagtcgaacagcagctcgatgtgccgcacattctgggctgcggacttctcgaaatagcgtagcacgacgttgtagatgtcttcccgatggcgtagcacggactcgcggtgaaagtacgcagcgaggaacgagttgagatctccgaatgcaatcccgttttcgtcgtcgttgaatgcctcctcgcctgcactgcccattggaacgccgttctttgtggcaatttccttcgcgagagtcgcctcgagggtgccctccatgtgaacatgcagctcaactttcgggatcttgtgcgcgtactcgagcaacaagtcgaccggcacaccgtgcccgcagcagcagcagcaatctgccctccaaagaaagtctacatttgttgtggaagaacggccgttttcgtataccggtgccgacaacctggcggcattcgcgaccccgttcggtgccacagccgcgttcttccaaggggacgactccagagctacgtgcgtcgtcatcgtcgctttcagcgtagtctcctactgagcatcttgcgctctgcgaatttcgcttgaattgacacggaaggtgttcatcgagggacgacgagtgcaggcgtcccggtgcgcgtccagtcaccaggtgaggaaaaacggatgtggaggagggccccagccgcctgaagcgaggctctaaaaagtggcgttgcaacagcaaaccgctacctgggtcacgcagcaggcccgagagcaacgtgaacgcggttgcacgggtgaccatctgcaagttcactcagccggcacatcgccccctggccccccccccccgcgtctgtggtcgggaaaaagctggtttccccaacttcataccttgccacgcggtcggtcctccccacggggggcgacctgctgttcccgcgggaggttagttccttctttgaaaatatgctccagcgtcatcgtttactgctttcagaattgcaaagcactttcgaacgattttacaaggtgtaaagacgggtattctcaaggtggcgcagccagagttcctagcagcttgcgaacgcaccaccacgtggaattgcttccgggagagctatcctgttgcctgcttccgctttgtggccatctttagatttttcatttcttctcagcgctccagtcttttcagtaaaggagagccaatctgtgtgcggccgcgtccgaaaaaatggtcgtcgaattgatttcgcagtaccctttcttgactggctgcactagggatgactacctcgatattgcggtctggaagtccgtagctctcatatgctaactttcctcaaaaagacatattttttgtttgtgctgtgttggcactattgtgtttcttaattatttaggtgtttgttttttcgttacccatcagtggacgcgccggctttgctcgctggcgtggccgtctcccagcttctgcgttgtccaataacaccggtgctgtctatttctgcgctcatttcgcaagaatcgcggagagtttcatctcttttgcccgtatcttgtcgttttcttaagaatcgaagaggctatcttcgctgcgactttagcctttctcggtccgcccttgctgttgaatctcattcgtgttggcatta

SEQ ID NO: 1298 - DNA, 1995 bp, Toxoplasma gondii
acaccacgaacgtgaccggacggcttcggagagtgttgtggtggaaggctgcagtcttatggaataataccgtatcgcggcgttgaatcgcgctcaagtgttctttccgtgttcttagagatacagcgctgtcgacatgtagcacgacgggtgtgttttgtgtagttgctttgctcgtgttaactgtctcttctttgcggtttgtgagccccttctccagatccggcactgcgtaccggactgctgcagctgtaacatcccgtgaagtggatgccactgagaactgtgatcgcgcaacacatttcctcctatgtgctcctgaagggctccgtgctgtttgttacctttttcagccgctgccagttcagcaccaacagaagaacataagtggcgtgaggcacgagcccaacacgattgtggaccagacatgtatgctaactaaacatatgttttctctgaagcacatgacattcggtgactctgtcttcaacagagaatgaggcagccactaggagtcaggcaaccccggaccattcgctgtggtgaagcggcagttccatgtgcatatgcgtggagcccagactgaggccgcccctcgaaatatgacagcacggagtcatttgcccagatattttacggacaacaagcgtcactcgaagtagatgcactcctttcacgaacgatatgctatagagcgtgtacctgtgtggactgaaatgtgcacaataacaccgccaggctcctcttcgcagtggtgtatgcatcccttcatgttaaaaaatgtactcgtttcggacgcctgaagcttagagttgctgacaccctgacattgccgcatctttcagtcccctgtacaccaaccaaacaaccaaacctggtgacagtcgctacgcacgacctaatacaggcgcgcaggcctgttcggatgctgcccgaatggaaagtccatcactttattgattcataggcggtcctgagtgattttatcactgaatctgtctcgattgtgacgttctctctctgagttgatgtaaatttaatcactaacaacgagaagtcgtacgtttcgagtgttccgcggttgttcagcacgctttcagggtccacggctccacactgcgtactgggctcctgtcagtcatagttatgtggcatcacttcggtgattcatcggttgtgcttgtacttgccatccgcgcaaaaatcacactcaactatcatccctgatacggagaatcaacagtgggaactcgctctgtcacagcgttgagatctcacgcttcgatgccgtttcgcgtggtcgccagatagggacgaaagaaaaaaaataggcgaaaactgtaggggaaatttaaggtgtcatcgaaacctttaccgtcgattgcgaaacggacaagagatctcctctactttccacacaggacacagtgcatggcttggagccatgagaacctcaagtctgaatttggggttgccagtgcggttcgcccctctgtggagacgggaggagtaagacccgtgccccgcatgcggtttgccaacgcgccacttcactggtgagtgaggcggcgccagaagccacgggttttcgcttcagcgacgactgcaattgaagtggcaccataaagagcttgcgaggatgagcaacctattgtagcaagattatttcgaggcttcaccgttttgggcggaatcagttccacttttctggaagcaggtgttttctcgctagtaagtaccccgccaccgtcacaggctagccgggctggttcccgggaatcgaagaaggaaagccggcgcttctttgccgtggaaccggttcttcgctttatacatgttatagagcaactgtaggaaaacgcacgagttctccggttgtcaaacgtggccatatgacgggctattaaagacatttcgaaacaacgatatcgacacgttcgtcggccagttaggcggttttcaattgagtttgtccgtctctgttgggcgtcatca

SEQ ID NO: 1299 - DNA, 4535 bp, Toxoplasma gondii
attcgtttctcatattctcggtctacaccaaagttacgcctgcttcacggcgccgaagattcaccgccacggacatttgattgcaaaatggccaactactatgtttcaattttcatctttttgggttagatgtgccgacattactgtttgtcgaacgcccgaggatgaattacatgtagattaaagatccgatgactttagctggtatctcctatacaggtggtggtccgtcacgtcccccaaaacaagttcgatgacatagacatgcccatggatagaacgagagtgactggctctcaacaaggactcgaggtccactcagcgttgacgagcgccaggtatttctcagcgtttcacgacgccacccaccgcaggggtgtaggaggtgtcttgcaagaagacacagaatgtaaatgtaccggtaaatataaaaagcaatacggactacaccctgttcgcctcactgcaagtgacgaactcaaaagtcactgctggagccccccagtcgacctcttaccgaaggagttcgcggaaggaagcacggacgcattggcgcacagacagttacctcatgagacaaatgagaggacggcaatctgaagggagtgggagtggctgtaggcaaaaacttgtcgcttcgttgtgggaggcgcacccagtcgtatttctctcaggacccaatcaagcgacattatccacagtttattccaaacttgcaacagaccgcgggagcagaggtaatctgagaggtaactccgttcttggaaatcgtcagactttcgcaccctctgtaatgcctgttgagtccttgcaggaaggtgatgccaagagttcctcgccctgcattctgctgtatgcaagggacgccgttgcgcgcgtatctttgcgacaacatgcatgcagatatggatcattcctccaccagttgaaagaacggatgctcccgtatcaatgttctgctgtctaccgcgttagctcgtgcagatcgaggagaagcgtcacaacatccagaagaccttgaaactcttgtataaggaacagacacccctctgaagcgaatcgactccccttcagacttttgagcaacttttttctgtaaactttgtcgtaggcatctcgtgcttcctctggttcctttctgactggtcttttgaatttgaattgacgctcccgatcgcgtaagatatcagacagtgtctcccaaagactaactttccatccacttggaggctgaaacctgttggtcaccgttgaggactcctgtgctctgatgggatcactataatagagacaggggcagagtgcaaggcatttctgtgcctttggggactatggtgaccatatcaatcacgaacgtctgccatgtggactagactacgaagtttcacgtctctgggcacaagttcgatgccatacacgtggtagcccacaagtctttttgaccaggctgcatatcaagaatttcacaccgtcgtcagtgaggggttttgcccaggatttcgacagactgggacccagaagcggcattagtatcacctggaatcctaccagcagttgctcctgtgatctatctctgagcctgccgagttgtggcgtagggagtttgacgctttacggatgcgttgaatcgagcgtgtagtctctgtaggtgagggcaattccatgcgctagaggttggtcttccggtgttctatttaataacatctgagtacacgcctcctgtctctgcaggagacgcagtacgaaacggtcttgtttttccacgtttggggtgctagactccacatttgatacgaaaagcttgcctacgtactccttggcgcagtcaagtttcttatatcttgcacaaggcaaacaacaggggttcctcctgaaccgaggatttgacctacgcggagttgcgctctgttgcctccctcatccatcgcatggcacatggaattaatcggagtcaagtcctgaaaagcttctaaaacgtttcggcttgtgtggctgtccgcctccagtcgcaggggcggacacaaaaacgacatacaaccgctccatcttctcccataagtagctttcctgttccagccctcccgaagcaacttttgtctctcaatccgcgcacaacttcctaccctgctgtgaggtccgaccgttttactgataccgccagatcagtcacctatggaggccgcagccggggagtctcccgcgtacgaacccgttggccacggtttaagtcaacccgcgagcgacgccatagaggagaaaacgttctttctagacgagagcctcccgcatgtggtgtgtgtttgatgctgggtcgggctttgaatctgttttgtccggctttgcatgagtctgggcgaacgataaactctcgactacaactgtttcccgagcggagagtgtaagaactcgccggagcgagagggagatgcacaaaaaattctcctgtccttgtttctgggaccgcctgcaggctagaccgctccagaagtgcgatttgttttggtgcacgcgatctgaaagccctagcgacggcgaccaccaaaactggtgccatccctgggcgcatgacgcacatcgcatccattgttgttgagcactgcacggaaagaccgctgcatggtttcctggggatgctgtgttcctatcgtgaccgtcaccattcaattttctgcggaggcaagactttgggatgcacagcgggacaaaatccacactgtaacctgacagtggccaaggctgatcgatccacagaagctagtcgataacaaaaagagacatcgccgcgttccggttttttcagatgacatcagatccgaggttgaacgcgctacggctgtttacacgttagcctttcggaccctgcgacgaacaacgtgtcatcgctgaaaaggctccgctaactggcaagcgaatacagtacaagacatggtaccgatccagcctgtgaggcgtttgcatggcctggcacggtgtcggtcagtgacgaagaacgtacgcgactctctaatcattgtctgccctgttacctcgcccaaaatatgcaactggctgcttctgcggcatcggcgaacaggatgtcctcgtgcaaattggtgtcaaacgggcggagtgaaactgccaagctagttatgtggtctgcgtgaaacctaggtagatcggtaatctaaagacggcacagcacgcccccccatcagaaaggcccaacacttcaccctggccgtttctgatgcgtggctgtggcgcgttatattcatgacttcgttccttgcaaccgcctgccaaaaacaccaccctgactaacgcagacctccaaaagggtccgacaatgcgtagatcggggcgacgaatctattccccggtgccgtatcgaaagcggaagtaccctttgtaacgaatagccgcgtctcttactccctgcccaaatagttttaggcggtcgtttctttgaacgagatatgccacgtaaagacaacgaaacggtgtgtgcggggtcgcagctcaattttgtcgggatacccacaactgcagagaacagtgggtttcggcagatttggaggacgtggatggtgactcggatgaggtgttcagccatgacgaacgagaccaattcacacaagtctgaaacccgcggattttcggcagacaagaacaatcgcgcggacccagggaagggcactccgcgaccacagtgcccactttcgagccagggatttaaaaatcttcggaacctctgggttgctgtcttagaactgacgtaagaaactacagtttgggcaatcagcagatccagaccggtctctttgtggaagcgaaagcgattcgctcgccggtagttgcagcgtatgtgtccttatctcttcctgttgtggcgacgaccgaggcaacacagtggtgcagcatattaatgtcttcgagaaatactctttgtgatgaaaagacgagcctcgactccagtggtacacgactcctgcgatatgtcactttctatgctcgagtttgccggctgctgaggtgcggaacgcacccaggaactaactccccattacacatgccccgagaggccccagtcactactttcgagatgttgcttaggccgagctggcgaagcagcgctggtgcctaagctgtatttctatcgaacattggcttttcattttctctacgctgtttcacgtggattgcggcaccgcgtagcgccgcagttccccgatcttctcgaccttctcatgatgaccatgcgcgggcaaaaagctaacgtgaccagcaccgccccgaccagagaccgccggggcccgaccttctgcgaaccgtcaccactatccatgtcgccttctttgcgcggtggtcgcttcattttgaatgcatgtgcttttcagacttcttcgccttctgatggacctgaaatggttagaaagacggcaacaacgaatcccaatgaggtgtgatttgctgcctcgaccgggcaaccgcgcggcagccactgaggaaggcctgaagaggccgagcaactactttctgttgcgaatgttttaaca

SEQ ID NO: 1300 - DNA, 4787 bp, Toxoplasma gondii
gataggcaaatctcagcagctttcctaacggagtaacattgggaaggagactagcaaagtcagaacctcgagatttgtgcggactgcctacaaacgttggttttccaaaactacgtgtgttgccactgcacttaatacacttgtccttcacacagaggagaaggcgaacaaaggaaccactgcaaggagttccaagaagacattacagaatgaccctttcgacttactcaaaagtcacagaggccttgcagaacagtgtggtgcgggtctgtgagacgattatgtatcttaccagtctaggtgtgcagcattttcctacgttccttatcaccgcagctatccatctaaattgttcttggattttgccgtgttctaggtgatttgttgcttaccaataacgaaagcagcgatgcaagaatgattgcgagttacaaagtactttccgcccaggcgaagatcccatttatctctgatgcagagagaagaacacagaaggcaagcctgcatgagtggccgcgacaagcagccaaacaacgccgtcacgaatgcgcattcacaacagcatcggacttctctctgcatctcgttcttcctttcgccgttcgttttcacccatgggtttcttggagcagaaccgtgtcagcaagcaagtgcgacgagagagtaattcagcatgattgctgagttcttttcgctctgtttctgatgccttcgcctctgtctttcgtggctcttgtcttgcgtctgttctgctcagccgacttctctcacctttcgtccagctgggaaaagccgcaggcgatcagcctctgttgaactgcgagaactgagtggtagggcgaacctgtctcattcacaaaagagaggaagttcgccccgtaccttctgccgccctctaggagtgcagcggcgactgcactgctcgtgcctagcatgttggtgagctgccggagaacagagaaaaaggagaaacactgaagaacccgaatacagcgaaacaggaggagtaaccgaagagggaagaaaaatggcggcgtacactggagagaaaaacacacgacagaagacacctcagaaaaagatagcacggagaaacggggctcgcgtgcacgcagtaatgcgttatgtgcgtgtgtagaaaaggtatccgcggttgaaaagcgaggatcgggttagtgtccaagtaaatgcttcacaaccacgctatcgcctggggacttgccgtgtcacagagatggcagctgcgaggtcttccgcacagcactaaacaggatttgcatgcgcacacgactacacagtcaaaatgaaccgaccggagacagcgatgtctgttgcaaaaacctcgttttgtttcattcgcgtgcagctgaacacagttgcctttgccgactcaccagatcgagttctgtgccagtctgcatttgcatgcggaaaccaaagccaagcacgcagtgaggttcgcgtcagtgaactgttgaacgccattccataactgcgcagaaatgcgcacttcgtccgaaagataaagccttcagtcctacaaatccaatctctgatacccctcctggaacagatggacgaataagcgtttccgtcactaccatttcggatcacaacgagtatgttgctacagcccgaaaaacgacggacagcatgccgagggatgcacttgtttgtgcaagcgaagaccttctcaagttttgttttcggtgtcgcttgtccttgcacacacaaggtattctcttccccgtatgtgacactcggaactggaaaattcgctagccctcggtggaacacactacacagcctcacaagcgtaggtcgggagcggttaagtcccgttggctaggagaggagccttttcctgtttctgagaagagatgcaccctattacgtggtgaatttcatgtaatgtaacatcgatagtggactgtagtcagttgtctgtcgcgctacattggaaagtgcaccgctttatgacaggcacgctggaacgagaccttaggcggcggtaccacttctgttgttttgaggaccggttgtacagacttcttttctttttccaagttgacggaagaaatgaagacgaagcttgcagcgcacccggttctttcgctgcgacgccccgaaacgctgcaataaatgcccggtgctatcctttgcagaagcaagtacgggtactgtggactgactgaacacaagctgcacggggaaccatttgtaaaggttgattgaaatccatgagctcagtgttcttcgtattctgataacaaaacgacctgccgtcttttctggggggacatttggcggagaaaaacacaaccaaggcttaactcttgttcaagagtcagagggagtgtcgactgcccccgaaaaagtggggtttggtcctgccccgtagaagccactttgctgttggtagagaattcggcaaaactgttcaagaaaaaaactctgcttagttctggatcagaaaatctgtcgttttctaaattcccacgctggatcagccgtctcttcggactttgggaaccatgcaaagtcacgttgtcatggaaatcatcgtggaaacggagaactcgttgcccacaagttgccagtgcgaatgtttttcaacagacacctaaggtgccgggaatatacttggaagctttccacgcttagtcgtcgaatccctctgacactgttcagggttttgagctggcaaggcaagggccagccccgtagattcggtgctggtatttagtcagtcataagtgagaaggaaggctgacagtccagtgcttggtccgagatcagaagagacccggaagcagtatttctggcaggtttgcggccactgacggaccgactggcgtaaaatccctccgtccacttcggtcgctaagcagcaacttaaaacaacaggaggcaacctcgcgaatcaggaactctggtccacctacatatctagagaaaattcgacaattcaagaaccagccgtaggccaagaaatagagctctgtggacacatctccttgtcttcccgggaaaaaacaggatatatggcatctaagcaagttggcaaaaatgccttttctgtcgcgggcccgcggagcgacggggctgaccagaaacgttattcaatgaaggcgccctacggtgtctgttcttccttggtagatcgcttgagaaatccttcgtttcaaatgttcatattatcatgtctattgacgggaaaaacagttggaaggtgattgcggtcttcctgtgaggacacgacggcgagctgcaatcacgcaagatgatctggttcgcggtgtctttcgagcaatgtgaccccgtgactcttgtggctcgcgatcagtatccaatacgcaaactcccctgagaatttcagcgaaaaactggtttggattactgaaaagtttcggcgatgctggcgtcgccaagtcttgaatgctggagcgtaaggaaacgtacaactagctttcgggatgcggtaagacgcggcgtatagctgctaggggagttgccacgcggcttcttcgttttcgactcgacgacggcgctgattccgtatctttttagggttctgaaaaacaaccgctttcttctcacaatcgatcttcctttttccactctctttcgctcgaagcgcttctttttttggtctgctgcttgccccgcccacgtttctcgacagctcgccaggccggttgccgctgtttgcggcgcttcgctactcaaccaagactgtggtcgaaacgagcggaggccggctctaagatcttgaaaagagaacgctcaacagaaagggatggtgttttgtcttccggctgacactgtgcggctactcttggctcagaaactttttctctggtgggatgaagaacgcacgtttctcccgcagtcttcagtccgtcgctatgtctttcctcagctttccctgagcaaacacttgcctcctgactaggttggcgtagcgtttgacggtttatgagtctcgcgggagagttaggaaaagacgtgttctaactagaccttcgcatccccttaaagcgctggaaaagatcggggaaaaccaaaacgtttttccgttaactcgcggcctttgctgtggccctcgcggtcgcaagacacggcgagctgtgacagcctgtggcggccgaacggcgtgttctttcttcctgccagaggaaacaaacgcgcattcgtcttttccttttttatgaaaaactgtttatttagaatgatctctttctctccgaacgaaagctgattagccacgcgaaaagcacgtgccaggcggttctgccagccaagtcgagcgtctagaaagctaggcgtacgcccgtggtactgttgtgtgagtactttcttatgcatagcagaggaagcgcgtctttgcatacggaaggcccagtgcttccaaacttgtttggtctgccgtgtcagagtcccttctgcgtcttaccacaggtgccgcacgctttcctccgatcgtttttgtcttgtttctcgaccttcccacgccgagagactcaaggagcggcgggtgccctctcccttgcctttgttaggtcctgtccccaacttcacttcttcggttatcaggatcgtcgcttttcctcctctattttgtgtcgactttgggtcgccacttgcagaccgcatcggttccgctactgtctctagaggtttgtccgtcctatcaagtttatcccgtcttctttttcggcgatggcatcgagccagaacctgggtgtgaggctcttgcgcacttgtcgatagaaagaggaagaaaa

SEQ ID NO: 1301 - DNA, 2233 bp, Toxoplasma gondii
ttattggatccaacgtctactgggttcgcgtggtttccacgtcaccctgccaggtttcaaaactgagcatgatctccagcagtgttcccacacgttcatctgcaggataacagatatatatatatatatatatatatgtatgtagtaagagagacgtagaattgtaaatatacatttctctacgcatatacaatatagatgtatatataaacatacatttttgaatataaatatattaatgcgttaatatgttgtgttattttgaatgattcagattcatttgcttgaacactacgaaaccttagcttttttgtgggtgaacattttcatcggtgagtagcagtgtagtcggaagaaccccgttgtttgcgtgtcaagttcaatcttactaaagacagagatggggacgcgtcttcttttattccaagaggtcctcatttctcggcgttctttgttcgctcgtcatgaagaggaggcactctggtttccagagaacgaaggccccttgctctctcgcactgcgcgtttcctcaagtgtacactgttcccttctcacgcgattgccatctctcagatcgagcgcaagacattggcctttccgcgaagcactggagtggatgttccacgctttcgatttctctgcacagctttcgggtcttttcgtgtttcgaagtggtgcatgggagagagtcccgtcgagggcgggtgcacagcagaaccgtaaagaacttggttgtctcttatatctcattgcgggtcccctgccgtctcggctcactgggcagaatgtgcgttttgatgtaagttggtcgttgtgaattcctcatgtatcagtcaatctgtcaacaagagggaggtgcagagggagacagaacagcacaaatctaggagagctgcgggtttagggtggacgaaaaactgcctctctaacggtatagagactctagggctgcgcttctctggaaaaaagattcttttccggctttctcttgcgttgacactcacgagtacgtccttggaaatcctctgtttcttcgagactggtacgtgaagggataccacaagaacagtgaagaacgtgaagaccggctagctgttggccggcgaaccctccttcagagaaactgagacaccacttcgtcttatccgttaacatcagtctaatgcccgtcttttccgttgatttgcactgcgaacatcgggctaaagtgtgggggaaaaagcttcattcttggaaggaacgcccgaaaaactgctctgacgtctctcagccgccagagcctcccctctttttccagcgcagctaccggccgctcgagaagcgttttctcgcgctgaagagagggcttgcgttatttcgtcaagtaaagggatttctggattaatctctcttctcgtgcgtgtttccttgtggtttttctctttcgttcgcgaccgctgatgccaactttgtcgtgaatctcctcgaacacctggcagacacagcctgtgcgttgcgagggaaagcagccctcggcttttcccgtgctttggagttggggaaagcgccagaaaagcgcagcgactgtcgttttccactaacccttttgtttctttttctcgcggcaaggactgggagaaagaagccgcgccctctccgacgtttcttcgttttttccgttcctgctggagagaattccgcagaagcaggccccgtcgccttctctcgtttctcgcttgtccttttgtctgttcctgaggaaacacatcgccgaggcgcaattcgcagttctcctacacgcttgcagaacctgcaacttagtatgttccttggcgcaggtacctttcacggcacagccccaagaagtcaaacgccgcgtcttcccgagtcgtacgcgacttcagcgaagccttcctcatcagttttttcctcgcgctgctaatcgcatgtggcaacagcagttgacagacgacccctctccagttcctttcctcgaacttggtgtgtatacttcaatcgacttacatttctagacgctggaccgcaaaactgtgtgaaggtcggggacagccgtcgcagcccgagacattgaggccttgcctttctcccgtttctcacttattttccacccgtttgaacgctggctttgccggctccttgtctctctctctccgccttcctgttccctccacgtctcctctcaggtgcagaagtcccttcgtctcctgcaaggccgtttcctctcctccacaa

SEQ ID NO: 1302 - DNA, 2928 bp, Toxoplasma gondii
tcaattatcgacactcaagaacactcaacacgattgttgtggtcatcctgtttctgttgatgcctttatacgaatagtccgctgccatcatgcacactacagaatggtggccggatagattagcacgccgatgtaacttagtgtacacgagttgtcagacgcggttacctttttcaggatttccgtgtctatgtttgtattcatgtttttcgtccttttcggagaggaacttctacgcatatgcattcgcatgaaacccaggagtgagtttgccaagaaacataaagaactcgaatagctaccacagccaatcactaaggcagtgtctgttcgaagccctggttcgatggaaagctgtgggcctttgcggatgtgctgtgaattacgggaagtagttcctacgttgtcggaacggcggattcccagttgccacagaagttgacggaaacagtagctccacaaaacaatcgttgcagccccgagtccggtgtccacgtaggaaatgaactgcggacgcaccagataatatttaagaatagcggagcgcctctgcgttctgatagtcccgggtacgtacgacagcggaataggaccgaagacgtaaagtgagacgctgtatggatgcttctgccgacgctcatgcttgtgcaacgacagttcaagggagaagagcagagggcgtcgcatgaaacgcgtctaacgcccacctctgtgactctcagcgcagttcacatagtcaggatggtccatatagttcggtcgccgtgtccgatgctggttcagccaacccaacaaggtgggacgttgcgtccattacgcatgaccattttcggcttcctcagctagtcacaagaagtacaatcgatcgatagactgagtggcggcagaaacgggcgttttgcggccggtaattcgagtgggaagggcggcgaataactctgtctcatgtcgactaccattttcatagtccaacttgaaaattcggtagaaccgtctggcactgtgtcagtctctctagtaatctcaggttccgctagattgtcgatgtttgacaggagtttccttgaggtgcacactctcatgaaacgcttttcgaactccgaacacgaagaaaactgtcgataccgacgcattgtttgattcatccgttcgaccaaccatgactctgctaacctctaatcgactagacttgcctactctctgatgctgatcccctgcaagtgcccgaacctgattccagcgaagtgtacggaaggcgacccaggatgacacttccaggaaattctatgtagcgttaagagaacacgtcgctcgaggcatacagaaaatcgctttcgtgacagttcctcgaaagtcaacgactcctacatacctccgccaaccatcagctctgttcatatctaccggtacggtgcctctatctgtataccgttacgatggaattgtgtttcagtacacaactggctgtttgtttgacacgttatcttcttttcggttgtcattcgacttgcaccagcaactggctaccctgtttattgtcgcccgacttttttgcggatgccgggctaccgaactttgccgtgatctctgttgcgtctgctctgtacagcagccacaattgaatgttagccccatgctgccgcaacagttttcaggacttctgtacggtgctgctttctcaaacgcgttggattcgtgcacttgtaggatgacctcttaacgaaaacacagatcttgtctctcactgagtcttcagtggaggccttattagtttttccataccttcttccacttgtccttattatctggccagtgtaccgccactcttgtgtattgttgcgtacgttttcatttttcttgtgaccctatgtagtgctgtcgtctgtcccatccggactgaagtcagcgtaaccaacaaaaagatttgttctgccactggttcttcatcaaccaccgtgcttcaactttgtaccgactattgctgtcgcccgtgcggtgcttgtctgtcttgttgtcttcacataaacggaccatcctactgcgagacaagcaggcaacggtgttgcgcgcaagccatagctgacgaggctgctgtttctattcgaatctctctctacagtaacggcaagggcggctatcaaaacaacagaggatggaagtcacgtagacttccgcttttcatcgatcgcactcgttctgtacttctccattcttctcccagttcaacaaccctaagtgggcatgcccccgcgaggcgtttttcgtgtgtcgtcggaactcggtgtcgcataccatttcactgttttgtccttgtctttggtgaatcggtcgctcacttcagtcagaatgtacttctattctcagcatcttgagttgatttgcatcttcaatctgctgaggccgtcatcgttcgtcttttcttgttcttttctacgcagaaatcgatagattttcccggttccctgcgactttaccgagtggtagcgtcactgtctctcgtggccacgttttctgtgcgttgtgtgctgcggtataatccacagaagcaacaattgtatcgacatttctcaagactagattgcgtgtcatcccaggggagattttgtttcctggattctgttcgaaagtgactctgtgcaacttccctgtccggcgtggtgtgcggtatccattcccgcttgtccccaaccggggacaaagctggaagactgtgaaggaaggtgccccaccattgtttcttttgagtgacaaaagcccaaatatcggagtcgtcggtttcagggtggggtcgggttatcaggcggagggaatacaattcctcacgacggtttgcgtcaattgcaagctaagtgagaatgtttttttcttcgcatttggagcacatctcctccgatacgaatcgaatgccggcaaactgaagggccacaa

SEQ ID NO: 1303 - DNA, 3216 bp, Toxoplasma gondii
aggttccagaacagggagacacgaatcttccgtatcgtctgtactggctcactggggttgcggcaatcgaggcactgtctcaagaagaggaggggtagagctgtttacacctgtgtgttttgttcaggagagaagaaccagcttgacacggtacgtagattcctctttttaagatcattcttccccgagagaaaccacctaaaaacccgagggtgctgtttggctgtccagacgggtacacggcggcccccgtaactccgagggttcgaaagtcagcacacgcgtgtagaaaagtttaactgcgctggagagacaaacaagagcagaaagagaagaacaccctccgtgaaacagcgtacaccagacgttaagaaacagcgaagaaacaaaagcactacggaggcagtttcaacgaacagctcgtgtggcgcccattcgaaagtgacacggccaagcaatcggcttcgcccacttctcagcggtttccgtgatgggtctggaattacaccagtggcgttgctctattattaggctcaatgttgacgtcagaaaaaggctttgatattgccgcctcattccgatattagctccctgtttctatcggcactaataatactatggcatgctatacccccggaagctactatcttacaccataccgacggattgattccatgcgtatactacaccagcactgttaatgaccaatgcttccaagaaaacaaatccaacaatttccgctgttctgagcagtccagtggggtggcgttgagtgtaatgtgggattctcgttggcataacgctatgccagtagatgcgacgaacgttccttaagaactgaaacagcagattatgattatgtcgtggaacaaaaaaagagtcaattgtacgtcaacactcgataacgtttttgccccatatcggtgacccagtcctcaattcgcctgctcccggctacctagtcgagtactcagacaaaggctctgtcgtcctatcacgcttcgtcagtctgctgaactacaaactcctacatgtctgctcttcgtatcctgtcctaaatagaatgaatatgacaaaccagtgcacaacagcacatctaattaagcatgttaaagaggaaaacaacatgaagtggctgccgttcgtgctccgcgtaactggactgagcaggctctgtcaagttggttcttgccgttgcacatgtgatcaaacaaggatcagatccgaagcgcagcacactcacttattgtgtcgaaatcgagagaggtggcaacgtagggatcctgtcacgatcacagacacagtcatcgtcttgcgcaggtcgaagtataggccattcagcttctgttcccctcacgcctttggcaacgaaacgatagatccaccttgacacacactttcaaagtgcagaatacaaagccacctgtaggcgtggggaagacgtttgcgacagttcgtgtacgaaaagtgtgataacgatgagtgcccaatgacgcttcggtgatctgtcgtgaacggaatttgtttgtgtctcgtattcgaagacagacgtgaacgaggtatgcgtcactaacacctcgcgaagcggtcggctgtgcctggcgcgtgcaccctgaaatgtgcgccgaagtgccgtgtgaaaaagtggctgccaaactctggccccggagccctttgagacgcgagttacggctggcttggctgcagcgtcactcaccctagaacaccgaacaactggagagactgagacagcgacaagcatgtttgtcctgaactgctcatccaccgaccgtttcatgtgctcaaataagtgaagtggcatggtcagtgtgatatccgagcagattacgggcgagggccatcgcgacaacgttgccaagttacataattgaaacagaccagacggacgcagttacttggtgtgggaacagacacatgcgtattccaaacttgtagaaccgataaaaatgttcccggttcaatgcagtggactctagagcggaggacaggtcaactgattcgtgatccaaaacccagatttccgcggtcgcgggggtgacgtcgtagggcgggttgaggaatacaggcgagctcactgttgcagctcggcggtagatgcttatggttcttgaggaaaattaggagtgagcctgcttacttcgagatttgtgaagtcaggaggctgcggtctagacccgttgtgtgcgcttgcccggatggtacgaaagccaactgagcggaaccggtttgtggacgatctagtggcggcttgcagcgacatgtgatactagtttctctgcatatttcttcatttacagcaaaacgtctacatactatttttcatagtattttcatcgtgaattaaaaatagttcagaatcgtcaacagcggctgctcaccctgctgactttattgtcgcacgcacacggtgtagcacatcaaaatagacttctcaatgttagaaacaatgtcctgtggcgtattttgtggttcagtgatgtggtataaaaatgaattttccacagttgctgccgctgcgaaagattgacctggatgtgtcctgccttcggtacagaggtaaacgactggtgtcctggggaaggccgtcggccagagagcggcgcgaatctcccgtagcctacgaaacgactatatggcacgcaacttttttgcgctctctctttctgcatctaacttgcgtatcgtcagactgactctttgctttgctcgtgtcattttttccctctgattcatggactaaaaccgtcggcgacgaacgccagtaggcgtttggtgccagtgtgcgcatgcaaagaacagacacgcaaaatctgcatctgcagcgactcaagaaggaacgcgttttcagccgctttggtgttgcaacctcgccttctttgttcgctttttctccgtcgcagaccactccccgtccagtttgcgtcaatttgcagcagcccatttttcgcgctaaggccgtgcaccagagtctctttcgaagccccgaagagacgacatcgaggctttctctgtctctctgcagctcaatgtccagaactcctgaagagaaacaggagggaaatgatgttgttgtcattgactcatcccttaacagagggctgtcatgtgttatgcgtggaaggttcttcctcttgaaaacgacatgaaagtgaaggataagctggagaggaagctgaagaggaaaccagcttacga

SEQ ID NO: 1304 - DNA, 4246 bp, Toxoplasma gondii
agaagatggaccttaaccttcgtatctcagtgttagtatcgacccagtaagatgctttcgccgttgatcttcttttttgtaccttagctaacgcgtaaagtattccgcctgagtagtacgctcgcaagggtgaaactgttttttaaaataatcaatttccgtggcgtaacgggcgatgtgtacaaggctcgaagaggttttgggtacataaggctattgcatcaagcaaatccaatgcaaaccagcccatactttgaggagcccctccgccaaaggtaattcggtgttcatatgatttttgtgcgcttttctgatctacagcaactcaaaaatatagtcttgcgcatcttgcaccggcagcaggatgccggtggaccgaacggtttggtcgagaaccggcacccttcatctcctgacgctatttccctaataccgctggctacggggggatgtgccttggttgcggcggcttcagcagcttggttgacagttcctctggacaaagtaaagctcaggtatattagatgatcgagcccgacccaataggcgtgtctagacatcgccgttgaaatggccacctgaagccatttgtggaaataattacactgtatgtggcggttggtagcaaacctattactgcagacaactcgtttgtcctcccgttcagggcgggccaaaacaataaacgtggtagggaattaacatgcgtgatatccgaagtcgcaaggctacacctgtggattacccctgattccggcagtcaatagcgattcaatacacgttttggccttttcaggctgcaggtccagcgtggacagatgggcaccgcgagtcgagggacaccgtttctgtatcgcaatacgtttcacgtaagtgcgtcactctgttgcctcttccctgaatcatctgtttgtgaacgggatatagccagaaccgataacgaccccagaaggcttcacagcaaagcgatgttgctccccttgtaactacctcccgatgtacggcctgaactcgtcatttccttttcgagagctaatctactgttgatggtattttaacgagcagccatgacttctcggaagcacctttcagaccatgcgcgcgcgaagcctgacacggtgcgcaaacagcgtttctcgatttattggtacggtgtaaaacctgggctatatccatggcccactttatgctcgttcccagatttcagcgtaatggctacaccgaggagtaagtgaactggtcagtgatgccgctgcgtgtgcgttaccgtctgtgtcctgactatgatatcgtggttggtttgtcccagatggtagtgaaaacctgccggttttgttaggcttttctctctgtgcacatgcgtgcaggggttagcaacagtctacaaggaggagggcaccagaggtcttttcaggggaagcggagctcgtgtcctgtttcacagcgcgaacttcgcactgttgaaggttttgattgaacacttcaagtctgcttacctggaatatgctgaaccggcttctccataaaagtttcggttccgtttgttcttgcctgagaaaaatattgcgacgagcatgtaatacaccagtactgtcgataaaactagcagagagagattaatgaatgacggaaattccaccactgtgactgagttaaagtttttgtgcattcgtcatcttgaactgagttgggctatgtgaactagtaacagctccagttcctcggatggatgcattggctcccgcgggcttagggcatgctggagcatcgatctacgacaacagtaaattctcttattgggttcgtcttttttttccttaacgctgcttccgtcacaacgcaacgcgggacaaatctgcgaaaatgtggggcactccgcagccactgcggcaagcatgttgcattgtaacaaagtacgatcctaatcgttcgcactcagtttcgaagcttccatacaaaaaatcaaggcctcttctttcagagcagcgagtcagaatcttgcatgagaagtgctagctttcagagcttccgctctgccgcacattgctcacccagacgatttctagttcccattccgttctcggagtgacattcgactacgttttgggtcgtgcgacagaggaaaacgaccccatgtggcaaggagcgcggctatgaggcacctgtgaggggatgcggaagctcatggaagccggcccaggcagacagatctctttcggatgctggttcagtggcatagaaatgaccgaagcacattgtaatagcacatgcgccaacggaaacgagatacacagaggaaacggttcctcggacggtgatgtatggcgctgccgggagcatacagacggcattttgtagtcgccgaggctagcaagcatgtaatatgaaaatacactagtcagcaaaaagctatcatctcagggcacgaagtggccaaaaaatgctcacagctccgatcacccactatgtccatagacatgggctctaacactaacaacaatcgattcgttataaaccttcaaaaggggaatggcttgctgacagtcgtctggatgcgtctgtggcatgcgtgtctgttcacgtcagatgttgtaacgtatacaatacacacgcggtgaaatgccactcaccccagctgggtgcagttttgaaaaaggatgactcttcgttagtgatccgcattacgttacacgtcgctcaggagacgcgcccttgaggtggcccttcgtagctgttcgcacttcgtgcctgctgattgattcgatataccaatacatcggcatacctgcgttgctcttcattgcgtacccattcagcctaatgccgttgtggacgagcaagcatatatcatatttgctctgattccgcaattgctacgtcgttcccgcgtaggacgtgccagtactgttcggatgtactagctattgctgcgaattcaatcgctgaacgctggtgttgctgcgtgcaggtcagacccatgcgtgctgcagcgacgccgttttatgtacacaaactgcggcgctggacgagtggtggagcgcaccgaaggatcgtcctgccttttttccgtgttgccgggcaccgctagcgaaagggtatcacacgtaatctggtatttgaaatgagaagaggcaacagaaaaaggcaatactacgagtggcagtgctttcggaggcgctctgtcgtaacccgcctcagccgcgctgcaagcaacagaccccaatgcttcatcgcttgcagacactcccctacccccgccccccatacgtcgctccttgcggcagggtaatctgcattttggcgaaaatcagtaagatgggaccaataaggcgacatacaagttgtttcaactattcttctatcgtttcgtgtcagaagtccacaggacagctgtagagcgacgctggaagattcaattcacactagagtacctgtagcgaggacctcaaaacgtagtcgatttgtgactggcgggagaggctgtcaacggcaccttggaaatcctcatggaatacagatgggccgggttacatgggcgccatcaaaaactatcccgtcgcaaccagttctcattttttgcatctgctgctctcggaatgccatgacggaggtggtgaaggcatcgtgtcactcactttggcactcaaggcggttaatgcctctctttcgcagtgacttgcattcgaagcgtgtgtcgagcttcgcgcctgaactgagaggcaagaatgagtgcagctggtcgaccaacagtacagtttcgtcccccagctttgtataatttcagcaattctgttcactttcgtgcgcgaagagtacctgatcgcttttgtctgggttagactggggcagcgcggcgtatcccctgtctctggactctggactcagggaccacgcgacaaatatgcgacgcggtcaccactgtcctccagcctgtcattcctgggcagtagccgttgctgtcgccccatcagcgtcccagttttgtgcgtagtccttgagttccacctttttcatggtttccgttttgtctggtatgtggaaggcgagtttgttcttagaccgtttcgttcgctgaagtatcgaagcagcagctgacgcagcccacacggatcgctcgctcatggggcgctcgtcgccccccgtcatgcaagtcgatcgagcggagttgcccacgcgtgtttatccatggttgcattttttgtaaatgctgcttaatcgagaggcggtaacacattcagaatagtga

SEQ ID NO: 1305 - DNA, 1839 bp, Toxoplasma gondii
catttaatgttaatgtctgccaagacaagttgtcccgcactttcactggctgtttgcgtccacaccaacgaggtctcgttcgcagcagagaacaacgagaaagtatttcgagatgtgtgcgtgaagcgctgcagagatgtagtctcccctgctgagtctttcacgctgctgcgtgatgtgagggaaattgtagacaggcgcacttacgcgcgcaggagaacaggcatgccctacgagtttggacgaaaacacaatttgcatcacatcatttttccaggcgtaagacacactgcttcatcttttactaacaccgcatgtggccttgatgacatccgagagccattcgcacattagatgttgtacacattctgggcttcctctgtgcttttagaccggctgtgtatgtcaccgaatcttcttgattgtactgattttgaagcccatcgggagtagtgtgaactagggcgagtcatccttatcgttcctctttcgcattctatatagccgacttacacttaagcttctgcttgttttttctctggtgtaccgtcggcggattcgactaacttggattcagatgctatccgaaatatcaggtctacaaaacatgacgctgttctggggatgctacttttttcgggtgccaactgctaactaggtactagttttacatccgagctttcgataacacggcagaaatgggtgagcgtgttactgcagggtattcctgtctcaggacacctttttcaggcgaacagatcctggttttctactcaatcttgcagttttcaatttggcgcagtcgagcagtatgaatgtggaatcctgtgacagcccgtccccttaacagaaccccttatttttcactatccccacggaacacccctttttgaggaaatagcagctgtctgatccgcgcggaaaacattacgctggacctggataacggtggcacgggtgtgaactcgatgtgacctacggaactccactttttctactgcagaagctacaatacacggtgttcgtctccaggcggttcccagccacacaacatgcctgagacgtccatgcacaggcatactgcttcttgtggtgaaaagaccgtgatcagctagtgtcactaacacttggggctttggggctcttccgcatcacaacgccggccctgctgccattccttcctcattatctactggcccgttatatcgtgaagttagaagcgcccaacccgtccccgccccccccccaaagcgtcacttgacaatcaaatataccaaacatgtgctacccgtttcctttctgacgcaaacctgctgcgatatctacactcgtatgttcacgtccttcgtcgagcatgctcattttgtggcgcggagccttgttttttctcttcgtctctccaatagtttcgtaccagaactccttctcgaggcatcaatccgactccgtacggcttctctaatcgaaaagtacttaaaaaattacctcggaatccaaattaaaaggaagaattcacgttctgctaatggaacagacagtatcgacacgcgtgtccagttcaatttaaaccgagaagcaagcaagcattttacggaaagcgcttctgcactcgtcctggggatttccttcgtcccgccgcccgtcctgaacgacgaccgtcgacccgcctccacctctcgttcccagccgctcagacggaaaagccttccgctgggtcattgctgacagcagaagtcttttaaaagtacttcctcaccgactgtgtaatgtacacatatccgttcgctttcttctcggtttttaggcgtttttcttgacttgtctcgagagtttacatca

SEQ ID NO: 1306 - DNA, 2469 bp, Toxoplasma gondii
cagatattgggtgctcacaagaactgtctggaggcttgtacggtgcgtgagtggaagcgcggctcgaaaggttcggagcagggcgaggcatgcagaccgcgctgttagttttcaacatcttaagtataatcaacttaatttgaaggaatgaacacactttacgtcgtctcgtgtaaagatccagatggacagaaacggcaaggcaaaagtcgagaggggcttcggttgagacggcgcctactttctcgggagacgccttctcgacgagagctttgtagaggggtctgttctcagtaaaatgctggtgggctatcgaaaagcagccgacggtcttcatcatccgatcggtgtctgacaagcgatcgtcgacgctgaagagaggaacgcacacagtcggatgcagaggaagcgccctgaggccggtgcctgcgaaggcgagagggagagacagcctagggacgcagaaggcgtcggcggaagacaccgagagaagaacgaagggagcacgaagggagggagaatgggaaaagacggcgaagcagcgagaaggcgagacggcaggaggcgcaaacaagaagaggaagcgtaggaaaggaaagagaaagacgagagcaaaaaacggagagcgccaacaagagagagccgccttgcagttttttttctgaaggcaccgtcacacaagatcccttctaagcacagagtcgttcttcattcttcttttggccgcatttctctctcgcattctctctctttctctctctcgctgtcaggcttgtcacacacgagtacaggcatgcagggtgttttctcctggcctttgcagagaggatccgcggcagtttgccttctgaacgttcgatgcattcgcgcgaaaggccttaccggtccaggcttctctccagttccgcgtcgaactctgcagtgagagggctatgcctcaggtccgccgtaatccggtcgagcatctcaagctccgcctgcaccacatcggagacagtgacgctcctgtctccagcgtctccgtcgtcgccagtctgtgaggttggttcgggttcctcgacgctggcttccccgaaacgaacaggcgagggcgacgaggcggcggcaggactctcaggtgggtgcgcatacgccgcagccgggaggggagaagaagcagaggggatggggagcagcggcccgatgagaagaagcgcaaccaggcagccgaggagcgaagaaccaagcgagcgcgtttgccggagagaaagagaaaaaaagggagagctgaagagaggagagcacctctgaaagtctcgagaggagggaggatctcggagggagcacggagagatcgagaagaacgaacggcagtggtgtcgagaagaccagctcccgatgctgagaggcgagaaacgcgcaaggagagaagaggagaaacatccaatgtcctttgctttgcctctctcggctcgccggcaccagccgcgagagggagtcggcctgtctcgtctcacggacacaggagacatccttctgacagagacagggagaaaggcagagagaagaagatagagagaagaaggtagagagaagaaggtagagagaagaaggtagagagaagaaggtagagagaagaaggtagagagaagaaggtggagagtagggaacgcggtggaggacagacagacggacaggggaggcaagccacggaggaaaggggagagcactcgagagacagagagacaggtggaagcagggaaggcaggaagccgaagcgaaaagagaagagagaaagaaaccgagggaaacagaagcgacaaaaggtgcacagagatgtcactcatcggtcgcgtcctcgactgaggcgcaagccgccatggcgccggctccttggcaaaaggtccccggagaggacgcagttccgtcgaggcaaaaaacgggcaggccggaaggaaaaaggaaaagaagaaatctccacgaagagaaactggagaggcatggacggccagaacgactgcgagaaaaagctgacgcgagagcaacgccttcggctccttccgtcctgcgaaaaatcggccgaaggtgaccctcagctgcggaggcattcggcgttctttttctccgacacaccacgagttgttttctttgactgcctgtactggaagagcagagaaagcgacgaattgacaagcgtcgcgagagaaggattgaaactgatttccccccgacttctccagagacctggaggtctcagtggtgcacaccaccgcagtctcaaaagaactctcaacattcgcgcgcgagagagaccccccgcagcaacaggcgagaggtcgttttcctcttaaatttgaagctctctgtcatggtgagaatcgccttttccacaacctcgtcagctgacgtctgtgaaccttccctgcactcccccttcttaccctggccggatgatatgatcgactgatcaccgattcttcttattctaga

SEQ ID NO: 1307 - DNA, 4574 bp, Toxoplasma gondii
taaagtgtcaacagcagaggtttcgaaacctgccattcacccgatcattatggccccgtgtgctaccagtacgaaactgcgggctgatgcattccgtgtgacagctaacgcagagacgagcgagaagaaaagtactaagaggggaagagactgggtgatcagtggaagcgccaccgtcgatgatctacttggaaacatcaaggtcccacgcaaaggggaaacaatatcgggacgggcgccttcggcagttgtgtagtgctgatgagaaatctttaagccttttgaggcaaactgataaaggcttcttcttcgctgtgaacgcattatgagcttgcttgagttgaccaacaatctgcatgttactactctgacggtgatgaatcagtcaaagacctgtggaagtaccgcagttgcttttggggaagtttcaaggatgtgctcactccgaacagtccgcgccagcaatcataagacatgtattgcgtagcgcagaagggaaaaccgaggttcaaggtaacctgcgttgatgcaaagaaagtcgaccgcaggtgatagcttctatagtttgccttggacggaattaagaagccacagccgcttgcctcagtattgcggttgtcgcctgccctgtctccgaaattctgacactccgcgatcaacgcttgcttgatagggcctgctcaacatgtcagagccggcacgacactcgctcatgttacacgggtttctcccactggacccccgatttccagagccctcttggggaatgcgagaaaagcattttaacttgcacaactgcaattcagggttcattcttggcacagatatcgaaacgtcccctggtgtgcaggtagagtagctgttcgacagattgtactgtttgagtggcgagctgtcgtccacggaaggactgtgggcaaacgtcattgtacagatttcactgttcactattcgccgtgctttgtgtcttgcacggatgtgcaggctcttctcaggttgcgggatatgtcgtgtttccgtaaataacacgatctatggcacatgtggtaaatcttttcacaatgtggcaagattcttgaccgctcagaacatcgaagtggccgttcgttgtgaaatacggttcccggctcacgctcattgactgtacgtacacagaactgaatcgcatcttgcatgcggctccggagcagggtatctctgaagaaaccaactacgggcgccgttgtagtttgttcgtagccttttctcgaaattcattaagatgcaacttcaggcgtacattgctttgggcgttgctttgtgcttcgcctgttactgtcgtgcggagaaacttgggcaaccacaggctgtcgaccagtcagctgtgccccttctccggtccccgttatacgagccgctttctggtgggttcgccgcaacaataaacacatacctacccaaatggacttgaacaatgatcgcttgtttgtaggccttgctgttcaaataaaagtgcttcaagcgaaagttccgcagcttggacagtttatcgatgaaggtacttctgctacaatccagtatggttacgtttccacacttatgtaagtcccgcggacgaagcgttgaataaaagttcttgtgtttacactggtcgatgtcccagtcactggctgtcctcgcacatgaagcacgtgatggcactcatgtctgcccctcccctgggaacaaaggcagccggtaattagatcattagcaacggaagttggaacccctcacagtgcatttctagacctcgcgggcatttttgttgtgatgcgccgtaaactggaacaggtgatgtcgtgatcagcaactgatgacagaaaatagatagttgaatctcgattcggtaagcaggtcattgcaggccttcatgtcctcataaatgtcgaaggagggtcgcgcttgggagaacggccggctcagttacgaactacagccgaaaaagccctacaagctgtgctgcccctccgaacagctctccttgagaatgaaacaggttggacgctattgttcgcgatcatgcaaaagccacaattccgctctgttgcagacataatcaagcataatgcccaggaacttttgccatccaaagcactgtaccagattctggggcaactcgaggaggctcacactcagcctataacaacttctatgagtttcgtagaaactgtcaactccaagcttcaggaggcacgaactgaagtcaagaggaaacttcgcaaggctgtcgagtttctgaaaaccctgaagcactgcgtcgctgctgacgctgttgggtgggagagggcagccgcccttcgttcgtttatgcagacaatgcacttgcataaggtgaccctggagtgtcgttgtttatataaccattgaggcacccgtcttgtttataggttcctgactctcacaccgttgagaactccgcagcgatcactgcgacgaccctggagaagctttcgccggagcccgtttgtaagatgaacccatcgatgtgacccggtggcgtacaagtgaaaaatgcatatcccgcgtgttcacagacgggcaaagcgctccgaccgccacaatgtcatggccgacagtaagacagacttctccgttttctcctcagagatcactatctcactagttacaggctgtggcaaacctaaactttctccatactgctatcgtgccagagttcaccggggtggtaaagagaatcgaggctgcagagaagatgttggcgtaagtgatgtgcgcctcatcttctggacgacatacacacttcatgtcatacagcggtctccggaggaagctgcgtcgagtatccttcctccatcaaactcagggacgtgaagtaagggtaaatacccacaacaaattctgtcacttgctctacctatttctgtctgactgcaggccccgatggtacagtacttgcatcagcgagaaaggtaacttgaatgaatgttaccacgattaggcagtggaaaccaagttagaaggcacccaagaggaggtatgcgatgaccggcttccagaggcatctacagatcataagcagtgccatcaggacacggatgacgacggcatattcgcagtcatcggaggcattccctttttcgatttttaatacgtgacccatcaatggctgtagcagtgcctcagagttggtgtgggttagttcacgcgtggcgtctatttctctgcggctgtaactataagagacagacactcttgcggttctaagttcataaactctacagtggcatcgttgaccaacgatcgttaatagacaaaagctggggtagtgcgtgagatgaagcaacactacaggataaccgtgtcgcgacgctgcgattaagagcgaaaccattgggtgcctgtgccttccaatgcaatgagacggtagcattgcaataggcacacatggtctcgaaaaccaccacaagtaggccgacacgctgtaccaagacagacagatgcggagccacctggaaatttgacatcagctggagaagctctccattagttgaaggtagtcatgcgtaccttctctggtgatgccgaaacggactgtattaaaaacagctttgaattcggtaccgattaagaatgcctctgggtggaactagtgttcaacttcgcaatgcacaaacgcctgatccgtcttttcacaggcgaaactgtaaccaccccccactcacctacccgccagcgtagagccaccaacccaggagccctggtcgctcagacgtaacgtcgaatttccgacagtgaacggcggctttcaacacatcgaaatatgcatttttatggaggaataatctttttgcggcagactgatgtttcatatggaacggaccagcattctctgctctgtcggtatttgcgattcagttgtttcgcaactgccagaggtcaccccaatccgtcctgtcggcagccccccttgtcaattttgccggcgtgtattaactcgtagtagttcattctacctctcgactaccactcagccaacttgccatgctcctgaccttgttcgtcatactgtgattgctttcttcctctcctctggacaatgggtcgccgtctcctgtaaggactgtggatacaagaccgccatataattaaccctcaactcgccgtcggtaaagtcttctgcctctactgaagggtagctaacatgcgtccattttcatctggaagtaccgaggaggattcttactttcgagggaacaacccagcctggcggaggaggtgcatgtgcacccccttcaccgagggtttctcgtacacgggcgtgtctcgcggacggacagcgagttgatttctccgctctgccgaactttctcagttctttgtcctcctgtttggtcagttgctggccactttctaaaacttcaacgtttcagttgggtctcctagaagttgagaagctcctcatttcccctgcaaacctgatctcgtcttccactcttgcgtttttcttcccgggtatttcttcctggagagagtctcggcaaaggcaaagtctgtttaggcctcccatctaggctacgtgctgctccaggaaa

SEQ ID NO: 1308 - DNA, 2871 bp, Toxoplasma gondii
gcgactcgctatcgttctcttcactgacacttttggactttgcgatgacagtggcagcgtcatattctcttagctcaaggcctgctttacaaccgaacacgagcccggatgcacgcagtcctaatgcttcactacgatatgttgtgtttccctatttgccattggggtagtgctgtacggtgccgcgacagggtgggaagagctgtagttgttcgcgaggaattccacactgatgcatcgatcgctgattggttgcctcaaggagtttatgttactggtatgttgtctgtggtggtgagaggtgttgtgcgcgagcgataacgaggtggagcattgatcgccggatacctcacagagtttgtgttgctggtgtgttgtctttctttccagaggccgtacctgccggactggttacttccgcgcaagctctaacatccggcccgcctcccccaggtgctttaggtggagtggacgaatctgtggcgtcgcagctgctgtttaagcctgaagtcgatttgcgggagcagcgacggagatccagtggctttaccggtggtcagcaagggtttgtgcgttttgccgacgcgacgtttcgcgatccgaactcccagcttcagatgaaggacctgctcacccagcaggggaggaggcgggggtcgacagactcgtccgactacaacatttcgggttccggagtatcgagggaccgtggggatgagccagcagactgaagcggcacgtgggtgtctcgttcgtatctcagttatgttttgtcgtagtttctcgactttttttgaaatagctatttgcctatcttggcgtcatctttgttataccttgcagagatatgcaccttcggcgacaaaacaatgacttatgatccgccgcggctgtagacgagatagagaagggaaaccgtgccgttcccacctctaaacttcgcttctttggagagtcgatgtgcacgactctgtggggttcactgctgttttatttgttgtggcgaacgcttgaggaaatgcagtctgcagagcagatccacacaggtattttcctaattgttcgtagttggtactttttcatagtgtatcgttaatatgactaacgcggtcacacagcaacgtgctcgtgacaactggtcgtgttccactcttcgggtgcggtgaacatcaccggcacttaatttgcgaaggggggccctctttcgtccaaccgtttaccgaaacgtctgagtggcatacgccggcaaactgccaaattcatgatctgccatggcttgcgcggtggaaactaccttgtgatcgtgcgagtcacctgtagactcttcgcgggtagccacgcacgcgaaagtcgccattgatgtgtgggagaatccgcttgcgatagtcgcatatagtgagtcctttactagtacagtcttctggaaggccactactgactcacggatagttactcgtaaaaatcctgaagtggttatcgcgctgccctctaaaacttcgcagggtcagcgagataaattttcgtgtacagcctgtcctatctccaaaaggttgagggacgaagcaaataggcggttcacatttggcagctgagagtgacatgccacgtattcccacggaaaaataggagcactgctgcctagcccgcccccccacccctctcaaatcgccgccgacgtgtgtgtacatgagcggacagaaataggcgggtatgtgtcacgtgatcacagtcggcatatgagtatgcgcaggttagtgttttgtctgttgtaaactccgcacgcggtccagaaggattgcctcacgcggaccatctgtgcacaggcaaagtggtacgcgcctgaaccagttcaaacggagacttcagctctgtcttctgtaggggcgcagaaggctgctgtttcgttgcagcccgagtggcacggtgaatgtgcgccgagtactagagcggtgctatagcacgtctcacgattgcgggtgttcagaatcgtttgttgccatgggactcgcagggaatctcaaaattcctaccagctcaaagtggtaacggatctgggaaagagtcgaggccatcgtggagtgtgcatggggtcgcgaggctttgcggagaagcctgaggcggccgcgcaggggcgcgcgatggaggtgtacgagcccccctttcaggtcggaagctggggtcgatggttgagaacacaaggaagtgtcattcgtaagtggcttttttgccttttcctccacatgcgctaaccctcgggagcatccgttctgtcaaatctgagaggcagctgcttagtgtatgtggattattggacgggatatacgcgctgtaacaacacagggcagctagcctgattgcgagtggaagctgtttcgcagatggcctctcacacgctgcatggagacttttcatttccttttcgtttcaaagttcgagtggtgtggaccaacgcggggttcaagagtgaggttcgatgtggaatgagttcctgcgtgccgcattttgcctcggatttccggcaattgaggtatgcgggctcagtcaatccgcgttcaccatgacatcgcatgttttctgcgacaaaaaaagggctcccagggcgggtgcctttgcgttgctttgagcccacattaaatcttttttccctgtcatgcctctgaagacctagtttcgttgacattcgtggcaaacttgacattttccgccttgtcagatcgacaccggctgggctccggcgcatgccacgccgccgcgtttttctcatgtaaaactctgaaagagagagtcttttccctcctcggctttctaagtcttcttccttttccacacctcgccgtctagattcgcgactgattctcgttgccagcgtga

SEQ ID NO: 1309 - DNA, 573 bp, Toxoplasma gondii
actaacggtactgggaaataggagatcgcgttagttcttgggaaaacgacttccgaaccaccaatgtacagattggtacaaagaagttaccatatcctctccgtacaaagccggcattaagaacataaagatcatagctagaccatgtattgtaattatcacgttataagtagatattgtctctgtacaaatgatcagcgaaccagaactgtataactcaaatcgaaaagtctgacttcagcgttcacgtctcggtctcaggagcgcgagactggacgggaacgacaaaaatggtaagaaacgacaggtcttgaccaacgttcttctcctccaaaaactcgagacccagagagccggactgcccacctgttctgtgatctctgttcgactcagaccatgttttcagttcaactcgcgaggctcacactgggagagggggggggggcgcgcgtgcgcctgaggcttgcgcattcactggtctgcgtttttcgttctttttctcgcgtttcgcaggaaaaagcgaagcgtcccttcgcgtgacaaacggagtcgtcgctccggaaaaacagagca

SEQ ID NO: 1310 - DNA, 2000 bp, Toxoplasma gondii
aagagagcacaggccgtctgtgctggatctcctgtctgccgtagaagatcccgtcgtgctctcgataccggacctggactccctgcctgcactccttagcgggcgtctcggaccgatctgcgacctcgccagacgcgccgtccttcttctcgcaggctcgagagtccagaacgtcctgctcgttgatgaagtggaagacgcgctcgctcgcgcgtcgcgctcgctctctctccaaggagtcgaggcctggaggagaagacgacgtggaccgcgctggggagtcgccacgaagcgccgcagccagcgccgagggagacgccagaccctcgccgccccaggcgagaccggagaggaagctgcctgcatgcgaagcggaacgcagcgcgaaaaacgcagatggtcggtacaccccccactgcgtcgctcgctcaaaggcctccggaaagggagaagaagagggaggagaagagggagaagaagagggaggagaagagggagaagaagaggaaggaggagaagatggcgaagggtgtggagaggccgcacagaaggggagaaggaatgaagaggagttgtgagtcagagggcgccaggaagacccgagcgcgagacagagcgcgagagagcaggcgagagagacggcgagagagaaggcgagacgggagaggagagcagagcgcgtctcgagcacacctgagcagcgcgcagagaagcgcagcgagagacgacgcatcgcggccgcgagggagaagatctctttgaaagagtaactggaaagctttcgaggaacggagcaaggcggtgaagaactggttgtctctctcgctgtgttccgctctcctggcctcgcagcgcgctgggctcggacagactgtcaggcgacgcgatccttccaaggttcgctcgtctgcacctcggctgcctcggtcaactgtgtgcgatgccgcattcatgcctcagcggacgagagtcaagagtcaacaaaccgacggccggaagcgagaggagcggacaggaaacagcagacagagagcggagagggcgccactaggatggtgcatgcgccgctgacaagtccacatgcgtcgacttgtgccagacaggagagaagagaaagaggagaggaaacagcaacaagtggacggtggaaggaaggaaagctcgtggagagatgcagaggacggcaagacggcgccgctcgcctgccggtcgactagccacaagctccgcaagaggtttcttcgcgggggagggtccagaggggaaacaagaaggtgcccatttgctggaaaagagaaaattttagaggagagacgacggaggagacggtgtgtgcagcgcgcaagaagacactgtcgagatgcctggcacaacaatcgtaggtgtgcatgacagaatctttttctgcatgcagcctcgactccccaagtcccgtctcctctcagagggcgttcgagaagatcgacctggagaaagaggcgacagaggtccgcgcggcttttcgcgcgcctgttcttcacttctgcaggattcgcgtcgaagaacggagaaaacatattgcgagaggctcagagacatggagaggtgtctcccggggcagatgaggagcggccggggccgcgttgagcgccaagagaaaaccacgaagacctgtgaacggagaaagacgggtcatgtttccttcttctcattctccttttggtcgctttttctgcggaagacgtaggagaaaacgacggtttttcgtatccgctttagctgtctcttcccaccgacgactccctctctcagcccgctccgtgcggtgtgtacgtacaccggactgcgggaggctgactctggggcagagaaggcggtggagttcggccttcgtccatcacgcgtcagaaccggagatgcccgcctggagaggcagaattcgcgaaggaaaagaggcaagacgcggaagctgcgcttcaatgtcgacgttgacagcggcctctcaactttgccctcaacca

SEQ ID NO: 1311 - DNA, 2181 bp, Toxoplasma gondii
tactgcctggcgtgatctaaccttggttgaccataaagtgttctgtctctcctgattcgagtgcatctttgcccgccgtgtacgggcaatgtatgatagttgtgcaccgcgaacaggagtagctctcgtaggatgaagacaaaaccgtgccgtgattttttttcaagcacgtcgacgctgtgcgcttcatcgatgttctggtagaatccggggtgagattgttcttactgcagaaagcattggcattgtaggggtcgatggctacggttcgtgacatggatgttgtttcatgtgacatgcagtgaaaaagcttgtcaacatacgccatctgaaaacgggtggtccgcatccttagttgttgcggaagacaacgcgaggagctgtgcgatacctatacgaaagaaatggttcctgtcaggaagcttcacagcagcttgctgggacaccaccgaggcacggaagagttgtcttatcgatgcgttcactgagatgctcattccagttctaagtgtctcgatgacgaatccgcaatgccacttagctggaagaagagttaggcctggcagccgtgatctcgtggacgggtttcggccaatttgcttcttctcacaagtgactgcctgcactgcgtgctcttccttgttagcaagctggagtggcacatcgaccattaccaaatccattaccgtcacagtaacttcatacatactacgaatacctgagtactgcttacatactaatattagtaaggacgcctgcggaacctacttacggatactccatgaaaccagtacgcagagttatactcttactggcagaagcatctggaccagattttgttgcctctttgtccgcctcaaaaggctttcggcaccgccgcacttgtgcctgctgctcgcagatagagggcattttgcatctgtcacttggcgcgcgtctgcgacggtcttgtgagctggaacaggcccaggcaccgtaggggtgaaatacgctttctacaatgcaacacgctcatgcaagatcaacaaagggtggggattcgcactcactgcgaaggctgctagcatgtaccatgcgtgctgcacacttcctttaatagaagtcggaacctgtcgctggcagctgtcgagttactggaacactcactaggtgtcagcaccgtaattcacgaaatcattcgccgttgccataggtaaccatcgaacggcttcagccggtttctctagacttctaaagcgtcaaaaccatcagcacaaagaaacgtatgcgcaattccgaacgcgttgtccgacgaaatagttgcaaagggatgccgcacggaaaacactcccgagtggagttacgaaaaccgctgccaccccccatgctgccctcctcgctgccttcttttcttacgggacatgcagtacatcgggcaacaaaggtggctgattcatcgacagaataggtcgacagcttaaaaacattgtgtcacacacagtgattgttgattttgttgtggccagaaaggacgttggaaatgttgttccgccgctccggagcgttcgctggtagatgcctcgcgtgcggaattcctggttgatgagtgacatgatgtgttgcagtttgtgaaatacatgtcctcctgacttcctgctgaaaatccccacattcgcaggttttcatctgagattccttgtcacacctcccttccaagaagttcaaccgcggccgggtcctcgattttctgggtacatgcgtcatcgcgaatccaccggaaaaaggctggaggtacgatacgtctgagtcgtgttgcagttcgagagttccctccctgaaagtgcagtttttcgccttctctctcatccttgctcatccacacacaccaaccacttctggcgaaaacgcggctgcttcattgcgaccgacctcgcttcttccccgtttcgtcacgccagacgcaggaccgttctttgctcgaggttctactgaaccctttccttcacttgcgtgattttctccctggttcggccccactttattcgtccggacatccaggaacggcgcttcggccgccagctgccctgcagtcctgcctgcccaacccccggtgtctgcacaccgcagttccggcgggttctttccacacacacacacgccgctcctcggtctcccctgttgcgtagaaagcgtttctcataa

SEQ ID NO: 1312 - DNA, 812 bp, Toxoplasma gondii
gtatcatggagaaaagttttcgaactccgcggcttcgggccaattccactgatgcagctagcggggggtgatgccgctccctggaaagaagaagagaaacttctcctgacgcgtgccctcttacataagacggtagaaagtgatgggtcgacccgaactcctgaagagggaatcctgtcggcgggaactggcggctttctctgcggttcacgcagttctggaccagaagaagacttacgagtctggctgtcacagttgagttccatatatcagtaccacgccatgcggacgcttatgcaacgcctgcggcgtgcggaagacgagtttcccgaattccaggagttcaacctgcgaaactatagtccacgcctagctaaactcaaaggcctgctcaaagactgagtataaagacttggacgcgcatcagggggcaggaagtggtaataacacagttgtgaggcctggcattacaccgctttaaaaggtgccggtaaatcacgataggatggcgtgctcttccattcccagtcgtttcatcttttggtaaggtgaatcggcagtttaggccgtaaatgatcgtcagaccctgaatagtggagatgccagtgacaaagaagattacaaacaccggcaaacggcccgtgctatcaacttttgtggcaaccggaattacctgctcctgttgtttcgtggcataacataaatatttcaaccgttcaccgtcgcatgctcgccaaaacaaattttccagcacagaccttcgttttttctcgtcagatgcaaagctgcctctccccacaagcgagaatgaa

SEQ ID NO: 1313 - DNA, 2240 bp, Toxoplasma gondii
agagagagatatgctagaggatagacggaaatgcgatacaagagaagagagagaggcaaacagagggaggaagaggataaaaaaaaagagacaagagaaaagaggaaggcgaaagaggtggggaaggatacggagacgagagaggagacgagagaggagaggagaagagagagaatgagagcagcgaagagagagtagattagaggggaaaaacagagaagcaagcgaagaaacagaagagatcgaacatattttcataagcggggaaacggagacgatggcagcagtctctatatgtttatattgatgtacacattttcaaatcttttcccttgcatatacatatatatacatatatatatatacatacataatatctgcatgtccagctcttcacataggtttttactttaagtatttttgaggcggaagccagttggtttccaggaaccgggagcggctgctgcatgcgtctgaggcgctgcggtagccaccgggactgtctggctcacctgcgcccaagcaggaggaagccagcgtgaggaccgatcctctgagagagccgcgcgcgatcggcgagaaagctctcgtctgccaaggcacaaaggccggcgacgcttcttctcccgcagcgacaggccggaggatcggctcttgcctgctgtctgtctgagcgcggtccattttctctgcactcgcctcgcaggttggaaaccagggagaggaagcggagggaaacggacgcggagggtgagacggagaagaagaagaagcagacgaagaagacgaagaagaagacggtggagaagaagaagatggtggacgcgagtcactgggcggctgggcagtggacaaagaagaaggcctctgcgttcctcccttttttcgggaggcgtcgaacgcaccctcacgcatcctgcgcgagctcttttagagcctgggccgaggcgagaaaaggagacaggtctacatcagaggacgaggcagtaggaagccgccttcttcgcctccttgcgtctcttttcttctttagaggaaaccgaaaggccggagacgcacactctcagaccggctggagagacggcgggaggggaagactgccttcgtcgacgaagagcgcggaagacatgcgcgagggaaaccaaggaaacgctcgagaaatctggaacggacaacctggagcaggagcaggacaagccgcgccgcaaggaagcaggcgccgctcgactccctgtttcttggccgccagactctcgagcggagagagtcttcgaccgcggacaggccttcagacacacgctggagaaaagggagaagacaaaggctcaggagagaagacggtgaggaagcagaagacagaagcagttgaagaaaaaggcaattaaggccgtagacatgtctgcggagggcgcgcgccgcggggacggaacggagctgctgtcgcaacagccgacgacggcttctctgctgtgccgcgcacaatcaccaaagagactctgagcattcgcgagccgcgacgcggccgctttggagtattggccggaaattcgcctcgaaaaacggggaaaggtctgtagagaaaacgagagaactcgagggagagactcgcttccgcgccgagctcgctgtcggactcgggcaggaaagagagtgtagcgacaaagcgcatgcacagaagacaacgcgcagctgccgctgaactttttttcggacgttttctctggaaaaacggtgctcttgctgctggcctccttctcggacgccttggaacgccgccaaacctctgacgcctctctcctttctcaatccgccggcgtccacttccctcgtgcccacaccgttttttctcgcgttcgtccttcgctgtcttcctcctttctggcgcggtcgaaaaaactatcccccgccttctgtcctcttcggaagcgttccatccccctcaccttgccgatttgccttcttcttctcgtcgcgcgccgttctccgcgcttctgtcgcctgcagctcgttcgccgccttcgcagagcgaaggcgtcacaacgtcctctgtctctggactgcagacgccgcggcggcgaggaggctggcgctgctcgaaaagacatgtctcgttactagagtcgttcaggaaggtcgcgacctgtgcgtctgcgggggaactttggccttcccgcgcctccgcctcggacgtctgtgctgagaaccagcttccccaactctggaaagaatcgcgaaaaaaa

SEQ ID NO: 1314 - DNA, 1644 bp, Toxoplasma gondii
tccgacggccatgagcctctttttgaatgtgaagcatgttctgttgcgtgtttctcgagagaaaaagcgacgtacaaaacgctctttcctcgacagattctgacctgcggtcacgacgaagatcgctccgacagttcctccgactttcaggcctttctgcaatctcatccatctctctcggagtttcctttcttcgcggcgcttcgccgcagctgccgcggccctaccagcagccgcggccgttgctgtctgccgcagcggcgaggaggccgaagaggcaaagcgcgcggaagcagaagagcacgagagagaggaagaacagacggagacagccgacggacgtgaagaagaaagggagcttgcactcagaggcagggggaagagacgacaacgcgaggagaagcgacgggcgcaaccggctggagagagaagcgaatgcgacgagacgcaggaggacgatggagcgacagagaaggaaaaaggatgaacagaagagagagaggtgacgagctggggagacggagaggccgagaaggtcgagagacagccggaagaaggaaaggccgaagcggagcgccaggccattcttctcgcttctgtagctgtgaagactcgcccctggagagaagcacgggtgtttaacgccgtcatcttgaatagagaagaagaaacagacaatgagatgaagcaggcggtggcagagacggagaagacgagggataaggagatcaaggagacggaattgaggagcggcaactgtttgtaaaggtggggaaacgatcagtagcgaggacgaatacgcgcagagacaaagaagagagaggcaagtgaacaagaaagttgaatacgaaagccgggaatttttaagagaactgaagacgaagggctgcagcgggactgtggctggagagactcagacgcgaggtaattcgttgggcatctctgggaggaaaagaaactgaaaatggacaaaaatgcacacacaataaaggcaaggagctccacaagcccggaagaagcgaatcacaagtcgacgaaaaacgtctcgacccaggtcaaagcgcgacgccagcttgcgaagtatatccaccccagtgtatcgcatgctgttcagaagcgggagacaagagaagccagatcaggagagaaagtggagagtcaacagcgacacatctgaaaggaaacaagtcttccggtgagttgccatcccgcctgcaaaagaaaatcgaagaaacgtgatcgtgaatcgcagccggtgtttcgagccggcgcctcgtccccgcaaacttggaagacacaaactgcatgcaagaaaaggtcaggctttcctcctcgtctcctctcaaaagcgtggccgcttctgctgagttcttggcagaaagacgacgttcttcttcgatttgttcttccgtccgtctgtccgctttcgcgtggggtgtatgtacacccgaaattccgggcgcacctttacccagattgggcgttggtcgaggggcgcgtgtggatctggtcatctgactcttttccttccactttcttgtttgatttgtgttttcttgtcgttggcttcctcccgtttccagcttccccgattcgtctctttctctcgtcgtcggagaacagctccttcgtagtgtgtcaaaa

SEQ ID NO: 1315 - DNA, 2460 bp, Toxoplasma gondii
tgtgcacgtgtttctagtacgactatcatatacacatattctaataagctaagctgtacgtaccccgtcttgccatggacgatagtgtcacataagagttgccagcagacccgcctgtgtagtgcacgatgccacaccagtcgccggggcattttctagcaaccaagaggtcgtagacccgctttttcggcgatgagttttctgtggcattggcattcgccaattcccctgtggtgatgggtgaagcaagcgaatggataaagcactcgaaatgaagcgtttctcgaaacacacactctatgcagttccgggcatcctaaataccctcactgctttgtgtcctccggagctgcgtttcaccacgaggattcgcatgcatgcacgagctatgcaacaatattgctggatgtaagcgaagaggcagtctccgaaagagcatgtcaaggcttgaactgcgcgtctacttcacgagtgaagccacacagacaggtgcgagtgtacacactgttgcatatacgcctatatctgcatacccaagcgaataaacgcatctggtcccgcctcgcaaacgtccgtattctcaggctcacacgacattgtatttcgacttaattggcctgtcccttttgaggcgccgcctttgcctgcgtctctggatcctgggtctctggcggcacgcgcatgaacacagtcggtgtgaggccagcgttgatttccgggtccaggaggcgggggtttttcgcaacctgagagagcatgcattctctcaacagcaagtgtgtctgcaaatagtcgtacttctcccaaatgtgctgcagagagaagttcgtgtaccgccccttgagggtcaccttggtcgggtcttcggggttaaccaccgcagttcccgccgcgcacgatcccgctgtcggcttccccttcacggcagcaaacgcctgcatccaccggaaggaccgtgcgatatcttttgagagaacggcggcagcgccgctcgcagcaggggcaggcattttcttcaaatgaagagaagagaggaagggacgcgacggacggaaagcgttagtcgagcaacgggacttcgtccgcgagcgacgggggtacgacgctggagggggaacttgaaagatggagtcggcgaaaaggagaactgtgtcagagacgatggcaaacgtggtggaggcaagtagtcgaaaaaaaagcagaaggcaacggctgtgcagagcggcgctgaaccctctggaaaacgacactttcgccacaacgacaaagaactacggggcaggggcaaagctcgtttcttcttaggaaaaagaactccagtggggagaggggcacgaacacggaccaacaacgtgcagaagagaaacgcgtcaggccaaagacgaaagtcggtcctgggagaggagacacacgagagcactacctgagcgccggcggccgtgtagggcaagtttcttcggacctcctaaaagaccttcccaaaaaggcgtgtcatatacgcgaaaggtcaggacgtctttcaaacgaacaaaaacggtttccattttagccgtctgtggacaggaaaagccccccaattccagtcgctcaaacgcatgcaagaggaaaacaacacggccgcttttcagcaagggactgcggcgtgacccccaacacatgccagcatttttgcacccacttcgttggtgtcgccgggcatctttaaagacgttttttttaagaaggagaatgaccgtcccagacggaaaggggatcccctatcgctgcacttggtaactcatctgcattaaaagaaaagtgtacggtctgcagacaagatgctgcgtatatgcacgtgtacgtatttccatgtgcagtagccgctcttgcagcggtagcacgacgctctgtttgcatctgacttgttattctttggggctcggcagaacagcgaaaaagagttctggtagtacgtgtcggtcttgcaatgaaattcgtcattcctgactcccctctctggcttctacattgaccgacgctagtaactggcacagctgaaaaccctaagaagcccttgtgtgacctgttgggtatgtctcgcgatattctcccgaaaaactcgcgtgtatgagaagagatatgtatgtggagatccaaggcgtatgccttttccctatttcagaggtacgggcctttcctgaaccagcaactacatcaagttcatcgcgaacactagaaactttcgttgcattcttgtgtcggtgtggttttttcagaaagtgtctcccccttccttatggtacggtagcggatatagtaactaggcagaaggggcctgccgatcagactgggtgcttcggagccgttgcgtctccttttcgtctgagcagagggggccgcttaccaccagaccccttcttgcgacgtgttcccttgtaactgttgtcaagtaccctatattcctttcgctgtccaattaga

SEQ ID NO: 1316 - DNA, 1689 bp, Toxoplasma gondii
gacttgaaaggagtcgttggatgagatcctgtgtcacagagtctcaccagcggcagctcccgacgctgtgggtagagcagctgtaaagcaaataatgagtcgggtgatccaccgcgaatatacgcattaacagccagttacattaccttggagtgcagcagcgcccgaaggcttctcaagaagacctgagaacgtttcagctagttacgtgcatcctacggtacagccgtgcaactcaacaaacctttgtccttcatgtactggacatctgccaagagtttatgcctcaattcatcagcgtgctgcagcttcctctcaagcattttctgcatagtgtcgattttacgtgcctgagctgtagcaaggaacgcttcattctccatacagtgttagcaccacaaacatgcggatactaccttcgtccagctccggcagattcaatgagggttgagctggagtcggcatttcggcttcaggaggaaccacttcgacgcccaatgcctgtgcaactgtctcatgaacgccttgaagtgcacctcctgctgcttgaagtgcagtttgagctaaaacatcaaagaaacccttttcctgcgaccttagtaccgccgccgaacacgacggtacagccaccaacagcagacaagcggaggcagtctgtactttcattttgaacctaagcggctggtgactaaggcttttaatttcagaaaagaccaagcggatgcggataagctctgatgtttaagccatactaccaagacagaactgccattccgcttactgtatgtacaccagtcgacaatacttgtgcctgggcaagactgaccagcctttgttacgagctgcatagagtggcaatattgactggtcttccacgcttgatagactcccaacgccaaaaagatacgaatctaacgtgttacatggcaaaggtattgacagccaatgtacatactgtgtaagattcaagcgcttctgaattctgcggcgtcggtggcgcccctaccggcccatccagccaggcggacttaatttccacatacctccgggaatgtgaccaagggaattcgaattacggatggttctttgtcaaaagagaaagtctgccctttcccgctttcggataacgatagaagatttccccgctcaaccagagaacgcagagggtcctgcatgcaatatgcgatttccaaatgtcccatgccacggcatcgtacgctggtggttgttttctggacgatggcatattgattcggtgcgctggttcacactggctgcagtttgactcacgaggttttggagggtttcaatagcgatatgaactttcgttgtttcttgccttgcgtaactgtgttgacgtgtgcaggacgacgtactgtgcttctccttgcagcggtatcctggccgcgccgcgtacgtgtggcatgcaccgtgacgaaacgaaccgactgaccacgtccttaattttgctgtctttccaacagttgtgccaaaggttccatttaaggaaaaagtcttgtttcggttgttcgatttctttcttggggtgagcagggtatattcgttcttccgtcaccccccacgacttgcaccctcatctagattctcaacaaggactcggttcttttcggaaggacgatttgtgtatagtgcttagttctgcctttgcctcttcgtcccacgtcgcca

SEQ ID NO: 1317 - DNA, 1608 bp, Toxoplasma gondii
cgtcgatcgagagcacagaaacccaaatcgacggactctgggtgtccccattcgcagcaaaagctagctgctccggtgatatcgtctacaacttctctacaacttcccttccattacactggatgttgatacgtgagttgtcctctaccgagtcaaaagctcagacaagagcagagttggagagcacccacaggacagggctacttatagacgcggcaggtcttgcgctattggtccagaaagaatgacggaacacgtcaacggagaagtaagaagtcccgaagctcggttgctgcagcttggcaaagcgagccacagcaaatacccgggcgcgatgtcgtccggaattccctattggacaactggggtacaagtggttcaacgagacgtgccacagccaaaaccagcagtagcctgagctggtctcgcaaccgaagatgaagcaaatagaagacgagtgtgtctcagcactcaaatgaaccgcgtgtgaccgatgaggggaagtggagaaacgctgcacaatgcttccgtgggccgagtaccagggagtgttgtccggacccagaagctcccaacacacgatgtgctgaagaagtcagtccctgtatcaccacatacaaagcagtacttccggaaagagctccgttctagaacgctccggacgagataaaatgcaccgggggtaacccgagagacggccaccctctaccgatgcttgaacagttcctcacacaggacgcaatcacggcctggtcgacccccccccagcagaacaaagcaaaagtccacgcaaggacttcttctcaggaaaacgcgtagggctgaagagagacctctcccgtctcgaagagatccaaaacgacaaaacaaggccacttagtccctgctcgcgcctcaacggagcctgcaacacagtccacgtcccggcgaaacaggttgtctcaggggaaacagaggtttaaaatcaaaggtggttttatctgtcaagctgatttttcaaaccatttcgaacttccttccagttgatgcgtttttgtgggagaaccgaggagccagttgggataaattggctgcctgggagacaaagctcccgtcggttgtgcaacagcagagcgagtaacctggatgttccagttggaaaaaaacatagaacttggctccttctcaggaattgaaaatatcaaagcacttagaggagcaaagtggaagaaaatagttcattatcacaaaggagtagcgaacgtaaatagagctcttggtgacccaggcaactctgtaagcgtgaactggtgactaccggcaatgcggcttggcatggtagcggcttataaccgaaaaatgcaggcatgcggcgactgttttcccgaccagccgcgctgccaggaaaaactggaacaaactctgtttgggacggtgttcgctattccataataatgttcgacaactttccataagtgcacgaagctcgggttcgagtaaactgcttcgtttgtgtgcagctgtcgtatgaaattgcccagtctcttctggacagtatcggtcacagggctgtggtcgtcggtgggcgttctgcgtttttctgattacgtccttttctgcttctaacga

SEQ ID NO: 1318 - DNA, 1875 bp, Toxoplasma gondii
acatagggaaatgtgtcctgcgcattagacgtggcagtcgaggaacccaacgaagtctccagatccagagacttcggagccaattggctttctcgggaccagaatttcatctttgcgaggaatagagtaacttgcttttgactcactgctattttggtagtgaagagacgaaatggaaaaaacgaaatggatcagagcggcgtaaaagggactggtgcgggatggcgtgtcagcatgattcactggtacccgtatgcttgacagaatacgaaaacattcagcaagaaatactaaagctgattagggattgctctgaagctccaatttccaaaatagagacacttggaagatcggaaaagacctttctgtgcctgggttttcacagcctgctgtcgagcttcggaaactcccggacgggtacggaaccgccacgcttgggcacaaaaaagagccacatagtggattgctgggcaacgtagcagttcctggaaaactctagctcgggattactatgatttcatattcgttttcaaaagcaacagcacactgggcgaacgaagcttactgttcttgcaaaaacgagtgaaatgccgttagctcctgctgaaacaaaaacagctgctgtacttgccatgcgttagctgttctatcaaggcagtgcagaagactctgcagtgcaatttccaagcgagggggcagcggcagaggcttttcaggacgctcacacggacacacaccgccggcagctaccgaagaagcaggagaggacaccgcctctccctcggtggagatcgagtgcgaagcctccatgacgaaaccagaaaaacgttaggcttttgagaagaatgaaagagaggagtcctgccgttatgagcgcccggtaccccccgtcgcatgccgaagagctaccatcagggacaaggcgtttctatcctcgtagtgtggaactgatctccgtagatacgtgtagaatgttaagaaggaaggcgcacatacagttcaccaagccatgccttcctccgtaccccactcgccaagaagttgcttgacagcgtcacaaacaatgaatcaccaacaattttcaacaattttcaaaccatgtctagtcttcggaggccccgtgaagcgtgcaatcgcagtcgcatgcagcgtgcgcatgcgattcttgtccagaaaccgcagttagaaccacaaaagtaggccgcagctgctttggacacctacaaggaaattactacgtgctattcaatatgtaattaccctgcatatagcatggatacacggctgaagcagctctggaaggatttttccgctgcagacacgatggagcaatcaccagacgacactcagtgataatggtgcgagcggaggcattcttggacggtagcgaggctcgcagtgaaagaacctgaatgcagaatagagtaactggttggagtctcgggtgacagccagtgcttggcgtgatgtaccaaaggtgtggaatcagtgggtcaccgctgcagaaaaacttagagcgcgactggtacactcgagaaaaacacagcgcggagggggcaccggtacagagttctggcagaggaatctgacgctagaactgccgtcaactgaatagcaaagaccgactgtttactactcaagtctgtggagtattcacagatggctaaccttccaccattaaccacaaagagttcgaacaggatctttagatgatcagaggtaagcgcagaaacccaccttagaggcagcacggggtgtatgtccacctcaaattacccgaacaaatgggcgatcaccttcagtggatatttcaatcgaaagtgccactccctcgcctggcacaccctgcacgttgctgcttgttttctttcaaga

SEQ ID NO: 1319 - DNA, 2925 bp, Toxoplasma gondii
tggttgcctgggctgtcgtgtcaggacggatgtctcgcacttgtttccgaggttcgtcaccttccccgtctgcttctctccgcttttattcagctgtcatggacgtcccacccgccacatcggcgagcgagtgtccagcggcgtttccgtacccgtacagtccgactcgcgccttgacgttctgctgcgcgagcgaccgagactgttcgggggaaccgctgcaaccggagtctaagtgttgctacaaccacgcgtacgcggagtgcttggatgcgccgtgcgctcctcacaggtaagccgagcaaccgacgagggcgccggggaaacgcgttccgcagcaggggactcgcagcaccaagtcgtccaggagcggcgggcggtatcgcagttttctcatgtgcatgcgcgcgcatgcgggtgctttatgcagaaacgtgttggtggctctcggggcggcgcaccgatacagcttgactcctgagcgtgcaccgcgactcgtggagatgatggggaaactgaacgcgagccgcaaccaaagcgtgcgaatggctgtggaggcactgcagcatctgcacttggtggagaatttcatcaacgaagctttccgggacaggtcagaacacgaagtacaccgtcgctagtcaggtgaatggcgccgtctggctgctcggcggatcaaaaagcgctcggggccgcggtgtacgcgtgccttcgccacgtggaccgggacctccgcgcagcagactgacgtggatttccacgagaggaatgccaggacattagtgcataggaatgtgcgtctgaggaacggaacagtacattggatcaaagaggtcttcctaatggatgtgtgtaggcgacacagagacgaaacaactggccgcatcgctggaagatgagtctggaaaatgtttttgggttagcacaggaaaaacgcgtgacttgctggaacactgcgacgtgtgtagcccacggaaacacaggatatatgtatatgtaaatggtgaaggcggaaacgttttctcgattctattggcttggctttgggtaggagtgcctgcagagattctctggaagcaggcaagttgttcggcttgcactgaaacgtagattcgcggctgtaggatgcactactgaaattctgacgcgaaagagcatcttcgcggacagttcgtgcggaactgggctccagacacgctagtgggcagaacgttttggcagacgtatttggcattgttcgctagcatttttcttttcgtgacatcgatcgcgtttttgagctgaactcagatatttcgaacaagcaaatgtctataattctggtctcgtacctcgattctcgatccaaaacacacttttggacgaaggagctgcagctgtgtctagctttcgtttcactgctgaactgccgtcgtcacatacattcaccgcctgtcttcgtcgccgggccacagacgctttttagcggttccaggagcacttttgtcgcgctacctgtgtctcagaattgtttagcacgtctctccttttactaacacccgtttctacgaagttacgagcgctaaccaacggaaagcacccgccaaggaggtgccgcctgagaatccggtcatgctctagtgtctggttgacgatccctcggcttcgtgaaagcaactgtcgccgcacttgttgcggcgtttcttggagtacaaatgacgttgcaattaaaatgccaaaattatgtgatgacactagaattagagcacaccggtaaaaggcgatgtgtctcatggttcctcctctgtcatcagtgccgaaaccaggaaggattcagtcaacggcagccacgcactgcgggtcctcacttgtaaaatcgcacagcgacgtctacagtcgctcgagttcccaagaatcatcgtttttgaatgcaagtatctgacaggccccttgtgaaatgactcactgctggaaaagataataggaatagccgtcgtggaacaataggaaaccccacaacggtttcctgtcagtgtttaactgtgaacaaagccacgaacgacagtcacgcaatgacttttagcgtggtggccgtaggctatgtccagacgttcagtgtcgctttctgtctggccgcggtcgcccttcagatcctagtgcatcatgcctttttacatccgtttccttttagaaagaaggaactggcattttagctccaaagtatcgtgtgtcgcagaaccacctaggactgtcatctaccgaatcattgcgtcaaatcgaaacggacacttcacggtcccgagcacatcgcatcttcttgggcagatactcaaacggaccgattctgtagggattagactaggcggcagaataatgatctgccttcatagggaacgaaggacaccgtcaggtcatttctcaggcaaagcgcaagacgcggatctgaagcgaacgcacgattctctgttgtttgagacacaacacagtttctcccgtccattcatgagactcacgggcgccccttcaccaaagcaatctgaacactgcgcacagaggcgccggttttttgccttgcggctgccgctgggatcgctagtcagccagcctgggatcgtgagacgggcggcaccttcgttggtgttgcgcctcctggggcgtagaaggactcttgtgcgacacgtggaccgccgtctgttcagttgacttgatcttctgttttatctgcaccagaaaaaccttttttgtttgatgtatttgtagacgggaatgacagaacacgaatacactccaccgcggacatcccaaccctgacggacacaatgccacaaggacgtgtctaggggctctgctaggatctttgaagctcagaaacaacttgtgacctcgcctttcctcgttttggcgtggtgtatggcactggaatccgttcattgtcagtcaagacga

SEQ ID NO: 1320 - DNA, 3297 bp, Toxoplasma gondii
tttgcgtggacttcttgaatcacgtctgcgtctgtcgagagcgcctcgacgagctcccgctcttctctcgcgagcagctgcaggtccactgacgcggccgctccacattccccctctgtgtctagcagcactcctgtcacgtctttctcctcaccatttcttcctttcctttgagctctccagccgtctgctctcagcgcggtcatttcgacctcccgcgcctgtgtctcagacgcctcgcctcgctctccagtttctcgagcctcgttcgtgtttccgccgctgcgtctcccctcctccaaaagacctgcagagcctgggaggcgagacgcgcgcgcctctcgcggggcgttttcttcgtcgtgtgtcccctgcgcgccgttctggacagaccctggaaatgcaccccgcgaggacctgtgcatctggggaaacagaagcctctcggctgtcttggcagcttctgctgccgcgagcgtcgcacgcatgcagtgactggcgaggcgggaggccttctgtgggccagccgccggccgccgagaaggatctcccgacgcctgggagacggccgcagtcgcgaaagcagaaaagtatctgcgactgtccagtcgtccctgcagcgccgccagctcccgctgcttcaacgtgcttgccaggtcctgcatttgagtgtacagacacccaaggatggcgtggcggtgcgcggtggccgccgaggaagccccggggggctggtcgctcgtgcggcgtgcgggcgtgagaaggcgtttcaggtccggatgggcgcgaagtttcttgcgccgcgactcctcccactccgtctgcctcctcgccaaattcgtcacgtcctcccacgactccgctgacttctccagagcctgcaactgcagctgctggcgctgcaccttcttcagcaggagagaaacatctgcgcctggacccgcagagtccccacacgctgcagagacagtggaggccttgaaggcggttgaagggccgagagagtttgcgagcgtgtggcctgcgcgcagttggcgctcgacggcgctctgctctgctgcgcactgcgcagctcgctcaaggaagacaaatttgcatgcaggcggggaagcgcccggactcgagtcggcctcggcggccagagaaaagaaggggaaaggcggcgcagggaaaggcgtgtcacacagagcgcggagcgacggagagacctgctgcagggccctgcagcaggactggaagtcgggtgttctgtcacacatgttccagaggcgcagtctgctcgcgagagtttccggaagaggccgcagaaccccgagcacagacgcatgcacgcgttggcgcctcagagcagacgacatcaaggcgctgacgcggcgctcacgaaccaggcatccgagtcgacagggggggacgtgcgcgtcgacagacagagcacgagcgaaacgggaagtccactcgagatgtggagaggcacaaaaacagaaacgggagaggcgtgacccagaacgacaaaacgagaaagaggctacaggctcctcagagaagaacagaagctccagaaatttacgttactgtgtcagcgtcttgccagcgatgtgagcggccgactgcagtccggcccgccgcggtgtctagacacgcggtgtggccggaagcgcgctgctcttttgtgcaagtttccacgaagtcttctcgcaattcgtctgactgggcttggctccgtttcaacagagacctctcacgcggtgggtttggaatgacctgcaggagctgagaagtgcaggcctgggagtctgtccaaaagaagctcggcgcacaagaactgcgagaatctctggtcgtccgcgagacacacagacaaggtaaaagtgcacacacgatagcgccgccctggcgggtcctcgcgccctctttaggaactttgactgttttcgtggaaacaaggcagcgagacgcagctttctgagaaccgcggacagatgcggcgcagctggccgggggatggtcaggaaacaagagcggcgagacaagacacaagcagagatgccggaaagcgggttactgacagactcaaccgcacagcggagagaaacagaagtttgtgctcagagaggaagaaagaggtcccggaacaaggcagagtcgcctggcccgttttctcgcgcatgcgtgcgaaaaacagcacacggcggacgcggctagcagagagtggaactggaatctgtagctacggtcgaagaagcgaagaaagagaggaaatagaaagaacaaaagaagtcaccctttccctgtaaaaggaataacagagaagcgatgaaaagggagaagaggggaaacagaagaacgatgtgtgcgtgtgtctcacgcatgctctcgagtttgctgaatttcactgcccgggttccctttgtcatctttcctccactctgacgcgacaaaagctttccagagacgcacgattttcttcacaccaatccgtttctcgcttccgacaagactcgagaagagacaatgtctccataatgtattctacagaagtgtgtgaaagagaagtgtgtgtatcgcgtgtgccctctcgcatacatgaaggtatatatctatatctatatatatataaatatatatatatatatatatgcatgcatgtttgcgttcatatccatgtagatgtgtgtatatcgcttggggagtcggctatcaagatcaacggcctctgtatcgtgctcggctttcctgactcttgtgctgagtgttttccccggagaaagcgaaaattcatttttctggagtcattttttcgttccttttttccggatagatattataagccaccactccatagggagaagttcttttttctcaatcttctccacaactctctctcttctcggcgccggcctctcttgccgttttctcctcgttcagatgcttccaccactctcatcttgtctcctccagaccgccactttcccaaagtccctacggactctacaatcgtctttctattcttgctctactctcctcttcctctactcgcttctacctcgcctctgttcctcctctacgctcttcccttctcttcgtcttcttcccctctgttatgttttcttttctctctccccggatcttctctctcgcgttctctccccggatcttctctctcgcgttccgtcccctgttcttctcgctcgggtttcttcccctgttcttctcgctcgcgtcgcgcgctgaagcgattcggctgacgagcgaggaaaggaaggcctcgaggaagcgaggcaacgtcgcctctcagga

SEQ ID NO: 1321 - DNA, 3902 bp, Toxoplasma gondii
tttctcaccgcttcgatgtgaaactcactcagtccgccatgagaaacgaatactacaagtcgcgaaacgccatggcttactatggccccgctgtggtaaacgctgacggagaggtcgatatcgctgctgctgcggagcaggctcaggcttgcctgtcctgcagatcctaaaggctaattagcaagcactgggaaatgtggtgaacaggagaagcgacagtaactggaggccgtgctaattgtaaacggcgcaagcgagagacatggacagccaggcataacgtgaactgtgggtgaaagaatagtccaggacaagggaatgacagggaaaagaaatgtttttgtatatctttgtgttcttccagcccaagcgatccagtgcgtggtttgtctttatctctgcgctccgtgaagttggccgacaatcaaactcaccctgtttcaccaacatgttcgcgttttatagtttttttcggggaaaggtggaaagtgtggctgtgaaggaaactagcctgttagtcgtgcagacgagcaatggcttgtcttggggatgtggaccgttacctgcactttacaatacgaggttttttgggtcagctccgtgctatcgcctccatgagttaatcgctgtctcttttaacgcggaacagcaccgacaccatccggtgggctagtgccacaacggttcttaaaccttccgcccgcggtctgaccgcgagaaaatacccgtaaaaatagtttagctgtatgtaatagtagaaaaattgttgacaggttaagtcagacgactcgcagcacgtcgcgttgtgtggctttgccgacgaaaaccaacgtatggatgaactaggcagcttgagggcagacagggaattctctgtttcgatcgaaatgacgagaggtggtccgttcaaaaaggtgatcgccaccgaatcgcattgcgcaaaagctgggatgaaaggagacaatggaagcagtagctagcaatcagagtcacttgcaatcctgcccaccttttaaaaaccatgttcagtcagtccggcgtagccaccacgccctctgaactaggcatccatggctcaccacatgaacagcaggaactatgtgcactggacgcaaatgcggaataccagatcagaaggcgaagtaataaagtggctagcacaatcaacactagagatagcatatttctgttgctgcgtcggtgtcggctgtgagatttccgcaggaacggtgcatatgagtactacgttaaaacatcgacagttctcgagacactgcgctgcaattccggagacaaatgaaacatgcctgtgagcgaaatgcgtgcacacatgttggtgttgagacaaaaacaaaagcagtaggcggttcggccatgtaaaacttcgaaaagaagtcggtaaatgcaggcggacgtcctcatggttatgtagttagcccacctcatttcacaaatgatccaaacacgggtgtacgaagaaaaagcagcgcaccacaactgcggggaagctagggacggaatgacctttcagacagtttggaagacgcattggcagtagccacaggagtaaacgtaaaactgcaccgtttcaaacgcgaattacagaccaacaactttttcctgtcttcgctgcgtctaaggtgacaaacccattctcaattccaactaggtttcaaaagctgcaggacggcactggcttttgagcacaaataagctggaaacagtagtacaactttcaattatgccccctccagccgtcacgcagactatgttctcagcaagctactgcaccgccagacaccggggtatatccgcgagaatttgcaaacaaacaaccatgtgtcacatgcgacaggaactgcggcagcataactcattgcgatatcgacgacatgattttgcctcaagcagttgctctgcgactatcgacatcacaaaactcacgaaatgctcccatttacggcctcgtgtagctgatcaaacaaaggcacacttgtagatgagggaaaacttgcggattaatatgagtcacgaatccgatcggaagatgccaccaacacaaccggcaaagcatccgagaaggacacattatggatggtgtgtctcattcttgataaacaactacgttgcctgggacgtaaggggtgctggcctgcacatcggatcgactttgcatatgcttcttcgtatttgtcgtagctactcattgtatcgagatgcattactgggtagagagcgcgtgtgagcgccagcggcgtcatgatcctctctgagatctctgtgcaacattgctgcttagagacaacaagctgttgtcaccaataaaaaccaaggtgacagcagaggatagtgccactcagtttggggctggaggcgcatgtggactgggtatctttttatggcgaggcaaaatgcactgcttcttgcacatacgaggaaggtagtaagggtaacactatcgaaaaaaggagcgctcgagcgtatacgcggtaccagtcgctagtgagtagggtccaacgcgacggacgacaatggtgattgctgttttgttaatgggcatctctgcacatctgccgcagtccgaagaaagatggcaataagaatcttgcatgtttcttcgggaccttctgcacggcttgctgttgtggaaggactgttcaagggtaaaaaatgtctgccaattccatcaacgctgtctgaaccacgtcgcaggacggaaacgtacttgcgaggcacccgacgatttgcaccagatttgagagtgtggtacttccttccctatgggcgagtaacagaaacctccctaaacagtaaatctttttctggccaaactgatgagataatgttcatctctcttctgccaccttgctgaacgattgcttgtactggtatctcctacacatctgtgtgagactgtatggcgacagccctggtgcgaacccagaaggttcgcagtagatgcgttactctcgtatgcaagccagacaacgctctgactgcactcaagattctcttcctctcagacctcccccctgctatggacataagtctaggtaggagaggtgtccgcagaggctatattgaaaacgcccactgctgctagtaggcactgctgcataagataccgtctttattcggctaccacgattttacccgtgcaagagtttcacgccagagcgcattccaccgaagatattgaaggccgaaacgcagctgcttgaatgtcggtctgtgtaaacgcctgccgtcgaaggtgacgtcgcgcacacgctgtacatactacatactgtgcacttgcgactcccgggacactgttgctttttcccctttaggcatccctacttttgaagttactccgtcatctacgagggaaatgccgcgctatcctactcgtttctgtggtgttcgatagagaaagtctccattcagcattgaccctggtgcagttctgttgttggccgactgaaacggggcggctttttttctgctgcatgtggtacgctgccgcgcacatggccagaataccggaaatcgacgactgcgacaagacatgaccgtttcgtccacttttcctgggccctaagcatcgctgcgctgttcttctcccggtttcttcctattgttgctgctgtgggttgcagttatgcgttgagtttttgttgtttatctgcgaggatctgctcacaagaactcggtaaaagacgtgtgggtaagccggcatcgcgcgtgtgccgctcgtttccacgctgagaggactgtgcattgtgcgcggtttccgtccgcgatttccgctttcctgtctatctgtttgattccacaagacactttggcttgcaggccgtctgcatagatcgttgatcctgtcatcgtccacagaagaatctgttttcccgtcgacaaaa

SEQ ID NO: 1322 - DNA, 4631 bp, Toxoplasma gondii
tggatggcttcctgtctcgctcgcgtgtctgtatttcttaggtacggcccccacttcgttctccagttgaatgccgcagggctcgacgacttcctcccggtccttcagccggtcatcgaagacgttttcgaagccgagctgtcgactttgcttctgcggaatgattcgccgttgagacgactggaaaaactccccttgacgaagtccttcctctcaggtacacggcttttttgtcgtgctgtttcggttgctaacagctggtgcgtgcaaatatccgtgctcctcgtcactcattccagggctgagcgacggtgtcgtctggagtattgggcatcctccgctagcttcggtttgcgtatgcaactctcccggctgcatgtagactgttgtctgtgaaacatatagttgtcgtctcgtagaagaccggggatgtgtctggtaatgtacgaaatgtggttcgtgccggctaccagcttctgtacgcatctgacggcatcgtagatattcacccggagttcccttttcctggtgcggcgcgctggttcagggtatcgcgacacccccgtcgaacttcttgaaaatggaagcaccttcctggtcgatctccttgaaggcgaaagaaccgggtggaatttcgagcagcgacccactcgcgaaatgctcgctcctctctgccgccgccgaaccgttctcggtcagcagtggaggcatcatgcggctgaaactccttgaaaaaaacgttggcggcgccgagcacagccagcgctacaggaaaacacaggcgacacacaaactggacacagcaatccgtgaacgtagttgaggacatgtgtaggaaccagggccgccgcggttgcatcagttgagagcgaacgctagagcatttctttcgaagaagactcgccggctttgtctccgaaatcacgcaactcaatcacggcacactgtcgcacgaatgcagaaatgtgtgcaagtgcatttgcacatgccgtttgcgtacaccgtatgattacgacatgcggccgggataacggctgatttcgtgcttacttttagacgaagtctcgcacttgttctgcctaatggagaaacaatttcccgagtactgtcagaaatttggtgacgcctgctgaggtgcggtcaccggcggcgtggcccaatggatagggcgtctgacttcggatcagaaggttgtgggttcgagtcccatcgtcgtcagctgaactgtaatgaagtttgcccatgaaaacgtggcgttttagagttgccaaagagtccctcactgtagctttgtctcattattattcgacgacattttctttttacgcgttttttgccggagcgtggtcacgtcttctgttcctggtcataccgcggtggtgcggacgttccacagtatcaggggcaacgtcatactctcatttcttgtcgtatgtccttttgctctgcttttttccagatctgttttctcacggaggcgcgttcggcattcaggcagccacacacggggcttccgttgtggtgtgcgttcacccgtctagtgcgtctgtagagctgggccggcggaacatcgaagccaacagcttttcagattgcgcagttcacgttcaggcagacatccttccttttctgcttcagctcgccacagacataaacgcccatgattcacagtcaggaggttctgcacgtaattctatcggaacgctcccgtcgtccgcggggaaggacgcttctccgagcgactcccggccactgttaccttggttgcatgattccgtttcacgcgaaagaactgcagaagcggttgcagtcgcgagagcctccggcatagaaaaattcgacgttgtcgtgttggagatgccgtcagtgttctctttgtcagcgtcgaaagcggccgaccacgttggacaaattctgcgggcggcagtcaatatcacggcacagggggggcttcttctcataagagtagagagtacggcaatagggcgctttgaactcctttccctcattagaaggcaagtctcaacatgaacatgggactgaaaaaggatccaacaacacgacgaccgtttttgtagatacaatgagccggctggtgtgccccaagatgagaacaaatgaagtatatgccgcgacagcgaaatacgaggagaggcatacgagttaatagcgcattttttctagtggagtagtagcccaagtgaagccaaagaatcttatccattagtccaactcgcgctatggagtaaagaggtatttggggattcagggatcgaatctcacacagtaattcaatatcggcgggggacggcgtcaacactaacaaaccgtactggtcgcgtggcgataatgtcactgaagcacattcccgtgatgtacgccaagtaagtcgacgtaaaccacagtcctaacaattctagcggtccggtggacggcaactgtgtgactgcctgtgtttccggcaatgaagagtgctaggctttatttcttatttccaatgctcttttgtgtgctccttcagaacactgcatgtgtgcggcgaacaaggaagaggccgtggaggaaaaattgtcggcgagggaagcctggcaatagaccatccgattaacgttgcgctccctgaatcgcgacattctcactctttcctcattgccttggactgaccggggcagagttgttatttattgtttgtccaagtccaggctaatgacaaagaaggaaggaatcacgggatgtgactctcgctttcccgcataataggatacggggaagacgcagaacgccctatttgcgtttgtgtctatcatgttattacagcgagactagaagacggaaaccggaacctgatttctcaaaataccagcgagctggtgcggaacttgagtcaggttgctcttcggagtgtgcactgaaggaagggggtagcaagcaggccacgtaccaatgcagaggatttcttctctttctttggctgcaccctttatcttatgggcggtcgtgcctcctacatctctgtatatctctgtataaatgcctgtgttcacccacttcattgggtgaatttgaaggtagcagtgtcgtctccaccttacagcacaaacgcaaatcctacgactctttagctttccacactaaataaaataactcagccacacattggcacagccatcaggttcctcaaaatcccttgtagatgctggaagtcccaggaacccgctatcgctgggtgacatctgaaagcttgcactttcccctctcgatgatgtaacaggaagagcacggggttggttcgggggattcaagtgctagcagttttgtcgccttttaggtaatgcttaccatttggcccaggagctgtttgcgccgcgtccgctttcccagagacattaaggcggggcgtgctgctgcgcctctattggtggtagaaatgatactcaaacaagtgctacttgtgatctgcacttcttccaagcgtcatcgagtagcaagctcgggggagacgtgtcaacctccaaagagattcttgtattgttcaaatcgtttgttgttgcagagtaagccttgtgacggtcgtgagacgcagctgtaccacgctaacgatcgactctctgactggtctgcctcacgctcaattttcctttcattcagccgtactctgcgcaggaataacgcatcttaggcccctcacatctattacggtgtcagggcaaaaaatacctcctgggcatttcctgattatacccaggatctggtttttcatggtagtgccccccctcgatcgtggcgattcctcttgctgctggaaagttcagaggccgcaccctggcaaacgcttcgctatcctcattatagtcgctgttcctctctaacaagttttccacttcttctcttaagactgtggctaggactcaacaaccactggcttcggatggaataactttttgcgccgcacacactggcgctagctgtcattcaaggacgacacaaatagatggttgtggtgctaaggaggcgactcttatatcgattagccaccaattcaggtgtgtagcgaaacccgtgcttcttttcgtcaatgctatctatttgtgtcgccacatgtatctccacctacacgactttccctggagcatttgttccgttcttattcgctatggctcacagatcggacactccggaaggaaccccgaggaatcatcagaacaccgaaaactgagaggcactgctggctaactgagattcagacgaatctttctgaaagcgttatctgcagacgcgttttccccgtgagtgtcttgtggtaacgttgaccaagttactgcatgcgatatcgaggaactccgaaaggagtttcgacagggaaacgctacatctgcgcatccttagcagaggcaactcgtttagatgacacggggtgacacgttgagctacaaaggcggctgaaggatttataaaactggaggaaagcctcgatgtctttcacctcgcgttcttcaacgcatgcagcgattcgccaggccctccattttctgaacgcctctggcgaagtttgcattctttcgactttttcttttctcctattccacagtctaacttcttctgtaagggttttgttctccctttcctctgca

SEQ ID NO: 1323 - DNA, 1829 bp, Toxoplasma gondii
atcataatgcatgcatgctgtgcttcctcttttgtggaggtgaaccccgccagcagtgggactcaaatgggggaaagcttctctccgtttcttctcgtttcgccgaccacagggtagaaatacgaacgtgacgtacgcgattagcaagcatatctgcgataatgcaccagcacacatacaacgtcaaaatgtcgtgtttacagccgccacagcaatatacaacggacagaataagatccggaagccgagctatctaccactcaaattacggcccggcacggtcaccagaaagttttgcgaagagagtagacagctcgctaggacctacggctgcgccttcgcggcagcgtttttcactcgacaatcaccacttgaagttgccgggtttccacttcatccgcggacaagggcccgagaaaagatggaaacattgcactagcgaagacactcattcaactaccaatgaaaaaatccatgtctcagactctccttcgagttcccatccgccgcacagtctcgcacacacggaaggagacatgtcacgcgtgagtcatcaacttcataccgccagagaacatgctaacgcgaggagagtggcatggacgggcatctgaagcggggcattcattttgtttgctgatcgcggccgcggcagtcgtcgacaatattaagtctaacgcgtcagtctcggacgctgggtgtggcagggaaaacgacattcagcaagtgatgaagagctttagtcagtagggctccagcgaaaacagggacggttcgaggaagaagttcggtctgctactcctcacagccgcggggctacgatacagagtaaacctaaggaaaagctcggaagtctagtctgctttgcatccccgccctcgctttagacgatgccgtaggactgtaacaactcctactcgtcaagcatattcgcttgctagcctggcaggatggactgccgcttcacacgaactgaccggtaacatgcacaccgttcggcgagcgtgccggatggcaaacaccgaagcaaagatatctgctctttcaagcagcgtcacagttgccctgtgacgtacaaggtctaagtccaaatcagttatcttctactggcttaacaagcgtcacaacaaatccaattctgaaggcaacttgttaacgaaagtggagtgtcacacgcgaccttgccggaaacaatcattagagtgatatggaacgaactgattaagaaaaaattccgacccgcctgaaacagtttcacccacttttttgggcgtattcccagtcagattggcctttagtccgttttctgccaacggtctatgccgatgtagtgtccggtgcagtgtaccgtgtccaccgttagctgttcagcttctgtcctgcgtgactgttctcaatacccttccgcttcgcgcgcccccgactcgaggagatcctctatagttcactacgaaaaaaaacactcctgagctactgggctgtcgatgtcaatgatcattttcccagcggcaccaccacatcgacgaaaaatgcaaccaactgtcatggtggaactctggtactatgtttctgaaaagttgtaacagtggtcagaatggttagacttgcatcttgcaactggctgtgctgcacagcagtcgggcggaaaaggtggggtaattgcttctgcatgcggttctgccaacggctgttggtggcttgatgtaggtccttgttactgtgcagcggaacgaataccaacagctctgcacaccaactccgcacgctttcgcttcagatcacttaaccgtcggcatgcggcatactctgtcatgttttcacaagacaaa

SEQ ID NO: 1324 - DNA, 3094 bp, Toxoplasma gondii
ctttctctctcctgtttgcttccctcttgtctccgtgtctccggtctccttgcctcctcaaagagtcggctggaaacgctgtggagtgcgtcggggacgaacgcgaagggcgccaaggccgaggtgaggtgctcgcgcctgcgctggcgcctcctgcgaagtttctcctgcaagttgtctccttgaagaagacccgatactcgcaaaaactccacagatgcgggagcttcttccgcgtctctcgctcgcgccgccgccgcaacgactggggagtcttgacgcttgcttgccctgtcgccaggcgacgaagaagaagacagggaggaagaaggacagggtgagggagaagacggtgagggagaagacggtgagggagaagacggtgagggagaggacggtgaaggaggcggagaaggcggctcctgtctcaggaaggagaagatcgaacgactggagacagagtggaggcaggagaaaacattcaactgcctctcctttctacaataccatatttggaagctcgcagacggacgagtgaacgaaaaagaagacaaaggagaggaggagaagggggcaaagcgattgttggaggtcggagaaggccccgtaggtacgcgaagagcagttgcagcagaagagaacgacgaaactgaggaggcaacgcatttgaggtcaggaccacgagcataagtgcgaggagcaaagaagtcgagacgcagaaaacgaaagacttgacgggtggcgcagagaggagaagacgaactcgagatagacgttccgtcatcggtcggtttcttcagctgctcagcttcgacgttcgcgaaaggagaggacgatccagatgacgcagcaagtggagaggacaacgaacgagcaacagatgcgctcgacagaggacaggagtgccagagaggagaggatggcgagaaacagcaaagcggcgtcgtgaggtctctgttcccttgcgtcggagagagcaagaagtctcgaaataccgcccgtctcgtcactctcggaggaagcgaggcgaacgacgagaacgaagcagtttttccacgagacagagaaggcgacagaggagaataaggaaacaaataggagttgagagaaggacgcagctgaggagcgaagcagcggttgtgagggagacggaccggctgcgttctctgcgtctgaggaaagaagaggcgcaagcaaacgcgcttatttctcacttcgcgcgaatcccttagtccggagttacttctcagaggcgctgcgatcgccgcctctccccgtggcggctgtggccgagatcgccagagagcacactgtgagagcgtcatcgcggcctttccctggaaatgcaaacgacaccctggaagaaaaaggtctgaaaacagtttccacgcggcatcacgagcaggcttttctctcgagagggacaggacgtccaagaaagaggaggaaacgcgagtcgttcgatgttcttggtcgtttcaggtattctgcagaactggagagagacgccgtcggaagatccaaactggagccgcggcgagaagacgccggacagctcggtcgctgcttttgtcttcgctcctcgtcgttcttgcgcaggaaattcgaagaggtcaccggttcggaatccccgtcgacgcctttctcctcacccgttcacgacgcgagagtctctgtggtggctggacagaggttctgctctctgcatgtgagcgcgaagcactgcgagttttgacaacaacctggcgatacgaaaagagtggggagatagcggttggaaaggaaaaaggcagcgagaggcgaaaacgttacaggagacgaactgatgaatttcgcctcttcgctcgacaaagcgcgaacccgcagtgccgcgtgtgttgccgccacatcgtcgctctacgccaatggggaggcgagagaaaggaaaaacaagttttttgaaaactcgagggtctctctggagtgtgtcgcatctcttccgcccttgaaaaattccgatttgccttccggaagctcaggaagcatgcaaacagacgcgaggtgtgcagatgcagcgcagagtcaaggcgcctcacgccctgtctccgtggctgcgggtgcctttcttttttcgagtttttaccagttttctgctcgcagagacagcggctttcgaaatctgcagtttttccgcagttttggccgcgtttttttttgcgggacagaccctcgggacgccttctgctgtcgcgctgggtgtcgagagacaaacggtaggccagcatcgaaaactggaccacacgcaaacttggtgccgctcgatttgtccgcgtttacggtttttagggtctacgctcttttttcgagatgcaagaggaacactccgatttttctgcgaaaaaaggaaacccagttttcttcctcagctttcgtcttgctttattctcccctctccctgggactctgttgttggcttcgcgtttttcgctgctctctgttgtttcgtttgtctcctgctctctcccttttttctacgcgtcgtttcgtcgccgcctgcggagagagatctctctcccttgtgtcgcgtcttgtcgtcctcgtttcctctctgtcccgtgagttgcggcgtttactgaacaaaaaggacctctcccttcatcccgttgcctccaagtcgtcttcgctttccactgcaggattttctcgagttcgtttcgcattcgtgtctgctttttctcgtccagttagacgcttgcgagactgtttatctagtaactaggtctccaaatactatgtgtgcatatgtctgtttttgcctgatgttatccgtgcaagtaaacatgaaaattgcgccatgtgtctctctgtccacgcaacgccctaggagcctcgacagccagccgtaatacccgctcacccattaaggatctgtatggatatatgcggccaacgaagaaagaatttctctttacgcgttgcctcacagtgcgtaacgacgcaaccccgttgagcgagagaatttccttgtccgcgccgagaggcaaggcgcacggtccctcctgtgtctgttgtgtccgcgggatcgaaaacgaagactagcgacggagagcgagaa

SEQ ID NO: 1325 - DNA, 4428 bp, Toxoplasma gondii
cgcaatcgacggcttaactgaacacaaaaggcagaattcagcatgaattagaagttagcaggtcacaggacccggtcgcgaagtcgtgcatcacaatggccacggaccggcaccagaatcgaagacgaagtttatttccttgttacctcgagatcttggaaatattccagggtgtgaagacgaggaattctgagtggcgacactgtggtaccgatctatggaatgggacggagccagaagaaaaggcatctgtcgcgcagcttcccatgggatcgctgcgaaacgataaaaactgctgtatttctccagttcagcttccacacacagaacacggcaaaacatccagcactgtagaaagaagcagaataccgtgtgaacccaaacatcgtgacaagcccacttctgcggcttgtatctctggcggaatttacaatttgatgaaatagaggaacgcagcgcaagcgaatagcgcaggacggaaacccagtaagagagttgacattccctaccgaaccaaccttgtggaaagcgctcgcaggaggcccaagaaacgacagcagaataaatacgatctcgtcctggagttcgtgaatataacaaaagtccgaaggatcttgcgtggcaacaaccatctgccgttcttgctctgatgcagccgaagaccgcccagcgaaattcgtatctggaaacgtggtaatcgcttttgatctggcgtctgacagagactcgccctttacaacagaaaacgtgcttgtgtcctcggtagaatgaagtctgagaatcgctttcgcagctcttcctctgggacatgtgtccatgttttcaacaacttgcgacgtcagccacgcggaaggaatttagggctgcagcaaatcgtgaggtgtccagggggttgtcacgcgtttgtgatctacgccggcggaaaaactcgagactacggaaagagacagaaacacagacgcgcctttcctctccgccagcgttggcattggctgctcagatgcaacggcctcgttgagggcgtcgaacgccgacgatcgctaatacggtacagatgataggatacatgttttgtgccatctgataaaaaaaatgagttaagttgaatgttcaaactgcaggagaaaatcgacatccagtgatcactcaaaaacgccttttgagtcaagtgagcgccaaacaacccggcgccgacatgatgatacaataccgaccggtttgtagagcacgctcacaaccgtacggttttttcattcgtgcatgccattggattagcgcagatatcaagcttttgacgttgacaagtcacaattgacggaaaagactactttttagtctctctagcttttgcagacataagtaacgggggaagcctctactctgcctagcatctctaaaagagcatgcatgcattgttagacgagctgtagaacaggtccgagcgctcgcaacaggcttccgagaagatgtgaagagaaaaacttaccggcggaagacgcagacgtctaagcggtgcaccgggtcttccattcttagtcaatatgcttcatcagcgaaatgttttaccatctcctttgcacaatacccccgcgaatactggtggaaaatgcgcggaactaagtcactgtggtgagggcgagacacaaacaagttcacacggctggtgttctctcaaacgcagaaacctccaacagaagtcttccgtatgacggtcgatccgcaagttccgaagtgttgtggaacccactacggaccataggctgacgtctctggaatccgcccgaaatgacagcaatgcagaatcgcgtcagcttttgcccaagcgcccaacccacggaatactgcttgaaacggaagaaggcgcatttgctgtgcaagcaccaagtctgtctgcagcaggccctctctggtttctttttcaagggtagtattcaacgacaggttgtgacagatcggccttcgttggtttgtggcttgttggcaagcattcttgtccaaatacctaagttccagaaggtatcgtacaatccttgtccgtgcgcggtaatatggtaggtgacgttgttgccgaactgcgcggaggtaagtacgagatcggaccgctcacgattgtggcagaagcgattttagatttagcacacaacagcattggtatcgaaaaaccattccatcttcaaataggttttccgatattagcaagagtcgtcagctgcagtctgccgcctcctgtgccgttggttggcagccgacaatcccagtgacgcagctacactgacgaacagagaaaaaatgcgttgctacggcctgtgttgggttgagtgaaaggttagggcgctcctcatggtacggtgttccagttggggtgatcttggtagcgcgcagcggtaaagcgacacacgttctcgcaccacagcagtgagtggttctgctcttctgaaacttaaatcttagaagcaccgtttcgagtcagaagctgaagctgcgccaaacgcggaattttgaacacaacatcggaggtgcttcccaaaagttgtatttctcggctaccactgatgacgtgtgcggcagatctcacattactgaaattcatttgtcacgttcctgagtgagcagcacctcttgatttcccggagtggttccgtttcgactccagtatgggggagagctctggttgccacacggttgtatagtagtgttcgactagaaacaatgatcctcattcgcatctagccgacctgtcttggacggtttgtgtcaccagaaccaaagagaaggacgtcgaagcaagcatcggtccttcacctaggagcttatcgcctccaatgcaatacctctcacatgtcatcggctgcatcctcaaaatagaaggtactcagacaggaacatttaaggaaaaactaacatgtgagttaggcctgacgaggcagtttcttttctgtcctgcccgcttcctttgatgaacatgttctctggcacctgcctgggagctctatgactgttttctgcgcttcatcaccattgttgctgaaatcgctgtaaatatcccgtgtacagcgcggacagtaaggggcgttttcaagcgtacaaccccctcaaagccgtcgattcggccaaccgtccactgagacgcctgcccacattgtttcccggcttgagtcctctgttactacaagttgtcaccatcaattactggatatgtaaagtgcacaatagctcccacatccagccaggcagctagtggtgcatcttctctcggaatctgtcgaggtcatttgacagctaatatacgagcttattcgcaaagcttcgatgccatccgtcctctaggaggtggcgcaatcttatcgctttacaaatgctctctttctcgacatcaataatgcacttcttcggttttttctttgtgatccccgacaggatgtgcttggtcatcgagtacgcgatggagcgggcgtgattctgccggaaacacggaatccagcgcgaggtactacttcaagaacacggcggttatccttaactactctctttaagtgtagtttttatccgattttttcatatattgccaaaaaaagcctatatctgaaaactgcgccgactggatgatactggcagcggtgtgtaactggtatgcgaggccgacattctgttgcggctcactgggaagaagcacttgtgtcagacggcaggagtgtgtttccttcggcattgtgtcatgccacaaatatattgcactcatgccaaacaggctgcacacacgtcaaaaagctgcggttgcctctggtcatgaagcatgcagtcagtggatttctctgggctccatctccatcgtgcagtggcattgactagcccttggccgctgaaatccaactctccggcatgaacacgatgcatttcacctttctctatttgcgaaaactttcatgaagtcacaagcaacgactgttggaaaggccgtgctcatcagtacccgctgcggacagcaccccccaacatgacagtaaccaaggactcctgctgcagatgattgtgccattgtcaaaacacttttccctttcccgctcaccgacggcaagaaaacgagtcatcaaaactcaactaaaagtcatactggctttcgcaaagacacgtttcgttttcacccagtaattgcgcttgttgcacgtctctcaaccgaaactactgagaaagcggatctacatacagggccatcgcagcgccctcgcccacagatgaccgctacggtttcatctgcaatgcagcacattgactgctcaccagagctatgcgcgagataaagttctatcatatgggtgagtgtgcgttttcgactgtagttgagatctcttgcaaactggaggtgcttgtaatttcagcgagaagctacaaatggcacccagacgaagtgctcgtgccgcgcgagcagca

SEQ ID NO: 1326 - DNA, 2424 bp, Toxoplasma gondii
agtcatactctgcttcgcaacggtgcatgctgcaagcaacacaggagcagccgggaagctgacgatgaacgggactagagcgcctgatgaaccgaacagatgtttttccaatccgtctggtccaggagacgcgcactgattgatacctctattttgtccttcctagcacgttctgggactggtgtcgtcatagcgaggaccatgccataacttccttgcaaacggaagcttttggcaaaagagcccacactttgtaacaccggaagaatgtgaaaatcaacgcatataaaacgaaagcgcctggcacagcactgctgccactcctcaaaatgtggcattcacttagtgaatgtttcagcacaagcgtcggtgatgctagttttcgcggactacctcgatgcatccacaaatcatccagaaatgtaatatgtctctcgggcttactgttggcatttggatcagcgggaactgtcaccgtgacgacgcattttgttttgcctctgtttccatcagagttctgagacggatcccccgttggcgcccggtttgcccccgatgccggtgtggtgctgcaagcgaagtagatggtatctgtcatctcagggagctttcccactgtcagcgagacttctgcactcgtgcccgatgttgtgcttgccgttttgacattggctttcgatccttcgccgaaatgctcggcgaggggcgtctcgccctggagatttactctcgagtaacactttgtgatggtgttattgtctcccggcaacggcaacacgttgcccatatcggtaccacaactaaatgagaccttcttggttgctgggtcaacttcaacggatataccccctttagctgccgcgtctgcgttgcagatcttcgtagaaggggctccattcgtcccctcagcccgtaacgccgtagtggacatgagcactacgacgacgaaaaacaaagagcccatcgttatcaaacggatcgggacaacgctaatccttgccataatgtctacctgtgtgaaatacagaggcacacacagacaaaaaattactctccctcagttcgactcagtctagcttctgtagtcacactcagacttaacgctcaggggctggaatacaacgcaacgctttctttcaagcatgtgcactggattctaacaagtgagtggctcacaagtacacgattccaacccagaactttttgatagagagtgaccggagaagcgtgtactagactgtttgaggagacgccgaaatacctgttgtccacctgaggatggtgccgtcaccctagagagcctttgacttgacagcaacgccagaattttaggcagcgtttatgcagcagatggcttaactgcagaaaacaagtagcgcattcacatatctttcctaagttggagtgggtgtcgcattcaaatctcttaattgctgttcaccgtgacttgccggcagagtgaacagctgcggaagcgatagcgtcggtagcgacgcgcctctgtcgaggcgtgttccgttagtggggggtgccggagcaggcgttcttagtctttccgttagaatgccacaaaatatcgatggcgagaggtggtagaaaatctccacccaaactttgaatcagatggtcaaggtgcgcctagctcacgtcaaaaggctagcgtgtgtctaccggttcgagtaccgtttttcggccgcagtgcgttgttgccttggagttgggtgtcgattttgcatgcgcgtggccggttattccttgttttacttcaggagtaaaccttgtcttgcagggcaagagtctcattctcacgcatcgtaagggctattgttagtagcagacctttcgtttcctctgagaccatctcctgatagagcaaacatgatcgggagaggctctttgtctcgttcgtaggttccgcaaaaattgtctgttatccagttgttctgacccgccgctacatgcatgtacttccgcggtgtacagcccaaatgttgtcaggttcctgctttgtttctcaatcgttgcaacactgtgtttcaccgcggaaagagtaaagacgtttcaccaccgagactccaaagtcagccatgaacacactatcgacgcctgcaagagtactttctgcaaccaagactcctttccttccaaatccattcccgtcacatccgatccactatacgcactgatcgcctggtgtcgcttcgcccctcctttcaaccaagcttcgggtccgatttaccttgtgtggcggccctctcctgcttttccttttgatttgttgtgagggggttgacacgtgggcgacccgacacttcgacgagcttcgtcttttccaaaatggggtttctttcatgcgcccaacttagcctctgttccagccggagagttgcctcccaggagtgagacactatggacggacgacga

SEQ ID NO: 1327 - DNA, 2072 bp, Toxoplasma gondii
ggctaaactctacaaggctttgaaacgcacaggaccaaaacagagcagaaaggctggagttatctcgcttcacggtatgccgtatcccatcccagcggacctggatgatcacgttcacagcctgggcgttcgacgagttggaaatgttgatgtatgcgctgaaggtctcgccgctaaaaattctcctgagcatgaccacagtttacaaagaaggagagcagatgttcagagttacccaatttgcacaagtgaccccgcagctgccaaccgggcctggtgctttcttacccctgcgatgcaggcaacagcagcgcgtgcgtgctttcgagggctcgctcaacgcacaccctctctcgttccagtttcttctttaccgattgatcttcagatgtcacctcatcaatcctgagcagtggccatggctcggcgtagatggaaggctgcgacagcctcatgactttctgcgttaacacagaaagcgcaagccagacgaaaagagattcgacatccggatttcgtcgtctcaagcgtccttgccgttatcacctggacaatctggacaatcaaatatttaccagaaccgtaatgggtggtttccaatggggcgaagcaaccgaacctaccagagttagaacgtcacgactgtccgacgccatttggttcagcggctggaagacgacggcataagtgccccttgaaacgaaacaaatgagatggtatgtccagagaagttcctaaaaatctacattacccacgggagagcatagttggagcaggcacgccctttatcagaagcgttacacatgaggtaaagttccatccagtccgggtgtgtccaggtgtccatagctctccgcatacggtggcggattcagaaaagccacatggcttggttttattcacgcttcttgtaagatatacatggtcctttacaatattctgtgattggttgcggaggacactctcacaaatccacagaacacggaaactgggggtcgatcttcgttgttcccagttttatcaagacatcattaccgatgcttcttggactctccatccatttctgcgtacgctctccgttgctcactgagcggagtgaaacgtccacaacttacacactttgttcgacgagaacgcgtgagcaagactaatattttttcaaaaacgcctcagcatgcatgtgctggcttggtggcgggtccaccgcatgcaccgggtactcaagtaaagaacttgaaggagagcgtgaggcatcatgtaactcgcataccagtatattatggcagtgaaaaaattggtgaagtcgcctgtgggatttgactcataggaattccaaccggctagttcttggacgctaactgccgacctgcgggaccgtcagtttccatacttgcagggaaacagacgaggacgcggaactggtagacaccctagaaagtccaagaaataaggcttgttcgggacagctgcaatctagtgaggagcttccgtttggtgtgagagcagcacccagagtggagtaattgtagagtagttgtaacccgcccaggctgctgtggcttcgcggcggtccggggccgcatttgggaccggcaatcgccacttaacggctgaatgccaagcaagcaagcgatttttagattcatcatgaaatctgtttggaagaagaaggctgggtctcaagtccagcactacgccaaagagtaacagtactggatcgttttgctccctatggcagtaaataacgtgcaacattgaccgccgtcggtgatgcttcgaacctctcgcagtgcttgattactgcctgtcacggtgtagagggagactgcgacgatttcccactgaatttccaacatcctggcattacagtgtagctagctcaggatccgccaagcattgtcacgctattcttctggtcaggctggtgctgccataccatctttaaaatgttctgtacgtacaccagagagtcctggttggattggacaactgtgtaacttgttttcccctcccgatcaatttgtgaggcagagaaacctgtcgtcattgctgcctccttttcccctcaatca

SEQ ID NO: 1328 - DNA, 2203 bp, Toxoplasma gondii
gaagttcacggatcagaccaagcgacttcactgcaagggtgtcggaaacaggagactgcgttgattctcgggagcccgacttccgacccccagcgcagattggtctaaagaagttgccgtatcctccagtgcccccccccgccattcggaacatgtagatcatacaccgtgtcttggacgaagtcgcattgaaaatggatacttattatccgctccacagcagagctgacgttgagactccgcggtttctcctcatcgagtatatgttctaggctccgcattgcatgagaacgcctcttcagatgcaccgagcctcaactttttgatgcaaagatggactccagacacgacgtccagcccgcagtttcgaggagttttgtgtgtcctcgaactatggaatacttttgttcactgagagttctgtcgacgcattaacgagcgcagaagaagaaagtttgcggcccctcccaccacgcacactgcgcgagtgcctaccttgttggttgtgtgtgtgaatgtagacgaggttgtttttgaagatggcgtatcgcctctgtttttcttcctcagtcgcgtagctcttggcgtacatggcttggaagctgctgaaggcgtcctgaaagtgcgcctctttccattcccagatgttggcggggggttggtggtcctcaactggcgacggcgggaagaccgcgcggtcgtcttcgccctgccactgaatgaggaacgaggcaaagacaaggagagacaccgccgcagccacgagtgcgatccacgcccgcgctgtgaagttgcgttgacggagaaatttcttccagaagtacgtgcgggtcgtaacaacgaacggaggactcggccggccagcgcggacgcctcgtcgctggtgaagctcgccgttctccagcccgtcgtcctcgccgttgaggaaggagacgtagtgcgtctcgctgctgtccatggtgttcgagagcgaggccgcggggtaagagggacaaacggtcaaaactctgcgaaataagaaaagtacgggggaaacccgcgaaccgacgcgccgctggggggcaggctctttttcgggagccggggagggccaaaaagaacgtccaggttccggggtaaggatgaaaaaagccaatgttcagcggttgacaacggaatgctgtcgctttcttctcagttccgacggaaaacagacagctcagcgggctttgcggcgaatgacgcttgccgacaacggccgagaagccacaaaaaagtcccgcgagcggtcacggcgtgttgcttccttcgagcctcgacgacctcgcgtctcctgtcgcgttccgccgaaacaggcaaagtcagggccacacgaccgcctcgctcggtccgagaaagttcgctttcggtgccaaaactatagcagagaaggactgccggccgcgtcggcctggtcgcaagcgacacgcgagcctgaaactcgttagctcaggcgcccggctcggatcttcttttcgcgaaaagcggacctttccttccactcgtcgtcctagcacatgcgcggcttctgcgccgcgcccagcctcgtcgcgcgcctcctccaaacatgccgtctagcacgagtgaaaaaccacttttgcggaagcggacgagaaccgcgagcgcgtttctttcgggtgtcatgacacctgagaagccgggcttcccaggcagtggcaaagccggttttctgccctgcagaaggcgagagcgaagcgcgcgatcaggtctctttcaaagacgcgtggaaaacgtgagacgattttcgtataagccgcccggcttttctgtctggcgggtgtggacgagcggccggcacaaagttgcagaagggggtggtgcccgcgcgcgcaccttgtttagtttgcgcgcacgagttagagaggctgttgagggttcgtttttgaggggcagagcagacttcttcgctcaagtcgagaccagctgaggtgcgccttgcgcgaacaccgcgttttccgcgaaaaactgagacggaggctgcttctgcgtgtctgtgcacagtgcgaacacacccgagagagctgaggcagcggtggccgaaagtggggagtgtgtcgggaagtgcacgcgaggagacttttgctctgctttttctcttttccgtcgcgactttttttgcgattcgacgccttttgtcaactaagcggaatctctggaaaaacca

SEQ ID NO: 1329 - DNA, 1612 bp, Toxoplasma gondii
tccaagaatggagaacgtatacagagtcaccattttacgcttgattctaggttggtgacgaaggacgggaaggaaccggtaagtgcccagcataatggaaaggctgctcggaggcgctgcgattcaatttctttgtttgtagtcatcgcgcttaccggcttcccaaaattcatttctcgtcttcttgctggtggatcatcaggttatctattgcagcgatactgtaagtcacgtatgcatgggggatcggcctacattgtaatttacccttaattaggccctcaacaagggatttgccaaagcggagggatggtctggtcccttataggattgttagcaggtgccgcccagaaaaagtgaaaaacaacgaacttgaatggatactcatctcttttttccagtcaccactccggttgcattattaacactgagaaaatccctcgacacaagtaaaaaatatgatacgaggactagtacgaacccacacttgtaccataaacgtttcagacagcagaacaccatgcgacacagaaacggcccaagttttgctaaaaagacaagctgctccttctggccaagatgatttacccagccgcaatgtgaagctttcctctgatagcacttgagcaggcagttcgttaacggcgaacgagaagggggagacaatcgctcacttaggggtatcgggcacatttgtctggagctctttgccgacgatggtgtgaacgtctgtgtactgcgaaaaaaaacaggttcacgggcaacaattctgtcaatcgttcagcagtgacgaacaagactatctgcagaaaggccaggtccgtgcaggcagcctacatctagtctcgggccgcgtatcacacgttaatctcaccttattcacgcagcgatccaaacagctgctttcgcctgcgtccaacgttgattccttcacgtcagctacacacttagtccagcatgtgtcctgaatcctaaaaaaagagcaagcaatacaaagcagcgccacgggtcgaaccacaatcttacctattttgattacacagacgtatgctgtatcaccaagcaacaacaggacgactccaaccttacctcctgtacaagtctgccattcccacaatctccaccacagccgcctgcacagaatccatcctttcagtcatcagcctttcccgcctgtttcagtgttgatgtcagaggagaaaaaaggagattttaaggagttgcaccaaagtctcctgcgcagttgactgcgacttcacgcgaaaaagtctgcatgcagggcggccgaccacttagcatgcggcgtagccgacaaaacacgacgctagtacggactatcttgactccactgaagagctatcacaccgagtgtggctgtttcatcttcacattttcatctccgctacgtctctttatcagttcatgccattcaatcgcgttccatcatcctggtgttttgaggacttgcagccccacagaagcggctgtcgcttgacttaaattaccgaaattactgtatcttgcatctttttatccacggaaacattttaatttgcgatatctctgcagtcctcgacgttttctcccatttatattgttcagtgttgcacca

SEQ ID NO: 1330 - DNA, 4819 bp, Toxoplasma gondii
ggcatactgaagacggcaatgactggaaagaaagtgaaaccaattgaatacgtatacacagataactgcatgcaaagacatgcgtagacgcatacatatatatatatatatatagatagatagatagatcgatagatcgacaccgccacatatgcatgcatacatatgaacgaaaacacacaaatagacgcctatacacgtgtgcagtcatacatacatacatccacgcatagacatctgggcatggacatctccttatatacgtatacataaggttccaaatttgcagttgtcctctggtgaagacgcgagtctcacgtatcgggatccttggagagtcgcgggagattcaccgccttcacgtagccaagattgcggctgctggcagttccagatttcggcatgttcgctcgtgaagcggccccccaggtccatggcaagaccaccatgttcggttttctcttttatcttgcttccctcgttcttccggtagctcctgaagaaaaatacggaaaccaaagagcgccgttgccgtcagtttgaggggtacggaggtgctgtgctcgctggtcgtctaccgaccgcacccatctaatggggagaggagggagcgaaaacgcgatccttgcaaacgacactttgcaacgcactggagaagggcagcgacggaaaaaacgaagtggttcaattgtgagagtgacgtggaggtgagactgtcagtaacagcacccgtacggtacaggttgcgaaacatgaataacacaggactgggatctcgaaaagaaaacgacagaaagaacgggctgcagttttcgacctgttccagttggttgagccagcgtggagagcagtgtcatccttcgcaaacgcagtgtgtcggatgtgcaagtcttcaccgcacaggagcacctgagaaagaagccacgacagtgtttgtcactggcagaacgctagacggcgctcacaccgggaactcgtaccagacaagaaaagggaaccctcttctgtggccgaaaggcgtgaagtggcaacggctagcaaagaggtgacttgcagaggaaaagaacgaaagagtcactggcagggaacgaccgccggagagaacctcgctgcggaaacgaagaaacgcttggatatcgcggagaaacagctctccgcgaaaacgcaaacgatacaccgcaatccccctcgaaaaattcaacacgcgactaaggtgataaaatcccagtcccatcgtccagcagatatcgacggtcctcagagaaccacggaaccaccaacgccatgctcggcctagcccccttgcgacagcggcgcccctacgagactccggcttttacgagagctggtacatcacctgttggcgtgtgttgggtagcgtcgacttccgtgtccagcaaatatgcattagggaaagaaaaaacgcaaacagccaagccgcaaaaagaggaaagccgcagaccgacgcgcgcaaaaccggctgggtgcgctggctgcacgatttttcccccgtcttgacgagcacactgcttgagacctctgaaagacctcccgcgaaaagatatttcttcacaaatagagacaggctcttggcgcggcagcagttttccggaaaacaattcagcgaacctcggaaagacttccgacagaatggcgacgacgtcgagcgcccgccacctgctagcagggcgcacaagcaagtcacatggaagttcagcaacggactgtgagcgagctagtaggaccctcctcaaaaagaagcaacgtgcaaccgagcatgcatgggcaagacgcgaagcatatgtcacgtacaggcagcaaatgtcctgttgtttttcggatttgagttgatgtgtataccacgagcgcaggcaggccagggaagcagcagccctgccggattgttacgacgaacgagaagcgcgaaaaacagcgacgttacggagagtgtttgctctaaaaagcgtcttgcggtcacgccttcgtattcttgatcgatttctcggatgctaaggccctctcgctgaagcgttaaggcacattactcttttctcatctttgtacaacttgcaaggagaataagggaaccccgtggcacggtcacgatggacactagtgacccccaacagctggtgtctagagtgtctgtggtcgccccttgccgcagactcaggtatttttggtttgcagttgttttctcacaaaaaacaactacatctgttggatcattgttcctcagaaggtaaaaacactcggaagccgcgtctacagtcaaacacttcgcgtgaagcaaagctcttcggacggaaaacggaactgtgaattgattgtctatgtaaaagagcccattgtaaccgattgctagtgctagatcgatatacgcagaagcagcgtctcaacatcaaatcgcgagcaagatgcgaactacaggtcaagacgcattcgaccggaaagcagaggaacttgtgttcttttaaaattgaggtcatgcgcgtgcgtcagtccggcagatatacaataaaagacgcacgcagcattgtaacagaactggtttgttgcctcacagtgcagtgttgtacacagaagaatcgtctaacatcagtgcgatttcgtttctgtttagcaaggatctactgtcctcttacaggatgaatatgtcaaaaacgcgacaccgcagcagacgtttcttaagcgccaagactggagttcgggcagacgcagaaagactcccagttgcctcgaaagtaaaccaactgcacattcgaagaaaccacaagaactgcggatgttcgtcttcagctgaaaggaaacttctgttctctttgtgtcagtagaaacaatcgacagcttgccagcctgtttcgcaaggtctgtcaatgagcaggcgcccggaaagttgtcgtgcacgtttctgcaagcttttgtcgcaagctcttgtgaaaaaaagacaagcctctgttttgcggagcatattctcgatacctgatggtgagtgtctccgcaccacccttggccactgaatataggaaacgggaaaatgccccgtcatgaccgcggttttttattcgcgaggctccatttcctgtctgaattgttttcgctgagtgttcagtggaaccgactggctcggccgtcaccctcttgcaattcctaaaaaagtaacagattcttgaccgcaatgcagtttctcctgaactggtcgaagcagtgtacctcccgatccgagtttcagtctctggatgcagagaagtcaacgaagaaagtcgtcaacacagcgaccgtagggcctgccttcgatgcctaagactgtcagtatcaacggcaagccgtctaggatggcaacgacgcaaccgtgtttcccgttgagtagcctcgcctacagttcgatctgttgcagcacccttgtcactctcacacatgacctcccctcgcttttgcttcgctgtccgtacgcaagtggaatgtaccgtcagacaaagaagggcgctctatgccctagacctcggagcgatatgacaactccaagtggcgatgctgtcacttcgcggatcctctcacatcggatactcgctgaactgctgcacgacgctctgcggaaaacgctgaatgtgaaatcagatttgcccgaattttgtgtgagaagcagtcacttgaagcttcctcaattacgtctcaaattgcacgagatttgacagccaacaagaatacgcaactgcctggtaaaagcgcactcagacgcggccctcggtagcttccgttccacggagtcggcaaactgaagagactgaactggacgaactacctgcatctcgtgggcaagtctaaattcatggtgaaccctgcgccttttctgaggtgccgtcgcatttgcactacgaaggattacaggttcctctacagcgtctagagaggctgcagcagcttctcgtgaactggccgccttccacactaaggtagagaagcaaaagcagagtatgaatgcagcatcctttttttctctctacgcacataatgatctgagccagggaaccaggcacccgcgctgcttttttactgaggtcggggagccctcccttctgctttcctgaatgcgatgaaaccctcagatctgcggatttcgcgagagacggtggtcccgcccaaaacatgcggaaaaaaagtgccataaactgtggagggtcatctcattcctctaaagcttgtcaggacgccaccgcacagactgcatgcggtgggcttgcagactcgacatgttcttttacacatacgaccgcgagcaagtcgtcttctctgttcttcctatcagtttgccccaccgcttctcgtttcactgctcgaactccgtcctttctgtttggtctctgtccttgcagacgggatcgaattctgcctcgtcaagttcactcgtttcctcggttttgggtcttggtcgcaaagtcacctcgtcgagatctttctctacgcgtactttcgtttcttcgtcggccgttctagcagagttcggtctcgggaaaagggagatcgacgagctttgctggaccatctgtccttttctttctgttccatagatgcaaacaaattgctttcttcgcatttccatcccttctttccgagaagacacactggacccctcccgggtgttcgtttacagcgcgctctcgggcacactccatgtgcgcgtcgtttttcgtggaaactggagagcggaactgctcgagttcttttcttttttctcaactcgattcctgctgacccggtgcgtgtctcgaccggtgataatggcttcattttcaccttgaaactctcgtttcttccgcga

SEQ ID NO: 1331 - DNA, 2378 bp, Toxoplasma gondii
taaagttcagaagacgacccgcgaaacagttgcgcaacgggaatcacctggttttttgcgatttcagtgcctgtgtggtgaataggaacacggcttctcttaacactgcaagccagtccttcacactgttccactttccttactctcctggcgtggacatgcagaaagtctacgagttcgaccgttgctttcttcatctggcccttcggagtttgcaatgcagtcgtttttttctttgcgtgtcttctacttacatctggaaggttgcagtaacctcggaggcgtagaaaccgctctcttaaatttgcctcttgtccccttacgttaatggctgatggcaaaacgtcaaccatacttgagtgggtctggctgctgtttctatctgtttcaaagtcgaaagtcgccgtcgagaagcagagcagagaataccgacatggagaggacgtcagacttgtaccgcagttcaacacagataacaaaaaaaactttaaatgtgctacccactggtcacacatccctgcaccattgagagtaccgactggcttcgtaccagaagcgcacgtcacctatgtgcctctgcagagtttccatgtgaaccatgcactgggatttgacggtatcggggtcctcaagactgcagaaagacatcgaaaatgtctgttgtcgacgacgcagcagaaatacatgtccacctccagcctgtagcagggaaaagcctgttcctgccgacgttgtcgcgtgcacgcgatgtgaggacagctgcttaaagagtttttgtcaccccgatgttccagattacctaaccgttctgcattacgcggctctctctgtcttaggatgtgcctccgtggcgctaagaaaaattcagttggctgctgatgcatctatctactcatgagcgcttgctaagcgaagaatgcatcgttatccctggaatcgaatttcgagtaccacgcagtatttgctgtgtcccgatctcacacttacgctgatttacactctcggtggctagtacacgtttcttcttctcttcgctttcgaactcttgcacatcagccctctctcgacctctctttatctgtcaaatagttgtatctagcagtgtgctacaatcggtcgccgccgaagtcgtgcgtcccgttcagcgcctgcgacctgtcgagttgtgccggtcaactcgagaaaagatttcccccatggaattcacgttcgttccttctgcatgtttcctttttcggactgtgcgcagagaagcaacttgcgcaactctcaaacgcgtgctccacccgcctcccaatttcacagaatgattttttcaactgcaagcccccaagattcctcttgaagacggtgcctcattaaaaaattttattaaaactctccagtctatgtatcgcggcgagcaggtttggagggagggaaggaactcaaaggcttcgcggcgaaaaaattgaagccggcgtttgctgtgttttccgtcgcagacactgactggcctgaggggtcacttcgctgcgcactcccaaaggtcgcagaacgtgctgctgttgcggaactcttcgagcgttagagaactcagttctcctgcgctgcttttctctggagaaaagatcagccagttcccctgaaaccgtttcaaagaaaaagctgaaaatcgctgcgatggcggtcaccccgcgtgtcctccggtgacacgcagccaactcgcaagggcgcagtgcgagtgactcacactcgtgcgggtggaccctctggagaaaactggggaaggcgtctgaagtggagagtggaaaacaccttgacttcaataaaaaaagtaaaggagagttccgcgaagatgggaaggaagtgcaaatcggaacgactctttcttttcgtcttcttaaacagccctcgacccacggctagctgacctcagtggtgggcggcctcttcgtcgcgaaaggggggagcgggtgaagacaaagttcctctcgcaaaagagtcacgtgtcgcgagaagcaagacccgcttccttttctttgctctttaaaaagcgaaacgacttcgtttgaactcttcagaaacacggattcgaccgacacgctctccgagcgcgtgaagcggccgtttccgcgggtcttcctcgcgagacagggaattcgtttcctcaaaagaacgcacgtgttttagccctcgacgaagcctttgtcaactttcgcctgtgcaacatcttccgtccatttgcacgtagtcatcagatgactcattcgcgcgtctctgcttcgtgaacccgcactcgacaaccatcctcaacctccctccaaatggtacagacatctctgcgagttccgattttcccgaggtgctcagctggagtttcttcttgagcgaaatca

SEQ ID NO: 1332 - DNA, 2874 bp, Toxoplasma gondii
ccgcagatcgcgaaggtccttttagtgctaagagatgtggaatgaccttgaggttctgttgtgctacctcgaagtttgttgcatggcgtttggaacgagaacaatatacagactttttatggcatagttttccactctgttatttacatctttggggcaatgatgtccccggtgacgggctccaccttacgaaacgaaattgatgagagtaagtgaacgactgggaggcactgatgatagcttaccggtccacgcgccaaaaccttcttgtatttagcaggcgccttcacttcaggccagtaggcgcagcaattgttttcctgattgtcaccactgcagcagagctctaaagaaagcgcgtcctaccaactcttacaaatgcagtcttctgctcttcgctgaagtgactgaggaagtggagagcttcacacggcctatcagatggggtgaggacagtagacagtttctgcttgccttctcgcatgccgagtcgcttaccctctgtatcgccttccccagcactggccgttctgaagctgctgccatcctgctgggcatggtgcggaatagtctctcttgtacgaagggccttcgcatctacatcgactggcatgaacttgattcggcttaggtgtttgatggcacacttacaaatgagttggtttcctctttgcctcgttcgctacggctgcatccagcttctccatatcttctgcatttttgctggattagaaattattgacaggggaggcggctcgtattgccgaagtgcggttactggagaatcgtctgttcctggaaaccaggaggatcagccgggtagcacctagaaacagtgaagatgcgcttaccagttgctccgtgctagggagggtatcaaacgccagtttgaactcgtcggcgatgtctggtcacatgcaacttcagatcctgacgtttgagtgactccagagaacgcgactgaccattgataactcctcccatcctggctgaaatatgcatggacatacaacgtctttgtccgtttcggctcccagattgacaccgcactcaccgctggtcttcatcatctgcagcggattcaacgcagccacttcccgccacgtcccaactgctagagccaatgaaaaagcgacgaagcgtcgtgccattgttcctgtcccgtcctagatttctacctcgaagtgttgactagaccacattaaccaggcggcgaaaagggtcctccgtgcgtcggagaaaaggaatggtcatccctctgcggccgacttccgaatgcggcgcgaagtgtaactacagctggcttcttcatgtacagtcaagaatgtcaggtggtggctagcaccgttgccaatcttgcttctgtttcgtatgacctccgggaaggttgcataccttgccgaaacggactctcgacagagcctttgtgtggagaacgtagtactgaacccatgtgtcagcgctcaccgccagattgtgccgcggtaccggaaattcaaatcacacgtgactcactatcgcgataccggcgcgcaacctggtctacgtaagctgtggaaatctgatggttgaaaactacatggtctgggtggctgagccaaggagtgcaactttaccccgttggaccgaaaattttataaccgcggaatagtaaccggcacgttgccacgtatggctccgcgccccgcggttgctccgtccaccacgtgacccttggttacctgtcatggcgcgagaaagtgccagccaacgtatccgacccagcgtaaacaagcgaatgacctcttgctaattactgcgaatgctaaataactccgctgagcgcgtttcagccttcaggcaatcagtctcagctgaatgcgccaattggtgaattggaacttcgggaattggctctcccttgttgctccgtgaacatgccgacacgtcgctaagcgacataccctggaacagctgggtctgcagctggcagcttcggtccagcaccataagctggcacagacaatggaggattctcgattccagcactgcctgaatcaggtgggagccagctatgtatgtattgtgaagcggcccaaaatatcacgcagcaaacaagccaaaacgtttctgtggaagctgtgtaactcctgtgaatgaacgatacagtggcagtcaggtcgcgcggtgtgctcctctgtggtgcaaggggagaatcagcagctgctacggtgagggggggtgctgcgggtcctaggggggtgaaagcgtcgcgggtgctaaacggacacggtgttgaacacgcattcgagaaaagttttcgcgcaaaaggactcggcttctcaccgttttgatgtggccttttcgctatccatattttttcgcgacctaccgttaagaccatgtgttctgcgtgcgtttgtgagctgccagacagctggcagcttgatcggtctggcagctcgtggccggtcggtgcctcgtactcgacggtttttcttgagtgtggaaagtggacccatcgtgtgtgcgacgatctgtacgttcaaatcgtgtagcctttttctgtatttttgctctgttactggcggcggctaagtttttgttgcgcttcgttccaggcctgcgagagagggtccgcgattattgctgggcagcgtctcattggcagcatcgcggaaccgggtcctttggagcagccgctcctcgccgcggctgctgtctgtgtgcactgcttttttgccaactggcggagtcctcctcaatgactccgtgcctttctccgatttcttcgcgtccttcctctgatccagcgggtcgtcctgaacgcgtgccgacgagcgccccatacaaatcgtcatcaccctgtctgtccgtcccactcttcttcacgca

SEQ ID NO: 1333 - DNA, 2218 bp, Toxoplasma gondii
gaagaatccagaagacgaaacagcagtgtgacgcgatagcgagacagacacacggaaatggtaaggaagacacggagaaaaaaaagtcgaaagaaagggagacataggtccgcaagagcagtaaagaaacagattgtgggagataaacgaaagcagagtgcctgtgacagaaacagaaagcttcagaggaagtgagcaaccgcctacacataaatttacccatgatctctgtttggattggaaagtgaggtcctcacctgtgtctcaattcgcgaaacttcttgttcgagatgggccatgagccgcagagcgcgttggagtttccctggcagagtgaggcagtcctccagccactgctccacgggatcccccatttttccagggcatacaagtccgtccagcaaggaacttgagcgaaagcgaagcctcctctgcaagtcgttctcaactcaggagttcccaagtagagaatcacatgtttgttccctgggtcctcgagaattcgtttccttcctctcgcgcagaaaccaggaaaaacggaacaagctgcacctgactcccttcttgccagctctctttccagccttctagacgacggcggtgtgatgtcgtcgggactgaagatcgaaacggactcgtcgaagtctcaggagacgaagaagctcgaggaaggagcagagcatacaacacaggaaacgcgggagtttaactctgaaggcttcaaacgggtggaggccgcctcagagaacagcgagcgaacgcaccaggcttggtggtagcagaatcgtctgtctcgacagtctcctccccgcagggcaggaaactggaagtcggaaaccgtgagaggaatgcacggtgaacagaaaggcgcatcggggtacgctcgacaagcggaatggcagacggttcgtgaggaggttgcagttccgaaacgaaatgtcggtggctgtcgcgccgatggagcaaacccactgcggagagacgctgtcacactcctggggcgggcacaaggtccatgtttcccgagtttttgagatgcaaagtcctccgaccttttccacacgcttactacgtggaaggcagcgaaaaggtctccagaaaagccgagaagtgcgggaggaaaagagaaaaagagaatcggtcgccagaaaacagaaacgcatgcaagctcccccaaggagaaagccgcctctcgctcctcgcggctgcggcacgagggtgtctacgaaagcgttcttggtgttcttatggaacaggaggcgctgacgctctggaaaagtccacgagttcttctgtttccactcataatagcactgaggaaacgccagggaaactggatgctgtgcaacgcttgtctctgaggactcgcgcgagttcgtgtgtgtctgcttggagcctcgttgaggcgaggatcgaggtcttgtttttcatccatgtcagagcactgtgtacgttttcctcgcgaaacgcttaccgtgtacactcgtcttcgaggtcatattcggcgggacctgtgtagatctctcagtcgtattctttgctctcagcagagttcacacttagcgaactttgttgtgggtacgctttgtttgctgctgtttggtgcccacacgcgcgtctccgaagaactatgcacacaatatttgtgtttgcagagaacttccgtttttccgcagacaagttcagcatatgctccacagaatatccagactggggcgcccgaaaaaacagtgtgcatctgagacaccaacactcgcatacaagcctctcaggatgtggctgtagagagttctcccgtttaccgttgttgccctatgtatccttccgatcttcatgttgacgacttagtgacagaaagtctgttcgccgcttgttatataggtcgattctttgtgttcgattgtttcgctcacagtgcgcgcgcccgtgtgcaggagcgtcggctgtcattgtttgtctgaaactcatagaccccggaaacttcaagtctatgtgtgggctcctcgtgtcaaaagcagcagtggcaagaaacgacctctcccgtctttgaatgtcatgtttttttctttggtgtctgctacgctcgctgtctttcctcgttggtgatcgtgctaggtggtgacgttgctgcaagagttgagacagaaaatcctgcgctgaaaggcagactatagtcactgaacggaaggcatggcactgtaaattgcgtagaaaacta

SEQ ID NO: 1334 - DNA, 1712 bp, Toxoplasma gondii
aagagacagaggagtccgagacagaagacacaaagaaaatgacaaaggagacaggcagagagagagagggagaccgaggagacatcgagaggagactgcagctatgttggtagtgacgaatgtgtggtgaatcaagtgtaaaactcgaagcgaaccaatagactgaatgagcagtggtggtcgaagacaacgttgtggcggagaggagggcggaggaggcggggaaataaggtagaagacaagacgaggtccggaacagagacagaagacagagacggaggactggaggagagcggaagagtgcgaaggagaatgaggagtagagaagaaaagagagagagagcagaagatagacagtaagagataggcattgtaagagatagacaggaagaaaaagacaggaagagattaagaaaaagagatagggaggaaagagaggcaggatgaggtagagaggaagaagtacagaggaagagatagtgatgaaagagaaccttgtgcaccttggaagtgcagaagagagaagaaagagacagatagaaagaaaaaggatgagaggaaggaaggggagatagtgaagaagcggtggtgaggcctgttgttgtgatggggaagagagcagagagaaaagctcggactggctaatcacaggaatcaaagaacgaatgggagatgacattcggtgtggaaactcacctgggagccagcagtgatgcagtcccgaggacagcgagagctccgcgactgcggatgtctcgatagatgtggtgtgccagtttcatggtaagacttgacttcgaaagcaggcttaggagaagagaaaaagaaaaatgaaatctgactcagatcccaacaacggggggaaaaccgctaatagagaaggtcgcgtttgttagctctgttcagcgtgcaggaaaggccaagcacacacgtgtctctttttcttgtctcgcaatgcgagaaaccggagtggcgaaagaaagggcgttcttactcggaaaagcgaatggaagtccacggacgactttgtgcaaccgggtgagtcgggaaactgagagaaagtgtgttggtgaagaagaaaacagaaatagtggatctttgcgatctcttggaggacaaaccatcgctgttgtgtgcccgcggccgatcgcagggcctcgcgctcgtcgtggcgaggctaagaaagtgcatgtgtggtactctgccgaaagagaactctagggtaggtttttcttcgaaaaaacaggaagctgcttatcttcaaaagacaaaacgactatctttcgctgtgcttagagaatgccacgcagccttttgcccgagggaaagtgacgtgtctgtcccagtgcgaaggagaaagggcaccctctttgacacgacagcgagataaaggtttctgtcgctgttaataagcgtgactacagtagttcatatgttgcaccgagaacgcaccggatgtggaataacctctccgtagtaggatactgaaatccaacgcatttagctgtgaccaagaaaaggcacgttgagagggaaaaaaacaaagaattgctgtaatgctcgatagcgattcctggggagtatacattgggacctaatcgtcaaagaagtcgctgttgccttcgtcaaatgacccgttgtgtccctctctgcatccggcgcaaaaatctgcttctaaatctcttcatcgtttcggagtgccgttcgggtca

SEQ ID NO: 1335 - DNA, 3710 bp, Toxoplasma gondii
aacgcccgacgcattcacagacaggaaattggtcaaaaccgtgttgccacccctggtcacccctcacaaaaaagcaaacgaagcgtagtcatgtcagtacatggctactctatcagatgccgagatccatttcgatcatcactcaagggcgaagatgctggaaccacaccgaagtggaatggtacaccgcagtcgtcgcgatgttttgtcgtcagagactgtgctagacgcgcgggtttcccgtatctagaaaatactgtaagatctctttcactgtatctaagagtgttctacatccctgaatgctatttctcgtgaaggaccactggtggcatttcagcccaaaatatggatggcaagaaaacaaagacggtcttctttcgcggtacgcaccacacaaaattctacgacaagaaatcgccagaaacggaggaataggcacatcaggctttgccgtccacaaagtgtcacatgcgacactgaaaacaaactgcatcactagtttaataaaagacggttagcaatttcgcaatcacttgatcgtccccctccgcacagaagcaaggataaaagaggtgggggggagctgcgccagaaagaaaatgcggcagtcgagaagaaactggaagtctgaaatccccagaggaattgctgtttcttgtctagcagtggccctaattcccgaaacgactggaatcagaagcgctgtggacctcagacacaaatctagaaaaagtgtacggacccgcggcagcggacagagacgggagggacataaatgagggcgacacaagtgtgaagcgatggaaccggcgttgcttattgctgaaagaaggcaaacatggggtatccaagaacatgctgttttccacgatacgaagtggtgctttttgacccacctggcttcttgaagaggcgaagccatcggcggccacgatccgggaggtagtattggagagttggacttaggattgtagtggtacaaagcccgtagacaaaggatctctgcaaaacttcatccattatgactaaggggaaaagtgactcagaatttatgaaagacaaagccaatggcttgacctggtcgcgcaatacgcagccgcaaaaactcgtcctgaagagtggcaggacacccgagctggacgcaaagaaaacagttacacttcaagggtgtgagagtgttaacacctcctggttacatctttctgaagagaagtagcagtctgagagtttctgaccaaccagccctagacatggcgcatgcaagaaaatctgcgtgctgcatgaggcttcgcggtcaccccgtgtcacgcgactgcgtgtagtacagagtcagaaccggtccgtgcgaatgcggcgagaagcaaaacaacggaggagaccttcggtatccaaaaaccgttctagcagaaccaaccgtttctcaaaatggttttgactgcggtagcctgcgggtcagggcgtgcagttcacgatcactgtcctgatttcgttccacgtaaaacgcgccctgaacatacgcatgtgtattccagggaagtctgtcttgtgtctgcgtgtatgggccatccacttcaccaaaattaagaacccagtctgtctggagcagtggattttgaatgtgttatgctctctacatggctctatctttgctcctagccattgttcgggatggttgcgtctgtctccgttcggtcgcgctcggctatgctcccgacaaatagtggtccaacaagcggcaggctgccctttcacagggggtacgaatggccgtagagaatacttctcagaagtgcgaaccgtcgaagacgttgccctgcaagagtgacgagtggaatgtgaagcatacgaaggaatttatcggccattagtcgcgaaaaaaaaaatcgggtagaactttttgggcactagacaaggctgaggcaacgtgtcagcggacagtcgtactatccagccgttagcaggttacacacgcaacatgagaacgcgtattcttcatcaatgggttccagtttttctacatatcaggttgatggagtgggagcggtgtgtctgcaagcgaaattcatagaaatcgtttctcactttccatgttacacccatagaattgtatccagaaagtcgcttccagagattcttcactggaacgccgtgctggagatgctcggtttttttaagactacagggaaccgagaagtatgtcctttcttgctgctgtggtatctgaaaggggtgaatagccgtacgcatatttactccgtctgcagcgttagaaccttctctaggaataggggcgcagaagtttctcgatgtccgtccttgacgtagggggcaaatgagaagctaatcacgttacgtggctggaagttcccccacagaaatccaggactgggaaatgtggcacacagaagaaaagtaggcgctctgatacgtgatcggtttacccttgtcaacaccgttctgctagcgagtaacttccttgattcggcctgccaacgaacaaacgagccttcgctctcccaaaataccgcgctgtacacttttactgcatttttggccatctcactgttttcttgtcatttctgaaactcaacgatgcaaaggacggtttgtggcattgcattgctcccgctctcaaaactaccggtggatgggagtatctctactacctctgctcatcctgctttcaaacagacggccgatatgtgtgtacagaaacaccgttggatcattcctacagatagtttcggagttgtgatggggtacggttcactgtgatgacgtacaggaccccttgccgagcattacctgcggtaaggagcttctgacttttcactttcacgggttttgttttcttagtccactggacactgatgcgaacagggggatttccatcacgcagaccagacgccactttcgtattcattctgccgggagtgggactgccagaatacagcgtacccgggaaccaccagaacgcctgtgttgtccagcatgggtactttgaatgggaattgtcaaaacattcaaggacaccagaacgcctgtgttgtccagcatgggtactttgaatgggaattgtcaaaacattcaaggaaaggagccttttgcacatgcgtgtgacgaaaggtttcaaggggcgtttctctctctctatttttaatgtcttggcacatacggagaacgaagacaaccaacctaaagaaaacaacacgactaatcggtttcttttcaacagtgaaagaaagtagcaaactcgcggcggcttctttaccgtctcgccctccgatgtgcgctgcgacaactcgcactgacgtcatgcatttaccttgtgcgtgattcgatttttttcctgcatcacctcttcccccggagaatattcttcgctctctaaaatagtgaacaccaaaaagtgttggcggcaagacacaatagacagtctcagctttccgcttttgcacgagacacgactgttcctaaacagagaattgcacggaattttcaaggtctctggaacgaagcgagtagttgtagctgttgccttcgttgtcttgccggtctccggtaatttcttttgttttcgtaagcggaaggtaagcgggtccttttgtttccttttttttactgatattttgacaatttcgtccacttcgggtgctccaacctggtttttctccctcctgcgtcattccccagaatcgccctcgcga

SEQ ID NO: 1336 - DNA, 4417 bp, Toxoplasma gondii
gtaggtatctgcgaaggcgtctctgaatcgacgaagaatgaacagtggagatgcatgctgaacaggccggctgccggctgagaagactggtcgtgactcaaaaagaaggcatgttccgccgacgcacggcctccccaagaagcgcttaccctggtgattgcccgtcaacttatctcgaggtacggacaccgtacgaacggggccgcactggacgaaaagctcccacagaaggtcgtcgtcgacctgggagtcgagattgccgatgtacaaggtggcatcctgatttctctcgtagacctgagtgatgtctgcgcctccgccggtaaaggagcggtgaccgccccctcctacagccagcattgtgaaagatgggttgtgatgacttcgcagacctgttcaccggcctgtcttacggccctaaaaagtgggaagctgggcagtttctaatccacccgcagaaaaatctttggccgttccactccagctctcacgtccagaaaattcaaacgttacgaagagaaactttcggtgacgacggcagtgaagagggagacttggtaagggattagacgaagcaaaataacgatttgtctgcgtagactaaaaacgccgagtgctgcgcggacaggagggagaagagccaggtgaacgggggtgatcccgtcttcaaacaagcagacgcgagtgtctggtacagatatggtctgctacgaagacactgtaaggtaaaaaacacatcctggcaggttgtcgcactgcccgaccggaccctgcaggttacgcgaaggactccgctgtaagtgcggtggttgaacaaatccgtccaattggttcacgaagtttggatctttcccagtgcgggcaaaaaaaggcgcattcagttgatgcatggaaagaccgaggagagtccagagaaagatgagcgaggaaaaaaggacaaagacgacgggtcccgatgccctggaaggagtgcatgcgcacgtcaggatcccggagacctgctgcaacaaaatgacagcatccccgattcacttaacggaagacgacgggaatactggtttcaatgtttgtggttccaaacaggccgccttttcccttctactcacaagcagcgtccagaaaacgcattccgcggcgcggcacgcgtttgcgtcttgcttttcctttttgggggcagggaatccctgagcccggcaagtcagcaaacgaccttcccactgcatgcacgggaaaaagccagagtggcacggccgtcacagagcagtcccagttagctggggtagatagattctgagacaaaaggagtcctctcgaaaagttagttgactggtgatattattggagactcactgccgaggtctgtttgggcgcgtccatctcagacagacacgggtccgagaatccaggtcagtcgaacgcgttgttgatgccctctcaaacattgctacacacactcttctgctgtttttagggttcaagcggtggcaatcgagagtcgcacgtatctgtatatgtctgttagaccggtacagttccgccgcagtgaaacgtgtgtagagcagcgaaaggcgggattgttcggccacacaggaagcctttcggatgggctccaacccgtgcagctttcttgcccctgggcagcaccccaggttgcaacgttgcacaatttctatcatgtagttgcattgctacttcctaccatctttggatgctgcagctggaaagccgactagcgtacgataggtgggtccgcaaacatgccaggtgactagagggcacgtaatgacagctcgcaggtagcgtggcctcgaatcaggaatttcagccggagagtccgcgcttcctaaaggaagagcctcgctcgaattcgtgggttgtggagaactgtgtagttggagattggaaagcccttctcctgtgaagagcgagaaatgaaacggtcgaacgcatatgtcgctctcatcacattgcaaatgtgaggcctcttcggttccaggtagagcgagtcagttgcagatacaagtgtggtgccaatcgcctgttcagtctttgaaactgtcgacgcagcgtaagtaatcttgttcgtacagcgtacgcctccaccgctgcaagggtgcagaagtgaagtcgggtaacactattcgtccccggggcttgcccttgatcctggaattttcatgcaccgcttaaaaatggaatcagctgggcgcccacggaccgcattcatgaagttttcgagagacttcctttgcaaggctccccgctggagtaacaccatgatgacagctgggtgattccttggctttcacatttgcatagttgtatatcaatccgtgcatcacatggagggggatactgccacacatatttcccacgcttttaacttggtggtccgcaccgcagttgtagcctctcgaacttgtaacctggctgccctgaaacggatttgtcctggaggcctttcacgaggcacacagccaccataaaagggactttgtagttctttcaacgagatgactctcctcagacggctggtgatacggtaaaggggagagggcacagtctggacaactcaaacggcctggtcagccgcagtgctttagttgactagaacttgtccctgtccgagcgctcgtcaggtacaaagggggcaagtgacacagcggcccgcagcccctttgagctcactgaagacgaagcgtcttgtgtgtcgctacggaacgaagatagaaaggactccaaccggtacatttggtggccggtttccgatggcgctttggagtcttccatatccaagaaccttaggaaggtacaacaccgcacaggaaaaaagtactttgcgtcgaacgttgcccacagcattctaattgtgagtttttctttcgctcatctacggtttttgtctagttgacggtgtacccatacgcgccacaggcaaccggagctggctttcattgatctcctctttgcagcaccctggtcctgtggaaggctggagggtttgtagtcatacgacgttttgagtcgcaggcgagtgcccctagaaggcaaaagctttgaatatctttattttggtgatcgcgcgcgtgtggttggtgcgatggaagagtttaccgcctcgccctgctttggtgtgtctgcccttttcttgctatcacacatgtgaactacgaaccacacatgtttcaagtgtaaacggattcctgcccagctgcgtaccaatacgatgcttatcatgctcgctccacagatctgcgctgacatgccgaaaaaacctctggcacctcaacaacctttcggcgctgtaagcataacgacatctcgatattttgctcagttggctcgcctccgttgcggaggtctgagttgttccaaaacccccagaatagtcactggaacgtcgagctattttgcagttgaagaagaatacaaaggcgtatgcgcgtttcatctgcccgttctgacggttgagacagattcaaatgtaccacatacaggacgctcattcgttggaaggaacagtgagaccgcataccattttcagtatgaatgcctgggcgacggcatactttcacagaacgttccgggtgagtaagagcggtggtatgctgtgtcaacaggttgtgcagacgcaaaatagtggcgacataacagccgcccgagggcatcatacgttttcctgcccctgagccacggactctcaccggaaaagtgcagtcgatcttcagccgattctggacgagccacgcaagaatctccggttgcgcgacggctatgaatgaaaacaaataatggtagtgtgaagcccggcatactcttctcaaaaggatttgcgaggttgtgacggtcaaggtgttttctttcaacgggcggaaccttaacatgtacgaacgcatccgaaacaagtcgaaaaggaaccacaagatgacagccggagcattattattattatctttggtcttcgagtgctacgggcgcctcctgtcgttctgagcaaattcaccacgcaaatcgtgggtatcgtggaaggctctgcgttatcgtccgatgaaccgagagcttgacgcctgactgacattgtggtgggttccatctaaccttgttccccgaacagtatctctgttgttacacattatctcctcagtcaatctgaacgaagcagttcgacagcattctcgagctactcggctatgcttggactacacaagcaaccggcccaacagcagaataaacaagacacgcatgcagtaacgctgggcacagcgcaaccgagttttctgtggaccgctgttggctccgctgccacgaagctttcacttttctatttgtttgtgcttcggattggggtcactctcatttagggcagatcatagccgcggcccctctcgccgctatgctggttttcccgttgctgcca

SEQ ID NO: 1337 - DNA, 2819 bp, Toxoplasma gondii
tatctgcatgaaaccagaaccagagagttgcgcggttacacgacacggggtttcatgtgcaatggcgttctcctatagacgtggtagaaatcgattcaactgtgtttagagatgtttttccgaagggagccgcggctgcagtaagcagacgacagcgacctgtcgcacctatccgccaggatgctcaccgagttgttccgtgtctggctccaagttgcacaggtcttcaccctccctgatacgacagatatgcaaatctctatctacaattatacgtccacagatccgtgtgtacagaggaaaacttgaattatgactggaggaaatgactacgaagggggatgagcgatcggttgatctacaggtgtatacgcatctcaactccatggggcacaagcttgagttcttgcgtgtcgcatgacgccatagtgacgaatcacgcgtgaattggtgagtcaaagcgagaatagaagcatctgtttcagccttttttccgcacgacatgcccacccccgccggtgccgcaaaggcagttggcaggcgtaccgcattcaaggacgacgggtttccacaggagctcgaggcatacggagcacatgaattcctgctcaggagcctcgcctgtgagtttccgtacgtcctcttcctcgtcctctgcattgactggaaatatcatgatttgttgagtcgttccgtcaatgcgtcttgcgacttggctctggcgcggtggatcgccgttttgaaggccacgtgattccgacccatcgttgtccagtcctgggtggagaggcaccgcgtaaatttccacaggcgtccgccgagaaaaataattcagagagagaaacgaactgtctgcgtttccatgctcttctgccgtctcggtcccctgcccccctcttcgtgaagcgggcaccgactgcgtatcccccatttcccctgttttttcccaaaggcggaaagcgtagtctcttcagtttcaaacagctacctatccatcgtatcaagcggttcttccggagcggtagtaggaaaaaggcctggcgggaaaacgcttctccggtactcgcacggaagatgaacggcgtaaaaccggggaacgataccgtggccagccgttctcttggcggtacgagcagaatgccagcagaacgaaacagaacccaagagaaaggaaccaccgacaccaaaaccgaaacttgcacccgtaagaattgttcgtgtcgaacacgcacgcactcacgacacaacaaagcgtgcctggcgtgtgttggccggaaacgcgtgaattgagttgtagcgttggtacgcagatactttcttgagggagttagacaggaagcttgcgaaaagagagaagcttcaccggaaaaagcggcgccctttctgccaaaaagggctactcgtgacttcgacgagaaccttcacgagtcaccgaaagagatttgtaggaaaaatgcgagcaaatctcgacagacggagagggcgacacacttccgcaagcagccacatgccacaggccgattggacgtaacaccacgaccgaatgctccctgcaggaaaatccaggttgaagtgtgagctgcaaaggagttctttttcgtgcactgatggatgcatctgccttgtttcgctttcccagggcttttgaaaagctgttctcatattgcgggtatgcaagtcgacgcaaaatggatgagaaaacggagccgtacgcgcacaccctccttgtagaaaccggccgcctgcccaatctctcgatggttagttcagtctctaccgggggaaagcgcgagggaagagatttttatagcccgcgtttatccgtcagaagcgatatctgcagtgactgtggctctagcatacagtgtttgcctggccaagcaagcttttctcgctctcgagagagtttacaatgcacttgcacatcccaaaacgcgcattgcacgtgcctcgccgtatgtctccccctcaccataccctcctcgggggaccgctgtgtacgcaatttcgaggcagcaaagagagtgtcgcgcacgatgctcgtaggacgaagaacgacttccagaacaagagaaagaactagagtcacggaatatggaaaaaggttgcttaccagtctttatggacttcgctgctcgctgaatgtcacccgtcaaaacgtgttatacacaataaatgggcagccgtacaactgatactcggctgggtcagcacaaagacaagactcttctcaaaagggcacagtgctgcaattgtctgctgcgactagaccgcctcccaccgcacgtggatctcgaaataccacgctcgtgtacccgtttgagttctgcaaagattccctttcttgccagcaacgtcccattcaaccttgtcaactgcgaacaaccggaagaggcaacaggggcccccgggatcgacgcgaactttctttagccgctgagtcgccggagtcaacttttttgcagcgctcgaccctgggtcgcatctggttttttttcttttcttcaaagaaattttttctctcttcgcataccgactcagcgattcgctgagggagactgcgacgacgattaatcgcaggaagaactctttttcgttcccaagatgcctattgctgtcggccacatctgttcttgagttgttgcctgcgtccttttcctccttctccacagtgaatccttcctgcttctctgtcttgcgttctctgctctgcggctaggaagccgttttccgcttcgtccctgccatcccgggacccggttcgctgcgtcgttccgggttccgtgcttccgtttttcgttccgtccacccttctttta

SEQ ID NO: 1338 - DNA, 3401 bp, Toxoplasma gondii
gaaaatgggagagaaacgcgcaagaagaagacctatagcgaaacggtatctggcgcacagctcacgttgcctcgatcgtgtgcagcagcacccgttggatttttagcacgatgtcgaacacaggcatgcatctgtgtcgatttgagaaaagaaatgcatgcagagacttgttaaaacaggaaaagggaaaactctaagcagatgtccatcgtggtctttgtgggtgttttatgtagagaggcacaatagtgtcaggcagcttcactggcagcgattcgggaaacgattccgactttccagatgcagaactgcgttaccggcaaaaacaccaagtacacagaaacccgcttctgggttcgtgcttttggaaagggttggacacggtggttgcgtgaaactacacgttggtctctcccacgcgtcctcagaagcaaaagtaaaagtgaataggcgcagaagtacgcaacggtgaacaccctggaacgaactcagagtacgcatattctggtctgcagcactgtgaccacatatccgcacatgttttaggctttgtcacctttgaaatagaaagtcttcatttgcgacagggcagcggaacatcgggtgagaatcagcgcgggccaccaaacggtggttgtgggccagttaggagcactaggcatgacaaaaggacattggaacttagatttcgtttgagcgaaatgagtgcccgcgaaaaagagaagtgtagaggagcgagcagatggggaactccagagaaattagcattattacggcgggaaagattcgacagtaatgcatacccgacagccgcaggtatcagcggtcgtctgcgataataaaaaacattcgtcacaggaacagaaggaatgaatcatggcggagctgattgtagttaaatatgacgaatccagtacgtggaaagaggttcagaataacattttcagtggatcagtcgaaaagttagttggcaacatgatgccagttctcattgtgtattcgttggaagaacataattctcgattcgcagaaaaaagacgacactgccgtacacctcccatatagagaagcctcttttgacgtgagaagagacattcgacaagatctttgaggaaagatataacgagcgtcagagtttctaacttgattttccggttcgcggcggtgtacagctgcagcgtcacgaggacgagctgcgctcaatcacagataggcaaattcttcacactcgctgtttagttctgcgtttacaattgactgtgataagaacaatcatcgcaatgtcaacactagatccgccgtgacaaggtatatgcgtggaagcgcatccgtgtgtgtatacatacgatgcataatttctactgtgtagcaagtcgtaaaaaggatcttttaatgagatatcgtggagtctctttccgcccttgtaattttcgcttgccagtgtgacacggtcctcagtttctggtccagtttaaagaacagcagtccagtcttcagtgttttctttaactacaaactaaaatggcggctcgtgtaaacagacactgctcgtctccagatttttgatcggttggtaccgaatgtcaaactcattactcattaacacataaatcctacaggaatgaactgtgattgtgtttcagtgccccggagttgcgtcgtgagaatcgcggtggaagtcaacgaatccatttctgaaaattgtgcagagtctgcctagcagattgccatgttacggcactactttcacgcgttcttgccatgagccaggaacgccgcagttttgttggggtctattgtttttcggtcatgcttgctgcttacaatatcggcaatcgtttctcagtgtgtctcttaacattactggaaggtctcgcttacggttctgcgatgtggcagcaagggttgatgcttggacgactcggacgagttatgggctgtgaatatttcagcctagtaagtcaagttgggtatattacccggatgctctaggaaacgacgtctggaaaccgggttatgcagttctctgcatttaccctcgtcatttctaatggccgtgcgtcgcgtgtcaaggatgtttacagtttacgctgcgtgctgggctgttgccatgcctcttgaggaaaacgttggctagctggtgttagtcctgttcgcctcatggtgccggtttcgagaggagacacagccgagcttcatcttccaaaattgcctcggcctcatgagtcttttgtcggaaggcgtccgcgcggagtcgccgtcgacagcgagctcgattgacgggtcggataggccccatgcgctcgtaataacggagaggccagcacagagtgcgcggactgaggccgggagttttccggtgttcggcatcttctcttgcaacagcgccacagtttccccgatgtgagagaggtttcacgtttcctcgcttctttggtttgtgggaatttgcaacggacttggcagaaacgaagatttctgtccaccgtctgtccagccactcgggtccctcgtcggctgccgctccataatttttgtaagtcacgttgcgcgcggatgaccactctgtcaagcgtccatttttttccgcgccacggactttgccagtcagccctctctacttccgcgtcatttcttttgggcttcggctcactttgctcgctcgaactaccggttctgttatccccagtgcatcgaccgctcgaaaccagtttcagcgaagtgccgccagctggccgcgcaaacccgtgcaactgtggtgaatgtacagctgtgctgccttgcatcacttgtggcagacttgcgaaggcgttttgaaacgtgttccaaattttttgtcgtctgcggctgcacacggggtgagatggtaggaggtactgccataagtccacgggttcttgcttctgtgatcacctcccgctcgttgctcggtgaccaactcgccagccgttgtcaagtagaaaccgtgttgggttcgtgttctacggcgcgtgaagcgtttctcacctacctgtcgtccacatctcccggttgaaagtgccatcgcttctcttcctgtgcgacaacgatctctcccgtggctctcccgtgacactggcaaaataggcgtggttgtgcaggtatcttgtttaccggctcttccgcgtggccgactcgccccacgaaaatcttctgttcgtgtgctatgtgatctgcagagtctccctcggcaacggctaccacgcatttcgtcaacgcttgcatccggctctgtgctataactaccacgcgggcttcttcgcaaggtctttggggtaattgtccgggaagcgcctcctgtgccaacgcctttgcgtttttctgccgtctggtcgcacacctttcgtagaatttcgtcgaattcccctctctgcaagtcacca

SEQ ID NO: 1339 - DNA, 2799 bp, Toxoplasma gondii
cagtggacacggatgcgcgttcagatgcactgtacggctttcgctcacccgggagatcgtgacgaggagattgtgttcctgttgatggtggggggaaatcgggagaagcattcgtcctgcgagagtcgcagtcgcctatccacccttgactacaagaagacgaagattcaggaggagcaacgtggtaaggggaaggtgctgcagcggaagttatcctctcgcttccctgaggttggatgaaggagtcaccttcatgtgccttcttcaaatcgggaaccccgaatcttgatgacctttctacgaccttcgaatgagatgaggaagagtcccactcaccaacgctgcgctgtgaggaaggggccccttctgaagacgaagtgagtggacctctgtgcatgtgaagggaagtgaaggacaaagggtcaggccgaccaatggcggccatcgagaaacccgtgattgaaccttgtctttgaggatggtttacaggagcaccagtcgttacacaggggtcgccggtagaactcagccgctctcctcgttcattaagcacttgaggcgggacacccgattttcctttcaggtccttccttcgagtttccaaaatgtacttaggaagacctgggattgagccgacagaagcccctccagtgtcaggagagagagacgtcgtagatggcaaagaagacgctgggccagtaggaggagacgctccaccacttacagaacccgccatgacaacactaaaagcaaacttgcctgccagtactcatgcgccttactttttgaacagtgctcggaaaaaggcatgagtgcccacgagatgccacacgaatgctagcagcatcagatgataacgtagaggtgtctactggggtgtaaaaaaaaattcagtggaagagttcgtgcctcaaagacagtgatgcgaaattacacacaacgaaagaccatggggttctaatgattcgttttcttgcgaaaaaggaccagcgatgcccgtgtccgctacacaccagaaaagcatttgacggcaaaaaaggacacggaagaaaatgaccactggaggaaaacggaaggtcaggcgtcaacgaaagaagtcatcatgctacacacaattgtgcaatcaagacgagaaacgaatttcggtggtacatgcgaaaaaagtgacgcgcgtaagtgcagagacgagctttttctgtagtcgctaaacagtagaaaaagtgacagctttccatcttcgaaagaaagtggcagaggcattggtattcgaagtgtcagaagtcacaaactcgacccaaatgcagcgaaaaaaacacacgaaaacataaccagatgtagaaaaaggaaaaatcacgagcaatgcccgctagctcggccgcacaacggcaacacaccggcaagtgtaaagtgagacactcgttcgactaactttccttctttacgtgcgcgaagcaaaaccgattagcgacgctgtgcaaaaagaaaatgaccacagcgtaccattgccgaaacgacacggtatctccagtcgtcgttagcaggtgagttgccgaacgacttagctgccaacccccaggagcgccttgtcatgggtactgttgatgtcctcgcatattggcggggtagaacaagcagcttttcaagagcaaaacgtcaacagtaattttgatgggtctaccacacgcataacctgaggagggtcaacacgtcagttctgccatctactggaggcgattcgcaccacctgcaaaactacaaacagcatttcaagaccgtagtatttagacaaactcggaaccaacgccagagctttcatgccgcggaatgtggtaccttcacagatgatcatgcacaccagttaactctacaggcatcgaccacattcctgatggtgcaggcatggggagatgagatttaatcaattcgtaaacggcgggcagtcgtgacagagtggaaatcataacgtaactcttaatgccgctttttgggaagcgtgtctctatgatggctcgtaaaatgtgttgtttcacgtatgttctgtggtaccaccacacgccacacatcttttgaatgccaggatggctctcgaagttactgaatcactttcacaagcaagaatatagtttctgtaaaacccagctgtcttcccgtgtcccgtgctggtagacacagcaagcgactctctgctccggtggaggggacaaacaccgagacggcctcggactacggggaaactatggttttgccctctacagacacgagtacagatcgcgccaacctaccctaggacaacgtttctacgggtgctaatagaatgctttagagctcagttcgatacgtttggatcaacaccccagaacctatgaactctcaatccagtgtgtacctgagggccccccatcgtcagtttgacatccaggctagtcctctgtggcggcgaggcactgcagaaacgtggactttcctggactcccctccctggattttgagcaaacttcaacggcatgtcattttgagtccacatgatttttttactaaggcacctcagcccgttggtgtccccgttttcccttcctgaacgcaaatcagccgcttcgggaatcttcgatactcgatgtgcgcaccatggattttgaaattgagagtggcattcagctagggacaggacgacatgttcgcactttgagtagcgacaaatgccgttggaaacgaatcactacgaaccagtgaacggtagcacaccgtaggtatgcagaaatctgtgatctagacggagacagcttgaagctgcttggtgca

SEQ ID NO: 1340 - DNA, 3600 bp, Toxoplasma gondii
gcagttcgtgcatttgctcctgttcaacgcttggtcttctacgttgttatggtagtctggtcgctgttgcttccttgactcattgatgtcgaagggagggatacctttggcatggcggttccgcggatgaacgccggtctcggactgaacagcagggagtctcgctgtctaccggtagaagaaaagaaaatgccaggaatcgctgaacgaggaagactggcaagaaaagcgggacctaagaaagttccaagtctcatagatccgagcagaaagactgacaccgcagtgtattttccacagaggtctcacgaaccggcacagtttctttggcttgtttcaaatcgtggggtcactgactgtcccaatggagtaaaaactgctgttcctggtagcggagaaagtgcgttttgtggttcagcatctactttggtccttcaaagttccaggaggttcgaacgtttttcctctcaacaaggacttgtccgggctccacaagttaacggcagatgaagcagggaaaaaccagcagagaggacgcgtatggcgggtacgaacttagacgaatggccctgagaaaaggcagcgtgcagagcgggaagtgtgtgaacaagtcgacagcgaaaatgaaaagaaagcatggcaattggatctcaagaaacacgaagttaactacatgacatgagcagctgcataggcgggtcagtcgcgttagagggccgagtcgaaatacttctgcgtcgggaaaactcaagcgacgaggacacgcacaagaacggagagccaaatcaagtcggatgagcacgaaaaacacctgccatgccaacaaaactctcaattttgtgagaaaatgggccgttcctctcgattccacagaaaaaagatttgttcactttctgcattgcgaaacgatgcgtctatctgtaacggtgttttcacagaagttccaaacatcaaaaggccgatgcatgtcagaggagtaacgttcaccgctcggaagctccagaaggaagggactgtcaaatgttctagacgcacggttaggcatggctttgctcgtgtgtttgttctatcaaaaatcaacctgcatgtgcatgcgaatctagtcgattccggcgcgcatgcctgggtcgccttcgagagtgccacgagagtgaacctaatcggaaagtgcgttccttgtgaaagaaagcatagagaaggtcaggatctcgtgtggaaaccatcagaagtttccgttccttcaattgtttcccactaaatgcgtcggcagaaatgcagacgcctcacgattccgcactctccgccatcaggtaatgcgtctagcagttgcctccaaacctgcctggtcctcgctgcaaggccattcactctcagaaaggtttttatccagcaaagaaattgtttgcgatgtgggcaggtagaagcgagcctctgcgctagttggtttattgctgcgtcggccgcagacccacatataccgcattgcgtatgccggagtgtcaagggttgggcgaactcaggaaccacgggggtcatagtgtagattgtctcgtaatgcttcatgtattttgcagttagcgagcaacacaggagaaccggagtgagtgcctcaccgcgtgtgccacccgcagcagagcaacacacaactgccattgcggcggagcactttctttgaaggtcttgactggtatctcgacatgttgtattaccagagcgtctatcgtgagtcatgcgaagcaggttgtccagcacagaatttctctggtatacatggatgattctcgactcttgtgttgttatagccgctagtgccgggactgtatcgtgtacttacggtagtactgtcgagcctcttcactcgaaattgtctcagctgacagagggaacgcggtgttgtatatagggtgtcgtttggtgtggtccaggccaataacttgcgtggttgtagcgaggccagaaaccatcatctgtcagtctcttttgacaattgatcgggcatgtttcaccctaaactgaaattcgaaaggacacgactagcccctctgctacaatatctaaaggcttaaaagtcagccaccaagagatgggtgcatgcctgaaaacaaatttcgtctgtctcagtgctccgggcagcacgtagtggtcgagcaccctgctgcaccttctgccctttcgaagctggcaatagccaatcgttgaggttcttgcacaagccaagcctggtgtacacttgctaaattaattgctagtctcattagtgaaatctatctcaactgtttctgtatcacatgtgcagctacgtcgtaaaagcttaattacagagtatcaacaaacagacaaaagagcaagatgtaccatgaattgaatatgtcctatacctgatatagtggggaaaaagggctagaaacgctagaaacgtgggatactgcgtgcacaacgtacattcatttgttgaaacgtagttgcagcacaaacactctctcttcaggacaagatggattcgctacactgttcttgggaacaaccgcataaaaaatctcgagctgagcgcttgagggaacacggaaaagtgcaacaggctacggggttggaggggaccacaacggaaggcctcagctaagccccacacgttcttcggtgcaaggcagtctcaagacgaaggaacctttatttgccggtttcacgctatgcataactggtggaccaattagacattggcacttccgttttctgtagttcgtgaagggcggatttgactgttgacatttctgctctcttcggaacgcctccgctgcgctttaaagtaaaccatgcgacggctcaccagaggtccaccaaccgaactgtgaaaaaacacggtgctatttagcttgtgttcgcgccgcttgaagaggaatgaaccaccttgacagtttcccgtatatcagcagagtagctctgtgccatatatcaggaaacaggtagatcaaatggccaacaaggcagcagggtttcgccactgtcaacgccactcgtgaaatggagttctctgcatctgttctggttattggtgcaacacccttcccttacgcatattaatgtttcgtatgcaggcagtcctgtgaagagtggttcgctttctttcggcctaaagggaatcgcgcacatgcagaaaaagcatgcattggcatgcaactattacgctatgacgttcgctgttcagaaactgatgcgcattccctttctcaacttcgttcggtacaactagaccaaccaccctcacttgccctaaagtcgtgcactcataggcatctctgatgttttgatcggctacccttccgatcgccaatacacagatcctaggggtttggtttccctgttattccagttagattgaagagcattctggagcctatcatgcagaacagtttcaaccgtctcaatataccggcaagcctgaaacaaaccaggcatcctgacagtcctgtacacggaggaagccttcgactgtcactgttgatataaatggactaagttgatccgcaccgtaaagggcggcgtctcatgtagactggactgccatccctctctgtgaaacctctctgccagtgaagaccaaaa

SEQ ID NO: 1341 - DNA, 2174 bp, Toxoplasma gondii
agcatcggttactaggctttgtctggatgtgaaacgtttcactcagatcagttgttgacaggcttaagcaaaaaacgattaagactgtgtctggttcgtgtaggagctgggtgtgggatgaaatgtacggtctgagaaggctgggacgatcgaagtgacggctgcggaagaagcgtgacgctgcgaattgccatgcgtttatggtgccctcagctgcgttttggatgcgtccgcagcaattcctcatgcttgatggtgtccttctacaaagtgcaggcactatctaagataatcctctgctgcatactaaatgcggatggcagcgagagtgatttaccagccgtggcatgggtatttggaagcccttagctgtcacttatgttccatttcgtatgttattggagctctcggctcagagcttgttgcatgtccatttctacaacaatgtagccgtcgcttcacttgcaattccacctgttgccccgtctttcggagaacctgatacactcgcctgctcacaataaggcgaggcaggcggccagggaccccgagctcgcaaagacatgaaacaaaaagtggtacaaggcgggtagtgcgatcgggcagggattagagctttaatcttttcagcccgtgtcatagcagacaataaaacgcttgatacaagcccgctggcaattcaaagttgagcgcagctcccaacgaagttatattccatcagtgctatacttactgaggaccccaaatagccgtaaggtataatatcacgaaaaatttgacacgaacgtgagagacgtcgcagcaggtgtagacacatgccgcagttatcatggtaaaaaccacatcctacacgtgggcgaagtttgtttgatcgaacagaagactcgttgggtcgagagtatcttatgcctaggtgccgctgagattcaaagattctaccggcgttccagcaagcatcctcgacgtccagagtctggacctgctaggatggatttttgttctatatttaacgaagtgtggttgcaggaagaacatgggcatcgccaccgctcactcagttgttttggtatctgcagatgctgttattaaccagaagttcctgacgcatgtactactctctcccggacgtgtttcacatgcattcactggtgacgggtgcattccgtgagtatccgttttttccgtctctctttttccccttcacctttaatgccccatcgctcgcgatttttccggttctttccgtgtctggggttcagatgtgcatcaacagggtttttgctgtagctgtgtcgttggctgggggtgataactagctggtttgctgcttaagggagcgggaggggcggaacgtctgtgttcttctgctgcttcgatgatgcggatcaaaaagcggcgacacactgtccagcactttttggatagaagtagcaaagttgtgggaaatgctgtgttcaggagcagattaatgacaagcatgccactattaaaaagcgataatatgtgtgaactctttcccagcggagcaaaaccgactctcgggtttgcggttagcgtacgccgtcgtggatgccgctatacggcgtatttgagacacatggactagcacctcgtctggtgttcccgtttacagtgccttattttggttatttactttccacggcccaaaatgcccttaccagcgctatgttcctcttttaattcaacgtgtgaataagggttttttcagttaccgagtaaagttctgcagtacgccaggcgggtacgtttacgtctcaaggctgcggtcacgtcatcttttaagtaaggctttcccgcgtattttcgcgaaagttgaagcaaataggtgcaataatgcgacgaccgcaagcgctataagtgtggggtttcacccactacatgatcctgtggaatttttgaaattcatttattagaggctcgtcatatccttgctgcagtgtcattcagtctgtgtgttacacacttccttttggccacaaatagtggatgggtgtcgtcaggattgctggaaacttcttcaccgttttcccagcggtgtgtgcggtggcggcatatttttgtcttcgttttcaagtctcgttcttcctctctctccgctgcgccacacagccctacatgaagcgtcttgtccgcatctgaccttcagttagaca

SEQ ID NO: 1342 - DNA, 3322 bp, Toxoplasma gondii
aaagacctgcggagtttatcccgcttcctctgcctgcagagaagccaagtctcccctgctcgccttacaacttctccaaacacaccgcgcagctcttttgttcgcccttttggcttcaagtagacctcccgaggcggaaaagatctacgcgttctcttccagtttccttcccgtatgaagggacgtggcggctcaggtgtaggtacacctggaagccgctgtgggtgcagcagtcgacagtctttacgttccatacaccgcatacggtggcggctctgacacgacatatcctctgcaccactgttcaatatttctgcgagggagacgcggagtgaagataggacgagaaacacgcgcagaaaatcttgcggcggacgatggtggatctctagcgaagattcgtgtttctgacaggagacaggtaccaggtcccgatgcgtcggatctcttttgagaatccgtagaaaaccttgtatgttcacagacgggtgcttaatgccagtttcgggttcaaaagagcttcaaaaattcgaaaatgccactccgttaaccatgaatctccacggtaagcgtgtcgctggatctccgggtgtggcgtcggaaacacgtacacgttgtgtggagagacgaaggaactcctcgccctcttccccaggtaggaaatgcaacagatgcatatctagagtcgagagcggcggaagaaatgaagagaaacggagaggcgcgcttgtgtcgatgcagacaccggtctgcagctctgcgaattgcagacgacactgtcacatcgcggcgcttcgtcctgaaagcgacaacaaaggcaagttgaaatgagtgcgccagctgccgtcccttccaagggaaagtgggaacgaagaaagaaaaccaaaggaacctcgttcctcgtgaaagggagacgaaaagcggtggaaagcttgggcacgggacgagacacaaatagcgacaggaacggaggactggcacctgcaacagaaaaaacggaatggacgcctggacgacgccatcagaatgacgaggaacgcaacactgaaaaagagaaaagaagaaactaggcgagtcgaggagtctgccaataaaagtcgacggaaagccgtgcccgtccagcgtcttgttccccccttgtaattgtcggtgcgtgcctgcgttcaatactattgcaactttgaccctcgcgagcaaaccaaacaaaatgtttttaagcgtctgcgaaaaatttgaaaaaatgtcggatctcattcttattccactatttgctctattgtctttcaattagctgtcccctatgatgattctgagttcgctgccaagctctacagaccacatgcgttgtgtctacgcgtttgtggcgcctctgtcgttgcccgagtttgttctcgggcctctccggtcacgtggtcgatacttaagaggaaagtacagctttccttctctcacatgcagcaacctctctctttctatcggtttctagggtctattcagcttcgtgtctcccacttccgctcgagagttcaggatccggaatcgctacccgtggcagtaaaggccgcgagacagttcctttcggagggcgcatcgtgacttcgtcgagtcgggtccgatgttcctcgctacgtgttcctccacggagaagtgaggaaccgttagaaacatgacatggcaagcgtgacaactccatttcttgagacactgccagaccgcttctttctgcccgcctgtgaaactatcatctccagtcagggcacaccacagaaccatgccagtaggtgtcatacctggatctacagtacgccaggtatgtcttgcttcagtttcccccccgaatttcctttctggattattctctgactcctgcttgctgttctttctcgtaaagggagatggcacggcactctttgccgggatattttccggatttcaccagtatgtccaccttttctctttggcgtcggcactcatggccctccaacaaggagacgagtcgtcagtgcgccagaaccccctcggacgcagcgtgcccctcgagtgcctctgatcccgcgcttcctgaccgttcagaatcgtcacgcgttcgcccttcatctgtcaaaatatcgtgtcctgcaaatgcagatccgcacttaattacatggtcatggacagctaagtacgcattcgcagacacagttgagggcagtgggaggaactgtgggaatttccggagttttgaggagagatcccgatgggagaatctcgaccaacatcggcgcagacttgcgaggcgacgccaccggcctcggtcagtgccttacgctcccggggggccagtcggctctcaccctggtgggatggggtcccggggattcctgggggggttgcgagcccagatcgtgcttccaaggttttccctaagatcttgcacttgattgattgaatggaagagactttttttctaagagacgtcttttgattcctttgaaaaaaccccaaattttttcttaacgcgaattctcgccggaaaacccgagaccgtgtcagggataaggatcgacagcctcgcccgattgagtgcgcccggggacgaaaaaggtgttgaaccccgtgagggaactgtgggttctgccttgggaaccgccggacgccgagacactgcttccttttcttgttttttagtcttccctcaggtgataagcgcgacatttgccgcgcggaagtccggaactcgtacggcgtccgggtaacctgtgccccattatacagttcgcttccaggggaaacccgaggctgcattgtctcatcgattcgcgagcagggatcggacgcttcgccgtctcgtcccttctgtctcgttccgaacagctgcttccgcagttgtcgggctttgtttccagaaacacaactccaacatttaacaactgtgggccggttgccactgtgcgaagttcctgcgttgtcgagtcgagtgtatgtacagcccggacactcgaaccttggcaacccatcgcgtcacaactgtgtctcactccggattgtacagcgccttcgttcgcggtcgagatcgtcagttaccttgggtacttgttcagtgtacagaattcgtttaattttgatttgtttttcctccgttccagtgtcgtcgcctgtccagaagcttgaatcgtataaagccttgtttgcagtgcgcaagtgagtgtgagtctcaacgttcgtctgccaagttccgactcgagtcctgtctccggccactccccaggcagatttcgcccacaatctttcgttgctgacgtacggctgctatcgactattttcctgtcggttctcaacataa

SEQ ID NO: 1343 - DNA, 1653 bp, Toxoplasma gondii
actgacaactcatcgtgtgtagcagatctatttctattcactattcccgagtttaccacacaattcggtggcgtagcgtctcctgcatacagtactgtgtcggcaacaccccaggtcggtttcttgagtgctaatcacacctgcggacaagccagttgctcgtccgttcagacgagacatcctcgtttgttcgagatcgcgtagcaaccttgaatcaaaatggtcgcttcgggaattccccctgtgagcatcagacagtgtttttccccttcctgggaacttcgaagctaacgcagaaacaggcctcctttcgcctggtgtcacagtctggtgtctcgggttcagggcaaacaaaaatccagtgctaggcctcgttacataccggtgtctcctactcaaagaaacggagcagctgcctacgtaaagaagcagaaaacgccaatgaataatgcgcgtagacaggtgaaccgtatccgactgttcttagctgacacttgctttcttggtgagagtgacgcgcctgaactagtggtggtgaaaacctctttggcagagacgaatctgtgatagctggtggatttgtgcctttcactgtgccccactggaaacatctatatctgcacttgacgtaggacgttacacgccctccgagaataaacagctgtatagacaaccctgccctaaagaaaatatctaaaatactgatgaacgtcgtgcagccctggtcaaacagagtttgctcatcgaacgaaacgtaacgtgaaataacaacagagactagaaaaaaactctttggacaacctgggtgagtcatgacatcacgtgtatcggctacgtcatcgagggtcgtgacgcagatctgtggcgagcggtagcagaacacgtgcgttgcaggccacacatttgtttagtctttcttgttaaagccatgttgtgtttttctgagctaaaagacaggtattctcactgcagtcggcagggagagaccgagccgaaacaaacgtaacagatccatcgaagcacaccgaaaaactaccaaacttttcttttcaccgtacttagtcaccctcacaggtactacactggttgtggattataataaccggcacgcccatcattatcggcacaccttgcaagaacacggaagcagatcatcgtaggtagtgatgcaagcgctaatagatgcatcgatacgttatcaatgaaagcgtttttccccgcgtctcggcgaccagacgaaagagcatgcatacaacgcaattgagacgagtccgggagacgccgccgcgtacccgagagatccagtagcgtacagctgggcggaattatatattttcgtcctgcaaatttcttccgtaggcgcttgtacgactttctgcagtgccgcttggaaggggtgaaggtacgccaattttgctgaggctctgagaggcgccgtgcactgccagtcgtgtttcttcggggcttttagagcttccagagcatgcagcgagaggctctgttcacgctcgttgcgatattttccacccaatggggttgatgagcaatcctgttatctgtggataacggcaactctggttactttgcccgcgactactgggccgtcgctcgtgcatgtttggttccacagccatttttcatttcccatcgcaa

SEQ ID NO: 1344 - DNA, 1628 bp, Toxoplasma gondii
agtcgaaaagcgacgagagtgggcagacgcggaccagcagaaaaaaaggcaaagagaacttgaaaacggggcttctctttcctttttcaccgtgcaactcggcgaggaagtgccaaagcactcaacgagttggggaagagcgtggctttcgaatgcctggactccgacttgcgacgtcgacacgagcacaggcgtgtgagaccgacgaagtagtgcctccgacgaaaaaaaaatcggtggcagtttttccgcgataagcacccgtcggcctgcatctgtgaggagcgagagagtgtcacttttttagaacgagcgtcctttttgtttcacccgaggacagtccaagcctagtgaaatccagagtttccgtcgaagcggcacgaaccgcttcgggtggatctgggaagcaaagggcaaaaaagtcgagtgtttcccaggtttttatgagtcaagtgcaaaacagaaactttacaaacgtatttgacggataagtgtgtcaggaaagcatgagccacgtcgtgaaagcgctatccgcttcagcacggatccagagttgtctcgcacacgcacccacatctccgctggagttggtctcttctacgtcctctagtgtgttcaaaaacacaaacggatccccatacgaactcgcatccgcaagtgcgcctcacataaggaagcaaaggtccaccctttttgcgaagaacggggatttcgtggacagcgactgcgtaggtcgatataccaggcgtcctgcttttcagagacaagtgaacgcacagttcacacaattcagttacaaagtcccgctttggtttctctaggcagcccctgccctcgctgttatagagcaagcagtaagcgattcgtccaagactcgttatgcaaaaagaacgcgagacttcagggcgccttctcctagctaggcgttcctagagacggtcgaccagcggggtcagaagtgcccggctggactgcctaagacagctaaaactgttggactttttttcaaagctgcaggcgcgttggcatttacgcaatgcttgctcgcggtttactttggtcgtgagtcggagtggcaaaaagcggtatttgtgccgagctgtgtgtccgacaaccctctggcttacgtataagagtagcgtatctgcacatgtatatctgtgtcacactgtaacacagtggatacgacgtcagagagttaagatgatgactcctgcaaatatagaaaggtttggacgcaagggattaataggacaaagaatatgcggataatctaagttccttgttgacaccattaggggggtccgcagatcctcgtcggaaaaccccagggtgtctagcgatgctggaggcgatccagagggtcgtgtttgctcgcggctgaaacgccaaaaagagagcacagtcggctggcgaactggagcaggaattgagtcgacgggatctcagatgcagacgggtacgtgtgcgtggttagtttttactatttgcttctaaaggcaaccctgaaccgttgataatttcgtttgtgcaaggtcgttttcggtcacagccttttagcagttcacgtaacagcactgtttttctggaaggagccccgagctccattcacatttgagtcctcagga

SEQ ID NO: 1345 - DNA, 2920 bp, Toxoplasma gondii
gtggagaggaacaaagttaatgcgcttcctgaaagttgccgagcaacggtttctctctccagtaagaggttacacacacgcttcttctaaatgacgggagaacactcgcgtaagctattcacttcatggcgcccgagtgctgcccacgacagcctcgaaccacctgaatgaacatttccaggacattggtgggtgtagcgacaccgcgagatctcacggtgctcggctgctacgttgcacaccttgctcgtcgtcttcctctgcttcttcagactcctcttcaacctcattttctccgtctttctccgtcgcagggggggttgagttgctgtcagcaccttcagcaggtgctggagcagccacgtggccggcaccgacagctgcgcaggaaaagtggtatgggcacacgtgaaagtgaagaagagagcacacaaaagtgcgtcttcactcttgcgtcctagagcaaccgtcaaaagctgaaaaaaaattcaaggtttactctgcgttactcgagaaagaactttttctgtggcgtgggctcagctggcttcgacaggaaaacgccgcacacacacacaaagacttgccgttacagtcctcccgccccctcgaaccgtgacacccgggacgtaatggacgttctctatccgcgaaaggagtagacgtggcacagagagaccattcggtttgcagagctgcagccgggatacacaaattgcgctctctagcacagaggaatctcacgactcactctcgtcggccgctgttttcgcctgatcttctgccgctgacggctgaggggctgtggcagtcatcttaggcattgttttcagtggatggtttagggatggcgagtttgatcggacggaaacaggcggacggagttgccaacgacgccgatgcaacacccgaatcaggaagggaaatggcgctgcaagcccagcgaggcacaccaagagacagaaagagagactgtgcctcgtgacgctgctcgaagtaaagtatttttctccgcactggcttattcactggacatgaaaattcaccgaggataatcacatggcctggtttcgttgtgaatgtgcatgtgcgcgcggtgcatgcagttcaagcgcggcagagacgcgctgtcttgggctctcaccagacacgggatgactctcattctgattcgaatccagtgaaagcccccaggtaagagatacggaaacggggaacgatctccgaagagtagagcgaatttctgggttagaacttgttgaagacgaaggcgaaccgtcactggccgttgtcgtttggtgtggcggggtcatcccccttctcactccagatgtggtacaggccctcgaacatttacagatgctctcttcgccattacgactcggattccgcgcgtgaatttccgacgataatgtgcctttggatcacgagtactgtctttcgaccgagcgccagagacgaccgaacatcacgcaccaccatctgtagcgtggatggtgaacaccggtcatcttgctcacaggtcacacaactggcctttttgacgcacagctcgtgcctgatagttgccagtgttgtccagattaaatgagcattggtagaagtttcctcagtgagttcgctgtggcataggaatacgaaatctacgccatcatcggctacttgcgctaagtccactatcctcgtgagactgtgcacacttatcgagtggtactaccttggtcgcagtcacaggaaaaagtagcaatacattcacgtatatgcttatgcatgtatttcaatttcttttcgagcctcgcgcggcgcagctgccgcctcaccgtgtgtttcaatgggcgtcacacacgacttagcacgacacagctgaaaatagtagatagcaagtcattctgtcatccactgggtgacaattaccctctcatgtatacgagtcactaagcattcagcatcttagaacgcatgtatccatatgcatcgatatgaccataaagcataccataaagcggtgcaaaagtagctcaccagggtattccgtcacacgagaggacagtgtgaatgaaaatgcgatggtggatcctctgcgaattgtcaacgaccagctgcctctgcacagttgatgtgtttgtctggcagtgtagcatatataacgaaggaccacgattatggatgacgtcacaatcaacaatctattcattggacgccgacacccctgttgaacactgaatccattttgcgcccgaagtgcagctgaaattcgccagtcaacccaggaacagcgtagatacaagtgaccgttggacttaaaggagggtcgtgctactgcggacaccagcatggtttttacatctggttttttcgtagctcttctgagagcggagttgtaccgggatagagtgcggggtaggcgacggacaaaaacaaaaaacgaccgtggtctaacagttggtagttgtgcttttaaaagcatctcgtttgttgtcaacagaaacaacgtcgacatatttacgccacatcggcatacttcgctgtttccgtccgggtgctgctgcctttttgctaattgctgccgtacagccatccatagcggtttgccgtcttgctaccttgcgagaaggcatcttcctgaaagaagagaacggtcaagcgcgccgcaagaaacggtgcttcggcgcttgtctgaaacagcttgtttgcgaaatgtcagtgaccgcgccatccctggtcatggcggttgttggacagaaatccacccacgcaaacggatgccgacgcgcgggagaggagtctcggtcatgttttgtacatacacccgacgatgcgaatcgcaacatggctacttcgtagggccgttggttttcccatccgtcgttggcctgtgctagggtatcttagggaagctggtttctcttcctgtccacaa

SEQ ID NO: 1346 - DNA, 2080 bp, Toxoplasma gondii
tgattctgtagaactggtgatgcaccgccatttgatgaaaggctgcgcggcgcagcaaacgcagaagcccatgccaacccactttttcgcgaggaaagtaactgtttcgcgtttcctcagcacacggcaggttgctactcttggatgggatcttgctcagcggcacaccctgctgaagtcactgacacatctcagagcagtcactggcattttccagtgtcagcatttgtggcagtccacgctacggtagtgcgtttccacagccactggatcttctcagcacggaagagtttcgtcggatacagcggttactgttattttttcaagaccttccagttgcggtacttaatatcttttctggcgaaatcgggatgccacggttctctcgtagcagcggttatttacggacggcaagtgatatttttgcgttgaatctgcttttactggcgacggtcagacgtgaaggaaagcacgatcaattgacagtggaggcagaaaagaaacgtaggaatctcttgtcagttcgttgcgcgaggctcttatcatcttacagaatacacggggggatatgaaccccttgctttattcttctttttactctaggaggtaccacaggtgtagttatgggcaatgcaggtatgggcattcaactgttgcgagacaatatccactttcagtgtatgataatcacagtgattatattcgctgccatggtctgtaggaagttttcgtccaaacgtaaccacgtgtgagtgtggatttcgttatcactccttccttcggaaaaggtcctcctcgagcagtgactgcttcgtttcttgtgaaaaaacagcaggaaaaccttagaggtgggcgaatgtcgtcctcaaatcggtacagaaacacattttaaaggtgaaaccttgccaatagacactggaacgcgattgctggcgctcagagtacctcttctccgtttcactgctgaaaaaacctccgtctccaatatgtggaaacaaggaagtgagaatcaaaacgaagctctctatctctctacaatatagagggggacaggcgtctgataaactatagcagccgtgcgacgactcgcctttcagggcgtttcgaataaagtgaacggcgtatagtggcatcaaactacacccaatcttgtttcctctgtacaatcaagaagtcgacaacaccagctcttgctcgtgagcagatggaaagaatgcgcgatgtcctgtgtttacaaaacacttcagctcctccgtgactgcatggtgcctcagccgcatgtgcgggaactgaaactgaaaaaaatacagggccgagaaagcctggatgtttcaaagtcttctgggaaccggcgggttgtctctgcaatgcccggtctcccggttctgcatcggaggaaagaaaaagccctcgtgttctccatagcattttgagatcgtcgccagaatcgaataaagtgcggtcttccctgtcaatttgccaactcccgtcgctcaagaaatgagcagcgtcgatgcgtgtgtcgcagccgccaggagctggtgccgcaaaagcgcgaattcccgtgaaaactggcaaaacggggggtttgccgcataggattatccagaagaatatgttagtgttctgttgccgatttgctcgctaaaacggatgtttcagtagactcccttgggcatcttttgtgatcgaaggaaaacccaggttacttaccatcagaaccacaactaaccgaggccgcgaaatcgatgagctggcggtgacagctgtgcgtgtaggcacttctcaaaacggcgactacgcaaggcgctggaacgcagtttttcgtagactgtcgctgtacacgacttcttccatcacatcttttctccctgagtgactttggtgcgttcaacacgacaacgcccctcgtttcgtcgactgcaaagtctcctgtttcgaaaagggatttgtgcgcgtgcgtcggtccggttgagttgagttcactcggcctagcatcacgctgagcacaagaacgaagtggagaaacaagccggcaaacttacctcttccgttgcctttcccgtaaaacgaaacaaaa

SEQ ID NO: 1347 - DNA, 2095 bp, Toxoplasma gondii
ccaggaaacctgcttttccgttcgcttcctgcttcgcgtcgacgtgaagcccaccctccgcacctccctcggatgcatgtacaccccaggggcctgcggtgtctctacaccctggaattctccccctggccgggccggcgtcctccgtgcatctgccttcccgcgtgagagttgcagcggctctagaggtgtcttcgatgcttctttctttcacggacacggcagtaagccgccttttgggggaattctgcaaagattcgcctggcacctcctccctcacttcctccgcgaaaggcgaggagggagagaaagacagacccgagagaccgcaagatagaagccgcttcgcactcacgtggtcgggaacctctcgaggaccttcagcgcgagaagcagagacacccgaagcagatgcggcagagggagaggcagaaggcacagctggaggagaagaagaaatcgacatcgatgaggagaaggtcgggggataggagtgccgagcagacggcggcagagacgatgcggcagacgcagggacagatgcgggagtagaggagcctggagaaaaggggaagacagggtgaagactggcgttcgcagatgcagagttagaacagagagaagacgagacgggagacacggaagaggaagggtggctagctgcagcagacaatgacgccgagagactgtctgccgcagcgtaggcgaagccgctagcggctggcgtggcggcgcctgcttccatttttagattgagagaaacatatgaaagcctgagggagaagcatgtgtcaaggccctgaattttaaatggcggagcttcttcgaattcccaaacctcctcaaggagtataattacatgcaattttacgatgagaccttcgatcttttgacttatcaacagagtagaaccaaatcacacttatcttgccccgcttcgctcctccgaagagagttcacacaagaatggcaactcccgcaaagagcccccgcggagacggtggcagagattatgcaggtttccttggaagggaagaagcgaggcagaagcgtctcggcaggtgtcggccggaggcgtggatgacctgtttgacttgaagggacaaccggagaggcaaaagcgcgctggagagagttcgcagacaagaaacgcaacgactccgtgagcgaaacaactgaaaaaagaaagagtcgcgctttccagagaggggcaaggaccgcggctggctcccagagctggcgggtgtcatcctcggaaacggggacggcaggcgacgggaggaaggggggtaacaaaataaggtagaggagcattgacatgcagcgagatgcagaatgtaaagagtcaggagcagaaagagcttccgaaaaaggggaacgaagagaaagaaaagaacccagagaaagtccaagcagtgttttgcgaactgctctctcggtgtcttcgcatgcactggaaaataatagcgggaggcttcgccggggaaaagcggagggtatttgtcagcctgaacttctgtttccctgcgtcgttcctcttgttctgttcctcatttctccacagcatcgctccgtgcgccgaacgaggaaaaccgcttgccatgccccttcgccttaggtgtatgtacacctggaggagaacgtggccgcgggaatcaagtttgagtcgacgcctctgttgaggtctgcagtgtcgctttctgtcgctgcttccttccgtctttccttgtctgatcgtctttctgggaagcacaactcggaaaagggagcaactgaaaacgcaggggactacgagaacgtcgatcacaccgctggggggggcgacggataaacaccagcttgtgtacgcgtggaaatttttccggaatacgtgagaagcgactagctcgacacgaatcaaaagtcagagccacccgagttgccgaatatcttcaatttgctcatccagagccgtgtggtcaactggaacttgtgcgacccccctctctccctacgttattccagttcagcgcttttttcttccacttctcgccttcttcgtctactcgtcccctgtgtgttctccgaaaagggactggcacaggtttttgaaaga

SEQ ID NO: 1348 - DNA, 2138 bp, Toxoplasma gondii
tcatcacctcgaagcgcggctttctgccctttcacttacttcggtggaaccccgatgcatctgtgacatccagttgaagcagtctcttgaggaagtacgtattgaggacccccaaggcatctcgaatgacgtagacgacaaagatccagagaagcattcctctgaacacgcgccagagggcgcgaatgaccgatggtttcctctttccctccgcagcaagtttttcttcttctgcaagactcttgtccgtgcgctctgaccagtagctcacatcgtcggaagcgctgagaggtggtagctcttctggacggacgctatgttgcatgcacgtggagatgacggggtttatccacgtgaaaaagagcttcccaaagaccccggcggagtcaaaagtcagggggaccttcttctccctggatcgttgcctccagcccccccggagagacccatcttttgtgtagccgtcccgcatggtacacggactgtgtcctcattctcgtgtacacagaggccaaggacggaaactgcttagacaacagcaagccgtagtttgtgaaaaaattacgggaggccctccataatggatctgtccacccgctcaaacttcgatactgaatattgggaagtaggcaacgaactcgaaagccccagcgccttccctaatggaggctccgccccctgggggggtcggtggtgagaagtggaagctaaagatttcggagtcttctcagaagcagcaggggaaactgttggcaggagacgaggcagacttaagggggaagaagacagcgaaattctcgtggcggtacgggctttaactcgagagaaaagagctaggattggcggcagcgccctaggcagcggtacacgattctgtcggcgagttcagggagaagcgataaagaaaacggggcagatagacagtggaataagatcgaatacaaagcatgaagggagctcagacaagaaaaggaaaaatcaacaaacttttccagaaaagatggagagaaacccgtggctgctgccaggccgggtcagcaaaaagacaagacaccgtcgccgcttccgagcgatagcaggacaaaagcagaaaagcagcggcgaaagaaaagacaactgtttttacgagatcgatattctgtcgattcaagatgcgaggaaaattcgactatgttcaatactgggagagttcagaggaaacgcggtcagcaagttgacggcggcaaaccagcgagctgagtgttgaggcaggtttgaggtgcagcgacctcggtgaaaacaacaagaaagcaggactgaagaaataaactttacggaattatagtgagtcgcctaaaatgcattcgtctttccgagtttaccagttgaaacgagagactttcagtgaaaaacgtttcctgcgctggttagggcaatgaatgactcaagcgatgcgcagccgtctatgtgagggcctttgtgtcttccacgtacgctagctgactctgaggaggcggtatttttcactccaaataaaaagcccggtttttctacacttccttctctgcttttccccttccccttagtaatcaaaagtgacccttctgccatttcttgaccttggaatacgtgaataactcggccgcagccagagcatgcgtcgctgccagagcatctgccattgttgtcgagcagcctagcgggaatctgtcgtgcaggggtgtgtgaatttgtagagggcaattccgagatctttaatcaagttttcctcgatctcctgacttggttgagacgtagaagctccgtccacagaaggttttaacccgctaagggtggtggggtcccacagccctgcccagtcttcaaaactggaatgtctgtacagctagagttttcaaaaacgaggaacatctctatatacctttttgggggaaacgtcgtagagtttgtgggctccttatggtcgtatgttccgttgtgttacagcccacgctgaaacagcgacgacagagagcgccgctcgcgccttccaaaaaccttgttggtgccggctatttctcaagccaaggggtttcttcgcatgacatgaactttcttcttcgtccttgtttgttcgctgtgaaaacgtcgaggagaaagaaagcatttgaatacatcaa

SEQ ID NO: 1349 - DNA, 3469 bp, Toxoplasma gondii
ctcacgttccgccaaatcattgaccttaaactcgtttccggtaactgaacttgacttctttcgaattgaaaagcttaaattgtgtgatgttttgttgagggaaaacacacttcaccgtcttggtatttgacttcattcaggtctctgtggcactctcttgccattctgagagaaggcatgcggcgcggacttatccttgctgcccggccgttaccgcttgcaattctataatacaaactcgttgagtatccgcgcacgtatccgtccacggttactttgttcgtgtgtctgcgcaacttccaagacacaaagctcggtatccagtcggttgttgaattttgcacgcgaactgacaagcgtcaatgcggcaccacagccgttaacgcacgcacaacatttccccagtcaaggaactgattctcggcgtcagccttccgacaatagtcccacgttcactcgcactctccacgtgtaattcgttcccttcattgactccacgagcgctgatgacgacaaaagcgagctttcccaggcactgctatgcgaagccagaacactggttctggaaggaaccaaccacttcggcattagctccctcgtttcccccgatgcggtacaacgccggtgtcgcgcctgtttgacagtagatagccacacgagcgagacggcataaactgacagacagacgtgttcccacaccgtggcaggagaaacgctttcacacatgcattcacatacaatgatagcacgccagacaagtaaaacacattcactggtctctccgtctctgtactgtctgctggtggatattcccactgcatgggcttgagtaacatcacactgtttcacgaacgcttgtcgcaccactcaccgcgaagcctatcctcgtctccggtctcggagagttcgacggcctcgtttacatcggtggttgagacaggggagaaatgcggtgtcctcccatgcccagggtatttctcaaaacgtgccgccacgtttcgccatgcctgagcgaccgcgactggttcagcggtgtagagaaacgttgccgttaagacgagagccgctccaacggagaagagggttgaggggacgaagtcgccgatgacccaccaggaaacgaagcaggacagaacaatcgagagagcgttaccaaaacacttgagaatattgtctgcgtacttgaggacagcagccacaatgaggccgccaagtgcctgtagaagcacggcactccacactattacgttgtatccttgaaagaatccgtactgttgaattttgtccccgtcgttccagtaggcccccagcacagctaagactgttccatacagagccagctggatgtttcgtacccagatgctcacaggagtctccttgaggattttttccaagtaaacgccggcgaaaccgctagtcaagcaggccgaaaaaaccgcaatcaggcctattactggattcccttgattcaaatttccatgggaggtggtggaatctcctgaagggagcgaaataattgcaacgccgcccgttaggatcagaagtgccacccacttcaccaagggcaggcgcttgtggagaatgagaaccgacagcacggctgttgtgaggattttaaactggtatgtcacctggtagacagctccggacaagttggagagtgccacaaaaatcaaattgttttgcagcgtgtacagaaccgccggcactcccacttgcagcatggcaatcggcgaatgacaaattgccgcattcagaactcttcccgtggataaaatactccagcggttttccccgcaaacaataaggactcctgcaaccagttttaccaattcagccatagttaccgcggtcgtgttcaagtactgacgactggcaccatcgtcagatttggtaggaagacgagagacgcgtagcacgaggacggctgcgaccgtctgaacaaccaagagaaaaaacgcgacccacttcatagggagtctccccacgaattttggaggagtcgcttcgtccgcgccacgaccagtcattttgttccgttgccttcatcacaagctttgctgcttttgcagagacgtgaatgcggggaagagagtgcgtaacctcgctcagaaataggatcacatgaaagaaacctatgcagatatctatctatatatgtatatatcaagcaactgacctttaatgtacaacaaaacaccgtcaggcagtgtatacgcgcatcacctttggaacacatatatacgcgcaagccgtagtaggcgagggaatgggcacggccagagcgatagaccatcaattcgtatatgcacgccctactaagttaacatgcagctaccagagcatcggggaagcttatccacaaacatcgacaagccaaaatggacattcgtttccttcatcagcacaccatcgtgccctggagagtagcccatttttttgccacacgcagggagggaggttacaagagtacggctcaagacagcgccctattcaacttctgactatgcagaaaaagaggcggaaatttggtccctggaagacaacaccaaaatgtgaagaacatccttgtcaatttgttatcgaagcgcctctccagagcgcagaggatcataacgcacatgggtcgagctgtttaaaaccgtttcccctcggtgcagaatgccagcaagtgtgcaccgataaatgaagcgaccgcctgtgcccttcgcttaaaaccatctaccgctcttgtgaattcgcaatcagaagacattttcagaagtgcacaagaaaatcctccggaatatcgttgtgatgggcccccaagcagaaccagtcagctgttgggaggtgtcgtgaccagtcgccgagcccccctccgctgctctgtatactgttagcccgttcgcttacggtaagttttgcttcttattggcaatccgaagacgtattcgattccgtaagtctactaaagacgggtgtaaatcacgtatcacccccaaagtgggacattgctttcggccgacagtcgttcccctgcatgtacacccctcctagttacgcatttcgcttagacgtgcactcttttttcttctctgcctaggggtcccgaccatactgaacttttaccgatgggattttccgtgtcttctaccgaagcagcagcgaaatgaaaacttttgcgttttccgcagtcgcagccgagaagatcaggtgcacatacgccattttagatatttcagtgccttgtcgacggaaagaataaccagttcacagttgactcgcggtcttgatcaactgcggtgccgcgcaagtgagaacctgctgcgtcgtcttgtctacacctcgcgggggctgctcgggatttgagacgtcagctgcctgcggcgcggtcgaagagcggcgatggacatggaagcttcatgaaatgtgtagacccatcgctcgcagaacacttagaatgatgtagaaactcttgccttttcaa

SEQ ID NO: 1350 - DNA, 4978 bp, Toxoplasma gondii
aacagggagacgtgttgaattctttttaagtttttgcgcagatggtcgtagcagtagaggagagcaccctttgttccttcttccacacatcgacaaacggtgcctggtttgtcgaccaggacgagcattcaacagcgttgtaatccctaaaccctcgtagggattcttcgaattttttcttcgtctgtctcctgtgtccacgaaatccagaaagaactgctggagtacacgcagcattttttcgacaagtgatgcgatcgattcagcactggtcgcacacttacgtgcgctggagatagttggtggaaacgagtcctctcactgaagttgcccttttttgacataagtatagaaagcctaagaagtagaatcaaaaggatgctcctgtccctcgatgttcttgcacagaagatacattcaggcagcagaactaggggggttgttggactggatgaataggaaatggctgctgcagcaggatgcagaagcatttctgcctaccagcccgatatgatgttataagtacctgcaggaacccaagctacgaggcggtgtacacgtgatctcaccgtgaatattgcttctttgagagaacacaggcgttttactgttaagctgcgatttagtaaacgaatgcacaacttcttgaaatgcctgcattctttgcgcttggggcgagtcagtggccagacagagtttactaatgcagcccggctataaggcgtcatgtaaaggatggcggatgctctgcgataacgaacagcttctagattgcctctcagttttttaagctttttgaatccacgcatggcaaaacgtttcaaggtagcattcgagcaatgacatccgatgtgcgcccagaatcaagaagcagttgtgcatatcataccagagagggaaaccgagtagacacgcggcagcgttgcagtgtggtgacaatcgacagaacgtagttttttccctcgacacaacaaaccggtagcgcgtcttttccacgtggctacatggtacaaaaccaaactgaatcccaggtacagcagatgtgctcacacagcacttacccgccggtggaccatggtggctgctcttcgtttgtagtgccgatatagtctatagttcctggacagagtgaatggaatcatgatgcagcacccacacaatccaagggccaggaaaatagatagcaatatgataacaatcacgatatagtttctgttgacaatggaacatccggttccgagagcgtgggtctcgcacgttgagtatcgttctttgtccatgccagccacgtgaagcatgtaaaactggagagcaatggtggtaacattgtcgcccttctcgtaggctttccccgtctcaagtaggccaaagccgcattcgctatagcagtcgtagggccagcgacgaaacgttaaaaaatcatgcatcgaatacgcgcacaggattccatgaaatgctgtggttgtgatagtatgcttgactttgtcaaggaactcaggatctctggtctgaccttctacacatccgtgggtgactggagtccttgaagcgttcccttctgagagcatttttggtaaagagcttgttactccagatgattgatcgtgaccactggattcgccagtactgctgctatctcgaggaagttgcaatatgcggtatgtaaaattccaaatggcttctccggtttcaggtgccagatcgtcgcggtcatccggaacactatcaccaccccttccctgtgagaaatgcggttggcttcgaggttcattcctccaggagatgctgtcgctgactggcttcaatttccccagctgtagttcggcggcgaggcgtgccagatgtcttcttccggcaggtgagagccggtaagccattctcgaggtgctgccttgcaacaaggagttcagctcatttgccccttcattttccagctcccacattcgttccagcgaaagctgtctctccagtcgttgcacggtggctgcttgcgaccgaccggcccatctggctcgctctaaggcctgcccgtcctccttctccggcgacaaaacgcctgtatatctatttgtgggatgagccgtcccctctttagtcgtttcagggttagtgactagctgtcgtattgactccagggagtcaccgctcaccgtcgacgtttcgtgctcgtgcttgttggacgtcttaaacagttcttcgatgagtgtcttcgctgcaactggcgtttccgacgacgttctccggagtcccaggggcgcatacgaatctaggaggaagaaaggtgcatcctccagtgaccctgtggtctgcgagtgcctctcgagttccagtgaggtgttgattgccctgtacactctaacgtagtcactcaacaatgtgacactgagcacccaaacgacagccatgaagatgaacagacagaggactaaatagacgtatagccctagcagcgacttccatcgtgtaaacacgccaagtacaccgactaccccagtcacaactccggcagagatgaagatcccaccaaacgtgagactggtgtacgaaatgctgaagagaaccagtatgccaactgccaggaaggtcacggaggacaaaagaatgagcaagccagcatgacgcttcttgctgtccactggatgatccgcgacctcgctgggctcccttccgccctcaggtagaacaccagagctcgagacgggtaccagattttggtggctgacgtcggctgccgttggtcgacggcttgcgtataacgtatccgaaaaaccgttttctggcgtgtcggttttctttggtaactcaccaagatgggattgtgcactcgaaggtagcatttcgatttgcatccctattgatgctcttgccgccttcacccgtttgtccattgctggattgtgttttaccggtagattttcaaggcttccggctctatctcttccagtcaaggaactgccgttaccggagagtcgcacaggaggcctatcagcctctgccgcagagcttggaatcatgatggatgaacgatatgttcgcagtggcacagcccgctgatagctccagcgataaacggcgaggcggttgatgccttaatcagcaataaatcttcgtcgatacgctcataagaacggaacaagggaacttggaattcgacatcggctagcggcgcctctcgatctcgggaggctgggtgcaatttctcccaaattaagtcgcttggtgggagccaagggtgaagtggcctctgacagccaatcagaactccaaggcggcatacaaaaacatggcttcgaatatcaacgctgtatgaaccatacctccttacctcattacagcccaaaagtgagctgtcgtctggcactgtacgagtgtaaacacaagacgcacgtagcgtgtgatcaaaactttcaagtaacaccgacccttttgtaacaggttccaacagacaccaacaaaaatcattaaaccatttgcaggacttcttgacaaacgatgtagccccagcgagtgttctgagaaaagttctcgaagagctataagactgacgtgggctgaaacggtcaaaacccctaaaagtcaggcagaagtgtggtcatgaggtctgtagattgctgcacatccttgctgttgtttaggaatcgaatcacaaatggcggctgagtaaacggaggcagtgtgtgtacgcttctccctcgtttatcggctgcaaaactaacacttttctaattgagcatgcagctgagcatggcgttatctgctggctttcattactgtgccacctacgctgtgggttcatgctggtgcagaggtggctccccctattgcataacgatggcttgtccagccgagcagtgtgtcgatggacaagaaaaaggggaaaaaggaattcgggggtgagaggcgctaactgaattctggtatggtgttaccacagcacagaatgaagcaacagaaaaacgccgaaaccaacaaaccaacaacggtagctgcaaaactagtacgcatctctattgacgggcgaacatcgaaaaagctgtcagagagcagctttacgagtagacgggagagtgcgactcaggtgtttcatttcttcaacacgacatcaagcgccatgaagctttcctgatcctcatcagattcagcaagcatgatcctccatttctgtaggaaaccttcactgcctgcataatgcgacttctgaaattgaaaatatagagtaaatatacgcagaaagggttcttcagcagataaattaatgtccgaatacttaagaggattgagtcccactgaagttgtgaagttttcttagcactccttgaaacccttagaacttcatctacggtagccctcttcagcttctcgtctgtcaagcgtacagcgacgagtgtgccaacgaagctgaggtacatgtcgagctacgtcgagctgggcacatatcgcagaattactatcaaatttagaagtagccaacaagtagcaattgtacattctatgcgttcgaattcgcacctttttgcgtctgatgtactgatagaaatcgtggtgactagggcctttcgttggcaatttttggctccgcttcttggtagacgcacccgatcggtaaggaagagtcacgaacatgttccaaacagtagcctcagtaatcgtatatgaatgcaaatgaagttcgctcttttttattttctaatgcaccgaatctagagaatatctctggacgggtgctgcgtcatagtgatctacgtgtgcataatgctactcttggcaaaggaccaaatatgcgaatcgctgtaaagtctcacttctttgagtgtagacacaattgggaaacaaggcgagtgcctcagcttttgtcagaaatacaatgtgtttccatgattatattgggctacctctcagctccacgaaagatgcctgttctcaagttgatctaaatgttccggattcgtttttttcttttgtggttcaacaacagcga

SEQ ID NO: 1351 - DNA, 3708 bp, Toxoplasma gondii
acacgtcctcgatctgacagcctaccttctgaggaccgtaaggagtgaaggaactccgtccacgcctgtgcttctccggcttctcgctttttcgtttttgcttcctgtacaactccgttttctctgtggcttctcccgtcttcgttgcaccctcttcttacctcctctacgtcttcgtcgtaaactacggggagggtgtcttcgcgtatcttttgatcgctcttcgttcggagaaactgtttcttgtcgacccgaggcagtcggagtctccggtgtcgtgttgttccagaggagggaaaaaggctggatcttatcgctggaatcacgctcagtaccctaggcaccctaacgtctctgtgtccggcctatttgagtttaccgttctcttttccattgaaatttcctgtacactcgacgtgagttgcgccagtgcgaccacgcagaaaaccatcgaaggtgcgatgtgctcgtaggtgtctcaggacgtctttcctgtctctgtttttcctcctgttgttggtgccttcgcgttcatttgcttcctcgtttcctctcctttcctcagagccaattcgtcgccagcatccccaccgagcgacttcttcgggggagcttttcgtggccacggtggccgccgcacctcgaggacggggcggtcgaggagtggaggacggcggacggcggcagaacgttttttcctaaagcctgaacacgacgaatagacaacaactcgcttccttcgactccgccctgtctttccgggggctgtcttagtcgtgggcgcagcccttcgacgttcggcttctgtctgtggatgtgcaggggcgggcacctctccgctgtggcactctccttccgtctagacttgtctctgtgcatttgcccgtcaccttcccgaatataagccgaggcaaggaggccggtgagacgccccgtccacaaaggaaacgtgggtcaaatcaatctcgactccagttgtacatgcatatatacatatacatacacacccacatgcatatatatatatatatatatatttatatattgatatgcatgtatgtatatgtatatttgtatatatatatatatatatgtatatatatgcgtacacgtgtatctatatgcatatgtcggtatacagatgtgtatattcgtatggtctgtctttgtctcttttaaaagatgaaacgatcgagtgttgtttctccacacagctccgaacttcctcgctgtgcttcaaagcagacgcgctgaagttccgaacactgtcaagcgggccaatcttctctgatgtccgcggtttggctgaatagccctgccacgcgtcggacgcgagagaccaacagaacaggcgcatgaagcagtgctccaacacagcgcgttgccgtggtcttttatgatatcggttgttcctgtttcgcaagaaagcacaagaactgcgtaacacgaatcgaatctacagatcggccacttttacggaacgcgaatcgaggatacgccgtcctgtcgcgaagaaacgggggatttccgcctccggggggtattctcagtttttaaatcccctgcatgtggagtggaaaacaaagccactgcagtcgtttattagccgtgaaacgcttgacaaagtctgcgggttcatgctggacatccctggacggaaggtgcacgccagggtcctgaaacacacgagggaagtttggatccggtgaagaaagacacacaatgttttctcaaccacgctccgtctctgtgtatccggtttgagttattcagttcgtatcgggagccatctgcgcaagcagatgcctccacacgctgcaccctttgccacacaatggggtttgcttattccgacgaaccactttttcgcagtagtacgtactacggcctagcctgcttgttccactgtaacctcattttcgtttctcgggtaatagatgaaagtggtgttctaaatcggcgtgccgcaacggtcccgcgttcccacatgctttcccggtctctcttcttgcaaattacacgcgaagactcctgagcctctctggttctccaccaccaccgggggggagggtgtcgaaagcgagttcctcgaaacaccggagcttcctgtcgaggcacggacacgcaacccgtcgtaactatgagggaagaaagccgtcacaatggtgccttgttccggctttgccagtgttccgagttgcgtgagctcgaacgctttgagaaaaaggatgacaaacaacggctgcgacacgcagaaaacatgccgagcaggggtaagaagaaggctggacagcggggacctccggctttctgtgcggacgggtgcgatgtggccttccgccgcgtcggtcgaccgtcgcgcctccggaggagaccagcgaagcttcagtacgacaggaagcgtctctgtatcccttaggtcggacccggagacgggaactggcttcccgcttctgcccgtgctcacacaactgttgcgttccggttttgggtcgacctgtgtgactttcagaatcggaaccggagactctgccaggagtgcctttgtagaggatcaagcgatctcagctcgtgaaataaccccgtccgccggcttccgaaagcctggcgggagagccagagcaaactagaccctctttttctaagttctcgactgcaacgatctgggcgaaccccccgccatgcggtaagctgcgactgcctggcctggtgctacggcgcgtgagagacaggaatgttcgagtgagactggaaagcaagaaattcagaggtgagtgggacgtaaggactctctgcgtcggcggtgtaggaaagggggaggagcaaatgctgccttggggggggggtctgtcgtcccgcaaacgccaagacgagagacaggaaagggagcctctcggcggcgctcgcacccacacgaagttcgcgagcgctgcgtcgatggcggacagcgccaggagggattttgtgtttcgctttttgttccacactgtgtcttttagcttctcttttcgcgagcagatacggcgaacagaatgctgcaggcctcaaaccacagcctgcagtgaaagaccctcgcggccggggtgacgctggccagcagaggcggcgcgcaggctagcacacgcgtctcgttttcgttctagtgttcgacgcgtctgtgccgcgtgtgcactctttcggagcccgttctcgtccatttctttggcctcaaagatgtgaggtttcgcgtatgaacagagacgaggcagtgtgtaaccttcgtagtttcgcctctgtggccagagaacagcgtggactcgggggcagtcaagaatcgcctggcccgcacggcggagaatcaccgggacgcgtgcgcgcagagaatcggctggacgcgcgctcagcatcgaaggaccattgcactcattgggaccgtgttttcttcactttttctgccaagtctgtcgatgtccattttcacctccgtgtctctttcgcctccttgagttagttgtgccgtttcggtgatgaaagccgcggagacgacgcggcttgtcgcgacgccacgcgagtattgcatctgtggtcgctctagagttgagtcagccctcggcagcagagggcaattctggagaatggactgccatgtagctgcctcgggcgcgtgaagcaaatctcttagtggctgaacatccgcgcttttcctttcctctttcgtaggagcgaaga

SEQ ID NO: 1352 - DNA, 2245 bp, Toxoplasma gondii
gcacctgctgttcgcgtagcagccgaaaggattttcgagagatttctgctggtggcatgtttcgtgtttactgcgccagcggtcgtgtgatcctgaggagagggatgtgaagaggtgcactgccgccatgcacatagtgacttaatgcggctcccgaagttgatgatgctcgctttccctattcagtccgtcaccgtggagtagaagaactgtgtacacagttttatgagagaacacgcaaatagcgaccgcgttaaagtatatgactgaacgatatgtggcaatgatagcatgtgccgttctatcgaactaattgtttgcctacgttattagaagctggtgaaatcagcaggttcttttacatgtattcgtcggtagaacttgaaaaccccccgccggcggcgtgtctgtcacgtggagcgaaatcgacgcatgagaacgacggaaggaggtttcttaaacggctgaaggagacaacactggatcgcacgcagagtccgttgacagttttaggtgtccgctgcgctaggcgcgttatgcagtttcatctcgggcactgaataggtacctccttcacatgcactgatcaagacatcgttacttcaggcacgtgcggatgtcgcgtcaagaggctcacgacacgagaaaaagtgcgtactcgagagaaatccttatgctcagccgaagccccgagtagcaccataaagacacagtgcatgtagatgcatagtatatatatatatatataacccagatacacactcccttcgagcgagccaaagcgttaaatcgctgtttcggaatcactgtttagctcctcattgctttcagttttgctcaggcattcatgcaacagtttgtaccatgacctctatatgtgactgagaatgttccaagttactagaaaaaggagtgggacgacggttggaaccacgaatgcgtgtgagacgttctgaaacactcatcaatcatccgcacctacgcagtaacacaacagctcgtcacaactagtaatgacttctcacactcgtaagccttgctgaaacactgcctgaacgaatttgacagaccctaccattcaatcttaaaagtagagtgacattggttttctgccgaacggcacaatgcaagtggcgaaagctgcctctaagggtccgacatcagcaaaatgaacctagtaggagggtttccttttgcataaacaagtactagcgggacggaatttagcccccggttactcaagtgattcgagtgttccacctgaaagggtggcaggtgacttgtctcagtctcgtttgaattgtaacagctacgcacacagtctgcatgattcctgttgccgctgatctgtttcataaaattaggtatttccatcagtcacgatgcaaacgctttcacgcatctgtccccactctatcagtaatggacacgctggtaacatggagagaaacttcaattcctttcaatacctatgcatcggctgctggcgttgattcgggtagacctcgttgctacgagattcacaacagcacccgccaaccagttagagaaaattatgcggagcccggaatcagtcccataggatgcacgtcgtttagtacgccgtgaaaatactcttgtgactactgagaagacactgcttttgttgttagcggcatgaagctttttagcaccttgttttgcgcgaaacattacgaaattcccgtgtcttccgctgctcgtcgattgtaacgcggcgcacacaagaggctggctggccgcacggacccaccgcagcgccccgagtcttgcccactcctgcgtggcaaagaacgatcaagaaccatttaccgttggtgtttttttcaaagacaagtttctgcgactgagttcgtagtaactatcttctgtcggtgcttctttatccaaaaaaccacatttgaggtccgcgtggtggcctcgggtgcgttcaccgctaagatgcatgtgaccgattttatctagcaatgcgctagccgtccgtcatttttgtcactgtcgattttcgactatccacttttccgtttgatgacctagtgattgctacttctcagcgctttccccttcgctccggaagagagggattttcggagcagaggagtcgcatacgtggcacgtaagtggactacaacgcgtagcagttgagcgcggtgtcgggggtttgctacgatgcgcggagacgccgtgtgtgtgtaggcgtatgtgtgacaccttgcagtcaacagta

SEQ ID NO: 1353 - DNA, 1744 bp, Toxoplasma gondii
acatgtccgacttcgaccgcttcaagctcatggtcatcttgaagcaacggagaaaggtcatgcaacagaagctgaagagtctgaagaaataagtccgaagacagagagcaagttgatagtgtttctcttgtgcggcgtcgtctccaggcgagaagcagtcgcgcacgacagacgcgagcggcatgtggagacgcgaggaagaacgcgtttctctctcataactgcttctcaaggttcctaactcaaactttccgttctctttgtgtctccaaacacttctcaccaatgtctccaggtcgcctcaccaggcacccacggacataaaaaagtctcacacccgagaagagacaacgagaaacttcacttactgtctggtcaaacaacgcggggtgctccaacacgcaccggcgtctagagaagaaaggaagggggcgttctccgtcgcccaacggcatccgttggctctctatttttgactgcagaagttatcggcatacgcataatatatgtccaaagacagccacagcgacattctgatttccaccactcaagtgtagggtcgacaggattcaaaccccgccacggcggcaatctttccgccgcatcaccgcctaaattcattcaacacggtttctgccgtactgtggcaagatcgaaatcagtcatccatctcgttgtatgtatatgctccgaggaaggcagtggctctagtaactaattgtttactgtaagcgtagaacggatcccgtagcaacgcgtgagactgcattccctagtgctaagagcgtggctcagcagtgcagcatttccacgcgcagcagctggggcagaaggctcttggatattcaatgagaggtgcacggttctacgtagacactgagacattcgaccgaacctgcgatagataaatatgtccggatgattgcatgttggtgactgaatgtcagccttgcaaattctaggtgtcacacgtaatcccttcgggagaagacgcacttgatcggcctactttacgaatattacagagtctcagcactagcggttaaacgatgctctcaccatgctggtcatgagaagtacaatagaacttggatccagtacacaaatgccttcaaagtctcaacagtattccaactcgttgcggcacacatatcatagacatgaaggagttgctcccaacttactagaacgctgaaggagttgcgccctcgaacacagagatgcagcgccacagaatccgacacacatgacccgcaaaatcaacttcacagtgttgttgtctctctgcgaatggtaacggaacgttggtgttgcagtgcgtaccggtcttgtctacagcaaggtcttaaatgctgccttaacacttagccttccgacgagtgtttttgctgctctacaaacggaactggcgcgtctaatgtactgtagcgagatgccgattaagaccctttcttgagcaggtgacttcaggagacgaggagacccactcggggatagagcgcctgtctctgccgtgccggcgcgactttcccgggggtttgtccatcagcacgtgtgttcgccgcaggaagagagggagtttttcgtcgaggaaattccaaggtcgatggcttatctcgttccttgcgtcaccattctgagagctgtaaccccgcgtggccacatgcttgctgacattttctccgagtgacggagaattgctcccgtctcttcgctgctttcgtagccacacccgcgaccacca

SEQ ID NO: 1354 - DNA, 4914 bp, Toxoplasma gondii
aaccaatgtacgcgttcggctatgaaactcaactccaaatctttcccagaaaggactttttaaacccagtggagtgtctacaagtgcgatgatctacacacatgtctcagagaggcgaagtagagaacgcgcatctgattaatatagtacagcgcgcacgagaccgcaccccagataaataaatacatcttgaataactgttcattagcggctaggtgacaatcaaacatttcagttgggatggggcatgtgtgaccggaaacggaagaggcgcgaacagccgacggtcgccgaaaaatgtcgaatctatctctctctatatatatagtcgagttttttcgagagacagggatttgaaaatgtctgaacgatcacctgcccgacggcagaaagtccttcaaaaggtatagagctaacgtttgtggttgtagaggcattacgctatctctgggctgtacgatataggcgcctttcggcttgtgaaccctaaaccagtagtccaactcgtagtatattctacccagagaaacgagcgggcatccagcgtctcgcggccatgtttttagcgagaaaagacacaagaagactccgaagaggactggggaatattcgggctggcacaagtagcacagaatcgaataccgcgggtaagagccgagttttctgaggtccacgcgcagatagaaaagtaccttttccaatcgccatgatgcagagaacacggcgagcctggttgtttcagcaaagaaggaaacggttgaaagaaaatgcagtttccgaaaaggaaagaaatcgtccaggtcttgagactgaagttgggtcttggctggactacaggtggcgcggcatttcttgtgacaagctgctgctggagaacgacgtgttccgtagtgaagcggacgaaaaatgccgaaatacttttcgtcagaaggtccaagagcgcgacgtgaaaactttgagatgcttgcgttttcgtgggttgacgtttgcaagtttacgaacacaagagcgacaaaacctcgacgacggtaccccgccaggcgaggtacggaagggaaacgagaaacgcgttttgttctaacgatgaaggtggtttcgagacgcccagatctttcgttagcgaaagaacaccccccaaaaattgcccagaaaccgttactaggtctcggcttgcgaacttttaacgcgacatacacgtggataattttctgccgcgggcgggacgctgttggcttccgagagtctgcactgctcggcgtacttgtcaacgtacgagaatggaaaaccaatcggtgtcgagatatagagcacctttttcacgtgcagagcaacgcagcgcattactacacagaattcgctcggcgattcgcggcgaccggcctttggaaaacggcgagcgtaccttgcgtgtgccaagcagtccatacggacgcgaatcggaagctcggcccaggcagccaagcactgctcgttctgcgtcgttgagtaccttaccgctcgacagccggcagcgcttctccccaccctccgctttctcttgcatgtagacagccgcggcgctggtattcgccttcagcccaacagggaaggcggcaggccgtagcccgaagattcgccgcaggaaaactcggcgcagcggaagatgtgtttttcttcagctgagcagccgcggaaatcttcgaaacgcagccagacgcaggctgcaacggcagattctgcaaccgtgtcaggctctaaagcgcttccaaaagcaggaagccacccctaagaaaaggcgaaatggcgccgacggcgtttcccctcgcgccaacggcgttcgtgtggaagacgcgattcggatccgccgttcacaaaaccagaaggcaagtgtgtgtctgccgccggtggaaaaacggcgacacaagtggtgtgtagccgcctgtggtgacatcgcaggtccacgcagtttcctgtcatctgcgtgacaccgtttctgtgcagtttctgtccggaacctgggatttttgagtttcgcggcagaacgggctcataggacccgtttttctacactcccatgaagagtagagtcacgacagatggatcacgagcgtgtataaatccagataccgcccggctgacgctgaggagtccgtggtttctagcgtaggggcggtgccatatactgtggctggtcacggaggctgcttctcgacgtaccttccttgtcaaccgggaaaacgagcagcgtataagctttcatgtagtcggaacaatatagtatgggtcagcgaggaaacgtagcgtccatagagcacttgttgtgtctgtagtaaaaggatggtttagctggacgtgcatcaacgggcaaaaccttacaaggcattaagcatgcaaggtcgcccaagaggtgctccgcgaaaagcgatcaggtgtccgatcgggtgacaataagcgggcaggactagttatatataggcatatatacattgaatgcaggaagccgtgaacaagaggctaaataagcgggactcctgcgaaaccattcgacagagccagtgcgatttggtcccctgagaagatcgccagtctaatttgaaatatcttctccgatgttaagacgcaatgcacccctgatgcaagacaactgtaagcccttggcaaatagtcctgtcaggtcatgcacgctgactgcaagtcagcgaaccatgcgtatggtctcaacgaggcggcattttttgtgtaatttccacttcgttacgcagtgccaccggctctcatacgcaaacacatggtatccatgaaaaaatgtggtgcgtcagtgtcagaattgcgccgtgggaagacacaagaagaaactgcccaatcgtgaatatagtctgcagcctagttggtaacaaggactcgcgtcaagtcagctttcgggagtttctaaatggccaagcttcaggacccgtgaaccgcttcccttgcatgtttgacagtgtcatcggagcgggacaatgctaggcaacagcagatcgaccctcgaagccccctccatgtggagcctcgtgagaaacgtgaagctcattggaaaaatcgcgaaaaaattggaaacacgatatcgccgttcatccagtccgccgtgtggccgggcttgtcagtctgttgaatcgtcattccggcaattcagcacaacttatttgcttcaggagacgtgttggttcgccctatctgcttacggcatactgatgcgttttcgcctgatgatgcagcagtagagatgtatagctatcaacaaaaacagaggttctcctcgattgacacgacttctcgccaatatcgtttctttgagcgatcctcgctccgagtgctggaacggagttccgtgttcgacctgtgaagatcgattctagaactttttgacttcgacgcagagggcgccgtaccaattagtccacggtgagaggtaagcgtagtcttccaggaatgagagcaaaatccccgaaagatcgacggaacttcgccgtcttgatcgctgactcgaagccagtgtccggatcataaaaagctgcgcatgcagcttttcttgtaaacgcccctcaaagatcccacagctgcgaataagccctccgatacttttgcaaattggcctgacagaaaagttgaggcgtttgcctttgacggtttttgtctccgttaccatcacgatatggactcgtctggcaacctgctttgagtcttgtttcctcacatcaactacgacgcaaatcttgtcgcttgtcctgttgaactatttgctggctttaggcgagttgttatttcactcggcgaagcagtgcgaaccccgtcacactgatattttgatgaactgcgtctcccagtgtctgaacccgacgaagcatggttttctaatgctagccttgctccgatgaagccttccgcccctaagagactaagaaccgactaatgcgatgactttgatgctcgtctcaccaaagagttgtgaagaagcaatccagtatcgtcattttgtatactcgcctggaggaaggacccacgccgctcagggttgtgaatcgctacgtacagtgccgtcttgttgaaaactcttggtacgacagaagccaacaacgtcagcgtaggggtacacgagtgttttgttttccagcggaatggaccaagacagaaaaatgacgcatgataagcgacagccgtttctggggcggtaaacgcttgtcagttcctcttgataccagcaccgctacccattttgtcagttgggtccaccgtagtatcatcttggtaccaaggtacacgtggaatgtgtttttttgccggttactctgaaacgtcagtgtaaaatgagattgaagaatgggaaccgcgagctccaaaacgcaggacggcttcccacagcggatgccagaagtgccagagttccctctgaaagcgattctcctcggaagtccgttcagtggccgttcatgcgtgttcgaccggtaggtcccgcaagaccgctgaagggagtactttgatacccatttcgttcagcagagtgaaatcgacacagaaaacttggaagcaagccaagagatgtactgaatatcgatttgcgtttttaaagcagcgcgaaaatagcaagcaacaaagcagcagcccccaaaacaaccgggtgctgtcgccataccaaacttgcctcgctgcgttgttcgtatcgaactctaccatcccaccttcgagtttgtttaaccttcctgcacaagtaaatgcaacagtgtggtgcacactaattcacgtttcaagacgaaggtgcagcgtggatttaagacatcatgaactggtcctccgaaagtgcagctactgcggaatgtctatccaggaagagactgagcggtttagtgaacccgaatgtggcatgtcgcgttcgatgctttcattgacgccatcaaaaga

SEQ ID NO: 1355 - DNA, 2382 bp, Toxoplasma gondii
attcgtgtgtgcgtagagactggtgctaaatgtcgactctttctctgctaggaactttggctacaggggaagataccctttgagtgtgtttgcgctactggatttttgatctggtgaatcgttttttcggtgtaactacgaaacgcggtgttttaaccattctcgcggctaaagatggcgtaccgcgaaacctaaagctttttgcccgcgcaagtatctcgtatcacgcgttcttcttcgcggcagtcatcaccttatgccttgctagcacgtttgaactcgactccggtaactcaggaccgtgaatatgtagcatcaatccaattcgtgggtcgacgagggaactgtgtttcagagtcacgaggcattcagtcacgtaaaattcgtgtaaccgcggatgtttttccggtcttaagaacggcccctgcatgtggtgcaacagagctccagaatgggctcccccctgtctctccaattagcgcgtttctcctgttggcaaactctaaagaaactaatagatccagacgcagagtaacgagagtcggttgaacccgagagagttactcaagaatctccgtgttgcggcgacgcttcgctcgaaccactttcccttgcatgaagtctctggagtcgaactgcaagcgacaatagcgaaaaaagcatccacgaactgcacgatccgatacgcgtcgcactacacttcaagagtgcccttcttcgatcgtgagtggaggcccgcgacatcgaaaagtgtcaagcgaagagaaggtgaacgtgttctcttcagggaattccgggtcgtcccccgccaccaagatacagaatatggcaggagcccgcttcgatgtcactcatgcggttttgtctaaactggcgaaatacggaagaatgcttcgaggccccacaggagggaatccgcgatccgaagaacgccacgaaagagatctttggtgtggctagttctgtcagtggtaatctgcgtcatttgcttgttcgcgctgagaactcagcccttttgtgaaaacagttgctctctgttgttttccactcatttagcgtctttgaccgtatagtgaagtcttctgcttcctttgggcgcgcgaagcgcatcagcgcctccgaggttcaggagtgcgtgtcactagacggtgcaagctttcctgtttcggctgtctggcactcagacggaattcaagatacgtggaacagtatactgcgacagaaagagagtgatggtgcgcataggcatggagaagaaaaaagtgcatgtgcaaggagacagaatgcacgcatctgttgaaagagagatacggaaatacttaaagggagaaaatgtatgcatacatatattgacagagatactatgcacgtatcttgacagaacacgcctaactacacttttgtatctctatatacatggaaggtatgcacatggaagaaatgtgagcggagcatgtgagcattcatgaagaagctgatgctgggagtggtctcaaagaccgccgggggcagtggcgtcaaacgagaccgtgttttcaacttgttgaaaagctaccgtcgcctgtgtgtcgattttgggaaaagcgtgagaaggtctaagacctccctctctgtccgatcttaccagccgtcctccatctttttcgtccaaaaaatatgtgcatgacaagataatatacacatttactggggttgggtaacagaaagtgggaagaattctttgacccagtcttttctctgtcttgtttcgtcgaggcaacgacgtgcatgcgttccccccagctgctgggcggcgaggcaccggaaacaggcaggtattcttcgcatggcttcttcctcaccttgtagtttgaggggaatctttgagggggaaattcattctgaaatcaaaggtagagaagcgacattttcaggggaaatcccgcgtttattccccgcggttctcgcgtctctcccaggacaacgggagcgcgagaaaaagtgccgaaaggggcttgtgaaaagcagaggaacaaaacatttcggagaacttgtgctttttatcttcggacgcgttggccagaagagagaagccaagcgtctttgccactcttgcccccaccctctcttcgtggactcgtccgaagataaaaaaaaaacacaaaccggttctgcggcacttccatctttccctttcttactctttttcttcctttgcttctttgctcttgccttcgtttcttttctttcgctctctcctgtctcttttctcttcctcctccgcttcgtcgcgctttgggcttttcctgtgcaccgcacgcggtgtgtttcgactctgttttctcgggtcttccttcgtgttttccttcttttctcgtcgatttcttctgtttctctccaata

SEQ ID NO: 1356 - DNA, 2185 bp, Toxoplasma gondii
ctgctctcttctgcaaaagaccctccaaaatcgttcagattatggtcttcccgtcttgtgtcacacgagggggaagtcccgtgcggatcccctgtcccgtctgagtcgccatcacggcttgtcgtctcagcgcacactctcgacagggcaagcctgtgcagctgttcacgattgtctttccaagagatcgcagactgcctatcgaatccgcagttcctgagaggagagcacagggaagccctttgggaacttgcacgcaacagccatcgcagacgcagaagccggccagcaggcgcatgcaggtacgcaaacgcgctgggtcttgctcgaaaagcggagctgctctgaaagcagcgggacccaaagaaagaaacgaaaatggataaacaccggcagaaagtctctgccgccgagggcagccggcgcccggatatctgaggaatggccggaacagcagatgagcaaaaactggctttcggctggaagcctagaagcgccgagtgcgaggtcatgtgcaaggccttcgaatggtctgcattcttgagaccggcactggaagagcagagcgccacatggcgaccatgatcagcctcaaagtgggcgtgggggggacccgcgaagttccaattttgagacaacacgcgacctctgactgggaagaccacactcccgcagccggaaaccacaagtgcagcgacgaaggagaggaaaaagagtcgagatacagcgtagcagtcaacagaggcgcccatcaggaagcatacagccactgagactgagggtagagttccaaagcacaggaaagggggcagtcacgccgcgaaattgcaattcggcttctggggatattcagtaccgtgcactgagggcccatactaaaggccgatggttaaaccctgtatggaaaaaacaactacttcgcgctccaggacgcagttcataacacctgatcgggagagaagcacagctcaaattcatcgagcaaacaggcgtgtctcgtgcgaaaatccattgtcatgaagagccaccactcgttgatgaagctgccaagagacacgcaaacacacaccaacgatcagtgtcaaggcggctttctggccagtgtgcatctcgttgggtgtgtttcgtaaatatctggggcttgctggcggggcaacttggtatcgaacatgcttgttatgcgaacgtgatacacgacgactgccgtcgcggaaggcggaccacggcatgcacacacgagtgagaaatttactaagaaattagttttccgcgcttagagtgacgtactggagaaagaaagtgtggctccggaaaaggaactcgcaaaatgtgtgctgcaccacctgactagtgttgctcagtgtgcctgggcttccaggaagcaccttccgcaaacgggtaagacaactgccgaacagaggactgtctcagctccgatatccactcgattgagaaaaaagcgaactgcagcacagggcgacgaaggctgcagacctaaacgacgcaggatgcaggccaagggacctgcatgcatttcccgctgccaagcgtagttcacgtaaactggtgaagcgactcctgcgagaagttgcctttgtctgcgtccacatgttcggatatacgtttcacctggctaaaaagacacgtcaaactctataaagcatgaacgggagtatgtccatattaacagcgtatagacttcaacccaggtgacactgttcttgcatgaagtgtgtttcgcgccaaccagcagtgcatcagcagttatattaactgcaagatgagggttagagtcgctgtctccactcgagaccggagatatgcaacttaggaaagcgaatgcagacgagaataactctctgtccaggcgtgagctatggtgctttagccccgctgaggtgctgatctgcccggtgtgctgctgaagtctgccgccgccgtgtttcgcgttacgacacaaacgcagagtacccatgcccgcttattttgaatttatatttcaaatcttcccgttgttctacacatcaagaaaaatgtttatccaggagtagagctcgcatggtctgctttgtccacttatgcttccactgaagcagactatctcgccctcacgactgtgattcgcggcacttgcgacagcatggtttccctctagtgcctgtgaagcttcggcggtctgcaagca

SEQ ID NO: 1357 - DNA, 3019 bp, Toxoplasma gondii
cactcctccaatggaacatggtcgaggtaggtccattcccacgatgggccaagagacgaaggtgttcgtcgtgcaaatggtttgtcttccgttcttacacatgcacttacacacatataaactacttgctgtatgtgtacatgcaactacacaaggcacgaacagcacatctggatccacgtgggcacgcgaagagaatactggatagtgcacattgtgggacaagggaggcaaagtgacatctctggagctcaccaaacgaaagagcactcgaatggcgaagctatctacaaagaatgggatagcaggacaggagttggaactgcatagagagccagcggtgcttggaggatagcgctgactgtggttctaaaggtgcactgcaaactcgttgtgctctggagggatgcgcttctcaagtcggatggacaccggaaagcaatgtaccgaagggaaactgcaacgaaacatcccgcctcatttaaagataaagaaagcaacaacaggcgaacctcaacattccgtgaacttactccaacagctgctcgaatcaggggagtgtctctagccaaagcaagcgcgtgtgggtcgtgccagaattcagaggaaaaaacgtcccagcacacacagaagtcaaacacagcagagagcttcaatgcgattcgactccttcatgtgttaccatgttttaatgcgccaggaagagcggcagcagtccttcgccgtgctcacattcgctggagatgctgtgctcgcgctgttccgtcgttgcgacgcgtgtaaaggagaggcagagtgaagcataggcaatgagagtgtcagacgtctccggtcgaacattgaggaaggagccggtcatgcaagtcgtcaccatcgttgcaggacgacattaacaagaggaaaccactactgtttctaacatcggagacagagacactgtcaatgacagcctacttcgtttggagcctcctctggcatgtggaagcggatgagtagcaagtccaatattgtaagggagagcaataaaccaaaccgttgtcgtgaaccaatcggaagatgctggcgtgtatatattactgatgggtagctatcctgcatttccgttgcactaaacaatacgcggtgttgatgctcgaaaagcagtgcagcatgccagctaccttttgtgtgaataagaagactggataacataaacgggcgtcgagaggctggaaatgtgtcttggtcgaatctaatgtttggtcttgtcccgttgtggcagcttcgcctgccgtatttcgacgtagaggatgaagcagcaggacgccttgtggcaccggggtggaaacgcgtcgctagcgccacgcaatgttattgcgtcggctgggtctgagacaatacgtgtaagtgctgtgtgcccgaggaggaaagtccgggggaaaaaatgcgagatcgctcccctacaaatacgtagtagagcggctgccacatgtttgcagtttcctgtaagctttaatctccagcgttgcagcggctgtcgcatatctatccgtcaatatcaatgatcattgttcacgttagccccttgaatgtcatgaactgccctctgcgatatcttgttcgcgttgctgactacaccgcagggactttccacctatgttggcgtttggtggtcgaagctacgggttctgacgaagccagttcagcttcttctgtaaacacattttcttcacaagtggtgggcggttcacattggttctacctatgatctccgttagacagtcgcaccctcacagtctcacatcagtgacgacgcaggaataccacaactaacagaaaaagtagaggaagcgtggaggacggagtcaaccgtggttgtgtttatcgttgcagcaatatcggcgacaaatggttttttctcaattagagacctaccgtgatctcagcagttgtgccgccaccggtgctcgagacctcttcgcatcaaagctttaaacgttttgcagcatttcagcaattggatcccggaagctcgattgcagtactgccccactgtgcagcgatgtcatgggtttcatcccacctccttccgcattttgcgcagtgcctatggctccacgggatgcgctcgttcatgtgtagcacctactttgtacagtcagtgagttgaacctggaagaatggtttcacctggttctttccaagttcatcagcaaatacgtggcaaatctggggaatcgatccgcaaagtatcaaacgggtgccgccgaaacatggcccggttctcaaggcattgtgcgtgacccaacagaaccgcgcagggacggttttaaaggcggaatggcatcgattctcagcgacgaacggcttggtcggcgatgaatattcctttcgatgcaaggactaaacgcacacttttcgtggatgcatcttactgaattggcaaaagccacatggtgaattttgctacccgcggggacacaccgtttaaggtccgagcgtcacactactgcggtggacatgttttcggacactgctgtcgtgtacgagacattttgactttccttgggtccacctggccttcgccaagtacgcaggtgagagtctgtgactgtctggtttgcgacgcctaatgagcgtcgccgtagcatacccatgggtgggcccctgctctccgtgagccaagcgcacgtcccaactcgtacagatcccagggaagtgcccaaaccgcaacaatgtttgctcactgcgtatggtctcttcgttttaaggaactataatgtaggatctcgggtaccctcggtatagcaagatactaccacaggtgaaaagtaactcatacgtgttttccttcagagtggctgatccgagcaaagttttcttttgttgacgagtcagcagggggcttcttcctgaaatatcaagcggggttgcagagtgtcaggcacttgcgtgtgctgtttgtcgtgcctgagttcgtcttggtgtgcaattttgatttggcatgtgtccgcgagcttgtcgttttacgtagtgcaaa

SEQ ID NO: 1358 - DNA, 3332 bp, Toxoplasma gondii
gtcacttctggaaggaggtaagccagcaagatctgcagacgtccgtacccttcctgcggacgaaggggagaacagttgcagtcaaaagaaaactccgttctgcacatttccagaggtcgtcgctctgcgcatggaatgctcagctcaggtcttcaaaccagacaaatgcacagcgctgtcacactccgcgctctgcaacatagacgcacacgtccacataccctacatatatacatatatatatgtatatatagaagtatatatatatatatatatatgtatatatatatatatatatatgtggagacgagtgaacatggatgcttgaatctggaggcatgtacagcgcccttttcaagagttcttaccgtgacgagcccgtcacctgcttcgtcgggctgtgcgaggcatttccaccagccaaagcgtcccgggttgagagtgtctgccggactgcggagttcctgactcagcgcatttgcggcagttttcgcgcccatgaccagatggtgcccgagaggtagcacgacctgagaattggttgcagacgaactgggagctgtgcacacgatctggttgtgcatgctccctcgtcgagtcggttccttgttcggagcagcaggtgccattttttagacaagaaaggcctgttgcgaggaaagccgcgcgacccagcagcagcagcgacagacagattcttcggaggagcagggaccctccaaggctttaaagcgcacgatgtgcgaagaaagcaggaaaagcctcccgtcggaaacgactgcggaggaagtcgaaagggcaaagccagcagccacagaaaaggcggcggaagagtcgggaaccacaccttttgcccgccctcttttccgtgaaaagattcggaggactcagagtaaactgagagtgtggactgtcagacgggtcacggaagaagtgtccccgcgcaaacgagcagaagcgcgatttctcggtacaggattatttgcggagcacagggcaaccagccgaaaagccggccggcggtttcttgagtccggcaggtggaatgaggtcgaggaaacagccgcctggacagatctccagtccgaatcaaaaacagacggcgcatttaattggacgatctttctcctggcacacatcgttgcctagaggcgacttgtgcgttgctttttgcaaaaacgcgccattctggaaagcagctgggattccctttcccgtcgctctgccggaaagaaacgctggcaagctagcggaccgcaagttaaccagctcaagcaggagagttcgcaggcgttgatgaccagagacgacagtcaaaaaatggtcaggtttgctcgagcggttgggggaaacagtattcagctttcacaacgcaaggcaggcgtgtgcagcgcggggggagggcggacaagagagcagaaacgcggaagatctggcgacgacgctgacgctttaacgttgaagagacaggggacgcagaaacattagccggaaaatgcggaaaaccggacattttaaagtgcctcgcgagagaacggcgcggtcacctgcaacaccctgcaacctgccgcagagttactgctggtacagagagagttcacttttgctggaagaatgccttcctgtttcggaaaaaaggataatctcctggatgtcgtttggaatctccagctttctcgttgaaaaagacgcctgctcctggcgccgatttttcgctgacatgtgcgagtagagggctacgcgctgtgcccctgtgtacaggtgaccgaacacgcggtggcgctgaaaagcatctttcgttgcttcaccacgagttcggtaacccgacgaactgcgaagaagtccgacggaagtggcatgtcctctaaagtcgcatgcgtttaacccctttgtagagcgctagagagacaggtttgacaggttttgtgagctcgtgcggaagtgtagccatcccaactcgcgacacggaggagtttggggttttcacctcgtccccagttgcacacgaacgggtccttccgacaacaggcatttcgggccacattcacaccacgcttacacggtgttcttttgatgattgacatgttccggcggaggcgtagacgacagaaactccagaactaccaaattttagttttaagtccatttgttctcgatacacgcagtcctatcacatacctcgccagtgtcagctggggcggggcatctttaagacgcgtgttaaagcttaacaccttcaaaatgtggttcatacgcgctcaaatgcgctgtgaataaaccgctgaatgaaatctattcccctaaagtgaaaacgaaaaatctcatccacagtcttccgccagtacgcagggaactctacggcttagggcagagcggcagaaaatagaaaacccctatcgtcactactaagattcggaacgctcagtcgaacacgactgtgaggcatttggtgtgtttgtaaatgtcgctgggaactacgggcggggctctccagtgaggtcacgaggcatgcaataccaatcagataacaactgaagctagactccctgttgttacacctaaaatgggatgcctaggtttctataaactgcctttatctgacgaatatatactacgactgggactatcggtttagatctggaaggtctttgttcatcctacgtaaagtgtgtaaacagcgtacctaaagcacgaatatctttcgctaacagtacacgtttatctcgggtgtagcctgttggaacggcggtccctgagaaaaagaagtcgttaaatacggacatgtttgtgtctactgctgatcatccgcctccgtcggtatagaaaactatacgcagcgttgaggcagtaaacagagcacataaagtggaattgccgtttattgttcctttcacacattggtgacgagaaactcgtctctcagccgtcacaagggtataaaagtgagtagcagtaattttttccaacgacgagagccagcgtcacctccgtcacacaacgacgcacagtcaaaacttttggatgctttactgcgtgcggattctgagagttgatatgcttttgatgaggtgtgttgtatttcgcaggaagactggtggtatcctttgtgttggagtaagccagttttttgctaatttattccgaccatttcttccgtatcgcgttgacaaaagggttccgctgaatttttggcttcgatgcgtaccgtgcgtgtctctggaccgaccgagtgttataagatagtgttcttgagactttgtatgccctcgaccctctcaacgctttttgccccttccctacggttttgtcctccttttttgaacgtggcagga

SEQ ID NO: 1359 - DNA, 2532 bp, Toxoplasma gondii
ggcaactgtgctgcctggtccctgcatgtagcttgtgtgggttttgaaggacgtcgtagacttcagccgtttcggcaagttgcatttcgaatagtttctccaacacttcccccgttgtgttttttaccgacttatgtaacctttttagttctgcagaggcgaggcaaacgtgtgagagggcgagagccgatatcgggaagtagtccgtttcggtggaagttcacagcagagactgagggtgtacagcgcatgcagcaggctgttgacgttgccgaaaacacgacagaaagagcgttttctcggcgaagaaaggtgatgtgacgtttgccgggagcttctgaggcgagaagaggctgtttacaaggagaaagcagacgcgcaccgcgagactggccgaaggagagacaggaaaacagaaaggagcgcaagcgcgacggaaaagccagtggtgaagggaagagagaaagacggagaactgccgaggaagaagtagacgcaaagcccaccaatagagatggctacaaagaggttaccgtatcctccgcacaaagccgatacagaaagcgagcgacatgtaccaagagagaaagaaagagcaaactggagagaaagagagaaaggcggggagacacacgaaagcacaaagagaggatcggagagagaactggaaggaggaaaggtctaaagagtcgaccaccacacactctttcgatcagagagttccgagagcttgaggagcacatgcatatctctttttcagtataccttgtgaacgagaaggcacctcgacgcagaagcgcggttggtggaacggactcgagaaggagaatcacgatttcttgagggaagatctttgcgcctccgtcaaaaatcgaaagcggtcgagcaaggtgtgtttcggttgtttgcgtctcagtgtcccggcaagactctttgacagaaggaagagcaggagctgctctcactgcaggcaaatgcaagcgccagccacttgctgcttttccattctctttcttttctctccacggcagcctgtggaggaacttccttccacgtgtatgtctcggtccgtgtgtatatatctttgttgtgtgtgtgtaggtgtgtgtaggtgtacgagcagattcttgagcacatgcagaaaggcgtcttctgctcgagaaaaaaggatctcaagtctgaggaggcgctttttgtgaagtctggggggggagcgcgtcctgggtgtcggcgggaggcgttgcgctctcccgcatgtctcaaaaagtgacggaaagaaagtggagagagtgtggcgtctgctcaggttttccgcgtttctttgctgcgttcacactttgtcgcccccctgtctttcctcttccttagctctctttctgtttttctccgtttcaagtcctcttttccgttttccttcccggttcactctgctctgcgttctgggccgcgcctcccctccgcgtcattttcgacctcgccggcaaagcgcaggtagacagcgcggccgccgccacagatggcgttcgttcctctcgacttccttccttcctccgtccgtttttcctcttccgcccgccactttgagcgcgaccgctccttctttccgggacctgagtctcgcgagcacgaactaggaaagcgaaactctccgcttcctcgccttgtctgccgagcaagtctcgtgcctcgcggttgcacgtgacttcgggcagggacccgggtcgcgccacgagatccgcgcaagccagacggtgattctttcccccctggcgagagaagcaacgcagggagtcttttggacctgaaaacaaagaaaaagcaaagttccagccagaaaacaggcgaatttctgcgaaggttcccgcggcggtttccgcgcccgcggccacgcccgccggcgtccaaggtgtacgtacaccgcatgcgggcgggtcaccacgccgggctgagcatttggaggtcgaaaaaaagccaagacaaccctgcgaaaaaagtaggcttcccgtagaaagcgaggtggcagcaaaggcaaggaaggcgtactggtccttggaagaaaacgcaggaaaaaaacacgtttccttcggtgtcttgcgacgttctctgcccagctcacgcagtgaaaaaagccgctgcgagctgagttgcggcgacggaggaaggccgcctttttttcgcatactcccgtgaaattctatctgaaggcttcgaagattctgtctagcgctagttgcagcttttcagccgtggacaacgggagaaggagggatttgcgtagttccgtctccatgggggttcgcgcagcggaaagcgaacggtagaagaaggactgcgtgtctctctctgtgcatgagcatgaggctcaggcctacggtaaaagaacgctgaactcgcgcgacaatgcatcccagaagaaccagcagagttcgcagaaaagggagagcgaaaagctggacgcttggcagcgggagttggcggacacagccgagactctcgagagcattcgcgctgcgcttccgcctaccgcgggca

SEQ ID NO: 1360 - DNA, 1976 bp, Toxoplasma gondii
cactgttggctgttggacgtgaggtacatcagtacaaaggcgaaaaaaactgtggatatagcagtatccgcctggatgtaacggagcaatctgtaactaaagagttttcagcttaaactgaggaaggaaaccagtattaaccgtgcagtttttatattcatgcccatctccgcatctacgccatactcggcagtgttccgttggtatgcagcagtgtagccggttgagtgggcaacgcttgctcagcttatggcagatcgtttctctgtcatcatcaacgattcggaaagcggtgcgagaaccgtggtgttttctgctgattagtcgtcctctttcaaaagtgacgaaagcggctttcagccgtaaaaacctccatggttgtctcgagggttcgtaaccccgtgtgttattatctcagtgcaacaaggggatgatcagacggagtttgaggtggcacggaggtgcctttctgttttatgaggcattcacacgggttccgttttgttcgaaaatctgtctctcacagagcaactgaaaggacagaagcggctcttaccggaactgcggtccagacaggccaaaaccaaggcaagcatcgcaaagaggctggaagaagagaagcacctcggggtgtctacgcatctggataagcgaggaaacctgcagagtggagaacgctataagaagaagcagcgcgaccaaaagcgtggtcgtcaggacttgcgtaacgctcttggttcagcgggtcaactagacagaaagcaagtgaaaaagttacgattgaagatctcctagaactaccgaagaatgtgctcacatgtggctgtgcaatgcgtagcgggggggtccgaggacgtggcgaagaaccttccggtgaattacaatgtttcccgttgtcaaatgctgcattcgctagcggaaaaggtgctttgatgcgaacctgtggaagggctaggcgaatgcttacttcctgagttgggatggacgcactactgattggttcgctctgtaaatgtagctcggatccaccccccgcgatagtaccctggggtacgggtacctgttgccaagcaaagcaggtgggggggttcgtgtgactgaaaagctcgcgtccgacctcaggcaaaagcagagataataaaaggtgcgtcaatttccgagtcatagtcttctggagagaaacaaacgaagaaacaacgccaaggaaaataaacagatgtcaaccacatgcggtgtccacagcaaacctaacactggcgactgtaagcgtgggtcgctagcagccacagttttgtgttgtttttcacccctagttgggaatgtgcttggcaacttgaaaactgtgggagccggaatgtttcccatgcacagacgtctgtacacagaactctaggtgctattcttacgacgaaacaccgctcctagggcgtgaacactggctgagaagtttcgtctttgtgctagctggcgtgaacctggtgaagaaaacaacgcaaaatggcgtcgaagacactaactagaggtctgctgaagtcccagacaacacacaataatccatacagtgctcccatacgttcatttcggagtcaacgtcaggtgactggtggttgacgccaagaccgcacatggatatcgcagtgcacattcgaagcggaaatcttgtttcaacaaagccagaagagggaagagggatggagtttttgacgaccgcgctgcactgctagctcggccgattgtcgcttgcccaggtagccaatatctggtggagttgaacatgcagtctagcttttcttcgtgaatttaacgcgacaaacgaaacgtgtcgcatttggcctttcccgagtgatggcatcgtaagcgtttttctggtcgcgagctccatacggatctgaccccaataagagattttctctataaccgtcgccagcagtcaacctcccgggtagctccatatttccctcgccttcacactacga

SEQ ID NO: 1361 - DNA, 2159 bp, Toxoplasma gondii
agataaatccagtcatgaagagagtagcaaagcctacagattcagtgtgcacaccggctgattccgtgctgttcggcttcagtttacttgtggcaagcgagagggtgatgcttaagtgggttggggatttgtagaagtaatacaaaagagagcctaatggtctcagcctcagcaacggccttctgggtgtgtgcgtctacttcactcaccgaagatggccattgtcacacatcctcccatctgcatatggccatgaaatttgtttggacggataaaatttagatcgctcacatcttgagcgaagaagtgagccacgatcgcggcaacgcagaacatggcgaccaccagaatcctaggctttgatttctcaaactccatcccctcaatgggtatatcatcagggccgccgaagtacatctttggaaatcagcaaaacaataaagcaacctcgcggtatcaaaacgagggagtagcacaaaacagagatacagatcataaacaaggaagctttgcagttggagtgatccacagaagtgtaagaacagtcggctgcgccctgatgtatgcacactgcaacggcaggcatatggccaggtgcccaccacatgagacaaaacatttactcccttgaatgcgctgcatcagaaaaacctactcgcttcttttctctcgaagtccttcccccttggcgcttttaccttgcgttatgcgtgacaaataacaacgatgtggcgttttggggcgctttcaagtgaactgtcatggattgaggaatgcaagcgcatggatagagacccgtgctgtcaaagccgaaaggcctggacagcctagtccccctaaagcattgccgggaggtgccccaatagtgtgtactggcgcagggccattctcttcactcatgccccgtgtagtttcaaatcgaagcaagcacaagactgaacgccggcggtaccgcgcagccctgcgcgacacagccattcttgcgctctcgatctctcttcaaatgtgatgctggtactgggacagtcgaagaaccgacaataggggcaatgcaaatcgctacattctgcttctatcagagaatcaccgcagaagaagttcacccgatgagtttcgcggcgtcgcgatgcactcgcggactgcaatcgcttcgtgccagtcaatttcctgccgtcacagtacattagaagtgtctctgccaataggaaaccaagaagccccacagacagagagatgactgcagacgacgggcagctgcacacaactgctatgtggtttgtcctcccacgttatgtgtgccagtgggcgttgtcctcggaaaaatcgtccctcctgtcgccatctcagtggacattcgtccgaacttggaaggcgatgactataacagggaactcatctaccagtatttttttggcgacacagtgtgttcactgcgctgtagacactggtacggggacaaccaaggatctaccagtgttgaggcgttcgaaagcggacggcgtgctggggttgcgcgacacagcgcggcatgctgcggttcgcacacccgtctcttccgtcaaaggctgccgtcatcgcagtggcatcaagctcaaattggcggcgcgactcgatgggttcctgctcggatcatttctacgttacacgaatgctcatacactctatatctagaattttgtgacgatacacatgctctacatgtttttctttcacttgtgcacgcttctacctctctcttttcttctcgcaatccaccctctcctggatgtagctgtgcgctggaagatgacagctttgcacgttttttcggaaacgtcttgctactgcgacaaagcagcgtgatcttaaaaaatttagcactacgctttttttcacgcaggccgaatggtcagtttcggtatgtcattgagtttgctgcggcagatgttttttcctctgcatctgcgcatgcacggggcaagcggcaagcaggtgtcctatacgtggcatcagtagaaacgcggcactttcgccgtcagcattttcgaggaggtctgaaagatcgaagctccatatgtgttctttgagaagctcctaagacgtcttcctctcaacgaatgtggcgttggagtcccgttgaggtgaaccggtcgtccgttttcattgtacagttccagtca

SEQ ID NO: 1362 - DNA, 3714 bp, Toxoplasma gondii
gaccacgaggatctgagtattctttctcatctgcaattcgcgtgtgtttgcctttcggcgctcgtttttccactgttgaggtcttccgacatgttcgtgatcttcttcctcggccctgttcgccttcacatctctttgtgcccttgccgtgtaacgcactgccttgaaacctccgtctttcacaggatttctgtttttgcgcggtctccgcagttttctccgtggtggccagacctatgttgctaaagacttcttgcttttcgtgcagcgaaaagtcttcgagggctgccgaccgagggagatgtttgtgatttgcgtgttccgtcgttttcacgaaactgcatctgtatctattgacgcttgcaaactatgtgcgcaagatattgaacggcacctctctccgcactttgcttcggtgttcatagatttgaatgtagggctatgcgactgcatgctcttgcacactcgtgactccagcgcatctggagtgtccgttgcttctttccgcccccctctccgcactcgctcctgtggtccaggatcttcgttgtcttctctgtcctcgcgacatgggcaggaacaaaagagagggatgcctcatctttgtcgtttttgcgcttgagaaggctacagggctgcaataccgtacatgctatctaccgaaactcgaggaaacgagtgtttactcccaaacgtttcagcgagaaagaagagtggacaaaggcgtgttctacgtgtgtccagccctcgcctgtttcttgcagactgtcggattactttgtctctcactttcgacaaatcttcacataaagagctgtcggcctccacctaaacacagcgatgcagagtctacggtctcacctgatccgacaccgtcgccgaatgctacacatgaatgtctcatacacgtttataaatccaattgttcacatgcttgtacacgagcgtgttagggcaaaaaccgaaattttcgttttttctccgcctcagcaaggcctttctgtttgcacatgccgatatatatatatatatatatgttcgtatatagatgaatcgaaaaagatgcatgtaagggacatacgagacagagaggagcgtgacaaaattggtttgttctttttcttacagggagcgaacccgaaatggatacgaggtcaggctgaacgaaggctcatttcggtcctccgaggcaacgcatcttgatctcggggaagtttcgaactctttttgtgcaaagaacgaaaaaagcaaaaggagggggacagaaaacggaaacaaaaaaaggagaaaaccctcgaaagcaggagacagacttatatgcacgattcccttttttgggatagctgcagcatccattcgcgtagcgccgccgcctcgactgccatgtcctcccgagttcgaggcctgcgaaataaggacagaaacgccgcaacacaaggtgccttatcagcacaaaagaccaggcacgaaacggctttgtagggagtgtatgacttctttgtcccgacatatattgttaagtgaacaagtaccgtcacgatctaagtcagtgagccagcatatttagagacagcctaagcacacgcaaaggcacctcaacaggctcgctgtattgaacagacgactggacgcgcactgttccggcctcgtttttgttttgttcgggtattttcctctatttttcttttgctgcctcttcgcctttctggtaatgttcctatgattccttccttgccattggtcgttcctgtcgcgtgtttttccgaaagagaaattggaacctcacttttgctcttcccggtcaacgccaggtctccgctctaagtcgccctgaaaccgaggaaggacgtggaggtgaacgtgggacacggtttgtccactgtcgcgaccatcttggagagtaattgaaaaagaatctgctttgtgtttcgagactacaagagaagccacgagacgggcacttgcaaataaatcctttacttcctcttctgccaagtcgcgaaagttctgaaaaaacaaaaacatacagaagaagcgaaaccccggcgtacacatatccacgacgtcggcctccacgtatctgtacaacgacacatatgcatatgcgtgcatacatccacatacaactgtatatatccatacacatatatatatacatatatatacacatatatatatacatatatatacatatatacgtatatatatatatatatatatataggttggcacaacgtcagtgtgtacgcacgcacgtaggttcttcatttataggcgtagaaagaattgactcgggcgaatggtgcgcagatgtatgtgtgagtgccggttgattttaaggtacgaggggaacatgattctgtggaagtgcattttggactccactcgcatgcacgcattggatgggatggtgttcacgtgttgctttttctctgtcctggaaaaaaagggtgctgctttttctggatctgtgccccctccatttcgttccgtgagcgaaactgaccgggacaacgcgtttggggatgattagaacgtggcctggcacaacaggctttagattcgtaaaagcgatggagagagaactccagaaaaaaacgatgcctctttcaatcggccatttagagaaccggtatgtttctgtcggatcgtctgctcccaggtgccgctgccaatcgacatactctgcaggtgaggaaaccgatggacaagaagaagagacagaagaagagggcagagacttcgaaagtgaagttgaggaaagcaacgccattcttctgaggaaacagggagtaaagttcacaaaaaagagggaagataccaaaggcgaaagagaggcgcctgcaactcggccgcggaccgacgggagacacagagacatggatcgccagcaagaagcattctgcccgagtcgtcaggccgcaacgcttggcgctaattgactttgtctgcagaagagaacggcggaacgcaaagaaacaagtacgaaggaaacggtgagaacaagagaagaagaaacagagacacaggcagagacggcgagtgagatgaaggagactgatagacaagaaaagaacggaaaggcggagagaaacgcggaaattcggagcgttcaaaaggatacagagaaacggagaaagagatgggaactcgaaggaagcgacgagacgcaggcaagagtcacagagagaagacactgtggagtgtgagagcgagaaaactcacccaaaggcgacggaggtatgccagacctcgcaagtctggtcaatacggttctcctttactgacttcggccgggacagttcgatggcttcagttttttaaagcggaaaaaagtcgttttttctcagtgagttgactttgccggcctttttctgaaggtcgcgcatgaggcttaggcgctctgcgctgtcgtagattctctgcatctgaatggtttcttagcatctctcgtgcgactcaacgcttgtcgatcccttaacatctttatcggcattttttgtctctcttttctcatctcctgctctcgctttctgcttcgtctcccgacggacaccgtcctttctccacatgcttcgagttcttttctctcactcagggcacttctttccctcctctttcctgccggccttcttgttacctgcgaagttttttcttactcgtcttttttttctgtgtcgtttccccggtcctctctctcctcctctgaaaaaa

SEQ ID NO: 1363 - DNA, 4077 bp, Toxoplasma gondii
ggtaaaggagaagttggagagtagaaggcgaagaggacgcgagaaggagaccgagaaaaataggtgggagagggaggaaccaacagaccagcggtgtgttatggagcgtcacatcgagacagaaacggagaaagcgggggtgtacaggcacgagacgttttgtgcgttgttttttcagcttggacggctgggaggttcgcgacgggaagttttgtcgcatgcaaacccaaagaggcgcatatgtgtctgaatccagctcgtcgagtagctcgagcagcagcagcgacagcgaatcttccgacgacgaagacgagttggaagagatctcgaagaaagtggcgaagatgagggaaggcgtcgacgctgacacctggaacctttacgcaaagaccaacgccgtcttgctgcagcgacggagacagctgctctcggtctgctctcctgcaacgtctggggctcgtgtgacgtctgtatctttcgaagatagaagcggtgatgttttcctctccacggcgcagagtgcccgttcctcagacgcggatggaaagaaggaagacggggcagggggctcggcggatgcagagagaagtggggtgtctgtacacctcgccaggccaccggagacgaacgggacaaactctccaggagcagcggggtcgacagacagcgagaccagcgaagatgacaacgaaagcgacgagcaggccgacggtagagagaagagcgacgcagcatgtggagctcagaaaactctaaagaggagaactggagaaaatgaggctggacgcaacctcgcgagtgccggcactgagaaaggcgtcgaggggaacggcagaaacacgggggagacgagcgctctcggctctgctgctcaggagcaaaacgccaaaaaatcacgccttctcacctcggaataatccatatgtgcagtgtaactacactcactcacgagtcattccggttttacttctgggtgcaaacgcgcctccaagtccgagaggtgcacttccactcttgtcaggacgcacgtccacgctaaagccaccgctgcatgaacagtcgtcagacgctcttcgaacaagaggaaacacaactgcgtagtggggatgaacaagcgagtggacctgccgatttagacttcgtcaaagcttttgggtggcgaagctttcacaaactgctacacatatttgaacttgcttccgcgcaaccaacaaaatgcatggactgtcgtagaggagatgaacaagacaaagtgattctcaactcggctctcagtttctcaatagagagaacacggtgccacgtatacatacaggcacctctagggatgtcgatcgatgcatacatacctcacattcatgtatatatatatatatatactgtatgtgtgcgattcgctttccctctctctgatggaaaagtacgtgctgaatgatcgtttgctgacggaagcgtgccagagagcgtttataagaggaaatgcgagtttccccgatctcagtgtcggcaaaattggtccaggcagtgacttttagctgtcttaaacactccaggtggatggcggtggacagcaatgataaagatcttgggactgtatcccataagtggagtcgaatattcaggatcctgagtactatgttcacttccgtgtagtgaatctgacagagaaccgatggctggcctcatttgacgcctcttgtgaagtgcatggatttgcagactcacgcagatgcatgcaaacttacacgcagacagttaggaacacattcgcttagtagacacatgtgttgaaactaaaacgttatgtggggtttccttggagcaaggtgatgaccgtgtacggagtcattccttcgctcgtcaggcgaaggcccactacatcatttgggtttgactttgtagtgaagtgtcttctgttcgcttctgagttctttaagcgtctggtcttattcctggaagctgcatttggtattcatctgagtctacagaacgaaaaagttcgtttgaagccttcagtatgtccatctcaactgcgtcagagtgcagtagcaaacagacacccgatctatattacccagactctttgtttcggtagataccctaggtacccgcattttccgctttcttcgccgcagcgctcgtcccaagctcttttttcccttcctttcaacacctaactgaggaaactttgcggaacctagtctagacagtacttccgaagttacccgcctttgctgcaccgaactcccccgactttgaaagagtcgacgtgctcccttgggcagtaccttagattttgcacatcccgtgaaaacttcgtgccagcgaggagctgtggccttttccgcgttcttacttttgccgcgccagtttaacggcaacccccaccgagtaaaactgtatggatgtgggtctgcctccctcggtccgcgtctcctgcgaaacaaaacgaattgccgtctttctgacgtcctacctggctaggttggaacttcgcgatcgacgctggaacgcgcaattccgcaatggcacccttcagtcagtgcgttcctctgagtcgaggatcccgccgagacttggcttccccgaccagaaaaggcaccaaagccgcgttctgccgcatttcgttcgcgtttcgcctcttcggactcgcacgaaggacttcgcgagactgccacgaacaaaagccacatttctgccgcgaaaactcctcgattcgtctagccacactcaagaaaggatttactcaaacgcgccataccggggatacgcttggctgggtccgcggccgcatttcaggtgtctgtacacctggggactgttgcgcgctcacgtggcaagtgctcgaagtcgcgtttttgagtcgggcagggcttcttgtccttcacgcgcgcaagtcgccagcggaggcctcaggtgaggcactttcacgtcaacaaaaacatgcgagactcaatataattcggaaaacgccgtttgcaggaaccggtgccaaaggcgtcacctcgtctggctgtcccaggacgcgcacaagactctccgtgtcttgctcctgcttgtcgggttcgcgcgggtccgcttggcccgcatgttgaccctgttttctccagtttctcttttcgctgagccttttattcttccgaacttcttcccttctccatttccagtcggttaagcgcccgtaccgcgtcgtcctcaatcgcgttgttcgcgaacagcatcttccgggcgccgcggtgcccggtgcacgagcggagaccgtttgaacacgtttgttgcaggccttgtggcgacgcctatttttgctgtttccgtaagaaaatctccctaccacttctatttgactccgggcaaagtcctgataccgtctgaccgggccgaactagacatcgtgctccaattagcgaaaacgccacttgaccgccgcgccggatttgagtcacccccgagcgctgtcacgagggaaccggacagaactctgagtgggggtcacgtcgtttttcacgaagccgctctttcccctttttcggtagtgaagggagatcaaagtaatcttcctcgcgtcgcgttctccgtgctggatccctcagttgcttctcggctcgcgaggaaacccccgacttcgactgtctacagacgcgacaaaaaagcgcgttccccgcttcatcttcccttgcgagcgaaggctcgagtcagaggccactcgtgccattaaaatacgtggagaagctcgagacgccgaacccccaacgtctctgctcccgatctgtccgtttccagagccgtttccgtcatttttggaattcgcttgctcgcgccgccttctcgccgtctccgtcttcgctcgcttcaagacttttttcgacgcgtcgcactgtcactcttttcgcggggacgacggagcagacagggcggcagttgcactgtatatagttcattcccgttaattttttttcgccacgtgagcttccgactctcagtcttgactcttcgtagagtatctcgcaaggcgccgccctcgacacctgcagatcttccacttttttccacgagtatgctggtgcggctttcagctca

SEQ ID NO: 1364 - DNA, 2838 bp, Toxoplasma gondii
ggaagcacagagagtggtattgtgtgcagcaggtggaaaagttgaaaccatcatgcgtcctcaggtgttgtttttccttctcttttttcctggcatcgccgtgtcatacacatgcgtggtattgttctggatatttttgggtttctgcataagttcacgcatcgtacactgggaagtatcttcttctttgcagaagtggaggcctttggggacttcagagcacagcgcttctcgcccttcgtgtctgtacatcccaccgttttcgcacgtgaaaaacgactcaaagaggctgaaaagatcttcgttggacagatttcctcgtccgatctcttcgggtgtacacacacctctgcagtagcgcgccgcctctttctccagaagacgcagcagggatctcctggttatcacttgaagaacgagaggcgctgcccgtgaggaaacaaaggcaatgagggaacgcggtgtcgacttcctcgatgaagtcgctgctcattttccccttcgagctcagatgtctccacccagtgtgctgttacacaaatccgtacttcttgtaaagagacacaccaaagaaatggatagaaatgagtgtacatggacaacaccaaacatttggctttgctgagtttaccgatccttacagacccacatgcacccgcctctgctgctctctgtgtggaacttcgcctcgagagaaaaacgaagcgaagcagcagacccggacgttttctcctcgttcgctccggtgtacttggctgacttcagtggagggacgagtcttggttttttaactcgcgagtcctttctcgtctagcgacaaacatctagatggaggagtagcactagggtggtggcaacttaacttcggcatgcgacagataaatctctctcgcactgttgttcatttcaacacacataacctgagtgaggatcgtctgacgggagctacagcgatggacctaccacgctcggatgcctgtttagtttcgtctcgctttctccggtgctacgtacagacgcctcaccatctggaacgaacaaagagtacctagtagtacactaagacggcctgtctctgaacatcaacatctgaagctgtcaaggccacagtagaaccatagagagagcggatgcatatagcgacatacacaggctcctcctgtatataatacgtaagatgaatatacagcactggaatcttattcagtcgaatctgaagatccgccagctgcgcatacacctgatttcgagcagaatctccgtcgaccggaaggtttttgcctcgaggcgcgaaggtcttttctcgcgagctcattcttcgtttctcattcctccgctccagattccccctgctcacttctcgtttggcatttctcgtttggcatttctgcgtccctgtgagtgaattcttcgcatttctctcccttggagattcctctcaggcgccgatttagaacaaaacactgcctttcgtccagcctctagttcctgcgcacatccatcttctttgcttgcacggcgaatcctcctcgcggtcgtatcggtcttcgttgctcgccgcgccgcctctgggcatggtctgctgtggtttctgattcctccgcgacgttcttttcgacttttccgtgattcagagaactctcccttttcgtttcctcgcttcgcggcgcgcagaaccggcaagttcagggaggaggcggtggcgagtgctcgggagacggccgagagaagggaaaaagctgcgagttgtgctcaccgcgcgggtggtgtgtatgtacaccgcgctgtttcgagatcggcgaccgcgtttcgcgttctcccgtcttttcggatttttcctcgccctcgctcggccgaaggagtgcgttttccgtttctcagcgcctcgttttgtccctttttcttgttcgtcgtccagcttctctcctggcacttctcctcgccggcatctctcggtctcgctgggcgctgggggcgtcacttctgccttctcgagattcaggtgtacctacactctcctccgcggcgacagggtgactcgcgtaatacttcgcacgcgctcctgtcgcgttgtctgtcgacctgactcgctctgctttcctttcggtgcgggccaaactggtttttgcgccttttctcaagtcagtcgaccccgagagcgcctctccttttcctgcgaaaaagagtcgcgaggaacggctcccgagctccctcgtttcctccagacctcgtgcgcaggcagtcagagttggttttccgtttgatgacgttcctcggcctctcctctccactgcgacacagtctgaaactcctttcttcccgacagtcaccgcttccgtgtgctctctcccttttctgaggacgtctgctcacccgttccgccgttcgtcgagtgtacgtacacctctctcaccgagtgataccgggtgatccagccaccgtctccctgtttgtgtacagacgcgttcttttactgccctgcctgcagcttttcgttcgttcttcccaatcgtatcgcggggtgccgcgtcgctggcgaccctgcttcgtctgcgttgtcgatccgtcctctttcgactactttctgtttcgacaccttgccgctcttccaaagaaagaccctctctctgtgtcgcacccggactctgcgtcttgccgcgcagcaccgagaaacacagtttcctctgtcgccgtccgcggcctccgctccaggcaaagaggtcttctccgcaagtcctgtgtgagcgtgcggtggatgtacacccgagtgtttgccgcggtcgacacggcgcggggtccggattaatcctcttcgtcttccactctctttcaccaaaa

SEQ ID NO: 1365 - DNA, 2092 bp, Toxoplasma gondii
cagattgtcatagatctccatcaattctgcgatctacacatgtcgcgattgacataaaaatatatatatatatatatatttaaatggacaaagtattataaacatatgcagaggtctctcaacgcaggcgtgaacacagaccaagacgtacattgatatatatatatatatatatatatatatatatgtataggtattcggagaagagacggcgaaacgcgtactggtggaaacgcaagtcgaagaaggaaggctggcgtcgcagagtgtgtggagacacagacggaggagaagattgaggagttaggtggacagctctgctggaacagacagaggctgtctgcaggagagagttgctgtgtgcgttgccgcagaaggccttgctgcctcgacagggtgggtgttcaggagcaagcgggtgcgagggagaggccatcgaggtgaaaaaagagagactgaagacgaaagtacaagcgaggacgaggaggcagaaacaggaaacgagaggagagagaacgagaggagaaaagagagctgtaggacgaacaagagaacgagaaaagagaggagagaagagagagaagagacatacctccgtttgggccgagacggtgcttttccatgacttctttgtggtcgatgaggtcgcgcagattgactgcacagtcgtagggcaggaagtcatttgcaggatcgaggttgacgacgatgtgcggccgatggagcgcccgaagcatttgctgcatgccattgcagtaggtactttttccactccctggtggaccaatcaccagctgtccataccacatggctccgcagacgctgaaaacgaacgaggaggagagaccgacgaaaagaagaagagaagagccgacggcaagcagcaggtgaggcagagagagaacgagaagaagaagagaaagagaagagggagcggaagaagaacagagacgacggaaagaaaggaagagcagacacaatggggaatctgaggaaggcccagatgaaggaaacggagatgaagcagtactggtcgagacgtcaaagagaaaaaagagacaccgcgcgagatcagctgtcactccagccgagctgcgaggggaagacgccggaacatcatgcagaatgcaccgtttgcagactcagaaattcacagtacctttcacagacacgagaagaagaagaattttttccaaaaaggacctcttctttggcaattctttctgtggcgtcgtgtctcgcactcgctcgcgatgcctcgaaaagttgacgcgcctctgcagggcgctgcacctgacttcgtctctcgaggaggttcctctgctaagaagaagtctccgaagctccctcgacattctctcatctctgcggtaagcaactgtttgcctcagaaacgctctcgagtccggagaagctactggtagccgtttttcgaggtgcatgcgcgctggagagcgctggagagcgctggagagcgttggcggtcgcacgcaggagtacgtcgagaaacgaggcggagagcgtcgcgcatcgtcttttttgcctctttctccgagaagagcgcctttcccggagagaagaaagagccctttctcgcttccagagcgacactggtcctggcaacgcgcgacgcgaggaaatcctgcgctggcgggaggctacgaagtcgacgccggagagacagcctttgcaagacgcggttgggagggagagctgacgagagactcgctgggcgttccgagactgggaggcgctctaaatttcagaaagaggtctttcacggagttgcaaggaccgtccagacgctggaaaacgaggaccatgcgaagagtggaaaactccactggtcgctttctgtcgagtcgcgtcggagccgctagatagagtcgcctcctcgtttttgtgtcttctccctccctctgtccagcctctctgcgtccttcccaggcctccacctttcctcttcactcctccgtccctgtcgtcctttctatgtctcctctccttcctttctctttctttctttctctcactctcttgtctctttcgcgctccgacttgtctgtctgaacctcccatctctgagttgcaa

SEQ ID NO: 1366 - DNA, 4631 bp, Toxoplasma gondii
gcatctccctcaaccggattacactccttcatacgttacacctctgttttctccaccgccgcacagaaacttgtgtatcggggggtctcctcaaatctctctatctctatctttctatctgtctgtgcgtatttactggggggtaaaagtacaaagatctgtgaagaggatgtatttggtttctggggcttttgcagaaatctgaagactcttcggcgcacttacgcactctaccgtagaattgcatgctttccaggacaggaccctctgtcaatgtcttttcttcagttctggtgagacaagtacattgcgtgcatcgacagaaggcatttccacgtgaaaaaaggagtgcttttttcaggtctacaatatatacaataccctttgtaatttgaggatcacaactcatgtggccatatccctatacacatatgtataactatatatatatatatatatatatatatatatatatatatatattagagacagatacggtgatgagaagaagattgattttgatgttgaggcttacaccgtttatgtaaaggtatttctattctcgaggtccgctctatgcgctattagcattggttcaacgtgaggtggtcacacatcctggccaaagctctgtccacacacggctaatgctaacgctgtgaacaatgtaagcaatgccttcgttccaagagtttccgacgcatttatgctctctggagaaacgacttgtttcgctttagagtctcggcggtgtgttcgctctcgcgttcccggctatttttttctctttcgcttccccctactttgctgtcaaggattctggcagcggatgcacggcttctcacggcagatcggcccttgagcaggatccttagggtacgaatcggattaatgacggcgcctaacgttttgcgaaaactcaatgagaactagaaggggcgttcacgactcacggtttagagttccgtagttcctttgtcccaccggtcacgttcagagggtgaagcaaagatctttttcgaaagagacgagggaagtgcagtttcgactgaagaaatgcaacactaacggacagcgtcgtcgtactctggaaaaaccagcgttatcaaaatgtctcccggaatcgggcagccattctagaaagcgattcactgaatgcgattcactgttttgtgaatagacgcgcatgcttcagcaccggtagactgtttttagagtgccgcaaatccgaccgttcttctgttttagcgccaaacctccgcttcccacttgaaattccctgcatgtgtctgtttcttgttttggccattctttttcggtgcttcctcaggctctcgaggtggcgacgcagttcgcgcccaccccgtcagagtgtttgaatttcgcgaaaacgaaaagtccgtctgtggctcttgatagctcttcacgatccgagcctcttggcgacgggccagtgacccacacaccgtccacagacactagcaaaaactgtttctctctggagccgacaaacgacgcttttcggtcacttggtacggggggaccccacgaatctctctgttctggagacagtcgatttcctctcgagaatgggcgcggctttccaccgcttgctggttgtacagttgccagtggcgctagcggttatgatggaaatgccagcgcggggacaagtggcaacctgcatctgtcgagcgcaatttccgatacggctttcaacacatcgcagccagccatgtcttccttatcttcgagagatcgatctacactcgcacagccaccacgcggcactccgaatcactgcgacgttgttgagcaaaggcctctgctcctgtcttcctttctgagggctctcgtgctactcgcacaagatcagcttcttcacgaagaggcggtcaacgccaacgccgctccactggtcacttcaccgtggtgtccggcgccgaggaagtctgtagacgtcgctctctccagctttactgtctctctcttgcaattctatgagacgtgctctagcaacgtggggggcggcagccgaaaagagagtttaagcaatccgacgatgaagcgaaacagcagcatgtgcagtcgaagcggcagaaaaagaagcagtagtctcgcgagcagacgaagcagcctcagcaggaaaatggcctctccacagacgtttaagtcaccctctctcgacgccttcaaaccgttcacggatcccgagatcctgcaagcctttgcaccgctgcgaccttttttcgctcgtagatttgcctttgtgccccccgatgctggaccgagtttcacgggtgaactggagaaagcaagcaaaaccaagaaacaaccaccgggtgaaagtggtgagtttaaacctctcttctttctcatcctcgctccaaccgttcggcagggactgttccactctgtcaatcgactgctgctggattctcccgatcttcgtcgcagttgtgaaaatcagtgtccgcacatgcgtaagaccacttagatgatagcccagatgctttcacgtatctgaatccgtacttcctttcttttttcactggctggtagctttggtcaactgcgccgcaaacaagaacctccttccctttagccagaactcatcgcgatttgattgtagttttcgtgtttccgaaaatgtgcatctttgcaaactctctgcttgttcgagactttgaagagtatgtcgaggcctcacgacatccagtttcgtctgccttaacgaacgacaccgttgatctttctccagcggccacgatgtcgagaggtccgcgtatgacgggatctgtctacctccaagagttccttttgatgctgcgggtaagaggagtaatgggcatgacaccacaaccgtttgtatgcctactcatcctgcggttctcttgcccgcttttcgtctagcaactttcttctacctcttcatccgtctcttcttccggattgtggcacttcccctgcctcccagaactcgagggtaagaagagaagggaacacagcggagtccacaagaacgaacaagttgcatttcctgaaatcgacggtgccttgagaacgaaattcagtttttccgaggacgaaaaggaaatgaaatgcgcttcggcgtagggatcgaatagaactggttcacaatatcgacgtcttactctctttacggccgctttatgcagcgctgggggctcttgatatcgtctgcggaaacagaggctgcaaagcagatcctgcctgcagagccctccgcaccaacgacagaagaaggtaggttttatccgcgcagctctccaattttgaacgcgaaatcctcgtgtgcttagccatgaggtcgactgttgagagcagagctgtgccgaaaataccgaggtcgtttgctgaatgcactcgacattgccaatgagtatgatccctactatcgtgttgagagtagtcttcgtcgcgacagaattagttcgaagcgtttgctgggaagtgtattctacgagttggtcttctcgttcagatcctgaagttgtttgtctaccggatcaaaggtctgtgatgttagcacagcagagttaagagaacggttattgtagaaatagcaccgatagaacgccatgcatgagtacgacagagaaatcagggcaacctgagatcgttcttagcaagacaatgtgcgtagttagagatgtttcgcatctaatgtgtagttttctattgctatgaatacgagaggtaaaacactagtccatgcattacgcatacaacataaccgatacgaataacctcaatggtggaaaatatggaaagccaagggcctacctcgaacacaactcttcggtctggtctcttccggtgatgtgtaggatgagacgcatttcccttcgtgtgcccttcagtcatcgacccgcctcatgtctcccaacaggtttcgtgaaagctgtgaaacataaccaagtgtaagatgtgcgtgcatacttcatttggcatggaccggctccatttttcgttttctagaacaaccgtctccgtcgacagaacactcaactcttcagccggccgattctgaaaagacagcgggagcatcgggaggtcctttccaaccatcgcgagcgcagcgaacaagccccctttcggaggctcctggtgttgtcggtcgatgtgagaaatcacggcgacgactcagcgtgactgcgggatccccagacgctaagacggtgagaagtgagaacccgcagaaacataatgcggtaaaacgaccaaagcgaaatgtcgcaattcgcaggctgtctcgtcttctgcaagaggtcaacggggaccagacgagtagctatttgctcccgtctcgaacagggtgaagaggtcttttcagatctcagaacggagacaaagggccgatgcatgcacatgagcgcgtctctcaggactgtgttcgcattcaagactctaatctcaagcgaggctcttggtgtgggcctccacctcaatcttgtttcggttgagagaacagtcttctgtctacgtcccatccggttatgcagatgaggaaacgaggaatgtttgctgcactgtcgaaatgctaaggcgctgggatgcgtttgcataggtcggtttttctagatccacactgaacgggtgaagaaaaa

SEQ ID NO: 1367 - DNA, 3737 bp, Toxoplasma gondii
tgacagagcagagatgaaacagagacaggacgagaacctttccttccgaagctctctcgtcatggcgcgcggccactcttcgaacggaaagcaggtttcagatggtctacaggtaaaccaaacttgggttcttcagaaagctagagcacgtgaaatggccgagaaaagtccaaacggtttaggttccggtttccgacaagccacggcgaaacacctgcgacacgcacgggagtttgccagcatttctgtcgtaaaacatgtcaacgcaatgtcatttacgatggaacttatttgattcgcagaacaacagacgactacgtccgccgtgcaattatcatcatatattcacgttggcagtctccttcctaatattcgtctgtacggcatatacacggatcgaactcctggtggagtgtcgaggctcagaaagactgggacgacagcgagaagaagccagagaaaaaacgtaagattgaagcacagacacgcatgcagttgagagatccccggtaggtgagctaatagtcacatttcaaaggtacatccaggaaaagctctggtgttttccatggacggagctatcacagcagattatcgtcactaagcgtgcggtctcgactgagaggtggaagcaagacacgaaagagtgtacatgttcttcaatgccgtcacagaggcacaagcagaagcgaatagaagtgaagtggaaaacaaaaagacttcgtaaaacgaggcggaacatccacacagaaagcagcaaagcacggcaaaagacccggcaccgcaggcatcctgaaaaaacaattcctcccctgtcacagcccctgggaggaattcggtcccagatacgtgtgtatgcatgcaaatgccataggaagatgattctggaagagtaagccactggaaactagaaaaacggcaagtgttcgaagaaaagaaacgagagcggcttctcgctgcgcctctctgcggcgcgcccgcctgtggagcaggaaaggccgtcaaaggaaggaaagcgggggtattctatgggggaaaaacgtgaaaatacacagcgccaatcgaggagacaaaaaggcgcggtgaatctcgaggcagccctctcgaaaacgcgacgaaggtgcaacttttgatgcggcaaagcgcagacacaggaaccgatcctagagaacttttcacttacatcgtactcttcatccattttgtcagccgcggagagacagacaggaagaccaagaggaatggggagagcaaagacacaaaggaaaaggtcgaaggagagtcggaacaaagaagaattttaaaagtgcacgaaaaggcaaccccttagtggctcggcctaacgtcctcgatacagcggtagtctctccgcgtaaagcagcagaaaattactaaaagcgtacatgcggagagacgtagatacgtctgcaaatttaaaactctgtaaacgaatctctgtcggccagatgagatttttcagcattaacccagatgtgtgagcagacacaacagctttccaggggttcgtatgcgctccaccaaccgaaggtttccactccccagaatgatcgtgtgtctcttgcctaaaaaaatggagaaatcactggttggaggatcttaaaccgtttctgggatgcaagcagcctgagaggtgaaccaatggctggttgccccgtcgaaatccaaagtaaaaggcaaatcctcctcgctgaactcatccggtgtgtctaggcaacgttcccttcacagaaggaaaaaaacgagggaggacaaaggggcggaacccgcgcatctcgctgttcatgcacacgcaccgagcttggcggtacctttttaggtaacaagagaagcagaggaaatggcgagaaaggtttgttgtcttcacttctgtaggaccgggatcacacggggaaaccctgtgtctgcctatatacaatgccacagttcggtacttaacacgcggtgtctggagggcttttcaccaagtaccaaaacagcagcgtaaatcctgtacattgtttctataagagcggaaacgtgcagagaggccacttcacttcatgaggtctccgcttcctaatgacgccatcattgtcgtaccaagtgctcggcaagaattacgtctgcgtagatcctcaagtgctgctgtcaacggcgaggaaacctactcctcgacggaaacagagttatatcccttgttgtcccgaacattgcaaaacgtgtaatatgcgaatgcctgtgtgtataagcatgtggatccagttgcacattgatcaacatcagtgcagttcatgagtataaacaagcacacccgaagtctgcttgtgcgtttttccaacttagacaggattctcccggtcaaatcgcagatgccagttttttacgagtgaacactgtgctcccaaagccgcaatagccaaagaaccacgtgtaccgtgttcactattcactacaaaagagtcagaaggtaagcagtaccatgcatcacaggccagccgggatgtttttccaatcgggtcagcaagatttggattactcgcaccggcacccactaccccagcgctcgacggtgaaagtgtttcttaagaaagcactttgcagtcactccagacctctactcgcattccatcaaaagcgaattccgtgcgctgccggatctcattctcttctttctactgccctcttcccggctccatatgagttgttcatgcacgaagatttttagtgaagctgtgattcccttctggtgttgacagcccgcatattttggtgccgctttttctacgtcactcgttctcgttcgttctgccgaagaacattgtggtctagcgcacatatcatcaggtgtgccgggacacgtggtcagtctcacaggaaagcaaacagtcatttcctccagtttcatgttctggctaacgtctatcgactggcaggacctctggaatactagacctggatgccgtcgatccttcccgtggtacgtgccatgttctacaccgaggtccgcaattccgcgcagtgcgccggtgtaaccttccgtttgggcgtttgtgttgtttatggttcttggaaatcttcaggagtgtcaaatgcacgttgcctcgaatcggtgagcaggagaaagctacccgttttgcggctgttgctgccgcgcaacacgattggaacatgctgtatcgacctagcgcacggagtgttggcgtccgtctcgaaggccgggttttccgtaagttttcactgcatctgttcttttcgcgagaggccgcttttcgagagctcgtcgacaggaaaatccctcattcgttccttcatctttttgcgacatgcgtgcagttcccggcatgcgccacggcattcatgccagcgtgccggtgtgttgaaattcacgtgctccaatctcacaccatggcaagctgtcttgcgccggtgagcgatgcgccagccgaaagatgattcttccctggtgaagcgcggcggggtgcagtttcccacttttgttccacttgcttccccgattcacgtcctacattgtccagtaactttcaatttcgtatgattttgtcgcgcatcatactaggtccgcaacgttccgccgttttcccttgcagcctcccgtcccttgtgcagccggtgcaatcgagcttgccgcgttccgcgcgcccgaagccagccgttgtcgcaatcgaggtcgagaccttgggaaaccctgcgcagaaaagcgaggaaacgagacaaaa

SEQ ID NO: 1368 - DNA, 2929 bp, Toxoplasma gondii
gcagtactacttcgaggctttcctggcttttctgaaggacatctgcgcccctggcgtcctcgcccgcggtctccgtcgcctccacttcttcgtcgcgcaccggctcctcatctgcaccgtctctcgaaacgctcgcttgctggctgacgagttgcgaaacaacttcaggggcgtcgtcttcggaatccgacaacgagctgggtgccgcagcgtctttcttcgcccctcctggctccccgcggagtcctccgccgcgctggggggggacgcatgcggctccgccctgtctgtgtgtctccgtcgggggcgccgacagtcgccacgcttcggagccgctcttctgctccgacgtttcctgcgttttgcgcggcgaccccgcaacttctctccataacagcgggcgttgcagggcctctatcagctggtgagttttaacgaaacagccggccgaagagtcggaggaaacaaccgacatcggtccgtccctcggatcgtcataagacgagaagccatgatgacgcggcagcctcaagagaaaaatctggaccggcttcgcagtccagtccctctgtctgtcgagaacggaggcgccggatggccctctgcacgccgagaaagacgagccgtttccgaggccggagggagacacctgagggtcgggagaggggcactcggacccggggggaggagagaggagactgcatgcagagccggactcagagcctcggcgatgagaaagccgagagaacgacggaaccggaaggcctgttttcgggtgagtcgcgatgtcgatccagagggcctcttttgcacaggcgaaacgcaccttaggagacttccccttcagagtttcagcggagaccgtctgtccagcgtctgttcgaagggtgtcttcactcgcgttcgagttctgctccgacaaactgtgcttttctaggatgcgatatgacatctctgaacgcgcgatctcgccaggctcggtgacagataaggaacaagaggcttctggagcgtctgtgttgtctctgccccgccaccagcctaaaattcttaacgggggagagacacgagcctccgtgctgccctttcgttcagcactacacattcctggtcgaggtccgcgcatgctgttgcgtaggggtctactcctctgaggtgcctccactctccctccgacggtgttgccaggcgttgcaggtccgccagccaaggcgacactctcggcttcatgctcatctccagatccatctccttcgcactctgcatcggcgtctctctcctcctcaagaacgtcggtcatccccgtgctctgcgtcaaagagctggacgagcgcgcggtgagtttctccgagtctgcaaggaggcgcctggcaaccgcgagcggcaggggcgggagcagaacagccacgaccgcggtggaatcgcccagaatccaccccgctatccatcctgaagacgaagacagaaattctacgggaacgaagaggcgaaacgggtgggaagacacgttcattgtcgcgctggacgggtgctggacgcggacaggcgcctcgctcagaaagagggcagatacggcggaggaaccaagacaaaagagaagaggggggtcggacaggcgaaaaaaacggtagaggtgaagaagaggagaacgctagtgcattcgcactacaaaaaggggagggtcttggagacgaagcagacgacgcgcgagaaaacccccgaacgcctgggatcgtgacgaagagcctcgtctaagccaactggccgggccgcgaggacggttggaaaaaacgcacgagccgtcttcatgggaaacgaacagacaacgggcaaaaacgcatcttcatttcacctcgagatggagtaggaaaccgctctcgcgttctttcacgtggcgcagaaacctgcgatacacacggaagcacggctgtgaggtacgcggtggaaaggcgtgagagaaggggggacgccgccgaacagaagcgcgaggaaagctgcaaaacgaatttctctgaaacagagacgtagggacaaacatcccgacggtcaaactgtgaagacaaccgcgtacacgctcgcaagacggggtccgctgtgcctgtcgatgtgacttctgcatgcgcgcgagatgcatgcacactcttcacagggtaacggaaatgcaagaggagcccagagcctcgtcctcctgcattttcccgtctcattcgcctttgacaaagtccttcaacccaaaacctcctcaactgcatctgtccccgagtctcagctccctctgccatctcggttcgagtgtctccacgcagccctctgacacgacgcggtcgaccaagctgtgcccagagggaaactcgaaaattctgggtccaaatttctcggaccctccaatgcgtttccgcttttctctcagcggaattctagccgcttcgcgctgttcaacagagcctgtttctctcctttccgagagtgcccagcgcaggagccttctgccttttaaagccccgacttcgcctgctctcgttagcgctttgtccttcctctcgttagcgccgacttgtgcctctctttctcattcgctgttgatcgtttcttcagttccatgcacttgttcatacaggattcagggtgtttgagtctgcctctctctccggtggcatccatcacattaagctgattttgtctgctccgctatcgacctcgcgagcgccgcctgcttcgtggcaacttcattccttccttgttaatccccccctcgttttccaagactttccactcccatcgcatgcagaaaaacgttctgtcgttgctgcttcctcccccgtcgcctgtacatttgtcgcgctccttcaggacacccggaacgaggtcgcctcgaagaggaaggggagagtcgtctgcctctgaaggcgattttttctgtcaagcgcga

SEQ ID NO: 1369 - DNA, 3200 bp, Toxoplasma gondii
agcaatcgagtcggctgaagaagacgaagatgaggaacaatacgaagcagaagagaagagagacgacgccgatgggcaagaagaggcaggcgagggtgacggaaaggaggaggaaaaagaagaagaggcagaggaggggtgagaaggcgcaaagtcggacatctgtgaggtgtgtacggatgaagaggagacccagattccattacaaaaacgacgaccccgtcggttcccgtggttctaggaagcatccaggacataagccgaaagaggagtggtggctggagcggtttgcgacgaagcgagagaaactgaacgaagtgtagagacacctcagttcagtgtgcgaagaacgagaggctcactgtgtaaagaagttctccccacgagcaatgcggatataggtttacaagcatgatggtgtttggagaaaaaccgcggccgaaagacaattcccagtgccgctgaagcgaaaagacgaagaaacggaagaacggattcggctgtttcgcattctcttcacttctgagagttaaactgtcgcctgtatcggagtattttgacgaatttgagggacgcagaaaagaagcacatggaggccctgtgcctcaccggtcccttctgtcgagatcaaagcatcgcgacattggtgtttagcaggccgaagaagatttcagagtctgcagaggcattcttcgaccctttactttcctgcctctcgccttcttacgaagaggaactctgtcagcacatgccgcttagcgacacacagcggaaagagaaacatttgcagagagatgggagccttcctctgcttcttgatgtccctttcgcgttcgataaaagtcaagaatgtcttgaccactagaagccgccgacgcggtaagacaactgggcgacgttccgccttctatgttcgccgtactcgaagaaaagaggtattcaccctggcgaagacgtaaagaggagcacacttggagtcataaggaacgaattcaatttctagtcggtctacagacgcgaaaatctgctagcatttctgcattttcgcgtgcatgcccccctctcatgtcgcagtgcatgcgctgatggtgagctgtcggcctggaactgtttgccacgacccctcgcttatccagaaagcggtgtggcgtgcgcttcggttgaattgttagcaaagccatggcatgcagactgtctcctagtgttcctctattttaggctgtctaagattcgtggcaaggagcgacgactgtacagacacccggaacccatgtgacagactgggcgcctctgctgccgtagacctcacgccggaaacaacgaatccgactaagctagttggccctgaaattcggagaaaacgttaggttctttagatgaaatttatgttgggttaaacgaagggtcgcggtgtattcactactgcaagtctgacacattcttgagaagcgacgtcgatcgttggtaaacagaaaaacgacgacacgcacaggtgtttcatttctatacacagcgaaggaacttcgagagttgaaatgtatttgacagcgagtgtcaattcgttctttagagcacttcgttgatgtctgctataaacggcggtggtcagattcctctattcatataaaagacactcttggtgtctcttggagagtttacccacaagcacaccccatgttgcggacagaaggtaaacatggttttctcaggctcaaatagttctgtgtaaatgcgtgtgcaattgcttttgtgtgcaaccgacaggcgagtgatcatgtgcgtcacagtggtagtcatcgttgtggagaccacgatccttgacggagcgttgcagaccactggaacggaaaatatggaactacttggaacaaaatgacaacaacacctgtggtacacatcacacgacagctctcagagacatttccgcattcccttccacccctacgtgtgcctctcatgagattactctcttgacgtaaggactgtataattacgggatcggtactaccttctgcagcaagtgttccgttcactttcctttacgttggtgaattaatttcggttcgtctatacaatcctattaaaacggacagatgtccaactgggaaccgaaagtggaggctcagcatatctcaccacgttgacacctgcggatgatcgcaaccttgacgaggacactaatgcttgcttgtggtgtgaggtatagctcctgcgatgtgtaactccgtaaaattaatgggctgcggtagaaccgtagcaaagctataatcacacagttcgtccctgtgacgcatttgctatcgacactgggctttatattctgtaccagctgatctagattcgtatcttcagcctccgacgtcccggttctgtagcaagcacgcaaacgcagccccgtttcggcgttccgattttcacgggtatatgcggagcaaccggcggcaggatcaacgcgcggtacgcttcacaatctacattattagtcattatggtaacctggtgattcaaggaaaaaaatgcattgaacaagagccgcttcatcgtgcgttttggtaaaaccccttccaagtcgcggaaggttcagagacgccccagtcgtccgtttcgatcaaggccgtggtgttggcgaaaagagacgtgttattcgacgcagtctgttgaccggtcgagcgcatttgcatcgacgtccgctccctgtgcaagagcatcttcgcgtgtacttctgttctaacgccgatccgggcgtctctttgttttccttggagttccctctgagccgctagtagtctcctgtgccaggctggagagacgcagaaacttagatccagaacatcacatagtgattgcagttcgtttcctcaatttacgtcggaaagtcctaacttttgcgttacgctaactgtgtgaaaattcagtgaccgtagcttgggaagacgtcgtcacacgcgacggcgtgactccgaatgctctctgtcgctgtctttcggatcgatttgtctggtgtgcaggtgtatgtggaagaagagtttgaggctgtatgatttggggttgttttctgcgacacgtgtttggcctttccgtgctggtgtgggttcttgatgtagtttctgtttctcgtgagaccgtgaaaccaaaagcgcagtttcatctgcacagagtttgcaagagagagcctgtgttcttgtacagtcgtgtcacaa

SEQ ID NO: 1370 - DNA, 2942 bp, Toxoplasma gondii
cttcgaagccagtccttctccgtaggtcttgcgaaagcagcaaacggaggcaagaatggaggagaaagagcagaagacagtgaacaagcgcgagaagaagagcgagaggaagaagagtaagacgaagaagaacgagaaaacggagaagaaaagaggtcgcgttgtgcttcatcttgcgtcgcaggacgtccacagcaggagcaccgaaggacgaggaccgactctgaatcgctgtcgggaagagaggaaattgctccgtcgctcgcagcctctgccactcgcgctcccagaaaacgggaacggcttcctcgcctcgctcggagcgttggagacgactcacggatggagccgcgagactcgggaggaaaaagagacaaagcctggacagaagcagagacaggagatacgtccctctccgcgcctcgccttccgctagtgctctgcggcttctgcctctcgacttcgctgcagctgcttgacggtttcgtctgtgaactcctgcgacgaaaagacaccggtttcttttcctccgtctctctcgcctctctcttcgcctctctcttcgcctgcgcccctggcagctgcacgcgcttggtgcctggacgaaacgcagcggagagagaacgaaagacctctccgcctttcgaggttccctttgcctggtggcctcggttctcaaacaagctctctcgaacgtgagcctcccttgctcccctctccgctggcatctttctcttctctctctcctggcctctaggcgcgtcacactcgttgggctcgtctctcctgggtcctcgccgtctcgcgccttctgccgcgtctctgctccctctcctctctctcctctctcttcgctctcttctttctcttctctctcgtgcgtcttcctctgttatgtctcgccattcttcgtcggactccacaagcagcgtcggtttttcttgtgtccccgccttagtcgctgtcgctgcgactgtctgcttcctctctggcgagaagtccgagcgatctgaagaggagagaagcagcgtcgcgtctgaggctccaggggcgccgccccacaaagaggccgtggcggccgcagtttgctgaacgcagggcgttcctattgagacgcatttcagttctcttctgttgaaggagacgcccaggtcctcgcggtcgtccccagaaagcagcaaacacacatctcgtttcttgcagagccgcgatggtgggcgaagcagatgcggcaggtccccatcgtcaccgaaggagtcgtcctccctctctcttcctccttcctcgccttcgcgctctttgccatctaatctttcgcgctggtctcctcgccttgcctctcgcgcatctgtgtgcatgcggtggcggacaggcgccgcgacagggccctcaggatcttctctgccgctcgccatctgcacagagatgcaagcttgtgccaatctcttttcttcctctctatcttctcctcttttcttcctctcaaccttctcctcttttcttcctctcaatcttctcctcttctcctcctctcaatcttctcctcgtttcttcctctcaatcttctcctcttttcttcctctcaatcttctcctcttttcttcctctcaatcttctcctcttttcttcctctcaaccttctcctcttttcttcctctcaacctcctcttctcttcctctcaatctgctcctcttctctgtcttgtcttcctcttggtctttttttctcgtcttcattcgcgagtcttccttcgacgctcctgctctcttctctcgttccgctcttttcgattctttctctctcttcttgcttgcgcggctgtctctgctctcttttgccagtggttcgccagggtgcacactgagaagacacgacgcggacgagcgcacggagtcgacggttgcgagcaacgcggggagggcgacgagaaccgagcgagaggagagagagacaaagaaggtcccctcctctggggagggagaagaaaaagtttttcttcgacggcgagaaaagcgcgccgaccagtgcagcagcgccgagcaaacctggaaaaagcgtcgcatgcagcgaactgaaaaaagagtcactggaaaaagagcgttccctccgaagagagcagagagggagagagagtccttcactttgataaagaagacaatcggcgatacagagaaacgcgcgttcgctcttttttcgaagaaaaactctcattctttggtttcgccgtcctctcttctcctcccccgcgccgaaacgatcgaagaacgatatcttcggagaccgtcgactttcctctcttctttcgtattttcgtatccgtcactcgtctctttctcccaagtttttgatttgcttctctctctcctttttcgcacattatctggaatctcgagaacgcgcgcgcctatcctcatttcacaccctcacttcaacttcttctgttctgtctcttcctgtctcggcttcgggcgtcgtctgtcgttgcttcccctctttcttcttctgcagcttccgatctccagcgtcttggcgctttccgtttctccggagagtctttctgcgtgctaggtgtcttttccgccgaaacttgcgcctcgtcgctgacgaacagcaactgtccatctttttcacttacgaatcttctgagaagcgacttcttcttgttctctgtgcctcgctgctatcttcggagcctctcttttgccaggagagaaaaacggcagagcagaagaactcgaagagaagaaggggaggagaaaagaagagcagcagaagagaaggagggaagaaggagagaaaagaccagagagaggtggagacggaggagaaaaagagaacaaagcggagatggagacgaggagtcggtggagagaagtatccgcgttggaagcagggactcttgcctgagagaacggtttctgctcccgttgcgacggaacga

SEQ ID NO: 1371 - DNA, 2622 bp, Toxoplasma gondii
aagcagagaacgacgaagcgacacaactgagcaccacagaaatgctcgtcgaagcgagcggcgtaaagggctgcgggttcgtgcttttgccctctgcccctgttactcccttcttctctttgttgtccgaacctctcgtgtgtcgcgacatcctttcgtctctcctttcctgtaaggacacgctcaacgtggacgaaatggtgcccaagcacatcatgcagggactggaggaagtggaagagtttcaaagggtgataaatgctccatatgaacagctcgataaactcgggatatcagtcactcccgaagccgaagacgagcttccggtgaactaggtttcaagcaggaggcgacggcggtcctgacaagcaccaccttgctgtgttgggaaccgccaaacccgaggaggcgaaccctggcaaagtgccacgctcgactggccctccgtagtgtcctgtatgtttgacgatgtttgtatatgattagctttttgtgtttagagcgtcagcagtgtcgcaacacatgtgtgagagttcaaagtgtaaaattacctgtcggaatgcaaaaggtaatgtaagcaaatgaagatgaaagcagcgcttgactgcatgtatttacgccgaaatctactcagtgtgtgagctcaggatccacaatcgggtggtagctctgagttcgatagtagccagcggcgttgtaatgtgttgacagaaatggcagaggctcgtgagataagactggagagacccggctggcagttatattaacgttcgtgtgtccgtgtgttgcggctatccggcctccccgtctccacctggcggtgatgtattcgcatcagactgctgaccggtttcgagaggcttaacttcgtctctaatcggtttcagttcccataactgacggtactagggtttcctaccactggatcgcttcccctcgtggcagcggattaatttttcttaatagtcggtgtatagtgctacagttcgtagaagtgtgtttgagagacgccacctgctgcggaaccagtctgcattgaaactgtgtcgcgttgcggtcttgtacatcagcgagtaactggatatacgagggcacaagtcacacgggtagttcggaagaacatgtccggagaggttgcgacctgtgtgcttcggatgaatgccccaatcaacccgctggcgtttcctttgtttggcataaccaagtatgaaaatcaacactatctggcagcaagcaagattagatggactaggttcaccattgccgctgccgcattaaataatgtccacgaagaggcaacagttgaggcgaaagcggggcactcggcttccgaggtaatggcccaatttccggaggaacctatcttgtgttcggctccatgaagtcccttgaactcttattggcactagctgcaatagccgacacagtggccagtgctgcgagcgaaaagcccagaaccagataaggttccaaatcctttcagttgctacgagccatgaagaccttctgagtcagtgaatcgagagagagcttgtgtgctgaagacaatcaagtattgctactctaaagtgagctgcttcgtggcccggtggtccgtgcgaaccacagcacagtgcgttgtggccgaagaggtttctccgtttttagttgacatgggaaagtgccacgtcctgcaacttccaatctgttcctggtctcctacactaagcattaccacatagaaacaaaatagagcacgaaatcttaaacgcatttccacgcaagccgcaggcatggtctgctcgcttctcttctgcctgcgctacttgactaagaagacagaagatagcgtaaccattcctgaagaatcttgatttgctgcagaattagaattaagttactttcacatgttcaggtgtttttctcctggaaagttccttttttttcctacacaccggacattttctgggtcacttgaccggctctcccggtctggtcgcctgtctgtttgtgtgatcatgcatcgtgccaagaaaacggatgtctctcgtgcgtctttttgggtagagggtcgcctacgaatgtgagaagcgtgtgtggacgtggtggcgtccacaaattatcgctgaacaggaaccctatcttttttaatggttaaaacggtagtgtaccaagcgcgatgacaaaggccgccgtccttttcggctggtgcacgaatcaatcatcataaatcgtatccaagggtgacagggtgacagcgcaactccggaatgcggcaatcagcgagttggcagccgcaaattttttttgccttgcttcctcggcaacgtacctgctgccgaatgcacgttttcctggcatgtgtacaactttttcttccacttcaaaagccttgaggcctcctaaaggaccactgtacatatgccgatcacgagaaacgtaggcagactcatactggatcagaggtactgataggatgagacagtaatgattcgtgtataaagggcgctgtcgagctgcgtgaaagatagccgtaggaggagaggggcagatgtcgttttggtgtctgcagttcttccaaggtttgattcacttgtgcacgtgttccaagtatttcaaacagaggggcgatcggtagtctca

SEQ ID NO: 1372 - DNA, 1850 bp, Toxoplasma gondii
aggtttctccaactgcacaacttttagccaagaacggtctcagattagtgccctgattgtcttggtgtgtttgtacacggggttcagtcctttctatttcagagaagcactttaaatcttggaacatttgaaagaaacggatttttcagggtctccttccacccagttacgcgtcatttgaaagaatggactcacagtttcgttgtctgtgcattcccagtgccttggtatttgctctggaggtgctgcagttgagcttggatgctgaatcggtcatatcctgccatcttttctccgctgtaacgaacactccaggaaagattctgaacgcaagtcccccgagacctcgcgtcggatcacagagctttttcgtctcgtcctccttcctcttcagtctcggacttgaaaaaaacgaaccgacgagtgagaaaaggcgcttcctgcagcttcagccttttctttctacgcagaagaggggagatgagacaacaactactcgagattagaaaagcaagtgcagaaacgagggatttgtagacgacagaaaggtgttgagcgagtaggaagccaacgtttcgaagacccgtgggaagcgcgttttgagaaaccggttgagaggaacgagaagagacgaaaggagctcgggagaagacgcaagtggaaatcgagcaaacaaagagttagacaaaatgtggcgtctatacggaggaacggagaaaaccggagcaaaaagatcaggaaaccaagcacgaagacggggcggccgcggcggaaccgtcacggaggtcgagaagtgaagcggtgtgcccttctgaactgtcaaagacgacagaggagttcttcaagcaatggaaagtctctaagatactttcacgcgtctcggctttcccaagaaaactggaaaacaaccgcctgattcaatcggtcgccctgaattcagtccctctctagacgcatgcaaggactcttggcgtcctagagtgttgcatcttcaagatcaacgtggaaagaaaagtccccgggggcaacaagctgtttgtcaaaacgactgacgaaaaggtcttgctgtttcctgcaaatgcagtgaaaacgcgcgccactgaaaaacgaagccgagaggtgacttttcttcgtcttttatccgcatgcttgcgccaccacccggcgtttcaaatcgagaaagcagctgttgttgtctcggcgtgtgcacggccggaaagatggaaagcggccggagtactgaggtaaattctcatgagacgaatgctcgattcatccattgtgaaatccggaagaaacgcggtgatttcggacacacacccaagacaaggacagtccgcgtccacgtccttggacgtacagtaatgttcgcgtatatgcgcgacactcgagtcacgcgaatttgctttaacgttgcgactttgcgtggggatctctgttgccgttgatccctctcctctggtttgctgcatttcgtttctagagcacagatttctccgacccgtccttgctggccgagttcagtttctcagagaccacgggcccacacgtacgatgccattttgacggtggttttgtcgctttttcaagggcttggaactgttccacatcgcgctgctgttccgagcgaatctttgctttgccttctccagaccacccctgattgtcagctccccaggaagctgccgcctccgtgtctcccgtgtctcaagcagaagcgagagatctggtttctgcacagttgacttctcacctgtggtggcctgccagagctctggactgtcgtgcaatttccacttttcttctacttctgtctcttctcgcgttctcttctttttctgcctaaaaga

SEQ ID NO: 1373 - DNA, 1785 bp, Toxoplasma gondii
ctggcggcttgttagtttcttcacgtagcggcaaagaaggccattccccgacatctctccgtcagtcgcgcgcatcagccccgcctctggggagcacacgtcctccccgctcccacctgtccctcgagtccagttgctgatgaggcgcagggtgcatacagctgaactcagatgccgagcgagcacagtgctcgaccgcttttcgtgacgagcccgcgacccgcgatgacgaaccagccgccaaccgccccttcgtcatcgcgctgtctctacaccctagctctcacctgcaatggtgtggatgcgcttgacaagttcggggtcggcgggagggcggacgggttgcggcagcccataccccacggtgtgctcgtaccccccggggtgactcgggtacgctccctgctgcgagtagaaattgtttgcaatcgaactcccgtctcggtaacccgcattgggtgggctgtagacgacgggcgcaggcggagtgccgtggtactgctggctgtagtccagacttccttgacctgtgccgtagtagccgcctccaggcgtctgcgagtaactggaacccgccgcagaagcttgctggccatagttcatgccttgctgagagaaatctctgccctgctgaccgtacggactcgccgagtgcgcgtaaggcgtctgcgacggcgtctgcatgtagtcgcacgcgttttgtgcgtacatctgatgctgctgattgtagttttgcgggtcgtagctcggctgtacgtactgcccagtactcccgccagccgaccccagggagtagccggcacttccagggggtgtctgctgcattcctgtgccgcacggagacggcgtggctggccacatggtgcacgaatggcgaggaagcagtaggagcggcaaaatgacaagaaacaccagactggctaaggatcgaaactcacgtcgcgcgtaggaagaaacgccgggaaaagaagacgcgctgcagcgccaacctattcgcgcaagcaccagagggaggaccgcagaccttcgtctgcccggaaaaatcctgtgatgccgccctccaaccgagagaaccgcggatcctagtcttgatgaaaaatgcggaaaagcagatgcgcgggatctaagagaaaaggggatgaagagaaacggtgccgggagcgaccacgactgcagtccgcatgcgacggacagcagcgaaggggcagaacatctggagggtcacggccgtccacaggaggaaagcgtggaaccaccgttgttggcttcccgagggaagaatctgacgaggcaatgaacatgaaaaggcacccgcaaaaacggcgctttggacgaacccactagaaaaggcagactttctcgcgagtcgatgttccgccggggcagcacatgcagccgctccccgctttttcgcgtcgacacattgcttagccaacagcttttccacagaccgcaccagtgttggtatcggaaacacgaccacggcgcatggccgccgcacagaacacgggccccccctgcgcatctccgtggctctcgaagaagtcgaccgcgaaagaacgcaattcaaggagaaaagaagcgagaggagtgtgtacgtttttctctctgaatcgcacttgattcttgagtgtctctctgtctctctcttctgtgtgcgccgtaccacgaaactccggttaacttgcttcgctcgagcttctgggtggatctctgtgcgtggcaggcggagacagcgaagccgcacggtggcgcacgcttcaactactcgctcccaagcagcaa

SEQ ID NO: 1374 - DNA, 1736 bp, Toxoplasma gondii
aagacatgaacgcctcccttacagacagagaagtgcgttgggttcaggctgaaagaagagacgcggggtgaaggtgatgtccaccgcggcagccgccaaggagagaccctgtgagaagccgaggcggtggtgacagcacggagaacgggccaaaggactacgccaggcgagagcggattgagcgacaactggcgctctggcggcttgtctgtccgttggtggggagaggaggaaacagaagactctgaggaacttggcagagctcttctccatttgaaacaatgaggcacgcgtacaacaggagaaggagagagagatctgtgagaggaagaagagagaaatctgtgagaagaaggagggggagatctatgagaggaagcagacagcagtccctgagagggaggagagatagtgctgtgagaggaaggagagaaaggcagggatggagacgcagcagagaggagggaggaccgacaccggaaagaaggcagacggcgagatgacgcaggtgaagaggaaagagaagagaagtgacggcgacagggaaaggtcggacgaacgaagcaagaaggggaggggagagagcgacgagatgtcgcaaaggcgaaagacgagagacaacgcgtaggcagggatcttcgtcgcctgaatctctcggtagtcttccagaagcggcagcacgagaggtccacagaggcgagcagggagaccgactctgtcgtgtaagcgaaaggggaacccattttgacacactacgaaggagctgttctccgacgacgagagaaagagacgaatcggggaagctggaaacgggaggaagccaacgacaagaaaacacaaatcaaacaagaaagtggaaggaaaagagtcagatgaccagatccacacgcgcccctcgaccaacgcccaatctgggtaaaggtgcgcccggaatttcgggtgtacatacaccccacgcgaaagcggacagacggacggaagaacaaatcgaagaagaacgtcgtctttctgccaagaactcagcagaagcggccacgcttttgagaggagacgaggaggaaagcctgaccttttcttgcatgcagtttgtgtcttccaagtttgcggggacgaggcgccggctcgaaacaccggctgcgattcacgatcacgtttcttcgattttcttttgcaggcgggatggcaactcaccggaagacttgtttcctttcagatgtgtcgctgttgactctccactttctctcctgatctggcttctcttgtctcccgcttctgaacagcatgcgatacactggggtggatatacttcgcaagctggcgtcgcgctttgacctgggtcgagacgtttttcgtcgacttgtgattcgcttcttccgggcttgtggagctccttgcctttattgtgtgtgcatttttgtccattttcagtttcttttcctcccagagatgcccaacgaattacctcgcgtctgagtctctccagccacagtcccgctgcagcccttcgtcttcagttctcttaaaaattcccggctttcgtattcaactttcttgttcacttgcctctctcttctttgtctctgcgcgtattcgtcctcgctactgatcgtttccccacctttacaaacagttgccgctcctcaattccgtctccttgatctccttatccctcgtcttctccgtctctgccaccgcctgcttcatctcattgtctgtttcttcttctctattcaaga

SEQ ID NO: 1375 - DNA, 2411 bp, Toxoplasma gondii
aaggaagagaagttgtaaacgaaggctcgatgacacgaaatgccacttgctttccctcggcgagagagaggagactctcgccgccggccgtgcgggagaagtgcggcaaagaagaaaggacgcagaagaaaaaaacgagagcagcgcgcaaggcgaagcgcagcgaggccgaccgcgagcgaggtggagacctccccgaggcgaaaaagtatttggaacgccccatgtttttatagagacaaaacagaggaaagatgccaagagaagagcgctagcaaagaggggcgcgaaagatgggggagaagccccgaaaggagaggataagcatgggaaagagatctgggaagacaattgcaggcaaaaagagaaagcgtaagagtaccaaacgcgaaatgagacgagaagacagagagagaatttggagagcaacaaccgagacgacggggaagacactcgaagaggagcgacaaagggaacaaaactgagaaggattcggtgtggaaggcaagatgataagaagagagtcgggtttgtccgagaacgagacacacgcgactttacacttgtcacgtttgctttctgacgacgcgttttctcttccgttcctcatcgagtgcatcgttccatgctgcttttatcccttctgcttctgcatcttacttggaacgcgaaagcacctgtggctgtgtcgaaatggatcgaaccgatcaccatgcattgacatcgaaataccacgaggcatacggggaaacagcaaaagggcacctggtacagcaaggaagcctctcagagtcatcccctctcccccaacaatgcggcctcgcttgttccctctcgagagtcgcaggccctcggcagtctttgtgcttccttccctccgtcgttcacacacgactctcaacagagagtcttcgatgagatgcagcgaaagactcagaaaaaacaagaaagtcctgcacacgcgggaccgaaggaaacgaagctcacgacagcgcaaaaaaagagatctgcggaaggtcgacgagacgaacttagggtctggacaggagcaagcgtcggactcaaggaaagacgcacccaatgctttcacaaggtggagaacctgtacccacgtgaaagagatttagagaatggtggaacatatccgaggagttcgagtcacctggtcaccaagagacagctcttctgctgccggaattatttccatggtcgccatattctgcataatcgacgcacgcctgtgtcgtgtctgagattagacggagagaaattgcagagaagaaacgggagactttctttcctagaaacaagggcaaaagaattggaactggacgaactggacgagaggagacagggcgcttcaaagcaacgcagtgcggccgccgcgtctcgtgcggatgaggtagtctcgacaaagaagggcgtctgttcgccctcctgaagacgataacggaaacaaactattcaacagatccattcctttgaatctgaagcggtgaaaaagagatctctggaacaacgcgtcggcgatggcgtacgtaatcgagcgaagacaaacgacgctgaagcttcgcatgcgcgctgaaacaccgctggcgggtgggtacatgcagtttagagactcgggtcttatccagaagccgaccggctcctgcacaagtctcctttcctctgaaatgtgttaagaatgaaagacagaatcaaaacaccacagggtcagctcggatgtcttctctgccaagaccagatccagcaaacgcatgcgggcgcagtcgtgtaccgtgagccagaagacgtggtgagaccagcacagcagaagactctagtgctcttggcagatttgcatcgggttgacaccaaggtcgaaagctgcgtcgagtgttcgcttgcttcgtgttaaaacggtgcgagtgtgcaccaggtgtcgggggccgatctctcgagcagccttccggcctccgagacgtccggggtttccggccggtttttcacggaaccgcttcgcgtccagcgcctccttaagtggccaaaactcgctcttcggtattccctcagggaattatgggcccttggaggtagagatgcggtattccccgtttcgtgagtggtttcctgctgcgctgcggccgccatgctgatcgccagtgcgccagacgccctgcgaaagcttgcgtcgttcaggtgtatgtccacttgcgcagaaccggttccttcatgaaacctgtcacacttttgcattccattgaaaatcgctttctccgaactcgcccgtggaaagtcccgttcgtcccgttccaatgacgacgcgggttcgccttggtgaccgcgtcttctgtttttgagccggttcggcgtcgtgccgcaggtgccgcgtccacttgcccaagcttccaagaccggggtggtcgtca

SEQ ID NO: 1376 - DNA, 1689 bp, Toxoplasma gondii
gaactgtttgccgcttcaaacacaggatcacttcaaccacacagttgtatatatatatatatatatatatatatatatatatatatatcaatatatatatatatatatctacatgtatatatatatatatatgttataaacatatatagttttctatagatatatgtttataaaagtggtgtgtatagtcatatatggacatttagctatggtgtgcactgtatgaacccgtatgcatatattgcctcgatgttggagagagacgcagtttcgtggcggtgcagttgagcgtgggttgttggtagcatctctctggaggaaggggtgcagagctcgtcgctttcgactggttgagttgggcactaaaagtgaaaacgaaacgtaaccgattttcgcgaacagtcgcgttcgaggaggctttttcggaactacagagggggctccatgtttctgggtttcaccacactggcctcttgatatatacacgggtctcctcactacacattccttataaaagtaggccaccagactacagcgtctttgcatgaatccaccccacggtacattctctctaccggtctacggtatcacactatacgctctacgcacgtctgagtgaccaaggaatactctttgtcaacctctaggtacgatgatgccatttacacttctggtttctgtaacggaccaccgttctatctcacatcccgaaactctctctgtgtgtctctacgcgagcagagggccctttttacttaaaggaagttggtagtgaggagacagagctctctcgaccatcttggttctgttttgtttccatcatgtctgggatcgatggcaatcgccgaggagacgctgaaaacgcggctgttccctggttcaaacgcagcgaggaagacatcgaatggattttcgcagacccccctaccactgaagaaggttccacagatcccgctctctttggcgcgttaaacgcttcactctgtcgtgtccaagtgcacccagaactcgtcgcctgttcaccaacaaaactcattttctctcgcgaaaagcacaagcgctcgcggcagctcccgctgcccttttcggccgagtcgggaggtgtatatacacaccggatcggccgagcattctcgggactgtttctgcggccgttccctcgattctgcagcattttctttgattgttccacgacgacatggagttcaagcgcctcacctccagacgaggcgattgacctcagcctccagtcaaaatcccggggtaaatgcatgcagggtgtcttttcgtatctcaaacctgtgccgcggtggagttatgctttggagaatagtgtgcaaagttcgttgcatcgagcttcaaggacctctccggcgaaggaatggcacactgcgagagaggggaagaaagctgaaaagataagagttcctgtttcaccaaccgcttctctctttggtggctgcgcgcccgcggggctttcccagccgactcatggacctgagtgactctcctccggatttttttcgtatgcggtcggcttgtctccctctggaatgtctccacttcctcgcgcgtgacttcttcgcccacacccgtctcacttctacttctctgaacaccaatcgtattcctcttcccctcgaagccttccgtctctcgctcttactcccagtgagtccgccttcacca

SEQ ID NO: 1377 - DNA, 3843 bp, Toxoplasma gondii
gtcgtcgtccaggaagcctgagttttgtccacctaatcttgccttctctcgctcggcttctccatcgtcgccctcctggtcacgctttctctttttcttcttctccttcttctccttcttctccttctttctcttcttcttttccttcttcagacggcgcgcctcctccctggacacctcgcgctccgtaccccccagttctatctcgtcgcgttcgtctccgaaaaggccactggggggttcgtggcttcgcgtctccacatcgccttctctctccgctctctcttcttgtaggtcttccggattgacgtcaccggtcggagtcttgttcaagaaatcttcttcgtcagttaggctctccatgccgccattggcactttctggaaatggtctgggtgactctcctgcatttgccctgagggcatctccctcgtctcccgcgtccgccatactcgagacgcgtcacgaacgcttagggcaagagattccggaaaaaaacgaggtccgaggagaagtgagagacacgccaacaaaaaaaacgccaccctaggaccgtttcaggtcactactggaaagtagaagaaaacacgtgcgcattcacatacctacatatatatatatatatatatatagggagagagagagagacagagttagctgcgcatctgtctgtttatacgtctgcagatgcgcagccaggcagaggtgtactttagcgtatcaatgtacgtgagagatgtaggacgagacgattgaattgaaaagtggataatatacatccgacacaactgtcctcctcccgctcggttgtggtttacagcttctcgggatcttttcgccagaacgctggtgaagaggcagtgaaagagttttgggggtagcttagagacgacaacatagcggatctggaacaatacgccgtgacaaaaattggtgagacaggcaagacgagaaattgggtgtctctgaagccgcgcagcgtctttcccaaagaacccccagagggatactttttcgtttggaaatcaggagccagacactttcgagaaaaaactcaaagaacttcgtcctccgaatccgaatgcccgacagagggaaaagcgatccttgcccggagacaaacggatcgaatgcacggccatacagaccgatgactggcgttggaaaaccgagagacgaaaaaaagagtgacagttacagcggcggtgaaggacaggtgagagttcttggttaaggacagcaccggttccactagttaaaaacagtaagaagcgaggaattcgcgtgtgtctgccgcggtgcatgcatgcatctcgtgcttcacctgaacgcagctgctcatgagtgtttagcggagagcgagaagccgctgcggtggaactgttggtccagtgaagcacgacagaaaaatgtatttcacgcccaagtatccttccattagcttcacccgcagacgcctgtactcctacaaacgaagaggatcagcgtttctacggagggcgccgattgaacgctcgttgcaagataagtccggaaaacgaccagttcccactggaaacgtctacagatataccattagctaacatttatatttatatatgtagatggtataaggtttataaatccatcgagttttctcggtcaaggtcttctcgcacctcgtaacaaagcaacgtcggcactctctttaggtagatacgctctctctctctctctcatatatatatatatatatatatatattgccctttcaacagagaactacgggatgttttggggcgtatcaaacaaaactcactagccactatactgtacgaaaagtatcagcttatagctcgtatgagcataaagtagaccagtggagacagagacacgccgatcaattgttcaaagcccccccttacagctggctacttcacctcagtacagatgtcagttcgccaactttcgttcggacaacaggtgcaacgggtcgttgacaattctttttcctgaaagagagcggctgcactgaaccccgactgggcacgacgcatttcttcgctctgatctcagcataattgacctcgtgcctgttacgtgttacagccaaaactggccccgaaaaaatgaatccaggattcagctggcatcgacgaagcgctgattcactcatcggtcctacttgaatgaaaatgatgagctcttcacactgctcaaatgaaacggtaatgatgtgctgacacctaacacgatgtcaacgattggcttaagttgccacaggaagtcgtcgagtgcactgtaagaggttctagcagtagagcagcatcgttggcgtcttgagtgcgcctctagccaccgcgatatacaatgtgatttgggatgtgggtcagcggattccaacctcaacttgtgaaatatgtgcggtggacatgtagcactgccgtaggccacatacagctccagtgaagctctcctgatatggtgagcgcgtttcgttgttatgcctagtcgccggaatatccctatgaagacgcatgttacggctgccaccacagtctttacggtcttagcatctgaagaaagacaaactacgtagtgtttctgcgtagattgccccatccgcacgttacgactgtcttactgccttgcaatcgaagtcgtctgcgcacagcaaataaccatctaagaggttttcattcatgcacaatgcccgtggatgaaacgaatgacaaaggatcggttacccgaaaccgaacgtcgtggctatgtggtttccagctgctcgtgtgggcaatcgcgttcgcgcggcttctacaatcacgttatctgcgtctcggtcgatccgacctgtttttgagcttttcagattttttgacgaatcgtcatcgtccgtggaattcgagtttttgaagaggatgaccgacaagagctcatttcttgttttactgcgacctttggctcaaacaaaacgacttagaaaagtgttgttgtgtgtttttctcttgctttttgcagcaaaaggtttgcaaaaggtttttatgtccatcagtttttcgacgtgttctcgtttttccactctatgaaacacgattcataaggctatcttggctggttctgtgttccgttttttcccgccgctgaagtgtggagagaaacacgccttttgtggttcgcttttcctcgcgtcaccattcacaaaaatagcaggcaggcttatttcaccgatgcttctgacgtttttcctacattatctgcagtcgcaggaataaacatattccacgcaacatacgcgtcccaagccgtgtgtggattccgctctgtactgcattatcgggctcatatgtgtgtgctcggccattatttcatttgctcgttcgaaaatattgcaacttttttcgctatctgaagacgcgtggccataagctttgagggtgagcgtatcccgtcttttaacttgcggtcttttggttgtgcatatatatatgtatatttgcttatccgacgtgcgaacatatcacagataccgaatattgttcttttcgttgaaagaagaagcagccagtctgcgttgcctcttcgggtggtctctgcttgccatcatttcgtcggcttagaacgaaacgtcctttagtcgcattcaccgcctgggtttagcactgacacattcggctcgcggtttcatctgcgttcgtattcgtgttccctttttgttctctgaagacagtcgaaaagccgtcaaagttttcttctgtcgcgttttccgcgtgtgtaaggttctgtcttttgttcgaaaatacctgccatgggaaaggcaggtgacgttctaactggccttttctttgaaagtgacggaaggagcaa

SEQ ID NO: 1378 - DNA, 2017 bp, Toxoplasma gondii
gagaagaaagaggagactgcattgttggagaggatgaagagagaggaagagagaaagtggagaagttcagagggagaacaaccgagaaacgcgtcgacgctcgccaggtgctcgcggctaaaggacggcgaccgatgcagaaagtacagaatcgagaagagcggatgaacgacgaagaagaacttgaagaagagacgaagtaaacgactgacggcagacagcaaaaacgaaaaccgtttgaacgatttgtgggagccatgtccacgggctgttgatcgggactggcctgaacggaaccgtagcaacgtcatggtgtctcgcaggaagaagaggaaacagaacttcgatctggtctataaaggcctgcttcaagctttagaccggaagaccgggtcgaatcgcagacttgcgagaaagagttccctgcgactgacgtccagaagatattcttcgaaatcgtcagtgacttggaaatcgcgctgagaaggaccggcacggactccaggaaaccacgtcagcaggttgctcagtgcagatgccaccgaagcaaagatctccatgtccagacgtttacgcagtcgagctgtcgacgaggagaagtgaagcgcagcagctgcgctctgggtgaggcgaaggcagaaaataccaagtgcaacaagtccagtttcgcgaaggtacaccagactcgaaaagccgggatttcaggcgtcgaagcctccgcaccgtgtggtgcatgaaacgagcgccccggacgctgccttcagtgagctcacatttcctggggaaacgttcgccttccgccaggagaatcgcggtccagaagagcgagaaaaaagtctgcttcgtcgaacggaagacacaacaacaccgtgcagacaagaacatcaaaaagacgtggaaggcgcgtgtgtcgcgtagaaggcactggagaggccgcgacgaaagaacatctgtgtcgagaatgccttccctgtcggcttcagtgcatgcaaaaaggcgggagttcgtgagtccgaaaaaaccaaaaacctgaagaagttcagtgtcaagaaaactcgcggtttgtgcacatcgtcctcagttctcacacaccgccgtagagtgctcgcccccctttcctttctctgtgtcttttcatcgggacaactctctgcaaaagacactctaatatgtgtgtttcaagtcaaatccggcgctcctgagaagccggagtttcctgattctaacagaaatggagttgcgatccgttcaaagccgcagtcgctagacatgtccacgaaacgtcgcactctcctttgtacgaaaacggcagcttggatcgccgtcactcactcagctgggatttcgcgctcgctgctgattgtgctttacccgatacgaaagaaacaccgaaaaacagacgcaggttcctttctcagacgatggaagttctcgttccctttttaaatttactgaagtcgctgttcgacgtcgcgtaacgcgtatccgtcacgcttcatttccggagtctgctccgaaacctcccgccgcggactgggcttcccgcgttgaaaactctgtgcggcgtaaccagcctcgaagtcacaagaaatgtacaggaaactgttcataggcgtggtttttctcctctgcctccaaattcgctctctcttttgaccggtgagctgagtccagtccctgctgtcaagacccagcatgcaaactgttcggcagaacatccgcgcagcccggctgcgtctgctgttcgtgtaaactagagtttctcttctcgtccaccctctcgaaggaatcaaagacctttggaacttcaagagtgcgagtccggcgcagaccgccggaagacaacacacgagaaactggtggactgacccaagcaaggtgtatgcggttctctgtttctccttgtcgtcttgggtggttcttttcatcgttttcgactgttgtccgttcccttctggagagcatgcagtttttcgccttctagctgtcgccgtgcgatcgctgtctctgtccacca

SEQ ID NO: 1379 - DNA, 2175 bp, Toxoplasma gondii
ttgttcgcgctgctcggaaacatttacaacctcatatctagatgttgttgaagcaatgtgaagaatggtccacgttacattctctaacggaattttaacggtgtgggatggacaagcaatgcatatgcgatgtcgaaccctcgaaaacccgtaatgtgcgaccacgtcctgggtgaagcaaacgcgtttccacatacagtcggtatcgatgtcacgcttgccagttcgtgtagggaagttggcgtgtttttttttccacggtggggattgaacagtgtcattgcccagaccatggcagtaccaagtctgctctgatgaagtgcgccaccagcattctgttttttcgctcccacgagggtggaacctctagcacacaacttctctcttctgaggttgccgaaaaactgtctgctaatttatcgagttatttgaactacgggaccaacgggcagagactgttttcactcggatgtcgtacagttgacgtcgcgacgaaaggcacatgaccaaggcgattttttttattttctggttcatccggctatccaccagtgttgcttcggtcgatcgaacgccagaaaccaaaacacctgttagtaacatctgaccagtgtcgaacctggaagaaacgcagcagtttgcttacaacgaaattttcattccaccggagacgagggtctgattcccgtggcaatcattgcaaggcatcccgtaggaaaggtaggcaatatcgaaatagatccagtcgtgctatgcagcgtgtccctcgacgttactacgcacatcctgtgaacaattgccaggcagctgaacgggtggtgtgctgaagacgtattccaagataacaaacctccctgcacggtcactgtttgcttcctggcgatcagatgtcgtgtgtacggatagcaggtgtcttctgcggtcatttctctctcggtgtacacagaaaagagagaaatgtagagcgtggcctgggtacgcgtgaaaacacgcaaccggaggttctgggaggtactccaaggaagcctgttccgctcaggattccgagtggcattctattttctgctacactgcatttcctcggcaaaagtgtaagcagagatttcggggaaaacgacagtcgttgcaaacaatcgattcaccacgaaaaccggtatataccatcaaacgactttttcaataactgttggctgccggcacagtcgttgagtccgggttggctgtagtgcctgaagagagccgcacatgcttccatacgtaacaagcttatagtcctgccgtctgctccacacagaaaagtacacaacgtgtgtgtcgttcctcccggcacagacggcctcagatgaaatcgcttttctcatgagaccactcttttgtcagcctccaagagaggacacgtgctgaaaaggttcgacgtcggcccttcccagaattttcctgtaaagcacagcggagagacgagaggaacacgtttccgttctagaagagccggcgcttcgacggggtctggctacatacagaagtacgcaccagcgcgtagcgggtgttgtcgtgtgtctttttccgagccttttcgcaagtgctgctcacagcaggaagagcgcaaacgcaccggcaggcgaatttgccgcgttctcgcgggaacgttgtttttttcatttagaaggtcgctagtaaacaaagttcagtgtatggttttctcacccgagcaagaacaacggtgtcctgccgtagggaattccccgtgtccccacacttctagagttagttggcgcccctctgctgagctgtggtgtgcgcacctgccaggtctacggggtcatctgttcttctttgtcggggattttctccgtctttccattctctatctttgggcaggggaattcggttttccgtctcttactctcgcccgcgatctcttccacaccaccgtgcatgcgttcacgttccgtcgtctcctttccgtcctgaaacaccgctgtctcgaccgcgtttttcccctcatttcctggtaggcttcgtgtcacttcgtgttcacagctggttttgtatgttctcgacgttttccgcgtgctcgcgctccgcctttccctcgaggaatcccccgcgcccccgcgctcgggtccgcgcccgtccccctttgtctcccgtttcagcgacttcttctctccaaca

SEQ ID NO: 1380 - DNA, 1882 bp, Toxoplasma gondii
ttgtgacaaaggctgttactagcagtggaattttacagcaactctaccagcggcttttttgttcatgaaagatgcgtgctctttcaggtattaggtaattctaattttcttccccgtatgtgtgtctgatcggggcgagtaccgcgtcgaatttctctctccgacctctagggtaacgagacgcaggtatacctcccctgtgaagagttcctccggggaaagatccataaagtagctcgtgcgttacaagtgttaagaggaatgacttttcgacacagagacacaatgcatttcacttttcatacccagagacccataaagcgccacgcgagcgtacgccactggattgaggcaaaatttctggctagtacagttcatctcatcaacacgtaaaggacaattaaagcatcactttggggaacagttaacaggagcacctcgttaggcccacttgcgcttaccacaatgatcccagtggctacatggggagaaaggtagaaaaggagcaatagatgatgcaagcgatggtcaagagatgtccagaaagcaaacttgagtgtcgacggcgacactgtaatatcagatgatggtgggtcccaccgccacaccattttctactcacacagctacagtttctgtgttctaccttttgcggtgagcaatatgtcgaatgggcgaccgtttacattcgaactaggaagcctgcgatggctcattgcacattccgctggcccgagaaagtgaaatgttctgaagtagcaagtcggggctgtctttgctgtctaaacgttgttcaagatactttcctaatttcaccagggaggccctggcaaaacggctcaccactcccgttgcaacagcgatccagattcttgtctagaagacttcttgccagtagaactcgcatcctgcttcttgcatgactgcgtaccgggcggcgtatctgcttgttcacttttgttcgcgtgacttcgcgagtcgatttgctgccagtccaacactgaacacctgcgttaataccgatggatcggagcgtcggtggaatctgaagcagcacgtttcctcgttcaaagagggtcatgattgttaaatctgcagcgatgatcctatcgtaacaaaggacagcaggcacgaaaatcgactgttctcaaagcattctgcttgacagacgactcggctacatgtggcgcaaggaaatccctgcaaatgtgctcccggatgatcgtgccaaaactgagtgaaccaggctacctacgttttgtaaaatgccgctcaatggtgtcttacacctctttctgttccattcttcccgcagaatccctgcagaatgaggaaccgatttcgaatgtgcatcagtggatgttgcatgcgtagtgccaaaaactgttgcatgcgtattgtgactggcaaggaacgacgtttgtggagtagtctccagacgttcctagacaagttcgtcttccattcgatggacgaccatgttctgtgtgtatgcgcattctcagtgttgttcctactgcagtgaccaccagtttcctgaaaggattgagaaagggcaggaacaaaccggcatatgcgcagaggacagacacgtcgagacgaatgttgatgcatgatgcattcacattggcaccaagtgtccttcatgtgtcgcgtctatgcaaagctgtgtacggtgcctttctcccgctagcactcaacagtcgaccctcctcctttacggcatccgtgctgcacccgcggaaagagtatctactgacgcctcaacgcgcgtcagattctaattttgaagtcggaatggttctcttgtcttctttgcaagcccataactaaaggaaagctgcgtggtcaacacaactgcttcttccgtccgttctcgcga

SEQ ID NO: 1381 - DNA, 2913 bp, Toxoplasma gondii
gaaaggcgtcgactagtcaaagaagatcgacgtgtcgcgttttcttcctcgactgcttggcttgcgggaggagtgcaagaaatccagaaagaacccgaaagtgaacgctgcggtgtatgtacacccggggtcccagctgcacgtgcgccagtttggaacacgaaactttgtctttctcggggtctgcagtctgcggctctttccgtgtcgcctggagtgcctgcgttgtgctgctttgcggatggagtagtagttcgtgtcttgccagcttgcccgaatataagccgaggcgtttttcctcgcgtgcctcttcttgtcaaactccttgttccacgttgttctcggctgcacgtctgccgggcctacccgccggcgccgtgttcggaacttttccgttcctctcttggctcaaaaaccaaggcattcgcggagcaagaatcgtcggagagaagacctcggtggcgaccggcactaaagatatcgagtttcacgtgtagaagggaagcactttcgaggggtcgcgttccttgtgcggaagtcggcttgtgtctccgacctctagcctgagaacgaactccccttattcgcggaaacactttcactttgtcggccgcagtctcgtccgctgcacacgatgctcgcatcgaaggacaactgtggagtcacctgaacacacaagtatcccaagttcaacagagtccgtcggccatcgaacgcggtactcggggatgtgtataggtcgctctgaggaaaacctgagaaaccgtttttcctctagcgccagtcgggagccacaacagttagatgggaggagtgtggaaggacggcatcgaatgccgcagcgcatttccacgctgggagaactctgtaacacgtctttcacctgctgcgcggaagcgaacagtcttccagctcatggatatatgtagacgccttccacgaaacgactgcggattgtcgaaatcgcactgggcatcactggaagcagcaatagtgagagttgagaagaaacacttcttacaggcagatcatgtatttccggtcgatcagctttacttttcctatgtcactatttacaacaatgcctgcatgtggagtgaggatgtgttaactagcttgttgtctcccttttgtgttcggcttgtcatctttgttcctcccactccgttgactttcgcatgtccgcaagtgcatcgataattacctcgcctgacccacatgcaaatcccgtgtctccacaacgtgtgactcagtttttccaacggacacgggcgtcgactaagaagcagtgagggtcaccgctgccagtccgggcgcctgaactcgggacgaatgtggactggcaggcaatccagctaaatcctttagaatcctttagaaaagccagccagtgttcagacatcttctttcgttcagcttggtcttctcggtactttgtgtttgaaacgctcaattaaaaagtgcagaacccgcctgttcactgcaagaacgtgcaggggtttgacgcttgcttctccagagattcagcctgcgccacaccgcgagccttgcctccctacgcatagacacacccatacacatgtgcgtgtatatatatatatatatgtatatatatattcgtaagcgcttttgttgcggacaggggaaagtctctgccgcgggcgtcccctatgctaagattgagtagtcctggcgccggtgccctgccatgcggatctgtcgactgcatccctgattctgtaccaaccgatctaaaatcgtgatgtcgttttgttgcgtgaggagccgtgtgtgtgtgtaagactgttcgttaactttctgcgtcaacaacccgaggagccatctttcgttgtctgcgggtctgcctcgtcgccaggaaaccccccgcgagggggtgtgtcgctttgcggtcggagaacgtgtagcagcgacgagatgtgaccagcccccgaacggctcttgacattgggatacgcagaaacaccgggctctctggcgcgccctctccacttccaagctttctgcgccacccggcgcaaaattccccttcgatattagctaaaaaccccgtcgcctggttgcccgcttcgcatgctcgctatcacgaagaaatgggtgacccgctgggggcagcacgaacagcgctctcgggggtgagtgcgcgaagcaggacgggttttctctgcattttacgtggtgaatttcaagcgtaagccgtgcgcggccgtgtcggctcggcggatttccagggatacaggcgttctggtcaaaaggtcccttcagcacgagcaacgcgcgtctccgcagtcccgtcgatagcagtatatgcacagctggcgctgcggtgcctgtggccacggtttcctgagcagcttgtcagcgagattctcaggttctgtctgcgttttctcggttcttctcccccgctgggcgcgtctgtacgtgcacagaagacgcgcagctgcgaactcttgtcgcgaactcttgtgcgcgagcacccctcttcgtccacggtgtgcctcttttttttgacccctggcagcggcgtggcacttgtggatcttccgctgtacatcctgtcgaaccagcacgcaactcttggcctttccgtttcggacggctcgggactcggactccccattcgcttgctggaactctcgcgcgttccccagccaggctcacgcgcccgaaccctgtgcgcgacccagccacagtctttgcgtcggtcgccactgtccgcaactccgtcgcgtttctcttcttcccctatcccttctgcggcgaacatccgcttctgctctgtcgcttttttcaggtggcgagcgtcacacccttctgcggttcaagcttttcgacggctcttccccccatcgctctagacctctcttccccccgttgccgctgacaccaaga

SEQ ID NO: 1382 - DNA, 2210 bp, Toxoplasma gondii
tccgctcgagacttctctgcctcgtctcaaaaggcgagaccaagaaagacgctccctgtctgcatggtcacggcactctccatctttccttcagcgttctcttgcaagctcgaagctgaagaatgacgagcctccaacgaccgccaagagactgtcagtgtgcattcgcaggaatccacgtgcacattccctgagggtgcttctcctttgctcttcctctctgtctcgactcttcgatctgtagttctccttcggtctctggctagctctctctcttcgtcactcttcctcgtcttcgctgccttcctgcatttctggtctcctccccctcctttgccgtttcggaatctcgcgccggcgtatcgatacacctgagcgacgtgtacatacaccgcggcggcgtctgcctcttcctcactcgcagcgtttttgcggcctcagtcctccatcttgtctttcatgttttctggctgttctcttggcaaaggcagcgcgcgagaccgtctcattttttctcggctggaaaaaaagctgagaaaccgcaggagacttcaaagtgaactggcagaaacgcggtggactctgctctcctctccaaactggtctgcaacggggaactcgctttttgtggagctctctaccgtctccggaattacctggaaaaccagaggggaagcgaagacaacagacacgacgaactcatggagcagagaagcctcgtgcctttgtggcttcctcagtctgtgctttgcctttgtgctgtgccttcgagacgagtcaacgtatacttcgcaacaaaggcctgcagaggcatcggagaaagaagggaggctgagaagaaacagaagcgcctgtttatcaccatttcttgacactcccagcgcggactcttcgagaggtcttctccatgtctctctcggatgggcagcttgtggcggcgggcagcgcggagagagaggaaagagacagagagagaaaagggagcagaagacttgaacagccgactcagggatctgtcgacttccttgagtttagaaacgagtgaagacggttggaggtttttcgagtgccgggtgtcttgcgttccggcccgagagaatgcgtttttaaatgactcttctcggtgtgcatgcaacgccgttccgcggcctcgacgcctctatatttcgacgcgtcggcgttgctcactttcctccgttttcctgataatgaaaacggagaggaggaatctcccgagtcgtctcggtcgccttcgtcgacaaagaaacacggagcaaagacgcaaagcagacaagagaaagagaagagaacgcgccgtcgagagaggggcaggtcgacaccgctgagctttacagccttacctgtgtcggggagccagacagctacgcagtcgcgcgctcttcctctctgtgtggttttcttctctcgaatacgaggggaacacagaggggagaaacgaagagacaaggatctgaaggagagagaatggcagcgtgagagcgagagagaggaagagaggaagaaacgcgacttcggcgacttcgtgctcctttcagagaactgtctcctctaggtcctttctgccggcgagaacaagacagaagccgacagactttgctttggcgagagaacaagacgacaatcaaaggagggcgttctcccggacaaagagatcccctgcgtccgaggccccgcgtctctctgtgtcggtcctgcggcagtgaaaagaacgagaacgaagtctcgctctctacacttcttgcttgtttctctcgagcggtatgttctcctggatatcttccgtttcttccaggtgaacagccttgtcagtccattcagtccatcttcgttttccccgctctcacagcttctcgaaacctctcttctcgcgcgtttttcaacgatctcgtcattttccccgtcccgtccaaaacagttaccttctcttcttctacgccatccacttccctgtctgctctctttcctcctccctttcctccttcctctccttcatcttcatcttcctcatcttcctcttcttcctcttcttcgttttcttctccgtctactccctcacctctctcttcttccccttccccctctcccggtttttcttctgcctgcgctctctactattcgtcgttttttccttctcccagggtatcgcaaggagcgccctcgggtgtctgtgcactcggcgtcgagaacga

SEQ ID NO: 1383 - DNA, 1679 bp, Toxoplasma gondii
ccacagttactttacacagaaggcgaagcagcgaagcctcgtggggtcgcaagccaggcagcgacagaccagaagccgaggctcgaatctgcgaaattcgcactggctgacccgtcagcgtcgatagcagtagacgctggcgcagaaacgcgctgccttcgtagcacaggtgcttcatggttgtcaggacgaaggagagagactgggagggagacgaagatgaagacaagcagcggatgagaggacaggggggggagtggaagaaggcgagacgcaggaacgctggaggaagggaagagaacgagaaagccagcacagcggaagagagaagagagacagagagccactagagaaacgagacagagcaaaataaggggaggagacgctccgaatcagtgggggagcagttgagaagaaagaggagaagaaaagaggaaatccaagacgcaaagagaccacgaacgggcgccgaagacggaaagggccggacagaacgggcagacgaaagagagttgacgccacaggacgaggactaggaacaggagtggagacgaccgagaagaaacggagaaaaagcgagggacatactcgcgtagagttcacggacgaaacaccatcttcttttcctggacaagagagattggtcgcgggcacatacctccgcgtacaaacggcgttcatgcgacagtggtgcgcatcgtcagagagggggcaggtagccccctccttggagccgtcgagcttgctctgtcagctacgcatgcttcgttctttcgccaagaactcgaaaaaagcgcgcgaaacctggagagaaacctggaaatcgacttccacgaaaagcttcacgcgggctagagaggcgggctacagaggcggcaggagcgccgccgatacaaagggtccagcgagccttgctcggactaacgaagggtttttccgttcttttcgagttcaaggaaggctgcaggaagatgaaagtgcggtggcaaaactgcaaggcccatatttctcgcgtcttgtggggcaagagagccctgctcgcagcttgcatgcgcgaccccgtcgcatgcacgctgtcgatacactcgaggattgattgggaaaacctgcagagtgcgacggagtttcgcctcatttcctcggatctttcgccccttcttccctcccacgttttccgcgcctgtgggtggttcctcccttgtctctctcgcctctcgccgccctctcttttgccgccgcaaaccgtttgaggggaaacgctggcagagggcaaagccgaaccgggcggccgtcagtcgtccgaaggcgggggacacgttcgcctctcgacttcgagcgagtcttctcgtcttccacgcttgtccctttcgtccacgacagcagctgctgccgtctcgtccgtggggtcgttgggaggctcgcgggcgccgctgctgcgtctgtgtggacaccggaagtccggctgcgtcctcgcgtttctttttcgcgacgagttcctgaacttttttcgccttcccaagcgggcgggagttgcagttcgtgcgcggcctctttgtcagacggcgcagcgaacccaagtgctcgctggaacgcccctctccgttggtcacacgggcgcggtctccttcttgcggcgccggaacgcggactccactgacgcggaaaagcgtcgaggaaga

SEQ ID NO: 1384 - DNA, 4459 bp, Toxoplasma gondii
gaaagaaaggactattctgagaagaataagtcgagcttgggtatccggcgagcgtggagagactccccggctgaggcaggcccggagcagccattctgtgctttcggaaggaaaacgagctcgtcagtcctctctctgcggctttgaaaggcgcgccgcgctctcaagtgctccatagaacacgcaggttcttcgccttcataaaactgagttcggtgtgctttgcattccgggcagagctgctctgtcgaacgaagccgctcgctgcagttccgcttccctcctcgaagccgcacgcacagagaggagaagtcgaccgacagcagatgaaggccacagaagaagagagcgaaaacagatctctacacaccaaaagaggagcaaacgaggggattcaggacctccggaggaggcggaaaaagagcgatcggataaagaccgagtgaggaagtcagtgaaatcgaagagaaaccagcggcgtctcaacaagaaccgcaaaaatgctgcgaggatgccctatctctagagcacatacgcgcatggatcctttgaagcgtgacggaagcctcgtgaaacgaaatgtacacttccgaatatggagttcacacccttgcggcggtagaaccacaagagctgttgttccagtacatcacaaaagcttcattcaaacgtatcgcacggagggaacataaagggaactggggagaagtgtgcatgtgtgagaagcttaggtgaagaaggagaagttgacaactgagaaaagaaagcagagagaaggaagttgaaggacggggggtgacgggaaggacgcaggagaagaggaagtctgaacgtggacgacagaaaaacggggtgaaaaaggaaggaagagaaagaagagagagaacagaggagacgcgttcgagtgtacgtacacccgacccctttaggtgtcgcttggagacagccagttgggctggggtgtacatacaccggagcgtgttggtgggcggcgcgagcgcagcggggcaggttcagacccagcagagttgagaattcctcgctttctgataggaatgctgaattggaaacgaagagtgaagtttaccgtgaaggatactctgttcctccgttcgagcaagtgtcgtgcatgtctgcttctggtcacatagcagagaggcgcgaagaaacacttggcgaacaagacagccgaaaaagggaagcgaggagcgcttcgtcttctccagtgttacagaagatgcgagggaattctttggcgtctcaggcgactctgtgcgtgttccttcaaaggaaaggagatagcgcttccacggaaaagaaatcaggaatcgcgagaggcagggagtgtcagccgcgagtctccggagggggcaggagcccggctgtcctcacatggttttgtggcatagtccgggtggaaaggaacgggtgaatgacacgaaaagtgtagagttcaaagcaacacacgtttagactaacgtcgatttctgtcaaggaactcgaagctggcgcgagtctcgcgggtgccctccacgaagccagacacactcgttggggggtgttgcatgcgcgttcacagaagcgttttttcgcgtgaatccaagaagcgttttgctcgttaaccttttttgcgtgccaaggagaagaagcgaagttgggggtttcctgactgttcgtttgttcggctttaggaaaaggggcaacgcctcctctcgttttttcccttccgaaagcctcggcacatcgctagaagacaccgcattccaacgaaacgcgtgcgttctctaccgttgctgctcgaccgagaaactggtgtttctgcagagacaacttggtgcgttccatgcaagtctgcgttgcgtcttcacttgcacagagacgaaggagttactcgaaagcgcgtggtgtctgcaacaaaggcacatgctgggggtttgttcgtgttttccttcgtaaaagcaggaagcggtttccggaacccacacggcacaaacgactggacgcggcagggatctctcgtctgtgtctctctcgcacccattgacttccaacttcttcgactgagcgtccgcgattcgtctgaaggctcgctttgcagacatgcttcgctcccgcgtttctatccgggggttcgcgcttgtgctcacagccgcgtttcataaaaagcgatacggcagtgctgcgggtgaggaaaacagacgcgcttctctctgcttttagaatgtgtcaaggtcgctcagtgcgaacactctgaactcacaactctttcgcctctcttgttgacgacgccgaatgctacgacttctcttccgccacatccgtttcatctgaggagcgcgccgcgacacgatttctgccgtgtgtgttgcctctgagtttttcgactcgcccctttcttcttcgaaacacagttttcatttttatgacaaaaatgcaaggtgtgtcgagcaacaaaaggtagcagcgcttgaaaagagagggtactcgcggtacaaacacctggatcgtctcactctggcagttgtctgtgcacctgtttgaagcctcctgagtcttccggacctgcgaggacccctccgcgcagtagttgcgcagagaggtcgccatacgttccaagcaaagccgtcattacgaacactgcagaaaacgcgcttgcaattcgcacacttcgttctggaccagcgaagcaacatcacgagagttccactcgtccacgtgggtgcgcacctgcaaacttgtcttcgccttttacacggtagtgttttagtgaagacggaagtctgcgacagtgcgaaatgcgcgccacagcgaggacagccgtttgtgtcgtttttaaaggaaactcgacgagggttgtcgctttccgacagaacagattcgcgccggcggtcctgaggagacagcgagttgttttctccagactacagaggcgagcaccctgcctttccagggacgcctccgtcgccagcgaccagatgcagacatccgaacagaagctcgtcggctactctctggagactcttttttcagagtctctggatgcgagacctcagcttcgcaggtgacttcttcttctaaaagcgagaggaaccgtgcatccggcgagagcagctctgtcgcaggtcgtgcctgatgtctttctgctttcaaggatttcacagtctactttgtctaggcagaaaactctagcatttcgggagcgcggaaggcatccccgttatctgagaagaacagggaggagatctgcgcattcgcgagagactcaccagattcgaggcggccagaaaaagtcacgaaagccatggcagtccagtgatcttacggtgctgctcgaacgagaacaggatatcttccatttttctctatcagaaacttcacacgttgccagacaagaaactcgaggagccccattcgagctatacacacacagacgcaccacagttgcaagtcggtttgtacaaactggtaaatcagagaccacgcaaagggtctaactagaagatagcatctccttgttctctgccgctgcgtcatatagtgatgctcgaaatccagtggaatttcacaaagcgactttctgggctcgtgcgtaggattctcgagtgcagtcgcgcgatcgcgtctagtgttcttgcgcaccctcagtgaaaacgtttttctactgtctctggcttgggaggtcgagaactctccagtacacagagaacgaactgcttttcgaagggagcaaccgggcgctgttgagtgtcgcttgcgtttcacgtcaaccgggtgagggactgatttttcctggagaaattccggcagaaaaaatagactttctggaacacgaaaaagacacggacgagtcacgttccgggccttgttcagaaagctacagtctgtttcgggaagcaaggcgcttgaggccttcccaaaaacagtcaaaaaaactccacccctctcagaagactcgacagcagtgaacagttgtaggcctttgcgcggagaacaagagaaatcgactgttcggtttttcttgtagcgatcgagagagctccacttttttcaggcgcttctcggaaaccacagagaaatcgactttcgcgcaactctcctacgaccgaggggaacctacttttttccagcttgtggagcgtgaaacagacatccactttcgaggccaagatcacaaagaacgtatagcctgaaaatgcttcgatggttggtctgcagccctcagccacacgaacgcatgcagaggaggctggcgcacatgcagtttggaaataaattctgtttttaccgccgagaggcaaagagcaagtgaaagactctgaggggtctggttctggaattcctttcatatctgtattcacacatttaccggcttcacgaaacacacacaatgaagcactgtgggtcggtgtacgcacaccgggggctcaccgtgtgagccgcgcgccaagaagggcgtgaa

SEQ ID NO: 1385 - DNA, 1151 bp, Toxoplasma gondii
ggagacacagcaaagttgtgtggcggttgttccggtggtagaaagggtgggagaagccgccacagatcggcccacaaaccgaagtacacgagctgagtcgattgaatagaacagtggcaggacatgaaaaatgagtcgagaaaatgagtcgagactaccaccgttgcagcttctgtcatttagttcagggctgacgacacttctgtgacagctgtggacgaggcactgaaattttgtctgcccgagatacaccggcatgaatcaaggaacccgaagtttctgtttacatgcgttgcttcaaaagcatttcccttgaaacagtaccctgtagttctcatgcagcaatattcatacatgtgtgcagacggtgatttttagagaccccattactttcgacggtcaaaaagcggctggtaatcccgttccgtctgttgagaaagaacgtaggtggccgaatggcatctatgaggcggaagtggaggctgagagggcgtgtcacgaacagttgccagcatcatttctcgaaacaagcaacacggtcgagcgtctggcacaaggccagcatcaactggggaggctgagcacacgcgttaaggacgaatgcatctcgtaacattcggtgagaggattactgggattctggaagctggagcattactacgctgtagcaacaagggctgatacgaccactgtgtacgcatctgtgcaaatttacgcctttcgtcgtaggctacacaacgagctgcgtagtgactatccttccataggacatcaggtgcttgcagaaagtagagcgcctttaggtgggatcacgacaaacgggaacaggaagaggaggacaaaaagagttgccgccgccgggtcgccttgcagcggaggttttgacgccagccggaccctggaaagcgtgttcggatccgtaaagctcccgcactacggtgaagcttttcccattcaatcataaaagaactaggttgtccagcagtccacaagctgcggcggacaatcgatgcggacgcattgctgtgagatcgtagtagcctttggccacgttttttgagttccggaaaagaaagattccagcgcatcggctacaggcgggaacctgattatcacaagtgtcttcgtgatctcagatcatctgcagtata

SEQ ID NO: 1386 - DNA, 1872 bp, Toxoplasma gondii
atttcaccgtcaaacagattccgaaatatgtcttccttccaggcacaccttgtgtgggactgagttgtccctttgttgaatgaaccatgaactacatactagaaagcacccctccaggaaacaagaggcataagagccacaaaagggggtcgcaagcaccgatgacaagcgtccccagaatatttagaagcttagtggttgcgaaatgttgacacgatcccgcgttggcaccaccggctctgtgtcacttcactagccgaccataacatccgagacatctgcagatacaatcgattctagatgctgtggaatgcacttgagcacggatgtctcatattgcctatatcttagagtcagatcggccactacgcatggcatcccatatctctcattcggaagattacgctcgtcacaaggaaacgtagacgacttgccgagtcgatggtgtccgtaccggatctattcgctcgaggcaacacatgcgatcttagtgtacagatccacagactaaccacagcagtagttgcaaacccgcggggtagatgaatgtctatcgcagcgccgtcaacagtgcggccgctgttacctcagccgaaacagtgaataccttggtatcaaacacgtgtctaatcgggaaacggaacctggctggtgggccttacacctcaagcatttcaagaaggcagactctcaacgcctcttgtcgagaagtgtggcctaccactgattgttcatcccatgtgcaggttctacagtgaggtagttgttcggcagagagtggctgcacacttctcagctcattccgacggtagcaagatgatattttaagtcctcttgtacgtcgcaacagataattccaaccaggaccgcataaggatgacgagttggacacgagcagctaccagacactcgtcgaggtacaacaatcgacagcctctccagccagcgccgtcccaatacggtgaaaggtggaaaagagcacgccgctgcgccgccgtgccacaaagactactcatgaaggctttcgtatatctggacaatccactggatcgtggctgggtatctgagagaaattcatttgtcagcctaaagtgtccattatcacgtggacgctgtctgcgaaaggtgccggcgcaaagtagcagccctgctcgcgccggcttttcccagcatgccttgtggctctgttgctagtgcctgtgtgtctccgcaacaaggcatcataagcctcgaccgaaaatcctctgaaacagccgttctttactcaagacaaaggatttttatgcggtatggggtttcacatcgtctgcttcttttccggtccatcgcagcagcgacgagacgaaaacatgctgctgtgctttgcaggcggcatcttggacaagacgccggaagtgacccagacgcttcccttgcattcttggtaaggtgtgtcccttttgctataacatctgcgcttttgtgtctgtccttcatttcagttgatttgctgggctagtgctcaggacagttgctgtttttttctcctgagccctctgtagagtccaaaaagccgttgccctgctgatgcctgctagtacgcgtctctgtgtttgggcccggtgaccaggccgggccctttccgttggcttattctttgcacgacgttcagtgtctgagtgtccacgtgtcgctgcgtcgtctgtgctctttagtatgaagcgactttcctgtctcttgctctgcagtacacgcgtcacgcacccgcgctcgcgaccaccggagatcgaggtgacgggctgtgtaggtgggtcacttcttcacacttcttactaatcttcccgcttcatctgatccgttcgttttccagcttcttccaggaccctgccagaa

SEQ ID NO: 1387 - DNA, 2256 bp, Toxoplasma gondii
aaagatactcctcttctctctaccgacgccctcattttctttgttctcttgcctccgcgcttctctcgccccgcgtcctagccaccggatgagggtgacgaccctctggggaaccttccccgaggaaggcgcggtgtctcccttgtttcccatcgtagaggttcctcagaagacgtaagggagaggacgccaagaagagctagaagagcaacttcatgtcgaacgcgtgcaactcccgacagctgcataggtgcaatgctgcacaccacctacgagggggaatggggcctggcaacttcagacgcgctatccaggagtccaacttgaccgggtgtgtagtaaatttgtttactccctagaaaacgccttccgagacagaagcaacagagaaactcgggatggacagaggcgccttctacgacgagcagcagccagatgggaaaagcggccgcaggtcctcgaacggggagccgcgggaatagatggccaagagatcgggaaaaaggcgacaggcgtggtgacaccggaacgaagccaaacttgtcacagagggagcttgttcgagcatgcataaaatcgcagacgaacagccgctttcatgcaagtcgatgccaggaagaaagagtagctttcttaagtatgcatataactttaccgaggcagacgaaaagccggggccagcgggtatggaaacgggaacacgtgtagagagcccttcccgtgaaaatgacatccccaagacatggagcataaaacgctgggtaggttgaaggcgtctcgcagtcgaggttcggataaagacgcggcttctacacactccggcactttccacggagcaaaaccaacggcgtcaagacggatctgcgcaatggttgggtgtacattcaccgaagtaagttggcaagtgttcagctcgatattgtcgagctgcaacacgaaagacagccaagtccacgggctcgaaggtgccagaacatctgttccggcgagtttaagtcgctgcgttaacgggccgtgaacacccttttaaaagcgcccgtggaacggtccgagtcagccggaaaatcgtgacaaacgaggggagaaacgcgaggcgggaagtgcctccggcatctgtcccgcctgccgtgcggtgtgccgcgttcggaggttctcgagctgcctttccctcgcactgcatacgagcgataccagcagtccatacagtaaggccggaatccaaacgctggaaaattcccttgcggtaggatagtgaaatcccgggctgtcgctgctgcctctagcgaaacatcaccccgaagaggctccgcgaagacgtcagctccagtcaagcaaaacactcagatattctgaaagtgacacatttgcggcggacttctgtatccgctgtacttgtgggattgagaccagcgcttgcttctagaacgtttttttcggtcgcagttcaccctccgcgctctacagggggaaggcaacgatccagcccccgcgacgagacgcacagctttcgacggggaggcgcccgtgtgctgttcgctgtttcagctgtttgagggtggaggaagaaaagtcaaggtcgcccttccttctgcaatgctcaaggccgtgaactgaagctacacacgttctattcagttgataaccacgaattgtctgtgcactgacacttacacgtagattcacactgcgaacagacagctcatcgacccgctttgcgggtgagtgaaatcacgggagaaaagggggagcttggagggtggctcgagcaccgcatgcgcctgtgaagaacgtgcaccgaaaaagcgacgttctgttgtttgacacctgcacaaattcacttttctccacttctgggtctccaaaagtggaatctcttccccgctttgtcagcccgtttgtgtctctttcccctgtctcttgctgcctctcttcaatcgccctgcattcgtcgtatgtcacaaaaagtcacactgcatgaggttctgcctcgtctttgcaaaaggccggagatttctgcagttgcatttttcactgcagcaaatggcgccggtctcactctctgtcctgttcgaagaactctgccttttcgcgtgtaaaagagtctctgctgccgtgtgtttccaaaggacgactccctgatgttctcttgagagttctgcggtccgctgtgagctttccgactcaacatttcccccgctttctcttctgacagagccccttccacgtctcactgtccaggtgtaccaacagcgaaaa

SEQ ID NO: 1388 - DNA, 2136 bp, Toxoplasma gondii
tccggcccatcaagagagctggacgtacagtgcacagcttttcgcaactccagagatgtcgacatgcgaatctgagaagtaacccttttttgcgccttgtgaatttcctagttgttcgtctcgtgttaccctggccattcactcgacggacgacagcggagttcgaatccggacgcggattgactccacggatgcaggggacgagattttgcatggaaaaaacgctctatccgttgttgtttcatttgcaccgacacctgagtcgaattcccggcattctcgggtgtacgtacacttcagagacagggcagcctctgccacctctgggtgatggatgtggtctgctgcgcggatcgagacagctccccgttgaggaatttctgaatgcgaaaagtttgaattctttctgcccagagcactcagcaccagtcgagaaggcgaagtctgtcgagttgtgttcatgctgtggaagggcaaaaggaacacgtcgcagctttttcgcatttgtgaaccgagtgactgcagagagatcgcgtcacattcccgtgagtctttcaggtgcctctacagctcagaaaaaagtggaatccccactcctttttcaactgaatctgagatctctttctagatgcagaagccaagctactgcggattgatcgggagaaacagagacagacaatcatctgtgaaattccccatggttcgcgtacactcacctacaaatatacatatatctatgcatagtgcagtacgaaacacatatctatgataaatatgtgaacagacgggagtggccgttgaacagctagaaacaactactcctcaattctctgaggctactagacagcccaaagagatgtgcgcgcatgtttcgaccaaatgcgttttgtgtggatgtggacttgtgtagcggcagagcagctactgagttatgaaggaactgtttctctcgttctgtgctgcaattgcctctacatttcgtctctggaactgataccggtgtcgccgtctcaaaccaacggaatgcagacacgcaaacgcccaagaaaggcagatgaaaacggaggagaaggtcaacaaaggcgtgaagaagaaagaagagagagagggggagatgcaagagagggcctgctaataaagacaaaagaagaaggagacggaagagacacgaacagagtgaagctgctttctgtccagtttttcgctgcatgcatgcttctcgtcgttctcttttcgctgaatcaacggaagatgttccttctttccactgttttcactctcctcttttttcttctggaaacgttttttacatgggtttccatttcaagaagaacagaggtcaattcgcttaaagacgcacgaccacgtgctctcctcaccacttcttccttatctgctgttctctcattttctctctttcttcgcttctctttcttctttctcccttcttttcgtcctcggtctgtttgtggttcgcgctgctgtctcaagaagccttcgccgcgagtctgcgaaactggaatcgagcaagccagcagcttgcttcgagtgtctcttctcgctcctctctctactcctcttttttggccctcgtttttctcttacactcttcccgcgtttctctgtcttgagtttccacgtcgtctaacctctgcaaagggccgctgccgtcgctcgaagaaaaacgaggactgtccgtttcttccgtggaaaaggggatttgttagggaagacatctgtctctgtcaaagcgtgctttttcatctcccacaggcctacagaggggggaaggacgagacaagtggtgacaaaacgagcgagggtgtttctacgcccaactcttccatcttttttaaacgaaagggtttctcttctcgcccatgacttctcctgttctttctcccgcgctctccgtcaacgcaaaaaagcttcagttttgccgctcacatcttcctgcctgatctctggtgtcgcgtgtccgcgttcctttcccagggatggtttcacagcgtctctttcgccctctgatgctcctcagttgcccagcgtctcgcttcctctgggagaaataaggcctccttctgcctctcctgagagtcccccgcgtggttgcttgcttgatttgaggggacaaaa

SEQ ID NO: 1389 - DNA, 4890 bp, Toxoplasma gondii
agaaggagtcgcgctgaagttgttcacgccttcactgacacatttcgtttctgtttcttgctgcgtcatctcaaagtcaacagctcccacagagaccccacagctcgcctcgccttcctcttgcccggaaggagaagacccgcatgcagtctgatcagagacacctgtctctccatgtggggatccacccagacagcgcccgtcgccacttgggcctgaagcgatcccgcgggccgccacacccccgagggtcagcgcccgtgggtttcgccctgcctctgctggagctggaagatttgtttcgtccattgtggcgaggagacgagagagatcccggcgcgttgtttatacttgaaacgaactctgacgcgagacctgctggaagattggatgcagacagaaaaaggagaagacgcgatttctgcgtctcctgagtttgcctgtttggggacttcagaccgcgctcacagagagccgaaggaaggcggcaggggacaggagacacacacagcgagaggtcgacgaggctggcagagaggagagatcatcgagaacgagaaagagagacaaggagaaaagatgcaggactggaggactgaagacgagaaggggggattcaagacagtggagggagaacaacgaaggagaaaaatctctgctttcgagcagcacactccgtttctgggttccttagaggtagcccggaagagaaggaaaacgctaagaaaggacgcgcatgggaaaaacaagaaatgatacgtaagaggaagagatagagattcgtcctgctgcatgcgcagatcctttggacaaggcgacagaggaggtgttcaagaagactgagagggacacacaaacaagaggtgcagaccggaaatcgaaacctccacgcttcaaagaagcgacagtggacctaagaaaggcaccccgcatgcctactgaagaagttaaccatccattttctctgcattttcgacctgtgtctgccacccacccaaaggtttttcgccgttctccgcggctggcgcccgtcttgcgtgtctttggtctccagatctctcgttttcagatgtttttcgcctggttcctcaagatttcacgagcgctttgccgaggaggaagcagcaccacagcgacgcagaaaaagctgtcttctgcagaaaaggacgagaaccggaccccagggctgtgccggctcaacgaagagcacaggctgagtttgaactatacggatgacgacagcggagattcgacccttcacccccggcgcagcgaaaaacgtagaaaaaagagagaagaaacgggcgagctccgaattaagaaaaggaagggagacagctgaaacaaaggggacagcgagggcggggttgacggcatgcatggattccgaaaaagtgtgttctcagttacggaggagcgcactggcgccggagtggttggtgaaatgtacgggggaaaggtgagattcgcagaagcgaaggaaaaggaaagaagagacgaatatcaaaggaaatgagaggaagggccggagagaagtcgtcccagtacgacgtgcatgctccagcaaaaataaacgaaattggcaagatacggccgaacaaggagggaaaaacagaattgacgggagagcgacaaagtgggaaggaaacgaacaagaaatggcatgtttaagattgaaaaaacggaacttttcgcgatagaaaacggagaagcagagctgcgggtggccggcgagaaacagcagacctgcgacaacctgctaccacactctcgcgcctgctgacaatcgagacctcatgcagtgtagctctacggtattcgtgtgttttgcataaactggtaagacatatcggaagaaaaaggacacaacaaaatgacagaatggagaaggaaggaaaaacaatcttgtcgctcctgcatgcacacggcattgtgcacacccattcgcgttagttatttcagagatgttcgcctgctctcctttccgttcttcgcaggaaaaaaagtgacggatcactcgataccttttaaccttaaacaggagaagagagtgttgcacgcgttcacatcacaacacacaatgagagaccgcggtagtgggtcatcatcctttttacaatccaagttttcaggacagcgctccctttcggaatcataaaaccacgcctctggtcataacttttaaaaaatgcaacatatccagtgcagcgacttgcagctttgacagaatagatccagacagtttattacctaggggactgaataggactcgagttatggggtacaaacaaagaagttctccatgagtgccaaggaatcttgagaaaacggaaaaggggtaacgctctcgtgaatcatggccggcaaatcttgtaagttgcaagcattcttgagagagaaggaagtgtcaaaccttacaagaatacgtggtccgttactcttaacatggcaacgccaaagaaatacgaacggcctcaaatagggaattcgtggtgccagctttcgcatagcagcaacctgctcagcgacctctgctgctggaaaaaatgctgaagcatcgatttagggggaaaacgaccgacgtcatgtaggcatttgtgtcttcttgtgttggtttcgcttctgtgaattattccactgcagattttgaggccgtcagagcgaacgaagagaaaaaacacagaaaaatgcatggattctacattctgaggtggtctctatctgttgaataaccgattttttgggtttggattggacatcgagatcagtggaccctcggcggtgccaaaacggcacactgggttaacggttgtaccttgtcggaagacagtttgatcttctcattgtttgtgttttgctgctcccacatgaacttcaatcactctgggcaccttgtcgtcaagtgtcgcagtttgatttgcgatacgagtgcaaatggaaaaagattcatcgagtgaaacaaccctttcttcctgtgttccttgtcgaaatcataccgcctctcactgtctacagtgactctctaaagcaagatcgaatgcaacaacggggggtcaaggcgatcattaagaggtcagactgcactgagacagagatgaagagcagacaacgttggttttggtgccgcaatctcgagttgtttttttgcgattcacatacagacatcatgcttgaaggagccacggggccccacggtatgcctggctgtctgaaggacacattcgcaagcagacttcactgttttttccgagatatctaaaagttagcaattgtatcaagactccttttcttgtcttgattagttgccgaagcctgagctgtcgtatctaaaacgatggaaagtagccgacacgtggcgagactgcaaactagaattgcagactcagattggaaaacaaaccaacaagtagcaatttaatgataagcttcccactagcttccgtttgtcaatgaggcattgatgctatcctgcattgagtatagccaaccgaaactggcaaatgcatattggacacgcagcatcacgttgattatgaaagctggatcagttcagtggctgcatgtttgctgttcagataaagtggtgaggtacagatcaaaagtgttaggtgccttcctggatgagaagggaagcttatgcttcccatctgccactagggaccagcccagtgcatacctgaagcattcgctcagaagaatcactgagacgcgtttgtttcatttgtgttttacaccataggggaatccagataatcagcattacatgcagctgcgactcccttaagtgaacttgaacttcatcgcaacatgtcaaggttacaacaactgacatgggcacagacttcatcttgcgtgtactttcgagcacatggaactccctttttctgtttgcgaattcgcttgtaccttgtcatgaaatcgattcttacagcgttctcactgctggggagccgcacctgtcttccattgtgttttccgtctcggcctttactttttgcctctctgctatatggttgacagccggtttgttcctaacaagtgcttctcagacatcagtgcatgcggtaccatccgggaaactttctctgaattgaacggtctctgcatgtagttgccttagtttttctgttttatgtagtttacatgtcttggtcgtctcgagcactcactaagcatagtcagtctcaccgcaggcaagactgaaggccagtccgtagccctccgttgtccgagcaatcagaattttttaaactactgataagcgccgatgcaaatcgccaccgcttggttagtagtgtggaacttgcctttctgacctggaactcacaaacagcagggttcacacgttaattgtgaaatgagctaggttcccctcgaaagaattgagcactgtcatttcatctgcataattattctcctcatccaaccactatcggtgcaattgaaatagagtttgaaaagacattgtagaaaatgataagctacgctgtcgcctttgcgctctgccactttgactgatgccgagaataggaaacaaaaaaaactagtgaagtgtcaggatcctagctgtattatgttagcagagcgtttgctcagtttattcccctgtcgtgagatttgcttgcctccactactaccccgccactatcgattatcgatggtggtgtggtgagggggggaagggggcagcaagcccgagcctctacgtgtcggttgtcttgcaagacatcttgatgatcgtccgccccggcatgaggcacaagaaacacacgccaaccaacgccatacacgccagtgttcttactgctttggcaatcctggttcttccgccacctcctaacttgtttggttttttcgtttctagtcaatttgtctacagcatctgcacca

SEQ ID NO: 1390 - DNA, 3224 bp, Toxoplasma gondii
atacgagccgtaaggtgccgcagaagctcgccacgtttgagattcgtgtcccagatggtcgagataaagtcgaacggtgaagggaagctgtgtgagaacctacgcccgcctgaaatgacccaggtgagggggctctccgcagcgcggcagaacggaaacagaaaaagggtgtgcccgcaaaagaggcgcgcgcttcagcgctgcggccgaaagttgaaaaaccgatacaattccaaaaagtaccgcctctgagtgtctaaacctagacggggacacgttcacgcatacatggacgcacacgcacgaaaggcaaccggcgtgtctaaggacgtgctattacatcatcttgtatggtgtagatatgcaaacatactctatgctcaccgagaaataatccttatctgaattttcacgttcacacagagctacgttctgcatcgggcagagatgggagacggggttgggaccgcgacggcctcaagaggtcggacctacagaatatactttttctggtgcgacatgaagcagcgccgcccgtatatgagctgtggaactgtcacacaagggtgaaccaaagtgaaaatgcgatcaacggtcgtccctggaccaccaaacagcgtacgaatacaagatgcctctgcggttgaacacgtgatgacgtctgtctgaggaagtatcgacggcaggaacggctgtgctgactgccgacgatgatccgagtgcaaatcctttcttgtcgacggcctagacagcggattgttctgcacaagattcccgctcacgagaattttcgaaactggagagatgctgtgcagaacggacgcggcaacagcggcttgtggtgtacgcacagcacaaaatcaaggcggtgcaacaaacggtcgacgcgcagggagctgcgggactgaggcgtttcctgcaaggaaaggatatgaagagaaagacggtatttccgatcgagcaaagaagggaaaaagctgtgcatgcgattgcgactttttctagcgcagcgagatatgctgtcaggtagaggaaacagtagaaaactttcgcaaaactcaggagaggtccgcctagcgacatggccacacggtagcgaagagaaacaactcagaagccttgccaggaaaggcatctctgccatggagaaaatgtgacaggacggtgaacgtgcttgcccgttgctcggggcaaagcgcgagaatcgacgcagcgctcgacgcggctacgcgtcccgatcgaggtcgagcttcgaagctcgttgaccagatgtcaggcacggcggacggcaattcgtcctccttgttcctgaagtggcactctgtaacaaaacaattccggaaagcatctctgccgaagaaaaaacaggcacagaaaaacgggaattcgtccatgcgaacgagaaagccgtagctcggagggcaacatctggcacgggcgcctaggtgcagcgccgaaaccgcgatacagcagcccgatattttccgttttgtgcctctctcctcgtttttctttgctactgtctggtgtgcagaatccgctgtgtctgatggcgatgctttaaattgtcgaaatcgaaagatgaagatgaaaacagtagtgccgttgctcatggagcacgcctctgcacataacctgtcgctggctgcctctcgcacaagcacacagaaggctgcattaacttgctgccttttcccggtccttctcgccacggctacttgtatccattgcccagaacttttcagttcgacccgagggtaggaatttttgattctcatgaaggcgaatcaccaatttcctcacgcgattccccataacgcaacagaggcaggaggtgtctcattctttgtgcagagagcactaccgacggcaataggttttgagagtgagcagctccaggcctgcctgtcgccgcctgcaaccggataatctcagaaaaaaaggggggcaaaggaaaagcaaagctgagtagtgctgtatccacccgtcactccagtgtgggagaagacacgcgaacccgagtcaggaaagctgccgcaagacaggcaaaaacacgccttgaccagggccgctgaagcaggaacgcaagggtgggggaaccacacctcgcaagtatatttctttgtcacagaggtgtaatacctagggagaacgttatgctgaggcgacgaaaagtgcaaaaaggttgaaaacgtgtttctgcaggagttgtcagaggggaccgtggcgcgatccaagcagcaacagatttacgcgttcccacagataattaatgagtattagtcagtaatagacctcttcccataacgtcaaggatatcgtcctaacaataaacagcctcgcttgacatttgtttctcaagcaacagctcaatttctgtctgcgtttggcttcgccacggcgtgtcgtcccgagggcgcgtcacgccagcgcacaccgtctagggcttgccgagaagcagcagcaagagggacccaggagacgtgctccagttgatttcttgtgttttccatttttgcggtctatctctttggaacaaaggaattttcttgaggatggaaaagtgcgtgcaacagcagatttccgtgggacgagacgagcacagccatttccccaactgttcacgattgccgggaagcgatttcaccacatgcatgaacacaagacggctccgttcgaatggccggaacgttcaccgtcgccatctgtatttttaaaaagaaaatgctttaacaattcgtgaatgttcgcgtactccatcggagtcgtcgatgtggaggcctgagggggtgcttctaatatgacgacactcgtcggctctcttgtctaccagtctttctcggcgtttccgtcagtctgtctctgcgtcttcgcttcccctccgtttcctcaccatcgatcttccttgcctcgctctgctcccaccccggttccgccttctcacatctgatcttttacttccctctctcacccgtccttctatatgctttctcagtacctgtccgtttgctcttccccgctgtcaacatggtttcagttattattctgagttgtatcccaccaccttccctgttgcacgcggctgtcgttattcgaattgcctgaggtctcgcactggtctcgtacagtgagccaccgacacacggccgttcgtttttctatttcaagagtttctttgtgcacatcgtcacccgttttctccgctttttctgagcgaagggcga

SEQ ID NO: 1391 - DNA, 1198 bp, Toxoplasma gondii
taacaagggagtaatgagccgacatggaggtgctcctgaatgtaacggtacaagctgtaaacaaaggactccttaacttaaactgaggagtcaagtaggtacaaaccgtacaaggattaattatgtccatctgtgcatctaagttgatactcggttatatatgttagacgctaacttcccggctaaacatcccttttctttgaaacacacttcccttctcgccgttagtatgatctcaaagtaccagaagccatgtgatctatatagtataacgggacattagaccgaacctgcgatagataaatatatcttggatgattgtatattagcggctaaatgtcaatcaaacatgcgaattttaggtttccatgaaatctatttggaagaagaggcttgatagtactaccgtaagtacataatatacagtcccagcagtagcggttaaactatagaagagtcgagtattatccatacataccaggcgtaaaaagcgttcatccagttactaaacaggtgccaggccaacaagaatccgatccgtgtattccgtacagactaacattaggaaggagactaccaaagtgaatatcatgatatttgtacagcggaggatactcgacgaatcttcaggcgcgcaggcctgctcgagagaaacgaccgcgtctaggattcataaaacataacggaatcaccgcagaaaggcgctgagctcgtgtcagtgggtgctggcgcagcttgccgtctcattttcgctgtttttcgcgggtgaagaagcggacagaaacagaacgttctgcgaaaagagcgtacactcggtgcatgcagaacggtctgtcttgcgaattcgcacactcccctgtcgtgtcgcaccacgtgcacacgcagcgggcgggactcgacttttttcgcgttttttcgcgtgtctccgagttcgtttgaatccattttcctctggccctttccccaatccttcgtctctggttttccacccttttctggcggccagtttctgctttttgccgcaagtttcttcactttcgcggctctcctccaccttggcgagtcccgccgctctgccgtctcccgtcttgcctctcaagtgtacatacaccctgtgcggtgtctgcgtacgcgccagaggtcgcttttctccgaactttctttttccgcctgctctttcttgcgaagtccggcatca

SEQ ID NO: 1392 - DNA, 2264 bp, Toxoplasma gondii
atcgaaactctgagcactcgcactcctgccacctgcgtgcggttcttggaaaggaagcaactcctcccagaggcaagcctcgtcgcgatgctgtctccttcggtctgcgcttgaggcaggcacacttcggctcggcccccgaacgcgtctggagcccaacgtgcccgtaggcacctgcgggctcctcgggccccgaggccccgcgccccacccctcgaacccgcgaagcccgacgagccccgcccccaggggcttcccgtccagctcgcgaagcaggtgaaacacttccttcttctccctccgaacttcttgcagtctctgccagagccgcagctgctgctcgcgtctgcgcgccgcagctcgggccgccagcgacgaacaggagacactggagacgtgggtggaacagacagctgagtcgggcaccaggtgcatgtgtggagaggttccgggaggaaggacgagaggcgcgtaggggaaaaagtcggaggggcctgctgtaggatgtgcgtggaagaacttcgcatgtatgtccgaatggccttcaaaagctgcacagcaaggacagaaggcagcgctcctatagcatccgtctgagcagggaagagcacacggaggcggggccttttcaaagttgacagaggactggagaaactcgtctctttctggatacgcagcagcggcggtttcgagaggctctggagccaggggcggaggagacagcaccggaaaacagctgcacgtttcctgtggagaggccgagacaccccgagggagacaagacgacgcctcagacgcactctcttggggctcttcactcatggcgcatctctccgcacacaacgaatgcggtctctcgtccagcagacgaggagattcgccagccccggtgtctccttcgcaaaagccgaaacctgagcctcgcgtctcctcgaagatgtctgcctcctttgcacgggaagaactcgtgtgggagtgcgaactgaggcggtcgctgccctcctgtagagactctcgaggcatcatcgtggtctcatttacggtgacgaccccgttttccgtgaaagccccgtcgtcaacaactcctttctcctccatttcgtcctcggtggcccgcgttttcacacacaaagaatgcgtttcataaaactgctcgaccttgtccatcggcgaacatgcaccacctccggtgcctccttcagatgcccagggcccgcgccgcggcttgggtatacgtacacctcagagggcggggcgcaactgcgagaagggcgttcggatgaatttctctctcgacagaagttagaattcgagctcggcaatcgaaagaagggaaactttgcgcggcaagaagtgacgcgcggcaatggtagactggaggcactgcgtgcgaaaaatgcttgaagaagtttcgcgtcggtcgtcgagtgttgattcttggggaaacgcctccgtagttcccactgcagatgggtgccgagaagtcggtttgcgcatccaaacgtggatccaacaattcaggcttcgaaaggaagtcagaagatgacgacgtaggcataactagtgtgaccctcgagagctgtacatacaccccgattcaaggaccccaagaggcacccctgacatgactgaaaacgcgtgtacacgtaggtgaaaaaattaatcagaccgccaccgaattttgttcgtttctcgacgacacatgcgctcgcgcgcggactttttctcttgaaccgaagcgagttgcttcccttcgcgagtgagaaacgcattcgtgtgtttctgctttgtgtgaagaaagccaggggagaatctcgagaaagagggaaaaagcccaggcaatttcggcccgcaatcttggaggaagggagaaaacgagaatgccggcacctacaaagggacaaaaaacgcgttacattcatgaagcgttgtgagttcgcctagccagcaggatctcgatgcgcgggaggcattcccctacgtgaaagagacgcatgtgcttcagtgagtgagtcggcaagacgcccaagccatctgagtgagcttctgaaaaactggcggcgttctctcgcaggaaggcagctgtcaggaggcgacgagactctcgcgtcggccaacctctgtctgtgttcttgtcggtttcttatctcccggggagaagaacctcgcgtattctccaagtgagacttctttcttcgactcgttgttcctcgagtctccgctttctcttctcccggctgtcctccccctcgtctgacgtgaga

SEQ ID NO: 1393 - DNA, 1960 bp, Toxoplasma gondii
ggagagggagagataagaggcgaagaactgcaacgatttctgcttcattaacgtcttggccttgaggttgctctcgagtactagcggagcatacaagtcgggatgtcataatcaagcaacggaacagtgttgagaaacaggcgcttccacacgcacgttctaggcatattacatggattactgttgtccatcgttttaccggcgagagaaatctgctgtgtttattccgaggcgaacagtgccatcatactgtaaatggtagtctttgggccacgacactccgtagggagcttgacagagtccccttttgttcggatccatcggtctagcacacactcgatcccttgatgtatttattcattgcggtcaccattctggatctcgaatagggtgccgcgttttaaaagttcgggcagtaggactcgcttcttaaatacggaatttcgagctgacacggcttcgactgggatatagcgcgcatttccacttactcctgaaatcaaggctgaagctgccttctgcaattcattgaaaggccggcacgttcaccactactatagggtggcacacgctgatgagagaagggcaagactacgcagactcccagggtatgcgagttccggtcgagggtggctcttgtcgctgtagatatgtgtacgtttcaagaacctgtggacagaggaaatactcaaagtgtcttttgtttctcctttgcccagccgtgattcaatgacgtgttggtgatgacccgtctgagtgcagacattgaaagaccaacacatgagtggcggaaaggagaacttttacgctgctcagcatatgtgtaaagccacaatgaaatcaagggttggatatctagctcacggaatcgatgatctattcatcttctatctctctggattgtttgacgtacccagcatcgtggcaggcctgcgcggcctcagtgtagaactgtgatacttgccagacgccaacagagacacgttgaagcacctgcgaagtgttttttcttttttccaggaactttgttggcaccaatgatctctttccttccttttcttcctgcgtgtgtcgtattctcgtcgccgtcgtaggctgcggccagccaggattgcctgggtgcggcccgcgcatgcagtctcccagctgcatgcaacgcatggcgatatcgcgttggggggggttttcgaagtgtgtttgctgtttccgccaaatctggcgcatgttcacctctctttatgctcccagtttaggcttgcacggccaaaactgccataactgcgtagcgtcgtgccggacgattctgccgtgtctctggcttgcgaactctatggtcctccatttactgccgtttccatggcgccacttgatcaggcctcgccattctctgtggccttcctctctcttaatcaatcacgagaaactcttcagcagccgttgtcgtgtccataaaaactgactttgacgctttttgcacgcttgcacaggagtttctttgtaaggtgtgccggcggactgcgtgttgctgatctcgctctgcagaaaagttcgcctttgtgccgtcttatgttgtcagctctgcagcactcaggggacttattccccactttttcccttcgcgttttgccgccttgcttgtcctctctccagtttacaccctgactttcctcgacgatgcggggtcgcgtctctcctctgagaggcctttgactccgctataataaaccaggccgggacttgtcgcttgaaccagaatttccgaactatgtatcctctccacgaacgactttgtgtatcgacatgcatatgcatagattgcgtttggcgagctgaatatggttgtgtgggtaacgcggcgtttgtttgattcttttgtcgagtcgcgagggctctcacgtcagcctttcgtccaaagagctttcgcggaaaacctccgagtcgtggtccagctccaaaacca

SEQ ID NO: 1394 - DNA, 4918 bp, Toxoplasma gondii
acagaaaaagggagagcgagagacagtcggtgaaacaggaatcaaaaaagttgaggtggaaagggaaagacatgcgcagtgtggagaagaggaaactggtgcgcgtgtcaattgaaaacaacagcagcagaaagagatccttgtcaagcgacgagttccccacaaggcacaggcatccctatgcatccaaaggcaggaggaaatgccctcccacacttcggccaagagagtgaacctagagatgcagacacaaggaaacgagagagaggcggtacaacggtgtagagatgccttttttagaaccgtgcggagaggtccgactgacgcgaccctgaatccgctactcggcgggtgtcttgacgcgccgaaagagaatcacgcgcgtacggaacaaagtggagagggagtccataaagaggagaaggcgctttcgtaatcaaagccagactggaagccgaagtgtctcctttgtcgagaggaaactccgggagtcctcgcgctccggttgcgtcgtgtctgcggcagcagtccagcgggagcggatttcccgtcagcaaaagcggaaatacggagagtttcatagaagcgaatggcagtggcagacgaaaaagaaacagagaggtgccgtggacagagaaaagcgaagggaactgatggtggcgggccaagcgcgtaaggtaaggagggaaagtaactcgtgcaagacacacacgccgtccgagagaccagtgttgacgacaagggcccaaaagtcgcgaaggacgcgaaaaaagccgatgcagctttgacacaagcaaaaaaaaacgacaggtttgcgtgttttctgctcgaagtctcccggagaaactacgtgaacaagacacaggacagtagcgcagatccctgcgagcaaagccgtgccacaactaactcctccggttcgacctcaagtttttgacaagaagacgacggaaacagcaacaaaaacgaagaaggaataattgacaaaggtcagcgaaggaggtcgtgtttccttttcacttcgtcccgtttgaggtcatgttgcctccgtcgggagccccttggctgtcctcacagcccttgtggaccggcagcgttcctcccctcttcaccttggaacggtgaacgtgagattgctttacccctctagctctttcgttttctctaaataattccaattagccaatccaggcgaaaggattgcgagagcagagaggcacagatacagtcgcctctcttcccttggccgcgcatgccgtcggcttgcacggcggtttcggtttcccccaatataagccgagttcggggaatctcgactattaagaagggaaatatttagggatccggcattcagtgacgttcaatttccagcaagtgtgcacgtttgcgagaaacggtcgaaatcgtgaggttgtgaaatgcacagtggagacctcgctcggcttcggtggcccctgccgctactctcgaagtgagatcccctctgttccaccgcagaagtcagcaacatccatccaaaggaactttttcccacctaacagggatctggcaaacaaagaccctcaagatctagcgaacacgatcacgttgtgtgggaacatttacttatctttgctcatgctttggttaagctgaggaccggtccaggaagaatcagggtcgcatcttttcaacctctcctgtttgactagttttgtttctccgagagtcaagagcgaaaaaaaagacgaacagattcgcgcgcgcctcatggttgccttaccgctacactgcgaaactacagagacagtttgttcctttttttcgcgtcagctactgagaaggcgccgccgaacccctaatgtagagtgagacaaagaagtcattgtatccgccctgcgaagccggtattcagggtcaggacacgtcctagcaaactgcttgcgtggaattgctgccaacacagtatcttacgatttcccacctttcctgtttcttcctcttaagtgtttcgactcccttcgttctttttggccctctggatgcttcctcgcaaactgacgaaggcgcggttgcaagcacagggagggccctcagaggcaaggcaatcaggtgaggatttatgttttacagtaaagatgtgtcaaaagatactctgaatatgttccatgtgaatacacgttcttcctcttattcaacaatccaatcgagtgcggtaggcatttatcatccgtcgtcaacctatacggaggaaggaaagctttttaacacggcatcgacacctgcaggatccctagaactatagatgtgacgttttatgttcgtagtgccggcagaaaagattctccctcttgttgcgggtcgaaccagttcctcacttgcctctccactcttaagaaaaagggaatgctgcattgaaaaagaaccgatcaaagaggcggacaaggcgaaaagggggtgacggtgcgatcacgaaaggagggaaagcttccagcagatgtgcccggtccttgcccgcggaacacagtgctgctctaagtttattttctacttttcgagttgcttgaatctcaggttaggtgcatactcgtaggaaggccagtaacactcgttcgatcgattcactctgtgagatgcctgttgaggaaatccgttgtgatggtatggtgggaccggagcgggtgggagttgacgttttacagaaagacgaccagaagccgtccgatgcagaaaagtgtgacagaggcaaagaaaatcgtgagaggaagattcttgaagtcgacagcgctgacaaaacggttcgcccctgcttttctcctttgccccgtcttatcttgtgaacatgtggttctctcgccccaccgtcatatcctttccatgttaaagatagcgacttccttctttcaggcgcgaccagcctttctctgaggacatttgcgagattttctgtggccagtgccacaagagaatgtattggtgattttcgttgttttgccatcagtgagctagcatctcacatgctgcaggaataaacagaaggatcagaaacggagagggcgaacgttcacttgcttctccttcacacactgtcacttgttcttcctcgacagttgttgttcctctacatttctggatttgtgtgccgaacactctgcatcgtattcaaggactcctcatccgtgggactctgtctctgggatagcgatgtatcagcatttgcaggggcagaagcgaaggggggacaccggacaagcgccgctgatctcgcagcgaattccgcactctttcgcgagtcacgttcccgtccgccaagcacttcttgtccacacctgccagtcctgcggtggaatctgtcattcatcagtggtgtataattccttcgtctgaaagtaaggaaacaaggcatcaaagactttttatcaaaaagattgtacagagcaggatcacgtgccgatttgcctgcgacgatcggtgtcctttctccgccgttgccgattgcctacgtgcaggcagacggcaattctgtgcagtcgttctcaagaaaagcttctctattggggcagagatgctgccatgactcccctgcccctgggagaagcaaatcgacgcctgtgtctctttgtcgaatcgaacgggccgtctctgtggacccgacatctttccgttagactcaggagaaagacatatcatgagaaagtgaggaaaaattccacggagtcagtgtgtatcccctctttcagtgttgtgcttttcctcatcatcccaaattgcacacgatggaactaaagaagggtcaacagctgtctgtttagtgcggcagatttcttccaaaacgggtaaggaggcgaactcgagaagagattcaggtaacaaaatcggggatcctcgccgtacatgagaaggatttttttgtgccacatggtctgtctatagaactactgcagagggtttttcgaaacggctgagatatggaaaacctgtttcctgtgctgctcccaaatcagtgttgctggaccttctgagttcttgtctaatttacgtttcactaaaacatacatgtacttgggtacaggagttccacccacactcggtttcctttctgctgacactaccacgctattgcccggcgaaacattaacttctttaactagcctcgggccataaaagtagaaccgcaaggttgagcctaaactactgagtgcagcaatgcgctacaacgcgagtctaagcctaataatcactggaactccctcccggtggatctattaggatttcatccgatttaagtgaaaacacacagttctaccttttacggatcgtaacaaacctcgaggcagagaactcgacattccgttctcacatcccgtggtaagcattaagcgtatagcggaaggagcatgcatatgttgcgcaggaaccctaaacgcccgaagagtataaacagcccgttgccaggaaatagacactggggacaaggcagacccccgtcacggcaacaaggacttttccagatgggctccctagggtaaacattgctggattacagtaccgcgaagcattcagaccattccactccgcttgtgttctaggcatcatctatatggattactgtcatcaaaactcgtattaacacggagacaaagcgaccactctggtgcgagtatcatcagcaccgtcaagggaacccagcccgtcgcgctgcaaagggcatgcaaactccgaatgattgatcgcctgcgtcgatgccgcgcgggttgactcaagggtaccgtgtcatctgtcgccggcgcgtgcatttcgagactgtattcaaaatcctcttttgtcgccagcatccgcaaatccggcaaatcctcgcaggaaagaaacaccttccactgtctgacccctcggtcgcctcaagtccccggagtgtcgcctcgggctggtacgagcacca

SEQ ID NO: 1395 - DNA, 4924 bp, Toxoplasma gondii
tctttgataacgatatgcttacagtacgagagctggcgtagcataccctcttcgtccactgttttaacagatgtacatgcgcctgacggacaactataccacgtgtcactattacgtcactagacattcatcgaattaacaagaatgctattcgcgggagaatacctcgcagcctcttccgttcctttggggcgtcctttggcggacgatcctcctctcccgatggcgttatgctgggctgttccgttgtatcggctacttcggatggttcgttgacagacgaaccttggtcttctgaaaatgagaataacaggcaggtcacataagaagaaaggatgtctctctggttgggagtttccactcccgtcccctttcaaatgcatcatactgcacaacgagtacacctcccctgaccatcgaacattacaggatgcacatcattcgtgcgtcccgtgtggaaactacctacaaacctacgagcacgcagatcctacaatgtacagcagcagccgtgctgatgcaaaaaagagaacgccttggtcagcagccaagtggagtcaccggaaacatgaactcgcatctgaaaagatccgactgccttgcatgggtattattccttaaacataccttggtcagcgcaaggcccgtcgtgtaacaggccgacgccgtggcactcccggatgcagtggtttgcgtaggtcacgtgatccccaccgcagtttaattcgagattgcgcggacaagaacaaactgaagcaaagcacgcctccacaaggcaagagctaataaaatcgactagtcttcttggtttgaatgattcaaacgtctatgtgataaactgtgcccccacatttgacgttttgagtcgcggtctactacttacgtccccccgttgatgctaataacaggtcataagatggcacatcgcagacatcccaaaaattcctcttttgatggaaaaaacacaggcagctagcgacattcagatacagcaaccaagtacaaaaactagtctcatcgagcagtcactactgataaacgtctgattcgtggtgtacctttcgtttcgggcgaagcaaacacagctacgctgaacgaacaaaccagaactccggcaagaaacaaaagaggattctttcccatttttacgacgggttagcactaaccgaagccgtaaattcgtacgactacaagagacgcagtaactgggacaaaattcgcaacagcaactgaatacagaatgtgatgtacaggcgaaagagaaataggggaaatgacagcttgtttaacaacgtaacttcggtgcataaactaacccatcaaacttcttcgcgcgtctctgttgacatgtatgggggggccagccagcttacccgggcgctgcttccctgcatcggtggtgagtcgtcccatcgattcggcgtcgggttaaatagctatatcgctttttgcctcttgtcttagtccgaaaggcgttcaggatccgaacttctaagatccgaactccttgctgttaagccgctttcactgcgctaaggatgtctggctgatagcgtcgcaggagaactgacatcgaaaacaggaatgcggatgcccctaagcaagagagtaccagattccactacgtgtctgtggcctgacatgtaagtgtacttctagaacactcgttctcagaaggaaagatgatccctgtagagaggcaaagggcatacgacgctctcgagtttaaacgaatggatcgtttaccaacctcttcagctttgtcaccttttggtcttggaaaacacagtagaacgtgactccgataaacaaagaccttcaagagttaaactagtagtccatctagtagtacatactctctagaaaagcttggttgaacgcgtagagcccctgaagcggtcagagcctttgaagatttttatgaggccttatacactgaaaccaatccgtcgaaaaaaattcatgtcatgccggtccggagctggggctccactggcagacctcggaagacggcggttcggttttcgaccgtcgcagcgtgtctgcctactgagtgtcctgatcctacctcttgtctgataatgccatctcagcccagaatcagatacactggcaagttatgtcgtgttgcagtgccgtccaagcaacccagtctgtccgagttgtttcaagcacacatgtgtttaccacactctgtgtagaacttcagggagcacagcaagcagcatgccaagggacagtgagagggtcccaagtgctgtagagaggattttcttttcctggtgagccccacgaattctggaaatatgccgataccaccttcatgagagtttactaccaaaggctcttacgggacgtggaccctccagtctattagacagagcaggtgcctccacacgcctcacaattgccgcttttggtggctgcgagttagtcgttggcaatatcactgcagcaagctctattttaagggccaccgctagacaagcaacgcgctcgctgaaacaacttctgccgaatggttgtgagcagctgtagtatatagttctaaaggatgagacaagatacaaaaatgtctcgaataaattatcagagagcggggggatctggggcggagatgctacggttgagaacctgttcttatgtgacagaagaagccatatagaagcgtttcacctgttattgacggttgtagaccattgctgcccacgtaagtttgttggtcataatgaaacctatagccgtgtcttccacctaccacagctattcgtccttagcagctgcctgtgtggccccctcctgaacaactacagcgctatggccgctcttatgctgtgactatcaaaggttcccttttgttagcagctgaagaaccaattcttcaggtgctaacacgggcaagatcgcagcctggcacaagtgtgtgaacctagtaggatattctgcccagtttgacaaggcgatgacgaacacgaggcggggattcccagatccaaaaagctcatcaaacatcacagcgtagtgcagcaaaaccgcgagggtcgactatgaccgacttcgtgatccagaagaaaacattcgatgtcacagagaggtcagccatgaccaagaagggaccgtgcgcctcagaacctccctctttttttcttcgtgttctgtgcgatattcgcgcacgacattcgtcattgcttaggacgaaactaactccacaccacctgtgacaacgaatgtcgcttacgcaggcatcagacagaacaaaagctctcttatcatcgatgccgttgaaaccatcaaagcaacaagtagttcctgaccgcgtacgctgtacagcacatcactttggtcgacacttcattcacccagtaactttgtgcattgaaagcgtcttcttgtgtctggtgcgagcttaacagttgtgcgaaactgttcgtcttcgttggctttttttttccgaagcagcaatctagccacgatgtttcaaacccaagccttgcccgagcgttgctcgtggtagctggtgactcagcgatagtgcgacatgcataaacaatacttgaacaatccttcgggggacactgttttgacacgagtgagagtgcacccaaaaagttccttggacggaccggggatcgatcccgggacctcctgaatgcaaatcaggcgtgataccactacaccatccgcccattgtttaaagtgccagttagcgttgtaatcgatttctatgtcccagtcaccggagacatctgctttccgccatcgcacaactaatacagcccagacgtccccagtttgatcaccactttcgcaatgaaaaagacgcttcacttcaattttcttcagtgcacgggtaggaggtgttctacgtcccggtcactgtcatatcggattgagtgcggtaatacagttctcccttggagaaccacagacatgcggaacagctacaaaacgaatgtggcacccgcacttattcgtgcaaatatatcgtttgtggctcatcggcacgagacagaatcccccaaacatcttgacctccctcgctctcaactttcgtccagggatcgcaaaactctgtgaccgtgccattttatgcagaaattgatgtcgctgtggtcgttcattgactcacctgtgagacacattacagcgatgtcctgatttgctgtgtgtggtagcagatttgtctcaagtaaggatgagtggctcaacaagccttttttagcaacagtgcgaccacagagaggtgctactaccgatttcccaaacgataagagaaaacagttgttgaatgaatatccctcacgagcgtccacgcaaaacgtgaagttcacgatgcctctgtttctacagtattctccggcaagcagtagcatgggtgtatggaagaacgaagctccctgttgcttgacacctattctcctgacgctgttcccgatctctagagcgatgctgcatggaacagagcaacaggggaccgagactctgtacataaccgaaatagggacttagttacatatggccttgactatacatgcgcttgcctgactgttgatccttgctcgcacgtatgacacagacttgggaattgccgccgacctttgtgttgcagacaattttaggatgtggctcgacactttactaaattcatttcgagagacttgacgactagccatagttttcatggctgtgaccgaaaaggagcggtcacgatttgacgacacacgccaccgacaagctgggcgctggagcagccagcattttgaagaacatcgtctgccctgacatctcctcatgcctcaacatctccctcaaaagatgaaagaatcaacggatgtgtacatgccacatatcaaaaccgagtatgacgacaggcagctttcgttcctcacacacgctattgcacagaaaatcccgagtcactgcc

SEQ ID NO: 1396 - DNA, 1450 bp, Toxoplasma gondii
ttttttgtgccggcgtctgtgtttcactttttaacctctaaagggatgagctatgtgatctgtgggtttctagcagtagaacagatctcgatgctctacggccgagagtcacgctgatgttttgtgtaaaacagggactctgttgtctcgtgttgacaactttctgctgagacggcgctttgtgtctgctggttcggtgagaccggtacatacggaaagacgatgtgacatttcagtttcaggcttctgaggaactgtgcgtatcaccgcagaggatccgacgcagaagcagcggttaacactgctgcgcggcgcctctagacgctgaaggctattgtgccgctcttctttcgaacttcgctggttttctggcatctacaaggctaggcgttctgctgctttcgagggagaaacgcaactaggcagtggacagcagttccgttgtgtcgacatgagtcagcaaaagtgcatgtgccacacttggggctccgtaacgcaatgcggggagtttacctttcatatctgtgaataagtcgatgtgaatccagcgtgtaaaagtacagacgtgaatggatcaagatgtttaggacactctgcgtgagtctccagccaagggacaacagagctgcacttgagtgttttgtttcgcacgcttggactcttggttttgatcttcagtgtctattttcaaattttcacggtctgtgtcagcagcgtgcctctccgtcggcctttagcacggggaagtcgaacagaatctcgaagtcttgccacgaggtttctaggttttgtttttgaacaggtgaaggcgtggagcatgattcgtgtccctttcttcgaagtttgtgttcgcgttcagaagaatcgagtactccgtattcttgtggatacgcccgaacacgagatgtgcttggcatgttcttcatggtgtatgtggcgcctctactctttgttaaggcaagtcaagatggaagaaagaacctccagactgtatccgaacgaagaaaggaatgcagaagtgatatcgggttccagtggcgagtcatttattcctcgtacgatctggactcaccagaaaagaaagccattctcacttgtgttctggctacaagtttcgggacaacggcaaaacgtggtcacgaatgtcgacttaactgttcatgtttaacattcgtgttcatctggagacgaagccgttcaagggagctggcagtggctctcgtacaagcctcaactttgctgccatgttcgctatagcctcctcacgcaagcgcctgccacctcctttctacctcctctttcgcgtgcctaagtgcgccgtgttatgcgtgataaaacggcatctaattcactacaatcgcgcaagcaacacgctggaaagaagcaaattttcgcatggttttagccaccttcacagaccatcactcattgcagaaattcccgctcttta

SEQ ID NO: 1397 - DNA, 2624 bp, Toxoplasma gondii
gccttcaaataaaatgtggcgagagaatttactcagtcaagaggtcccaacgttgcagcttggaccgccacattcaactatcaataaaaacaggcgcgcccgagacgacgcatgcaacagcgcctgcagactcactggggtactgggggctccactcggagagaatgtattcaattttctccaccgtctcaggtttcaaatactcctttgccactgccgccacgagcatatgcccctgcggcaaacaaaggtgagaggagacaaaaaaaatcaagaacgaagagagcgccgttgagtgcaaagcagaaacgcaactgaatgctctctagggttggttatggagcggggaactagatttcacacaaccgtggttcagacgcagtcaaaggcacaaacagatcgggagcctcgcctctggtatggagaagccaaagtacttaggagaagctggtggaaacagcacgggggtagacaggaagcggcaaggatggagggaatgtgccgttggctaagctgcaagtgaggcggtggtgttggaaacaactgaaacgactagtaacgtctcagagtcaaaaacggtacagaaaagagtgacatgcttacctcgtcgtgccaggccttcactctgttcacgctccccgccccaaatgtcaccaccgagagccagagccaccagtgcctgaggcacaccatgttgcactcttgaatttcaccggaaaacgaaggcaagattgaaaggaaatttccggcacctagagcctattctggtaaagcaaatacctgaatatcatgggataggcaccggagaaaaacgggtaatctaccgacaggcaccgtccactagaaaaggaacgactcaagcagtcagaccggacgcgcacctcaagagagcagcaaattgcggcgcagatgtctgagctcagtgtctcatgggatgcaacaagcggagaagtttagaaaacacgggaaacatccgaggaaaactcgaagaagtgtggacacttgaaagaggaactcgcatgcaggcatcgactcgtgagagacaaacgtggaggccacacgcttgcctcacgaaaaaaaaacacggaaatacaacaggtcacagaacaggcgaccaggatttgtcatgtcttgatagagatgaaacttccgttttagaaaacggacacgaaacgccaaacgtgtcaagtccgcgactgccggactgcgaagcggtttgacggccaacacgcagctgctgaccgatcgggatgagaaccgaccgagagagaacacgcaaaacgaggaggtaagaccgtgcctccgtgtaaatagcgctcgcgaaagagcgtctagtgagggaagaaggaagctgacaaaaagagtcgagaaaagacctcataccgcctccacttctctcgagcttgatcgcgagagacagctatttgcacagtgtctgtaaactgcactcttgtccaggagcctggcggccacaacccaatcactaaaaggaaaggaccctaccatcggagtcggcgccacggaatgatttctttgtgcctcactgccgcagtggctaagtgagcagagaagccacgtgaaccagctcgctgggttaagcacttctttgcgaaaagaatgcgaaaaaagttcctgcctgagcagtttgccactgtaaggcagtgtcatctgatggggggttccaacagcggggatgtgcagtcctacatgcaggcatgtggtgcatttacctctattcttgtaccaggacacactggaaaaaacagcactgcatgttcacgccttgcaacttcaactattctgtttttttttgtccccgtctccttcaatgcttctaggacaccgcattttctttgttcaggaagaaaccctccgtcgtcgtgccattcgcgacacgcggaccggccacatttggtctgcgtcgaaaaaagagcatctttcgaccacccacccgtcactttgtgtgctttaagagaaagaaggtagcgcgtttttccagcacgagaagaggacgagaggcgaatcaaaaaggcagagccagcttcccagctgacccttgggcgtgggtcccccaggtcgaccttgagccactgcagtcagcgtcgctgtcgctgttttccgattttttctcctatttctgcgcttaccattggctatcaacccttacgcgatgctgcgttacgtctgtttctgtcgcagagcgcagaaccctctggtccgcagcaagagttgagattcgcgagcagcgccttagtggcaacaccacaacacacgggacaagtttgttgacctactggccaaaaccgactgagcatacactgcagcggcgtggagctcttcgaaaccaactgcggactgtcagcgtcttccgcagtttcatttcttcgtttaccaggaccaaggtatattatggttggcgttagcggaaaggagtatccggacatgtgccaggattacctagcgcgagttttctccgcactacagtagcagacctttctcggcttaccgagttccgctctgacgtttcaggaactacatctgggttctggtccggcggcgtctgcaggagtgcagccagttcgcggcctgtctggctcctctcttcgtcattcccgacaaggaaa

SEQ ID NO: 1398 - DNA, 817 bp, Toxoplasma gondii
gggaattagaggatatgtggctcgcgacaggaacttgaataggttctggagcttcctggttcccagatccagggtgggaacccccagtggacgcaaaggtcgatctggcagcatgcagacggccagttggcagcgtcgcggaactggaagccgagagccgggaacctaccccgtcggcagggctgttttccgcgagtccagtgcgttcttgcgcttccggattcggccgtatttgcaagccgttctggacaggcgctccgggtgacttctgcggacgaaacggaggagcttttcccacgatctgcggtgttccggcattcctcgctggatccgcgaggcggcaggcgggcggcgtcgcttgctggccgacctgcgcgtcagctgccccgcatgcagcgcttggagacaacagaggctcgcggagagcgcgtccattgttttccccgctctccggagcccccgaagacgaaatcagctggggaggaggaacaaagggaacgtcggagcgagactgcacgcccgcaagcgccacggagaggccagacttcgacatggagacgccgtgagacagagtgcctccgcctagcgaattagacgaggaattgcggagtggggcaccagggacaggagaagcgtcaatgccttggaagccatgtgcagagggattgccggtcggcggtcccgcgactttgggcgagactgccgagggacgcacggcgtcggagagaacctgaggtcggagagggacctgggcgcgagctgaaaggtggagcggcggatccgccatgtctcggaacctaaaatgctggagaaaaca

SEQ ID NO: 1399 - DNA, 887 bp, Toxoplasma gondii
aacttcttgcgcccttcgagaatcttgtagtaccgctgcgaatacggcgccccggtgtacggattgatgccttcggggacttctccgttcgggtacagaggcgccgcggcgacggacgccgcgccgaccgttccaggcaaggccgcctgcgcaggaggcaggccacccggaaacgcgaagccgggggctcggtccgagaagcctgacgcctgaggcagcggtcccgaggagaagttcgatggcttggcctctgtgccatctgagaaacctgtccggcgccgtgcagagtcgccacgaggatcttcgtcgaaacccgtcgcgcccaaggcccgcttggagcccaagtccaacttgggcgcgggaccgtccatctcgagaggggggaaagagagaggagagagggagatataaaaaaaaactgaaggaagaagagaaggagagaagcgacgacacagagagacggcgaagaagacaccaacaggtagaggaagagacgagaagatacttgaggggaaaaaaaggacaggctaatggaacggaagaagagaagaacaggcggaagcaaaagtggatgtgagacaagagtggcggaagagagaggagctgcgtggacgaaagatctaaaagtgagggggtccgcggtaaagaaaaaagagaaactgagaacaagaatgcggagaaccggacggaggctcggagggaaggagccagagaaggaaagcgttgaaaagaaatcgcacgaaaactgggagtggcgaagaggaacacgaaacctgatgtttgtcttcgaaactccgagccaagtgcaagggaaacgcaaaggaacacctgggagagaggaggccgaaaaaacttttttagaaaggtggaaaaccgaaggaagaaaa

SEQ ID NO: 1400 - DNA, 4354 bp, Toxoplasma gondii
aaaaaaggaagtgtcctttatggacgagaaacaactccgacgatctactcatcaggatgaagacgttttatgagcgccgatgcagttccgcttggagttttgttaaacacagagattcacaaaaaacgttcagtggcactaaggaaaacaactttggaagtgtttctacgtacgctgggaccgacgaacaaaccatatcgcgagacgctggtggaatgtggcaaaacaaagcatcctgtcacatcgacttccagcagaagtgcagcggcgtgaatcagacagtgcggcggacaggagcgttatccaaaactgctctgcttagacatgagacgttccgtcgccagttctcaccaaaatggaaccgccaagggttacgacggcgtcagacttgaaccggagaaagggaacgtggcaaggcaatcaggaccaagcagaaagggcaccgacgctgaaaatggaactacaacatgcttccggtatgacaacaacgcgcacctagagggtgccttttgaactcaagaactgggcgcgacagacgatctgaagccaaaatagagaccccactcccacaatctagtttccgcaaggcaaacttaactaatgaatcaactgtccgcatgtccctgtttcgatcgctcccgggaactccagaaaaagtcgctttagaaagggaaccggccccctacacgattcaaaaaagtcatttggcagacatgtactgaatccgagaaagcagcgactctgatctctgaccgctgacgtgtgtaaaacagatcttcgacgacgcaacgaaggcactgtgaaaccgttgcagtcgggcacacatgcaccacaactctcacacgcgctatgtcgaaaacataaaaagccagcatctgcttttccagtggacggcgacggcaattccgacgccgtgagtttggagaagccagtaatttttgtttccgcagacgatgaggactgatacgatcgtgagactttgaactggcagcgaaggcacgatgcctcgtccggcaacgaagtgtcaaaatggcacgtggtggatggagggaggactcgataaacacgcacaaaaaattacagcggggagcaagagcagcaatgaaaaactaacgcgcaacaagcagtagtgaaagccatcggagaaaataagtttgctacgactagacaggaaggtcccgctgtgctgcggcgtgggagctgctggacaaacagctacataaaattcaagaagagggcacaccacaggctcgcgaatctggaacagcatcccagatccagcagaacgaggacataaacagagtgtacctgtaccaggccaaaaaagcatttccactcgtgaaatcgttggtttatcaacggcggaacactttccctgttgcccaccttgcaccgccggagcaaccgtctacaccctgtgctacttaaatggaaactaaggagcggcacatactgcatgttcacctccttagctgtcggcagcccgagactacgaaaaaaaagcgtggccgcaacaaacagactcaacaggcgtacttacatatcgcccgcccagtcaggccgctcgcaaagcgcgaagggctgaagccggcaacgagctcgctgaagtgctcacccacgcactgtgaatcacgccgttgctcgttgctgagtgcgcgctgtgacgctctcttcgtttaaatgccgaaactcgggattcctgcctgcgtgtgcgagcaaggaagtgatcatttgcattgattttctcaaggcaagagtcctaacaagctcaccaacccttcctggaagaacactgagctgtgatttctttctgtttcccttggggtgaccagccgcccgccgcgcatgtacaaagcgcggacagcacagcagcgtcatgtgacacccctcgagtggaaccaggccgaagtctcctctgagcctgagcgaggctgcaagcttctaccaggtttgactcgtgagcattcagtgaaagtgaactgaccaatctgagtatgccgcagcgactagttagcctaggtgaagggcatacacgtgaatgatctaaaaagtgccacggagccgccactatgcctagctcgatcatgcgagggacagccgcgtttgtcttccacatcgcgcagcggatccacagagcgccctcgtacgcgcctacccgccgccgacatgagtagccaggagggcgcgaattcgaccgtgttaccacgcgaagagcgaaaccaatacgaagggttctgtctggcaagatagggccctacgcggctagaggcaggccacaaagaatgcacttttcaactagtcaatcccacaaaaccagtttcacgtttactgccgtgacatgtgcttgggaacaccgaatagtctgagctgacactttatggaaatccgtccccccacgacactcatacccggatcggggccctggctctcctgcacggtcgattgcccggggtcaactccgatggcgaccggaaatcacaggcgcagcgccgttgtttgaaggaacaagtaaatgacacaattcctgtgatggtgtcgtacaaatagtactatcaatgcatcttggatgcagacgtgttctttctcgtttttttttctgtacgggttctttccaataccccagcactcgaccgggccaatcgttttctgtgtgcctggaggcttgtcgacgggttctaatgaaatccccatgcctgaccgagttgcgtcaggaggctccactcattcgtttttttgagttacaggagaccatctagcttgccctctgatgccgtttcagtgcgtggccatcttacgggcttcagcagcaccctttcgtggctcatgagcatgtaggtatcgcactctacctatcaaagatccgtcgacgttcatggctttgatcaacccgagatgatattccacctcactctgcattcagcccctcgggaaactctctgttacgttggcatgacccccttcattctcactatattcgctgaaagttcgctgtcagcttccctttgttttgacgtgaaaaggcgaggtaccacggcgaggtgaacgaaccttgcttcggccttcaggaaaagttccgttccaacgacaggaaaatcctagcgattttccattgaagacgtccgtgtttgtcgtgcctcttcaagctgttggagttcgtcgaccgccagagtatccggtccctttctggacccagggggcttccctgtagagacacacgataaagacaagttgctgtagaccaaggcaaaatcggaataagccattgcgaagtgaggctttcatcgctgcaacatccggcaagacgtgctgcgagctcgtgcagaggagtcaaattctgtagagttttgggacctcagctcgtcgaaggggcatccgcggtacgctgaagaacaacggagctgccggcattacgatacgatttagctggtagactgttacccccagcgttacagcatcatcgttgttcagtcctttccgacttaggaccgttctctcaacggggatgggcgacggtgcacatcaccgcgcagccgagacgtgcaaccgtatcgctttactgagtctctcgtgtttcaacaaaagtatttgtgtgttcggagtatcccctacaaagcatctgcgatgagagtgtctctttgactctaaaaaagcgagttgaggccaaaaatattcgctctggttccacgtggattacacaagacattgagtgtctgaaccgcttcttctgggtgcaatccactattccctgtacaccgcggccgtagccaattgtgacctgaagaacgatgtacaagtgtgatgcgttgacaggctgattttttccattttgaagatcaagagtgccaaaacatggcaagcatcctcatgcgtatcccgacaactattatcggtcacgctcgcatattcctctgtcggtgtttcgggatcactttcggcagccgctggaggattagcgcactggagatttcacgaagtgtatacttgctggtatcgagctcttgtttgctttttcggtggctttatcggcggaggatcgttcaggctctaagtcaatacagtctcatctggaggtcgagcatgccgcgttaaacctgtgcctgactggaattgaattcctaccgatactgtaaaggaccaaccgtgttttgctttgcattcgagttttgtcgatactgtacatagttagaaggcatatactcgattattgaattcctggcattgtccctaccacaggtatgttactacatcatcaaggaaaccattccaaataaccgtcctctacaaagagacgtggtccactcgctgcactggcttccatgaaacaacgcggatacgtggagagacaagacaaaca

SEQ ID NO: 1401 - DNA, 3514 bp, Toxoplasma gondii
gagacactgagagctacatcgcttcgcctacttctccgacgaatcgtccgggtggaatcctccgaagccaagatccttgcaaaaaggcacgtcgctgacttgttcttcgcgtcgccacccggcgcggaattcttccgcagtggttggagcataacgaagttcatcctccgtgacgtctttgccacgatgctttttcttcctagttttcacaactgacatgttgccgacgaaagatatcccctgtggtgcgtgcataaagtggctcgaagctgccggactccctgcgtccggactctgactgacgcctttttctctaatcaaggcagccaattcgcgtcttcttccgcgttcctccgctgcgggtgcggtatcctggcggcgaaggcggggtaatgtaatggatgatgctcccaagcctttgcctgatggtgaatcgatgaggccatgcgactccttgaaagagtcggtcctcgttacagcatcggcgtgaaggaaaggacttagagtcgcttccctcggcaggtccctctctgtccccaaaggcctcactgcagaaaacgtgccgccatttgtcctgtggacgtcagatatcgcattactcagcgtttcactggagacatgaagactcgatgcgccacaaaccaccaacagagcgaacacgcagaccgacagcggtctactgccactggaggttgtgcccctttgaaaaacatattttgagcttcctcccatcactgcgctgagctccctggtacgacggtagcacaggaaaacgttcatagcacctccacgcatacacctgagtaaatgctgagccattttctttgaaacattttccagaccatgcacgacgtgaacagtaagccaccagggtcaccggccgtcagacaacagtccgcatctgctgtgcatcatcttcgtaacggatggtcgagtccagaccctttgaagcagaggtacacgagagtggcttgcaaaaaactcaactgaaattgtttctcttttcaacctgatggatgcaaggagtttgtgtgggatccgcatgtgacgtcgatagagcccccaagtattgctagattgttgcaactccgcggcatcctgttgcagaaacgcaatggcgacgaagccagttacgaaacatcctccagatggcagagcgcgctacatggaacttgtggaggaagtcagggatgttcgcggtgccagaaggcgaagagtaaacgtgcgactggaggcgacggaacgtcttggaacgggacaccagctttatgaagagggcaacttcaactggagtttccagcgtcactcccgtcctttggttgaaaaacttggtcctctttaaaagtgaacctggaacaaattcattcacatatacgtatgcatatggtttgtttccctacaaaagatttacggcgacttggccacttgactcgagcaagacagttaacgacgcagacaccgtcaccgcatgtacggctagcctccatggttgcccgttgccagttgtcgacgaaattaaccaaggcttttcggtgaggattcgaaaaagccatgtttccagcctactagtatacaatgccagtttcctttactggcgttgccgagcttcgtcttgtccaaagaaacgtcatgattgtcggttaattcgactgggctgtgtcgcacatcaccattcgctaacggcggcccatagcaggttcgagaaccatgttttaaccggtctttcttttcatttctagtcaaatctctatgatcttacataatgtcaggcgcttcgctgttacggaatgttcagtcacgatgtttcgcccgtcggtgttggagacagaggagatctagtgtctacagtttcactgcgctcctggaaggctcatcctcgggattccgcaacaaagaaggagaaaagagctgccagtcgtagctggtttgatatttccgccgttcggtaaatctcagacaacacattatggtttcactgggtgagtgggtattttgtaacggtacgctgccaacgttcacagccagagcgtgatatcgaggtgtcattcgtgtcagttttcgagaggcgggtcacccggacggcacgtaacgacgtcttaccttggcctcttttgctagttcttcggcttacttggttttttcgcctacaaatgtcaattccatgtcgatgacatccatgagggcacaactttacctgcgactgaaatttctgtacaaatgatccgcgatccagaactgtgtgacacaggaagaatatacagacacaaagaacgtagcagaaggcttgacagtccagttggttggacggtcgtcaaaacataagcacaagcatcgcggaggatgagtgttttctttaaatgtcacctgcttcttttaggccagaatcagttttctacagttcgttttgctgcgctttttaggctgctggtttcttcgcatcactacagtgcattagtcgccttgtgcctttgatgtaacgcgggtgtctactaccattcattgttttagtggagctttatgtcttgatcgcagcaggcacagatacaccgagtaagaagtactcgtctggatgtgaaatccatttacctttaagttgcaacagagacaattattattgttggcacccacaacggctgcatcggtacttctgcatctgtatgtgagtcaatacacgcggcatccatgcctgcattcatcctctcaaacctgttgcctactcggaagtacagcaccaaagaagcacttctacgcctgaatccatagcaacggtccagggaaaagaaaaacccgtggcgtgtgacacaataccgcgtccctgcgcatcgctgtctttgccgacgtctttgtaaaagaacaaaactttttcattcctctctccttgctagcgaaggattaaaattcgcctcgcagccgtggcattaactcttacgtgttttctctgcaggagtctgatgctcgtgaatcctccacttttgtggatctcgtttaacgttcctgctatcgcactttatctgaccccaccaactgtgcaaggctatccaaggtgcggaaagaatcaggcctgaattctctgtgaaatacaccaccagacacggtatagctgatgactacgtcggttctttgtaacggcctgcatgctacaaatgagtgattccggggaaccaactacaagctttaggaagctcaaaatgcaggtgacgtgacatggtgtcgacctcaggggcaagaattggccttaccaaatgcagtaatagagtggaacacgcacttgatgaacgggtgagaggcaggaggaatcagcgcttggttttttccctaaggtgacccattgcgctgcattaagatctcagtgattccgcgctcgcataggcaacagagagggtgcatgcctcctggctttgcggtagacgctgacagttctttagccattccagggacagtacaaggattaatgatgtccacatgtacagcgcaaacaaggacgtgtcccttatcgctggtgcaactatttaaa

SEQ ID NO: 1402 - DNA, 1943 bp, Toxoplasma gondii
agagatactttctagcagtttttcgggctattcttgggtagaaatggcgagacgaccgacggccgcgccgccgaggtgactgttcgttgatgagaatcttttgtctcaacggttgccaacgcatttctgcaaaactgtgcccaggagaacagctacgaaggccgatccttgctttctagtttttccgcacttcgtgttaagcccattaaacatcgtggtatccagcgtgcgtttgggaatccactgctcctaaatgtaatggtacacgctgtaagcaaaaagctccataatataaaatttttgttgcggtttgagttccagattttagtagaaaacagcatagacttttcccagcaacactgcatgacagaacgtaaaattccagagaacggcgacagatacacattgcttttacgcagacacgcctcaagcgtgtcaaagagtttagcagtgcggcatcactccagtggctcttcaccggcaatcaaccctgcacccgttggtggcttgtctacatacagtcgccttcaagaaaacgcgatgggtgcagggactgttgcttgaagattgccttttcttctgctacgtccgtttcaaagagtgcaacgaaaggctgtctttcacgtgcaagagttttcctttcctggtaacgagccgtttgtcgaaatcgaatagcacggaaagtctgaaagtgctaggggtatcgagagtttcacggtgaaaacgtacactgtgctcgcgcgacaattccagcactgtatcagttcatcgtgtttttgatttcgcaagtcactattcaggccaaatgttcatgataagttcgttaaggaaagacagaggcccggtagagaaacacattaagtggatgctgttctgcttgttgggatgtttggggcgggcatgcgttaagtttaagaggttgtctccccgagaaaagaaatggggtctctgcctccaagtaaagcgtgcactcggtttagtagttgaagtctgtggctgtgatcagaaaggaacattcatgttggcattcacggagcaactcgagtgcctgtcctgccctgttgaaaagcactattcactgctctgtaacttgtgaaaaaagtggagcacactgcctcttctaacccctcattctacacggtggttcaggttgaagaggaattgtgcttctcagtttcaaaagggaaatgtttccgctaaaagtgtggccttctgcaacttgttgtgttgtcgcatgcatgctgtgtggcagcgccgacttctcgcgggaaaagtctgcataccgtcgcgttttggcaagactcgaaagcgagacttccggtctccgtgttctgcgtttctacctgtgaaggggagagaaaaaacgaacgacggtggcgtcttctccttgtcgtgatggccgaacctgcgcggaaatcctctcttgctgcttcccgtttccctctcgtgactagtcgatttttctggggctttggccccgttgaatcacgggcccgtgtccactgtcttgccttctgtgcgcctctttatgcgcctctgtatcgtcgcctgtcgctcgtttccctcgttttgtgatccactggtagtcgcttctccactgacttcagacacagcggcttctacggggctctcggttgctcagagtctcgacgcagtgaacctgcgatcccaggttctgctcgcttcagcctatgcgagttcgtatttatctccttctccattgctaccttatgtaatcgtttctcaccgcacgtagatgccttctcaattcacaagagtgtggagccaagaaatgcgctccaagacaggcagagatgcacataaacaagcatatacaaatgtatgtgtacaaaactgtatgcgtggtttctaaagcatccgcgagagtttctctccaggtggatgcttttgaacgggttctgccctgaataagaattccacga

SEQ ID NO: 1403 - DNA, 3648 bp, Toxoplasma gondii
gggatgaattgggaccactaagtcgcaggccgtcggtgctgttcgttgagccccagtttccacacagcccgcttcttgtattgactggtggtaaaccgtgcgactgcatgggttttgcatcgttttgtgcttgatgagctctattgccacctggttgcaatacatcatccgaccgaagtaagtccaacatggagctgaggagacggccctgctgttgagcggcctgttgggctgcagctgcctggcttgcagtgtgagaatcgagacccatgctctgaagctcgtccttgagtcgtgtaaactcggcgactcggagatcatttactgcgctacgagcacatccgcatctattgcaagccctacgcctgggataatttatattgctgcagttattgcacctccagttgccaccctctcccatacgtggtggttcacgggcattccctcgaaatgccatcgtggaaccaccgtgcggtgtgccaggcatgcacggcgtttggcttctgggaccgctcgtccccgccgcacctgaagccaccacatcagatgaatggaaaggacccgtcccaccgacggtggccggtgtgccgttcagcgacgggatcataagggaggtgagatcctgcaatcctgcgtatccaaggccgatgggtgaatctctcaacagggaagatccattagaactcgccccagaaaacgtattggtcgatccaatgttacctccaactgagtcattgcccgaagatgcagccgaaatagcaagaggaatcaagttcatagccaaattgtcgtacaacatcgaagactgctccagttgatctaccccgctgtcaccacgactatctgaagagggagccatacacgtttcgctggtgcccccaagggcggggtgaaacgatggcgctccagataacgtctgtggtgtgcttattcctgataaaaagtcgccgggactttctgcctcctgtcgagcatgctcggaggttttttcagaatttactgttgccaacaccgtggcaccaggggcctgagaacgccctccataaccttcctcagccacttctggggacattttggacgggatttcacttcagaacgaaatgagcctgtttcctagggagggtgaacctgaacctataaacgggcacacttgtgctgggaaaaggttatctgtcttcaacagacttcaagacgaggcgcggaaacaacgatcaccgagttcatagtacgcttgcggcaatcacacggggtctgcggggaggagggggcactgccgacgcgaatacaagtatagccttccctcttgccacgggttacttagggtcagcaacctacacagtgtattcgttgtaaataacgctccgcacacgacaaggaggcataacaattaacagggacctggatgagcggctggcataactcgagtaccacttcagcatcggcacaagtccagaagcttcccgacaccgaccacatacaacataaacctgttacaggctgtgaaacacacgattacgctgtttgtaccagactcttgctcagaagcagcaaacattagcaaacgagcaaccacggtctaccagaaaggacgaccctatgctagtcacttgcgctgaacaggctccagctgcaaccatacgtaacgcgcacgatgacctaagatatccgtttgaacggccggtcgcgcacgctataccggtgatatacctgttggtaagacagcgccgtcgcctgtgcccacgaacaatagaatgccaacaatcgaagcacggttttctccccccgcggaaagaggactgcaatggagctgcagtccaaacgcaggatttgcggtcgaagagacaacgcgacaatcgaccgaatttgcccagaaaaaacaggcacgaactacacgacaactttattccctagtcttctggccagggatacgagatcggtgaacggagacccactcagaatcacctacggtgtagtaagtgcggggcgcgcctgcgggacgggtactgagggatgtagattcaccaaattaaagagggccgatcccggtctttccaaacccaacacgaacgctgatcaaggaatatgcagcaggtgcaacttccacttgaggaataatgatagagccacgggttacgcctgacgtgcttgggtcatttatctcgtacctgcaccagccagcaaaatggcgccttcccatcatcccgcgcgtctgtgcgctggtgacaaaacaagaagtgcgatcggcaatgccatccacccttctgtcacacttccattgcctcgatgcccatagaactcgatatttacttggagaaaaaaccattccatgccccgggcgaaaagaatcatcacgcaacacaaatagatggcgttccgtccctccggcctcggcgtgtctccagaggcaggtaacctgtagtaccgctagtccgacacaggagtcgactttctcgttttcagaaatgccgacacaatttgttttcacccgatttcatcacttcccactgcttacttgacaaacacgacccttctggcaggcatgcactttcggacgggacccggctgcgcctgctcggcccgtccttgcttccataaagccggcctcacgaacgactaacatccgaagaatggcgttcagctgtataagcatggtgcagccggaccgccacccgacgtcggtcttcgtggagcaaatttacactccctagtagtccactatgccggagggtgagacaaattcctcacatatttgcctcatttgtccttctcgtacacgctgcccagaggggctgcgaccgccttgacggagcctcctcaggttggtggacagcgaggcaagttgaccacgcgcgcagcggccggccggcagcatttggtggtggtagccagccgtcttctggcaggggctgctgcttgattggtcttgcatgttgcgcgggagcatcgctccacgagagacccgccgatggggtccagcgagcggggtttctatatcaaccttaccttgaaagattacagggctatcccgttcccacatgtcggccgtttgacgccttcttttgatacaagccgtctccgccatgcgtgaaacccacgcagatggtttagccggggcggacaagcttcgatgtagatcacacggggaaacccgcagccgtcatgccattccttctgtagcatgtatagcaggcactagagactcgtgaagcctcctcccgcggcgccatgagcggggtcacaagtagctagcatgctgcgagcgaagcgatgagcaatactttcctgcgcgttcgagccatgtatcgtgtgcttcacttccctttcgtgctcacggcggagtcgaccgcgcttggcggagggccagaaaaaagcagctttttccctctgtgctcaggaaactgatttgtcatattcaggtagaagtgcactatgttccggccaggatgagagacaagtatgagtccgcgttttcatcgagaagctgtgagatactcgcatctctcgacgtcgttgcttccccttttcactttcctgacttccaagactaggtcgctcagtgggatttcaacttgatttgcccgaacgaaccaattaactaggcggggggaatctacaatttgagatcggcattacctgtggctggcagta

SEQ ID NO: 1404 - DNA, 4076 bp, Toxoplasma gondii
gctccatctagaaaacgcgtataataaattcagtgaagattacgtggatatgctgtaccaccatatgtaaagtcgtcacgcctccacgaatgccaagaagcatggagaaaaaaagcaaaaagacacttggagggacggggtagaacggagttgcgaaagatgacgcaccttgtatgggagaagtgtgtggcgatccggtcgtatacagcgccaacgaactctctttcgagctcttcggtcttgccttctttgagaagctgatcggccactgggtcgcaaactttctccctcggcggcattttcacacgttccttcttcttcttctccttcttccttctcggcggttcgcttgtggtcgtcctccctttttcgatgtcttcgtttcgtcccccttcgccttgctctttgtcgtttccccgaccaccgccgacacccggtgactcggcactcgagtgtacagacgctgaccgctcttgcatcgccgctggaagctgtgtcatctcggtgcggttccttgttgatgttttcgcactcgcccatcgatagttccacgaccggtttaggggtcgacaacaagatgacctttggaaggcggatagaggacaaggccgaagcttacggcggcagccgttcagcgctcccagtatcctctagacgccgaaagttaagggcttcgtttcgtcattgtatatgtctagccgtgccgtttcagaatcggtcgcagctgttctctgcttacaccgcacagagccaagcgagactcactcaggacgtggcagagtcgacgaggtctttcccgtcgccagaaactttagaaacttttgcgcaatctaatggctcctacagatcaattgagtgaggatgttcagcggaatgaaggtcgctcgctcgcaaagctcatttcgggagtgtccattgttgtggaaagatgcgctgcatgcgcgacgtccagcaaagaatgcggggagacgtagacgtgaagtgagcctccaggaaaagaaccatttggaaaagccgtcgcgtggaatgggaaaaccaagaggggtatgttctccgaggtgtctgcaattcgatagacgttagccgttgcccaaggacttgcaatttttttccatctgcatgcttgtctcgatgagtttcaagcatgcagttctagcggagaaacgacccgggtcaacagcgagttcctttgctaaaccgacgtaccgcagttttttccggtcctcctggtaaggatctgccattgacactgcgggtgattcgagctgggtagacgacaggtttaacgtctaattcttcgctgcacaagagactgtcgcttctattggttctggtggccgtgctgtgtttaaggaaaggttaacgtttcgctttcgcactccacaaggtttacaataccaatctggtagcgcgcagcattcagcttgctcagtactcgctgcagttcacaccgcttttacttcttcgtaggtgagtgatgcgctactacaagaatggcaaggttatctgttcagacacgaagagggaaacactctgtctcggaacactaatttgcggctgaggacggcaggcttaccgagtttgcagattggaccctctcccccatgtgagtcgatctctatgcggggacagcgtgacgcgtgacaaagccgtgtacacacgcttgaccaaatgctgtgagggtggtaggcgatgagcgttgactggcgacagcttttgccatgaaaaatatcgcttgtaaagggcctgagttcgtgcgtacccaccaggcagaaacttcaatgcaggaatccatctgaggtatctgccgcttgaaagagttttgcatcgaactacaggatgaaatagggtcatcgttttcagtcgcgtgaatctcagttcagaaatcggtgcccgttaccggtttttgtatcaggacttgccgcgtatggcatcccaccatatgtttgtaaccgttctcagaacatgctggatatgtatgcgttaaaaagatgcccaactaaggcacacttcaatctgcactaacgactggaatgatatctttgaatccattcaagtatttataccgttccttcttttatgcactgctctacatccaaacactcctttaagggtcaaagatcagctagggttgcggcagtacggtgcgttcacggtgacttttttactagccgtcataggacgtgacggttggtcttttctgtggcaggtgcgggcggataccgcctgcaagagacagtcgttgtgacgacatcaaacacactgggccattttggttcactcttatgaataacgtctctgcagaattacggccgcttacttcttgttctcacggcagccgggtgaccgagaaagttttcatcacccttagtctttgagtgtatatattcaggcgaacactggcttcaataatcgatacgctcctgtgtttcgaggaggctggaaaagcaagttagcctaatagactgtgttgaggaagcatgttgttttttcgctgagtctcttgctgttagtctacaatgtgcttgtagaatctaggtgacagtcacacagtcacaggctgataaagctcaggaggcgtcggcttttaggatgcccttccaaaaagccccaaaagcgtcaccgttcagcgcactgccttcaaggtgaagccgcgcaagctcctctaactgatgtgtgtgccggggaaaactcgcgtgttgcctccgcggccactcgacttctcgttatttccaaatcgggcagtccgctacaatcacactcgcttaccagctactgtttccactgcagatcacatttgtttcatcttactacctgccgggcgtcgctcccgtctcagccgcgctatctatttcgaacgacggcgctgctttgtgaacgtgtcatgtagtcacagtgatgggcctgcaacgggacattagaccgaacctgcgatagattgaaatggtgcaaccgctaagcctctctttcttgcgtcggtaaaacggctgtttgtcaatatcccttcaatggcaggaattaggttttgagaacccagtaagaacgccctgcgcacatccatatggcctttaaaatccgaacgagagaagcatttggctgtgcagggcacaacgtcttcaatatcagttgtcttttgggaagacggggatcgagtttgtagatatgttttgtagaattcgtagagtcgcaacgtagacccgtactcgtccacttcagagccgcctctcaacgttcaaagaagtgttccgtggttttctgttcattccttagtcacaaaaggcagaaaatcgtgcaatgtgtccagtgcggttgcatcaaaaatatcaaatttctggtgtgggggacaaccgtgtagtgttctgtgttttttcatgcatgtgcagcatgccacagtggtacgcaccacctctgcgcgtttccgcggcggtagtcgtgcaagaacctggcaggcgaccataaaaagaaagtgaggcccctcacaaaatgcctacgatcctacagcatgacatacattatctccatatctgtttcgcattacgtggaaacaaatttcctttgccctccgctgtattccacctagaggaagcagagacgtacatcgaattgtacagacgctggaactactttctcgaacctctaggggtaccagtgggcgtacgtattccggaatttgagtagctttcagaattcaataacgtctgattggcggtcaaattccacggaggttaaactgaaacagcaatcaaagtacagttcgcagaaccgattattcaacacaactacggtttttctgaaaggagacaaggccgcatctgtcaccgattccggttgtccaagtcctgcataacctatttagtgtagacatctcgtcccttaatagattcaaacgattctacggaccagaaaaaagaacgtcgccttcagcatgcatgaggacaatctatcgggcgaggaagggctcgcaggccccgtctcgtccgtttttagcggatcccgtgaaaccctttgtgctcgtgaacacacaacaactgactctgacagtcaggcaacatcaagtaaccaaccattcgtagaaa

SEQ ID NO: 1405 - DNA, 1828 bp, Toxoplasma gondii
caagattttgaaagagcagatcctgacgtagagtgtgttttgcgaacgtactttcaaacccctgcctttagacgaagccacgagttctctttaaaagttttagaaaaaccgtttgacactcgaatttccgcggctgtcgatgttcatagtgtcgaagaatgcgagagaggctgtctcttctatctagggggcgctccgcccgtagaataagggcaggagaaacgaggagggtgagaacgaactctctggaagcagaaaacagtttttcggactctttcgtctggaaggaaacatatccgagacgacgaccctctcagcgtgaagtctcagaggccgagccgagtgagtgctgcttaatggaatgtcgccgtgaaaaactcggatccattggaaacaacactgtgacacatttgaactttttctgtggacagttttattctctgcgactggaacgacaccctggttggcatcttggacgcctcctttaccgggatcaagttccttgtttctcggcaagctcgggaacctcggcagagactactcgacccctctgaggaaggctactcaggacttgacacactgatggccatatagtgagatccttctttcttcccttccccagtcgtatcgctttggcccagcagacaagaatcctcgtcggtgtttgcgcttgaacctcccttccgttgtctcaagcagtccactctggggtctggtgtattacagcaaacataaaaaaagacgttgttgtctgtacctctctcaacaggagttgtgctcaataccgtaggcggtccgacgtctctgttcggtcggtggagttgcctgttctgaagcgttcgagtgtttaaaaaacgaagacgactcaccgaagcgctttactggggttcctggtcttttcgttcaagcgacatttccatgcttcgcaggcaggccgggacagaccacccgacgaagccgagatcaggagcgtagaggaagcgttttcccccgaaccaaaagagagtggaaagtctccgttttctccactgtcaatccaagcaggagaactttccacctcgttgaaaactcgggagcactagaattttctttttttccgaatttttcagcgaaaacgggtgcttgatataactgcagagcgactgcgcgagcaggaaactttctgcttttcactttagcgaaaagcggagcatttcgcttctctcgaccctttttattcatgcgcctcgagcttcttggaaagtgaagagcctcgaaagattcatgaaagatgcatgcttccgtcaacagggagcgcttgcatgcagcagcttttctcctcgttccgcgtttgctctctctgtggggctggaccgtcgattcattttctctcggtcgacacggttggttcctttcttctctttttttcaggcggaagcaagtctcttctttcctgttgcgtcttgacgtcgagaagacctctttctcgactctgttgtctcttcactcctcgttcctccccttcctcgccgctcttcttgtctccgctacctcaaatgctgcaagctcgctgctacacaaacgcaagacgctcccttccttcgttgtcttttgtcaaagtgcgtctaaagtcttcttaccacatcctctctgcctctccctcgagagctgttagagcactccgagcttgttttttcctccgcttgtcacttgcgcttttcttttcctcacctctgctgcctcgtctgcgtttcctgtctcctttgtttcgctttcttccacctccttcctttgattctttcctttctgtctctgtctccgcttcctcttctcccctgtagatccaaga

SEQ ID NO: 1406 - DNA, 3906 bp, Toxoplasma gondii
atacaaaagagaatgcctcgcggcaagcagagacaagacaagtggcacgtcaggctgacgagcagaaagcagcaggaaatactgacagacatttcgaagacgagggggacacggcaaactctacttgtaataaaaagtgtaggaaggagaactcacagcgtgaggggtccttttcgaaaggcaatgcagcaaagtcggaggccgataatgctatgtcaaagacaaaagcgaaaggaggtaccagactgtcaaatcaaacgttaatcagttcgttttttcgaaagaaacactgagtgtgtaactcctctagtgcgttttttggaagattcggtatgtggattgatgggcagtggctgggcgggcattcagaaactgagtaccgagcaactgtggcaggatggcatagggaatcttactcggtgcttcgtgtttgccgagacctgtgaaaagttgatgctcctgttatggcgtacacatgatcagaaccttgcacctttgctttggtgcttgctcgcgtgttcggtaggaacaccacgtgtgtaagccgtggacttgttcttgtatcatgagaattgtgttgaaaaaggttttgatatacgatgatggactatagggggaacggcgtggagcgccggcgcgcgacgagtgttttcagatataacctaatgtaaaagggttcattttctgttggaggtctcctcgtgcgtaggagaccgatggacgaagttttgacgccgagtgtgttactgcgcttgtttggcgcgcgctgcatggaatgcagttctgctcacgctttttctgcatggaatgctgccgcgttgcaaatttgaaactactcgaacgatgggaggaactgcgttctcatctgcacaccccatctagtacgaaaagaacggttacaatcgtaacttgttacatactgaatttgttgcggaaagcccgaaacatgaaatgaattgcggtcggtccacatacgactgccacggtgcgatggaccggttctagaaacggcagggttcgttctatcaagacacaggaaaccgtcaccagtcatccgtagcagcgcgacacagtggttggttggagacgtttgtgatattgggactgtgttacaatgtgagaaaaccaaaaagaaaaacaatgatgatgtgtaacgatgatgcctctattgtcagccaccgtgaagattgaaaaaagcagactgccaccagccgagtacggtagactacagaattgctgtgatcgcatcgacataaaaaactcgcgtatacgtagatgaaagaaacctgtgatttgttgaagacatgcggctcttctccttgcgcccacctcaagatacttcatcgaagtgatacggacggttgccgagtttcctgccacggctcgtaccacaaaagaaacagattaataatgccatcctagagattttgaactcgctgtcctcttgcactgctatggctaaacctgtgccgtgctctggcctccgcttcagtttgtgtttgccacgtattccagtgtcatggagtagaacatggcattcgtttgagttacttcggacagagccgaacaaccgtctcctcatgcgccccccaaaaactcgagatgaaacgcttggttctggtgcgctctgttgaagaaggtgctggaggccacccaattaccaccatcaatagcgaaagcttccgtcagaacatcgaacgcttcatctgcttctcgggaggcgacgtagccaccaccacggtcacaattgttcaaggggttagtcgttatcattcgtccgttcgtccgtggttgctagaagatgtgtcgcctcactgaccgacggtctccgaagccgccgcagggcgagttctggctgcacccgaatcgcggaacaacagcctgcatctctgtacccgtgtgacgcgggcgcctctaggttgaacccagcattggttcggcgaagcgactgtaaggaacaaggctggcagtcagggaaagggtgtcttgcgctgaatgctggatcttcggaacacgatgtgctgaacaatcgtgaagttctcgcactgcttggctctcttgttccctgtcactaccgtttctgttgttgttgttcctgaagacgtttcgccttctccctcttgcgcttgtcttccggactttcttcgtccgcaccaagaaacggtgtgtcctcaggcatatgtccagcatatgcttctttctccatgcgcacgagcttctgttgaagacgttggagtttctttttgtaacggcgtcgttgcaactgggtgaggccgacaccgattgcgcctgcaagactactagcgatgaggcccatgttattccgcttgtgcactttacggtcctctcgctcgagaaattcgccctttttgtttgccatccaatacactagcatacctgcggatgccaacgccatgctgacaatggacgcagccccagcaaagctttttttcttctgcagattcttgaacttctgtaagtctttgataactgcaggacaacgtcgcatccgatcaagcacattccacatttgacaataggtaaaagagcacgaacagtctgtgacatcgggcggtttttcggcttctttgcctcgaacacgtggcggacgacttgtaatttgcagccctgggtggccagatcgtcctttatacctactcttgggcagttgaagcatcaacagagaaagcgaagaggcagcaacacctactttacaaagaaactccacagcggcattcccattgtcaagcgagtactggaacacttacatgcgggcgattcttctgggtccaagtcatcatcttccgattggtactgttgcagaagtttttttctctctctgtcagctgcacacacaccagacccgcgcatatccaatttcacatcgaaggctctaagacacaatttttagcaagcggcttcttggcgtccgacctccgtgctactaaacgtgtccacagcagaagcgtgctcgaacatttgaatgtttctaccgcagacgcaatcacccagttgctttcaccagctggacacaggaccaccactgttactggctccagagttcaggcaaggataaaggtcactaggatgctaaattccagcacctttcacctgtcttacgcagtccagtgtggtggtggtgcagagacccaagagaactgggctgtctgtatcccgtatgtggaaccgcatttgcgcctacgtttcgttcaccacgaagaaacgacctcccgtgcctcccgtactttgcccccaaagtactctccgttcgatccctacctttcatcttgcggtattcgcggttctccgaaagaagctcgttcatcgtctcgagaagctttgtctgctgctctttgcgcatcttgcttcttgtagttttctgtgcattttcttctccatcctttgcgtcgtcattgtcggccgttgtttccactgattgctgattctttttcgtatttgctgcctctctccggtccttaataacagaggggccgttatcagtcaagtcgagttcttcactgcctcctgcgccttgctctgtagcgacatgcgctccggaagaaggaggtcgcgcagctgccacactaagaaacaagattccgagagcaacaaggattgcagctctacggagtaccgcacaccgcacccgatacagtgcccagatgttgggttttgagccgttcggggcctccatggcggcaagggctgaaccggaaaatgaggatgtatagaggtagtggcgatgatggagtcctgtccagctgtgtggagatcatattccgcagttgggtgtgcactgattcttaaaaactagaggcagacatgcaggcgggcgcgagtggagccacagttttcttttgcccgaaatatcgaggcgtccctgcccgccggaagtgctagctctca

SEQ ID NO: 1407 - DNA, 3819 bp, Toxoplasma gondii
tctctctcttgtgtgtgtgttcgatttcactgtctatgtgacttttacttccatcatttctacgaacgtctccctcagattcctgtatctgaacaaactttttcttctcgtccctcgagccaggtgtctctcccacggcctgtctccgagagtctcgaagccggcaggcgaactcggaagcgaattcagcgacttgtcttgcgacttctggagagaagtctggacgcatcggagccacgaggctttcaacgaattgactcagatcctcttcctcgcgtctctgtcgctctttttcagggtcgtctaggtcgcggaaccttccttctctgccgcggccgctgtctccagaaatgaaagagacgagctcctccaccaagtaggcgtctgcatcttcgaactgaagcagagctctcagcttcttcagagcccaagcggccagctcaggcggcagagacggttgttctgtcatctgaacaggaagcggagagcgagaaaacttgagacgaatgcgtcgagaagactcggagagacgcctcagacccgctgcgacacacaggcctgttccggacagcggaaggagcagagagaagagagaagggaaacaggcggttgacgcagagaacggaagagcgagaatggaaggaagagagagaaccaacatacagagagaaggaggtaatcaacacagagaggaaaggctcaaagaagaaataagcgatacacggggaagtgaggagacggcgagcgccggaccgactgccgagaaatgaccgtgtgttcgctgtagagtcggcactgactgtgagtttcgcttctcagtttaaatcgagaaacaaagaagtccctttctcgactgacgaaaagccgaagtccctcttttgtgccgggtcaagcgccagcgggcaacgcgactttcgctcgacatcgagatcgccgctctctggcgatacgaaagaaagacagttcttcgttttcagactcgagaacgcagaacgaaaacggtacgaagtctcaaacagttaaaatgagtaaacggcgcttcagaagacgcgtttcgagctgtgacaacgcctctccaatgtgtatgtttatcactgcatgcacccggtcaatgaaaacgcacacctgtggttcagagggtctgtcaaacccaccggcacattttctctgtcagaaggactttttttgtctgctttctcaaggcaggaagtctgtgcatcgtcaacgcaatctggaaaagaggtttgccatcgtgctgcacacgggaagacacagacgagtagcggggtcgcggctgcaggctgaactgtatttgaggcggaaatctacgcgtcgaaatttatgtagaaacatagatttgtgcgcaggtgtgaagtcgattctcctaagaagcgcttgcatcgatgtaatggagtcgggcgacgcctcgtatgtacggcagagagattccgatccagtgaacgtcgtgacaaacatatcggcacatagccacaaagtcaagcgaaaacgtccggcgttttcgataattcgagtaacgtttgttccacgaagaatatgtttttcttcgggaagcgagcctcatgcgtctgtgcacctcgtgtacaacaggctcaagaatctgcatagggggggttagcgtgtgtgctgcatctctcgtcgtttttcacgtacacataagtaaactaaataccgccacagacatgcaggaagttaagttacttataaatatcagtacatgtggacaaactgtgtctctgagaagtttttggtagacatatgtacacatatttactattatatatatatatatatatatatacctagatatatatgtatatatagcttacaaaaatatacagatattcatttaaatacctatgcatatttatgtatacctacacctatatatgtacgaatatatatatatatatattaactgcaaaggtcctcagattccccgctgttcaatgaccgtatagacccgtatttgcgttgtttgtagtgtcgtttctttctcgatgaggaactcgaggcagacaacgcatgtgtagtgaagtgtatcactgcacaaacggtgcacattcgacagctcggtccatctgtccgattgccgatggcttttgtaagacccttatcactcttgatcacgggggaacgatgtcgcaacctcacgacgctcaagtgctcctatctctcgacatcatagaataataccatttacatatagatatatacagatacacatttgtacgtgtgtatatgaggctaaaagtgggaggatgttttgccatctgtagtgggttccaaggtggtttttaccggagtgaacatgaacgatttcgcgaccgtccgtagcgtgttgactctctgaagtggtgtggcgaacggcggccctggttggctttttcgtctgagagaggttcttttaaatatcgcacgactttgtctcagttcagcactgcgtgcaagatcccgtactgctacacctcggcattcacttgtccggcattgcactcttcttgctgtcttgaagttccatggacgtccccgctttcactttctcgacgaaacgcgcaaaccctacttggttgtctggtgagtcagttgaggccctccggcatttctcttcttgagattccccgtcggcacacgcgaaaggcggtgcttggtttgctcacggcctgccggacgggagttttttccggcagaactggctgccgtttagcactgggcaagatcttttctttgctgcactctacttcgttgactgtggatcggatgttggactgcgtcccctgcccagatttgagcggtggaaaggccagaagcgtctgttttttggaatgttttcaggaaaagcactccgccaggaaactctgcaggcaccccgaagaagacacgacagaggcaaggaactatttgcgtccacgtccgcttcagatgccccgcggagtgcgccgtcgcgcgcgatttctttacgtgggaatgcgacacaggctacttcttttctcagggtggtgggtaccgctcttgaatcttccgcattcggtcttttatgaagcttttgccgtacagagaaatggttgtttcggctaaacgggtacactggtgtttcctcctttctcgcgcggcgtccgtccgtgtccggttcttcttcgatcctgtttccctttttacgctcctctgccacacgaaccgaaagaatcgggttcgcgcaagccttcgtcgtgcgttttctgcctgagtaaaaggagaaacatccatgcaaagcaccgcgcgccaaagtcactcggctcccgttcttccctctttttcgtgagcgtcccagcgcgcagccaaaagacaagcccccgcgaactgtccattgtatcctttcccttttctgtgttttttttcgcacgatatcggcctcggttttcctttgtgcctgcgagggtgcacaaaaccccggcctcgcaggtgtgcaaccttctgcgcggttatcgcacagaatgaagttgctctttttttgacacgtttctcccgacctttcctgcccaattcttccttttcctgccttttcggcgctggactgggacaagactgcaaaggcgcgcgagctacgggtgtgtgcgttctgtgctccacgtgaggtgcgttctgtttatgctccgtggaagcggcctacattctgcgttgtccagtttctgtagtccttgtggcggagaatccttgctttttctcacgcagccagatctgtgcacaggcaaaaaactgggcttcgctcgcgaggcagctcggtgcggctggtcgtgggtttccccggtggatcgcaatgta

SEQ ID NO: 1408 - DNA, 2901 bp, Toxoplasma gondii
ggcttcttctgcggtggaatagtcatcctttatcggagatcttcaatgtataagcagggccttccctcacacagcgcagtccagtgtctgcatacccttggtgtcgcttaacagatgggcagcggacgggttgggaggaatttcttccttaagatctttgatttcagtctttttcatcacctttccagatgcattccagttaacgcaagtgaggaaacgggtttatcttcggtgccttgttaggcgtcaacggaaattacatataggaaacatctacgtttctcaatattcatctttcacaccacacatatttcggccgttgcaggcggcctctccatatattttctgctgttgttttcctttaaacatgctctgttggcctcacttgttctgctgactgtgttgtccctttgtcgtctgcaaaccagtggccagatcctccctctcaagaaagctggcgtggtggacgacgattcacgtgaaacacgatattcctcgaggtattcactgccaagcagagaatgttaatcccttttgctcctttaactgtttacatgtgctgctgtagagacgaataaaagggaacagcacttcttttgtgtatttagaactctggcgcatttcccttgataccttgcgtgttctcacaggctcttctgtttgtcaccaacacttccacaacaaagttgtggtcatttggacatcttcagcctccccaattttcttcggagaggacggaaagttgctacattggtcgatacagatcaggaatggcgaattttttcatatctagtggcagaaagtatcaacgactggcagtaatgtacacagggagcgacaggcgatctcctatttgctactaacattagtgaactcttttggtgtgcctttccgagtacgcagtgagataaatagatacaaaaatcttgacaatctctgctagattcttaacagcagaagccatcccgttttcagatcggccgatacagaacatcaatcccaatactagttaaccgagttgactactacagggttgacctgtgtccatcacgctcgagcgaattgttcttcttataagtggctttaggtttctcgggctcctttcgccactcgttgactgtgtttaccagggggaaagggaaaaagaacagaatacccaggtgtttgacgagggctcagcggtgcggaggattgcagcaattgtaaaggacccggttgtctgtatctcgtaattggaatcctgctcactaccataggtaccataatgtctcttttattcgagttgactgtatttgtccagaaacagtagctccttgtcacgagacgcttatagtacgtcgtctagctacggcctcgatgctcttcgtgctggatttttacagcgggtatattttaacttcgttgttcccatctctattggttcagaaatgggaacacgcacttcggcctccaacgttttctctcgagtgcggagagtaggcgtgatttcgcaaaagttgaaactaagttgtcctgtcttgttggactgccgatctttgagcagcgttgcttcgctgctctccgtcaagacttgtgtgtcttttctctctttcagtgcttgtcactgctccatccttcagtcgttctacctttttctcaatttctaactcgaaccaaagagcaaacaaaaacaacggcgggctctccatccaaccttttccgctatccctctgactccacagctctctttgaggatgccaagcaacgtccaaagaacaaagaccttctctccagccctctctgcggtcgattagaagcgctatgtctagctccaaacgtgatttgtttcgtactgggttcctcggaagcagaaagtcttttgaaaagctcccacctgtcctgctaaaaaaccactctctccaagaagcaggctcaggcgttgcgatcgtagtttcaagtggttcgaactcgtgttccctttcggtttcgatgtggatccaacccagcccacggtctaccgcagcacacacaggttttccctgattcttgaagcagactccagaaacggattctcctgtcgctcgactgtcaccgcacaaaaactcgactgacgaaatccgttttaccccggggggtgcagtcgcagcatgtgcggtagaaggcgattgcggctctgatttcgttggacatttctgcattggtaggtcaaccctgtgagttttactcgacggaaacgaagaggaaaggactaatttggtaagaaaggaaaaacgatagagcagaaccaccagcacaggaggctgctcgcaaggcatgcctcacagaagaccctcgtccaccctcgcttttctcgcggttgtcctgacgcgctccctcagcaaagtggaaaaagagttgaacgcatttgatacattttcctcttttccgctgtcgtttcccccgtcgattgagtggagagagcaacttgactggagaatctttgcccttctttcctgggaaaggacatcgtgcttccgcgtttcgctgcgtgtttgctcgctgttcaacgagttcagagaggagcccagccactttttcccactcagcggagacacagaaacggctcatgcaacctcgaacgcggttacatcctttcttccgatgtgtacgctgttttaaagccaagaagactgcccggacgccattcgagccgctagatgccgcaccccgggcgactcctcaataatcgttcgtccacgcaagagaaattctcactgctccttgcatgcacgcgccattcttaaggcagaaaaacgctcgttttacccgtgcctctgcgttttttttcctccgggtttgtttcgacctttggtggacgactggactccccaagactcttctccacactcagcacctgccccgttaatccagcacgaccagata

SEQ ID NO: 1409 - DNA, 4627 bp, Toxoplasma gondii
atctccgcagacatatgtatctctgtgttgggacatataaaaacgtatgtacactatatatatatagatatagatatatatatatatatgtacataaacacatataaatatatataaataaatacctaaatatatatgtatagatgagaaagagggaaactgacagaagaaagcgggtgctgcaggagtttcaactttgttgatcacgaggcctgccgagtgtttcacaaaaagttaaggatgttgttttcgtttgccgtcttcttcacctgcctttgctctccgccctgtttctttctcgtaccagttgcatgcagcggtgcaccgtccgcgccgacgtgtttgccgttgacccagagaccttgaatgactcctcccgagaagttgagggagatgccgttggcaagagcgcgagaaactccggaaggtttcagatgaaattccacaaggatttcgccagcatagacacatcggccactgttcagaccgctagctgaaggcgccgtagtcgcggcagagggcacaaacgttgacccgcctacgagatgaatgagaagtgagtagtccacgctcctgacaatttcgctgcgtccacgagcctctgagtgttcttgaacgtctgggacactcagctgcaccagcgaaggaaagagtcaccggaaacataacgctagcagtcccgtgcagaggaaagaggtggaactgactcatgtacgaagaccgagtcacgagagctacgtcgagatctggacacgagagggccagactcctggatgaaaagaatgctaggatgaaaagcgaattagccaaaaaaggagcgtcacaatatttcttaacataaattcaagccggttcactagagagtcaagcatacgtgttgaaatacgtacgtgtgcaactggagaaagtgttacgtctgccctactgtctccaactaccgggctgcctctacggccgtatatatttccatagattacatgcgttccctcatacttatatattcagggcagtagaattgcagacccagacagctggatgggtagtcatgcattgtccgctgtctatgggtttgagtttgacagttgtgtttttttaggaatgacaagtagttttgttgtgggcgctgaaaacgaagcgaggcactttatctctgccaccagtgcaactcgcgatgttccctagtctgcaactcccggagagcggaagactctttttgtgtgaatggcagctcgttacacaagcaaaaggagttcgtcgtgtttcactgacttctttgtcatgcaaccacataggctccatgcgttccttcgtcctcctcgcttctgcaatccaactgtttagccaccatctgccggcgtagagagctacgccaagcaaaccaagaaggaccgcctggatgttcccgcctccgccgccttcatggaaatcacccatttttgatttgaaaaagaagagtgacagggcacagtctggagtgaagcatcctaatacgacggagaagatctattcagctcccgttcgcatggaggaaacaccggcgaaaaacgtgttagagaagacggaaccagctgctctgaaacatcagcctgatgctgaataatatatcctctatcacaggtgatgtccgaggcggctccagtgtgcctgcttgttgaccatgaggaaaagcgtggaagatacgcgcgccctctctcgaagcgaagtgatcagactcgcggaagttgcattcgcccgaagctttttaggatttggtggaaacgcgtgtaggatacactgaatatgatttgcacgtaagccgccacacaaacctacaaactcgtgtttacacggccgttgcgtcaaaggagtgtttcttccctatggattggctgtttgctacccaattgagttccggtcgaattcatcaaagaaccacgtctatcggtgggcctgtatccgtgaaatggtactaatccaaccgcagagattcgagtgaattatcgactcaggacaacgtctttgtctcacgtggggaaaagtgctgttccaccctgcatgaatccctgcttccatgtataagcgccaagaaatcctagattcgatgcgtttgcgaaggcaagagcagcaggaaaagaggaccgatcgaattcaaccgtttccaagtactgatcagatatggtgtaccagcagcagaatctcttgagtccgcgttgcactacacacgctcctttacacttttcggtgacagtcaagaacaaaagaggggttgcacaggcacaatgtgagtctgggaaacgcggagaatgataaaacagcaagaaaaggaaccattctcaacgccaaactcggacacacctcgaagcgtccgtggaccgacggcgttcctgcgtggacgagaacgactttttaggtggatcggaagcgggagaaccaattaaaggacgaaaatcctcaaaaacaaagatttaattaggttgcccgcatgcgtcagctcgtttgccgtatgtaagttagacatgatccaaacagtgcagttcctcattctttttggtctcgcgaagacggacggcgaaaacgcactgccacttttgccctacgggacgagagcgcaaaatgtggcttagcgtcgaagcaaccaaccacatctgccttgcgcttttgctctactacggcaacattgtgttttccagtctgactgcttctgagctctccgcggcagaatctcgaacacaggtggcaaggaactacagtcacctagaagatgcctcagaagaccgttgcctctatgggttgtgtggtctgcaatctgaaaccgaagtgaatggtacatcttgcacctagagacacatttgagtttgatgagcactgaaactgaagcggtaaatcgtgctcggaagaccctctggaggtttgctggtcagtcatagctacgtagtctcatgacaggaactcgtaggttaactcgaaatgcaagtaatacgaataccatcatactgttgtgtccagctgctttatctatgatacgctgttctagatccgaagttgtaaatcgtaggtcgccagtccagtacagatccacaaaatgccgttgagctgcattagccatataccactttgttacaccaccgctccactggggaatgcctaagacaggcataggtttggacttccacatcatgcgatatgatgtagtaggacagggcactcgaccaaatttacgacagatgaaaatatcgcggatgactgtatattagcggcaaaataccgaatatggacatttaaggttttccatgctccctgtttagaaaaagaggatagataatagtaccgtaagtacataaactattaatggatttgattatgggcaatctatactgcctggcatgcattccagtcatttcattgtcggtgctatctcgggattcttttatcagtgtgtgtatagctctctactggcagccctcaagccagctgactctgcagctggaccatttaccagcttgcataccttctgtgtcaactgcagcctcagtgactcctggcaacattcattttagaaagcattctttagagaggtatgtagaccagctcttgtagccgtctcgaaaaaggaagtcaagtttttttcataaattccaagcaaacgaagagtttcttcagtgatcaaccgcgtgtcaggacaacaagaatcccacccgtttatctcgtatagactagcgtcaggtaaagaggctgcggaagtgaatatcatgaaatctgtaccgctgttgtgaataagtaatagtggcacctcggcgagtcccggccacagacaaccacttggaactcacctgctagcattcgtcttcggggacagcggttcctctgaaacaaaccgactatattccagaatatactcatatataaatatatgttcgtatatgtttgttattttctaatcaatttagtgtgtgctacaaatgcttctagggggaaggtgtccggcttcggcactgttggagcgctgccgaacagggaccaaacaccttacatctctgcgcagcaagagatgcacagttcatggtacctttatatttccaccgcaggagtacggaaacacgtttttctgtctttagagtctcgtctttgtcaacagaagtcgaggacactgacgttgacagaagcgcgtctgtcgtgttagttgtgtccgcgtttgtgctctctgcagagcgtctgtgcctcttgaaccagcaaagggttctaaacggttgcaggacggaacggcagacggaaaatgcagacggatcaccagaatggtgcactttcaacctgtcttcttgtgcccttgcgactgtcaaggctcgcctgtagacgctattccacagaacattacgcgtattcaccgtctttcaggtgtctgtgttgtcagtaaaaagagcaggccgcgttgacgtggcacagagcaggcacgatacccatgtacgatgtgtcgtcgatcttggcgctgatccagactgtaacgacctgggttgttgcggagggggtccgtcccttcgtccagcaatacaaaagtcaattgaagggggaaagcaagctcaacagttgcaaaacggaaacggaaagatactttttcttatccgtggcggcacccttgcaacacgtcccaaca

SEQ ID NO: 1410 - DNA, 3462 bp, Toxoplasma gondii
cgctatcagaaggaccttcaatctctgaaagacgttcggaagtactgcgaagaaacgggttgccggcgcgcgtgcattctgaagtttttcggcgagaccgtggtgcgtcggtgtggtttcgcgaaaccgtcaggcagacgagaaagcagcaaaggtccttcaaagaagagacacagagacgcagcagaggagtcagaagcaacgtcctgccgcagtttcaatcgagcgaaaacggaagagaaactgagcgttcacagtggtaacgccgacactacatttgtctctccaggaaatcggaacctctcagaaggaaactctctgtgggcgtgtgctagggaaggggctcctagctgctctgaccgcggtgccggcgtcagtgaagtgaatcttggaaacagccaaaacgcggaagacgtgaaaacgaacctgtgttcagatgaatccaatagaggcgcccgccttgatgcctggcgatgttgcgacttatgtgaggaaagcaaggaagggaaaaccaacggaggcggccttcccgggaagggccacttaacctcagcgccatcggcttccgttctggcatctctgaattcgcgaggatgcacccgcgtttcctctgcttcccgtcgggctccccggagtttcgctggcggtggcatggcagctgtggctggtgaagacgatgggggggttctggcgcgtggaactttggaattcgagaaagatgactcttcaggcgaagagactggtggcgattcacggtggtatggatctgagaaaagcttcacagcggccacaaccctccggacggggtcctcgtggtatacaggcacctccgtcatgtcgagaggactgatggcgtctctgcgaggaaagagcagtgagtattgtagaagcgctggaaccggcgcttcaggcgggggccgggtggtttatcacaaaagtgttggaagcgctttttgtcggcaatccgaggtgacgaaaggacagggaattccatcgttgaagagtggaatggtgaccgacgcggttcgcgccaaaggtcttcgggctgttatggaagagctggagaggcaagaacagttggccgaggaagcagaggacgaagggaaaaaaactcgcttcttccgacagcaatttaccgcgatgaggcgctcatcctcagaggtggacactcctggttctcggtcctgtcaccttccattccgtcggccacgcccgccgtcgctgggacctgcaagtcgagaaaccgcatgcggaatgactctttcaaatcagccagcgcattcgctggcttttgttagagcttctgctcttccaagagatcctacaaagtccggtgccgttgcagcggcccaacagttaaagtctggtctgtaccatcctcgtggaaagggttaatctagcggggctgtgatgtggaagaagcaccatagagaattctttgtaaatgggcgcttcgaaaacggtgtcaacgggcaaagttttgactcgagcaacactagatttcttcaatgtcagtgaaactctattactcttggagcatccagcagcccaccggcacgaactgacgagtagcaagaggattggacggcccctaaggaacaccgctgggcttctacatgaattcctgtttagattaaaagaaagccaggacggttaatgtgcctgttagtatgggcacatcttgtgctgccgtgtctaatgtcatatttatcgtgttcataaaaaacagcctgactcaacgcactgctcctgtcttcaaaatggttttttctgtggcacgatgggctgtaaagggggacttgagtgcatgcaaccaaacgagtagcatcagccgctgggtggcacctgccccttgcactagagtaggaatttcaaacgaagcaaggcatgtacccgtggactgcctagcgctgagaacgtgaacactgccctggcaacacagaacggttgcttttctgtgttagaggggatattgactgcaggtatgagctgttatcagttggtgtcaaatccagtagtctcgcaaatggcagaagattccacacgatggatgccaggccgctgctacatccacaagaacagctcccacatgcagtaaattgataacatttgttggcattacgtgcggtcccagacatagacatgagaagagcctcccggtagagctgaatttggaaggcgttattgccactacaacggccgcacgcttcacgagagtttcgtgaaggacttgccaagcggtttgttttgttcgcggtggagccaacatacgtcagcaggccgatgacgagaagagcccgtaagaactgcacggtttttgtcaaattcgaaaaaaatatgttaatgcagcgtccgttatcactgctttgctctgttcacggagttacgcctgtccacaattaaagaacaggtgctgtcggtggacagtcaaaggttaccaacccgttaggatgtgtacagtatctgaaggaaatctgtcgtagacaccgtggtggctgtatttcggaacaaccatgaaaccatcgaccaaattgcagcgtcgagtcgatttttcgtccgaacacaatcgtgtgcatggcccatcggtcttggcattcgttgtgtgaagccccgtttcggcagatggggtcgagagtcataatgcgtgagtcttaaatgtaaagataaagaaggaaataggcgagacaaggcggcagccggagaagctccgtggccaccgacggacacgggagacacgtgtagtcgcgcaccgccctcacgggacatctgcagtgtcaagggaaggagcgctggaggagaccttgaagatatgccgaagcaacaaaagaaaaaagggtacttcctgctcgcggctggggatgggagaggcaacactgctacaaaggcaacatctatgaagtggatggtagaaagttcgaattctcacgcacgcaagctttccacggcgtcaggtgtgtggcgctgcgttccaacgccactgtagatacacccctcggcacgtctcgaaaattggtggtgacagcatgtctgggatgctcagtgatacgactctaaaggtcattccgtactagaatgtctttctcttttttctcagtttcccgagcggttctttaatttgtctctcggtcgtgtctcagtaaacattcgtgttgtatggtaccgttccactttaccgttgtgctgcccgcgtcgtccgaggacctagggccgagtagcgatttggaatttctcgacgcggcattgagttttatcggcctttcggaatctccgcgtcggcattcggctgaaatcctcatgcgtcccttacgccaacgacgctgagggcccgcatgctctaggtcttgcgcaggttccaaggcaagcggataatcgtttcaccggtcgcttcacaatttccgctagtcttcgtgtcgcaggtgagacagccgacagcggcgcgctgaagttttctcttcgaccaca

SEQ ID NO: 1411 - DNA, 2388 bp, Toxoplasma gondii
gtttttagtgggtgtagcgtttttgtttcttggacgtttcggtggctgcccagctcgatgctctttcgtgacgtttcaaagtcttttctgggagctcgaaaaaagtcgttttttcagcatcccctttcagcagaaaaagcgagtgcatggagggagcgtttgtgtttttggcgtcaagcaaatttgcccgtttactttggccctgtagggcgcagtgggacggcattcttggattcgaagtttttttgtcacttctgtacaccattatatgtggatttctttgcatgcatgcacgcatttatcttcggattgaagggttttttcgagcaaagtttttatgtgccaagacatcacgagtgagtaccacgcgagggagccgaaaaatgaagaagggagaaagtcctccgacacacctttctccactgcacgagacaaaactcaaggtctagaaggtttgcctccacaacatacatctctgaaacatcgagaacgtacattctgagcgtgtctcgagacgaacgcgcgttaggatagttgactgcgtcgacagaatgtagacggcagtatttatggttccaagaccttaatgcacctttgcacaactattccgagttacacacttttgcttgttccaccatcgttaatctaaatggacagcctaaaaagtcttccgtgtgcgactttgcctaaaaccctcagacataaaacaggtgcgaggaacacagaaaacccacgcgttccacgacggagacactcgcgcgatgcacaagttatgttgtagggaaaatgtgtaggaaaaacgcgagcttctgtttgccgctgcgtcagcgtagggtgttcggaagagtctctcgtccgcaacatcggcaaacacagtcgttcttcactgcgtcctgtgtgatcaagaaataccattttatatgtgtatgcatttaaactcaccatgtgtgaataatgttcctttgtgtgcgatagttgctgggtacgctgttcggttgcccgttactctgccccacgtaccctgaggtctccggcgctagagggtatcatcggcagtgcttttagaaacaatagtagagcagttcgattcgatgctttcgagctcattttagaaatgattcatttgcaggttttgtcgaatggaaaaacggtggctctcgacagggctgtagttcacccggcatccgcgcgttcatagtgccttttcaaccctgtttccctgccgtgtgcgtcagtgagttatctccagaaactgaaataagaattgatttgaagaacaaaagacgttcaatactggggctgcatgcacacgtgagagtgtgtatttcgtggggccgcctcgagccagactgggaacagccgcattgttcggtagaaaacagtgatggcgacaggagtaagtgcaggtggggggtcaaacgaagtgtggaagtaattgagctgattgggggacaaaaccagacacagagaaaaacagacagggggctggcgagcgtttttctctcccagaagagtttgtcgccagagacacctcagccagccctccagaaggaacgcttcttatattgacatggacgctaatgccgacttcgcttttgcgatcgtttccaatcttcaacgcaggtgctttcccttttttgtgaggacaactcccgaagggaaaggaaatttctaggcagagctttgcggctctttacgtgtgaacagagacacgcaagaccgggacacgacagatactgtgactcttttcgggtgcttctccttcgtgattgaagactgctctatgttgtctctgtttcttcgcccgcgattgtgggaggtccagactagtttaagagaccaccgtttcctttccgggatcttttgcctcatcgttccctagaacgggcttcttactttccgttaaatcacgcctttcaacagccaataacgaacgcactgtttcaggcaaattcaacatttgtatatagatatgtaactggcgaactgctctccttcacttaggcgaaattgtgttgggattgaaggaaggcggtctagggatggaaaccattctgacaagtgtgaaactgcaacgaggccttttctgaagatatgctgttccttccatctaacaattcgtctgcatcgcagcatcgacggctacttccaagagaaaagagagtcaaccagccgttatcaatgaacatacgtagtcttacattgagtacagtcgtctgagttggtagcgatacaagtggccgcaaatgttgatttccaaccgatccgtggctatgtgcgaaaataggttacacacatagagcattgtgcatgtgaaaccccttgaagggatttctcgccaagcgtcgtttcggagccttctgtgcacgttgaaaaagacggggaaaa

SEQ ID NO: 1412 - DNA, 3621 bp, Toxoplasma gondii
aaatgtttgccgtaataacgagactgtgtgcacggtctacggtgtagaggttgtacgggcaggtgcgtaacaaaaaacggctttctcactttctgttgtcgccaggaacaacgcgttcctggggtggccgcgaagaagccattggtaaggtaataaacaggaaagttccctttcccaacaggggtcgaaaggcttgaccgaagacagggctgaagatcatgccagcggtctatcggttaccagacgcacagcttcaggtgagacagaagatgagtggtaggggagagagacgattcaggtgacgaatagacaagcgtgtattttccaagcggggccggaaatgacagccagagcagaaagcaggcggattctttgctcccaggattctgcaaaggaatggacacccaacacggaactaagtctcgctcctccgttccttctgtcttttcacagagtttcttccatttctctcttcctctcttgctgtccctggcccttcggctgtgcaagagctgctgaagaagacgaaagaatggaaagactgttggctcctgatgtcgaagggagaggcagcagagctttagaagacgcctcctctcctgtgtcgacagaagcaacgcagaaaagccgcatctttcgacggggaagagaggcctctcttttcagaaagacttgtgcagccgcgaaagaacgggagtgcgatcgcaagcgaaaaagctcgagtgtccagtccagtcgttgcaggtccgggtcgaagagactttccccggtagccgaacccggtgtgtgctatcagggagctattttgctgtgcacatgcgcaaggaaagctgaaaagaggggaagtgtaaaaagacggcacacggcaaagacgatcgacacaggggaacaacgagagaagacagtcgcgtcttgcgaagctcggattctttgcccaactcacagcttacggagatggagggagacaagaggatccgaagtggtcccccaccgggaaagagaaggggacagaagaccgcactacatctccttcaaaaaccgcaaggcacgaggcgaaaaagcggctggtaaaaacactctgcaggaatcttgcattacgtgagagactcgcgtagttatcgaggggggcacgggcgcgcggcaagcttgcacagcgtgccgctttgcgtctggaaaaagaacttgtcttctagtaaaagccgttgccaataacaaattattattccgtggataaagctagtccgaccgacatgaactagaagcagggtgatagatttttcatcattcctatttacaatgagggaaagggtgccaacggcgcccagggcggagtccccgtcggcaatcgatggcgtgacctggccggagtgggcttgctggaagatgtgtcagcagtcgcgtctctcttacgcaagctgctaacccaatcatcgctcgtttcgtcagtcatcgcattcttttattctatcgaacgagagtagatacgaaacacctgccttgagccccggttgtctcatgccggcgcgcctttgccttttgacaaccgctttttactgtcttacattcaatagtctaccacctgctgagtgatccttgtaggagaggtgtcccatgcacgcaaccgctggttatgtaaaccttgctattggtggcattcaaaagacgaggatgagagaagctgaagcccgcccacggttgtttgtcttttcgtcactacactgtgtcaactacgtctgttatccttgcttgtatgcaattcccaccattctccgacagctttttatgcgggtggggcgatgctgcgacaatgtttcttgatttctcgttttgccacccccacgacaaaaagtacgacgacaagaggatacgtcattttggttcatcaggctggagagtgtgacaccgccgccgcttcagtgtgtcgcggtacgtatcaacttactgcttcgactgcctccgggaaacgtgtagagctgcatttgtcgccatgaacgggatatcctgttgagtgaaaccgcctccaagtggctgtgatgctcgtgcccgtaacagcttcccatttggtcgaatcgagggatcgctaccccgtcgtggtacagcccaggacaagtgcaagggataacagccaatcccctgaaagcagtcgccacagaaggcagatgcagcagaatgctcaacgcgggcagcacttttcctcccatatatatttacttcaggagttaacagttcccttgtggctggtcgaaaacattttttccgttaagcgtaggtgtgtgtcttcatctatggaacaagccgtgtgtcgatagcgaatacatcttttgtttgcgtcctgcactcgacttgacgaggcggctacagtggaaacgaaaaaaaagggtttcaggagagtgtgcagatttggcgtagctgatttcgtacacagacagatcccgctgaaacctctaaacacgagagataactgatctcatggggtgtgagcatgtaggtggaacgcgcagatggtcacacttactgttcccatgattggaaggccagtgaccttcattcggacacatttcagcaactatacgccaagggtttcgtcgtagcgcagtcccataatcccctgggatcactgtaaaccccaagtccaagtcaatatgttatgttactgaaaagtatagtcaagccttcacagtagtttccagtgtctgccacagtatccacttgcctccacgagtatcaacgctacgctgcagtcttaatcatttccacatagtttttgttcccccagactaacaatcctggctgagccccccatgtacgcgttccacctgccagtgcatatgggtttgcatatttttgctgaagtccgaaagaggggccacgcaaaacgttaccggtttgctgcaggcagccaggtaggtggaacagatctccagcgagtacgaccactgtgcgtgtacttcgccaaaaggaaaatacacctgcaccgctattaagcggcagtcgtctacctgaatcgtctccccggcctcatcattttgttcgacacaagtttccattaggactttgtgacagtcgtctgctctcgacctttccaaccgtctcgtaggcgaaaaatcctcgggtgacttgccgtggacgaacgcctcccgtttgcttcatcaagtagctatgcgataggttccgcagtgcagccaggcttgcgaaaaacaagttcgtcgcaaaaggttaattacctacgcaccacgaaggaaaacgcgtatcacgtcagtccttacggtcaatatacaaatacttgggccgtccagtggaggcaacgtgcccgtcgcacggtgatactgactggtgacttgcacgtacgtctctcgccggcgtccaaaccaaattgacccggggcagcctactccctgtcgtcccttaggctaagtgcgagcaacatctctacacagagacgacgccagagacgcaaaatgaacagcggaacctgcgtcgctgtctgtcctgcgaactgatgacagaaagggtcattaaacgatttcttttgcaattcgcgtcgttatcgcacgttgtttctcgtcccacgaatagttgttttgattagatattgcttcttctccacatatcgcctcacaa

SEQ ID NO: 1413 - DNA, 2227 bp, Toxoplasma gondii
acgaaaagaaagaacatcctcactagatccctcacattcacaggctcgctgaacttccacagccgagtcgacgcactacgatacctcacgacagaagcggccaacgtggtctccaccataacacacttacatacaccgtcaagcgcgagaccgcctatccacccatctgtacacctatctacaccataaatacgcacatacgcgtatacgtatatatatatatatatatatatttatatatatatatatatatatatttatacatatatattatatatatatatatgtgaacgccgaggacaccttatgtgaggaagaagcgcagtgtgggcattggcaagatgttctggcggagacagcttccttctcacctgtggggtgttccagtttccctcagtgacttcctcctcgggattgaagttgtcttcttcctccttggtggcctgcgtcgcctccgcgggctgcgcgggcttgggctctgtagcagcgtcagacatggtgaagactgaaagacgaaaaacgcggaaaacgccaaagggcaggagaagcgaaaagcggagaggaagacggcaacaaagcagaaggcagtgagaggaaggacgaatccgctggagagttcgaagcgggctcgcagacgtcaccggcgaacttcgtccaaggtgtgcagaggtttctctctgattctcctcagctgaggcgagaggaaagaagaggggagaaaggagagaagaaggagctgtgtgtagaaaaggaccgaaatccgccgcagcacacgcgagaaccacccgggttgccaacaagaaatcctctctcctccgcctgggaagtagtcgctgacttttggggtgtatgtacaccgcaggacaaccgttcgtgcggtcagttaactggttcctccgaagagtgcagagagacagaaagaaagtcttcccaggaaaagaagcgttttccgcgggcagcggctgcagcgaagagcgaaaaaggagggagagcgttcagagtgcgcgcgattgtgggacggagttcgtgacgcaagcgacaactcgcggagagaagggggaaaagcgaaggagagagttcctgagagaagacctgagaaacgagagaggaaacgctggagaagaagtctttttgggtcacatagaccccaggaacaagagaggagagagaagagggccggcctgtgtcctgtagcatctgcgcccggtagagcgacgcctgttgctgtgcttgcgcccatgtctcggcgtatatacggagacatccgcccgcctttctcgcgccttggcaacgcccagctgtaagtacaccgcagaaaaggtcttcgacgcggctcgaggcaagcctgcacggcagacggcaagcaagcgcttgcgtttttcgcaaggtgtgtctttccgctgttttccttcccccttttgaggactacggcgttctcctgttgggaggaaaatacttgttctgtcgcttcttctgtggaaagagagttccacgagcgggcaaactgagagcgaggacgcagcaagaacggagtgagttcctggctggaaaacgaccgaggaacttgacttagatcgcgaggaagtctctcaccttcctcatttcacttcttcctttgctattggatgagtccgttagcacatgcgtggagagacgaagcgaaaaagcgcatgtgttccgttctttcttcttgtgagcataacaagagagaaacgagaaaacccgaaaaaagactgtggcagaagtcaaagagcgtcgatacaccgtcccgctcttcgcagctgtccacctgaggcctcgtaagtctgggtttcgctgcctccgggagctgagtctgtcagaggcttgtcgcgtttctcagcttcaaagtccctgttttgtgtgcctcgtcgccatctcttttcggtttctcccgttcgatgtgcatgcaaacacgcacaacgtagggggaacaagaaggctggagagcgccgcgaacaaggcagcgggcactgctgaacgaagcaacgcccagaccatcgctgctcggttcccccatgtctcagtgcatgtacacccagtgggaccagagatgatggcgaaactctgcaccgaataatgccgcagcccctcgttctcagtctggattgacacactgtccagttcacacatggaggggctgtacagtgtgtagcgtcgccgcatgtcgttgtttttctccgtgtcaactttgcctaacttgtcgata

SEQ ID NO: 1414 - DNA, 4451 bp, Toxoplasma gondii
agtcacctttttggcaactctccgcgaaaaatagatggtggtttgcaagttcgaggaacaacgcggatccggggcgagttgctcaatcgggtgctacagagtgaggaagttgtaggaactagttatcttacttccaaattggccttgtctctattgcgtgtagaatcgtttcccgaatggctgagtcgatggggctcgaaagttagggatttacacgtttgctcccgcagtgaaaacgtaaccagtctgaaccgaagacctgtctaacgtctctttgactctcacctggttgaaggcgataagaaacgcgaagaaataaacaaatcccaacgcgcgcagaaaaacctgcatgttcacaacagcaccaagaaaagcagtctttatggggttgctactgaatggtgaccgctatttttgcgatcaaatccattaggtacatgtcagagcaaggtgcatgaaccaagtatgcgaggatccagattccatttccagcatggttttgataacataaagtaaatctacgggtctattccggctcctttcaagcgtgaaaacttggtgtttcgaccctagaatatgagaacgagcacaagattcattcaccagtgtggcactcctcgattctggttcctacgcatgcacttcagatctgaattcagcgagcgggaacagcgtgtctgaaaaaacatatggagatgatggacacttgcaagaatgagggctacaccgggaggtgttgcccattacgccgcaagatggagcacaggaaaaacagctccctgaagccattcatggctgcgatagctgtgattgtggaaaagaaaagttttgagtgaacatataattccacgtcataaccagttttttaccatacaagggaaactctactagcccagtcgcagaacccagtccggcaggaatttgctgagcgtggcctttactcacaatccgtgaaagccagtacgttgattttagtttcctcaaagtctccgggtccaggcggcgtctcttctcagcgcaagaccatgttggatccagtgcgtcccacacgcgccgcccaaggttgaggctcagttgcttccagctttttcctgtcggggagcctgccttcagggccgtgtctgttgcagatccaatagagaatccattaggcccactttcatctcggatgcccctactgttcacgaggctagcctcttctgactgaggggaggaatacatgctgacaattcagggaaacggagagaacgttaccggtgcctctgtgatatctgtgggctcgctagcacgatccgaaccgggaaggtgttttgccgccgcgaagaccaccgccgtcagtgtgcgaaaaatggaaactgtgggcacgacagcataaagtctacgtagtagaacgagtgaaacaagaagaaaagaaaacgacgaaatgaacggtatggggcccgagcgtcgccgttgcaccctcactctcatctagccagacaaacgtacaggcgtttccgagaaccctgtgtcacagcgacggagaatgtctacatgaaactgcgcgacgaccaaatcttgatccctccttgaggtcgaattggaacacaatcaatgacaacggttcatctaacgcaaacgtcattggctctcgagctcctcgaccagacaaggcccgggatggcatcacggagatcactcaaattccctggtaacgcaaagtgcggttatggtcttcacatgcgttgaaattccgccatcggatatgagaatagagccaaagaaaaccaccgttcacagataaaaaagttgcgggattgtcgggccatcgagctgttcgtgccgccaggaccggtgcgtgccgcaggaccgcgagacacaggtcgagtgcctctttttgagtccttgagtactccgttgagggaaaagaaaagcacaaaaccctttccacagaatcggacaaaatctgaatttcccgctaagccgtggaacggagtgtcgaaagcaaccaaagacaagctggcggctgggctaggacaatctgtcttgttacccgtggcagctctcagcggggctctatgcagcgagctgccgaagggcaaagcgtgccaaaaaaacgaacctttgtgcttttccgtttttttccgtattgaattcaatttcccattggtgacgaaacatcgggagccctccaggccgccgaggccatcgggcattaatttgaaaccaaccgaccttctggagaatttgtcctcttcgggtaacacgaaattgtgattccgccgcaatacacgagccgctgaagtacaagatcaacagtagtagacgaagcgaaagatacagcataaggcggatagccctagagaaggtagcagaggctcagaggtttcctaaatgatgacttgaatgaggactttcgtgttgactagcacacggtatttcagagattttcggtaactccctggtcaatgggcaacaatgcggcgacgggacgcctgtaacctcttggatgacaggtttgattttatatctgcttcgtatagccactgcgttctccgaatatatactaccatggaaacaaatgactctgtggcgctacaggcatcacagacctccgtcacggatttctgtttacctcgcctcgtcctttgtcagcaggccacattcggtttctatcatcactgattcctcgacaacctggtcatgttctaaccaccacctcaatcaggggaagcgggcttccgcaacagaatcttcctcaattgacgcgtgccctcggttcttgtcaacaggtggtacatgaaatcaagcagggcaaaacgagagctgctcttcccataaggagcgtgtagcagcacccgacgcagatgagtggcactagcgacacgtggattgctccagttactgtaccatcggcggtcccctgcacgaaggataacaacggtgtttttttcggggaactgcactgcatgaaccttcctattgaagctgagtttcagttcctgaagactgcccctatggcttttttgacaccgagtaccttttgcctacaggcgtagcccatgctgcattcgtgtatcacgtaggttgtatgttccctgagttttcagtcccaaactctcgcatgacctccacagcaatggagtgaatagttcaaactggttactcatgtacatctggggaatatcgtaaaaaaatctcttttcgagccctgcacattatgatgaagtgttgcatcccgcgtctttcggcgggtgcttatctacaaaaacagcttgtcggcatctgctggataacggtacaacatagtttatcgtaagcgatcttgcccaatggtatgatttgtctcttcttccgtacatgagtaccctatcacaattctccacagtgtgtgagatgatctggtcacgcagtttgctcagttagtccaaagagccaaagattcgaggctgattcgttgcgtcaaggtggaacacgcgacgggtacatctgctcccctgacacgcaacacatccatatgggcaattcattacatattccaatcctttcgagccttcacaaaaaacggtgtaagtatctgagggaaacagcacaccgttcgtgtggagggagggatatgggtttgaccaggagccttccgtctgagtttagtcaactggcggactagcggtccgccgtttccgtagacgaaaaacgagagaaatcgtggatgaaagaagtactttgcaaccattattttatgtttacgaggcgattactggatacgtctttccgcctcttttgcaaccatcgacagtccgaataactcagcctctacgttttcggctgcgggggagacatacaacgtttttgcgggccgctagacagaggctgcagaagacatggccagtagtggctagcatttcaagcgtcgtgttccttcagcgtgcttctcgcgtttttcggccagatagcccaaaaaaggacaatcattgaagtgtgcacttcaaaatgccgtttagagttggatcatccactgcgtcacgaattctcgaatttttgcaccttaccagctctttgaggcaaccaacgatgtttcagcctcgatcaacgatgccacacccgccctttgggggccttgtcctgcataaactcttttccaccgtgtgtctagtgaatgagttgtgtggcctacaattctccggaaatacccgtctttgaacttcccgttttcgctgcctgccgtgtgtcttgtcggagccacccgggttcaagacgtgtgagctagcagtgttggcagtcgggaacttgaagtcgcacagttctatttatcgctcgcttttggagcactagatgcttgcaaggccactgtctgctcccggggagctatgtttttttccaccgtgactccttacggtgtgttcggcacggccacttgccctttgccattgctaccctatatcgacctaaagaaaaacgttatctgtgaatca

SEQ ID NO: 1415 - DNA, 3507 bp, Toxoplasma gondii
gcccatcgatgcgtcacccactgggagtgatttggctgatacaccggcaagctccggcttaccagcggggtttctctttaacgtcgtgcgtttctgtttgctcgcgtcctgcttaccgctggcgccttgcggctgctgttcgtttcccttggtcttcgacgccgtattttgcggagtgccttttccgcgagaagctccctcccccgccttcttgccttgcgatcgcttccccttcttcgtttcaggccgttcagctcccgtcccccgactcgcagggttccctgcatcgccgttgtgggcaagggtaggctgaatgtggttcgtcggattctcgactttcgcctgaccctgactctgcgtcacgaggtgaccattcgcggcggaaacaaagagagaattggcctgactactcaggtggtctcttatcggcagttgctgcgggcgtgagtacccagaaggggagtggccacctgcagaagcagaggtcaaatccacagcagatcgctgaagtgggctgcattgagaacccggaggaatatgacacacagaagaatggtggagactgctttcctgttggtgctgtgggacgccaccaccttcgtgagcagcggtaactgtttcatactgcgaggggtgactcagtgtagtgaactgccccgtctgatgtccgggggagggcgcagggggtggcacgacaaccgatgcttgaaacccacggacacgacctccgtttccgcataagggagtgcaagcgttgtcctgtccctgggatagtccagaatccgacgagttttccgaccagtagtcctggaagtacgcagtgttggaagagtcgtgccgggtgagggcgttcgactccttagacgggagccggggcaacgccatcttggtgggcaaaccgttgaacgagatgcagttgtggtcttcctcccccgagacttgaggacgaggatcggcgtccacaaggtaaaacaaccgatctacagacaccccgtcagaaggagcacctctcggggtagaagctcccgtcaacgcgccagctagcaagcaacagtggagggtatcgagacaaaaaggaaggttgatcggtgagcattggcagaaataagtttcacgctaagttccgtcccttgcacgcacactccaccattgtcccaaaactggaaaaactggagatatccgttcttgaccagcaatccccgagggcaaaaggaggcatcaagaacctacacaagacttgtgacagcgacacactcgcgtagccggtgtagcgttacgactgaggagaccagaatccgggacctctggacgagcaaaggaagctagatgatttcggaaggaagaagccagatgcctgaaagaacagggtgcgaagcaacaagtctccaaactggtgaattccgacacgcaccggcgctccgctagttggcttcagttttgacaagactgtcggttgtaggcgtgacagaggcgttacgacaacggcgaaaattatctcacgaaaatgccgcgacaaaggaataccaagacgaccgtggcttttccaacaaaatactgggacaaatattcccagtacacgcagtacagacacatagtatcgacaaaactctgcaatggaaacagagaaaaaggtgccaggacggcagcgaccgttgcatcgcgtggttcggtggactggcagcgcgatcagtgcacgccagtgtctatcgcggaaagtatataaggtggcgcaagtgttttgggttaccgattgtcgtctgctgagagtaaggcgaaaaaaggtctcagcaaacacaagaccttgtagaaaccctgaattttccgtcaccttatccatggtccagggcaaacccgcgcgcacggacaaacaggcaagcatcgacagctaggcaggtctgcgcagcttcggtactcagcacgacccttccgccacaaactagctagcgaggggatcacttgggtaacagcaattccttctcaacgtgctgcacgaagtctcctctcactgcgtgcaagccctggattcctcatacactcccctcggccatgtgcacgcgaaaactcctctagtttctcagtcgcttccgttgtctgcgcaggagaggaatcgtggatcatggtgacacacgcgcctgactacggtccacggaggcatacgaagcacacagggataataaacacgcttgtccagttactatagatagacagtgtcgcacaatctataatttagaagaactcatgcagttgcgagcgtcaactatctggatacacagacgcgctctttcgctgagtgccaccgctgctgtttctgcataccgggcgcccaacagcgtaaccaccctcttcaaaagctcattccggaagacaggactgcctttctcgatttgaccgcgggcacatacaagacaacagaggaggatgcctggacaagggtgttcttcactggaagatgtttcttgaggttcgtggattagtctgtgtatcaggaagcagtcggaaaacgacgcttacctgccacaggccacaccctagggacaccattgacggaacgggactggcagggacacgcaattctcgacacgtcttgtgtgcgggacaaagaactaccggattcttcaccagaaagtacctacaccttttagaggacaatttgcgagaagacaattattttttgtagatttacgcagcgtaggcatttcgcgtttttttcgcggtgtatgccttgcgcgctggcaaagccttctgccatcgacagctacaggtacttttcacagtagagaacgcttctttactcaacttcgccgcgtgtgaaaaggtgtagcttaccctttgagtacacttaacaacagaatctgcattatcctgaggtctgtcaaacccaacacagctattttcctgtggattgttagcgaggggaagctgttgacaattttcgtgattattcagcacctttttttccccgtgtctccgcccgagacgctctctgcgccctaccgcaattccacgaagctaagagccaaagacacagaaaaaccagtttctctcccccatgttctccgacaggacattcaggaatctgtgacttcatttcccgtttccgcggctgtctgattgtttgtccgattgtctgactccgctatcttcgattgtctcccttctccctctgtacctcctagttttcttcgtctggattaccactggcttcttcccctcgttgtcccgtgtgctgaaccttttcctgcgacgcattctatatgcgaagcgggttccagacaccaggccacccacactccgacacctccacatcacctgaaagacccacgaagacctcattcgccctgcctgtgactctgcccctacatctaccgctgtagctgcacagctcttccgtcctcacctacgggcagatcctcgcggttcttgctcggctgcgtttccgcgttgttttcctttctgatccgttctcgctggcacactttaactccatttgttcgatccttcacaaga

SEQ ID NO: 1416 - DNA, 4276 bp, Toxoplasma gondii
agaaggagaatccgaggcgcaaagagagactgcgtttcgatggaggcgacttggagagaacctggacaacaaggtgccaggctccgcatgcgcttgagcccattgagcgccttttctcacttcccttctgaggtgtttctcacgcacgtgacccttccaccccgcctgtttgttctcattcacggcttcagaaggtagcgagctgacaggcacttgcaagagacaaattgttctttcctgtctctgactggtgattccagcatgtccttcacccacagaacccttcacatctgtcgctcctccaccctgccgtccccgtccgtcaggccttgcaggtgcagtgttgtcagcatcgttcgtcccccgtagaggaaaaaacctgtttgttttcttctcttcgagacgggatccttctccattggaaacatgggagagactgccgttgctatgtcgccgtgagtctcgggcagcgcagaaagagtctcctacgatggaggcatttgttccgtattccatgaaagaagacgtcagcgacgatgcaactgagaagaaagcggggcgagagaatcgtttttcttcgtcttctttcagtgccgctaaagtggcgaggctgccgagcgacgcggaaagcaccgccgcagcgcagcgcctcgacgggaggccagagctggacggagggaccatcttttctggtgaggaaaccgccaacaaaaaatttttgaggagacaaagtaagacagaaaggagaaacctgtagaggaaagcttacgacatggtgggcatgtcaagttgctagctaccttgttcaacaactgcagacatctgtcgcggcgttcgtccgccacgtcgaggggaaggaaaggtcgtgaggaagaaagagaggagagaaaaaagtctctctcccagataaaagcaggtgtgtcccttttcaacgggaaaaggagttgcctcctggcagcttgctgaaacaattccgtggtttgacaaacttttcaagttaagacgcgcgcatgcatgcggcagcgccgcgcatgcagccatttgacggcgtgtgcagcagtaattctcagtgtgactaagctctgctattacagtggaacttggatccgcacggcgctggacaagaacggaaggggacatgcaaatggtggatccttcgtcttcagtacattcatttattgaaaaggtgtcggtttagccagctgctataaacttcgcgggcaagcgggtacgaaccgttcacgtcgcacgcaggtgtcacgagaagcagcttttgccggaccgtcgtagaaatgttgcgggggggaaaaacgaggctctgtgtaacccggtgtctcaacgtacaactagattcggctgaaactgtgggcaaccgcctccagcaagggtcaccgacggcagccaaaagaaaaccacaaggccagaacggtggaaatcggtaaacctagaagcatgtgcaaaggtcagcaagccacgggctgaagtaagtaccgcatgctgcaatgttgaccttccctccagctagaatagcagcaggctgctacgaaaaaagcggttccacaccagtgagctgctccaaacacgacccaactccagaattaagaagaaaatcaggattcatggttccagaatgcgttacgtgcacttcatgtgggaagagccgacaggaggaatctattgagtttgtcgtgtgtcaactatggggcagcggctccgcagacgctggatatatccggtgcatgctggactgttgcgcaggttgtatagtaccaaaaggccaatatagatgacacggtcaatccggacacgcgtggtaaattttcgcttcagtgtagctctcttttgatctgaaaactcgatgctgtatggactcgaggaagtctcattcttctgtcatcccgccttcctggccctcctctgcacagtgtttactttatctcccatgttacccatgggtgttgcgtcagcgaggatccaggtgcgttttcaaaatcagtatatgttagcgagtccccacgctgtcgcacttgtctccagtttggaatgggaggggtaagaatgctgtggaccgtcagtttctgcagccgctttctagggtgtacgtgccggaatgtttttctttccgtgtaaatggaaggcgcaaagcagtcagcgtatccttggttttcccatctcaggagcgagtcctcctgaaggtacaaatgactcgacggtttcccgtaatgcgaaggcttcttgaccaccctaaaagttgcagggatattattgttcacatgtgtcttgaaacgcatcgtttaacgtccggttccagagacaggtaattccttgggattcaactgtgtgaggagcccgtccacagaaaatgcccatgtcaccacggtcaggaacttccatgtgcacagggagctgaggggcctgcgaatgtacccacggtgccagcatgattcgttgaagtgttcacaatccatcggcatggccaactcgtgttgaaacacttaccctttatgcagttttttgaagcgaagcttacagaaagtacatcaagcatatgcagcgggagaagacgtgccgtatcactgagtcgcgctgcgtatcacgccagtgtttcgagcaccgggaattttctttctcgactgtattagctaacagctgcggtgatcaaagtggcaaatcagtggaaatgcaacctgcattttgggaggtcaacctcaccaaggaaatttcattccccccacgtacgctcccgtcgttgccccgtacacacggaaaataacgatggctcacacattttggcatccggacgaatttcatcggccccctgggcagcacccacaaaacacgtccagaaatcggggcgtttgcagaacagcatcttcattacccgatcatgaccgtcacatgtgcgcagcaaatgcaagaattgtcttccccttccttgtgcagtgagccactcccactatcttttgcctcctgacaatactgaagttgtttgattcgctctgcctgtctcccaatttacctgtgccttcaacttcgtccttccatccaccagaatgcaaaaatggagcagctgacatgccagagaatgagcgatagcccccctcgtgagtagtaaggctgctttggcgtcttgttgcactgcaaggcacctcctacaaaaggtttgccgtacaaacagtgctgtgatcgcctcggtcgacgttgcatcattttcaattcgcagcactgtactttagtgctgtcgcacatatatatgtagtgtcaggtgcatgtgtcgtgaaggttcacggtctatttgtcctgcctcccagtaggtagaagcagaggtgctaaggcactgttggttccaggctggtgatccaggaacctcgcttgccggcacaaccatcaccttccagcacctttgtacgcgtattccccacgcatggcatctgtatccttcgcaccatgtggtgctttcgactaggacgaatctcgctcaacaatgcactgtttcaggacgcatgctaggcggaaagacagcgattcaattgattcggtggaactctgcagtcaacaacgcgtggctgccaccgtccgcaagttcggtcggactgtgatgaccggcgaatcttgctggtccgcgcacacggcttgtctcggcttcacagtccgcccttcgcctagaaaaaagacatcaccaaacacgtcgtatcactgactcactctcatttattctcagcacagatggagtagaaagcatgttatctccgatagtttaccttccacaccacgacgcgcatacttttgtagagcgagtctacgtacttgaccgtccaaacggcgcgggtgttgcacgtttcgtgaggtggcggtgagcttgtgactgaacaccgcacacaaagacttctctcagtgtcccggtccgcgtttgtgatctgccttaccatcgaaacagcacgggctttttattgcgaactgtttcatggctacgcgtcctgtgagtctgcgtcagtggctcgggaaacagacgtttctgggacgtttgtgggacgttttcccttgaaactctacgaactaaagggggatccaaggctcgcgggttgacaccactgcaacgatcgacgccagtgtggtagggctgcagactgcaccgcagcagcgtttcgagttctctttgaagaggtggttttattgcagtttggtccgtccgcggattttcttcctctgtgtgtccgtcgagtgctgtttccttccgttttcccgtacttgcacggttccaaggattagccagcca

SEQ ID NO: 1417 - DNA, 4691 bp, Toxoplasma gondii
acgtcgttcctctcggaaggagggcgacggaaaagatgcgatttttcgatgagactcagtggcgtctcccgacggtaccggtcatgatagagcaatgcagcaatcaactctttcacgtcttccggtgtttgttcggaaccgcggcaatcgtcgaagtcggggaccaggcgatctcgttctatggtggccacctggttcatgaacccttccatgtcagctcgatttaggtgcaagccaaagggtaagcgatgacaccagagtttataagaaacgactccgaggcaccagctgtctcgactttcgagcaaatccaaccgacgatctggctcactgaagtagcacgcagcgcgtgcaggctcgtgcagggaaggagtgcctccacctcggggaccgcagggccccgtccggcggtgaccgagagattgagcctgctcgaaatctccgagaaaaacgcgtccgttgtcgtccaggaagaagttttcccacttgacgtcgccgtgcagaatgccgtagctatgaagccgagccacgcggtcgaccatttgcttagtcagctcgagcttgactccgtccgggagacgatgcgcactgaaaagttgccctacactacacgccaccttatgaaatccgaccacaacactcgtcgcaccgaactcctccgttaacggagtcattcgcggcttccccgcgaggataccctgaaacaacggcaggacaaacccttcttcgtacaactgctcgggtgacttgtcaggtggaaacaacctgagtactttcatctccttgcgaagagccctggcgaatgcccaatcctcttcgcgcctccaggcatcgtggctgaggtcccccacggcctctagaaacgtgctcatacgcacaagcaggagtttcagtgcgtatacgtggccgtcactgtcctgcgcctcaaaaactagaccgtttcctcccacacccagaagcgggcctctgacaaattctttggactcagatgcatcagagagagattcgacaaagaaacggtcgccatctggaaggtacatgttgaacgcttcgaccagtttcttctttcgcgattgcgagacaatgtcatgcgtgtttgtggtagccacgagatgggcaagtattttcaccgcttccggatcagagagggactcaatatgatgtggatactcgccaaggtgtagaagctcgctgactagttcgtcgtcaggtgcgttgacgctgtcggtttgggcgctgtcctctccacgaaggtcgtggtgatcggacctctctgttacttcttcaattgagtgtacgactgctcttcgcattacaaatcgatctggatccttggcacgatttctggagtcaacagctggacgcgatgaagcattgtagacgctcctcagaccagacagtatgcttgtcgctgccccccgccgactccggtgacttgtgggcaactgctcttcagaagccgttgccagtgcccgtttgttgcgaccggccgttggttctacatttgattcagttggactgtgaatagacccgacgggcgcggtgttatcaatttctgtataggaacggaaaacacttggcgttgagtgactcagccggcgcggagagttagctgacgcccataccatagtgttcggaagcagcgaccttgacatgtgcataaacagccccacggaatagcagcacaggagaattcgccatgatgtgaagtaaggaagaaggtctcggcaaacggcagccattttgttcaaactgtggagttagccttatccaggtcaggcgtacgagacacacagctctcggtcgcagagagcaactgggtgtctagcgccctcctgcacacgaaaacacgcgtagcagagctattgtaggtggtatgcgtattttccgccacgcgtggttaaggctacggtagaaaatgcggagagtggaaacctgtgctatctagtctgcacgtgtacctcattactcggcagcagacagtgagctcgcggatcctcctgaaacggacttcttcagtgcctcgctatgctgtcccacgtctcgatgcgaaagcgcatccgagggaaccatggggtcaaaaaagggagaaagaaccagacatgagtcatttacaacgacggacatgctcaaaatccatctgctgttggcagcgagccagtattcaagagcatggttacgcacctcgagtcatccgaccctcagacgggttcaaacctggaaagtgtatcggttagaccagtcaaaaacgagtacatcttgtgcacagaccacgctaatactctttctcagcgccgcacaaaggacgacgagcgcggataactgcacagcagatggctgacgtgaatccctgccacgaaaccatcgttctcagcatcaatttcacactttacatttccttttgccgggtaccattgcgcaggacgttgctacctatcaacggcggttgaaacggaaacacttcgacgcgagactgaaataggaagcgtgtttgtaaccaaggtcaactgccactgacaccaggaaacttttggcgtcatgtttgtgcctataaaaagacatggtatcacagcttcatctgtacataaattgtgaagaaggagtcactgttataaaaccccttgccgcattccgtgaacggaacactgggagacacgacaggtgttgacggtggaggcgtaaacaccgggtatttcccaggtttttgcaacgcccctcccggtacgggccacccccaccaaaaatgcgcgacgagtgtctagaaacggagaagttgcctcagtggttctgtgtgtctgcaagtctgcatcagctacttctgttattaaaggagcaagaatcctgtggatagagactgactaccacgatgcaatatagaaaaacgtaaattgacaccagtgagtcagtcgacttaacaaaactaagacacggtcaggctgtagcaaggttcccttgcactttcagtgccacaaacgcgttcacaccgatagtttatatggcgaactggggactcttgaacttccgaatcaaaatgtgtcctgtcatcgatggaaaaatgtcagggttgatgctgcatcggctgaatgccccaagccacagctagatgggtttttaccttaatacaaattctctgcggctgctggaatcttccgtgggcacaaattcccactttggttcacggttaaggtttcgcctcaagaagtgaaacaacacatcactcttgtctggaaaacggcgaatatgagatttccttggcttttccacagcatttgccgttgaacattcaactttcataggtgaccagtagtacgcatgacgcaggctagttgcttgatatggttcgagggcgttgggaaaatcgcattctctgctgcctcggtcggtgggcaaagttcccaaagaattgacacaaaatcgcagagtagactagtgatgtggcacccatggtcgccataatgtagttgcaacaccaccggtacataaacaccaaatggtcaaaaagtggaactgcctgacatgtcatactcaaagactttcgcttgacagtatgacgagcctttgaatatgcgtgttagggacctaggtggatcacgaattcttcgagatttctaagaaaaggtactcgtcttattcgtacctctagttctgatatggtgacggctgttctgtaaacaagcccctaacacaacactacacccatggctcccgatggtatcgctcaaggaactgcccacagaaaatgacgacgtactgaatctacattaccagaagtagatttgcgttcagaccgcaggtaacgatttgcttctacttgttagacacggacaccggtcttctagactgtgaagggtgttcgttgacggaaatccaactctttgacatctccataaacgcggtttttgccactggcaccgttgcttgtcaactgaaaaagcagagaggggtagctttcgcacgggatcagatcgatgttttctccccacgtagtattcttttatgcactgaggtgctgcagactacattagagggaagaggataaagtgttctgcctgtccactcaaacaatcccccacaagatcaggtatggatcggtcattttccattcttgtacctgcagaccaccgcatcacacgatacttcctagcaaacatgataatcgtggcacatcattctcagtggcaggtcttgctccattagtcttgtttctcgagttctgtcctctccccccccgcgatgagcttgatacggtgagaaatctgtacacttccaccgacgaaaggaagttctcacacctctcagtatgtcgggttataagttctgttcctcaacagaagattcagacaggactatgtgtagtttctgactgagaatggcgccacagtcccgaacaccgattcctctatacattcctccgttgggtatggagtcgcaagggaagaagtcagactggaatcctcttccttgctgaagagaggcaatccagcgtaataagcggcgtcttgcaaccagcggctgtatcaagtctcaccgtcgaccacacacgcggttgcacattttgcccctgaaagacttccacagagccccgatcgtacttggaccgggtaaaaaagacctttcagctctaaccggtagtccaactcggtttagatatgtcctcaacataacagctatccgcttatatatctacggaa

SEQ ID NO: 1418 - DNA, 1069 bp, Toxoplasma gondii
agagacgtctgacagaatctgcaggcttttcagacgcgtggagtttcgtcgcggctccctctcctcgaccttgcctcctccctctctctcgtcctcgtcctcttcttcagctcctaaagcagcagcatccacttcctggccgctggcgcgcgcagctgctgggaggaaaggcagtgaagcaatggcctctatcgcctcagagagagcgcggccgctctgctctggcgggtctccgttcgcctcttgttcaccctctctgtgtccttcagtgagctcgcaacatcgtccctcgcgactccgtctggatgcctcgccgcggcgcggagaagaaagaagacgagccaagtcaggtcgactcggaagagcaagcgaaagcacagacgccagtgcggcattgtacgtcgtggtagggggacgagcggtggggccatggaaggctagcggcttctgctcgaaaggcgaagaagacgaagggaggtccgctgcggcagccatcgggactgaagcgcgggtgaacaagcaaaagtcatgtcttcagggctcgcgggcgcgacacaggagtgaaaacgacagcgtctgaagcgacagagagacgcccacacgcgcggcaccgcttgtgtcgctgctgcctccaggtcttcgcggctctcgcggtcatccctgaagtcctaaacccgtcgtttacataactctgcctcgattctccaaaccgcatacgctggccgacttagtggggtgtacatacacctcggcaattcttctggtgtacatacacctcagaagactaccgtggtaatctggggaaagacagttttgtttgcgtgtcgacagtctggagttgcgttgttcgtcggcatcggcgctttccgtcgagcgtttctgagcgagcaatgctgtctttcccagtctcgcaggatctgccggaaacgggaagaccctttcgactgggattctgacaattcaactgtgctggcgtgtgtcttcccgcgctcggccacccactcacgcaggcgactgcggagaccaccctgagaggtgcgaggttgccctcgctttccgaaagttctga

SEQ ID NO: 1419 - DNA, 2743 bp, Toxoplasma gondii
ggactgaagacgttcgacccgcagcagaaaaaggagacagacgaggaggaacacaggcgaaggcggcgagggagaaaaaggagatagaagcaacggtacagacaaaaggagagaaggacaagaagaaggagacggagggggttcggggaagggaatgaaggagaaacgagtgagtgacgaaagagaagaaagaaggacgcagaggagagagtgaaagggtaggagaaagaatgacagagaaggcgacaagagaggttcgctctctacctggtacacagcgccgcctcctgtgtagcgtcgagcgagcttcacaccattttcctccattttttgaatgttgcattcactccaggcattctggtgtcgcccgatgacgatggttttgtcatttctccacagaaagaggagcggcgcacgaaaccctgccctctgagtttgcgcctcgtccctcttcgtgccgctcccaccgacggaggtcaccaggcctcgaccccgcccaaggacgtcagcgagaaagcattctgctgcgaggttttcgacgatgtctgaggaagcagaagagagaatgtggaggtctctcgagctcgacacatccctggaagtcgaaaaagctgcctttccctgcccgtaggaaagggcaggagtccgcgacgaccaagactcacgcagcgcggcaggcgaacagtgagagtttggactcttccttggagaggagcagttacgcggaaaccacggagcgtcgccagagcaactaccctccttttttgtctgaaaagaatggaccaagcaggaggcggtggaacttggagaaaacacagatttgcgaacaaagggcagaggaggacgaagcgccgcccgactcgtgggtacgagggacatggtgtggaagaaagaaatccgctctgcaacagaagagaagagactcgagacggtgagtctcgcgagggaagcacagggaaaaaatctcagagagagggaagcttcaagtggaggcaatcaacgacgggtcggtgagagaacggaagcaaggacagcaaagattgaggcgacaaagagagccgaaacgagcaacaagaagggcgcaaggaaggggatgagaagagagagacgagagaaacacgaaatcaagggcagagaatcccccagaagcggtcagccaggcccaggagagaaagagacgtgaaacgcagttcgctgttttcgcaggtgttcagcggaacccgtgtgatatctggaagaggaaggccacgaaaaagccccgggaaaactcgcgagtcactggaaaagagaaactacgtggggaatgtgaaacaatcgtgagcagcgaagaacaaacatggcaggacgcggcgccaacgtccacgagccgacaggcgggcgagagagtctgaagaaggaaagggggcaaaaagagaatcggaagagaaagaaatgagaaggtcaacgaggtgagatcaacaacagcgctgacgagtagagatgcagcggaaatgtggaccgaactggccaagcgcgagttgaactgccgtgagtgccacaagggggggggacggagcagagcccaagaggcgaaggggtgtagaggcacttcttcgtcaaggagaaacaatccactgttgtcattgagagcaaaaaccgatcaaaagagtgaaaaaaaggaaggcgatgagcctcttttgaaactgatccaaaacccacaccagatgggactcgaacccacaaccttatccttaggagggatacgcgctatccattgcgccactggtgctcaacaagtaaccctctcgcacgccgtccttcgccttctttgatgcataccacgtctccaccaagaatcgcacgaagcttccattttccaaaaagaagcgacactgtccacacgtgacatgtgactctccgcagaaatctcgaatgcgcctttcaaggtgagcggcaactctctgagaagggcagcgtaaggggagaacaccgaactcggaatcagtcgattgtttctaactggccagtttcgttcgtgtggacaacaggatagacaacaaagagtgtttcaacccaggggtgatctataaccgcaaaggtcgctcacaactaggcggcatttaccgaaaatcgcatgtcgtgtctgggttacaagacacacaaaggcgaggcgggagcccttcgctgatcgctataccgctgctttaactgttggctgcgttccctggaaacctccgtttccttcagcccgagccacatggattatgtcgttgtagagtgagaaaaaattgggaacgcggaagcctagctgcacgattgcgaggcaaaaagtcggatgaatcgacgtcgttgccactcgacaggcgtggcggccaagcggagtgagtttctcaacttttttgtgcatgcgctttgaatcgacagccccatcgcagccagtgaaactctccacgatggacgcataccgttgatttcctagagattcaaactccgcttagttctcaggaaatatctttcgagcagctgccgccgcgccattccttgtgctgccgaaaaacaatgcaaagtaatcgaatcgcagcgacagtggcgagcatctcttgcgtttgtggcacgcaagagaactagccgttcctttcgacgcaacacgacgaaaaacgccttcttttcttttgaaaaatgctccgtacagtcccttccctgttctgacaggtgctttccccgacttcctcctttggttctggtcgtccgactttattgtgga

SEQ ID NO: 1420 - DNA, 3078 bp, Toxoplasma gondii
cagaccctgcaagctcgtgaaaatgtttccttcttcgtcgaacgcgaggacgccgacgtctccaagttgaccgactgcgaggcgtcggtctctcgtccgaaaggcgattcgcgcgatgggcgcgacgaccgcctgcacccgaagcgcactgggagatacctgtctccccggagaagacgccggccgccccggcgaggcaaagatccaggagcgaccgcgcttatgcggcgtgtgatgcgaggcctcgacgaggactctggggagacagacacccgcgccgctggccgagagcgaagtggaggggaggagacaggcggacgccggctgcgaaggcgcgcagtcgggatggagaacccggatcaggtcgggatgctgcaccgaccagaagaagcaaggcgcggccgcgagagacgagccgttctcgacgatcagcagcgttcgcacggagaccgacgcggacgcgagacgaccagccgcctgagctggcgagggcaggagcacttgcgcaggacctatcttcagctgaggctgctcactcggcgccgcacccgcagcgacgccgggaagcctgcccggcgccggcttctcagggtggacggcgagaaggagaagagcaaggagcagaaacaggaggaggcgggagagagagaacttgaagagcaaggcggaacggacggcggaggcgccgctggaaggaccgcaaaacagagactgagggcgcagagaagagggatgcagagaggtcgacggaaacccaggagaaagagcacaagtcaccgcagaagagaaggcagacgaagagacagcgtcgaagccgggcatggccagaggcgcctcgtggcgtccgacaccgtcgagctggacggtacggcggcgcgaggccgcaaatgcgcgcatgtttagagacaagaaatgaaggaaaagcggaaagaacgaagagtgacggcagtaagaaacgatggtagtggaaaaaaggggaaaattcgggaagaaatgagacaaaagaaagacaaactgaggagagaaggggcgacggaagtggggagtgtctgtacacgaaagcgggtaaaagtagcgacagtgtgaaggaaagtgagacgctgagcgtaccgttgatctgccgtcacacagaaacagaagccatgcggccgcctggaggaaaacgatacactgtaaaacatcagatcgacggcaagcaggttgtgcggacttcgcgctgactgtgttcggcgatgcctttcagatgtcgcaagtcaggagagaagcgtgagtcaggcaagaggaggagaacgcagagaggacgcgagaagttgacagcctcgagacggtcgaagacgcggagacagttacacagcaagacgccatcgttggccaagaagagcggcgcaggccgcgacccggtgagacatcggtttcaccactgtcagccgtcgtgagcagtcgaggaaggcgatggtggatgcaggagatccgacgaagcgtcctcctcacgagccgcctgaagaaggacagggacgcagcggagggagcgagaaacgcgaagaaagaggagacgaaaggctgggggggagagtgacaaaagatgaaggaacgcgttccgtcggagtctctgtccacgggaggcgtcgtctgtagagagaggacagaagcgacgttttcgcgggcgactcggcggcaccacacgcactgcggcggagtctcaagttgacacactggccagattcgcgaaacagcgaggaaagatgtgagcgggatgaaaaaggcggacctgccggagaacatgccgtccagcgtccaaaaaaaggcgacgaatgtgccaagccaagaccgtacgaaaagacaaggagacaagacgccagacaagaaactgtggagtgcactcgccgagcacagcgtcagcgacaagtcaagaagttcgactggagaaaaaagacgagagagcaatcggaaacccaaaaaatatatatgtgcatgccgctgaacagatggagactgcgggtggagacggtaaaggcccttgggtggtcgagagaagtcaaacagacgctcccgcgtttcccccagtgtgtgttcaagcgtctactttcaaagcagaaagattgtctgggcgttcgcagcttcgcttcgttctcaccgctccccttttttcgtctccagagagacccccccgtgggcggcggaagaagcctttgctgctttgcggttcttttccgcgcgtccccaccctgcctctctctcagcggtcgctggcggaaacatccacaaaaagaagaagcgcgacttcctgcgggggaagagacggagaagcgcgactttttcttcgggacatcctctcgcctttgactgggaactcgagtccttcgtcttttgtctctcttcactctccgcctcgacaccaccgcgacgcctcggacagctggaaaagtcggaaaaagagaagaacgagaagaacgcactggttcgtccaaagccagcacggcggaagtttttttgacggagaagctgaggaagaaaagaccttcggacgacgtcatattgttctctcccgattccgacgtcaaaaatctgctctccctccgtcgctgctctttttctcgagggtgcctgctcttcttgtgaaaagagcgtcgagatgcacacagctgtctacgtctgaatccgttcatcgggtcgatcggaaggacaagcatcgcgtcggacatctctcagtcgttcttcctttagcgcctgacttctgctttctctgatctgcagcttcgaagacgcacagaagactccgtttcctttttccccatcgggcgacggggggaagaacggacccgcgccccccgagagctgctctcgtttttcctcttcggtgttgcgcatcacactcgctgtctcctcgtctcgcctcctctctcctcgatccgtcggattctcctttccgttccttcccctccttccgttccttcccctccttccgttccttcacttctctcctctttctttcgctgcttctcctcccagtctccttttctctgtcgcggcgtcctcttctcgcgccttcgccttcccctcgtgagttcctcgccgcca

SEQ ID NO: 1421 - DNA, 2852 bp, Toxoplasma gondii
cagcgccaactgcagacaaactggagattgcgattgtgaggaaagacccggctgacgattcgcgtttgattcagcgcctcctctcaaacgaagaggttacggctctcatcaaaaaggcgcaagagctccaggctgaagaacaggctccgtaaaaatgagacggaccactgaagccaatggtcattcaccgtcatatgtgacgggggggttctgctgcacttgtgccgtcgtacgcaaagtgttagaaaaagacaatcgatcaagtgcgtgggtgtgtcgtttgtgggatggtggtgaagctaccagtgagtgtcgtgtagaaaaacgagttctgtctgaaaagaaaaacgttcgagttttacgaacaaacagtagaattcggggaaacgggggtcacaagagctgccttctatttcgccggcccagaaaaagtcacacctcgggtcgcaacatcgtagattcccgtacacgagagaatctgctttttctccctttccaaagtataggaagtgccttcgactcagggacacagcgtcagaggctcgttgacaggaacaaatctgctgttgctttcgcaaaacataaatgtgcctttagccagaccgtgctgttgtttgaagctggcgaatccgcggctggaaacaaaagtgcagccggaaaagaagtggaggactgccacgaatgtaggcgaacgaatgtgcgatgtaggaacgtcacatcgtcggtgctttggaggtgcactaaaacagatttcgggtcttacttccggtccagccacggttttacccgaagtaagtaaaggattttctcgaaaaaaacctgaagagcgtgaacgtgacacacgggaaacattaaggagcaagccgtagagctaccctgcaacaacggtcagagtggtagactatgaactggagataaaccgttttcaagttctaggacaggccagcgggtgtgtgtgcagtgccaccgctcaaatagtcgcagggcgacacccccggttccgagggtgatagaaagttggtgttccttaccaacagtcgaagggcgtagagtgaatggcattctatggttctagaaatagaaccatcggtgaacacttttcttcgcctggcgactaaacagcggaaaacgaatcctggtaggtgaacttttgtaagcactgacggaagaactcgacacgcagagtgatgacgacgacagtctatgttttttcattcatttttaccgaagcagcgtggagacacacaagaacaaacccaaacggatgtccgtccagcgatgctctgacccttattcgtatcgccgcaagcagttctgtgtgagaaaaagtcgatcagcgagcgaaattcgggaaggtcccccctccactgacttggattaataaggagtggcataaataataacaaaccaccgttttttggatgcagttgcctgtagttccctgagcatacattctatagctctgctttggacactgaagccatcccacagctcaaccatgtattgtctacctctgttaattagtgtcagcactgatattctgtaccaactgatctgcaaaccgattccaccaacaatatatatctaacgtggtagattagctcaaccgtatcgcggaatgtccgttcaagggggctgttgtttactcaaagccacactgcgagaacgaaacggcgtcaacgttccaagtcgaaactacagtaggatgtcaacgaagcatgcattctccccgcaaaatgttatgtgttgaaaaggtcgagaaaacatgaaatgtatactgggcagctaccgttgagaaaagcagtgtgggtggaatagggaaacacaaaaacggttctagagtgatttcgcttgtacgggaagttggattcccagtccacaacggaccctccccagtcgagagctgggttcatctgcgtcgttctggcagtttgtccggtacgcggggaaccgcagaggagcgattttgccaaagatgtcagcgttacataaaccacgaggaggtgcaataagcctttttccagagcacccgttgctcccaaacgtatgctcaggttgaacgttcttgttgcgcccgtggttttcacggtttgctaatactcgatgtgattcgtgataagaaacaaaggccagggggagaggaatgctacaggaaggcactgtttcagttctgcttccttctgttgaactggcggtaccgttttccaacattattctcatcgctcggctgacatcatcacaacctcaaattcgagggttagaacgtcagccacatgaaagattaaaacagttattgttgtggtcagtggtgccaaaacggctggagtttcagacttacatcgagacagacacgcgatcaaggacgcttgcagaaaaacgcagcgatttcgcgaagtgtcctccccggggataggtacgttaagatgttttttggtttgtatctcagcacgccgagcctgctataattgttttcgcgtgtgtgttagtgatgaagccacgtttctgcgtacagcgtagtttttgatgtttcccacctccaccttgctgtcaacaacgtacatccaacttcccctgcggcgcaggatagcctgcaggcaaaagaccgaaatgcctcgcagagaaactatcgaaagcagacgactaacactggcatgatctaaagcctaacatatgaaaaaagagtctcacgtccatttcgaccgtcttttgttggagaggtcaaaccaacggtatcgtgtcttctcacttgccaaagtacttcatgtcactaggtcggacgtccacatccgtttacacaaacacaaccggttcgtcgtatacccagggtgtttccctttctgatttatgcaaaa

SEQ ID NO: 1422 - DNA, 2314 bp, Toxoplasma gondii
cgtggaagttccgctttgaagcctgtgcttccgcaacggaatccccatgtcgaccgattggtgaggaagcgggagcgcagtgtctaatcacatatttatggccgtggggctttgtacatcgatgggcgtttcgtttttctgtgaatctctcttgaactcgttttttgcgcttcatcaattcgcagtgttccacacagtctcgctctcaggtggcaactggggagcgaaacgttctttgtcgacgttctacaggacgaaaactcatgcagtctcgtcgtcacgttgtcaagaccgggaataggtcccgaaaccgactggcttactgttacggagcaacgctaaaacagcagagaccgcacatgcgcggcacacgcttgcgcacgactataaccgagtctatacgtacagaaattcagtgagtaaatgtacgcgtctgtataaatatatctgcacatacctgtgtttatctgcatgttttgtttccaaataatcacgcaaaacccgtgcatgaggctgtgaaagggggacgctgttgtgtgtcttggatgccctttgcgacgggaacacaagcataacctctatgtcactggagatctcgatccacgaaaaccacatcctccctccagctgtttgtttgcactctcacaaccatggagattcttttctgttgtatcaccaaccaccggccgaagacaactggttttcgaagacagtgcattggcaccgttgagcgggatgcgacctgtgaagatggaccatcattcacagtgaggcggctcagcgtagtaccgtagttcgacgccagcttttttttgccggctacgctgaaatacgcaatctcagtggactcggggcacttaattcgccgcctgttaacgtcaggcgactgccacatcaagaaaacgcctgtgtctcacggacaggacgcttcccccaagtgccacagaacctctctggtgtacaaatagctgccgagtgttggacggcgctttccgcagccgttttcgtttcccgtgtgtccacctctcagcggcacttttccacgctagggactatcgtgaatttaagctgcgttcgagcgtgtccgcctcccactgcgacaggcacaagccactttcacctgcagcaagctggtacgtttggttctaaagtgcgtagaacaaattcgagtacgggtgctgctccgccgctcctgccggcctcgctcgctatgcgtgacattggaaaatgaaggattctgcggtgtcagtcgctctgtggctctttgcgagttcaagaaagcggggaaaaccgacagtcaggctgacaaagagagttttcagtgcacgaggaagctccgtggagcgacgcagggggcgcgcaggactcagagaactccggacgcggggagacacaaaaaacagaaaaacaggggacatgaaaaatcataagggtgaaaataaggattatagttcgcacaggcaaacggttatgacgagccggagccggaggagccagaaaatctatgaaaaggcctctcagagtgacagcgactctgcatgctccgtgtgtcgatgatgctcactgtttggccgcagcgtaggtttcccagtgaaagctttctgcgccaagacacctgcgttgtgctacagttttttcgtttctcgaatcacctgttccagacttgatcgagtttttgccaccgttctttcgctcgaaccccagtgtattcttcgtccagtcttttgccccttggcaacaagccacggcggttgtgcgagaggcctggatagtcgcagcagaaagacgtcgatgaggcatgtcgctggcaaaggcggcaaggcaccggaaaaaaagctcacaatacccagtttttgatcaggtgagcccttgtttgtctctcgtactgttcggtgaaaatgcgaaaactgaggcaggtctgttttgcttctcttcctggcggttgcgttggtgccctgcagttcgtgaactgcaggaattggcgttcttccgcggtcgtgtaaacgagcaaagacgcgcggcaggccctttcgcgaactctggctgtgtttatctcccgctgttccgccgatattactctcccttctttctccgtttgtggtgcctctcttgttttcttgattgccttggcttgtgccttttttccttcgatactcccggtcacgtccctgattggatgctgctctaaaacccgaacaaaagtgtgcacgccagcatgcataggttttgcgttgcactttccccgttcggtttggccgcagagatcgctgctttccccgctgcccgtcgtttctcctccccccacctctgtcca

SEQ ID NO: 1423 - DNA, 1827 bp, Toxoplasma gondii
aaacatgtgtataggtgtcttctttgccctccgcatctctgtctctcagtcgcgctccgcggctttctcgagacgagcttctctttcgccgttttctccagacatcttcccgcttctctccgtgtgcattcctcccctcgccgtgtctcctctcctcgcgatgtctcctctcctcgcgatgtctcctctcctcgccatgtctcctctcctcgccatgtctcctctcctcaccgtgtctcctctcctcaccgtgtctcctctctctgccatgtctcctctcctcgtgtgaagagtcgctgctgtgagttttctcttgtccacgccgtctgtcttctcgatgccagtgtctctcgcctcctcggcctgctcccctctctcttctgctgtcgcaatctcgcttcctcattctttcgatgcgaaggttcctcttgagcgcttgcgcgaacaaccgccgttcgcagaccagcgggtcgcgggaccgtgagaggcagcgagctgcgcaggatggaagggagcgtcggaacaccctgaagtcattccatgtggacacagactcttcgcagatgaggggaaagccttcgtttctccctgaagcttgttcaggaacgcgtagtcttgattgaagcgctgccggcgtagtccgcgagtcgagctctgattcaagctggccggccttcccccccgagtcgcaagagaagttgcctctcaactgccagtgcagacaaagcgcctcttcacagacacagactgggaggcgcaggagcaggcagagcgcgcacagcgcgacgacgcacagccgcgtccgcgagagtcttgacgcattaggtaggttttcaggctggtgcagtttactttatcactgcatgcgcagaacaacgactcggagctcgaaagcgcagacgccaccgaggagagcccacgggacgcgctagaaacttaaaggcgtccggggaagacccgattctccgcgcagagtgcgcagtggaggcaggtgccacaggcggttgagcggggaaaagcgagccgaaaggattcagcagcagaaagggcgcagtgcggagtcgatctgctttgaatggccgggtgaaacggcagagaaagccgttttccctcaccagcgagtctcgagacaaggaagtgtgtgcgcaaacgaacagcggacacggcgcgggtgtcgcttgtcaacttgcgcgattctgtgctgtgcgggtcaagacaagggcggactaccgagtttttctcgagtttttcttgagatttcgaaagccagtgccgtgcacctttcccctggacgatgggtaagcgggatctagctgcgaaaagttgacttctttccggcagaaaacttcctagaccaccggaggggcttccgccgactcggcgtttcgcggtccttgggtgacctgcaggagatcctccacgcttgcattttcgtgactcgccgttttctctgcatgcatcttcgcgcggtgagcgcgacccccccacagctgcggtgtgggacgcaggtttgcccgcatgtcggctaaaaacagctcgcgtcttttcgcttcagactggcgcatgcgcgccgggggaaaaaagtcccccaacgcatctttccacggcagccgtgtggcgacaacgtctctggcggattcgcgcgtccggaaggaaacagagcggccattcgctggttgtttggagattcgagttgcacgaggtttcattgtctgtcggacctggtccatgttttctgctttctgacgcctcttccgtggggagcgccgagcctgtactgggcgcctgaaatcgccgtgtgggcaaccgacctcgcgttctccaaaa

SEQ ID NO: 1424 - DNA, 2128 bp, Toxoplasma gondii
tttttgttccgtctcacccgtcgacgtggtcctgcttcatttcttcgttggggaaatgctgcatgtaggagacgaggggggcttgtttgacgaagtcgatggcggtgccgaaggagaattgggtgcggccttggtggaactgagacagattgaggtaaggaaaggtgaggcagtactcagtccctgcaagcaggcaggcgtccaaaaactggtccctcgtcacgttccatgtggaaaggagttgctcaagttcgacccagtcgaaagttccccgcgcccagtcgatgttaacgatgacgcgcggtacgccgaaaagaagaagtgaaggcgggccaaagatcgcgtccagaaagttctgctccgcaaagtacgcgagctgcgcagtggcaaagaatggcgcctggaagcattcgcagcccttgcttttgaggaagtgcagcgagaagtggacaaagtccgagttgatgcgactcgtggcgtgggcaaacttcgacagcgcgacttgtccaccgccgtgcgcatacagcatccagccttcgtcgatttgctggtgaatctgcgaggagaaaagcgtgtgggagcgcggctgcagaccctgaaacacgaagaacgtcgggatcttgtgctccttgaacagcgcgacttgttgagacaacaccgcaaagagcgagggcggaagcccgccaatcgcttccgcaagcggatccttcaaactcgccagcgaacgcagccaaaacactgcgtccacccccaaacgcatgtctgtcaacgcctcaatcttcccctgccggagaagcatgttctccgacaggtacgtctgcagatgtcgaaccctcatcttgactgtctgcgataggcgtagacggacagagccacctaagagcgataacgtggaacaggaaacaacacgtgcgatgaaaaatagaaaacggaaacgaggacaaaaatgggctgcaaaaaacgcggacggattggagggggggaggggaattgcgagacaaagtgctcgactccacctccttttcggaccgccgcctggtccgttcccaaagaaaacagatgcagacacgaagaaccaggaaacagaacgaaaacgccccaagaaacgttcttccctcggtcagcacatactgagtgttgccgggagtccgaacggcgcggcggcaggagagacaagagacggaggagagaaacacagcaaaggggtcgacagactagtaaccgcttgatggctcagaaagtgaacacgtttccgtgcctttcctgcttttcaggcacaaggggaaaaacagtgtcgaccctttctgttctgtcccgcagcgtccttcaaccccggaaagcaatcgcggcccgccgtcggctttctgcgtccctcggccggcaatactccgctgatcttttactccagaaaaaaagaaaattgacaaagaaaaaagctgaaaggccgtcaggaggtacagcaacagtttcagcggatcaagtccatcccagttgacgatcacgaacagtaggcgcacagcagtggtctcccactcttcttgtgctgtgtgtctctacgcctcatccgcctagtgctgcttttgctttccgctgtttccctgccacaactctttcagggacgcgggcggtttcttcccatctttagtgcactgccgaccagattgagggccctctacttttcaaggcgacgcataaaaaagccgatttgagcgcatcctctgcatcctcttcacccgtcgcgaacccgttgtactgcgaatcggggaagtacgacccgcgctttgacggaaaattttgccccagttttgctaagattccctgttgtttgtagactacagaggtctcagataagcagagttgtcatttcttctcgccgcgcgtatctgcttgttaatgttctcctgccggagacacacacaacgctcaaatccacagctcgtcgaactgactttttttatcggcctctttgaaattctgccacaattttttttcaaaaacgttatttgaagccgtctgttccaccttcatttgagtcgctgctcgccgttttcgctgcctttaacggactcagttcttctgaggttcggctgtctcgtcctgccgttgctgtgcaccgtcaccgaaaaaa

SEQ ID NO: 1425 - DNA, 2163 bp, Toxoplasma gondii
aactcacaagtttcactgaagcctctggcgcatccaggtgtagccagccaacggaacacgcgttagcttagcatgaatctcggaactgactgaacagtgtgagacgtcttgacttgtgaatcactgtcacattttgtgagacctttctaagaaatatgcggtgtccaaaggcgccccgttgctttttacaggtcctcctactgtcgaatgtggagtcacttattattcgttaggtgactcgaggtcgcgcgaacagccgccccaaaacgcatttgttcacgtggtagcggacagcattctaaaacagatgactgtgggtttcctagtcgccctaagccgaattactaggcagctgagctgagaacagagtcatgtgagtggtcgcgtgaaacatgaaaaggtagatgtttcgccgctcgttttcttcggcgaaggcaccccagaagtttcttcgcagatgtatacagctaaagcagtgcgattaatgaagagtactccaataaaggttgcagcgttgcagaagaaccgcttccaccatcggaacgactgtagttcggtttgttcagtgaaaacagcacacagcattgctctttttcagaccatggagacattccacagtgcgtccaggtttcgtgtagagtgagcagagccacgtacgaccttcctgttctggttaaagagctacttcggagcaggtgtgaaccatcgttgtgcagcagtatcggcacgaaccgagaaaatgccgcagccgttgtaatcagccagtttccgtgcagacgctattccccgtaatgccttggtggagttcccgaaacgagtgtcagtctgctctgcagacgtttcctcatcagagtgccacataagtagtccttgtgtccctaatttgtgggtcacctgctttgttgtgtatcgctggatggcttctgcgcgggtcctaggtcctctccacgtcaaaaaatctgtcatagtcttgttcacgttcgcatgacaacgccgtgagttgagctgtttgccattaaagctatcttcttccgcaacagattggtgagtaattatgtccgcatggtcagcacgtgatacagctttgctgtatcgtttccccttctgctcctccggacatccactgtagacattgcgtttgtacagctccatagcgaaattaccccgtaaacgaattttccctgccggtggctctgtctcgaaaatacggtaatgggtgtccggtcgcgaacgcctctcactttgaagggaggagagtcttctccggacttcagaattgctgacttgcacgcttgattcctgctgcagtaaactatggttcgcctggcttctagagataaaatccgtattgccgctgccctttgagggacgagaccgaggtggagggatacaactgtaaatgtcaggttccaaacacatgcacatttccctactggaacagttgctaattgtggccaaatagccagtgcaggtttgcgtaggcgtccatcctgcaggacatgagacgggcgttgtttcacggtgtgaatcaggactgtgtgtcacagggtagttgccagaggggtcgggccagtagcggcggcgaccccgaaaagacctccgatgtggcgaaaccgctgttgcgagaccagcagggcggatatctttctggtccggccccggcgctatcattttttgcacgccagccgccacgttgaccactgcggctacaggtccgcacaaagaaacagggccagcaatacagttatacagcacggcacaattacacaggcggatttatgacagcatgcttcggtgtcaaagtgtgtgtttatttaacagacaacgtgtcagatggaaatagtaaaaattgaggaagcgttgtggggaaattgcagatgtagggccattgtagcagaatgtcctaatgcagacgacaatcgttacagagtgcaggactgcagcaccttatcactccttttcttgaatgcagcagcctagcagaaacctgctggctgttcgcgtattaaactccttgtcttcaatttgtttctgcttcattgccgctgagtccctagccccttttgattcattgccggcggggctgtggccgccgacaggcagctggcagagaacatgcgcttaatgcattttggtgacctttgttgaattccgatatcacaa

SEQ ID NO: 1426 - DNA, 4114 bp, Toxoplasma gondii
cccttcagaagttcagtcatcggcaggaatccggaagagctttcgtccagcgtttctctctctctcttctctcgccgtcgttccttgcgcgccacgtcttcctctggcgaggcaggacgccgccacaagtcactctcgttttcccctggttcgtctcggactcctctgccttcccgtgtctctttcctgagctcggcggcggactgaggacccgaccgactgccgggggtgtcctgtgggagtctacccttttcgctttcttccgcgccccgtccctccgccgcgtcgcctcctcttctcccgcattccaccgatcggctccgacgcccgaggctggacgcgagacctgcccaccaccgtttcttcttttgttgcagacttctgcctcggaaaagcgattcaagactagcagcggactcgcctcgctcccaggaggttgcggggtcactcggttcttccccaaacgacgactgcttcacctgctggcttgaggttccgacatggtcgtcaccgccagtcaggtcgagtccttcttctctttccgcgattgtctctccgtcggacgcccagtccctcccgcgttcctctgcaggggcgcgctgcgccccgaagccgcaggcgtccctgccttcccccttttttcctttgatcccctcctcgttatcctgggcgctccgcgtctctgccttgggcgctttcggaggcgaagaaataaggaaaaaacgctcagcgagggttctcgacttctttagagagacgtccggcgcctcctgcgagacgcgaatcgacgcctccttgacaggtgaagcgacgacatgttccagcacacggctacctgcagaccgaacttcgcctgccagagccgcctcagtcctcggcgattcctcggtctgcgaaccagacagagcgtgtgtgagggatgccacgtcgggtcgggactggtgtccggcgcccgcagcaagttgccagccgttttgctcaggtcttttctctggaaggaaatgccctctggatgccaagctcctctcggcgtcctgtggggcgggactgatgctgcggaccgtccctaaaaaagggcgagccgaggcaggcgacaaatgatctcccttcacctgcggcgccttgtgttctgtggtgaaaggatttccccaaacagaagaagtcgagaaggaaggaaacgagggcgtggaacaaatggggtcctgaggcgtgctggagtagtgtagcgcataaggcacagaaggtgcagaaggagccgggagcggagacgagggggaggtcataggcgagtaagactgacctggccaacatgtggaagagctccccacgcagtgcggaggaacagaagaaactacggaaggacgactggccctttccccacgatgcatgcgctcccggtcccgacctcgggactccacagtggtaggccactgaggcgaatacatcgctgacaaaggaagttagaagaagcaaaaacgcggcttgcctatacaaaaatgtgcgagtgaaagagctaccccaatcaaacggaattacccgtcatccgtcgccgcagaaaaacgatgcaaggatatacatatatatatatatatatatatggctatgacaaacgagaaactgtttcgtttcctctcgctctcagtatgtccagtcgactaggatttaaggtgcacaatttgaattctaaaatagcgcttctacagagaatataacaagagacgcggcagactcttccaggcaaagattcagtgggcgtgagaaggcgggacgacttgggaacaaggtggaggtcaagcgttgacgctgaagcctccacaccggcaaaagggaagaaagtgaggaaacccccagaggaggtacaggagaaagttcgagggaaacccttcgtagacactataaagtccggttgaggacggggctgaaacgcagcggcgaagagaaaggcgagcacgggacgagaaagacggcacacaaaagaagagagtcaaagaggcgacaaaaaagcagcgagaacctttggaaatcttaggagagaaagagaaaaagaggcacgaaactagagcgtcaaacgcgtttcagatgcgcgtgacttcgcgagtcggttagaccgaagaaacacaccgacaggcgggggcaaaccctgaggaaaacacaccaaagaaaaggcagagacgcgagagggaaagaggcggaccaacaaccgatgaaaacacggaaaaggtttctgcttctggagcgcctcgaaagcatgttgggccagctagatggcggcatggataaaccgaccaccggaatttctctctgcgtcatcaaatgagaatccgcgcaaatatttttcgccttttccctgtcagagctttactgggtgtgctctctttcttctcgaaaacgaggctgcgacggtttgtttccagcggcgaccagagagatacgtagtagacagttgtcgattgaggacggctcttcccggcgtttcgttccctgggaaactggcgcattgaggcgaataatattgacgatttccacgcacacaatccctagtgagtaaacacgacaaaagagagaatgcaagacctcttaaacgacggaaaacgcaggcacggacgcagcgagagtaggaatcctataggaagccgctctgaagaaccgctgggaagctagcccttttgccacgaccatcgaccaaaaacatcgtcccggtttcgacgcgggtcttttcagtaaaaaaccggtgagacaagaagtctctctttgggagtttcctctcccaagcgcagaaagcagctttccagagaacagatcaattttctcgctctctggattttccgcagcgacgaggaacccgagaaagaaccacgagaaaggcagagcgcgcttgactcttgaggttcccgcgcgcactcgggcgcgaggggggagacagagtaacaaggaaggcagggaaactttttggaggcgttcttcgggaagcaagaagcagcgagacggtctctctgcttcagtttgccttaaaagacagaaagaaggaagaaactgcgacgcagatcaaaacgcacggagaagaagcctcgcgcgcaggcacactcgaacctaaatccgcgccgcaggctcgagcgtgacggcagcgggacatctggaggtttcgcgacaagacacgttgccgcctttcattctctctgtgttgccttttagctaggcacttcttcgcgctccgaacagctcggaagatcacggaaatgagtgcggaagacaaacagtgaacggacaaagagcaaaaaccagactgtcggggactctccgtcgtctaggacagcctagaccgcaaaggacgccgcgcttcaagacgtctgccgggcacctcgagagcacgataatcgcagaaaagaagccagagcccgcgcttaacactttctcgtgttgggagtaactgcggctgctcttttaaacaaagagtagcgcgagcttctccgcagcggtcgagcgcgcggcgcggcgcagggggagcgggcgagaaccgactctgcggaaaaactggaccgacaaggcgcagcgcggcggagcaactttacgcagaggagctgaaggaaagaacctgcagtcgtttcttcctgatccacgatgcagacttcaaaatagttttttggttggaaatatcggggtggcgcttttgctgtggtcgtcggtccgaactcgtgtgctaggagggagaggtatacagaggcaggagacccccaggcgcaaaggtctcctcctcgctgctctgcaaagagagcagagtagagaagagattaaaggaaagctttgactgagtcgaaaaaaacgccgaagggacgaggaagagtgaacgggcgagaaacatcgcgggagtcaatatggctgccgcgtcatcacagccaacgcctctgacctcaactcacggtgcgtcttcttctgcgtgtctctgctcttcttcctgctgctcccggcgctgtcgatcctcccgggctccaacacacactttcctccgccttctacatacgtttctgctctttctccccgattgcttgcgtgccgtttctttccaacgtgacgcatgcgcctcctgtctccttttccactgctctgccactaaaaa

SEQ ID NO: 1427 - DNA, 1770 bp, Toxoplasma gondii
gcgttctgaatgtacatctctctgcaccttacactactgttacagcattgcattgttgttacagacatgcgcatgcatgctcgcatactcacatgtcaaacacagcacagaaggaaccatgtctccccatcgacctacagacctgcaagtacgcatgcacccggagtgtgcctcatgctatgcagacgactatacgcagacggagagacatctggggagaagggagacgagaagtcgcccacggaaacagtttcagagtcatcttcggtggatgtccttgcagcaaagtctaaagatccggcgaaacactcctcgatcgtgagattccactgcgcatatgttcgtatctagatgtttgtaccagaagcagcgagaaggagaaaatgaagagtcatcgagttctgttgcgagtgagttttgcatgcaagtgaaagagggtgaaacgaggcacagtctgcgcagagaggaagagatgtagagccagccgacaaggtacaggcagacgtctcggccctcggtgcggcagagaggagacgtcttgcagaaaccaggagaccagtgacgagacaccgctgtattcagctgcatgagtgtacttttccgagattcaagccgaaaaaaaggaggcacgctcgtctcttcggcagcgagagcggagagaaggaaaagaaaacgagagacgaagggatgtcttcaccggtggagaaggaagaccagggagactgaccgagtgtgagtcgaggagcccggcgcgacaaagggagttgcggtgtcggacatagaaaagcgaaggaaaaggagagaaggtgaaggaaaaggaacgttaaacgaaagagatactgttcttcccggacggcaggaagacagcgagaaaagtgaacgaagaagcgaaaaaacgagactcggcgatgattagtggagaagaatggaaacgaattcaaaagcagcattcacaagacgagagagaacctagataaaccgcgcaagacagagaaaagaaggaaaaagtcgagaaacgaagagaaaggaagagcgcccgcttttcgctgtcctttgcccccttttgtttccgagatccagacatgcaaggtgaaaatttttccttgacagctgatgccggtggcatctgtctccacacgccctgccctttatactcagttgtcttttcttgaaatcccccatgttaaacgcgaaaaaaagagtagtggaagagaggttgattcttcgtttctcggagatgcaagggaggcggggaagaaacgcgacggaactctgcctctctcgcaaaacgtctggaaagactgcgaagatgtagactcttcaatttcaagttcttttcctctttctccgtctcgctgtgtgctttggtgcgttctgaacggcgccggaatggagtccggattgcattaacaacacacgggaggaatcgagacagccttttctcgcttttcctcgacagcgtctcctcttcacggcctctcttcttttttcaacggcgggatcggattgtctccttgcgcgtgcggttctttttggttctttttccttccactttcgttcttttcctctgctgaaaactccccaagtggggaccaacgttgctcaggaaaacgaaacgcttttctctcatttcttgtcctgcgaaaaagcctcgccgccgacccccagcggctcctctccttctcttcgcctgctgttccctttcgtctctctcagctgctgtgggggcggcaattccgactgttgcttctcctctccgcagtggcaaga

SEQ ID NO: 1428 - DNA, 1736 bp, Toxoplasma gondii
acgttcgctccattctcgtgtgactctgcaaggacatgtcgaaaaatgcgcctcgatcgaggtctacgcattttccttttttcagacgccaaatgctttcgtttgaagttctcgcaagaccgaagagggccgtgatccctctcaagcgtcttcctcctctgcgtccactttttcatgcctcctgcgagtcctcctgtccctgacttctgcctcctgggcttcctctctttcctgttctgcatcgcctcgtctctggtgcagagaactttggaggaagggcaaaatgcaaaggaagagacaagaggagaaaaagacagagacgaagagagacacacacagacgaggaggcacccttgttcgccgcttcacatgtcgtttagctacaccttttcaaatggagtgtggggtgagaaagagaggaaaagcagaggaagcggatgcgtttcctcgtttctttgatcctgatgcagagacagaggaaacctgacaatagaaagacagcagcgagagatctgcttgcgtttcgggggtctctttgcgcgagattcactccgatttcttcggaggaccttcgacattgtctccctcgtctacatgctttatgtctagtcgcacggcgaactgccatgcgaaagcagtgaagtcctccgagagaatctcgctctgtctttcacttgatttcgaagaaagatactctctctagtgaccgtggaggctcccatcagttaggcgtgacatcgctgaaagtttctccctctcaaaacgcattaaacaaataggctcgcgtctactttggagcgctggtgagcgtgtgtgccctccttcgcagatcctccctgtcagtgaggttgcatcctgcagtccaccctcatgtgcgtttcgaaacagtgaatcaataaaatcagaaaagccttcgtttgactggtttttctgaaaggcgttgtccctggagattcggtgatgtctgtcgggcgtatcactacgaagcgaggctcggctcttcgaatttccgcgcttgcctgcgcctccaacggaggaggaacggagcaaagttcagggacgttttcacaccatgcagagaagcgcttgattcttcacctttcacccatcctcttgtcgccatttgctttacggatcccccgctttcttcgctaggcaagttgcgtagcaaaacgcactgtcgaggcgacaccccacccgctgtggcgttccgtggcgactgacggcggcgcatgtttctcagtttctcgcggtaaaacaacggaggttcgtctgcctttctcgcagaagaggggatggagagccatcgaagaacagggaactcctcttacactcctggcttccaactctctcgaactccccagtgcggcaccagtcgtctcggggtcaccccgacatatggtttggagagaaaaaccgcgttcgaaggaagaaattcgtctttttcgccggaaaaaagacgcatccttcccccgtttgctcgactccgttttctttccttcttccattctgttcgattctccgcagaaattccgcgcgtctccgcctcgttttttgttctgtgtctgtatatgctcccgcgccctcttgccgcgcatgcgccggatgggcgcgcagcgggtgtctgaatcgacggattctctcgtgtctcccgcgacaacgacgaagtcttttttccggtgttcttccattttgagtctttcctgtttgtccgcgcgatctgactgtcgctttca

SEQ ID NO: 1429 - DNA, 4229 bp, Toxoplasma gondii
tctcgcgacttgcaggcgaagccgctcctcagaagaaacttttgcctgggtgaggtcgtcgtcgccttcttcgtttgtgcgccctgctctctgcgactctgctctcggttccacggaagactggagagactcggcaacttcgtcgacaggagtgacgctcagcaagagagggatgaggagagaagccgagtagacgtgaggggcggcgtttaacgcaaagcccgacagccagctgcagacggaagcgccgtcgtacgagctcaggatttcggatgtcatgacacctgcgggttgctgcggcgcgccttgcgacgaatggcgcggaggactcgcttcccgagagtcaggagggacgggtttcagcttcgcgaacagcaggggaggagcagaggcaaatacgtcgacgcggaggagaaacgaaacaggcacagacgaagaggcgtggttcgaagagtctccttgccaaaaagcgtctccaaatgccgctggctcttgcgcagctcgaagcgccttcgcagccgccagcgcccccaacccgctcaggtatacagacacctcgagggtctgcgccggcgcagagtcgctggttcccggcgtcagagttccttctagaacgacagagtctctgctttttttgaacgcattcgccacttcttccagagagagatacgcttgtgtggaagtcacgactcctgcgggcagcggcgcgggcgcagccgaggcagacacagataaggacaaaatgccggaagcgactcctcgaggccaaccccagcaatcgacagacgccggaggaccagtagcactgcacacagacaacaggagaagagaccacaccagcggaccgcaccgccacaggcgagaagcctcaagggaacccatcgtagaaaaaatgaaaaccctagcgaattcgatagaatgaaaaatgtgggtcaaaagaaagtgctatgcaagagaagtggtttacgtgagcagcagattagaaaaaggttcgagaataaatccttaaggggaaagtttgccggagaactactctggaaaggttgacgcgaacgaggtggcggtgacggcgtatagagtcacacaagttcaggcgtctgtggtgtcaagtccgagaatcccggaaaaagggggctaacacgagaaggccggcgtcaggcggaagcacgcggaaatctctgagttcgtaagaaaagactcttttaagatgtaaacgtcattccacgagtgtctagagagcaggaagaagcaccggagactgatgccgactagcaaggaacgacgacacgcactggctgtttctatcagaccaccactcagattatacaggtagaaaaatcaaggaaatgaggaaaagacgaagtggaacagcacttgccactaagcaatacaccgtagacaaggggaagaacgcggaacgcacgccgagaacagacagctcgccagcacacacgaggtgggccggaaagtgtgaaatgcactgcttctcacaagctgaatgtgaaaaacgtagtcctgggaggaacgcggagaaagttgccaagggaaaagaacaaaaacgacggtacaaagaaagattaacggtggaacgctttaaacgcccgctgtcactcatgaaactccagccagccagtttgccaaggagcaacctcgaagcatcgcggaaaccggaaagccttgcgaaagtgaaatcttcggagtccgtttcatagttgcgactaagaagccgaatcaggaaaaaaagagcaaaagagaacagagatacaactctttggcatgatgaaagactgcgcagtgtcttgttgaggtttacccggcacactttcggcaaaaagcgccgtgtcgatggcgcttgcacactcaaattcgtgacattctcggcgctggttgcagccgcgccggaagacacaacacaaagattgtctgaggaaaaaactaagcgaatctgcggcaggattcggctttgaaaacgaagaagatccgggagaaaatcgtacacgtgctaacagggtcccggcgggttgcgtacaccaggtgcgcgactctagcgtagacatgcagcaggctgctcgacactggaggtaatttggaatctgttttgtcgctagtttttcaacaatccaataaaacgactcgcgagtgtcagaaaggagcgaaactccacacctgcggtgggctttcttcgagcacagtctcgagcttcgagtgtgccacgccccgagcggggaatgcctgtggttcttatcgttcttggggggccagcaaagtcacaggaaaggctcgctgaccgttgacagttttctgttcctctgtcatgtcacctcctcacagatgccaactgcgcgcggtcgtcagaaagatatccggcccttcaaatcctgaaactgaagagccgccgtgtacccagcaaccaaaacgaattcggcgaacagacaaccaagaaaccccccggattcagtgcagctcgacttctgctggctggccaaagggtggaagaccttatgcggccggtggtacctataattgaaatcctttccgatcggatcccatctaatagttgcggtttacattggaacagggtgtcttttctcgatgaaaacgcgggaaatggaacatcgcgataatctaggttccagaatggaagtggtggtgtacaattgcagaagctttctgtattagaaatgatcgaggtgaatgattgcactcaggagcgactgcgtcgacgcctcgagctaggcccggctcacatcagggtgactagtcgattggaagttacgactagatgaatcgaccacggtatatcacaggagactctccgttgtgctagcaagtacaggcagatgcagctgaagagtttgcgtttcagatatcgtgattacgttgtcaaatcccttcctaaaacatcaaatttcgacatttgcgagagttcgcaattcctgatgaacgagtctacaagcaacactcaatggcaactgcaagtcgacccttcagccacaatctgctgatgcagaccggaaagggagccgggggtggtattcgatgtccttctacgagaaacagacccgcttgtccggtttctgtcaaaacacagctcaaaaacccacccagtctgacccttctggcgcgcgactttttcttttagactgctgcaacgatccgaagccgaacctgctcatatcctgcgaagatagtggaaagtatacgagcatctctgctggttctttggacgtccaggtgaacatgacactcggatacgttttaattttaacttactaaagcccacgggagcgaagcaaacagctgcttgtaagcaaatttcctggttagatgcgtaacaactccacatcctttagaaatttcgtcgcggtgccgagttccttgtgtacagccgaaagaaatgtgcttcacattactcgtgaatgagtgcgcgagagcgatgagtctacggatttgtctggcccacaccttctcgacatgagtgcgagaggggccgggcgacccgtccgattccatgaagcatgcttggcgtcttttctgatacagcaggcatcccggtgacccagaccgaatgtgtgccgactcaccgggatttctgcggtgttttactgagtgtgagtcaaaaaagcgtttggtttttcctttcacagcatacgtgatcattgtatccggcgatatgaagttttgaaacccatagatgcgcacgttcgttccgttcgtgtccctgcatctgcttaaagtacgtgcggacgataattatatcaatgaattaccaatttaagctgaagatgcacttcgcgtggctaactcgttagctcgtcgacagggtgtgtagctcaatggtagagcggccgactgcagatcggcaggttcatggttcaattccgtgcgcgcccttctcagacgtttgagaatgggggttctgcgggttaatttgttgtccggtttgccagttacaggatgagcggatgccatacctctgtctcgatcttctggaaagaagcaagctaactcgttagctggtcgacagggtgtgtagctcaatggtagagcggccgactgcagatcggcaggttcatggttcaattccgtgcgcgcccttctcagacgcttgagaatcggacttctgtgggttaatttgttgtctggtttgccagttacaggatgagactgcctcacctctgtcgcggtcttctggaaagaagcaagctaactcgttagctggtcgacag

SEQ ID NO: 1430 - DNA, 2187 bp, Toxoplasma gondii
ttttttcctgtcctcacgctgcttctgcccatgctaattgaagcctcgtgatccagccgtcttcggcctcactacgttttttctcttttttccttccttccactcagctcgacttcgtccgatgccctctgccttcttctccctgcatttctcgtatgctttgtccccttctcctaatctgtgctttcctccctcgtccctctcttctctctctctctccctcgtccctctcctctctccccgaatttgcctgtcgccttcgtagcgcctgcctgccgtctccacccgcggtccgtcgttttctctttgctcaggcctacttggcgatttctgtttttgggcgcgtggggcagtagctgacgtggattttcttcaggtagcgaagaaagtcgatgcgaggaaagatcgcgttcctcattctcgctctccgtcgctagtcttcgttttcgatcccgcggacacaacagacacaggagggaccgtgcgccttgcctctcggcgcggacaaggaaattctctcgctcaacggggttgcgtcgttacgcactgtgaggcaacgcgtaaagagaaattctttcttcgttggccgcatatatccatacagatccttaatgggtgagcgggtattacggctggctgtcgaggctcctagggcgttgcgtggacagagagacacatggcgcaattttcatgtttacttgcacggataacatcaggcaaaaacagacatatgcacacatagtatttggagacctagttactagataaacagtctcgcaagcgtctaactggacgagaaaaagcagacacgaatgcgaaacgaactcgagaaaatcctgcagtggaaagcgaagacgacttggaggcaacgggatgaagggagaggtcctttttgttcagtaaacgccgcaactcacgggacagagaggaaacgaggacgacaagacgcgacacaagggagagagatctctctccgcaggcggcgacgaaacgacgcgtagaaaaaagggagagagcaggagacaaacgaaacaacagagagcagcgaaaaacgcgaagccaacaacagagtcccagggagaggggagaataaagcaagacgaaagctgaggaagaaaactgggtttccttttttcgcagaaaaatcggagtgttcctcttgcatctcgaaaaaagagcgtagaccctaaaaaccgtaaacgcggacaaatcgagcggcaccaagtttgcgtgtggtccagttttcgatgctggcctaccgtttgtctctcgacacccagcgcgacagcagaaggcgtcccgagggtctgtcccgcaaaaaaaaacgcggccaaaactgcggaaaaactgcagatttcgaaagccgctgtctctgcgagcagaaaactggtaaaaactcgaaaaaagaaaggcacccgcagccacggagacagggcgtgaggcgccttgactctgcgctgcatctgcacacctcgcgtctgtttgcatgcttcctgagcttccggaaggcaaatcggaatttttcaagggcggaagagatgcgacacactccagagagaccctcgagttttcaaaaaacttgtttttcctttctctcgcctccccattggcgtagagcgacgatgtggcggcaacacacgcggcactgcgggttcgcgctttgtcgagcgaagaggcgaaattcatcagttcgtctcctgtaacgttttcgcctctcgctgcctttttcctttccaaccgctatctccccactcttttcgtatcgccaggttgttgtcaaaactcgcagtgcttcgcgctcacatgcagagagcagaacctctgtccagccaccacagagactctcgcgtcgtgaacgggtgaggagaaaggcgtcgacggggattccgaaccggtgacctcttcgaatttcctgcgcaagaacgacgaggagcgaagacaaaagcagcgaccgagctgtccggcgtcttctcgccgcggctccagtttggatcttccgacggcgtctctctccagttctgcagaatacctgaaacgaccaagaacatcgaacgactcgcgtttcctcctctttcttggacgtcctgtccctctcgagagaaaagcctgctcgtgatgccgcgtggaaactgttttcagacctttttcttccagggtgtcgtttgcatttccagggaaaggccgcga

SEQ ID NO: 1431 - DNA, 2040 bp, Toxoplasma gondii
gagcttcgcacaggtggtgccttttccatttgttcctgcaacgtggattatgtcgtagtcgtcctggggactgccgagtcctgcagcgactgcccgcatgcgatccgttccgagtttcaccgcgtggtgagaaaaaagttgtttcaagcacgcggtgtatttactgcccaagctggcgggcgtcgccatcctgtggcacagcgcgcgagccttttcggagtgtattgcgaacgtgtctccagttcgccgacgtagaagttgcgaggagaaagggagagtacgacgaggacgagagaggtaagaaggctagaaaaagaacgccacaagaagaaaatggggtgaagtgaatcaggataaacaaggtggcagtcggcagcctaggggaagtccaccgtcctctcgaagtgcattttttcacttctaaccgacggatgcaccctctctcgagctctgaattgttttgccacctggaaaaagagttcttgaagctacatggacgttaacattcgccagacaagaaagtgaatagctctggaccctgaaaaaaacagcggtgaaagcagagactcccctcctccccagttgcaccgtcgccggcgtgcaggacgtcgtgtgctctacgcgctgtcctgtcctcctacccagagacttggacgtcggctttttgctgttgtttataaaaagggcacagacagacaagccgaagcacgtactcgccacgacgagttcggaacagggaactaacggccacctgcatgtgtggatctcaaaaaggcgcctagcagccactcgttgaacaaacaatgccgaagagccacacaaatggaaaacgaaacgaaccacagatcggagtgagaaaaggtcttttcaggaacaaggtccatcccaacagtccgggtgaccgagacgcaacacacagatactggcggttgagcctttccgcggacaagcaggagtgtgaaacagacaagatctcgtggaaacaacgttcagcagctttgccactgctttgtctacctctgaaaagcgcctgaaaacaatcgtcttcacaggtgaacggatctccggaaacccagaaaggtgtcgttgcaaacgctggaccgcatgcacacaaatgtgcgtcaaaaatctcaaacctcaacgagaatcgaagccatttttctctggactttgctgcggggccatcctcacgcaagggaactggcccacacaaacagctccgcttccttttgtttctctgttttcgatttccctatgaagggatgccaatgccgggcatagctattttgcctccaaggagacacgctcgtgcgcaagtccgcagacaggagtgtgtcatagccgctcgcgacagctgaagctcgtggagggaagactttattggcgaaagttttctcttccattcaattcagaagccgcaaacagagagagaaacgcgtatttcaagccttgtcggcagagtcgggtggtcagagagaagcagaaattctaactgatgaccgggcctagtggttgcgcgtagtcacgcgtcgcagcaggggaaggcagagaatctctgtccgtgcctccattcttctttcgagtcttccaattacgaagacggttgaggcgccgtgcttcatgtgtcgattctgttccttctactcaaggctctcgtctgttgaatttcaccttcagggtgccggagggtgctattgtacggtctacagcgtgatagtcctttgtgttgggaaggaataaggtctagaaagctctacgccacctcgcagaccaggcgttcttcgattctacaccacctctctggggcctacagaaagtcaatcaatctatagataaacgaaaaccgggcaactgcagtgtaattcttctggctaagtgaaggctcccggagattgtgcgatcttccgcctgtatctgcctggaaccctaccatccgctggaggcgcgatcaattgactgtgcgtttagcagcttgttttggtatgcaaaccagtctttgaaattcaaagggacagggctccgacttgcggctcagaaaga

SEQ ID NO: 1432 - DNA, 2500 bp, Toxoplasma gondii
catctttctctgtgcacccgcggaagcgttccaggtccggtatctgatcgacggtgctggcgcaacatccagaactgcgccgttcgtcagtcccccaacgtaaaaagaaaagaagcgcagttcccctcttgtgcggcgagacagagcaggttcccgtggatctgaggcatatcaagtggctgcctgcgcgagcggcctggcgctctctgaaacactggagattccatacacaccaggaaggccaacaatctccccaggagctcggtctaaggcgatgcaaaatttgacagacatcgacaggaaccggaactgatagatacagagtagagtgtgcgagtgcaagtggagagtctcaagatgctttccgagtcttgccgcttttccccactgcattctctcttggatcttccaggaaaacgatggatctgcgagagtggagaggcctaaacactttagagaacaacctgtccatgtacttttggcttcgagtgcactgcagacgacgcagacatcgagcacagaacagacgcagaacatcatttaaacgcgtatgaagagacgaagacatacccccggagcactacgcgagtcagtgtccccgcgtcacaactcttccgcgttatcgcttgcagttaaacagaaagtcaaaacgcctgcacgcttgtctgagtcaccattcacagatcacggagagaaagcggagaaagaacagcgaaaaaaattggctttctatgctttgtcgacgtcagcgatcctgcattgaaacgagttaggcggccagacgtgcggtacacgacagaaaacaagaccgaaactactttatttttgaggaacttggcgtccagaagtcgcctgtgtctgttcgttcttactgtctcaagagcgcagccatctcagacgcgtagcgcgtgaaggagactccactcgatctccacatcttttaggcagaaaaagaagagaacgcgagaagagacagaagtagaagaaaagtggaaattgcacgacagtccagagctctggcaggccaccacaggtgagaagtcaactgtgcagaaaccagatctctcgcttctgcttgagacacgggagacacggaggcggcagcttcctggggagctgacaatcaggggtggtctggagaaggcaaagcaaagattcgctcggaacagcagcgcgatgtggaacagttccaagcccttgaaaaagcgacaaaaccaccgtcaaaatggcatcgtacgtgtgggcccgtggtctctgagaaactgaactcggccagcaaggacgggtcggagaaatctgtgctctagaaacgaaatgcagcaaaccagaggagagggatcaacggcaacagagatccccacgcaaagtcgcaacgttaaagcaaattcgcgtgactcgagtgtcgcgcatatacgcgaacattactgtacgtccaaggacgtggacgcggactgtccttgtcttgggtgtgtgtccgaaatcaccgcgtttcttccggatttcacaatggatgaatcgagcattcgtctcatgagaatttacctcagtactccggccgctttccatctttccggccgtgcacacgccgagacaacaacagctgctttctcgatttgaaacgccgggtggtggcgcaagcatgcggataaaagacgaagaaaagtcacctctcggcttcgtttttcagtggcgcgcgttttcactgcatttgcaggaaacagcaagaccttttcgtcagtcgttttgacaaacagcttgttgcccccggggacttttctttccacgttgatcttgaagatgcaacactctaggacgccaagagtccttgcatgcgtctagagagggactgaattcagggcgaccgattgaatcaggcggttgttttccagttttcttgggaaagccgagacgcgtgaaagtatcttagagactttccattgcttgaagaactcctctgtcgtctttgacagttcagaagggcacaccgcttcacttctcgacctccgtgacggttccgccgcggccgccccgtcttcgtgcttggtttcctgatctttttgctccggttttctccgttcctccgtatagacgccacattttgtctaactctttgtttgctcgatttccacttgcgtcttctcccgagctcctttcgtctcttctcgttcctctcaaccggtttctcaaaacgcgcttcccacgggtcttcgaaacgttggcttcctactcgctcaacacctttctgtcgtctacaaatccctcgtttctgcacttgcttttctaatctcgagtagttgttgtctcatctcccctcttctgcgtagaaagaaaaggctgaagctgcaggaagcgccttttctcactcgtcggttcgtttttttcaagtccgagactgaagaggaaggaggacgagacgaaaaagctctgtgatccgacgcgaggtctcgggggacttgcgttcagaatctttcctggagtgttcgttacagcggagaaaaga

SEQ ID NO: 1433 - DNA, 1862 bp, Toxoplasma gondii
gaggaatgcctctccgtaagtgcagatacgcttgtacaaaaatctacgtttatagatgccgatatcatctaatgtagatctctctttatatatatatatatatatgtccatgtatgtgcaaacgtatacatatgtatatatgtacacttgtatatatagagattcatatgaatatctgtttggatcatcagctcgtatatgttctgtttgtccgaagccgctttttcatgtgcaaggacactggggaaaggattgaaacgcaggaggagagtctcgacagatgcgtcgacttggtttttccgtttctccgcgaaagcagagaaggacacaaagttctcagcttgctcgagcaatctttgaatctgcatgaggacgcaagtctcttgttggcattcgttctagctggcaaaggagcatttcgaatgtcagacgagcgagaggctttgtgccacagccatgagccaagcgaaagagacgcaaagtcgcagcgggagtcgacagcgatttgctcgaaaaacagaaattcgagagaggacgcattctcgactgtgaaacccaggactcacctgtaactgtgttgacaagcgccgctggctacatagaaaaaagcatttacattaaagtaggataaaccatcttcaaccgcgtcgatgtcttttaggtggtgggaaactttgatgtatctctttcttttcatgcgctcccgtaccagcgtatccatatatatatatatatatatatttatatttacacatatttatatgtcgacaggattagagggatccagatagaaatagatggatttatagatagctagacatagatagataaatggatagatgcgtaaaaaggtagatagatcgacacagatatggatctagatatcgatgcagatgtagattttacagataaatatatagataagatgttgagagatctatggtggtatttgaggagaagtatgtgggttgaaagatttatttttcctgtgcagaatgaggcatttgcggtgaaagagggaagagcggattcggtgtgtctcggagtcgagtaaagaggcgacatgagagagatgagagtgggcatgcagatagatgcttgtgttgcatgcggaacttcactttcgtcgcgtttcttctcctctttgacacacacacactttccccccgttctacccctttctcccgcattttggagacggtctcgatgaaattgaaaaggcggagaagcgagagagtagcagacacagaagcacaggcaacggcccaccaagggcaggaggagcagccacaaggacgcaaaaaaggaagaagatcgaaaagcagaggagaggaagagagaaagagaagaaagaaaggaaagacatttctctccgtgcaccctcgagtgtctttcttgttgtgtctaaaaaaaagagaacggaggttggaagccgtcagagataattcttttttcgacagacggggagtgcctcgtttcttgtgtgtgtgtttgttcgcttccacttttcgctctccctgtggtctggttccgcagaagtcttctgttgctcctctgcgaatctcgtcttctctctctttcctctgaatcttcacttcttccttcctcagaccttctcttcttcctccttcaaatgctctcctctgtctctgcccctctgttcttccccccaaattactgcgtccttctctcctaactcctgtctttccgactggctttccgtcgcctctcagcgcgcgttctgctcctccctcgcgtcttctctcgcgtcttctcttgcgccttctgagggtggaggaatctgtcttgctttcgcagagaactccttcggcgtcgatgctcgccggagtgaagctgctgga

SEQ ID NO: 1434 - DNA, 2240 bp, Toxoplasma gondii
accacaccactggattgcttgatgactaaaagtgtaaataggtaagacggtgtctttttgctccggtaggctaaccactgcttacaatcaacaaatctgaaaagtgtgtattaaaccttaagaggacatctttcttttaccatagtatcgtgtagtgatatgttcgtgctgcagagaagaaaccagcgctgacaccatgacgacgtgtgagccgcagcgctggtttcttctctgcagcacgaacatatcactacacgatactatggtaaaagaaagacgtcctcttaaggtttaatacacacttttcagatttgttgattgtaagcagtggttagcctaccggagcaaaaagacaccgtcctacctaacagggaggaaagggcacctatgacgtctgtttccgcagtggtatcagcaaactaatttacagggttgggcatggcagatagaaggcgctgatcctagcggagagtcaacacaccttaactcagtttcgtccaactcgacacgcacatgcgatagtgtccaaagcaggagatggcgcctgttagacgtgtacatttccagtgctccgggaaaggtctcacctggttgtcgtgccctaatcccacattccacagttgctgtcgtgtcacacttcagtcataacgactgtcgtacgacacacctgtatctggcggcatcctctgcatcgcgatcagcctctgagttgaatacccccgggttaccggacattagagtcgatttccaggcacaatcggcacttggcttgagcaagggtgggtatgcaaagcctcttgtccgtactgaaagattcggcattcctgataccggccttcagattcacaaggtaagccaaaagaatgatacacacggtagcgtaatattgacagtttcgtgctgtgtaaaattcccaaaaactcatccccctcttccccccccgttggcacatacactggctgatgcatgcgtcccagaccgcgcacctgtgccacgtcacaccacacgtgagatggagaaaaaagcgagatggaatactgacgggtggcagaacaccctgcagaacagaatccgtcacttacacctcccggagaaggccctttttacagagtaaacacttttgtcgctgaggggaaaaagcgatagacaacgcccacgagcgcacccggcgcaagcgatgctgatggttcggccaagccaaaggaaaccaccacatgcctgcagtagatctccaggggaggctcgccgcacgtctgacagcggctaaccattttcccacaagagcaaaataaaattcacgcgaatcgccctcagcggaagttgccgttgattgacgcgcttcacgctcaggcgtgctgaaacttacgttttgcttgctttgtttatgtcctcccgcaaggaaaggatcgttgataattccgtacaaagcccggaaggcagcgaccgccgcgtggctgccgtcgctattgcaaaacagcgaacagcataggagaccgcgggagctggtggctgccgtgccagcttttttcacgtggagtagggaaagagtactcgacttcttcccttccgcgtaacgatttatgcgtcctttttgaatgactgttttcttttcttctcaccaccctgcgttttggaggtgagtattgccacttttcctgtgtttttcccatatcgtttgcatcaccttctctcccgtgactatcgtcgtccacttcgactttcacagtgcaattgccaagtcttcttttcttttcggatagctcttttttgcgtcatggacacaactgtcactggccgtgcctcaccgctgcagttcgtgtgccgcgaggcctctctcgtggagaacgggaacctgtcagtgtagttctctgttcccgagggatggtgtgaagtcttcaccaggatcctttccacattgttcgtactgttgtctcttccgcttcggttattcttggctgcttggtctcttgcctcatagactggggcgcttctgttaccatgcagcccggctctctggtcgagggcaattcgcgccggtctctttaggcaggccgatcgctatcgatcatatgtcttttgaggagatacaggggtatcctcgattgttttcagccgccgttctctctggcttgtgtggcggcggcttcagctgtctgtatcagctgaaagtctgttgggacactgagacaggccaccgtggagcaaggacatatatactgcaattttagggtttgacaaga

SEQ ID NO: 1435 - DNA, 3800 bp, Toxoplasma gondii
ggagagaacgtttgcaagtctggacgacgcggacaagacaacatcccgcgagaaggaagcggagggagaagacacaggtgcagtgtcgctgcctggggggcgcatgtggcagcagcagacaaggagccaagccgctgtgtctcccgatctctcctgtcccctcccgcgaccgcgtctccgtgagcgccggacggcggggcctgattcggtggccaagtagacgccgtggcggggtgatcacggaggcggtcgagagtgacacttgcgcggtagcccaaatcttctatttggcggcgaatctcctcgactgtcacagtaggtgacgggaacgaagggtcgcacgacgctcgatattcaaccgtcgctgagtctaggatcagattgacggtgatcgacgtcacaccaggcagcttctgaacgtgtttttcgatgtgtctcgcgcaagacgcgcaggacatccctggaaaaagaaaaaaggtctcacagactcgttcgcatgcaaacgaccctcaatcacaccgctcgtcaagggaaacatgtgccacagtttcatctcggtcggggcagaggaatcggttgaacacgtttagtggtgaatcctaaagtattgagctggcggttcgattcaaaatccacggcacactgctttagctggagagacggacgccgatgtgagctgcgtggaccgcgtaccccgggacggggaagcacgcagaaagcgacgcccattcctcgtcagttcacacgaacacgatcggacgggaagcccgaacggagctaaacatgctctcgagaagctgcagctgacctagccgccttcaagaacggacctacagacgcatttacagcagcacattcatgctggcgtgtgcgcacctacacacatttatttttttctagatgtaaaggcttcgtgtctcagctgcgaatgaaaaataactggagggcatgcagacgcggcatcgaggagcaaaccgcggtgaagtcgaaccagctagcaaggatggagtcactttgcctctgatcctcggagtgcagcggcacctccattcagctttgtgctcccttgttactgaagacgattcggacaggaacgactggtcacgatcagcaggagtacctgagctgagttgaaaacgtctggtgacaggtttgtctcaccttcgacctggagttcggcatagtggagctgcgccgtggaacgcgcttcttggcctccgtacgtggcatctgcgccgcgctgcactggcatggccgtctcgtccgctgcggcgcaagacgagggagaggccgaaacatccgccgacgtcgcagacgacgaagagttgttggttggggcagcttcgttcacgagcgacacgtctagtccgagactttcgatcacggcggcaatctgcgcttgcgttacgataccgcgctgaaagggaagagacaaaaaggaagggaaacggcgagtgacaccagaaagaacatgcgagaagcaacgaatacgcgtcatacgagacatcgagaagaaaggcacggggagagacacacgcaaataagaggcatcaaccggaaacaaaaaagagagacaacacacccagtgtgccacggttttcagagaccgtaccacttgctcgtggttgccagggcgtctaggcaggaatgcatgttgggagtggcaaatcgaagagacaaagcgcgtccacagcaccttacagatgcgttcgcatacacgtatacatattgatttatttctacagctgtctttaccctgctgcacatcgttgcacggtaatgatacgccggtgtctgtgcgactgtccctacgaatataaatatgcagagccgaagtttctttcgggtgctgggacatttgacgttcagctttcaatgccttactgcagcagagggtcttcgacagcaggcacccgaagtggaaactttgacgcgtcccgcccgaacatcgacatcaacggcgagaatctcggacgtgaaggtttgtttcactttgctttcgatattcctggcgcaattcccgcaccgcattcctcctactctgaattcccatacgttgaagggaggagactggggactagatgcggcggggaaagggacacacgcagaagtcgagggttctcctgtcgggggctcatccatttttatttgttccggagaacgaggtacggggacaagctgaaactaccgagactgcggcatgaaaatcggtttcttgaagcttcggagtgcggaattttctggagtgagatgaaattcatgggggaggacaagcagttgacgacaagagtctctacttggaaactttgctagacaggaacagcaggcaactcaacttcgcgcacacagcgacgcgaagttgagcttcagtagcgcgcggagacgggatgtaggcgtccaaccccaacacaagggggttttagatgcaccgtgttcagttcgcacgtaggcgtttcatccatcaccgcgtgtctgaattgccaaaaactggtgactctggaaggtgtcttgtctaactgagttcctcttgtcttacacccttcctgcgggtgatccgaccccagcagttgtgcccccctccttcaccgctgtcgtgtagggaggccgatagagtttcagggcgcacaaagaaagcgacgtgccaaatgaaggtctaggtgccacacatattgtgacactcgacgttttcaatctcgtgttgaggctccgcgcaactggaagggttaattgcataagagctcgcttcagatcttgggcttgggcatggcgaaaagcaaatgagcaagcaggccgcggcctatgtatgccctcgccacgaacgattcgttcgccgtcgattcctcgacctggtcggttgtggagaaagactctgagctttccagcacctttcccggtgaagggagacaccggctccctggcgagtcaacatctacgccgcggtgtcggctcaacaccacaagcacggtaccacaggagacggcgaagcgccgggaaggtccccagtcacccacgatgtgtcctggcgtagcggtgctagcagcgggcaaccacggagtcaccaggggtagcgtgtctctctcagccgctctctctcggtgtggctgcggagcaaaggtggggaaaaggcaggtttttcgtcttcatctttctggattatgtgcgatgtatcagcgagaaatgggcaacttgacaggtggcggccttcttggtgctgaaaggaggcggacgcctgacagttctttctcggccatgcggtgctcttcgcagtgctacgtgcgagatgaattcaacgcacgagacatttcgcacactcaaacagcctgctcaccattcaaaggagctgaaagaggctttaagggacccccataagagaggtagctgcgctcaggtggcttgcgcaggagctcgagcgaaagggcaaacaggccgctgccggggttagcgagcgtcgattgccacagcgcgatgcgcaagatggtggcgagctaattatgctggcaacgagaccctcaactacaagtacttcatttccgtttgcttcttgtcatctccctttgctgaagttgctttccatcaagattttcccccaactactcgttccgagattctgcttcgcgtaagttcccgtgcgataacgacgaggtctgtacgtaaccgagagccaaggtagcggtgtcgcgaaatactgctgagccggctgaacaggaagatcaccaggaaagagcaaatcgcccggctacaaagatcggcgacgccgctttggctctttctaatttcttcagcaatttctcccggagcaa

SEQ ID NO: 1436 - DNA, 2817 bp, Toxoplasma gondii
ccaccttcaccatctcggtgagtcaggttgcggtcgttctggcgaggtgtcagcgctagaagcactgggatgaaacgtagaggaaataatgaactctcacgttctcactaaagaaacacaatcagacagtgatacataaggtaattaaggcccccactcagctttgtaaatccctctgtctattgtgctatttgaaagcatgcatgtagtcccatcgataaacgcatggctacgtagatccgacagggtcactgttgcttacaggcaagcagggaaacaccttcaccaaaacagctgttttagtcatttgactgcacagagaagtcaacgggcacacgcaactgggtggatgaatcaaagataaaagtcacttggtgcaacgaccgggttcgaagatatttccgtatagatatggtgttaaaataactacgactccagttgtatcgtcttcaagtgtttgtttagtagctggtttgccaactaccttgtttcgacatcataccaaccttatgctgaactgttgcagaagagggcacagcaaaataacgcgttcaacataccgtgataggtggagcgttcagacgcgagtctcacctgtttagctatccttttcggtgtcaatctacagcgaccacaaatagtccggactacgaaatgcttcatcacagaatccatgttgctgtggtggttttcacgcgtatcatgcccgtgttgttgtccactctcccgcgtgatcatttcagtggcgtacgtgcacagtagttcatgtgaaggcaactgcagtggcgggccccgttgaaacgatattctggcgtatttgctgttttgcgggaaaggatgttgcagtttacaggttgtctatgctacgacattttttgtacctagtattgccgcggatctaggcttaacgagcggaattttctcggcaagcgacgaaggcagaaaactaccgtaactgagcctcagatacacaaaccttctactggaactctttcccctcgttcagaagcttcgttactgcagagaaactatccctctgctgcaagacattcctcattctgcgcagtgcatgcccttactacagacaagatgttcaactacagattcactgctggtaattgcccaacctttccggctagatatccttgtaccgactaacatgtctggtgaaacccatcttgtgtagataaaacttcaaatatgcattctttatgttgagctgatcaagtgcatctctctgggacccacggcaccgccactctatcgcgtcgccagacaatgtacggagttgcagcttccgcaccacgattttccgaggatgcaaatcggggccaccttacatcttgctcgggcgatgttgaaagcatgagtggaagcttatggagatacaataaatatcagacagaataatgggggacacagcgaatgacttgcaatccttcacgcatgagggttctgcctggtttgaaggcaatgaatgcggcaacgccagcagcgacgcgcggccccatacatgacagacatagcaagtttttagacgagagcacttgagttcttcaggaccaacagtgaatccccgtaattttttaaacatacttcatgattctgaagggagctggtgaaaaagccggtcgcaggtgacccagttttcccaaccctgaggcagattcgcggttccccatgttcgaagcgtccagctagcatggtaaagcggctgttatgtcttgctgtctagcggtgcgaccctgttgagtcaaatggtgaatttgcttgtctctgactgcttttggcgagcaccactggattgggacccgaggcaggtagttcacgagaaattcctgtgctatcttgtttggcttcccaggaatgctggtcgttttcagacctttcctgggttctcgtcagtaacggcagcgtcattgctggcttcgggccaaaaccaaagcgtgcaaggccgcaggttgtccgcctctttgagccttagctcctatcaactcttgaagcgttttatcgaagctgaatatattttatttctcacggtcttacccatcactcggttctccgttgatacgtttacagcggatctgtgggacggtggataaggtgcaagtcaggtttttgtccgatatctttcgctgtgtcgcctacgatcttgaagcgatgcgcttcaaatgaggacatcttctcctgtaaatgtatttccggcccagtcagttttttgatggtatggatccaagaatcggtgaaggcccggcaaagtaggcagctcgcttttttccgtcggagtggtccttgcaaactgctctgccagtcagacgcctttcagaacgtaactcgttcatggcattttcaacgcccttgacggcatgtcctggctcattcagaagaaccaggtgatttgaggactcaggaacgcctatttttcaattgtatgtatcgacttccctctgcaatttcaccactcgccccatttttgccacgtcgcttgggtcatgctcgacctgttcaaggacccacgagtttcattctgtgttttgttgagtctgtttgcaccacgtcagtctgtctttgtcgctgttgcaattccggtgtcgttttcttagtgcttttctccggtttgtaacgattcgcggaaatcggtggaggcttgcggggtcttgtactgtcggatctgacgtagtcctgctcgatcagatctccgatatccaggatactatcgaatttcatcacgtctacccctcaacctgcgtatcacgaaacgaccgtaagaaattggcttgaacatcgtagcggccatttgaaggcctattttcgcaa

SEQ ID NO: 1437 - DNA, 2454 bp, Toxoplasma gondii
tgatcgagacatggcagaagagcgctgaactctgtgtttcctcgttcccggaactcctttgcctttcgcctccatcaattgtctgcaagtcgacggatcctttgagaaagacgttgccgcttcgattttcttcatgtcgtgtgagcgttttctcttgcaagtcgcagcgcttcgaactgcaagtacgggcgaggtgtggggagttcgctctcgaggagctgctcccggcgcagagcctcgcatgctgaagataacggaaaggaaggcctgctcggactctctgcattcgcctttgcgcgccggaaagaggatctcgcctcgaaagcctctcctttttctccttgtcgcccccctgccagatgtgagggaagctgtggagagctgcgggcgtcgactccacactgcgtgccttcgcgcagagaaaccgttgtgagggaacgctctgcgagagactcgcgagttcagaaggcgtcagggagaagaaacgcatgccgctcagacggcaagctcacacgcgaccccacacacgctccgcgaagccggagaggagacggggctacggaaaagaagagaaacagcgacagagagaggggggacgagcggcaaaaacgacaggtaaggggagaaaaaagctcggcagaggcagagccagaggagacaagggagagcgaagggaaaagagagaaaaaactcggaaaggcgctttgcggtcacagccgagagagaagaagccagccctctccagtgttcgacttttgccgtcggcacagcagttcgcggagacatgctcggacgcctgtacgctcaggcggaacacaggaaatgcgtttcgccgagcatggaccccaccctctgggagccgcttgcgagagagagaagctcgggagaaagggcaagagtggggacggatccccgagcgagggcaaggcctgacaacgcgaggcaggcggtccggacgggagagctcggaagcctcactgggcgtcttgccatcgcgactcgaacctgaactcttcctcctcgttggaagctgacgacgaagagcgaccgaatcagttaaaggcctccgcgtctctcgaggcgacaaacggcggcggtcgccgcgccggaagagacggagacgggcggcttttctcgctcgctgagtgtctgctgaagagagtctccttttcgtggaaatcgttgaagtttcttctcacgcggtgccgccgcggttcgtctcctctctttcttttcctcgaccctctgcgcatttcgagaagcctgtaacggccgaaaagcctgcgctaaatcggggaactgccggcgctttggacacacacaagagagacggcacagctagcccctgcatgcaagcgagtgcacacggcgccaccagcgccgcagggaatcgctgaaaagggcggaaaaaaggaaaggcctgtagaactttgaaatgccaggtcgtcttcgctgcgagtcgaatctcatgcagcgggagagaaagggagaaatagggagaagaagggagaaaaccggaggcggcagaaccgtgagagggagacaggcgcgtcggtcgcaaaaagcaaccccccgctgtgtttcacacgcgcgtctgtgtctttcttcgcgttttttttcctctgggcagtgcatgtccctttcaaacctgcgcgcgcggtggttcccgttttcttcgctctcgttggatgccagcgcctgcgaccgcgttcttcttctctgaatgcacgcgagagccgaagatttccagcgacgacctggcgaggccagaaatcgacgacacacacgagcggcggccctgttttggaaactgaagaagagtctggagagaagcagacgcaggtcggcgcggaccagcttccctgctgaagatcgccggacctcgaatccgcggggaaatgctgttcaagttcctgacacccgtctgcacacccatgcggagttgaagacccgtttctccgcagtgtcgagttgaccttgtcttgcatcttcgcgtcgacgtctcttcgttggcaacgagatccggcacatgcatatttgtagccgactctgtgtgcgtctgcatatgcgcatgctctgcttcctgtgtacacttgtacttccgcatgtttatgcgcagacacaaagacgctgttttattttcaccgcgatacgtctcgacttctccacgcagaccgctgaggctggacatgtccatcatgtcatcagaaagcgcttgaatcgacaagcaagccgtctacaaaaatcggatttcctttcgccgaactcgttgccattctcctttgccaacaacagcatctcttcgtcttccctcttctcccctcttctcccctcttctccccttttcttccctctgcttccctctgcttccctctcgccttttttcgcctcagatcgaggcagtgcatgcttcttgagagcggaggaaggcgcgcctgctgaggcgttcgtgga

SEQ ID NO: 1438 - DNA, 1248 bp, Toxoplasma gondii
ttttttcctgtcctcacgctgcttctgcccatgctaattgaagcctcgtgatccagccgtcttcggcctcactacgttttttctcttttttccttccttccactcagctcgacttcgtccgatgccctctgccttcttctccctgcatttctcgtatgctttgtccccttctcctaatctgtgctttcctccctcgtccctctcttctctctctctctccctcgtccctctcctctctccccgaatttgcctgtcgccttcgtagcgcctgcctgccgtctccacccgcggtccgtcgttttctctttgctcaggcctacttggcgatttctgtttttgggcgcgtggggcagtagctgacgtggattttcttcaggtagcgaagaaagtcgatgcgaggaaagatcgcgttcctcattctcgctctccgtcgctagtcttcgttttcgatcccgcggacacaacagacacaggagggaccgtgcgccttgcctctcggcgcggacaaggaaattctctcgctcaacggggttgcgtcgttacgcactgtgaggcaacgcgtaaagagaaattctttcttcgttggccgcatatatccatacagatccttaatgggtgagcgggtattacggctggctgtcgaggctcctagggcgttgcgtggacagagagacacatggcgcaattttcatgtttacttgcacggataacatcaggcaaaaacagacatatgcacacatagtatttggagacctagttactagataaacagtctcgcaagcgtctaactggacgagaaaaagcagacacgaatgcgaaacgaactcgagaaaatcctgcagtggaaagcgaagacgacttggaggcaacgggatgaagggagaggtcctttttgttcagtaaacgccgcaactcacgggacagagaggaaacgaggacgacaagacgcgacacaagggagagagatctctctccgcaggcggcgacgaaacgacgcgtagaaaaaagggagagagcaggagacaaacgaaacaacagagagcagcgaaaaacgcgaagccaacaacagagtcccagggagaggggagaataaagcaagacgaaagctgaggaagaaaactgggtttccttttttcgcagaaaaatcggagtgttcctcttgcatctcgaaaaaagagcgtagaccctaaaaaccgtaaacgcggacaaatcgagcggcaccaagtttgcgtgtggtccagttttcga

SEQ ID NO: 1439 - DNA, 2591 bp, Toxoplasma gondii
cggagacacgatcattaaggccatctttcgccacgtgactacagtttataaccgcttctaggctttgtctccgtggctatgtttctctgaaaagagggaggttcgacctgtaagctacagaagaaccagaatttgtacaaggccgcttctaaaatatacagttgttgctccatctgctacgacgggggtgttgcactgcatagtagtcccagttgctcaactttccggttttttcattctgcgcgggtggccaccacgtcagaacatcattcgtggagcttggtctcgccgacagatcatctgtcagactttttgcttaatgaggttagtttgttcggtttgtcagagactcctttatgtgtaactgccattcctacaacatgcgttttgatgctgcagagatacaaaacgggtatagtggttgcctactccattcaatcgttaatgcgcctcgccgctaattgccacgagcaagaggcaacagccgagctgctctgtggctctcgcgccaggtgcacgtacgccgcatggtcactgattgataccagcatagcagttggttgcagttattcggaagcttttcgttttctgcgggccaggcaggacataccaagaatctgggagtgccttacgatgactacagagaaccaagctcagtaatgccctgaagcgtttcacctggggatcccccgtctcggtcttctgaacaacaggtctcctagaagcattccgtcacaagtgctcgtgtacaccagtcgtatttgggattggcatttcggagaagcggccactcttccttccccgtgcagtgcagcgtgcaccttcgaccgagacagacatggttagactcacagcgaaaaattgcgtaggttctcagcttggtgtttctttcgcacattctcccctcctccccgtcctccatatgtggcaatttgccgacacacggtcttccattaaagccagtaactaccgggtggcaccattatcttgaatcaggaatgagtggagtcttgccacatttgaacacgagagataaagcgtcgccaataataaacaggtagcccagaacacattttgtacagcggtagttgtacaactggtgcaggggtgcgtgtttgctaataaacctgtcacagcaaggtgaggagcggcggctgagaagtggaggagctgacaaggttgcaaattggtcctggaacatcaccagtagtcaacagaaacaaacgatggtttgggttcactgcagtaagtgggtgcgaacagcgaaaaaatatacgcaaaagcctcctaataaacacgagaataagacgttcatttattgacttcctgtctcgtatgcacacggattttcctgtgctggcgtgtatggcgcctccgtgtgaaaccccacaacggcacccctggcatattcctcctctaccaatgtatccgtcttcgttagaactcgcgtactgccggtgtacttcatcctggcagagtctatccttgagatactgcggaacggtttttcaggtatgataaaaggtactttatttccttgtcaactcagtgctcgagtgctaccgcggctcaagtcgactgtacccagaaaaacagccgaagcgagctggcttctctctagctagcgcagcttcaggccactttcagagaacttcttggtcattccttctcatactggagaacctcccttctacttgcctctgttgcagctttctttctttgactgcggtcaaaactcttacgtaaacccccctcccgctcttcaagctgcgaagcggccttcggatgcgggcactctgcagagacaagagcaaacaaccgtgtcctaacggggtacggggttccccatgtcactgaacaactttgcaatgagatctttgctgtttttttccgaggagacatgcctctctgtgcatgcttctttcgtcacgaagtggtcaacgaaattttttctgccgagacaaagcagtgggctaggctgccatcctgccacgcgccgggtggtcaggggacgcctttgtccgtcaaacttctgttgcttccatttttcatcttctcctccacaaggaggtcaactatcttccttcacaagtagttgtatattaatgaatcttggcacattcgaataaactgtcgcgaaacttatgggcgacgacggtctgggtgtcaaaatcgaccacctgggcagactaactcgaagtgaatcacatttcatgaccgctctacgccatcaaccaccgtcatgaacaaccgcgtaaatttgtagagcgtgcgcatgaacacagcggatgaatcagcaaatcaaactcacaggttctacgtttacctctgttccggttctcgcgtcaccctgcgggatgcgtcttaaccgattctatgccttgctgtcagcgcggtggtcacacgacagtacagtggccatctttgaatgacacagtagtccttgctctgtacatttttcggaccgtctgttgctccttggcgagacatctctgttggctgctggggcacagcggtccgctgccgctgctgtaagagcctgtggcaaggcggcttaaattgtactctgtgagaaagcgtagtcgtcacta

SEQ ID NO: 1440 - DNA, 2457 bp, Toxoplasma gondii
ttccgcagacgacgagctggtcgacagcgagatcttcttctccctctgggcttccagtctcaggcgactcgagctcaaagactcgccactgaacgggcctcgccccttcacccacacgggcctcggcttccgccgcaagcctctcgttcgcgtggagaggccggtagttcgcgtgggatctctgttgcgtcgccgtatactcggagagaggcgggagaacgcgcgcgaagaccctgagctcgcagtctgcaggcgcggggtcggactggccctcgaagtcgacgttcgggtgtatcctctctccaaggccgaggaagaggacatggcggagcacgacaggacttctggggaactcaaccacgtccactaagccgacttcccccgcggctttttccggcgagtgaacgaggtgatggaatccaaggacaacggggacgggatccagcgccgggcgcccgacggctcggcgactctcagccacctgagcattctgcaactgaagcaactcgaggacagggtggacgactgggctcgctgacgacggccccacggcgccctgaagcggcgcagagcccgtcagagggcccccgacacctgcggctccaacagcatgcgcatgcagcaagtggcgggagcccttggctgcggcgaccggccccgcgtgctggcccgcgtagagaggagacgcgtacgcggggaggaaggcccccgagccggggaggccggcagctgcagcgggtggagcgacgccgcggagcgcagagtgggcttgagaggagagcgacgcagtagacgaggcggcagagggcgcgagggcctgcgaagccgctgcggcatgcgagacgccgttgtggcgagacggcggcggcagaaagggcacactggtggagctcaagccggcggcgcccgccaggcccaaggatcccgaggacagagacccggccaagcccggcgccgcattttgcgctttcgtgctgcgggggtggggctgcagcattgaagagcaggcagcagagacacgagggagaggtggaggagcgaaggccctcagagcctcacagggtccagggcagttctggagggcgccgcgggagaacgagggcgggggagttggagaggtcgcactcgagacagccgacgaccaagcagagtgtccacgggccagctgcgagaagagtgggcggcggtgcggggcgaaagggagaaaaaggacggatgagccagacagttcggcggaaaggagaaagtgaaaagacggagaggacgagaaagtgcaaggaaaggcgaagaaaaagaagagggacgcacgggcagacgctttggagagagggaagagaggcgaagctgcaggcagagagagaggaggaaattcgacagcagggagcgcccagctccagggaggacggaggaagagagacggagaaaagaagacaaggaaaagaggaaccaggcagaagaacagcgagaccctacttgtgttcttcttctttcgaagtagcagacccgttgccgacgcacagagggcgagaccgagcggcgagattgagacggcgaaaaagagatttcgtccgcagacagcagccagcggatcgacgaagaaagacctcgagaagcgagagaaaatttgccacaagggaagaggaggcacgaagagagaagaagggagtaaactggaaattcagtctcgcgcatgcacctcggcgtgacgacagcgagagaacaccgagcgctggtcccgggaaaaaacgccccacgcgtggtgttctcgttcttctctgaatcttcttctttcgcgagctggaaagcgaacctgttctgtctttccctgcctttcgtctgttttgtttcccctggccgttgcaaggcaaaaaaacagagagaaacgcgagtcgagatcccccgcgctcgccagagaaccgaacctcgagcctcttctcggcctctctctccagccagccagacggtctccgagcccgtccagtgtacctcgactcatcccggtgtacgtacacctcagtttcatcagctgttgttgacggggctggtgcgtcgaatggtttgcacaccgggaagggagcaggctcgccgacgagagggctgaagttcgtgtcttcatccgccgtggcgttcttgtctctcttcccgaatttccagtgacgaagcgaagccgcaggaggcttcttccggtgaggccattcgtcgttgctcgggactcgtggaaggctggattctctgcctctttgcgctctcgcctcctcctgcgccggaagaagctccgagtctttttctctccgcaaacgcctctcgcctcctctgctcacacccgtaccccctcacgccgatccgggtgtccgtacacctcgcgcaacacgcaggcgtctctattcacgacgtcgcttcagtctgtctgtgagacgggtgtgccgccaactcgtttcctctaagaaactcgagcca

SEQ ID NO: 1441 - DNA, 2281 bp, Toxoplasma gondii
caaaacaaccacgcccggtctttggctaacgtctagagtgtctagactccagcgatgaggcgtacagatcttctggcaagatggggaaaacaacgaggggcctctctctgccaaacgaggggagcaactcgttgaagggtacggacgaatagcggggcctcccggattcgaaagtgactccactgcacccggtggggggcgcaggtgagcagctgcgggaggagcatagagaggagaacggaggggcgaagagaagagaaaggggaaagggaggacaggacatgaagccgacgaacggagacaggacgcctcctttgttttggtggagacaggagaacaaacggcgcgtggagactctgaagagccactggaggtgtggcgcaaggatgcggactgaacggggagggaaggcgagtgagaagaagagaggctgtgcttctgcactcgagccgggtttcctgactgtcttcctttctccttagcatgcaacgaagaggaagagacagatgccaaaagtggatgacctgatgacccaccactgggacggcccgacaatgaggctcccctccgtcgtcccgtggtagaagtcgatgttgaaacagaaatgctagaggacaaaatcgttcgctttttgcagttgacactcttgttcgtgttcctgccttctttccgttttgatgaaggaagggcgggagttcgagtaacatcctcgcggtttaattcgccgccttccccactcctttcacctgagagagatgaaataccatcgtgggggtcccctaaggtcctcattgtcattctcgttttcgataaactttttcggttttgcggcggagcctaggttctcttcctcagagcctgtgccctcgcatctgaagcagaggccccgctgtgattcaaattgcctgcacagcgaccagaagcctgtgaatgaaaattttctctcgggcgtctacgtagctcccgcagcctcctcgcctttgaaaatcttttagcgtttatagttcgtgcacagccccatagaaacgtttctgactgatcttaggagaacttgggatataggaaagagaacaacctagggcctgctacactttgatagcattacatctttttgagttagcttctgtctatttgcatctgtatctacagtatatcaatctcgcattttcttcagaggtggaaatgaccgggttcaagcgctgcagaaacctaacaaaacgggcaaaagcttctccccagtctatgaacgctgcacctgaactcatgttccggccgccagcttccaatgtgctctctacgcggtggctgagacatcgtgtggatcgcctaaaccaagatctcagctctacctcctctgcagctcttcaaaacggcgatatgaagagaacaaaaatcactcatcacaaagataggcaaattcatcgtcagtcagcttgcaagccagcacactcagcttttcctggaggaatgttttcttccagaaagggattatggttcaaaagagataccgggaagaaaccgagatgcatttcagtttctccctttcgcgtttgaaatatggttgaaatcaccttcgtttccgaaaaagatcaattgccctgtcccgtcgcgaagctgtacctctggccctctgcatgcgcgaaaaaaaatcgtcgctgggcgaagagcatagagatcgggaatggtccagagcctgtagacgggaaactgttgaattttctctctctagcggttgatgaaaatcaaaatgaatttctgaggaggaagacttcttcccttctctcctgcggtcagcaggccgtctcccaagcaacggcgagaagggaatccggcgagacacgacttcgttggctgctgcagagttaagtttacttgctcgtctccttttctccagctttccaccgtttttcatgcactcttgagaaaaaacgcttatctctgcatatggctgcctcctgcgccgtcttgagtccggtcgtgcctcttcctcgtcgccggttttcatcgtctctctttgtccggttggacgcgtgcggaagttgactaaaaagccgaaagaaaaagacatttcccctctgttttcgatttcctttcctgtctcgtaaagttgtggatctccttttcgtctctcccgcttcggtccttgcttccaacagacaaatcaaggaggaagtcacacgtcagggcagaggaagaagtaggaggggcggcgagagaggttgggcggatggcagaaaggaagaaggagaagaaaaaggcgtcgttggagaagggaactgca

SEQ ID NO: 1442 - DNA, 2306 bp, Toxoplasma gondii
gagattctggagtcggtataatcggcatgacgactcgaatcatccacagagaagaagacaagaagggtgacacggaggggaacgaggaaggaaatatcggagaagttgggaagcctagagagtcagcggcgggggagaaagacgcagcagggaaggctacgagagaagaacgataacctggaaaagagaatgacctccgaacaggagggtctttgcagagagaccccgcactgaacaagaaagcagataacttgtggtcaacttcactgttttcaaatggcggccgggcgacgaccggctcgcaaacctttgtcgtttggtagacatgccaggcacgagaattcacggggacggttctggagtcaggaatacgcgaggacagacgatcttctgagaaccgtggcgatgattgcgcaaacaacgaaggccgccggactccggcgttgtgtatggtgtccaaataacctcgaagcggcgagctggtgaatcttcttgcctgagcaaagcgcggtcgcaggcaggctgcagccaccgcgacggctgccaacagcggaaaaatccatcgtgtctggtgtcctctccgtgtccacctcagcaaaacctttcctttgcatccagtatttttgcaagcactgcatgcaaatgccggactcgcatcatcgccagcgaccggcctgccccagaaagtctggcgcatgctggcggcggatctggcgaggcgcggaaccggagtcgcagtccagaggctgtcaccaggggcttcgagaacaaggaggaaaggaacaacgaaaaaaattaagacgtcaataagttcttaacgtccgagagaacctggtgaaggcaacaaagagttgtgagatgacaagcagacaaggttatgacagggtagaaagaagggaaagcgaccgggtgtttggccatcacttactgcctggggtccataactttttcactgggaagagtgcatgcagtctcggatatgacaggaaggtgaagacggccatcctttcagggaagcggtcctcaaagtgggcatgaggctttcccaatttgcctgagtttctggataccgtcggcgactttcaagggccctgtgatagagtccgacaaggcttcggcgcgctcctcgttcttctctgcagtcgattccatagtcttaatcttgcagatgtgtcctaccacaatacgagcacaaattttagccgagaattctcctgtaggagagaccagaaacgcccaaccacatttgaaggaaaagggacatgtgcgcctcctcgtgcacactgtaaccaaggcctgtacgaaaacgcgtaacgggcaccacagaaaagcacttggaggatcttggcgctgagcagaccggcagactcgtagtttcttttctacatctcgatgttcagtacaccgttccgccaagctgtcggacggtctgttcgttgagtatggctgcatgcggatctgcatgcgacatgcttcctcgcgaagacaactgacaactgccagccaggaaaacaaagtttctacattaccatcgcgaaaagaaatgttttttgaacttcgcgtttagatcggcatgacaagcagcatgcatatagagcaaggtcttcgattgatgcttgctttctaggcttggaccttgcccctcctaactgtctccagacacggaggcaagccttggcagccagcagagctattgggatttgagacagctgtgacccgccctttttcttcattctagaacggtgtgaaattatattttcctctgtatcgtgccagaactttgctctcttccttgccgtaattatcgccactcgttcaaaaggccgtcttcgccgttggtggcccgcgactcctgcttcacgagtttttcttcgttttcgccatcgagacacgtttcgcatgtttgttttcgagttttgtgtatgttgagagatgcggaaaacgctattatgcagtgggggatctttcgtcttcatgatctggacgtacacgggctctgttctcagcactttctcttttgcgtgtatgtaggaccgtcggtcaaacgtttaagaagcgcttgccgtgtacaccagagacttgcaacttcctctcgtttttgcttcacggactggcattgtaaaaggctgactcgcgatttttcgtccaacgtaacctttctgggcgaagtggttaagccggcaacgaacggctgtttattttgaggagcatatggagtcgggaagtccgtttcattccaggggacagccaagtcaagagtcgtacgacacccctgcagcacctgcgttggacttgtgcacgttgaa

SEQ ID NO: 1443 - DNA, 3407 bp, Toxoplasma gondii
gggaaaagtcaaccgcttcctcggaaacggccggacagcacgtatcctcactctctcgtcttctgtgcgcctcaaaaaacatcgatggcagccgagacacgcccttgggcagctgcccacccgatgccgtcggagacatgactctcgggccaggagtctctatcaagtcccccagatctcgttcacgacatccttcctcatcaacctccgctgtctctttcgtttccatgacgagctgtccgacgtcatctggatattcgcctccgactggggcgccgtggtcgtctccggtcacctcggcagcttctcccctttcttcatatttgtcaacctcccctccggtcctgcatgcgtctgaagttttttcgtcgaccctgctgttccatgcctctgtcgtcacgtcgcgctgtaggtctgtcgggaattttcgcatgtgtccgttgtcgacatcgaaaacctcccttcggtcgcaagattcgtggtgtttggtaatttcaacatcgtggtggtctaaaactcccctgtcccggagctcggcttccggttgctgctcttcggtaacttcagtctgtttgttgtctacctctcgttcgcttcttctgtatccatttgagtggacggcctcgggctctgcttccaggtctctgcaccccgttgtgtttccctgtgtcacgtcagcgacgggggcagcgtcgcgacctgcgccccagtccatggttctgtgacgctacccatttacagatatcgcttttccttactgggtcgaattcctaggagtggcagagcagcgtcagagagcggagaggcgcacacaggagaaagaaaaaccgggggaagagagttaaatacgagggaaacggaccttgcaaacaagaccgatgtaatctcagccatgaagagagcttctatatggtaatggcagaatggggaagcagattctcgcgtcgttctgttcacacgcaagacatgggttggcttcctttaaatctctggaagacaccggatggaaatggagttacggagcaaacgacacactagaacgattggcggcaaaagatccatcaacagtaggtgggcttctagaggggagactacacggttctgctgcacacacaaagggcggaaagaactaaccgtgttgtgaggcacgcaaagtgagtcgtaccacttccacgcatgtccgtgtgctggccgatgagctagcttttttggggaagcgaagcacgtagcggcgacgctgaggaaacacggctgaaacaaatggaaatgggaaacaataccaacaacactcttgtgatgtcctgctggctgcacgaagaactcggtggactgtgaaagccaaagctacttgggcaaaaaacttctttgcatgccacccgttcgcttgcaccggcctcggccgtctcctcggtccagcagtcgacctcaccgatatctcaggcaggtctccaggaggcaactaaccctttgctttccctagatcaaccaacatatgcataatttattttatcgggtatgtggggcgaccgcttcaaagtgtctggttaaagggccactgaagaagagctttcgttgccctggtggttaggtttatggacttgctcgccattgaaatgtctcccaggctggcatgcagcaaaaactcgatgaatgcacacagcagacccaagttgtcccagcattgtagtctagacaaagtctcttgtcaaccactgcagttagaaatggctagggctacgcagtgagagacgtacggttttttcacagagaaggattgtttgtctcagcgacgcggatgttttggtttaggaaaaaacacacatctctctagtatcgcttattgccgggtcacagcagtggaaacagcatgccgcacaaactcgagccaaaaaaataatcgtgtgattccggtttcatgtgtctcaagagactgaagcggaagtggcacacggtgaatagatcccggatcctctgagcgggtgtgtcgctggcggaaagatttgaaggatatcccctgcaccttaccttttcgcagctttggaagcagattgccctcgtccagaagttcgggaaacactcagggaatatcggtgagctggtggagatgtggcaaggcagacagtcaagtgcaggagatgtttcgcgcaagagatcatgaagcggctccatacacaacacacccagaatgtgtttttgagagatgtgcgagttctctgtttgaattcgcttctaacctgaggaaaggtactcgagtggcgacttgctaatcgcggaaactctctagctcgtacgcctctggttgtaagttgcagaggaagagttttttctcccggtacactgtagtccgccgaatccaagcgattgccgttttgtccgactgattatgtcttagcgcactcctcactgctgtcagtgcatagagaatgcgttagcattggatcctggaatagtaagtgaagttaatcatgcttgtaaaagaaagtaattccccaccaagaccacccgtctgtccgatattgtgctgcacctcggagtcacgttatagtgtctgcgccacgttgtaatacagaatttcatttcctcagtaatgtttcagctcgcggaatgtacagaagcaagtctgatttcttaagcataccatttttcattgaccatcagagcactaggtttttgcacactcatgcctgtgtcacgccggagttcggtggctgttttgggtggagtcggtgtgagctgagcggctcttgatatgaaggaatgcgtcatgaacggcgtcgttaaggtaatgcgtgttacaagctttcaaacacttgaaaaatactcggacgcgttcagtgtgaaggcagtcgtctggcgagattcctggcgcaacgcgtgcacgcaccgacatcaagtcatgttgtcctccatgattctccacgatcaaacaaacgacctagacatgaaacattattgttgctgcatgtcgattacgtgtgccaggcaagcaaacacagaagaaaacctcacatttgccgttttagctcggcttagctcccttcattcactctctgcgcactcttctagctgcgagtgtacaagttgcaatagatttgctacaggggcaacttgcttcatgtggaatatagctttttattcgggcatctgcaaactgctcttcggtaccacgtgcatgttgatatccgcccgtggcgcagcatcttgcttgtgtttctgtcttcagagaatttcgtcacagcaggcagcgaggcatgacactaaaagtcttatcacgttgttgtagaagagatgaatcacggtgtcggcgtggtggccacggagaaccgcagacaaaaaacggcatcggtagcggcacacgtcccaattaaggcagtgtacacatacacgcttcttgtgggtccctccaa

SEQ ID NO: 1444 - DNA, 1818 bp, Toxoplasma gondii
tttgtcttgcaatcaaatctgcggaaagcgcttgcttcgcgctagacaggaggaatgctttttggagaatctatggagcttcactatagggggtcccgcgggttttctggcagcccgtcgcccactgtgccggctgacgagcttagtgtttctttgcgggtttcctagtccacgaatgtggcatgcgaaacgcgtgcaagctttttaagggccgccctaagaccacgcttggactacgcaaatgaacctttttgtgcagttcacgacgtgcacgcagtataggtcaacacgcatttacaagcgacatcgatcttcgtgtgactcgcgtgtacgtacactacagcacgcgtttgcgatgcgagggagaaacacgaaagaaccgtgcaggaagacaggtgtttgacaatctatatgtaattctatatatttgtcagtttggcgccacagtgggtgctgcaagttcttcggcacactggctgaactctgacgctgtccgtgttttgttgtaaagctgcagacaccgatcatgatctgctgtttatttagttcagatttcgacacgtttttctgcgaagcaggagactgtatagaaccagcatagtgtacttaggactgcgctcttctgagtttcgggatttgcaacgcgtctgttcctaagaaaacggggcaaagcaaacggctcaagcactgacgcctccgaaaatacgtaccaccaagaaaacaatttatctactacgctctcgatgaacatttgaatgccatttcgggcaatcgaggcgagaaaatgatgtacgattgctttctgaaattgatatgtgtgatcttcgatctgttccgtatccacgatactactacttgagtgcggatgagcgtacggttcaattttgcctttggcaaggaagcagaaacagcgtgatactgtatcttgaattaggtccgtatacggtggctatgcttcgtttccatacctttctggatgtatgcagctaaggaactagaaaccggccatgcgtgacagaggtgtaaaagcacgcagggagcgtgtgttctgcgctttcagctcacttgcaatctgccaaatcacagtgcgacacatcgcaacagcgtcgggacgaagtctctgacggccgcgtcgcatgcacgcgatatagttattttccgttctatcaaccgctggaaggacaacgatgaatacagctggaaagtagcgacggaaggttctccggtgtgcgaaaatgaaaatatttttttctgacagaaacagtgcctgcacgagggttgtgttgtttgctcaaggttctttgcgtcaacggtgcatgcagttcatgcctttgctaaaatctcccgagtccaggacatgaaaaccgacaaaaacacgccttttgttgtccgacattgccgagaaactgtgaatggtttgtttggaggatgtgtgttgtttttacctcgaatcgactgatcgactgtgtcgcaaagcgtcggatgtccagtgtcgatgtgaggaccattggaccgctttactccgcagtcagagctcctttcgtccgaatctgagtcttctgccacaacaaggctccgtgaatgccgattggaattgaactgtgttgactggcagcagtgtagtctttgtgcggatgtccgggcgggtgtgtgttggtctgcctgttctgataccccggcaagaggcaaaaaaggcatcaaattacgtggcaagagaaagcctgagattggcgcggtgagtgtctcttcctcgtttctttcgtagcgcttgcactgaccatttgcagttcctcgcaattcgcccctcggcagccacga

SEQ ID NO: 1445 - DNA, 3094 bp, Toxoplasma gondii
aaggacgaggttcactcgggattcgagcgaaggctctgcgccacagaggtgagcgtcgaacgcgagcggttccacagcgtccgtcccctcggcggcgaaggacgcgaaaggcgaagagaagaaagacaacaggcagggatacgcagcggctgccccccaggcctcgacgcctgggtcgcgcgcgtcctgcgagctcgccgggtgcagcagcgacgcaccgagcgccgttgcatgcaccgacccccacggcgagctcgctccggtcgcggccgccgcgcatgcagtcgctgcatgtagagaaaagagcggagcatcgggtgcctcggaggggagacaagagttccgaaaggctcggccgacgggaagcggcgcctcgacggcggcgacgaggctgcggagaagcagagggagacatgcggcgaggagcacctcgaggagtcttagcaagccgagaaggtaggcgggatacaggagcttcgacgcatgcaaggcgcgaagcagcgacggggcagtcggcgcgcgacgacgctcggcctcgagggccttcaaaaacgcctcggccttcccaaggtcgtcctcgtcgattgacgcggatccccccaagaacgggaggaacaagcaggaagagaaccacgcaaaagacaacatggaagatggagatgaagaggatcgagaagcagaggcagcagaggaagaagttgacagagaagaatacggaattggccagagtgagagtttaagagagttcttctcctctgccgaggaggacgagcaatcgcctttgccacagtccatcgtccaggcagagacaggctcagaaaaaaaacaaacgccgatgcaagcgcgtcaaaacgctagacgaactggggctctcgatcccagagaatgatgccatcgagcaacggatgtcgaagggtgaagcgcggaaagagtacgagacgaaaacaaagaggacggacagaaaaaaatacacacacaaacacacagttcctctagagagacagacccagaatcgaatcaggacaaggaaaacgtaaaacattgtcgtcgccactgctcgacttgacaatctaggcctgcatcccgacttcggcttcaacttccacttaacgccttgcgcatctagactgcttgcgacctttcgttctccttccagttctcattctatttttctccctcctcgtctcttctgtgtcgtttcttcttcgtttccttcgaacgcctcacactcctgcccattgcggcgcccctgcgtttgtcatattttcttctctctgctctcctctgtctcctctcctctgtcttctctagcttgtctcttcctctccgtctcctcttctccgactgcacctctccgcctctttccgcggatctccttttcttctgggtcttctcttcttctccctttgcatttcctgcattcgccgttgctgtggctgaagccttttgtctctctgtctccttttcccctcgcgagggtgtctcctcgacgcagaggaggaagccggaaaagagaggcgcgccgattcacttggggagagcggaagacattttaatgtcggcaaagaagaggagcttgcgaaggcgcaacgcgagtctttggcggcgcgctctggtcgaccgccggagcggctcgagcgagaaggtgcctttctggcagggaaaagccgctgtcttgccagttctcggttcttctctaccgctgcctctgcgccgacgcgctgagaaaacgctggacaacttgcacaacttgcagacgaaaataaaagcgagagaaaacgagaggtacgaggagggagacggagacagtcggtctgcccgcgaactagcgcatgcgccggccctcaaatcagcgcgcgcctcgaaacgcgcgctttttttcgtgtgtgtctgcgggcagggccgcccgctccgagagagagaggcaaaggcgagcagggagtcgcaagacaaagaaaagagagttgaaagcgtttttccgcaggctggggctcggtgtgtggactctcgcggaacagaaaggaatgcaggcacaaacgcgcggctcttttgtcctgttctcgaggctctctgcccgctcttgtctttgctcgtatatacctgaagatgcacaccgcagcgtcctgcgactcgggactgtcgagacacccgagtctgagagcaggttcctgaaacgaaatggcggcttttcttcgcgacttctcctctcttctcccatgttgacaagcggttctcgtactccttccttcgtttcgccggctggacaagaaggcgatgctgccgtatagggagagagcgaggaggaacctggagaggaggtctccatggctcggcgctcgattcacaggatacgttttttcatcgcggggaagctcctcagacactctcagccaccacaacaatcgcgcgcttccgtcgacggtcgcgagggcgtttcagcatgctgccctttcctcttgagtttcctcttttttctcgctctgccttcgtcgcctctgtctccctgttccttcctcgttgcgttcttctctttctccggtcctcctccgcgcctgagcctccttcgtctgcattccagcatgtcgtcgatgtcttcgcctccgtagaatgcgttgcctgtttcaccctccctttgttaagtttctcttttcaacaaattcgtccatcttctccccgtcctcactctccaccctctctttcgttcgttttttcctctccaccgcttcgtctccaccgcttcctctccaccgcttcgtctccaccgcttcctctcctccgcttcgtctcccttctttgcttcttctttccttaggcgcgtttccttttcctttcactcggtagattcactggcttcttcttctggcttcgatggtcctgagaaggcgcaacagatcttaggtctcgtcttcacagccctgcaagatctaaaccgcagtcggacgcgtagcgcactctccccagaaaaggtttctcgatcctcctgcctcagagacggcgactctggtctggtcgcgccggtcgtgctcctgtctggtgaatggttttctctcgctgtcaggacagctccgagcagtccttccattctcagcaggga

SEQ ID NO: 1446 - DNA, 2537 bp, Toxoplasma gondii
tgcttcttcatccgtcctcatcctaatccgtattgtgtttcgcgttttctcgtgtttgtttccgttgcagggagcagactctgtgcagcggcatgtttgaacgcttggcactgtgacgtatattttagaaagctgcgaaacgacatgcgcctagcagctgtctcctccaaattacgcgcacttcatttgcacctgaaggatagtcattgactgtcaaaagcattccgtgtagtaggtgcaagtaacgagcttggcagtccagtgtgcaacgtgtcattcacggattttggaccgctggctccgatccaagcaatcaactgatccgctcctcgcttatactttcagcagacacagcagccttccagtgtagcaggacggtgccccgtgcttggatgggagcttcctccctccggggtgattcctggaacgattgtcattgtacattttgcgcgcggttcggcacctcccaccaagggcaatggaaaaaagttgtaagtcagccataaagaatatgcaagctgatgaaggtgattgccttgcaccagcccacaatgatgcaagggtacagttccggcaactaatgtgttattcactgtaggctcgcatacgaggagcgcaccgcagggaccatcttgtatggcgttcagctacgatctcaccttcggtgccatgtgaagtgcagtggagcgtaaaccgcaagagacgacgaatcaggccttctccatgtgacctaaaacatccatatatcctcacaaggaacagaaacaccgcggcaagtgcatcaagagttccactgaattgcatcgagtgtgtcgttcgtgaaaatgagcgcgattgtaccgtactagaacaccgctggtttaaatttgcaggatgttcagggcgccacgcgtgcggcctctcaacccaaacgatgaactcgtagcatgtgtaaaaaggcgtctatcgccagaatccaacaggtattttcaggggtgaaagtccgtccaactgtggacggcgagattggagcactcggattgcgttcacaccatgctcgcgtatgcctctatagcttgcgcccaacaggttgtctgtctcagcgtccgaggtagcatcgcacacgtcagtgtgttctctacgggttttaagttgcccatagaacaaagctgatgacgacttcagcgtccttctccgtgactgcaccggagaaacttgaaggacagttttcgccttcgattgatgcagctgtagactagtaggttcaatcacgctcccgtcactccttggtgaaaggcacgagtatgcatccgaatgagttgccaaccgaatagttggacattgttcaccggctccatgttcttgtttgtaaacatggtttcaagcattcgcaagaaagacatgagtctgcttaattgcttgggctctgttcagcgcttacgaaaggacccggtgggaagaacgtatccgctttctaattaataacgcgtcacttgcgtataaacgaagtagagtaccatcattacaattctgggaagctactgtcggttgttccggtttgacgactgtatagacgctggttgtagcaactgtacttcgttacaactgatggatggttccatggacatgtacagaattatgttgcttaccctatattcgtgtggtcggaaagacagcaaactcaacgaccacacgagatgccgtgtcctggtgagtgctcattttgcaccgggatggtgttttacgtgaatggcatgatgcctcgatcatagaacgatacgaccacccaccgcatgtgaagaaaaaatgttttttccaaagcaaatctgtcgcctatacggtacgacccggtggtgaccccccaaatgcagaaaccaacgtcttgtgccactgtagagtagcaagcgtgtacgtgccgtttccacaagacatgacgcttgcggtgggctcttcagcgagggtacttcacaggccgccatactgatcccaccgcccaaatccttcatgcgctccgaaactcccagcgatgacttcacgtatcgcacacgctgcatcaagccaccatgcatagtggaacatgtgaattgatgggctcggtcgaaaggccaaattcagcactccctgccccattcagcactttacagttaaatggggaaaactgcttgatggctctctgaatgggaatggcgtgtagccgtccgtcctcttgccgatttcagttgcacggttttgcgcgtcgccctgcccgcttcatatgcagagacgcacggtagagtagacaccgggaggccacacccctccacgccaccggcagcggaagcagtcggtcgatgcctgggtaaagccagacagtcacacacgtgggccagtggcctacagcaaccatactgtcagctttggtaagcgagcactggacgatcggttacagagtcccccctctccgttctgcagcacacaccccgagacatgtcgatgtgtccgtttgtagaggtggccgatgaacagatttgtttgtgtataggaaaaatccactagaaggtgatagactgtaggtaata

SEQ ID NO: 1447 - DNA, 2872 bp, Toxoplasma gondii
catcgggtgtacataaactggtgatgtggaccctgttcagttggtccttgagaaaccgggcgagtgcccccgtctttgtcgcggctacgaagacgaattgcaggtcgtttctgtgcagcagcgcttcgttcgacccctccgcgttccctctgccagcttcttcccggccaaacgcgggacgagactcccgcatttccaaaaggttttgactctggtgaggcgacgaagaccaccccgccctcgcctgctctcccccgcgctcagggccctcgagggcgactttcgcgaccgcaggcgaggcctggaagcggcggaagtgagaggagagcagcacacagagttcctgttcgtagaacgagtcacatagcgtgtctgcctcctcgatgacgagcgcttgtacgcggtgcatgttcacatttttcttgtgcaggtgcagaagcagacgcgctggagtcgccaccaccacgtcgactccagagcgcagcatgcgaacttccttgacgtacgactgacccgccgcacaggccgcagaagtgatcaccgaggagaagcgccgcaattgccccagaacttgcgtggcgagctccctagaaggaacgaggacgacgagtcccggctgctgcgggtacggcgcgagacgttctgtgtcagcagccaggagtcgatgcaggagaggcagcgcccaggccagggtcttcccgctgcccgtaggcgcgacgaccagcgaagacttccccgaaagcagaatcggaatgcagcgctcctgcacatctgtcggagtcacgatccccccccccttcagaaggggaatgaggagggaacgatggagagaggagaactgagaaaaaagacacgagtcgaggccggctgttggcgcggaagaggctgcgggagacgcgcgcgaggagacagaggcaaacggaggtgaagaagccggggtagcatctgagaaatcggcctgaggaggatcttcgagagacgcaaaggggatgcggctgggaccggagaacaacgtggtggatcccgacgaagctgtttcgcgatcctgcattcgtctctcttcgtctcgcgtaaggtcagcagcacgccagcaaaaaggcgcttccagcgtctggcagttctcctccccttcctggcctttttctcgtcctggctgcgtctccccgcgagacccctcgacgagaggttctcctgggctcccagactgtgcgccgtcctcgttctctgcgaacgggagatatctgctcgacccccccgttgcagagtctcgttgaatcttctctgtatgcgtccgcgatcgccggagagagcgagctcctcgcgacgcgaagcgactccaggccccggcgcatggaccgacggagccgtcgccagagtctcggctgtctagagaggtccaccctacaggcatcccggcacagaggagcggcgcgggacgagagagcctggagacgctttcgttgggtcgcgtcttttgagaggtgatcgcgccgatgcatgcacgattcctaaaaagcactcgagggcgagggcggctgtgccgggtgacgacactggacgtacagggggggacggcgcgcccccccggtgtaaggagagcggagagacgagtggccattcgcaggacgcagaggtgaaagggagatgcttctcatcgcatctggggctctctactacgcgcgaggaagacagaagaaatcgaaaacagagtgtccgatgcacagacagggaatactcgccctcgggacggttggcgcctccttgattccacagttttagctaccgaattctttggtgacgactggcatagtcacgctcagcagatcgtccaactcccagtagtcttgcgtgttcacatggtgcaagtcgacagacaaggagaaacgggggcgaaacagcaggcgacgaaatgggggtcgctttgagcgaagagaggggagacacagctcgtgtgttcgtcgaaatgtgcaacgctgtcgaaggggccgaggactcggtcgtcgcggggttttcagaactccatcgaagccgaagagacagcgagcagcatgcaaaggcgacagagataccaacagaagaaaataaatcaaaagcagaagcagaaggcgaagaaaaggccggcgggaagtcaacgaaaatcgaggctctttcggggctgcacactcaaaaagcccgcgagcggcgactcggcgaccctgggacttcccacaagatctgcaagtgacttcatggaaccgctgctagacacagaaagatacctcttgtctgctgaagtgtctggcgttatttattgtgcgctttggggaatctctagcatgccttttctcccgcaaagggcctagacgaggcgtttcgccagtgttgcatctactcgtctgtgcgctgtggacaagtcacatgcgctgcgaaaaagcctcgaaaaataatccctttttgacgatgacgaacgccgacccgtttcccagctcacagcacacacgagtaacagggcacttgaaaaggctggttcggcacccatattcacggtattttctgtctgtctcggctttctaggcgtgtgcgtctttccgtggcaagaaccaatgcgtttttcgcgagtcgtcttacggtgggcagagcgcccttgttgaaaacgggcgtgttgagtgcgcaggttgtctgaggttctatgcttcttcatttggggaaagagggagaccgacgtgactgtcagaccgagaagaaagctggcagatccgctggcagtttgtgttctcagtgcagagtgctgttcgtggcgggacgggcagacgtccttggattgcgacgaaagcaggcgtttgggatacgctgcgacggttggacccgatttcgagagcctctcaagcgcaaa

SEQ ID NO: 1448 - DNA, 3628 bp, Toxoplasma gondii
tgcctaaaaactcgagggtcggaatcagtgctcttcggtgtgtcagggactgtggcttcttccgaagcaaggcagaaacagtgggggggggtctttatcctatgtgagttcccttcctgcttcccaaaggggattcagcagcgcactgtcacttccatacaatcttgaaacactctcctggcgaagcgacgcttgtttttcccccgtggccatggcagtctctcgtcatatatatcgtgctatcgagtcgcgatcgacagcccgagcaagaaaaagatccaccatgttggtttgcacccttcggacaaaaaatcgctcacgcggcaacctctgaaacaaatgttggggacgccacgttcacggataaggcgtgaccattgagttctagatctcattatcatgagctagtagtggacggaatctttttggaaaatggagttggtgtcgcggtcagaacgggaggaaatcgcattatgacaagagacataccattcctcttttgcggacccagaaacgagtcgtcgccagagtgtacaagatacgacgtacttgacaaaagaaagacacacggcctgtcattttcggagcggcgcggctcggcggctcctcacactggttgcatacacaaataaggtgtctctcccgttcaaattaaaaacttaacagtggacatgactgctttttctcctatcgtttgtttgctagagtggcctcctttttcagttcgatgcaccatgctggaaaagtcagacaagacattcctccctcgagctgccggcgttcagtctcccgtctcccccgggaaaaagcgaccctcagtagcccttgaagattgacagagacagtaagaagcaccatatagtgacagaagatgcatgagatgaataccgtcctttcttcatgcggggctgttggatactatggaagtattctgcgctacagcatcactcacgtaggcacgacctggaagagtcaaaaatacctacaccacggaccgtgccccttttcagactgacatccacaaggaacaccgcgtttttcgtctttgcgatggtcaaaagaatgacagtccttgtacctgtttgataggcgtggctgcatccgtgtttgcggcctcattgattgtgtgcacgcaaccagcagccacacttcccacatctctcgaacgaggcagagactgcagttccagctgaaggagactggccaccatacccatgggcagatccacttcacacaaacgtaggtctgtttccgccggtcttctggcaagaagtgaacagagacaagacatggaagcacaccgagcgtgatcccgcagacacgtggctgagagaaaaagcgtttcagccctctctcccttttgtttcaccggaggtgccagcttaggcctgagcagcgctctcgctcttcttggactgaatagcagcctggggaggcggaggaggagccttgagaggcggcggacctgaaatctcaaccgccagtttcgccggctccgcaggagctgcctcggtcgtcgcagcctcaggagcgggctttgcctcttccgcgttttctacaggtgcggcttcagcagtcgctgcttcagcggtctcaccagcgggggcggcctctgtaaaaagcaacacaaaaatgcgaaattcaaatcgatctccagacgctcaatccgaactagttttttgcatccgctcgttctgcaagctggaacacgtgaccgttgaagaagcgccagcataccacacacttcacactcgcggaaccagacacagcacgcttgctgtcagtgatcttttttggacccctaaaccctaacgcgttttctttgcgagcactcaagactgccggaaacaaaatatggtctccgaagggtcttgcgcccgtatgaactcacaacagtggcccgaaccccctgatcttccacctgagctgcttataatccacttgtttgtaagtcatatgaccatggaaaccactttacactgttgaagctgtattatcccttcccgaccgacaacaacgtagccagcgatgtaggccgactttgaggcggctccactctccccacgcgtcttcacaccaccacccacaaacatgttccagcatcacttgagctatagcgtcttctactacacaccgacgagaactgacaaacagatttctcatctctgagagcgctctacgactcacatttcgttggctgtgcagtagtctgcccagccgcaaacctctgccctagcactggtagatccgacatttttattttgtctcctaacgaaacatcactggatgtctcctatgacttgatctttcagttttacacaatagtgaacgacaagcctcagaattccgttgtatctggcgcatcccgagcaaccacattgggggtggcggtatcgcggctaggcgcctcggaggctccgctgcatagatccactacttccgtattctcacagcgacgtgaatgtgcgaagcaagcgaatcggaactcaacaagctggttcttatagtctaagtccccttcgccatttggagcggtcgacttccgcggcagttttcctgctcgtggtgtgggagctaactccgccgcttctccatgcgtgcacttcctacctgtggttgctgcaggagcagaagcctcctgcgcaggttgttccgacgtctcttccttcttctgctcaacagcagactccttcttttccaccggagctgcaggcaccgcgggctccggattcgcgggtttttccgggctggccgcagacccgctctcacgggcaggctgggcgccgcctgacaagcagtttcccatgatgactctcaagctctagcggcagggccgcggaaaagtcaaacaaaaaaacgtaagcaaatctcgctgcagaggaccgcgcctcttggactttctcaaaaataaccgccacgcaaagtaggggtaactgtcgacacgagcgcacgcgcctctggaaatgaatcccactgcgcttttcaatcgggtagcgcaagaacgccgcggaatcccgcgctctcaattcctaggcccacacagcggagcagctcgaagctagtgagcacatgtagctcgctcgcgatggcgcggcgtcatcgcggaacagctcagtgcacgcgcctgcggtcgcgctgcgaaacgcggcagcccgagccccccatgttgtctcgacaggatccgacgtgaagcgaaatcacccgtggtctctcgagtgacttacctcttccgtggtgggtcctcgtgagcctgcatccccatgccgaaacgagagtgtctgtaacgagtgtagttcctgaacgggaggcgtgcgggaaccttcggcccttcgcaatggaaaacaccttctgagttgacgtggtgtcgaagcttaagagcataatgctgttgcttgtgcgaccaagtggaagaagcaagagcgtggcagctggtggaggacgcgagaaaagaaggtgaaacgcgttggtttgcgcggactctttctggtgtttttctgccctttggggggctgggaaacacggagaacgccttcaccaacaaagaggatgcgtcagaatgaaaaatttggagggactctaaccctcccgcgagagatctgcgatctctagcattacatctcggaaacca

SEQ ID NO: 1449 - DNA, 2069 bp, Toxoplasma gondii
caaatatattcaccgtctgtaacagcagacattcaaacagccgtgaaattcgactttctagatagaaaggaaacttagtctgcttcgcttccgaaaacattgagggaaaattaagcgtacgtattggttttaccccgaagagaacacgtgaaaagaatgagtgggtcatctcgattcgcatattcgcacgaacatcacgtttaaatgggggatccagctctggatgcccggagtaagtgctgtcatataccggtttggaagaaagtgaatcgtatgctagggatgctgccgttcgtgtcactttgttgattgtggagcagaacaaacacataccgatttgttaaggaagtcatgcgggcagctttgggaatcactcacgtgcgagcagccttcgtttcaaaagtgagaaaagctgctagaattgcgctacgctgcctgattgcccgttacagagttgctggtagtgtttcggggggccgatacagctgactagttggctgtgcaaccagtgccgtcgtgtatgcagaacgacaaacagtttacttccaattggatatcgggagagcgaaacaagctgaatgcgacacaccatgttgtttttgacagctgtgcgacggtttaccagatagcatgccacggtcgtctctcaggatctgcggtcacttagtgaataaacctagtaatatgagcgcacgctagcgcacgtgtgagcaaccagagaacgtgagtgtggtggtccagcgtgcttttgctggtgggtgccatagtggtcatacccaatgaggcagctttgccagaggctgttttccaacctctgcagttttttcttcgcagtgtctttgttgtgctagagtcaaatatccattggcaattgatgcacttacgtaattcagcgatgtgacacggattgagacttcttcatgaggtgaagcacccaccaaggtgggtgccagccgtacgcctctacagctatgaaatccgttatctaaatcgctcatgttccagtgctgcgcagactcgaacatgcgtctggagtaaagctgggcgcgtttttcctattgagggtgtctgctgtgcagagagtttctagctgaacgcacattctctccaggagtctgctttactgtggacctgcggcagccacacacatctaatccttcaacgtcgccgccgacaagcgaatccatttagcgccttttacactttcacagcgtactgcttgcacaaaccgcgtatcagatattcccgccacgaaacacttcttagaaactgatccgcgtactgctgatgccaggcaagcatgcatagattgcgtggtagctcgtcacattcgacagaagaaatcggacagcaacaccattttggatcaaactctcgatcttggcatatttgtgcccctttcaagtgcggctgaagattttggcgtggcagttgaatcgagagggcagggtcacctccgttacgggtagcagatacaccagcgcagtgtgcttctttgcgtatgcaatggactcatggacagcgacactatcgttctaaagagcaaacaaagagtacagtagaatctctgtgggcgtcatttcttgtcgtatcgatcgaaagccatatcagtattctttttcatctgccgattttccactgtttatgattgagatttattcgcattctgtggggtgattggcttccggtagacagagctttcggtccgtgagtgatttttctttttgtccaacccagggctcctccctttcagtagcctagtttttcgtgccgttttgttaatgcaaagctgcattctctgagttccagttacgcaaagacgtgtgtgttttcgaaacctcctctgaaattacccttggagctgctctcatgagtcattcagtcgccaattgtcctgatttcgccagtttggctaggtcgcgaattcctaatgcggctccgagaaatcgtgttgaggactgttctacacgaaatcgtaccgagcggtgcagttttttttcaggtatgcatgcggcgaagatcacgatgggaaggagagacgacgtgctgtaatagttattgacccaaga

SEQ ID NO: 1450 - DNA, 2482 bp, Toxoplasma gondii
tttctgtggtgctcctcgatacagggaacttcaccatggacctgaagcaagctgaagacgaccagcggtacaagcagctgcagtatgggagagtgccgagcattctaacgaagtaccacttgtagggcgtgggcggcgttcgcctctaagacggctctcggcccagattgtctattccagacggttttctgtaacgactctgccggagattctcccgtagacgcgtgaattgctcagtgtggaccaaggcaacctttctgtggttcccaagtgttagagactcagacgaacgttggagtgcactgctttttggtcgacagcccacgctgaatccaacgataaaaaaacgtttctaccgtgcgttcagaaaaaatgcactgtttttcgcgcaccagatttagaatgtctgtctcgaagccgtctcgccggggctttcgtaaaaaaacgtttcgcggtgtcttcttggctacatctgcgagtgtccgttgctctccaggtgtcagtgtgctgtcgcaaaaaacagaggggcagaggggcgcgttagaagacccacactatgaaacgcacttgagtaacgtaacagtgtagaagcttcagctgcgtctaatgtttgaaccactcactggatgcgttttcatgtttccaaaatcatgggggcgaagagcgtatcacgcggtggaaaaggcattccttccagggcccacgggttgttggtattcaaataatcccttaaggatcgaggaatcctctttgagatccacgctaaacagtcatgagtcattagcgtcgcccgcaacaaattaagccgcatgtaaggaagagagcgcgtatatcgtgaagctcccgcccgcgaggaaaaactctgatgttggtgtcgcctttctctagtcagtggagacccgtgaacgcaagataccgtttgcctttagtcacaagcaagagccgcttgcggagggaaatttggaaagacggcactacggcgacacgactgaatttgaattgcacccaagaaccattttgctggttttgttttccagtgaacaaacctaggggctcggtgaacctagacgtcgaacgcaggacgcacttggcgctggcacacctagtttgaactgcatgcttttgtctctgaagaaatctccacgttcttgtcaggtcgcaggatcacctttccataagctggtggaagacagcgtcatcagtatctgtggagcactcgagttgaacagagtcggagtccaacccaacagaaagcgtgtcgacagcagtgaaactgagagttctcgtgctgaaaaaggtccttcacaattgcacaattagaatcacgtgtggaagtgttgaatgcctcaacgcttggtgccagctgttccaaacgcctacttaaccgaaggttgctagaacgtctgggcagatcggcgcttaccaaattcccttctcaacacacacagcaaaatacgggattgccgcgaggaccttgaaagcagctcttttggatgcggtcgtgaactgttctctcatgacgcacgattcaaacatagccgattcggaataaccccactgtcggaggatcttgaaatccaacgcttttagctcgctgaagcagtccagtgcggcgggcacgtgcaaaaaagccgtaaagaacttttctgattgattcacctaacaaacacgtcgttgcttggaacaacactcttgtataaggatttcctttaatagtccacgaagaagtttactcgcacttgaatcccaagacgttggagatggcttctgcagcgagacgcgtgtctcgtagcaaggcacatgggtccgtctccaacttctcgtcggctgcggtttttcgcgtaacgtggatccgtagttttttcaacgcgttccctatattcgccttctgcacatttaagtgcttgccacacgcatttctctgttcgtcttctcgtcggggcaacttccgcgttttccgcgtcactcagacacacacattttcgcgtgctctgcaagctggcggccgtggtcagctggttctgtgttcgtgtgcgacaggattacggcttggttgcctccactctttctcctcataaggcgcagagattcttttggcgtggatggtcacgggaggaaggacggcttttttgcgactggaaggttttttcggagtcgcgtgcgcagcgtgtcttccgtccgcgttcaaaagcgacctttcgcggttcactgacaagcgggagtttctcttttccttttccccggtagcgccgtatctatctctctttgacttcacactttactcgcgaacgagtttcctcttgggtttctctctcacgtttacactggggttttctccggtgtcccgccgtccaagaatctgcgaagtgttcaaccgcggtccgtagctctgttcttctcaataacgagctcagagagactttttgcgagttcagcaagctttgagcaagacgcgttgcactgaagagcgacgctttcgcca

SEQ ID NO: 1451 - DNA, 1443 bp, Toxoplasma gondii
tacattttggtgtgcattggttgtgagcacttcttcgtggttgtttggatatgccattttttctctggaagtttacgcgaggaaggaatgggacacagattgttagaagagaagtggagcgccccgggggaatgccggcataagaggcgaatggcgatcttctgtctgcacatgtccaagagcacagggaagtcaaaggttttggtgcttcatttccgtcacacaggaattgaaagagaacatgtgacctccgtcgctgtgaggataagtttaaattcgactggaacaccgttttctaatctcccgcttgccctgctgtcgggccagtgcagatgactctagaaaagtcgtgagaagcgagagaggcagcgagactttcaggagagagaaatgacctaaattcttggggcgagtgtcagtacacaagggcaaaaacgaggatgcgcagttcaaacccagcatgaatgcttcctgtctacctttctgcgccagaggaaacaccgaaagactttcttttgtgcaactgttcgaaacgactcgaattcacagtgtgtgcgtcttcaaatcctcgatgtacacacaggttccctcatgcagtcgtctctgctagagtgtcttctccgacaaacttccgaaagtaaagcgtgtaattcactgttcttacggaaaacttctctttgcttgttgtcaaaaggaggaacggaaggagacaatgccctccttcgtgctggggaaatgccgtttccgccaggtcctagcatgacagtttcaaaggagacgatgcctcccagtaagaggtactgatcagacaagcatctaaatagggttgttttctggttataaacagtagaaagcgaatagtaatcctgtcgcacagatgacgcctcgtagtacgaggtactgatcataccagagcctgagagggattttccctcggtggtagtgcaactactccttagtttatgtcgacttgattgtttcaccatgtaccactacattctgttcgatgttttcattcgatggagtgatcaagctttttttactgtttagcgcttctcctcccgtaccttcaacactggaacacattgacatggaacagggtgttccgcggctctttcagtctttcctctacgcgcatgtgcatgagatagcagcgtttaaaagtgcacagcgacaaaaagacgacgacaagacatgaaactctgtgcgaccgtcccctcttgccctccattttgtcttgcctcaccacgagagttcaacgcttctgctgtctggcttgacacgcatgcgagcaatcgagactggagaacaagtgccgcttttttttgtggagaaagtcacaggaaacacaccttttctccgccctttaaaagtcttcaaggcttttcaatggcagcaggaattccttccttcctctgtttcgagttttaggtctttttctca

SEQ ID NO: 1452 - DNA, 1977 bp, Toxoplasma gondii
ctcgaggccgacaaggccttctcgcaggatcgacaccgttcttttgccgagcaaagtgtctccttcctcacctcggtacccagtgggcttccgacccgttggcgcgggaggcggcgaggccttgaagattttaaagggcgcaggcgtcgccatcttctccagctgaatcgctccgatcacgttcttccggagcaatacgttccacaattcacgatctgcgggggcaaagcgcgtctccctcctactcttttttctccccacgcatgtacacacacttgcgagaaacacaccaatgcatacaatatatatatatatatatatatgtaattcgggcatacgaatacataaatatatatatatatatatatatatatatatatatataatctttgcgggtgacgaggaaggcagacgaggtcgactgttctcagacacgagagagaagtcgagcgcaggttgatgagaaggaaagaagagaggagaggctgcccgaggcgaaggtcgcgtaggggagagcagaccaagaagaagtggaggagagagacaaggacgaaagagttcctcaggacggcaacaggagtttctgggcgcagaacgtgtctgctggtgtctcaggtcgttgccgcagatcggagacagcaggggctgggcgtccgagctttgctccctcctgcctcctaacttgttgctttcctttccttctccattttcgtctgtctgcgttggtggatttcagaagagatcgactgagctgcagaaaccttctcgccagctccttctctgtgcatgaagaggtctttgttcgcccgcggcttatctctgggagaagagagcgtctcctgtcttcctgttcaaggggaaagcgggagacatccgaagaaagacgtgtgcctctacaggaagcagagagaccggaaaagaagacacaacgagcgagagaggcaacaaggaccaagccagtcgagggcgagaggagcgcagagccgacaccgaacgagaagttgtagccacatgcagcgatggcttgcttcgacacacggactcgcctttttctgcgaagaacagactcgcacagatgaacctctgcgtctcggtgtccgagagtcgacaggaaaaagaaaaaaagacgcatgcggcgcatggagagacccgcaaagtcgcctgcaaacctgcgtggggcccaggacaaggtcgaggaggaagacgaggcagcgctcgaaaacactcgccgcttttcgggtgtaaagacacccaaaaaggtggaacgcttgcttcctgtgctttctcgtctgcacgcggacgctttcacatctttctgcgaaaaccgactcattccctggctgctccaacctcgcccgcgctcggcgaggcgcagacgacaaagccacacagaggccccgagagaagacaaagaagaccgagagagagagctgagaaaaacgagagagacgagacgcagacagggagagacgaaaagcggcttctctctccacttccacgcccgagtttctgcactcttcccccctcttttgactccgcccagccaatttcgtgtgcctatatcgaaagcgtcgcggcctgcacgttctcccggagacaaaatacgctcttttatctctgatatttggagatggtaccaaccacgcagcttctatcctttgctcgaagcccagagactcgcgttctcttctctacgtcaacttctgcaaaggaccgctgctgaaccgcctgcccgcgccgttcaccgccctcgtatctgtgtgcagcgacagcggacctttctgttcattgtccatccttctcatgctctgtcaaagccaccagactctcctcccatgtctccccttcgacaaaagcgcgacgacatgaccggcggcagtggcgagtaactccggacgactcggctagctgcccctgcgtcctcttcctccacttctcctctttctcttcttctccctccccttcgtctctgcatca

SEQ ID NO: 1453 - DNA, 1581 bp, Toxoplasma gondii
cagaaactgaagttttgcacagtggagtgctgagcacccacagttgacaggtaatgatgcacgtgtgggcaggtctacgcacgcaggcataggggttggcctgtctagacacctgaatgcccacacacgtgatgtactcccccagcgtagcagacaaacaggatttgagaaccagttctgcacaatgctgcagactagaagggtggttgctctctggtgccgacaagaaatgtggtcgacatacgataaccgtttttttgagaggtgggttctttcgaaaggcctaggcggacgagtctgataggtgaactttgaagaacccagttatccgcaagcgtaacttcaccgatgaaagctcagagcggcaaagaagcgcgaactgaatgtttttgatttcactcttccagggaaatcctttgctcttcagcctccgtcgcagcaatgccagtgaccgctgccattcgggtgtacacacagggaagtctcaaacaaaaaggcggcttcatcactggctgatgtgtttatcaggcgaatgtctcttctttgcacttgcgttccatccatatgggcgagaacgcctccgaaaacatatctggaaaaaacactcgagttttttctagctttctagcttgtttatggattgtgtacctatcgtcatgtcactatgcccagcagtgagccctatttgtgtcatctctgtagacgcacgtcgaacgtagatgcatatatcgtacataatatgtttcctatacatctgctttttacattcatatgatgcacgtgtatctccctattcactgggggtgtgactgaactacccagcagttactttttcgtcacaaagtattcgctccttgccagtcgtccgtatatatttctgataacgaaagttgcaccggacaactcactgaattaactcgtcgctgtgcacatgcgtgaatatcgtggcttttttcgctgggatgtctataccgagactgaaggcctgcattggatctcggccgcggcgcatgcatcgctgcatgcgggaaaactcgacgggcgcggccgtatcgagtctcctgcgaacgtctttcgcgtgcaaaggcgttcacgttgcattctctgaacaagccacgaatccggccctttatggtgtttttcgttttcttcatttaccagtctcctttcctgccttctgagtgtctgcctgcgcccccgttttacgcacgccctcaacttccctcagtctccgcatgttctcgccccgatcctctgttcagacgctctgctcttttcttttgcttctctgaggaataaagttaactgctctccccttattatcctccggtgtgtccagaaggctctggaaatacgagggactcacagcgaggagaaacaggcccgcgcttgactcaagctcggcgagggctttgccaacacatgcgaaattggatccgtaaacaaagcgttccagggtataaggcagtagtccagatcgtatcacatccccccccgcgagcagacgtcttcttggcaatcagctactcttcgttctccgccgtttttctgtgctgcgggagacgaattgttcgaacatca

SEQ ID NO: 1454 - DNA, 1521 bp, Toxoplasma gondii
gtccctgagttggagaacttccggcactaccctgggcctctgtttttagcggcacctgctcatccgcttcggtggccccctcagctccagtggatgcctcattttcagtgcctggctcagctcctgggatcatatcagctcctgtgcctgctacatcttcagtggccgcgtcagttccaatgctcatatcagctcctgtgcctgctacatcttcagtggccgcgtcagttccagtgctcatatcagctcctgtgcctgctacatcttcagtggcctcctcaacttcaggggctccctcatttccagtggccacctcagctcctatattcgcttcagtgtccggggcagcctgtgctctgatggtcgatacactcagaggggcaacatcgctttttgttgcaagaggggggttaaacacatctacctctttaggctcgcctgggctcttctcgaggccatctgtcgtcgcctcttgccgtgagtcgtccgccacagtggcgccagcaagggtgcccgggagatcagttggcgacgtggcatcggcagctggaatagtctcagatgcagctgcgctatcctgtgaagcctccgctgatggttgggctcctgattcagccccaattcgctgtccagtttcaccactagaggcagtctctggaccactgttaagtggatctacaggtatgtctgttacttccgaatcacccatggtgtcagagccagaatcttcacccgactctgaggcgtccgtcccctgtgcggtaggagtgttagggtcggccgtcgaagactgactttgatcctctgatttctctgcttcgtctttcgtgtccgcctcccctttagcctgggctgacgattcttgttcctcaccaccacggtctccaggggacgacacatctaccagtgagcttgatcgccaaacttctccttggtctgacccagtcggaacacctccgtcagattcttcttccctagagccgctgaagccgtcctcagtttttgaactcacaggtcgtacaggcagcgccgcgggcggtagcgaagatgtctccagtacagggtcacctctgtacacctgttgagttgcgtccaaaaataagtcatcgtccccggcgtcactggtatcgatcctttgtggtgcatgcgcttcaagggtgagggaggagtcccagcgtgatgacggctggacggcgcggcggtcctgcagaggcaacaggctgtcccattgcggcgattcgcgaaatcgaagatggagtccgctaacagagaagcgcttttcagatacacacagcaagcttaaaaagaacatggaaggaagaggccacctgggtcgtcccatctttccgcggaaatttatgtatctctcgcgggtgatcgaatcgactgaggctgccagcgagccgcagcagagaaagaaaacatgtatgaactggcaaagtgtgcctttcgaatgagctcgtcattcaccaacaaaaacgagtcgaaaaagagacgaacaagaacaacttcttctgcgca

SEQ ID NO: 1455 - DNA, 2457 bp, Toxoplasma gondii
tcgggtatctgtctctttgtgtacaactcctcgttctttctcatcactgtctcttttccactcttcgctctgtatctactttcttcaccttggtaaatgtaggtgctttgaggcttggacgaccatgggtctttttgaattccaaatagtgccatcgcttgggccggcgcagtctgcttcatcgtcgcgtcggtgtgttctgcatgtatttgctactttcgctcgaactcttttttcccgtgtaccatcctgcctctttgctgtcccgttctgcttccacatgctcttcttgcttgaaggaagcagtgcctcccctcccagagtgacaagtctaggtcgaagatgcgccgccggataccagcttgtagttacagccataatgaatcgttcgtacccacttggcatctcagttcaagttagcgaggccgatgactgtagcttcaaccggtaacatcagtgcttccttaacgttagaaagtgacggtgcatcgctggaccggaaaccgttacgcgtagcgggacacttgtacgaaagaagaggcaccctacaggtgaagtaagctacaatcaggaacaagtgggagtgacatactgagctggaatccctgtttctccaccgtttcgcgttctgcggctctttcccgcggctgtcagatcgcgtcaatgcagacggttccgattcgacaaaggatttgtgaatatacacgggaaaatacgtccatacaagacggttcgttagtaccctttgggggttttctatgcgtgacctaagggactgtttcagcatcctctatctcaatctctcagtcgtgaacaagaacgggaaagtgttctttgtcgctttgcgtaccacttgacaggggacccctgttacgagagactcccgcttcgatcctgatcatcgatcccacggcacaatactggtggcgttcggatttcagtgaagctcagaggaaggcgacacgtgcttgttcaccaagtaaccagactcgaagagtctgaagaaccgcccctcgtcaggttgtttaactccgcggccgcggactgtgattatctcgaaatgtagggggatggacagagacatatgcgttgtaacttcttgctcgtccaatttatctaaagaatgtcctaaagaatacatctctttgtggactggaccattttactaaataatacacgtatgatcttcggcaaatgcgaaacaccggcagtggtgcgtgggattgacttgagacacaacctccgtcgagcgcacataaaaaacaggacagacccgcagacgccgtgcttgggaatctttttttgaatgctgctcgccgtccagagcccctgcagaaaacgcgaaaccgaacggaacctagttcgcgtgtctgaaaagcaggtgctcatcctgggtctttggctgtcgtcaaaactgtaaaacgcctctccctaactcgtcgtcggcctgaagtcggccttgtggatcggcttatagtaggagaattcctggggcgcggcgcaggaggcgtggtggcgtgcagcgcacaccgcggaagcttggggagaggccggtgacgaaaaagtaaggaaacgcaactgaacggttacgagcgctaacaggtaagcttgaggaaagtccgcgttccgtgtggtcgagaaaaaagcgagaaaatacctcgtggcagcaaacacccacccggggactcttactgcgtccaggcttgttgttgcttgcaagtcgcgggacaggggtgacacacaaagacatgtgtctgctctgttttcgcttcgtcgcctcaggcatccgtgtcattttcctctttcttcatgctctcgagtttcctgttttcctctgtttctgtctgaccgcagctgttcttgactcttgccactcgccttctctaggggtttgtgcctcgcgagtttttctcctaagtcgcgcgcctgtgtgtgtccgtttccttcacttcgggtggctcgacgccatcggtcccttttctctccgtatttctcggtcccgtttgcggcgcttcccgctggtgtccctctccagccttgtccgtcttccgcttccaaacttatagagaactcctacgggcttctctatcagatcgttgtttctcaaaatcgagcgccctcttcctgcttctcaggcatgtcttgctctctcgccgtccaactggttttcttcggcttttctcgtcgtagttctgtcccaggtctgtctcctctcaggtgtctccgcaacagcatgcactgctttccctcgcgttttctgcgtttcaacagctcctgtgtttcctgccgctctcggtcccttgctctgcctctctgagcgccaactttctctcttttttcggaaagcgtctcgcttcttgctgccttcacgccgtcttcctctcgccgtctcgacctctcgaccctctttctctcctcttttcaacccacggttgagaaaacgcagagcagacacca

SEQ ID NO: 1456 - DNA, 3520 bp, Toxoplasma gondii
accggtgtatgaccaactagctgtacgctcttcgtcgacaccatcgcgcccgcagaaggacaaggcactggataagaatgaagggacagtggaagaaggatcacttcaagtgtcacctcggggcatctgcgaatgcgctgcgcatgaaaaaggcaagcgttccggcgagcaatcgccataccgacctgctccgtctgccgtaactacaactgtcctggtggaagtcggcgctgtgttggcacaagcacacgccgcagtacgagatgccgatgccgcagccgattctcttcttgaagactcgtcggccggttcggcatgcattccctgcgaccgtcttgaagagtccggtgcatcacatgatacaaaaaagaagcaatctattcatctgacgtttaccggatgtggagattcccacaagccggcctccaaatcggacagtacgaagaagagtaacattcgttgtcaacctcctcacgcgatgcagcttcacaacgcggaagattccctttggcggccactgccttgctccaaggaaccctcccgtacaactgctgacgcagcctcttatgatggtgcgtgcatcccccaggggtctctgtcgaagcctgagctcgacacagcagtcgcatgttgctgtgccgctgtctcctctgtagtaatgaagccgcccctgaccaaggcttcttcgtcgctttactaccagaaacagaattcgtctttttcgcttccggaaacccgcagtatccctcagtctgacagtcagcttttagggccgtcgggacagtcccctgcagaggcttcccctatggagggcaagcccttccgccgttatctgccgccgggaagctcgtctactccgttcccggattcctccacacctggagttgccgatgattcttgcaccctcgactccagctgggaaaatgcctccatcaccgcagcagggaagattgccgaatgcaagatgtccagttcaggacagtttcaaactgagggcggtggacttcgctcagactcgaggagttcagcagcatctttcctgtcgattttggaagatgagcttttctgcgccagagctcttgcgcaactccgtcacaacacgtctctgtcgccgcacgagttcatgaatgaacgtacccaaccagtggcccttgagttactaagaactggcttctctgcgccaaagaggcctttcgataattcgccttgttcgtcggcctatgcaacgcgtaaacctgtccattctggaaaaagttgtgttcacaagatgccaaagacggaagaaaaggcaacgccgggaagagaggggaaagtgcttcaaagacatgagattggcgaaactccagaaaaggcacagtctgcctccatgaccacacctttctctcagccatgtggacgagcccacaacttcgccaattcgttcgattcaattttgtgccctccttgcgccgctcagacacaacaagaatcatttgcaggacgttcggagtcccttgagtctttgtctcagctccctatctcctgccagatacatgtagccgctgaatcgaaaccaagtcacctacagcagtcggcaacacttttctcgctttcccctccttgtgacaaactgagctccctcccaacactgtgcgcgccttgcactgaccacagatgctgtccgaatgcctcaaagaattgctctgctagtgtcagcaaatccccaacgcatgagacccatcgagagttgagaccagctgcaggtagacttccgatatctccaacaggcaagcatacctcaccgcgagctcctgtggcacctcacattcagatcacagtgccgagggagccttcccctcaaacagcatcggttgatcagccagtgcctgaccagcagaaaactgaactcagggcaacggtagaaataacgaggaaggctcttctctcagctgcgcgacagagcgctgccttgtgttgcattccttcatctgtttcgcatgactctgaaacgccttcaatagagggatcttctcgagaggatgcagaatcagcatccctgttggaacagaatatattaacggacactaccattgcgaggaagctgtgtgtactagacatcatgtcaaacgcacagcctgcggtctgtcaatataatgacaggccagtgcaacgtgacacgaacgggccagccagcagacctcccgtgcctgccgtcaccgtttgcgcgtttgaagagcaatgtacaaccggaaaacgggatctcgccacaggtgtcacgacgattgccacacttccgacacacagccggacagcggaaagcgaagccgagagacggacgtcggcgacgcaagcacagccgatggtgtaccatccgtgggtgaacaacactgccttgttgtgctctcttaaagtcttcggctgtgaaacaggctcgcgaaaccactcatcagagacctttggagagcctcaccttggggagcgtctggaagacatcccgccgcggtccagaggtcaaaatatccatgcaatgttgtgtagtgagggggcccgacggagcgtgtaccgtcccaaaatgtcatccgggcacctcatgctaaggctcaagcctgggtcgttcgacgcgagtacctgctcagctgcatccgcggaagcactttccgctcgatcaaacgccggggaaaagcacctcgtctatccggtcgcaggacgccgttctggccagcgaaagcccgaaaccagcctgagtagcaaacaagcgatgatcaatttctacagtccgcgttttctggaccgtatagtgtcgcggaaccctgccacaggtttggtgtccggcagccccaaaagatcacagctgccagagctcagggaatcgacaagaaaacctacgcactcttatatgtttgtagttcgaatgcaagcaagggcagaagaaaggaggcagcgactggcacagctaaagctcaggtaggacgaagactctagagaaggggttgtacaacgacgtagattaaggggaggggaagatggggtgaactaaacaaagttcgcgtatggcttgaaatccgtatccactcaatcggtcttacgggggactctgcagtttatgcgaggctgcgaatattaccgcgtggctccgcagcaacaggaaagacaggattgcacccgcaacctaacgcagactacattttgcctccattgcacgttgcgcgaaagagacacgaccgctccaggtgctgctgcccgagttcccgcaatactagctctgctgctgaactaggcttgagtgtgaccattctctgtaggaaggcggaggcgctcgctcggcacaaagagctggaaaagttagtacgcacatacgttttatgagtgcatctcggctgagcggagagaaattgatccatcgccgtcgagacggatttcaggtgattgtatgtcggttcagaacatcttatttacggtataggggaccaccgccagtgaaatgagcctaccctcaaaattcgttgtgatgcagcagatgcgtccactggttgcgtcatga

SEQ ID NO: 1457 - DNA, 2088 bp, Toxoplasma gondii
aagcgaacgtccattccgtcttcgctctcgaagttttcgcagatgcacaggtccgccgccgcggacaagtttgggctcagccgagacgccgaggaagcagacgaagaggaagacgaagaggaagaagacgaagaggaagaagaagacgtagaaagagaagaagcgaaagaagagaaggaagaagtggaaggcaactgcacagatgctgcagccgacatcggagatgaatcaggtagattgagtgacggcgacgagagttgagaggttcctcccgttgccagatatgcattggcattctccccgattctcttcttcttcacgaatggcccttcgtcttcgtctcttccttcgagtctccgttcctccctccctgctgctcctccaggctgtacctcgacagtcctttcagcttctctgtgaacctctggccgttcccctgcggagagggcgccaagtgaggacgacggcatgctgtttgaaagcgaaactgaaagagtcggaggcgaagacggagaagaacaccagagcagaaagagaaggcagcaggtcctgcagccggcgcttctgcatgcggaacggaggtcctggatgcgagacactaaacagcgaaaaaacgcatgcgagcgcgagagggacagggtggaatgtagacgtttgggtggagagagataggcgaacgaggagagagagggaaatgcagagattgataagtagaacgagatagagagggacggaggaaaagagaggtatacagagaaaaactcagaggaagagagagacagatggaaaggagcagaagcgagcagagagaggggagtaaacagaggtccgtggaaaagagaggaatacgaactgatatgcagagaaagagcaaaacccaaggatggaaagagacgaactgagttgagacgtgagagaagaaggtcgagattcactgcgcgtaaaagccgcagaaggttgaggcatggcacatcagtaaaaggaggcagcaaagaggagaagaagaaagacgagtcgacgtagccagcgagagatgaaagaagagcaaggagaaccttcaagacagaaaagagcgacaaacgaggcctttactatgcgtgtcttccaggtccgaaaagataaaggagcatgcagacgcgtcgcgagccagtggctccgtcagaagcgacgaaagaaaaaactgcgtctctcgtcctgagagaagttttcttgtttctcgctggtgttcttcctctctcctgtcgccacagtgtggttgatcggctggtgcatgcaatcgggccatggtcgccagagccccgtccgtgcatgccttttttgttcggcttctcctctccttcttctccttcttctccttcttctgtctctctccctccagaaccgtgggcggagtttctcgtcttttgtgttttctgaaatctgcggctaggggatgtttcttctcctgcggggatccttctctcttcctccccgattgaaagcgcagtgggagaaaagaacgctgccgcaaaaaggcctacactgtggaaagagcttgaccgcctcacaggcaagagtcgcctgaaacgtttctgttttctcccgagccgctgagttgcctgatcgaaatctccgcaggcctctgtctgttctctgtgactgtcggggggccgtagccgtttgtcatgtctcctttgtctccgtgtctccggtctccccaagccgtccctcgaccagtcgtcgatttcttcttcagtttcctcgtgctctctcgtgacgggagccgttcgttcatgtttcttcctctgggtttcgagtctccctcgaagttcagcgccgccaacgaaagtggaggtccgtctctgccgactcgcgttcagaagagagagaagagaaactccgagaaaaaatagcgcagccggtcctcctctctctgcgtgcctcttctctgtcccttcctcatctccgacggcttcttttctctcttcctttcctctctttgccctctctcatcttctccctcgcttctgtttcctttctcgtacaccttccctactgaggcgttcctctgtcggtgtatctccttctgttccgcgcgtcttcctgcca

SEQ ID NO: 1458 - DNA, 2179 bp, Toxoplasma gondii
gtggtgtttggcgtcgctttagcagtgtgatgtttaggagctttccggggaaaggactcgcgtttacaaagtccactccaaaatggtcgtttgttggtaagcgacagtcgcttactgcagatgcggtttcgtcatgatcgggaaaacgtcattaagagaactggtgcttccactcgcgtagaatgatgtgctgagagttgaagaagatacttccgcgattcatgtctcttcaaggaggaaccattctcattgaggccctggcagaaacgagagaagtgatcctgcgtatgggttgtcctgtttttcttggcgcgacagagaaacgcgccgtgtcagcacgagcagtgtccgcctctctaggtcggacaggaattcacagacgcgacacagcggattttcaggaaggcagtgactgtgatcgacagaaaactccagaaaagttctacgagggttgacaaaggactgaagagcacgagcggctgctgtcacttgccgttactggcaatttttactgtcagcatgggactttggtggaacgtacacttaatcaaatgactccaagaagttactgtacgcgttcgtgcgttcacagtcgtttgtttatcgctcaggaggatcagcgatgaaccacagagactggaccctgtggatatttggaaactcaacgtctattcacaagctgtacaacagtcttgccgtacactttgtcagtatctccttcccatgttcgtccgcacacactccttcggtcgcgctttgtgtatcaccgccagtggagtcggtagtgtgctacttactttttctcctcactttcccgcgcacttcatcgcgcattctgatattttctccacttttcgaggtcacgcgaatgcagcacatgttctataagctgccgcaatggagtcccctttttgttacagtttgcttcttcgcggagtcttttgctggaacgctctgaattctgaggcagctgactcgccctttcaaggattcgctctccggtgtcgtatccttacttctgtccagttccttggtgcatctgcctttgtgggaatgtgcagaggccgcgtctaccgcttgtctggccacagtgttctctgagacggctgtgatctcggttgccgccgttatgggattcggccaagacacattgccatgtggatcattgctcatgtctcgcggagccactgcaagatttaaacagcgtactttgacgtacaacacaaacagcgaaactgtgggattcgaacatccggcgcgagatcaggttttttggctctgaggagaaaagttcggttgctcttgttattctcaatctcttcaccgctcgacactcgtctgccgaagagaaacgcaacgtcaagaatcacatcgattgctgagaaaacttgactctctcagggtctcatttctcttttttccgggccgtccgttccgtgccgactgaagttgaagacgcggcaactcgggaaaaaggctgcatgcacggagaaagctgccgttttctctccgtgacgtccgtttctctttattctttctaaatcgatgaagaggcttcttttctcgacgcgtctcccgcgtgcgatctgcgattctcattcgtttgttctctggaaaaccgtccgccgactctctctcgcgtgttccagttcccttttcgaaggcaggaaaagttaccgagcctccctgttttctttgcctctttctttttgcgtatcactcccactgggcccgcttcttttcgactgaaaaacgctcgtcgccgtcggactttgttttttcgcggtcttccggccgtacgttcgcatgcagtctgcttttttttccttcgcgtcgactgtcccggttcgatcgtttcctttcttttcctcaacactccgaatgtttgttcttcaccgcttttccgccctttcctccgattcttctcggttcctccactcctctggacgggatgcgctacctctggcatccatgtctctccagattcgctaacagacctgttttcgccttctcccagggtgggtcgacctgccccgcttcccgccgctcttctctttctctccgtccaagtcgcgtcattctcgcgcctcctccttgcttcgtctctctgctgcgcctgcgtctgagtctcgtctttctgagtctgccgttggtggattttttctcgcgtcgccaaaaa

SEQ ID NO: 1459 - DNA, 3594 bp, Toxoplasma gondii
tcctttcttagtccgagcatgaaccaccgaatttggtgttggacaccgggaaaatcgttttttgcgataatctcgccatggagctcaactgcgggggatttgatgcatcgcggtactccagctggcttgcaggtcgattaatgaatatctggcgattacaccatccggacacgctgccgttttgagagtactccacgtctacaaagccacacgattcctgaagtttgtgttagctatacacccgttgcaacctacagactttttgcgctggggttttgtgcgttcagccatgaagcccagcatatcatcaaagttcgctacagcagagaattgcttcgatggatctctccgtacataatatcggctgggtgcagttacagtagagttcattagcgcatacaaagcattttctgaaaacgttcaagatccaccgtaagaagtgcttttcagctcggaaaggcgaactgcatgaacgttatgaggtgaaatagcctccgagaatgttccgcgaataacctggattgtatggcaagcctgaatttggcatgggtggacaaaggcaaactccgtatgcgtgttcaatacccgcaacacttgaaaaaacagaagtgacggatcaatgccggtgaaagaaggcggcgccgcataaatgaccgtctccgcgaacatgctacaactcacaagggcaggtgacggtatatcctctgtacgtggcatttctatcacacagtcacaaactcgacgggaatctggtgtttctggttttactgactcatacgtgacaatacaagactcctgaacgtttgctgttcggtacaattactgtcaccgtttttcgcggcactatcttttcaactgaaaagacacctgctagaaaaatgtgtccgatgccgtgtgatactgtggcactgtgttctgtagatgaagcctgctctgtagaggagcaactctgcctgaagcttacagtcgattttcgttttgactggcacatgcccgtgctccacgattacgggactctcgtggggttttccgcactttcgggtgaacgcccctctcctgggtgtccctactgggctaacatccctcagacgggcagtgccctggacgagatcataggatccctgtgtccctgaaagaaaagtcagagcaacaattgagctggatgagcgcgactgtttcttggagaaaatgcttgggagatccgtcgagcacgacagcctctgacttaatttgccgcgttcagtcacagagtgcactgtggtcgttatgcgtcagcagctctattctttgtgtgtgcatcgaagggtcgcacaggatcttgaaatattccaccgcattgggaggctcccacgcttcatgaggttcgttagcagtgtgctcgaactgtcgcgttttacggatcacacggattcctaaggaaaaggttgcaaggcagtttgcatgaaactagacttcatcccgtacttccgacgcactgttgaactgtgtagcgacgaatcgctctgccgcctgtttgtcaatcgatttggcctcgcaggaactgatcagtgccttcatgtgaatcgccttggcttccgatttccattgctgcagtgaccgaggcaaggagcagtagcgttggtaaacgcttgactgaagcaagtgaaagcagtgcgcttttaggagacagtcagtgtcttggatttgtggccggtacaagactgtggacagcgcagcgaatggtcacctgccagcgtgggtacgcacggggtagcttgtgttctaacctggcagtccgttctgcttgcgaaggttgtccgaggtcctggaaccggaggttcaactgtcgaatatcgcagtgcaacagcaaacagttgggcaaattgtgtcaagcatttcctctcgcgaaccaagcagttgtggataagtttgtgacacgcgacagacgtgtgcacttcgactgtgacacttccctttctcccagaaaacaggactcgaagagtggatgatcatacacgttcttccgtacatttgtgagcggactcatcacacaggcccaagactttgcccactctttttgttcgggactgagcgtttagttgttgacgacttcgatttcgatgtcagattacgcattcatagaaagccctccgtacttgagagcaggaaatgacataaaacacaccgggatgcaaacagtccgtggacgcaagaaagcctttcctggaaaacgagcgccatccgacgccgcaaacacacagttcgacttcaacagatgagcaacacgtcgaccagtagaagcgtatgtaagagcccccgcgcatcaaacccacaaacactgctgaggtcgaacaatgagcagaagcctacccacaatttacagccatctgtgtaaaactaccgcccggcttcgaacagtggaatcattccacaatcaatatccgctgcagttcctgcacgtgccagagacactctacgacctgagtctcaatatgttatgagccaacgtttccgcgtatttaacatactttggcaccacggttcgtttgcagtcaaaagcatgttttgaggacgaagttcatcacactgtagttatgtagttatagcctcgatgtgagcatcgtcccaactgatgctcgtagaactcatggcaagattttgggggcttgaggcaataattactcactttcttcaaaccgtcatggccactgaactgacctggcttccaagaaacaggtggcttcgagcctctggtgtacatgacatccttgtaaagacgttcccgcgccgtggttgccattgcaaaacactgttacagagccagagaaatacaccaacggagttagctaatgaattcgcatgaacctacgttcgaaagttcgatcatggctatggatgcaagggacagaagggtccagcgaacaaatagggaggcttcactgagctcggtaagtgactcagagagtccagaaaaaaaactggccccgtgtggggctgctgctgagatgagacattgagaacgaagttctccgatgcggcagttccactgtaggcctctgttacgtctaacgagttctggcgtttgaaaattccaatcgaacacggcagtatggaagacactggagcggtagcataactgccgtattgttttttctgggtggctgcagcctctctacctcacactagatactcagttgcacgacggtcgcattgttttactttcgtaggtttgatttactggatacatactctgaaaacagcattcggtcatgcggctacgtcaattatctgccacatcgttcgaggtggtgtgatagaacagttgaccaggctccatcccggaactcttcgagtttaaaggcgtctgtggacagcagggcaaatggtggtaaagcgtgcagtgccagagattcggttctgctcggttattcgtctatgacgtacttcacccatttagcctaaatgcgtgcactccttccctctggtcttctgccttgggccgtaaaagcttgtggaccattcacttctggggggaacccgcgacgaggcttctgtatcacacgcgaatatagcagggcagccgagtatggggttgtttcagaaacgacggaagca

SEQ ID NO: 1460 - DNA, 4380 bp, Toxoplasma gondii
tcttttcttctcgcctctttcctctttcctcctctcatttcgcgcgccgtccgacccctccattctgttgaagccggtcgcctctgtgtctcggactcccagcgcggtggcactggcggccatgcgaggagctgagacgcgttttcttttgacactcgaagttaccgcgtttcagtggatgagcaccatacaatggaaacctcgggaactcgaaagattcctacgaaaggatgaactgcataggctgcatcggggcccaagattagatgttcactgcgactgacggaagtcaagcatgagtccgtctaccacgtctagaccgtgatcgaccggaagtaaatgaacttcgccaacttcttctcgacgtaccccgacggcggagccaatcatgacgaggagggggatgaggtggaggcccatgagggggagacgcagctgagtgacgcctgcgtcgctgagactcgcgtcgacatggaagcaaaaaaagggaatgatcgcgatggcgtagtccgggacgctcggcggcggaaagagaacgcgcgccgcgacgacgagaggaaagcagaccgctgagaggaagaggatgaagaagaacagagaagtcccgttcgggcgacacgcgtggagtttccatgcgaggcatgcaaggttgaggcggcatcgcggccgctctgcgtcgtctgcgcgcgcctccaactccgcagccaccaggttctgaaaggaggtcgagcgtccgacccactccctgtcttccctcctcggagagccgcggccgtcctctctcccacggtctgggctgcttctttcggaagcgtctccctcgcctgccgtcccccgctcgataaaggatgcttctcctcgagtcgagtcttcgaagtccccttctcccccctcccctgcctgcgcgcggcttgttccgccgagccagccgcgcccaggtgtatgtacaccccagctcgggagccgcgggaagacgcggggcccttctggacttcgggggacacgccgcgcctccggtgtatgtacaccaggtcccgcgccgcccgcgtctctgtttcgcacgggcagaggcgtcgcgggcgccgcatcagggaaagcctcaattgaggacagagaagggagaagagcagacggcgggggctgcgggtctgcgaggaagtctggagacgcttccgcgatggccacagaagaggcagaagcggtggacaagctggaagcgacaaaggagtgccgcggagaagccactagactcgacagacggaaatgcggaggcaccggaaggccgggagaaagtgaaagtgaactcctcgactccccagctcctcgcgaagacacgagagaagaagaggcctccggccgcgtcgctgagggttcgagaagagacgccgagaacaggaaggagaagagcgaagagagccgcgggcgtcccgagttctccgcgtcgggctccgctgctcgactgtctcgacactcgaagggcaagtccgcgggcggagcctctgcctcactcgctgcgtctctcacggcaacgctgtcgccttctcgcgactgctcaccttccacgacgaccatcgtgcactcacgagaagccgaagaaacacccgcgtcagctatcgaggaagaatcgtcctcatacctctcttcgaagacaagacaggctgcagcatcctggacagtttccccccgttccggcttggccgaggaacaaatttccctcgaagacagagtcgaaccacaggaagaacacaacacaggagacacaagaggggtccttagaatacccactgaagaagaggaagaagaggaagatgaagaagatgaagaggagggagaagacggagtggaggaagaaggggaagaagatgagaaggaagcggaagaaggggaaggactcccttcgtcctcttcttcggtgtcgttcattccgacctctccgagagggtcggcgagcagcggggcctgctggcaccggcaggttggcgggaggagcccccagtgcggtggaattctggtctcctccatctctgctgaagttttccgggtttctctcgaaaaaaagcaccacccgacgcaagcggttccacgagagaaaaacagacagcagagaaacgccgcgcctctgtcggccacaggcgtctcggcggaggtcggaacggagagaggaggaaaaaagaaaatgtagtccgtgctatccgcgacgcacacccaggcaggcagaaggaagggaactcacttcaggagagcgcatcggagccgtgaggacggcacaaataacttcgcaagtcgagacacagcggacatgcatgaacggaccaaaaccatcacaagacggatgcaaccacgagtatccgtctctctgtcgctctctctctgatccgtttcttcctttgtctggcgagagatacactaccgggaaaggtgacggggaagcagcgaccggagagacgacggttcctggtctctcaggctgctctcccgccgttttcgctgcgaaaaaagagaagacacacagcagaggcaggagctcacgatggccgcctctctgtacgtagcgatacggagaaacgcacgaaactttttctgaagagagcttccatggaggcggcgcagtacattcggaagacgcgattttctgtgatacagcgtctctgggagccttctctgagtgtcactcttacacgaagtggacgccgctgtccatctgtctgtctccataaacattcatcccctcgaattcacctccacatatccccactctcctctagcgatcaacctgttgatctctctccttgcctcggtctctgtcttcctgtcttgatctcattgtctgcctctttttctgtatccatccctacgtctgtctctttctcttactctcctcgctgtctacctctcggtctctctctccgtctacatctccctctctgcgtctccccctgtctccctgtcgctgcctatcggtccttctctccccccctctgcatctgttgctatgtctctgtcactttctccccatctctcgcacctcttacggttcaccctccgctgccgactgcttgctctgcttctccctgtctctgtctcctctgccagccagcgttggagggcgctgccgcgtctccgactgcgtttcagccgtgctctgcggcctgcccgcgaggggtcagacccatccggcgcgtgcattctgcatttttttctggattctctctctcgaaagccaggccgccttctcgaagtccggaggactctgcacggctctccaggtggcgtcgccttcgccgtctggtcgcgagcgtcgcgagccagcaacccaacgtgtggctctctgctagacacccgcgagactccgctgagaaatgtaaaaaaaacggaaacgcgagaaatccgccgcgctcgccgcgcatgcagaaacctggccgggtgtcggtacaacactggagcgcgaccctcccccagagctggtgccgcctttaagggaaccgcgaccgggacctgcggagacgccgaaagaagccttttcgccggcgcaggttggctcatacacgagtcgctctttggaccgagaaacttgaggcgagaaatcacataagtccccgaacggcctggtgtctgcagaatcccgtctctctgcgtcggattcctgcggactcgcaatgccgcgcggcgccgcagctgcgctagcgcgcccgccgcgagagagacggtcctggctggcaccgcgcggtcggctggggaagagactcgtcgcgtgccgttcgagagcggcgcgaagacacccgaaaaagagcagaacagaaagacaaccgcgagagacaaagcaggaagaaagaagcaaacagagatgacagagagaagagaaagccggggagaagggagagggcgggagaagaaaacggggagaaaggaagaagagcgggagacggagagaagaagcaaagggagacacgagagagatgttgagttggggagggagggcatgcgcgcccgcgcagagttccgcgagcctttccaaatcgcgaaggcgtcgcacacatgcagactgaagaaacagacggaaaaggccccgccgagtgtctagacaccagcagcagagaagacaaagaagagcgagaagaaagagagaagaaagagagaagaaagagagaagaaagagagaagaggaaagacgacgaaaggtcctcgccaagcgcccttcgcgcgtcggcgtcgttccgttttgcatgtgcctgcacagcaccgcgttgtgggcctcaaaactgtcggaataaactcaaagaaagtggaagggatgtcttagcgtttcgggctcctcgccccagacgcagaagtctcttccttctctcgaaactccacgcctatagtcctcctgaaagaaaa

SEQ ID NO: 1461 - DNA, 3414 bp, Toxoplasma gondii
ccaagaacagccgcgagtgggacattgttgtcacgttcaacgagttgtaagtggaggtaaatgtacacgtaggtgatccaggcaaagaggaaaagccccgtgactatgacaaggggaatcagcgacagccccctgacggcgcggctcgtcgcgtacatcgttttcaccgcaagcagacagacacgctctgcaaaagtgaggtggcaggctcaagctgcagttggtgcccagagaaaccctctggcatggtgcaaaaggcggacgcccgagaggaacgccgcacacagactccccgaaacagagacaagaaaaagaatcaatacggaggaagacgttacagtggggccgacagtacacacgatatgggaggtcgtgaaaaaggatctaaaggggaagcactttacccgcagtgcggcaagaactgaaacagccgcgcgagtcgtgggcacagcacacaccgggaaatgcagaccttcgtattacgttgatcatgaaacgtgcgtcgcaggactctgatccggtaacgaaaggccttcaaagtccgggccagtagtctaagtcgcagaagacactgtctagaacaacgtcataaatgctcctttgattcacgaccaacaaccgaacctccgtttaagcgtccagaaaatccatcgacagtgatatcgcaaaaaaactccagtgacggtttcacctgattcccgttggctcttcgaccgcagagtgctgaacgagccacacgccgacacgcgcggccaagggaaacgactgttagcagaagccttcccggatccaactgttgacgcttactagaaaggtcttttggcaatatggaaacgctgtctatatttctgtggactcttgagcgtctctcgtctgttcacaaaacagggggactcaaaccgcatagccggggggttcgctggaccgccaacagaaggcgaaaatcgttgttcagaaggaaacgagagagcgaaaacgagcgagaaaagcaacgcagatctaaaggtaacaacaaactcctccacacaaattacaaaaactccgtcgcggaagggttttggacttcgacgcgagatgacgagggagctgaacactctcacgagacgtggtgctggtaatggtgcgtcgagaccggagaagcaagcctaattacactggaatgtgtgtgagttcttattcagtggggtacttgggaacgatggacgctggcatcagcaactgataaacctgacacgaactatatttcatgttcccattaacagggtcgcgcgtcgactcagcggcgtgtggttcctaacttcatcacagggaaacggagacctgagacaaaaaacgccgccggaagcgcaccagaaaacccgcagaactggaaacttttcggaagtaccaaaacttgtgatagagacgagtcttgttgagcgaacgctcgatactagcgcctagcgaaaagagaccccaatggcagggccgagtcaagcattccttccattcagcgctttctgtgaaacagtctccagtaaggtcttgaaaatcggttaaaaggacataaatatctgcccctcgtttgcaatttcattctcattcagcaatttagcagatcgccggcatctcggccggccatgtgcctcgcagcttgcacggttcccatggctcagcaagctgacacatctgcgctatgtctctcgtgatttttccccatctgcatttccggtcaattctcaacccttcaaataagtaagtagatggcttccctggaaacactgcaagggcctgtcaacaaaagacaaaagggttcaagggttccgcagagagttccgcaggattcggcaaaagacacgggaaaaaccaagggtgcaaaagctcactatactgaggccggctaatagacgaaactacatggaaatgccaacgcttgcaccaggggaaagagtggcaagcccgtctcgaacatgtttttctcctgtttcgatcagcgatctgtttcaagctataaaaagcacacgtcgctctcagtccttgtgaagggagcgctcctgttcgttccagagaaacgctgcactgcagttcctgtaaacagtgtgtggcgatccgcgaaacggtactgcctgtacattttgaaaactagtgtatctggggttcttggggggaaatcagcctctcataccgttactagagaatctctatgtttaccgtcggtgacggaaatctccgtactagtgaacgtatctactcctgggtcatgccgctactgccacgaaagctggtaaaaccctagtacgaaagatagctatgtattcaaccacaccggtgccttttagagatctcggcttctctgtgcgatacgagagagcgtgccgatgtttcgtgagcgcagaagaacgggaacgtccgccgaagctgcggaaagcgatgcggacctaagtagaacactcagtggggggccggggtggcacgcgtgttggtggcgcgtttgttgcgcatttttgaaaatgctgaagggtgcccgtcaacgcggaggctttttcgtccctctatcgctcattactactctatcatgcattttttgtcacagctcgtgtcctcttcgcggctcctctatcccttgcagacacgtccttctgctctagtgttgacacttccacatgtctgatgcggacgtgagcgtgtcgaacgggggtatttgcgcagaccacactgcgctgtgctttgctcgcctaggtcaacgcgctactttcgcttaccggcccgagcggtggctgttactttcaaagtgtgatggtttttcgaaaggcgtcgcgtctgttgtctccgttccagtgtgttcacccagcgtttgggataggaacacgaacgtagttctccataccccagcctttccgagagccggtaagcgccgctgcggggagttttcctgagcgtatgtggttttgagcgttccacacatgtggtgcgagttttctccttgcgttttttcgacctttttcttccaatgagttggccgcagcctttcggatccgctaaaaccagccgacaattgcgcagaaggttctaccgtctggcggtgcagtgtgcaagcgtatgattataaacgactaccgtcgagttttctccgtccgacccgttcggcctgcgcgtcagaaaaacgtttccattccctaatcgtcaataggacatttcacaagtccaaacttctccgtgctgccggcttccagtccgttccccggagttagacaacacgagacatcgttcctcgtttctctgtgcgcaccggatttttcgcgggaaacgttaattattccaggtgtttttgcttgtccccgtttgttcatgtctcggcgctcccgcgttcttcattaagttgtccgtccgctccgtcggtaatccactctcggtattagtcacctctcgcagaca

SEQ ID NO: 1462 - DNA, 3662 bp, Toxoplasma gondii
  misc_feature (2427)..(2446): n is a, c, g, or t
tagagaagcaatttggaacgtggatgccctcgtcggcgcgacgcatcccgaagcattggagagataatcggagaagagaatgaaaaaccacgtggaatgcgacgtttggagcgttgagacaagagactgttctgaggtagacgcgtatccttatctgtttgttttcctgacagacccaggtcagacggagagagtgcgctgaccgacatatttccaatttttcgcggctgaattttcagaaaagttgacgtttacgacggaaaccacaaactcaggttgagaaggcattctgtggaactctcgtgcataaaacgattgcttcaacggccttccagaagccgtcctggccccgcgagctgtgaagaacgacaagatttccccggcatgttgctcaagggagtggcggcgacgtgtctctgctgtttttaaacaaatcggaggcgtcggttcgcgacgcggaaacctgtaagagacgtaactgtgccggatctccagaggattggaaggtaacgaagaaaagaagatgcaaacgtggatcctccgctccacggagtagttcaagatggagcgagcgacgaattttgacaaacgagacgggctcgtgaaaaaaaaaaaagggcaaaagccacctccgaaccggagggctgctgttctgttgtcgttttcctctcgcgcccacaaagagactttgacaaattcaccacgtgatcacgaagctcatcaactgtgggacacaaagagaacggaaacgaataggaaatgtccggcagatcgacacaccgtcggctttcagatgaagtccgtgccggcgaggtgacttctgcactagggtaacgacggagtcaagtttcaaagatcttgcggtgaaatgagcgattcatgaaacggaagactttttaaggagttctcctcaccgaagaaacccctaagagataaggaactgcgcgatgcagggaaagcagaaatatcaaaaacaactagcagcttggcaatttgctcaccgccggactctacacagttgagtcggcagcgacagtggcttgccgagaaaatcgggggagtttctccaatacactcgagggaatctcaggcaatctttccatgatattcagagggtttctgttcttccagtgtctccaaatggcgaaggaagttttcaaagtgctgcggcagatatgcgcatgcaacagagacgagggcctacgaccagcgcgggagctagcttgtcacgggaaaccgggttgttcctgaacatctttggcgagacaactggcacatggagaaaatgctgcgacgcgacagctccagccagcgattaaactgtagagatttcccgcggccgaaagcaaagtggactttagggtgtgacagttttctccgtgtagacaactgcccatcaacgcggcttgctacgggggcaaaagctaccggcaagacaatgccattgcgatggtgaagagcgacatgttcaggatctttacgatcggttcccgactgtcatgctgtcacgaatggttctgcattatcgggtcttgacgagtgattcaataatgtctggtctctatttttagcgcataagaatcacacgggctggacagttgaagtggccagcatgtagaagaagagcacttttgtgtgactcttaagtgctcccggagtaaccgcatccattcatggcatggctccaaaacaaatggtcgcttattcgttcccaacggttatgggaaagccttatgctgaaaaggaaaaggcgcattgtctgcagagtatattgtgcattcgggaattcacaagagttgatattcatcagtacacatgccccctgtatcgcaaccgcgcaactaaaccggtcgcatacatgtaaaatcaagggatagttctcgtagaaaaaagtggtaggtacctcacagccgcccatagagacagagtgaaaattcgtggaccgctgtccaccctgcttggacggcatgtagacaacaagactgtagatcgttccaagaacatcttccacagtgtacctttgcatttactcaaagctgaagtacagttttcaggcaagtaacgaaaaagctatgtacacgtgacatactgtgactaaagaatccctggacagcttcccttagggtagtcaattagtttcacagggtctgtggtagcggagatttccttctagctttcccctcgctttcgtatggcataaaagagaagccgtcaatccagtgacgaggggttccctgtgccgtcagcgtagatcagcaatcgcagacggcaacgcggtcatacatctcatcggctgtctgggagcgtcgtcccagttcgactgtatcaataatacgaaaaatgaacacaactcttttcggcgtgtgcgagcaaaaaaaatccccattttcggttctgctgttgaattgcaacctgctttccatgtgnnnnnnnnnnnnnnnnnnnngcccatagagacagagtgaaaattcgtggaccgctgtccaccctgcttggacggcatgtagacaacaagactgtagatcgttccaagaacatcttccacagtgtacctttgcatttactcaaagctgaagtacagttttcaggcaagtaacgaaaaagctatgtacacgtgacatactgtgactaaagaatccctggacagcttcccttagggtagtcaattagtttcacagggtctgtggtagcggagatttccttctagctttcccctcgctttcgtatggcataaaagagaagccgtcaatccagtgacgaggggttccctgtgccgtcagcgtagatcagcaatcgcagacggcaacgcggtcatacatctcatcggctgtctgggagcgtcgtcccagttcgactgtatcaataatacgaaaaatgaacacaactcttttcggcgtgtgcgagcaaaaaaaatccccattttcggttctgctgttgaattgcaacctgctttccattgttgttcttgtccgtcatgttctatgatccgagtatggtgtaaatttcgtgatttcggaagctctttctctgccataaattctacactcctctgcaagtatcaaagacacgcggcgcatgtactgaagagaacatgtcggtgatatatgcccagttcctcgggttcatcacactccaattctccaactcattcctttgttatgcggtcggattaaacccttgtggactccctttaggtattcctcaagcgagtctggtggattttgtattctcatctacattctgctcttctttgggtgcggtcctttaccatgtttgttccagtttcagacgtttcttcattataaaaatgtttcctcccgaagttgcagctctatgaatttcttttcgcctgctggtgtcggcggatgaccgctgctgcagccttgcttctgctgttgcactcaagcaaggctctcgaagacgaacttcccctatgctttcctcttgtatcctaagcgtcttagaaagcgagtggcacctcggcagacgtgcgaaaagttagtgttttttaattactctctcggctgacgagaccggggatgtctcggcgaacgccggggttcgttaccaaatgtccattcaataacactgttcaacccgggacttatgttgcaacagcaaaggtggaattcgtgccgcatgaagggacgcccagctgaaaa

SEQ ID NO: 1463 - DNA, 1456 bp, Toxoplasma gondii
tttgaatatttttctgcttttgccgctaaacagtatgcgagtgtaagcgtgctacgaaaccactgacggaatagggatgcatatctgcgcttgcagcgatataggtactttggtgggtgtcgataaacgtgcgatatagggatgtttgtccgttagatcggcctgtgtgcggtaggagtttgctcccgcgcttttttttgtgtctgagcctctcgcaactcggcggcgaggtccgactccctgatttttcttcctttttcgcgggacgaccgtgtaaggaacctcttgcagggttctggggagaaaagcccggttccgtgagactttttgcaagcgctgcgagttttgtcttctttccctgcaagcgaggctgctttgccgccagcagtgtacaccaaaatttgctttgtccccgagaaacgccagtccaaaagaatgaaaacccgtcattcgtggatgcatcggccattcccctcaaaaaaacagttcttagcggcgtgcgtatccacatcggcggagtgtgccactaagtcggtccccgatgcaaggcttcgatacatcaaacgtttgggcgtgcgtttttataaatgaaagttttgtaggattttgacaaggtggtttgggatacgtaagtctctcagcgagagcgggcgagttgagtagccaggacagacacgtagattcacacatgcatgcatcctcgcccactgcactagaaacgacctgagagagccgctgcatctaacggtactgggtggattcttagcgttctcgcaagtgcatagcagcaggttacccgagtttgcgcgagtttcacgctttcacacgtgctgtgcttggagctttgttgacggacaaggtctcgcgtagccttcagtactgggagcagcccaacaggaacaagtttcaggcctgcctcagagacactggttagcctaggacacccgttcacgttcctgtcagcatgcaatctaattcgtcaggctgcggcggctttcatggaagccgcgtgcgaaagcagaaatcccgtgaccctcaaatagaaaaaactgccacatgcgcgtttcgtagccgtcctcgtgcttagttgggaacttgtccgcgtgaaaaatcgtactactgtagtatgcacgcaattctcgaaatacaaaactacaaacatgctttcggatgtacggttcgaagttcgtggctcttgccgtctctcggcacacattctgaaactctgagctgcttgcagacgcggattgtacatatctcaggcatcacgtcagaacgcggtattacatgttatcgtgccctttataggttgtatctcaattgtgtgtttacctaccttctactggcacactggagtgattctgaccaccgtgagagttgccagataccacgtctgaagcgaccactccaggctatcagcggtttgcacacgtgtttgccctcggcgggataacga

SEQ ID NO: 1464 - DNA, 2166 bp, Toxoplasma gondii
gtccagctggatgtacagcggaggttctcgtgattccagctccacaagcgccagcactgccgccttctttgctgctgtggcgagccgatgcattcgcaccagtgatacgggataaagcgcagagaactccaaggttttttgacattcttccagcggtctgaaaacgtcggtagctcgtgggtcctctgctgtgtccaccgaacggtggagaaccgggttgtgttccgtagccgtatcgaggagcatacgcgaaggacaagaatctggagggttcagtctgcgcaggaaccgtcctctgttagagcgcgaacagcgcatgcactcttgagaattacatctcttctcgggagccactacaacgaacacgagagctgccgcatgacacagagatggagagagtgggtacagcagccagtcgccgccatatgcaaggccgtcccgaacgaagaagccttttcgatgcaaatcgacgaaaacacgagaccgagcagcctctgccttcctcacgcgtacactcgacccacccatggagatgataggcgaaggatttaaagcaggaagggacagtacaaagacggggagagcctcgcttgagcacttccaggggcagacgcgacctggttgcgtcaaccaagcccctacctcctttcccgacaccaaacagttgtatttctgttcagaggcagtcaggtctgccccgctgttcgcagcatccctgtgaccggaacatgtatggttctgccgctccacctccccaccgagtagaacacgagactggctagcagaaagaagaaaaatctccctttccaacttgaaaatgtttgtctttctccttccatctggccctagacgatgttgaccatcacagccgcccccctgttgaagccgcggtctcttcctcgttttctctaccaatggcttaaactggatagctagcaaccgatgcgtttccaaagcgtcacgtagacgacgcgaataaaataggagactcatgttgaactccgactcggaagaggacagaacgatagggttccgcgactgcgcaaggttgactggggaaggatcctgcgacgaagaatggccttctttcctggcgtcatcgttatcaggactctccaaaaggacttcagttccactttcaccttccgggacaaaaaagcgcagacactgggcacaaacgaaacccccgtagccacgcatcgccaaatgggtttcgtcaagtccgagggggaacgggggtcgcggtgcctcctcgcggctagggccaaacggggcgaactctggttcctgatcgagggtgaaaaaagcattctctttcctcgtcattttgtcgacgaagtccttctcagctgccattcacaccaagatccttggaacgcgctcagcgtcacaaaacaatcgctggcgcagacgccgcgatgaagaaagttgaaagttctgatgcaccacaatcgagcaaagagagatgtttgagtagggaaggggaaacaagttattcatttttctcacaataagggtatttttcgttgtctcccaaaccatatctgcgcagagaccgccgcctctcgattgcatgtgcatgcgcgtctgtcctgtattagatgcatacacgttactattgtcgatgtcgagtagctcgttttagcttcatgtccacagcgctaagtacaagacttgtgggacaagtaagaagtacggagattcgccgtactcgtaggagaaagttgagttttctgtttccttgtttttccaacattcaggcgcaaatgacctcaagcgttgtggcgctggtcgtttaggccgttgtctgtcatggtagaatgtgacttgaggcgtctacgatatcgtcggcgattgtgcggtactttctctttcgttttcctgatatctacctttctattacacgctgcagctggtctggtgttagccatgttgcaggggaatgctgtacgttttgaagcggtgacacactggatctgtcaggcggcctgttgacaggacagctcgcgccgttgcatgcagaagcctgcatcgggcactcggtagtgaaatgagagcatttcgtcaggcaataatcgatttcttactcgcaggaattgcaggtcttggccggatttgaattcacagctggttcctcctcggtttcgctcgccactgcatctacga

SEQ ID NO: 1465 - DNA, 3086 bp, Toxoplasma gondii
tataaacagatatgaagtggtacagaagatccacatagcgactgcagaaaactagcagatacatctcctgcatgcggcatgagatcccgacgcagtttttcgatcgtcgcagcttgagaagcagcaagacgatcgaaagaaggtgaagcatatcaccagcgaaacgaaaggcattcatcgccatcttgactacgagaacggtacaaaaatcctacacgaagtcgctgcctctcccacgcaggtgaacgcgtccttctggtgccgtacgccgcggaaactcgcccacgaagaaacccgacgatatggagggacgcttggcacctcgtacctttctggataacccagatgtttccacgacctccacgcttcgtttctaccgagaatgctcacgatgagcctcgtgttatccgcgacggatctgctatgcgatgatcagcatcctcttgaaggggaagaacccacgtgccctacagctagacactcgtcgggaatacagtaagtggcgctacgcagttttgacggctttgtgctcctgcgtgctgctcttcgtcgagcttcgctacgaacctgcaaaaccacatttgagacagggccaagtataagacgcttgcaacagcttgtaaaagaaacccggcttgctccaaacagcaaagaacaggcttcgagtcctccctgccactgcttgtgcttcgttgtccacactccacactcaaaaagagaatccatatttaccgctgacacacgggaaatgtctctcgaagatgggatttgcgttcctcttctacaaaaaggtaccagccggctctaacatccgatttacaaccctcctgctagtctgcgtcaaacactgtttgttgtctcttgatggtagcatgtacgtctcactgcgaacaagttttccctggtctcggtagcaccactgcccccgaggcaacgcttcggatcttccctaaaacgaacaatatctccattgtgttcttcgccacctcagcagtgccacctcggattctcaggtaagatggcgtagggtgaaggagagacgcacgatgaaaatgccactatatcctagacggcacacaaaagtgcgactttctctgcgtttttgaggaagccttcgggatgcagagtgtcccagaaccgaatagctcgggtgaggatcccaaagtaactcgtgcctcccgtaactcttaacggccagtatccgttttggtccacgcgggctcccctctactccataactcaattggcgcttttctgcataactcgacacttacttcgctgcggaaagaaattcgacaggcgcaggcgaacaccaagaaaaaagcctgtctcgacggttaggagtggaagtgaggcaccccatacaaccgtggatatatacggaggtcggcgatgaaacgccagctcgaatttcaggaggttcgaaaacaacttgtccccttgcttacactaattcctgcgcttctactcacggagtcgaagccggcaatctcatcgtattccctgctcgaatccacgaggaacaaacccgccgccttctgtcgtatcgtggagcaggctgggaggcttgtggagggagagtgcacagaaatgtacgggataccggaacgcagccgaggagaaacgactaggattcgacacactgtacaaaaaatacaaatccctccgcgatgaaccggtccaggaaacgaactctggcacccttcccgcgctcttcaccccgaacgcgcacagtagctccacactctgcgtgcctatacatgctaccacctctcctccggcacgctcctcaccccatttttggacgacttcgtgccaccagccagcctctttgttgagaagggggaagacgatctgagaaacggagcttttcagacagccgttacgctctgtagaattcgaaatttgcgctgaccgcagagaaacgcacactttcacacagaatacacgcgtcgacatcaccaaatacgggattgcgaacacacattcaacccaccacactgggggcggccaagaaagacgagactccagcaactgctggcgaagactgctctaggtcacagtcctgaacatgcaatgtacgaactgtctgtagaacttctttgcagctagcgaatttgacggttgcagaggctttcccaggaaatccagttaacgccgttgttcaaaaacggaagagcaaccactgaatgagaccgaatccccgtgatcaggtgcacgctttcgaggctgtctgtctccttgccaaatacgacacactaatacccaggagggttgcccacaacaaacagcaagcttcgtttatggagccggacttcgtttcttttgccgttatccactttaacgtcggatagccatcccaaaagaaactcgctcacatgcgtactggtttcagaatcgagaggtgactttttctggcaactccggcgctagttcgcaaggtgctcgtgactttctgggattctcgcactcgactgttttttgagtcatttcttaaatgttctttcaatcccaatccaatattagaagtcgctggtgctggccttgggatatgctgaatcaaagggacgaccgtgcgggcctttccgctttgcctcgtctcagttcgtcgaaaacaacaagcttcgacggtgagacggaccggccaaaagtgaaactcgtgtttggtgtttatcgcctggtcaagatctttaaggagtttctgaaccttcttccgtagctgctgaagcgccgcgatgtcttgcttgcggagcctcggttttacgaccaggctttctacctgcaacaccgcggaacgaaactgtggcgggcctttccaattttgaattcgcctcatctggatcccttattccttcttgcgtactggagccgtctaccagaaaggactgtagtggcgttgtacgagactgtgtacacaggcgccgtgaagtgactcgcctctgtgccatcttacggcgatcaggtgcagccttcgcagccgacacaacctgcctgagtggttctttctttgtgatgggatacgccgcttcagggaagaaaggacgaaattcgttgtcgacggcctactctccgtcgcttctccaaaa

SEQ ID NO: 1466 - DNA, 2221 bp, Toxoplasma gondii
agcatagctggctctgctaaagcgagtgatgcgaaagcgggtttccacgctacacgttcatattcgtagcacacggacagctggtaatatctggtgcagaaatatcgctgttttgtgaaagaacatgtgaggtgcctctgtgtgtctgtgcatccgcttcagatagccagctggagttgctagaagatattctcgaacttttgaatcccgagttgttcacaagttccgaactcctgccaaagtcgcttcacgcgctgcgcgtggccgttgcctcactaaacattatcaccgacgcccacacaattgttcgcgatattgaacaggctgtttttcgaaatgttgacccggtcaccattgttaagtcataacgggccaatcttttaaacattgcgagggacgcaaactcgatgaggggtatttccagggtccccgtttcgcattttcgttgttcgtgttccagcggggtaacttctgcttgataagggatgatgaaaacaaactgacttcttttttttacggagtcctcgtgttttcaagttagctcgagggagacggttgagtagattgtgaacgatacagggtccgatatatgcccttaagtggaatcctctcgcactccttgacatgtagcacggtttgggactggagctcaacaaagcataacgctgaggaaacggcatcacttctgcgacagttagaaacttaaggaacccgctgcacaaatgtccaatttttttccccaggcaattcctgtacccttcagctcctatgttccacgtagatccgacgaaatggtaactagtttgcttgaagaagaccactaggctgacgctcgttcaaatattgcgtgtgttcggtgttcctcgaacgttcctttctctatgggtttcacctctcacccgaaagaaacgagccgcaataaaggtacctagtgcgtagttgagtgttcttcgttgatattcgtgtgcaccatccgaccatcgacttcgtatctgatagatctcgtgagatcatgttcttcattgtagcacattctggcaaaatctgtggcagaacgccgatcaggactcacagaactacgcgtgcaacttctccgacctcgattccctataaatttgccctccccatggaaaaggagagtggcacagaacaccatcttgctttcagacttcagtgttcgtctattagtcaaccgatttgtttcgtgttctctaggagtctctcctcgtattaggtacgagcagccgcagctcgaagagctggcagtgagataccaacagcggccacggtgtacgcaaaaaagaaatgctgttccggcacttgtcctactcataaaacccagattgacgtggaaaacgaaatgacgttttccttcctttgtgctgttaatcggccgcgatactgtagcgctgccgtcgatgtctcttcattcggaaggtagacaaaactgtcggctgcaagaccccggcagacgccacacggatttagagaagtgcaccgcaggatttggcttgtctttcttatcccatgaaaccttttcagagaacggtgtctccgcaaactttctgaccccgttcaatgaattctctcgtttcgctagcagctgcatctgacagtgtggacgtgtgggtgcccacccagacaacacgcctctgcgcagtccaccctccaactctttccactatctgcaagttagttacaatccactacctttccttttctggatcaactagaagcgcgcaaacaacgccgcgtttccctccgcgaacacttgcgtgtcagtgcatttttcagcgacttgcgtgctcgatttttcccgtgctgggcttgggagtttcctcttgccttgcaagggtgtgacggaattccgggaattcaccgatccgctgaacagcgagcgtttccgcatggtgcgaccactaggtgtatgtagcgaagggttgcatttcttgtctgaaaaaggaaattttcttggcaattgtggacgttgcacaagtctctgaccagcgaatccgccctttccccgaacgcggcgcccgctgctggttgcgtacccgggcaacgacagagtgcgtagatgaggattttcgagggtctgcctcacgggattcgaaacttctttagactcggctcctacgggcgaaaggctttcacgtagatgtgcttttctgtcagcaacgacctacctacacaagttgtctttggggaaaggcatccaaga

SEQ ID NO: 1467 - DNA, 4603 bp, Toxoplasma gondii
ggccgcaaacgctggacgctgtggaaacatgcgccatgtaccattcagtgatcaacagtacgcacgtatgttttaaattgatgcatccgacagtttcggaaaaccagttccacgagcacaggccagctatatctgcgtcgatgagggcagcgctccaggacgacttggtgcggtgaacctcccacatctttcggctaggcaaagcgccttcagagcgacaaccacgaacaacgctgataagtcttcaacaaggtcctcctgatctgacacaccacacttacgtattcgatggcggcaggaatgttgaagtggtcgcagatcttcttcatttcatccaccttgggatcctccacagcgatagacagctgaacccgcctgcccatggccgctgtgcgttttttattgatgtacgcaggataaacaatttgccaccgactccggtcgaccccgtcgttctgcatcattcctgcttcatccgagtgctgatccatgcccacactaggaccgcctggcatgccgccgagcatctgcgctagaagctctggggataaaccctctggaagacctgcgggcattccgcctaatgcagcggcgtctaaacctccaggaaatccccctggaagtcctccaggaaatccccctggaagtcctccaggaaatccagctgggaatcctccagggaatccccccggcatgccgccgccttggcggcgctggtctcgctgccgccccatgacagtagaaaacaagaaattctccgcttccaccggcacgcctatactcccatagtaagctggcggtcagacttcccgatccactcacaaagcgcacttccgcaaaagacagacaaggcaagaacacggaagacgctggacaacggcagtcaggtggagctgcttgagcccaccgtccgacgacttccggtctttttcctagtgacagaagacaggcaacacgacgtggaaaaggtgcagcaaaacttaggacaaatcgccgtccaccaccgaagaaaacatgagggtatgcaacgtgagtatacaggcgacagagtactgtagtctctagttggaaatgggaattactcggtagatagcaagactgtgaaacgagaggcggaaccgaaaaattgagggggtggcgctgtaggacatccggttcccttcccgtgagtacggtttctcaaaacctgcatagaaccccacaaaattgacagaagttatgtaaggggaggaagaattgaacactcacgtctcttctcaaagcgcagccgacagatgccgggtcgcaaacgccgaggtttaggcctcagatggcatgcacacgagcagagcttctcctcgtcctcgtgacttctctcatcagaccgcaagaatcatcattctccggaccacactgggaccgcctccttgcaagcaaaacacgacttcctttacgcgctttcaccgttgcccttgcgaatttctaccccgacgtatgttggctgggccttcggccgaaggtgtcagattgtctgcaggatcttggtcactcacaagcgcgtgcatgcaagaaaaattttgatttatggttagcttgtaagaccgaacccggcaacggacgcactggagaacggcctataccgctgctaaagtttgtgaacgcatcgtaagctcgctcggtgcagtcatttcttttctgattcaggctggtgatgagttacacaccaatacacaaagtcacattaattgtatgcagcagcccagaaaagttcaaatgccgtgcaaggtcataaaacgcgctgccatggcgccaattgacgtatgcgattcttaggtcaccgtgaaatggggtaggaaagacgaccgctacggccaagtgtgttatctctgggacctcaaaagattccaaggcttacagaacagcagtagttccaagcaagagcgctacctaaaacagtagttaccgataccaccagcgactctctgttcgtgcatgtccgcccccttggtggccccacgaatttgctttcctagagatgcagttttttctagatagttcggaatttgccggacacggatccggttttgggcatgcaagacacgtgtctggcgacgttatcctgccaagcactggtcttgcctgaaggcccacgcgagcatcgcaccttggtgatcccggcagggctccttactgccactgatagaggatgtttcagtcaggaagccttttgagctttcgaataccgaaaaccggattttcctatgagcaattgctggtaacgccacatcggaatattctgttctgctcctgttgcaacgcagagcccgtggcctcaagtacctaccttctcagcacctgcgtttctttgaatttgttatcttctcgcccagcatatggccctatccggtgctacggtgggaatctttagggagggtttgtatagtaaaccccataacgttgggtggatgcagaactacattgtatatgatatcttcggaaccattcacaatctgtttcctacatttcgtagaatcacgcctgcaacaagcctgaccaaactctcatagtcgcgtcgcgtgccaactcatcgatacaaactctggcatccctctagacgcggtagttccccgccttttcggtccttcctgtttcgtgccacggccactgttgcacgattgtgtccgctggtcactacttagttttagcggagctctcaatgctagtttttcatagagccttgaccgtcaacgttttttagggtaggatagtgattagcgatgacctccaggtgggtggtcggctcactccctccaagacattccgcaggacgagaactggttccatttctacaatggttggcacctttacgatctgctaacacaaccgaacgcggatcccgtaaagtgtgacattcatcttggtctccattgcaacttgtagatctcacacttacgcgaggaaggctgatgccaacaagccaaatgttttactggatgccactctgttgggaaatcaagaccgttcacgacagtgcgaagagctggggaatcaggtgcatccggggacacgggataacgtcacacactgacaggttcaaactctacatttgtggactaaacctatatttctctccttatggcacgtagtcgtaactgttacatgagcgcctcggctccagcaaacccggacggccgatggcctgggtgcacagggacaaatgcgggtggaaagtggtcaaaagagagatgctacaaggaatcacaacatgcagggatacttgttgcgtagcaggcatgtcccgctaccaataatgcctctttgatggcgtagagcaacacctgcaccaccctcgagcaataagagtgggaagccgtgattagcgacacgatgccagagcataaactgacaaagggataccacaagccatggagcgaaatgaagaagcaactactggtgcggctcaagcacccgagctcgctgcgtttgctgaaccgtggaaaatccctttttctgatagactacgtgtcgcgataggttatgccaacgaggatgtctctggatcgacaaaccaactgaatacaactccctcactttcagcctactgaccgcacctacagatcctccacaattccaaaaattctccatggtttagccttcccccagctcgcctccccctccccctgctagtcccgctctcctggtcacaggggacatggcgttgagtaaatctacgacggcctccgtccttggatgagtgcagacggtttgagcgagtgccacaacaggctctctgttgcttttccgccattaactaaccttgccattcgaacttcactggtgccatcaccttcaaaatagcatgtgaactatcccttgagccaccacgtgcagatgcctgttattgtgcgggttaaacattctgcaataaccgtcaggtatgtggagaaacgcaacatcccaatgttcttgacgcaggatagaatgtcagtgcgcaggcaatcatgcctgacggggtcaaatctgtgtgcacctgcgagcgaccgcgacggtagccccggattgcgttgcagaacggcggcaggcgtgtacaagcatgcaccctcctgcagcggttgacagcccaccgttgtttggaagtgtatatagtttcttttttctacgagcacgctatctctcatcttcgagcaccgaagtaggctttttgagtcgcctttcttgaggcctcgtgaactggattttggtgtaccgcgcgccacaacattcctcaagttcttcctgactcagcctggcgagacacctgggcggcaatccaacgtcaagggagacagcgagatttctgttgaagtttaaaaggacaacaccttcttttccaaggagtgcgaagaaaaaccaggcaactgcgtcaactgtgtgagcagagagggtcagaggggccgaaaacttcgtttgatcaagcttttcgcgccgcgctgagcggactgtgcaggcagaatcggactaattgttcacgtccggatttcccgtcagcgatatagtcgtattttgcggagagggtaccatcttttatgtttccagaaagggtgtttagagcgtgtcatattccgttggtaactaagaggcaaga

SEQ ID NO: 1468 - DNA, 2565 bp, Toxoplasma gondii
cgatgaaacattaacgcccacaactgtctgctccagttcttcattgcttccacgaaggcgtgccatccggctaagcgcgagtcggggtcctttgtgtttcgtcatgttttttttttgtttcattccacgtttttaagaggagagaaactggttctgagggcaccgcagcatgtctttgcactaagcagaggcaaaacgacacatgatacaggaaacgaaacaagaacatgcttgctatacaattcatagtgcgttctttaacgggagagcgccgacctacacgtacgcattctccagacgattttttgcgtttcgtcaggttgtgtttgcgtttcgcagtttctaccacggcaaattccttttcccgggcgtttcttgaaacagctggttgctctcattggtacattttaaatttgttcttctgtttcggtggtcgatacacctttaacgacctttacaaaacgcagctctggctggaactgccgcgatgagatgctgacacgaaaacggatctgagagtacgtatgctctctcgaaagaactaaagaccgcgcgtagcctgaatcaaccgcacaatcgcatatctgtggatttgcctgcgttgaatcccactgccttcgtaaacccaaagctggtacgcgtaagatgttgaaacactttccgatggtctgtttgcttcttcaaacagtctagacaactttgaagtcgcgttatttaatttacacgacagagatgttggaattggtgtgctatacccgaggatagcgagagactctcgtaaatagtgtagaacgccatcctctggtccacaacgagcagcttcttcccctccctgcttgcggtaaacgcgtaagactgcattcgtcaaagcgcagctgctctgtctacctggaaagagaaacgaaagtggaaaagacacggtgaactaaaaacaggaagcgaacacccaccgaaacgagctggaaagcgaactggtgctaacgtgtgtaaaattcgatttgagggagttttgaatcgcggaccatttgcacattcacgatgtctgctgacaccgcattcctcgaaattagcgctcaccgttaccgaactcaagaagaattgtttcgtttcccccacaaacccatccggtggtaatgttaaaggtcgcagcttagagtccgaacgtctttatcagacggaaattgcgttttgccgaccgtgtacgttcgtgtacgcgcagaactccttcctatttgacagaagagcccgtttctctgctttccatcctacggtcgaagacaaacttttgtcctttctctgacaaatgggaagctgcttccgtcttctgagaaaagcgaacatccgcaagaaatccaccaaagagaagaagagctctgtcctgtcgcctccatagtgcgagacggtgtcttgcaaggggtggcgggtggagttcgcgatctgcgatgattcaaatctcttcttcaggttctttctcttggctttgtctttctttctctcctcgaagaaactcatctgcgggcttcaactcttttcggctgacaccacagccaccttcttcttcactttcgtctttccccctcagctcgcgacctgtcttggctgcttttatttgacaccccgtaagacgtctcgacacaccgccggttcccgcaatcaactccctgcgtcgagttttttcctgcgtgaaattggagaaaaagctttttcaaaggaattattgcatgcgccttctcgctctaaacatcttctgcggaacttgcagccaacctaaaaagcggcttggcaagacacaaccccgcctccgccgacgcgctcccagtttcttagttgagtcccggtgatttgtgttgaggtccctcgcgtctctcgaactttagaacttcaagaaggacatatttctcacatcgcaagtctcccagctcttttgcactgccggctctcggctgctgttctttttaaatccggtgcctctgcagaaaggtgtctttgcggccagcgcttctcttcgccgactgattttctggttctttaaagacaagaacgaaggctctgcaaagcgtttcataagtttcatcttctctccaaagcaagactagggattaccgctccctttttcactttgaacgagactcaggcgaatcgcagctcgggcttgtcggccttcgaaggaacgtcgttgttattttctgcaaccttcctcttgtctgcggagcctcggtttctctgtgcatttcctttcgagacaagccagacttgcgcaaagacgcctactgaaagaaagcggcgaggatccttgacaccacgcttctctgctgtttctcccctttcctatcttgtgtgtctgtagatatccccctgttcgagtgaaccacaggaagcaaacgtaacttcgctttcactggtccgtcactttactcgattcagtgatcacggttccccttcggcttccccctctgtttgtcgcttcctcgcaagggtggctgcgcagttcgtctcgcgttttgcccgtttgacgcgacgcttttccgagctcgctagcaagcgtttctgcgtttcttgaaagga

SEQ ID NO: 1469 - DNA, 3495 bp, Toxoplasma gondii
caaagacctcagcgtgactgtgaaggagagcatcgacacatgaaagccacacgacgaatgcacagacacaaggagaaacaatgattcatatacatacatatatatatatatatatacgtatacgcttgagcaggctgtgtgtgcggcgcggttctgtatgcagagggaagatccagaggcctgctccggagagggtcatacactgcactagagtgtcttcagaagcccgataaaccacgtaaattctaggtctcgacagtcgctgcactgcagatgaattgacaaacgtcggagtcggtggccagtacggagtctttactgagaaatcgacatgagagcgcgcccgtcagatggcgagaggccacccacacacaaaacacggcacggtcgataaaacctatcaactcatgatgttgaagataagggtaggtgtgcttcttcgaaaaaatgttcacccccttgggctaacgtctgcgtcaattcgtggattaaatatgtgtaaatgacgggagaggtatgtgggcaaagagcagtggcgacttccggaaggaacggaaatgattgacgaccagtagcttcagcagcataccagtccgtttacaggattcacgcgacactgatgcacaaacaatagggaggtgagttgcaaagccgcagcgacagtcgactgtggtactctgcctctagcctaaaaaggaacggtgaggggggagggggaactgcaattcaccgccgttcgatgaaccgtccgcccacgccatcgtcctccggccctttttccactttacccccctttttccaaagtagaaaatctagccgatgatgaaaaggcagctccgaaataaaatccgagggaatgtacgccggtactcgtatctattgacgcatttgagtgtgtagtgccgcgcgacggacgtcggacacctgtttcgtcgtcccctgaagtgaatttttcttttcttggccagttttctcggccgccacttctatttcgtacttgcggtttattctctcttgtcattttaaaaagctgacagtcgttttccccgacagtcagctgagtgaacgcggcgatgctgcgtgcgtccagggtggggagacctggcgaggcaggaaagccggtcactagcttgtctgtgcgttacgcgttttttttcttacctcccgcagaagctctggggcgcctttcagagtcgtggtgagcagaaacgccttcgtttgccttcttccccgcggcgcttccggcgttcgtcccggacagctgtttgccggtactttgcgtttctgctgtgggcacaggaggcgaagagagaatcacgtcctcttcacccgacgaatcccctccttcgctgtcattgtccgcaaaagctgagaatttattggacacgccaacggtgtagtattttcgttggggtgccatgttagagactcgctgagttcgccgtcaaaccacgtcgaaaagggagaaatattggccgttccgggtcgaaaacgagacgtcgcatcacccgaaaacttcccgggggttccgcaaacaatgcgcgaacgcagcacagcacagagagtacagacgaattgacagcaaagcagaagagagaggaggcggcaacaggagggagaaaaggagacgaaaaaacgcagtagtgccccctcgaaaaataatacgagcctcgggacgaagaatgcagaagcgaacaagtaggaggtcgagaattcgacccgctctcccgcctcgtatactagcctggatccaggtccccatacattccctacagcgctctccacctgtgtgcctgcacccccgcgctgagatcttgcatgcccggccgaccgctgtgaggggtgagacagagaggctggcctacgtgcaagaaagcgtggccaccccgctttacgcagcttcgtccacagcgcagggcgactgcagcaagttggcacttttcggaatgcacacgacacaaaacgattgtcagctgaatgctttaagcacacctcgatctcaagtacactgcgggagaagtgcggcgcagttgagggagtttgcttctggtttaaaacacaggcaaagcctctctaccgtccaaacgaggaaacgagggggagtcgacagccaaaagtcttgctcaccggcaatggtttgtgggggaaactgagtggcaaagaaaatatacggccaatgctcgagagggcgtgggccacttcagcagggcgggtcggacaccctaaacgcttggatcgatacgtcgatttcagctgtttctctgcctttcataaacacaaaacactcaggaaccgttttttgtgcacccgtttccccacccctagtcagcacggctctcgatagcgcacacaataggaagaccggtcgacgactcgaccgcgaatgagaaacgaggattcgctgcacctcgagctgacggcccggaggtgggcacgggtaggacgcatcagcttttttgcaagttaacggcttttccttggaacatcggaagaatagcatggcacacgacgacagctgacgctgtgactagaggcgggtgagtcgcacttcgagacagaacacacgacgtaacaatcgagcgatggcgccttcagcgtgttgcacgttgcagcacagcgtaccccaggactcatgcagggaatgacaggacagtccatctcgagaaaactgtccttgaagaaaccacaaaaaagtgccacagagtcaccatcggagcgattcttttcgatgatgagatcgacagcgtcctcgcggcgtccttgccttctcgttagctgtatgtacaccgccgggacacgcccgcgactgctttgtccatttccaaaaccgtgttccgatcgcggttccattgcttgtcactttttcttcctcgttcccacccttccttggagttttttccctctagcggatggtgagggcctgacgggtccaaaggacctctccaatgcaaaaccactgtgtgtggcgcttgcacatctgttctgtagtcgacagtcggcagcgtccttggttttaaggtatgagccgctgttgattgaaaaagctcgccggcttaccccaaaacagttgacaccgggacgtggttttttgtggccgccagccgttcgttgttgagccggcttttgcctcctccgcatggagagatatccgtacacggtgcggtgtttgggtaccgagtgttttgacgaacgtctttgtgcattgccgccgtatatccttacttgtccaagagtatgctactggttcgtgctccgggctgtttcacctgcggataaattcaggtgatctttccgaatggtgccacattttctcgacacacttgccgccggacaggccggagtggccggtccccgtttgtgaaactgcctttttaagcattcacgaggagtgtgcattgatctgaaggggaatccttagaaacgtgtcttgatgctgtcggcacggagcagctagcttgcatctgacttgtgagtgtcaagcagtcgccaggaaaa

SEQ ID NO: 1470 - DNA, 4431 bp, Toxoplasma gondii
tgacaactgtttggttaaacgagtgacctcaaaagcagcactaggtgcatgttgacactgaccagtcatccgtggacaggctcctgggggtattgctgtacttcagaggaaatacttgttcgacggaggaaatgtgcacgttgctgttcttctgtatgttttcgatttcaagagtaattcactcatgtatgccagttgtgcgcttggggaatcaatttccgtatctataccttttcttgagaggaagaaatgtcttaagtagccttcagctggcgcctgaaacgtctatcatgccttcagaggaataacggttcaaattcttggacgctccgctacgcagatcaaaggcaacaggcgcaaaacactcaaccccgatgttttcgccgactgtttgtatatatatatatatatggggatgcaagtaccagcctaggcgttcctagatcacaagaactccgctctcactggagctcgttacagccacgtgtaccaactccatctgcgaagccactaaaaaccagatgcgtattcgctggcaaagagtgacgccgagaagacgagttcagtaacttcctgtataccgtgtcacagaaggtaacatgtgcgcagtaccttctgcttcaccgtgctgcacagctgttcgtcggcgcttgtctcgactagcagggcgggtccaaattatacagtagcatttgtacgctaattgcaaccaaccgtctactcccacatagtaaaggagacgctgccgtttcgattttgttcaaagcagcccatacatctgtttgtgccctcagatgtcccggcgatttccccctgtattttggagcgaaatgttattaacgactgctgcccccagaattcttttttttgccgtaacaggcgagttgccttccagttcacacatgataggtgctggcctgtgttttcccccgctaggctgtgtttataactatcattgtccggaacgttccgaagctgtagtccggaagcacttttaaagagtcgcctgatcgttcacacttgtatcaccaaaatccaaagacgctctctacttgggttcaaaagcttggcaatcatgtttatccaggttttcatcaagatttgaccagactgtgaagagtctgcgaggaacaccgtcgcgctcaatgggtctaacgtcattgatgcatggagagcactcgtatgtatgcagaactgatatatttggagtgtttaatgaaagagagaatctggtgcgctgtgcacgggcatatactttttttttgagggcgatcactccaaagtagacgacgcggtttcgcaaggatgccttgcatgactggggttgagttacaacctatgttaactttacaaacgaacattcatcacaagtatgcgccagtctaccagcttgcggagcagtacctgcttccctcaagaatacatcaacaatcatcagatcacacagtcgtagaaaaaatgtccaccattcccaaccctcatgagcagtctttcccatccctgaaacagtgaaatgtcaagttctaatgccaagagaaatgcagcatccgtgaacgcaaacggcatgccacaaagcacctgaagtaggtctgtttttcctgctgtggccaaactcaaggggaccaaaaaggcgacccaatactgatcacgtgacaagcgaatatattgtatcccatgtgagacatggaacgagcatcgacattctggaatcttctcgttcgcttgcattgaatgacaaaaggatgaggtcacataacgcgatcttggactacgcctgcaaagaacagaagaaatcgcagcattttcataggcgccgttgcttccacgcaggaggcaagaagagccggaaggcatttcttccgcagaaagcaagcatcacggagcacatgtcatacgtcctcccatcagccatgaactagtgagaaacgcaagtatgtgcacacatctgcagtgagaggatttggtatcgtccggtggcacagtgtgacaagagggtttaacacaatgtacagccagtgcaagcatgaagacaaaatgctggtttcaaccgttaaagtcagatgcgcctggaggttcgcatttattaaagcgtaacttaccgacgagaaagacatcacatgtgtcagtccgaatgaccggctatgcttgagtgccctctcgcacgtgtcatgttcctccgaatggcagtctcttgatccgctgcacgctgtgccattgccgtctagtcttcttttgccagggttacactgagcgactgcagcagcgtggtccgctccatcgacactgtccgaacccaacgacggcgcgaagtcactcatgctgctcgtcgagcatgatgtgctttgcggagtcaaattccctgccgcaccggctccaagatgacccgacggcaccgcaaacccgtcacaaaatccagaggtgggcgtgaacagaggagttgattcctgtcgtctctggatgtattccggaccgtttggcccctgaacgcagacgtaggtgtggtgtccgtcggagtaaaggacaggaggcatctcctgagagcatgtcgcattactgatccacgtattcatcttgcgtgtattcaactttggttcagccagtctacgcaacgccgaccaatctctctccgcaaacgtctttgtcggtcacgcagtcaaaaaatgcatatgtaaatcgaaacctttattttccactccagcatttactcatagacggaattcgtcgaagctgggcattcaactgcgaatgagcacttgaccagagcacaacagtaaggcaacaataaatctagtcccctccaagagaatagggttctgctgtgactttgggtttgacgcggtaacaactctacagtccccttcgaagaaataggttcaagtctgactttattacattagtacgtgagagctcgcaagcaaacgagaacgcctcgtcactggttgtctctagggaacaaagcagccggcatatagtgtccaggacatgtggtgcgctccagctccagctgaaaacgattttcccgggtatttccgctgcgtttgattacgatgacgcgccaccaagcgaatccacgattcgatgcggtgctatctgcgggatgccagtcaaacaatgacgaacaacatggcagcttcttcgtccacggcccctcgcgaaaccggttttctttggtactagacggaccggaccgttagcgactgaaagaagtgttttccgttgaccaacagaagctgaaggcggaaggtgaacaggtaggcctcacacagcagacggaactcagcttgaagtccgaggcacgcgtgcctcatcaggaaatagctggtaaggtgtaatgacaggaagtgttgcacgaatccggtgagaattcgccgcgaagactaatgattttttcttcaccgcaacactctgttcatttggccaaaagtaaaacggtcatgcataaacaagaaatggtcaataatggccgtgtcccgaaaaaacggaagttcagtgtacggcagaaaagcaaaacaactgcacccgccagcaggtctttgtgccaccgatcgggacgccaccagctgacgattgcctgtggtatgctcctctcttggactctacaacaggagtgctcgacgccagcggtggaggcctgcacaggtggacggtgacacgtgttgtggggaggaaactggcgtgcgatttgcgtaaatcgagatgtgcgtagttcgtcggtctagcgtttccgagcagccgcggcacctcggaaagtggtgcgctgctatcaccggaggatttcccccaaaacgcatgcttgccataccgccgcatgcgagtcacaaaactcctccagcgcttacagtcacgttggcgtggaaacgggaaagagttagcgcttttccgtacgtagctcgatagagccacaatgaatgtctcaggatccttgcatgttttcccgaactacagtgccctgctttaggtaagagtctgggagtagcgggttttatggaacaccctctcggcattttctcctggggtacccggctccgcaactgcgtttgtgcgtgagtcacggctgctggggcaacgacagctcgtggatcaagaggcagtgccaagtgatcctcggaagccgctaccgttacaatttacgtatgggtgtatctgtgctcctagactcctttcaagagataatgtaaggatgtaggaaatattgataaagcatcctcgcacgcccactcgactgttctggtaccgtggctggatgagaactgtcagaatatcctccccactacaaatatctgttgtgaaagccgagtcaggcagcgtggcatgcccagatcctgaagcgaaggacacaagcgaatcatgtgcctgggctaccaagagagcgattgtcgtttctcggcgacagcgacgacgctcagtgctattccgtatcgttcgcaacga

SEQ ID NO: 1471 - DNA, 3233 bp, Toxoplasma gondii
ctgttgattacagtgaaaacagcagccttccgaaacagaaagaattctgtttgagaggcacaaaacgctcaagagtagattttccatgttatgcacagtcacgagtcgcggaagcacttatttgctatgcagtgtcatagcagatctcagagaatgttactttcagtccgatggtactgatcatactggcataggtacgcataggtacattaggaaggaaactatcccaatgaacagcaagatatttgtacaacttgtacacacttgtgccactgctgtgaacatgccagcttgacagatggagaattccccaatcgtccacgggcgcttcaatcggtgatgagcacaagtgtcagtgctgcttgcgccgtagccgttttttgtactgggcgttctgaagtatatgtaaacggtagaagtgcaagtgccatcccctttcacatatgcggcctttccggcttaaatttggttcattttcagtaacggatttcatgcagccaccgttcaaaaattgccgcctcttgctacttgaggcaacacgtacagatagctgactgaaggcaaggatcgttctgctcgtgcagaactggggtcaagaaaaaccgattaccgtagacgaattcagcaaatgatggagggtacactatggtatcggggcgtgtaggtgcctcagaaatcagctgaagctggactccctgttatacattgtaagatcggattccgaggcctctcgaagcgtcgactgagggtttctaaactgcaagttggactcctggtctagatctcctagatgaaaccagatgaactacgcatatatgaatacgtaggaatgttgcacattcctggaaaccaccatgtttttgttgtttgttgttggaaaaaactcgccttttacccctgttgtcttcaggtttcgctgtaccgtcggctaccaatgcctaggtcggccttctgctgctggcaagtttcttgcaagtcgccagacctttgttgtacgcgaacggctgctaaacataggacggtcgctgtatcgaaaacactgccacgatatcacaacggcagtctaacaacaattggaaagtgactagtttgacacttaaaatgagtttcggcgcatccgtgtccctatcgaaacccgaatgtagagccgtcgtttgctttgttcttccatacattttacacagtatcccacacaaatatgtacggtttatacgcgagaacggacacgtcaacagactccatgattaatcaccacttttcctccgtacacgttgctacagtttggctggacacgctgacggcgagaggaacggtaacttacgatgcatcctgccattcatttcgccaaccaattctctagttcggacctcctttacttccataacaagtaattccttttcatacgttgtgagatcctcttcactgcagcaaaatgctgttggttacagggcttgcactaaagtaaaaagggcactctactgtagttggaataccgtaggcgtttatgtgttggtaacacatgaggataaaatacaactttaagcgcaacacctgtgtctgcaaagctgctagaatcatttacacgtaagatgaatttatgtggaactactatgatcagcctatgaaaggcgatgggaaatgtaatgcgaaaaatcgttttaatgttacatcggatacatagtaccgcgaacagtggtgagatgctgaacgccgtaccagagaattcaccctttcatgtttgtcacgctgcatctctcatagtgccgtccggagagggtactcagtcagtaagcttcgctgtctgcctgtgtatccttgtttgcgttcctgaaaacctaggaaccccttttttgtaatgtgtgacaggaggtctagcctcatttgttatttgattagcactgcatgcctttttcttgtcttcaaagaagctttctgtcacttcatctctcacaggagagtcgcgaacccttctcaggtcggtgcgaattccgcaacgatctcggattgccatttgcggcccccacactgaggcgacccctaaaaagaagtgcctcgtacaagcgaccaagcactgctctgtggaatctggattaattggtggctgtgaacacttccactgcattcgttaagctcgtcaccttgtcgtttcttgagagactgattcaggttttctaacactcgtcggcggccctctccgacagaccgtcagactgtcttgctgctaccccgttactccatgattcagaaactggaggtcagtggactcaggtgaaacgttagttatggtttctgcagaagaaaatgaccgagaatgccattcctgtcggaactggacaaacgcagccactcccggaaggttcggtaaacagacgtgttttcaaacgactggcggctgtcagcagcaaggcagcgcagtatctaccatggcgtgatggggtaataacgctccgtcagacttgaataccgggcgtctcagggttaggagactctgggaaataaaacgaaacagcgaaaactcagtctgtttgtgcgctgtctggcgtcgcaggatgcttcgacgttgtttcgcgggcatgcatcgacgctaaacggccacatgcagattcgagggttttttctgcatgggttttggaaacgagcgcgtttgccactgatgtagtctcggtgatctccatttcccatagctttctttccgttatggcttctgcacgttatgatttcgtctgtggaagggcaagtttctcccgtttccagtccctcgaacctcgccttcgacgagtcaaagcagtgtggggcccgggacgccagacccttccgtcgtctgctgcggtgtacatacacctgacttcgtttctggcgctcacctttgaatggtcacttcctcacacttctcaggtttctcacagggtttcagttgtctcttcccaatcctttccctgccttgcgaggagctgtcgcgcccacggtgtagcttcacgctagcaaaccaagtggggagttgaggaggcgacagaaacgtctcgttttccagtccagcgttcctcaaaccgttttccgccactccaaggcaggaagatctcaggatctcgtcgctgtcatttgaatttactgcgcaaccatcctacgatgtttctccgtagaaatcgagttctatgtggtacagtgtctgctgccgtcgctcgttcggcgcttgatctttttttttcgcctgtttgttcgtcgcacttcttgta

SEQ ID NO: 1472 - DNA, 3888 bp, Toxoplasma gondii
tcgttggcgacgctttttgagcgaggaaagggagcattcagcagtggcagtcgctggcactcctctcccaagaagccaaggcttgaagggaacggagaccgcagaaggaagtggaatcggagactgatggccacagaggacaggaactggcgaagaaaaagaagggtgagaggacaagaaggacagaaggggacaaggatggaagaacagaggggaaaggtggagagaagaggaagggagcaagccgcgggggcagacttatctctgattgtagagttcacctgcaagagatgcgcgacgcggacgacgttgtcattaatgcgtagattgtcttggaagaactcgagctacgaaggtaaaaacgagggggaaaagcaggcctgtcgacaaacagaaactatctcaaagcattcaagtctacatacacgcgggtgtgtactggccttgttttcatgcggcgaattaatatctgttcataagcgtagcgatacgtgattacgagcgcgagaaggagaggggaggaggggggagaatgacacgacgaatgcagcgaggagttcaccggaaggaaactcagcgacagactctgtctgccgggaagaagatttcggagaaagcagcgagagaaagtcgagagcagaaaaggatcaagggaagaccgcaaggaaagaacacaacagagcaggcagaaacgccgaggaagctcgggagcacacagtggcggagagagagaaagaaacgccggagggagaaagagggaagaagcgagaggaaagagaagcagcaggaacgcatgaaaagatgcaggaaggtggagaaagaaagaaaggagagctggaagaaaacgggagagagaaaaagccttacattgtgagccgtattatcgaagaggcccccgacgcgggcggcgagatggatgagtgactgcggtcgatatcgcagaaagagtctctctgtctgggtgtaatccctgaagaagacaaacaccggcggaagcagaaggaccgacgaactgcgtcgaggaccagaaaaagatacgcgacatgaaatgcttgtgactcagaatccttcattatccttcattaacacttgcggagaaagggtataggagtttttgcgagaagcacgaacctgcgccagagagacagcagaaaatggcggacagagcggcgcctcgaacaacatgaaaacaagaaaaaagagatacaggaatcattcaacgaaaacggtgctcacatatacacatatacatatatacatatatatatatatatatatatatatatatatatgtataataattcactgcatgcatgcaggtacacaggtacagatgcacatccagattggacaggaggctctcggcgtcgacagagaggcgggggacggctgcgaggaccacagacaagagtgtctgtttcttgaacgccgcgagaatcacaaggctgaacaacctgtcctttggaatttgtagagagaagagacttcggaggcaaacacgagaggaagggagagaacaaagaagagtcctcagacgctagaaggatccgacccattgtcctgggagtgcttctcgctgagacaggattgtccgtgagccttttctagggaggatgtcctacgacgtggactacggtcatgagactcggaaggtatttgttcaccggatgcaagttctactgtgctacctcagagcctagttaagacgataattcgtgtagaggtcgaaccagttgaacaccctgtgttgctatagaaaagcgaatcgggggggaggctctcgcgtcgcgtcttttttcgagatcgacctcagcattcagctccactcgtcgcttcaccagccaagccttgaggtcacctgcccttccgccgttgccagggagagagacctctgttcactggctcccagcattgtgggggacgcctggcgaccctgttggcctgtggctttgaattgtgcatagctccagtccattttggctcgccctttctagagattgagaaaacacagactggagtcgcagagtcctcctctcctccgcatcacatccagcgaccgaagcggcagaacagagagacagaactttgtctcctcctgagctgctgcctgtacgttttactacgcgtttgccttaacgcctgtctggcggtgtgtgttgagcaagcatgtacacagaagccaggaagcctcgcatcaggcttctccgttcttctcttctctgttccgtttccttttctccttctgctgcgagttcctcaccgcaggtctgcgtctcgcgaccccacaaaaacgaacgcgacagctcgcgccgagattatcgtcggaccttcaagcgacgcttctcctctcacagtcccaccgtcttttccctcagagtccgaaggagaagaggaagaagaggatgaggaagaagaaggggcttgttctcggagaagaacggactggagagcttttccaacaaggccggagccgccggtgacgaggcagaccggaagagacggagaaacgcggtctcccgccatggagactgcctgtctgtacaccgcacagacactcgcattctgttagaactcacgatggaaaaaccagtagacctgagactgcagaaagctcattttgcgtattcaacggatttacaactcgcgcacttggatcctctctgagctcttcgctacttcgagactcaggtgtctccaggcctcgattcattctcaccatcaacaagaagctccactctctcttcttcactttcggctcctcgcttcttttctgtattcttttctctctgcttctctctcttcttcactttcggctgctgccttcttcgctctctctctctctgtctccagctgtttctgctgctctttcttcggcttgtcttggtttttcttcgattttcctctcgcttactgtgcgtggttgagagggaggagtggattgcgaggagtttcgccggagttcgaggtcccttcgcctttgcagcagctctcgttcctcgctgaaaacgttctctgttccgctttcctcttgcctctgcagagcaactttcgcagagacccagacgcagcctggcgagcctcccgcccgcttgcctgcgcgcagccgctcttctgcatgcgagaagcagctccatgtcctgccagcaatcgaaaaacgacggtggagatcgactcgcacagagctcgaattccagaaattcagaaatccggcgttcttcagggaggctctcgcccaagttttctctgcgacagaacggagaaacaagaggcggagagaggacgccgacacacacgatctcgtggggtgcggcgtaggtacaccgcaacccagaggctggccgatccctcgagtcggtttcgcgtttttcaacgggaaaatctggcggcaaattctccctttcctcgcttctgaaaaatggattagagcggcgctctctgcgaacctgccctccctcctccggtctcctttgcatgcacaggatacctgtgtccctccacgcattgtcgtctccgtcctccttcttcgattttcttccgctatcttcttctgtccgtttttctggacatctctgctctcttgttctctcttctgcagctgcgggcgtaggttcgagacctgccgcaacgcactgcactgaagatgcacctgtgaatctgcgcctcgacttctcgagcgctgtcttgttgctttttttcctctccctctccttctcatcctttctcccgctccttcctcgtcctcccactgttgctccctcctcttcgtgtgtttcaccttccttgttctctcctcctcccttctctctttctctcttcccttctctctctctttctctctttctctcctcctcccttctctctttctctctttctctctttcatgctcca

SEQ ID NO: 1473 - DNA, 3659 bp, Toxoplasma gondii
ccacaggcttcttctgatccactcgcaggcacaatgaggacaggaggctgctcgcagcgtctctgcagttcctccagaatccgccttcttctctcctccgtcaagaaaggcaccgagagagaagaagtcggaagtgcagtggcaggagagacagccgaagaagaggaaggagacggaagagaggatgcgagctgtcgtcccgaatctgggatgcatgcagaagaagaacgagggcgcagagcatcggaagacgaggaatgagaatcgagcggaccaggaacaggcgactgaggagaaaaaggagagttgggagcacaagacgagaaaagcgggtggaggaggcggcggaggacagaggaaaggagactggatgcggtcgacggagtgtctggagaggcggaggcgtccatcatggaaagagaggaggaaaggagacagacggaacagtggagaaagatcaaggagtcggggacaaatcggagcacgacaacgccccagacacacgacgaaccttcgccgcagcagcgggtgcttcttgagtgaggagagtgaagaggagcggtgcgaggcaggagagacccaaggcgactggcgaaaagaaagacgcgggatagacggagaagaaaaaggcgatgaagcgaaagtaaagttggagacgaaacccccgtttctcccccaaagaagaagagacgagggcgaagaacggctgctgtgttttgtgtagcaccgtcattgactcagacgaaaggggagaaagaccgccaaaacgacagagagagagcgtctccgagtcgaccagcggtgaccctgagagggccaaggccgacagacgaaggacagaaaaatctcgaaactactctggaacatgccagacagaggaagcgagaaacgaggggatcaagcctgctttttccctgcctcgaagagacagcagagagaggactcttccgactcctgcgacagtggggagagaacagagtctgacaaatgcggagtctcccgtcgaccgttccagcacccacggatcagcgtctctctcttcgtctctcgctcgaactcccagcgaaaagagagaggaaggggggagaggcagagacgtccgctcttctcaaaaagtgaaccaccgccgccttcctgtgtgcatgctaaacacgcgttgcagacagactccaacagatacgagacaacgactcgctctacttccttgaaaaatcgagaatgctgagagtcttctgtctccagatctctcttcaaacgcagacaaccaccgagaaactttttccgctgcatgcaagcgcctcgcgccgtctacacgcgctgcacgcgagacccagcatgtacgccttgcatgtgagagaaaaacggagtttggacaagtctgtgactttttctctttttctcgttcttgcagttttcggaaacactgaggaactcggaatttccaagcgtctcgactcgggtgtccagagtagacagaggcgagacatactgctgaatcagtcagaaagatgtgtatcggaaggaaaaacgatcgttgttcaaaggatctgggtttatctctgttattcgacgcttgcgtccacgtttctgcatagagagctctctttcctctcactggcatcttttttctctttgtcgatccagtcctctctttgtgtctgtccatctcagtgtatctcttcctctctatcgatctctgactcggtttctccctcttgatctccgtctccacgtctcctcggctctctttccctctgtcgcttctgagacttcgtcacccctgttgtctctccgcaggctgcactttgaaggaacaacggaattctcagcatcctctttcaagaaaaaaatgcattttgacagagagatacagattgcgtgcgagaagatggtatgggggttttcgttgacgtcaaataagcaatttccccttgtttcaaagactatattcaaatcagaatagaggcggagagtgtctcccctcacttgaaaagggaactcgaaagccttctgcctctagcagaggttcagacagaatacttttctttcttcataggaaatacactgacgatcttgtagtcgaaacctctcccaatttaaggctctttttctttctagagagatctgaaggagaaacaccagaaagcagaccagcggagggagatacacaggagaacttaggcagaacgtcttgtgccgcgttccactatacaaagcagtgtcgaggaaagccacagaaaagaagtcgtagggagaaacgactggatttccgaactaggaagcctgagaatcggcgagttcgagcaagaaagtcctcgagaaagaacgcgtgttcacctttttgtccctccataaaacaaacagaagatgcaaatatttccatttctcttagctacgcgtcttttttaaagaaaaaaggcgcgcagtctaacaccttcagacaggaagaaagtctgcttttcaaacgcctcctctctgtcgtcttcatggaacttctctcctcacaaaataacagagaaaacgaggacgaactcctctcgtagtctctatcttcatgtccttattttctttgttgaaagttgatactaacacctgtgtatgttcgacgcagcactacacacaggactccttgcccatcactgaggagccaagtccatacaaacagttttgacgacgaatacatacatatatgtatatatatgtatatatgctctgtttttctgtgcatgtacgttgcgtgtgaccgtttatgtttgtgagacgctgacttgcccgggtcgcatccgtgttttcttaaactttccttcgcgccgttagcatagtcgcagaaacgtatcagaaggcatgaagtttacagagtgtgctcttgcattcgaccgaacctgcgatagataagggggcttccacactctctgtgttttcctggagacacgagagagagaagggacatcctctgtgaagcgaccgagcgagggacaagcgagggaggaggaacgacagagatgcaagaagcacgacgaagcacagagggaaggggaaacctagaactgggggaagatgcagaaggaaggggaaaccaccgaggcggaagatcgagacaacaaagaaaagacgcttcataaggctgaggcaacagaagagctggagacaaatacggaggaaacaaacgagtgtatctgaggagatctctgctgtcgctcttgtcttgcgacagaatgcgagaaaaactgctgttttctctttgttttttcaaaaccctctgttaacagatagatggctactcactggatttctctcgctcttccctgtttcctcatagagaccctgtccgcagatcaaaaacagcctgcgtctcgtagcaccctctctccaatctcgtcctcacccttcctaccttctgcatttcccactggttctcctacccgaaactttctcggcagacactttccttctttatccttccaaaccaggagaaaactgtgcaaacaatcctgccggctgtcgactctttcttcgctgctgacgagcacaccgcgttcccccttctcccgcgcctcgaaaaattctggcgtcgatacacccgaacttgtgcctctctctccgcacgctgaagcgagaaagccacgaaaacgcaaaagcaaaagacaaacgcggctgca

SEQ ID NO: 1474 - DNA, 1951 bp, Toxoplasma gondii
gcgattgcgaggtggtaggtgaagcgcttgagcatcgtggagaactgggaagggtgctgctaggagagctcccgtgcgctatggctgagaaccttgagctccgttgtgcctgtattctactacaggaagtaacctggcactttctggtaaaccaataaccgtgcggatgacctccacggaaactgccgctctgcagatggacgctgaagccgggaaccctctcccgtgattctcgtaagagagaaacggacggcacattcgcgtatgcgggggttcgggacgaaggtgagccatgagaaagacagtgagcactagaaagtgaattcagtggaagacaatgagcagtacaggacgtgcgtttgaagagaggcttgaggctcttgagtgttaggaatgtggacgggtgtttgcatgcactctgcgataacgcaccagagacacagaggcgaatccttccctccttctcgccagagacaagaaacaacaagaaagccagcagagcaagattggacgacgcctttcgaaaccgagacggccacccgtgtctcccccaagaagacggggaaacaaaggcaaggacgacagccagaacgaaactgagcaggaggtgccgaaacctgaacatccacgtcagactgttaggatggaaaaaggggggcttcaaagtgcccagacgggagtgagtcatggtgaaaaactttgcgcaatgtccccggtatgtcagccttgcggctagccagactgaaggcgaatcagaatacagccacgagcacgtgtcgagagaaactggagagggacgccatagttcctgtcgcacagacctttcgagaaaagccagaaaggttcagaacgctgcgttccgcaacgtacgcgaaacaccctctcctgtctcgtgctcatcactctcgctggtagcgccgcaccgagcgtcgaaagcccaacagagaaaaatgttcttattgtggacgacaccccctcactagaacagcgaacacgctgaaatgtgcagggacaagtaaacgacggaccggcatgttcattgtcaacaagtctgtggcacgggtgcagctttggcttctaccgcgagtgttgtagtgtgtctttgatggaaggcaactactgcagacggcagtggcaagggaacctgtcaaagcagcgcaaatagtcagaaaagaacagcgttcaataaaatacaaatcacgacgaaaggcaatgagaaacttcctcaactgcccatggaaacaatggcggagacatgccacgcttctaacatggtccacgcgtcgccgaagttgtgcatgtatcccgccgacccgcagcagagaacggacgccgccacttgtacccgcagatcctcatttcgcaaatttataccgtagttcttttagatctaaggcaaagataaatgggaacagacacacttcccttactactggagaatcaagacaaactgtggcaagaggctgtctcccctcgacgcaatccgcgcatgcaatacaagtagtatgttggtggttggaagctgaattgaatacggacaaacacgagacattgcccctttattcgattcgtccttccaatctctgtgtgaggggatggcagtgatgaaaagagcctcaaaaatccctttttcgcttggttagcagttcacccggcagggagtggcacgcgcgacaccggactgcggtatggggaaacgcgatgaggcaaccgcgtagcccatttttgcaagcacggacgcgcatatctcttatgcccgctgcgttcggtctgctttgtttttcttggcaaagggtgccagtgtcatggaaaaggcaatggctgttttggtcaacttcgaaaagtcgcgactgttgcacagttagacctcctaccgtaccagttcgatgacaactagatgtactacggcgtttgtttgaagtagacatccttgtcgtgctccatagcataa

SEQ ID NO: 1475 - DNA, 2129 bp, Toxoplasma gondii
cacaaaaaggcggaaattcgacagacccgttcgaggttgctaaacgggagtcaaacgcgtagtacctgcactcctgaagaaaaaatgctcctttgtttatacaaatatatatatatatatatatatacatgtatatctatatgtatatctatatgtatatatatatatatatatgtatatgcatatgtcgacaaagagtcatttaggaggtacagcacaagtaaatagaggtcctgtaggtgtggatgccgtccggggcgatctggaaccttgtgttcgcgtgagttcttctgtttgtgatgagaagtggaatcatgtcgctgaaccaaaggagtattacgagttttcgaaagctcagtcgcaacgtcgagctcgaagaacttcttcaatgaagcgtttctttccggaaccggtgaagaaagaggttcgagtaacgttgcagttgtgcgttcacctcctggagagtctgctgcggaggatagaaagaagaaaaagttgaaagaagatgctgcgtatgaagcgcgatgtgggcgccctagataggcagcgcaggcaaaatgctggagaggtgtgtgtagtttaccccaggtgatacaaaaagaattttacacatcttaggcacagagcagaagacctgtgaacttgtttcgtggatcaagagagacagagagaagagaggcggtcttgttcgttacctcaaattccaattcaacttgaagatagactctcactttttgtacgcgtcttcgcggacagagttactacgatcggcccaaaaaggagctcgtgaacggtggtcgttgattcatggtcaactcccttccatccgttttttggatcaacatatcttcctgagcacctgaaaaggatctgacgatagctttcgtcttggttccgttccttctgttgtttctggaaacttgcttgtctttctcgaccgccgccgagagtgccttctgcccccaaggtgaggcgcggagtcaccgcagccattttagctgtaaactcccccgactcgaggttttctttcttcgctgtctctcgcgccttttccctgggttgtccactcttctctgcgtccttttatgaacgccatcttcctccaggctgttctgaggcagacgctggcgtcctctcggcgcttgtcctttgcaatctcggcatcgacagggaagctcgcgctcgcgcgtctccgcgccgtttttcgcaggctgggccgccgtctctcgccggccaagggcagggagaagtcgccgcgaaaatgatgcgagaaaagagagaagcacgaagcggaaaccgagcacaaggagaaggaacccacaaacttcgctgaggacgcacgaaggtgcgtccgctgcttttcgcgctctttttctctcgggaaaacggcgttcagcgcttccccgacatctgtgcagccgaagaagcaacagcaaacgccgcgcgctcgttcttttctcttaatccttttctctctgttttctcttctccggtggctgttgttttttctgtgacggacaaagaacacgggggaccggaagacaagttggacggggaaaaaaaatcttgcatgcccttctctggaggtctcacgctgcccgggctcagtctcggcgagtagctcgttctcttttttgacgtttcacaaattccttttctaattccgaaactcgcaaatacgcgtttcgcacctaacttccccgcttttttctccttggctgtggcgcgctcactctctgcgagatgcgcggcgcccgatgccagtcgcggttttgtgtcttgtgtgtctcgtcaggtcgacttcatctgtgcttcctttttctctccctgctcgcgtcctctttttctctctttcctctgcttctctgcactttttgcgagcgcaaaaaacgcgcgtcctccgttgacggcggtcttccgggcaaaaaaggacgcaggaaacttccacccgccaccactggcccgggactctctgagcactcgcgtcgcctctagccttctcttttcgtcgacggccatcgctcgtcttctcccattctcctctcttgattcctctccaaagtggactcgcttcctctctctcgtcttcctgttctcggtctccacgttcccccatgcctcccccagaa

SEQ ID NO: 1476 - DNA, 2022 bp, Toxoplasma gondii
aggctggtttttcatttcttgacagtcgacacggtgaaatgtgtttttatgtacgcaactttgtaatgagagctttctcgctcctgacgcggggggcgaggcagcattgttgatttcggttctcatgaaagttgatcagaggtggcagtgggtgcactaccggtttagatcgtcgttgttttttggcggacgtttcagaactgtgcaagcgttacgggtgaagtcatggcaatttttatggtttgagacgtttcagatgtggcgcgacgacgtcgaaactgagaggcactggtactcttcagagagagatgtctctgtgcaaccgttggatttctacaaaattgttaaaaggagaggcggcagcaaaggaaatcgaagaaagaagtcaaaggagtgaatcgagttttacctttggttgcatgaatcagtaatcttgaaaaacctcctgttcacctcgtctgtaacaggtgtcgaatttagcaacacgtaatcagagactcttcccgttaaactgaaaaaagtagtgtggaaatgatgaagcctccgcttcttctttctccttaaacacatgctggagaggcaaaccgagccacgatgccttcgatgtgattgccgaagctgcctctgcattcttctctggatctctccgtgaaacaacacagcgtagtcaattttaccaggcgaactcttcgagctgcagcaagcgctgctccctttcgctctcagatacttttctatatatttcataaatggagtcatattcactgtcctaggtgccaccgtgtcaatgtgcatttgacttgggttttaccaatatgggcccctacggaacgagccggttcaaatatacccaccaacgctattctttcttaccgtaaagcgagaatccacaagaattctcacacggcttcttccttgtagctttgaacggcagagatggtaccttgttcacaattttaaatggaggagagggaacacactgtccgcagacgttcttaattcagctcacatcgtgcatctgacagcgaactacggttttgaacggggtcctgttcgattacacgcaagtagtgagccggcacagaggtactgatacagtccgaggactcgagtttcaacattatctgacgtaccattttccattctatattggcgggcggttacaggtccggctcgttcaaacacacacctgtattggaaggtagacacagagaaactggattgaagaacagagagagttctgagctgaatagacagataataccaacgtttgtgtgcgtgtctgctcctgactttctccttgctgtgtcttcgagtccttttttttcttgtgtcttcacagtccattgttatgccctcctctccgtggctgcatgcatgccgctctttttttaaaggccatctttgctcgcgatctctctccggggcttcaatgcaaaggaatctcgttctgccttccgtcctctccacttcttctttcggatcccttctttcgttctttccttttgcctgggctctcgtccctccccgctgcgcgtgtgcttgcctgagacactttttctcgggtgaaagcaggcgtaggacccgacggcgatcgaagccacggggaaatcgacggttgcttctctttcggggaaaaagttgctgcttcctccccggctctcctttcgttttgtttcagacacaaggtatacgcctgttctgccgtctctgtactctcctcgccgttcttccctcttcctcgcgagagactggactgaaagaaccggaaaaaagggacaaagaaccagaggaacggacagttacaagaaagagtgtgacagagtgcgagggggtgagagacggaagcccgggtgagcgacaagagaaacaccgtcagcatatgaacgcgcgtcggcggtggaaaaagtggaattgactcttcgctttcgtgtgaggaagcgtttgtctgtggtgaagagttggacttttctacttgagatgccgggaaccaatcccaaaacgtaaaagacgtcgacacca

SEQ ID NO: 1477 - DNA, 1966 bp, Toxoplasma gondii
gaattcgacgtttttatagcgcaccgtctccacattgaagccaatcgctgcacagcgcaagcgagacacagagaggtcgagcaaaggccgagaaggtgactgctctccggcgacgcggcccaagacagcaaggtgcgagggaactcgctacgtcgcgcagagtcacgggcaaggcactgacagcacaacagcagcaggcagacggacaggaaggcgggcaagaggagagaagagaagaagagcggggagagccttactgggaagcgtttcgacgacctcgttcaaatgcagtcgatctgcagagagaaaagcaagcgaaggatttcttgagatgtgaggaaacggagagggaagacgacttgcgaagcgatgcaggtgcgagcgacgacgaaccagttgtctcgactccttgacgccttacagagaatcgtcgtctttcctgcattgtccaggccgagaatgagaatccgaacctccttcggacctataaggcgtgagaaaagagctgagaagtaacctcccatagtagcaatcgatggagacggacgaaacgaggagggagagacaaaaaacggaggaaatggtaaagaaaaagaagaagtccctagagacaaggcgatcgcgctctgcccttcattttaaaatgccgttcttgatctcccttgcggccattctcttcttctctcgtctttgctgtttcctcgcagtcttctcttcttctcctctccttctcgtagcccctccttccgttccctctatcctctctctcctctctctcctctctctcgtaaattttcctctctctccttgcactcttttcctttctctccttcctcgccgctcgactggacgcttctccttcgttgtccagcgacgcggcttagacttgagttctctggtcttctctcgtcgtctacttcgttctctcgtccgctgtgtcttctggtccctgcgccctttcagctgcttttcttgtgaccggttctctgattcccctggaaaaaaacaaaaggagtttccaatgaagaggacgcagaatgcagtcggaacgcagaagacgagcagaacatcgggcagcaagacgtcgcggaaacaattaaaacgaaagagtcggaaaggcctggcaatgctgctaacggtgtcgccagagttcgactgaagggaaagacgaggtcgacaggatgggcgccgctcgactcacacggaaaacgaggaaatagagctttctatgtccacgaaagacccagtcgcaggtcaaactccagaaagggagagaaacaacagagaaacaacagagttacagcaagacaaagccaagccaagcaaggcgcgctaggcgcgaaaaggcgaggaaagcgaccatggcttctgccacggactttacgcaggagacctaacgccagtgctgtcgcgtctctccctcgcagatgcgcacaagaaaaaaaagagaagacaattgtctcttcttcacttttgtttctcgcctgggcttctcgtgtgatctccttcttgtctactgctttttcgccttccttcatacgccggacggaagcgaatctcgaattccccgaatataagccgacgaaccggcgcgaaaactttgtgcgctatgccccagagcagcgcggtgtctcctgccgtcttgtcgcgtgcgtttgttgactgaaaaaagattttctcccgtcacagagtcagggagaccatgcggcgcctccaaggaggttcttcgtttccgcgtctcttctcgccaggagttcgttttctgcgtagatgcagaggaaaggacgctggaccggaaccggatgagctactgcggcgttcctcgcgctgtgtatctatagacggcgctctgcgtctgtctcgccttcttcttctttcttgcgcctcgctctgctcggaaagcggcatcagagtgtcgacagggcgccggaaacagatgcttgtccgctgcatgcaacaacgcaaa

SEQ ID NO: 1478 - DNA, 2809 bp, Toxoplasma gondii
ccccgttcgtcgtcaaattgcattattctcttgtgctgcaaacagagaagaaactgtgcgtgcggccagctcagccatttgcttcatactttgacacacacataacattcagcgcttgggacggctgcggcaaaggctaactctaagcgactatgatttaccttttcagcatcggagaggcatgcctcagcattttgtagatcatgggtgagcttcattacgcaaacgcacaaacagcttacgaacgccaacatgaaagcgctgataaacgccagaatgcgtgggatgctcctgaagtgtatctaaacgttagagggtgtcttccgaacatatagagacaaggaagccaccatatcctcagtacaaagccggcgacgatgaatcgcgtcgctagagaactgactcatatgatggtgcccttggcttcctgttacacgcagaaatcacttgtgcgagttcagtcgccaattgggtggcgagtcgctgcctacctccgagcatgcggcaacaaaagccgtcgtatccaaatttaccccttgcagtttgcgggagagaagaaagtcttccagggtttgcggccacattttcctgtagcagtgcgcttgaggtcggaatgaagcagctgccgcgacagcacgatggttttcgatttggtggctcggcactgactgccataaaccaagcaaacccggaggctaaatttgtacccagcaaaacttcaattttgaccaggctgaccggttgcccacaaattcgaccccgtagctgtccccactatggtcatttattattgctgcacctctgactaacgttgagtctgtgcttcaatgatgatattcgaacagacacaaatcgccaagcggcctttaatctgattcgggtcggaaggaggccgagtccagcatgtgcttggatcgagcagagcagaccagatatgatgcctgcgacgtcggatgttgtaaaggaacactcccgcaaggacaatctctgtcacactttttacgtcgtgcgcgcaggacggcggtgggttcacactgcgtgagagccggtgaagaggctgttcggcagatgcccgggggcgctgggcagccacgcatacctagacaaaaatcaagaggatctccggagacccggatatttagtaggtcgcaatttcacctattgattgactgaaaatgagtactgtttcccctgctctgcagggcaaacgggcatgcgtgcttcctcgccctcagcctcttctacctcttagtgccacgagagacaagccgacgagcggacagtcttttcttgtacagacacccggcagtacatgaccaggtgactgaatctgctccaccgagatatgccactgtcggtaagacttcgtagaaaagccagcgaccgacacgcgtggagacacaacgaaccttgaacggtgtggccactcggttgtcccactacttccagccacactgtcgatggaaaggaacgccgactggcactctggccaacaggattagggggggcataggcccattacgccttttcaccgaaggaaatcaatgtctatgtacatcaagagggtctcttacaatgcccgacttgttcccgcttatccacagcctaacattcggatgtggccatgcctcggggctgtctcgagttcggaaatccagttcgtgcttgcatgcagatcggtcttgcgcttgagaaaacgttgtcgcctgcgacatcgcgtcgcgcacgtgggggcgcacccatcgtcgggattcggtttcgggcttttcgccaccttattgtgtgctttgttgccaccgacctgtgtggcacgtttggtagccttcttggaattcagccaaacttatctcgagtttcgtccggagaatgccaacgagtggagaactgagacctgtgtcccctcgtattagcggtgtcttgtcgggaggttcaaccgctcgcggccccgtccagctgcagacgactcagtggttccgatgatggcacactcgacgcaggtgaacgcgtgcatcgatcacgcttttccatgtccagaagagctgcttttttcgcaccagagtcagttgctccctctaatcacactttactcatcggttgtttcgactccgacgtttatgattaccttctccagacctccctttacgtggctagccgtcgagttgcccagagataccgaaacttcgtccgataccgaccagtgattccgaagagatgaattcgtggcgagtagtggcagtctcttgatctaaagttcagaaatcggagggaaatgagcaacttgacgttttcacattccagtttccgccagtgcacgtacttctgctcacggcaaagactcatcatctcttacctgaagcttgcggacgacgtcgccgccgacaatcttaagtggacaacgacattttttgcaagccccgttgagtggtttccttcgtcctctggtcccgtctttcggctacaggatgaatcttggtgcagctggcctgcttttaagctgcgcaattctgttcccactcctggccagctagtgcacgagtgtctcctggccgcagcagggagcgaggtcaagatttttttccctccagaaattctgagcgccgggttcttctctcacccaccagtggcttcatttgcttaccgttttcaggacttccatgggcggcaagggaccgagcacccaacagaacaggagtcccctcgtttctgagtgaggtcactcacgcttcagtcagcagtttttcccagcgtgtcttcttccacggcgaccaattcattgcgacgatatgcgtcttccaggatgtgacaacaa

SEQ ID NO: 1479 - DNA, 2921 bp, Toxoplasma gondii
tttccagttggagctgaagctgttctgtctcggattcgatcgaaatggaagtcgacttcttgccctccaccacggcaactccagctgacgcgagcgtggcaggtaactgcaggagaacgtggaggggcagatgtgtatccttcaggctaccgccaggcaattggctgtgctggagaaacgaaagatacctcatcaggcagtactccggagcagtcaaaacggggatttggagaagaggaggcgtccgtttgaggtccttagttaggtctccacttgcgagcgtcccgccatcactatgtgcagcagcttctctctgcagagcgtcgtcgatgtgaagaggcgggacacctcgcagctcgcggagcaaggcttctctttcatgatgccaccgtcgtgcatctttgtcacaacgcagcgacgcagagagttgaagagagtggcgcacggctcccgtatccagaaaagagctgagagcgggatagacttcctgctcatcttcgtgacgcgacaacttcacggggtagtccccgctcaagccagccacaggtaccagggacgcctgaaagcgatcttctgtcgacgacggttgtggctgttgagatgctgaatagggcgcagaagtagcacatccgaaactatctagcggcccgccgtagagccgcgcttggaaaactctctcataccgatgtatcactccttctacatctggccgggtgtgccgagagcgtgacaatgaggcgtgatatccatacgctgctggtaacgttagctgcaccttgggcttgtttaccagtggtgggcgcttaggatgcatttcagtcaaatccccatatgcccctaaacccggtgcgtttcgcgagccacctcctccggaagggatggaatttcgcacacagtttctgagagaatcagcatcattgtacaggcaagaaagaactggtggagcagaaatgtttctgagactacatactccagtatttcgcgccgacagagatgccaagtctattgtgggggcgacagggagtggcggtgtggacagagcaagtggctggggggagactgctacagggaccggcattatccctacacggaacacgcctcaaaacaacaaaaaatatagcgaacaaaacgcgcaaggcaaattccagaagagagtgtcgctttttcttccaaaacaagcaaatcaactgcttctccgttcgaaaggagtgccgcgatttttcgatgtcgaggaatgaaaagatgtgcagcaacaaagaaatagcgttgtttttctcttgaaacgcatgtgcaattaaacggcagaagttgtgttttcgacgttgcaaataatgaaatgtcgactggcagcaggacacgccctggttctcatgataccggttttccttccatttttaactggaccgaagtgtggcaacacatcccctgaagaaggaagtgtcaaatatgtctctaaagacgtcccgacagacgaacggaacgcaaggaaaaagcacagtaaactggtgaatcgtcagttggcggctcgcagatagcgacacaggccaattccgaaacggggttttcaacgaggaaacgattacagaagagtggctcggatgaccctttttctcactccgacccggtgacccgatttggatgcgagcgatccaaggggcgtggcaatcgacgctgctacactacaagaaagcggctgacgaactctcttgttagtgactaacgtcccaccatttttttcgctgtcatgattcttcttcactgcgaaaggagacctctccatatcggtgtcgagtcagtcgtttggcgtacacctgcatggtccaggagcgcaaacaccctaacccacagccctggcggttcatcgactgcagactggatcggagtcagctgacctggcaagacaatgaggaagcctcgcaaaggactggaaactagataagatccctgaacgtccagtcgttggggggtgagttccccgattgactttgatcgaaaacagttggcaacaagtggtgacggggcgatcaccaccgtcgagttaaatcttccattttgcctgctcctgatccgagttgctctacaaattcgttccgcggtgaaacagactcttctacggcagaactttgtattttagcttcccagagtctatgtgcttcctagatgcacctaaaaatcccaacgtaagcgatgaaattggcgcagtgcatgtcgatacggtccagcatataccagggtcaataatatgtcaactagcggcagcgccagtccggaaaaacggttgcactacaatttcaactccgctattaccgctactggtggagtttatagcatcggctgcagcgtctgtagcctctggcaaaacagcgaataccaattgcccaaaagttttttacgcgaatcatacgtggagacgcagtgaaacatcctcgttcgcaaacaactgcacggcgtacccccttatttgatcgataggtctaatatgcgcgtttccatgtgcttgttttcttcaccctaacacgttctatgctgttgtatctgtattatcacttgctgacgtagcgttatcttgaatacaccagactgccacactggccttgttgacagcaagcttcgggcggcgacactcatcggtaaatgctgcgccaaaatgcatcatgctggcatcgccgagccgaatgcgaactagcttatttcgttatgatcgcgcctgcaccagtcgtcgattgtgctcgtatgaaaccgccagcataggcggccctgcagtagccatggctaccagcgaatggttggtaaacctaaggcaaacagccttcacacttctgcttagctgtgcgttgtcgatattctctgcagattgttttgtcacctcttgcacagtcctctataacgacgtctgctgacgtattctagtaatagtatca

SEQ ID NO: 1480 - DNA, 3259 bp, Toxoplasma gondii
tgtcgttttcccgcaagctgaaatgcaaagatgcaaatgacaagtgtttctttcataggggccttgggcggctggcgaacaagacggtgtgctggacatgcagggttttccccaggttttgcgtcacgttcgattttgagcctgactggctttcggggtgcgcttctgtttctgtttgagtggaaaggcgatcacgcaatgagggggggagtgcgcgggcgtccatctggagagagtctaaaagtgcctcagtgcaaagtccactgtttgccgcctggggaaaaatttcctctttggggtcttcaaaagtccgttatcggtggcggtttcgcgtgcgtcgggggtccacagtcttgcgccacgcgagtccgtacctctggaaatgttcgtgtatttcccggggaaaactagacaaaagactgccgatggagggcaacttttttgataggcggatcccgtcaaagaagttacaaaggaaagaaccacgtttcgaaaagcaccctagttccggcgcagaagtcgaatgccggctgatcactttcccatgctacccggaaagaattcgatgccaagccactcaaggtcctcggactgtatcagcacctacatgtcggctcactgatcccttgttactgtacaagattccgtttcgaacggtagttcagcgtcagatgcaatttgtgagagcatcggtacggtcccgtttttacagacacgcggtgcactcgctcgtgacgacactttccaaacagccacagcaatttctgctgcttctttcaaacggaaaacagccgggacatgttcgcagctccgaggcggtaagcgacgcttcttcccattccccctgctctcgtgagtgaggcgtcaacttcacttctggcaaatgaactaggaaagctgtgtaaggctccggacttcagaacgatttacctcgtgctcgaaaggaacttccacgctgacctgtagctgccccatcagcaggaaagggggcgtcatttgactttatagagttcccaggcaaaaacccccgagggcggttcacagccgaggtggacgaagcaaacttgagcactttgtttctcagaaaccatgcaataggcttgtgatctttgaggttctccatttgttgagacgaaaaacagtctgcatatcccccgggaagtattatcgtctacgggcactctcttcctgccgagtgaacacaggttttgaggcagcaaaccagaagaacttctcagtgtctccgattgtgacgcgttgttctagctaaaaatggcgccacaaagttcaccgccacaacattgttgcgctgaggggaactgtatccgcctcgatggccaccttctgatccaaattcatccggagctgtggtgttaggtttcgtgtgactttttggaccagcgaagcgccacaggccattcgctggtcccagcctctctccgttcgcgccttctgctctgcgtctatgctaggctcagatggtgcccattcttctgcctgcacggaacgtggttgtctgcccgttttcccagaagtggtggcgtgctttttgtgaagccgagaatcaacgtaaatgcacagtctcacgctccttattcgtgttcgtgtgccaagttccgacgccgcctggcaaagtaggaaagggcgcctagaaaaaggcaccggtgaaactctccgtgcacatttccagtttgaccctcacactcgcttcttcggcatcacctatcaaaaacatgaagttcatcgccaggccatgtcctggtgctgccatattacgagtaggtggtgtctcggcaccaatgatcggcgatccagaactggaaaactcacgtccaatagattgttctcaaatcgtccactgccgactttgtactccgggctcccgacaggactaaagtcgatctattggaaagttccctcttgggtgtgtctcggtgtctctgctggaaaactggactctggaagttcgggagggagagaggtagctcttttgtgaaggcacctctgagggactgagtagcagcagagagggaggagggtagtaggccaagaaactgacatcagaatggaggaaatgtgtctttctgacgacggggagccggcactttcgcctggatagaacgaaagaacgaactcgacccaataaacacaccagaaagaagaaaaatgcaagaaaaagaggcgaaggcagcctctaggagtgggtgccgagagactgcgcgctggcactagagagatgggtggaattccgagtctccctaacggcacctactgcctttttacctcaggttcgctctgcaatcttttgcatgctctcttctgctcgtttgtcgcgtttgttttcccctcccgagttcgtcttacctccgtgtttcttctcctctttgtcgacgaagaacggttgcaaaagtcgccctcctccctcgttttcttgccggactggacaggctcctcgcacgcgcgaggtcactttttaggggaaacttttcctgtcaaccggaatcgcgcacgacggttctgaagagggagattgcagtgaaacacagagatctacagagccttcctcttcatgtttccggtccgttctctgtctttcccggacatcaaatatcgccccccatgttgcgggtctcccttttgtgtcttgcagcgcaagcgttttcttttgttcgcgagagcatctccacagttgcgtctttgcttcctttccattcttgcccgcgtcggtttgcatttcgagaagcttcactgttcccggtttctctccaggtttccccaaggcgtctgtcccttctctccgccgcgacggcacgcgcggcatgtgagaaagccttcgcatccggtgtctgtccgccttttcccctgatattctttgtccgtttcattctcaaaaaagagcgctttctccttttcagcggctctttattccatctgaacggggacgttgcaccgcgagacccaagccgcaaacgctcgaaaacgaacgcgagcgggagcgcgctcaagccttctcgtttttccccgtttctgccgtctcgttccctccctgtcgtctaaagagccctctgcgttttctcccgtctgcgttaagccacgtatctccttcttttttttgctcatcacacttccccttgtgcccgccatatttgccgggtgtttccgccttttctccagactctgtttgctgctgttctcgcggctcgttgcttccacttcttgcttccacttctcgcttcctttctctcctctcccgtcatca

SEQ ID NO: 1481 - DNA, 2529 bp, Toxoplasma gondii
ccgatctcttctcaagacacacgggcgttgaagcttaccattctggaaatacgcgagaaggcggctgagggccgcgttcgtcggcaagcagtcatccgcgaagaaacggagagctcgcagaaatcgacatttcttgcatgtcgacagattcgcctccttctcctcgttgtcctttgagaagtctcgctcttcatcgtgctccaccctgtcgcggcgttctgccggtggctggcggagacggcctttcggggactcttgcactcgacctgcttcgctccccattccgggacgccgccgcatcgactgattcgtctgcccgctgccggccttctctctcactcatcgacaccagaaaagaaactcgatacgcttcttgggctcatatgtaagcagcaaaaatgggcatttatacatacacgtcgaaagccacctagagaaacatcctcagagcagaaaagagtataatatccatttgcacagtacgtatacataaaatatgtaccaattcatatatatatatgtatatatatgtgtatacatacttatgtgtatatacgtgtatttggatacgtagatatatgtgtcgtcgtttttaggactgctgttcttcgatccacgcttctctgtctcccgcttgaagggcatgccgaggagtcaccacacagcggtcgactacgggcgttgtcgttttatttgcgcaacgaagaggcgaagcaaatgcagagggcttcttcagaagacttaaagagagaggttttcaaaaaaaaagtcttctcttggtggagcgaatccggacatcgttggccaaggcagagacagcgtcagaggaagacaccgcaaagagaaggcggaagggaggccgaaaaagagagagaggagatggacagagcgaagacgaggagatacggagaaaaagaggagagagaaaaagaggagacacagagaagcgatagagagagacacagagaggcgatagagaggagggaaagagaaagagggacaggaaaaggccggaaatgcacacacagatgcagagagaggaaaaacgaaagaggcaaaagctggacagatcgagaaaaccggagaagaaggaagaagcgccggacagagggaaatgccggtgacagaacacaacaaaagaggaccctttcgtttcgccgtgaaaaagccgactagctgcggatctccgagtgttcattcttgtacccttcgagacaattaaaatgagagagaaaaaggcggaaaacgagaagagaaaggacgttgcggcagaaaacggaagcgtttctttcctcgctattgtttctctggacactcgagacagctgccgattcaggttcaagtgaactatacgctgcatgcgactatcgattggtacgacggctgcagacgcgaaagctgcagtttcttcttcgccttttcctctggactgtttcgcttcctgtttgaaagcgagtcattttccttctccctctttctgtgtctctttccttcttcttccctcaactcttgacagtaccgaggcggcttgcatgcatgcgctcgcgaatttttctcgcgttgttgagactttgtcttctgcaggtttttccctccgcagtgtttccccatttgtcccctctgctgtctcctccttcagttgacttctttcatcgcattcgccttcaagtgtctggctcctcctccttctgctctgttcgtctctcgcgcctcttatctccctgccgcttcctcacttttcaggtctccagtgtccctatttttcggctctcgccttttcaagagcctcgacagtcgtcgttcctgcgagctttctgtcattttaaagaggaaccactcgttcttttcagttctttcccttcgtttggtcctcgactcttctcgcttctcctttcctcctcccaggtgagccgtgtttcttcgttcttcctgtggtgaggttgagtatccacttttctttctcttttactgggaagtcagagacagagagaacagggaacatccggtagacgaatcagcagagtccgtatggccctcccgagtccctcttctcttcctagattacttttcttctcatcttctcttttccacttcgtctcctaccgttttgcctctctttgtccattccttgcggagactctacgcaacctgtagaggcgccgccgccgcagaacggccttcctggctgcagtcgttcgtttcggacctccgcatataaggtggacgacaaaacactacagaaagaacggggatggacttccggagcgcttcggcagaccactgcctctgagatgacctctctttctcttctttcgagagacagaatatcgcagagtacaaaacgaggggatgcttcctcacgcgcgatccgagccttgcctcgcgaatgacggaggggctttctgtgagagagattgagcccccaatttcgctccacgtgcatgcagtcacgcgccccatatactcccatgcggagaagggagaaagccagaactaggtaaggaggactcgcatctcctttctgaaaaa

SEQ ID NO: 1482 - DNA, 2502 bp, Toxoplasma gondii
gcgcttcctcagggacttggtaattcgaagtaaaaatcacgcatgcacagagcgcggagacttgctgtgatggcgccaggaaaggtgtcttgcagattggagtgtctcatagaattcttctattcttacagatgttttgctcaaagtgtgaaaacgacgcgtcttacaacgattgttcctctgggtgacagagaattttttggcttccaaggacgacatacagtgccagtcgggcgacggctcctgcaggactgaaaacgtacttgttttcccgcagtcgccatctgaagagcacttttcggtttaaattcagttggctggtctgtctgacactcacgtagcgcgtgcgacttcaactgcttccagaaccggacctgaaaaaagcctctttcaaaacgttacttcctaataaaaatagaatctttcgtcaggcgacatctcctacctgcagcagtgtcgcgcgcagcctttccttgctcttagattacaagatctgtgtattcgaaaaagactcgaaacacacccggcagcccttgggtacgaagaaattgccatttatcgtccgtgcgaacgcgcgggcaaccagatcacaagggtcacagctaacgcaggtgtattccaggtggatttcgtggaagacatgaactgaaaacaccgtccgtgtgttgagcatgccgttttccgcgtgaagacatttggtttttttcgggacgacagtcagcatccggtaaaagcgttttttcttcggttactggttacccactgtgtgccttttgtcggcgtcggatctcgattgtgttgtggcgcatctacagtctttccccctggcgtgagagtgtcatttctccacgactgaatcctgttggcgaagtgaccgaagtacgtttcatgggcatctagttggtggaagctcagaggcatcaagcctgaaatcgggcggtacaagaattcaaacctgacacaaatgaatcggttcgttagatacgggggggatgacttctctgtcctcacacctagtacgactgcactgattaaaaaaggccagtgtgacagttgtttattgcatctcaacgtcgaagtgtggtctctctgttctaagtgtgtctaggtgccgagtttttcgaaggttgtggcgacctgcttgtgtggaaagcgtctctccggacacctgttgtcggctgcactgagcctgtaggctttgttcttatcctacacgctccttagcttagtcagtgttgctgtgttgtcagaatcttttctggatttcacagcacacttcctctgcggcaagccctgttttgtcttgaggaacactcttgatgcagaccactaagaagaacgtggaaagcttcgtactccaataatttcgggtatcaaaatagctttcagacatacttagaagcacctttttgtgcacttgctagcgttcaacttttattaaggagagatgtaccagcagaatggggatctaggatgttacctgctacaacggcctagccatataggcacctaatcaactgaaaatttcagtacctgtgggaagaggaatgacagttgtcacagctgagagtacgttcgtgtatcgacttccagacggaaaggccgaaggattctagaagaaccttcgacactgtgcgtaacatcccccgaggtcgtgttgtgtgtcgcctttctcctccccagctgtgaacgacgaccgaagggcgacatcctttattacggagagtacgcaaaaagaagccgcacaaagtgtctgctctgctctcggtcgctcacacgttgttgttgcgtggtacagacttgtggagttccagtccagcctccacgtgaagaagtcgataggttgcggcaacacaactcaccggaaagaacagattcccattttcgagtcctctcgcgtgattcctgcactcgccgcagtgtcacactgaacatgattgctaaacttttcgccactgttgtttcacgtaaggcactactgagagttttctgtctttgcgcgattcgtttcactgcctcgtttctcgccgctgccttcctcgcttttctgatctttctgttccgactgtcttttgtttgctagttcctcttcctgagggatcccttgagatccgtctgtctcgactctcgtctctgcggctcgcacaaacgaaccacgacgaacagccacgtttcgactgcaggagtgggggtggtttttccccgagtaaaacacctgtttccagcggtgctttcgtctgccaagttgaggacgagttcccaggtctttcggattctgtctcagcaagttttcgcggaacttccttgcgcgttcgtccgcgacttggtctgcgtcgtgcgtttgctgtcgtcgctccgaaaaggcagccccgctgctcgtttctgcatgtcgctctttttccacatccccggtcgctggcgctggcgcgttttcctcgcgaacctttcgcctggtccttctcgggtcgattggacccgcaattctgcaagtttcgtccttta

SEQ ID NO: 1483 - DNA, 4657 bp, Toxoplasma gondii
actctctacgcattttctgctgctggaagagggagctctgtttcgccttgctcttggacagagttggggacgcggttgtctcttcttgcttgcccctctgccgccactttgagtctttgaaggcggacaaaagaacgctagaccgtttatcttttcttttgggggcgactcagaagctgcactacgaaactgttgccccattgatcatggacccgtttgtatttatgttttagaccaggtctcactccaaaagcctttgcgccgagcgaaagagagacagagagaaaagagcgaaacagaacagcaggcggcttcagagctaatctggggcgtcaaggaacgtgcggcgccgcgtcgaaaggccatggtttcacccggagttttctatgcgagtacctttttgcaaaaacggaaaccaatgtgcgttggtttcgaaatctccacttgtatgaatgcgtgtacgcggcgagttccagagacatggagaagtcgtagaaaagtcaaaagagtagagagacggatggggacagttcgctcggcgcagccgtccgtcctttgttgaaagtctctgcttcttctcgccggtgcagatccgctgatggccgcggacgagaccgcattccgaactgtgcagtcaaaggcgtccaagtggagatctgcatctctgcatgcagctgcgtttgcagaacgtcgtacgcgtgcttctctctgcagatcttcgcatgtctacaccgctggtttctggaggctagtgtccgtgaacatttgtctatctgtggctttgctcagagcggcgtttcccagtgtctggctctcctctttttccgtttcgttgagatgcgtgtgtactctgtggtgccgggcgcaggacgtcggtgggggaggcccatgcaggttgtgcaggtctggatttcgccttttggagggtgtcgctcctctcgtttcgtctgcaaaggatcagggggactttggccgtctgtttgtcgtttatagacatcgggcagtgcttgtcaagttccctgtatctttgtttagctcactgtgcacttcggtcagaccaactgagttcaccaatatggtactaggaaataggagatcgcggcggcctcgctgacagaaagaaaagacttcacctcagaggaaagcggtgctcgcggtggcggcgaggaacagggagaagaggctacgcaatcgagagatgagtctcgtcttagaaaactgggacgttcgcagcagaaaagagttgaaaacgaacatcacctttctggaacggaatgctcaaggcaacgttacagagaggacgtgagagtcgaaacgaattcggagagtgaacgtacaccttcgtagctgcgtttctttggagatctccaaaatccaggcaggacacagagacgctcgcccattcaggtctgcattcaatattcactgaactattcatcaaaaaagatactcatactccaagcttccacgcacattaataatatctatagatgtatgtacaaatgcagctgcatttgggggtcccatttgagtttttgaattcctgtccttccgtcttttgacgcttccttctcttctccttcctcgttcgttgtgtcgtcaacttccttacaccttcgtttacttttcggtctctacacccctctttcgattccccctctgtgtcgccgttcccttcctgcctttccctctttccttctttctttcccttccgttcatctttcttctctgtcttcgctgcttctcgtgtctctcgtttctctcatttcttctcgcgttcctgctgtctcaagttggccggtttggggacgcgcggcgttgttcgtagggagtgtagggcacataggcgatgcggccggccttcattattcgacagatcgactcctctcgcggttcgttccgcctttctctcggagagtctctctctcgcgcttccgggagagagagaacgtagcgcttccacatttgcttcagcagatgaggcgccctttcttcttcatgctcttccctcggcctccgcccacactgagacagaagcccctcaagaatcggatcagactccctccatccttctcgccttcttctctcctccctagtgcactcgttgtcctctctctcctctcgccctcttctctctcgcaagctgcgcctctcccccgccttcgcctcctctcggcttctcccgcgccgcgctccttcaagaggctgctgtacgcagcgcgcgtcaaacaaccccgcgtcgatcccctcgtggactgcagccgccagcgcttgtcgcccttgttcgtggctcaacatttcccgaatataagccgaaaactcggtgtcgacgcgttggtgcaagaccactccaagctcggaactgcttcgcctgacgcagtgcccatccaccggcggttcgcttcgccctctgccgcgagtgtcgccgccgctttcgctcgcctttctggagtttcttttcggctctcccctctctctgctcgtcgcgagggaccgctgaacccccttggctgtacagccgcctctcctgcgccgtcccctccaggcggcttcgtgcttcgtgtgtatgcggcgagagcggaagacggcaaggaggaccttggacgcgaagagggagaaggagaggcgtggaaatcgaacaagggagacgcagagcgaagagaggatggaacatcgaaaggacaggggaacggggaaagaggtctcctccgaaaaaggcgaggaggaggagcaggtgccgcagaagccatgctcaagaaggagagcaaatagagaggagaaaatggggggggaggggcgagcgggtgagtgaggtggaaagcgacaacgctggcgagagcgagacgtcgaaaaaagagagataagggcaaaggacgaagagaattgcgtcgccacggtgaggggatgactctcgtctacacggagctcgagtccgacatagttgatgggagctaaacgcttggtcttccgccgcttgagagattcttcggaaaaattccagcagtctcaaaaatcgcgacaaagtccttttgaccgctcgaaaaacgctcctctctcaactcaactccccttcctgacttgcgatccgttctgcgcacaggtatacaaatggcctcgaccatatctctctctctctgtcgctatcgatctgtgtagatgtatgcgtatgcgtatgtctatatgttgatatcgacgtagatgtgagcggttaagctacacctctttgtttgcgcaaaattgtctacgaaggcgcttgcgctcctgtgtgaacatgtatgttttcgttggcgggtgtcgaaaactcgacggagctagctcgctagcctgattgcagtgcatttagagactctcaaagcattcttgttgcgatacccaagtctcagtgtccctcctggccgctcgtcgtttttttgagaggagaaggcgcggggacggacgtcgttgtcgatactcgagtacgcgcagtggcaatttcgagttcctctttacggtttcggcggggccttcctttcgctacgttttctgtcgtgatcgagactgttgacgcgtttcaaacgagcagatgcacaaatgcatttctgcactctcttctcttcgcctgtgaaacttcggtgccgatacacaaggcagagtgtcttgccgctcttccgagagcaggccagagcgtcggagtagagggccgctcttctccgttccttcttcgattctcctctgcgcgtccctccggacagaaccgttgttcttctccgttccttcttcgcttctcctctgcgcgtccctccggacagaaccgttgttattctccgttccttcttcgcttctcctctgcgcgtccctccgagacgcccccgtcacctaagagcactcggcgcgctcggcgtcagaccgggaaggggaagcgaggaagccgcctggagtctgagttcttcctctcggtctctccagaaagcggcgcgagaagagaacttgaaaacgcgctgtgcttcctctctgcaagtccgaactctcctctgaggcgccgcctctctttgctggggggagggggggggcccacaagcgctggcaccagatgcgcgaaagtttgggcgggggggggggggggccaaggcctccggaggggacgaagcaggagaaatagacgagaaaagaacatcacaccgtgcgttctctgttattctccgaagcgactcctgtttcgctttggcctcggacttcccagctttaaaagagcgttccttcctggacgaacaaaaacgccgttccttcgcgctctccaggaacagctccccctccaggaggaggatcgtgcagcagctgtttgagttgtcgagacagccgcgcgcgtcttgccgccgcattgcctgcgtttcttttttttcagtgcaaacggcgcctcgtccggaggataaaacatcggatttctctccattcagaattaaaagacgaaaaacaaagcgcggacggggccccactcccagagaaacttccaccgcccgttagcgaactgagaaccagccgcagttgaggcgctccccaacaatgtacgccagcgctcaaacgcaccgcgcggttgctaccatgtctgcgtatcttcgcttttccgctggaccttagcagcatacccgtgtcttcttttcttctctccacctaaaaacca

SEQ ID NO: 1484 - DNA, 1594 bp, Toxoplasma gondii
ttcgttttcacaacagggatcaccaacggtcaggagcaaagctagcgcgtgaggaagggcaagactatccactacataattctaggagaccttaacatctggcgaagcagcagatgccaggtagttattctgtgtaaaccgatctaaaatcgtgacggtgtcttgtttccactgaacttcatatctttgagtaagtggaatatacagttctggatcgcagatcacgtgtacatttaccggttagatgccagtatggtcagcccagacatgcaacactagtcagacacaactaaagtcgttgcatattgaaactacatactgatactacctcagtgttacttacggtagagagtcagagcaatcactcggttcactagttgctggtggcctgtcaacaaaaccgtgccttgtgcaaacggcaaaaagcgtgccgcggggaaagtagcaagcgtgtcagagtgtcacatcttgataagctaccgcggacgctgtgtcctgacgacgcctaccgttattttatttagaagaagcgttagagtggggagggtccctcagaagttcgatttggagttggacagcaacacgcgaataagaaacccaagcgccttaccggttttccaccaagctggctaatctcgcaagcccttgtggtgtcttctggaggcacccgatcacccaaaaagcctagaaaagtggcaggttcgcttttggatcccattttctcgagaaaggggcggcaacttttcttcggttgaactgagagctgccggcaagagacttgcaggacgaagaaccgagaaagggaggcgtttttggcgtagagcgaagatcccctgtttgcaattgattggtagtcgtttttttcggacgttgtctacaggatgatggaaaaaaagatcattactgtttaactgtgagagttgggaaaatcacagataacacgctttcgctgtgcgacaaaataggcaagtcttcgcagcactgctcgacaccagacatccacgcctcacacatccacacgactgattatgtcggatgcaaagttcccgtaccgaaaagttgtttttgccttctcaccagtacagttgcagaggcagctgtaacaaccgcatgcttcacaaaaaaagaagagtgcatgcgcatgctttaccttcttcgctcccgtgacttatcggcgcaccatatgggatacacttagaccccgcgaaaaccaacacaaaacatttttgagccgcgctcgtttctctggaaatagaatgttaaatgcatgaacttgtgaacaggagtcaaaattacacttatgtcaaggtttctggtcccggcgtggaatgcggcacgttcagagaatcgaaagaaccagggacaaaccgttgacaatttgcgttgcgccctgtggtcgctgtacgctaactcttgccagtttcattgacagggcagtgccgctttcgcgcggtgttatgcggtgatctttttcaccctttctcacttttgcagcattcgccatgcaatttgtcgtaaataccagcgcagcgaatggactgaaacacaactctgattgtccattaaacatttacagtatctcacgggcacaata

SEQ ID NO: 1485 - DNA, 1873 bp, Toxoplasma gondii
tttttctgatcagcgactgagcgatgtacaaccgaacatgcaacgtttctaatcttataagcagccatcgatttttcgctcggaacgacagaagttaacgatgtactggtttgtgccttagataactacgatgcagttccgcttccaacgaaacatcatgccattttcaaagccatttaacacaggcacgaatatatagctgtatcttcagcttgcgaggcaattgacccaccgtgtactctgcacgaatgaactcacagaaaggcgaaatcagctgtcacgcaccagacataagacacattacgcgggttttcacccataatgaactgttccgacctcccatgtgtgactcatggtgcatttccccaaatgtactctactaccccactgaagacacgaaatgggcaaaaatgttttacaatattaattgcgcagctacaggacgtaaatcgtgggaaaaggtgtggtgtttactcttgaagtgcactggagcgcgctggagcactggtgcgtgctggagcactggtggagaccattgggtcactgggcacgatagccccttcattaggagtgcaacaacagaagatgtctgagaaggcactccgtttttgcgaccgggatctgaaaacaatgttatacacatgtgtaacactgaactatttcaagagggtattctacgcattatctctacacgttgctgcagtgcacgagtcttccaaaaacttccaatgccaagactcactcttcaatgggtttggacgccattttgcttcacgttagggaaaagttggtaggcggtaagcaacctctgcacggaaacaacaagccacgcaaaaacaccactggtacagcaacatgggtaacggacaacacgacctggacacaaccacggccacttatatctccccgacgaacgaggacgaagtatctctgagccaaagtccgtatacacctatgtatatagagagaagtaaagccagaagctgtaacaaatactgtagtgtcctcggatggtccgtgccgcgacaaggccatgcaagcggatgcatgcatgtgtttactatgcgtgtggaaatttgcgacacggacgaactagatatagcggcgccgccagtggaattacgaaggcattcggcacacaatgacatcgagttcagtacaaacgcgcgtggccaagcagtgcctagtcgggacaaaaaatgaggcaggaggaatgcgtgtagtgcccctccagcggggaaaatggaaacatcgggatagtgacgagacttgattcggtgcaatggaatgcttatggacggtgacatgcacgcgacaatcactgggccatggagtgcggaactttacctcccgcgataagggcaatcgacagagaggcacggagttgggtcgagagaacaggcgtcctgctttgccacagacggggtcaaacgaaaacgggactgggaaagagtggtaccagcgcacactgcagtttgcttggaacgacggcgcgtcgtagtccaagcgactgtggcgagagcgaagaaagaaaaatatgattcgtcgccttgggcattctcgacgggacatttaccccatgaacattacttggggacgacgcggacgtgggagggacgaaggtggagaagcggacgcagaagcgacaggaagggacgactgtcgccctgcggagacaggaggcgcacaagcacgacaatccgaaattccgaaaataaggcgaaccactgtgttcggcaccgggtccgccgggcaacggcttctgcgagagacaaacgcagccgcgcgagcacccggaaaagcgaaagggtaacccgacaacccgaccgcgagggggaccaggcgggcaccttggaacaggagttgaacggaa

SEQ ID NO: 1486 - DNA, 1274 bp, Toxoplasma gondii
atgtctccaggaaggtttctggtatttgacgtatctcctcagacacttagagatagattctccaggacccagaattccctgtttcgttgtctcttctttcaactgtcaattgccacgagcagtgggaagaggtttcatgaactttccccgacggcgctccaatggtggacgaggcgcagagacgggatgtcgcagtcatcaataccacgggtcggctgtggacgcccacaaaagacgagtaagactaatgcggcttccgaagtgaacatcccgtttcgggatcgtgagttcagccttttctttcatgcttgtgagtcttcttactattttgtgttgaattgtatcccgctatgtggcgctagtgcgtataggtcgccttgagtaatatttaacacatgtatcacgaagagcaccacactacgagtaaatgcagtatccgataggaaaattaggagcggttgagaaaggatggtgctcagtattgttattggagtcagatgcagcgcattttcttaccgggattatatttaccgaatgctctctattcgtttagtctaaggcagctatgtctgtgtcaggtacgtctcagtggatttcatacacgtctggaaaaacaccaggattcaggtcaagcttctcgtcgacttggcgttgagctggtttccacacttcggtgttggatgtcagcaagattcaggtgtggggagaaaacatgtgccaaccttttgggcggtgctgcgaccctgcaacgcactgacaaaagccacactgacagtacttctcacgccgttcctttgtccagccctgctgcacacatccgtttttaaaggttccttctggttttcaaaaagtgtcacgtttgtttccctttctccgatgtatctgatctagagggctccgtgattttagaatcagaagtttcaggtatctgaatcccgacgtaaaaaaacaggttctgatttggcgttttccagtttctccgtagcaggcacttcactcggtgaagtcacttgtttccacctcaagggaacccggtccggaaatgctgtcagtacgcttctcctttgccctactgtgggcaacactgtgtctcaaggcacagggtaagactttcgctctgtttaagcctgccatcctgaagtttttcctcagttactggtggttattcttgctgtcctatgatgaacgtccacatgagctcgacagtcgaggagtgcaccagcagaagcaatggagctatgagcaggaattacggatatcctcggagtgactca

SEQ ID NO: 1487 - DNA, 2044 bp, Toxoplasma gondii
ccagtttcttgcggacggcggtagagaagcagggaaagaagaggagaggaaagaagaggagagatgagaagagcagcaggaaaaccgggaagggaacgaagatggcagagatgcgaacgacggggaaaagagaaaggagaaaggtccggatctgtctggaatggcccatgccctcctatgtctttcagaccttttgtcgtcgccccacagttctctcggtcgtagtcctcctcttctatctgcaaatcgggaccggcggcgcgcactgctgttgacgggagggcggagcctggggtccccgtgaggcgcatgtacactccacagctttcgcatctctgaggcctttttctgcttccgcttttcctcttccttcgacgctccttggagactcggcgtggacctctcagtctctcgttcgcctcccgatgcaggtgaccgaagaggcggcgcgctcaccgaggcccagcggggaagccagagagaagccgccttcagaggaggtggagacgaacgcggaggcggtagactctccctcgctatgtgaagggaaatccgcggggaacatggcttggtccgccgagttggagacgcagacactctcgagaaaatgcttgggtcccctggaggaagaaggagaatggaaagagaaaagaggacgacagcgaacactcgaagcaactctgctgtagtccgcctgccgccagcccccgtcgcctcccctccacgaaggccaggtgtacgtacacctgaactcggagtctggagcgcgttcatcatggttgagggcaaagttgagaggccgctgtcaacgtcgacattgaagcgcagcttccgcgtcttgcctcttttccttcgcgaattctgcctctccaggcgggcatctccggttctgacgcgtgatggacgaaggccgaactccaccgccttctctgccccagagtcagcctcccgcagtccggtgtacgtacacaccgcacggagcgggctgagagagggagtcgtcggtgggaagagacagctaaagcggatacgaaaaaccgtcgttttctcctacgtcttccgcagaaaaagcgaccaaaaggagaatgagaagaaggaaacatgacccgtctttctccgttcacaggtcttcgtggttttctcttggcgctcaacgcggccccggccgctcctcatctgccccgggagacacctctccatgtctctgagcctctcgcaatatgttttctccgttcttcgacgcgaatcctgcagaagtgaagaacaggcgcgcgaaaagccgcgcggacctctgtcgcctctttctccaggtcgatcttctcgaacgccctctgagaggagacgggacttggggagtcgaggctgcatgcagaaaaagattctgtcatgcacacctacgattgttgtgccaggcatctcgacagtgtcttcttgcgcgctgcacacaccgtctcctccgtcgtctctcctctaaaattttctcttttccagcaaatgggcaccttcttgtttcccctctggaccctcccccgcgaagaaacctcttgcggagcttgtggctagtcgaccggcaggcgagcggcgccgtcttgccgtcctctgcatctctccacgagctttccttccttccaccgtccacttgttgctgtttcctctcctctttctcttctctcctgtctggcacaagtcgacgcatgtggacttgtcagcggcgcatgcaccatcctagtggcgccctctccgctctctgtctgctgtttcctgtccgctcctctcgcttccggccgtcggtttgttgactcttgactctcgtccgctgaggcatgaatgcggcatcgcacacagttgaccgaggcagccgaggtgcagacgagcgaaccttggaaggatcgcgtcgcctgacagtctgtccgagcccagcgcgctgcgaggccaggagagcggaacacagcgagagagacaaccagttcttcaccgccttgctccgttcctcgaaagctttccagttactctttcaaagagatcttctccctcgcggccgcga

SEQ ID NO: 1488 - DNA, 2378 bp, Toxoplasma gondii
ctgtcccgtcacgccggtcaaggtgacgatctgtttcttggttgcctggggtgcttcggcgaagacggccgagaagcggtcgcgagtgcgggtcctggcgaactgtccactgaactgcggtccgccgttcgtctccgggaggcggtctgcctcagtctgcaagtctccagatggagcgcgcgcgcgctggatcgtcgtctccctccgagctcgccgcgcacggggagtgtacatacacaacgcacagccgccaggttctcggccgggcgggagctgcaccgttttttcgcgactgccgagagactctgtgcacgctgcttcatttttttgtttctttttcttgtctcttgtttgcacggaccttgttcagtcgtgcatgcgttgcgttctctctctctctctcgtttcgcgactccgcgtcttcgcatgcgcgctcttgtgcgcactcttctctctggcgacgtttctggaggcgccgctctcctggagagcggtgccttgtcttgttcacgcctctcttcgacgcgcttgttttttacttttttgcttgcaaagggtgcagcggagagcggggcgcgcgggagagaaggtggagtcaccaggggtgtgtttcctgtcgtcttcacgcacgtgtgatctttcgagtggcgacgggatgcgcctcgccgctcgcgcctcttgcgtgcatcttccacaactgacctccacatgcccgggaaatgctcgcaaagaaaagagagaaaacgaccagaaacgaggcaaacggaggcaaacggagacgcgcgagcgactgcggacgcgtccagcctgtcgtcctgcggggcgaggcgacgagcagatgtgcagactcgccaacattttcgactttgtcagagcaaaggttggagaactcaggaatcccacactgtttatcttcagtcaaaacgccgcacaggagtcgacgaagcccctggcaaacatcccacagttcgaaagcaaatcgcaaaaacatgcttcagttcaccacaactgacgacacacagggttcagtgtttagaacaaaacactctacatatttaggtatatatacacatattcatgcacatgcatgatgcagggtataaaataacgttttctatacatatatacatatatgtacgattatacatatatatatatatatatatatatatgtacgatatggggttttacggtctaggccgcactctggcggttcggtttgagtgcatgcatgtggacgccgcagaagttttggtgcggacggcgcgacagataatttccctgaagcactgaacctctttcctcctccggagcccggcaggtgatgaactggacgctggagcgctcaaggtttttgctgcgctggtgcggaaagtcttttgttcttgagtgacttttcaccgaggaggttgtgagtgttaaggcgctgcagctttgtacgtggcggaacatccccgacgatgaatttcgcttttcttttgtagtccggttgtcgctgcggccgtcgcacatcccagctgattcacacgggatgtctgcttcacgcttgtcctcgctgtcaggacgtcagtccttggagccaaagacagggtgaacggcgggtgagatgaggcaaagccgtgcatgtgaggctgcaggggggtgttggagaaaactgcaaccgcggacatcgagatttcgctttttaactgcagaaaacgcaatttccgcctcactattacactggatgcctgctgatgcggggcggatttcaggcaaagtcgttttttccgcacatgcacgcggcatcgatgccaaagtgccgtggctagctagagcgaactgtgtgcgcatggataaatacgtatacaggtgtgtaaatgttggcaggggtcctactgccatttcgctttctttcgactctgctgcggattctggagtttcaaaacgaattctttctcgtcgcctttccctgaaaaccgagaaaagtctgtttgcaaagggagattcaagagtgcacggatcttgtctggcgaggtccagctcgcggacgagccttcctcgctttctgtctcatcccggggtgtctcttccatcttttcctcgtttttttctgaaagtgcttgcctgcgagagccactcagcagtaagagcggcctaattgctgccctttgcttgccggcgagacagaaaagccgatgtctcgcatggtcctcgcccaggaacgaggctatagatacaagacactcaaaagacccaggtgtgtgcaggcttggactcaaaagacttgggtgcatgtacactcgaaggctctgtgcggacctctgtaggtcgtagttgaagagtcgagaagctgggggcgcggattcgagaaaactgtcattcaaatggcgaaaaca

SEQ ID NO: 1489 - DNA, 3097 bp, Toxoplasma gondii
aaagcaaatagccgtccagtctttgaagaaattttgacattgttcgtgcctatccgaaaacattctccatcatgcataaacggggatagaactctgagttttgtttctgcccgaaacctgtgcctgggaaaatcaaagtcgaagcaatctcgagcatcaggcaagtgaaattcctttaggtggattgctttagtttcagtaacaggtgcgcacgccacaaatgtgtcgttctgccctgattcccttttcgtatcttctgcatgctgtcgataagtacgggcaggtcgtttcagttgacaagacaacaggaaacaaaagattttccgggtatacacgttggtcacttgcttcagtctacattctttcaagtgtaactgtctattagctcaatcagtgaaagaagtctctgttcgattcactcacacgaagacaaaaactgaatggtgaactaaacaaattgcacgagtccgatctgtggttgttcgcttttctgcggacgaccacacaagcagcgatggctgagagcagtattgactgtgtcacgtatcgcgatttgtgactttgaatgaccccctttttctccagcatctgcaacatggaatcgatgcaagaacagcgtcgctttctccaagtcgcatgcgtatctaaatgctatcttggtgtgaagcaacaaggcaccgaatcaaaacgcagtttcagctgttcgctcacatggtatttggtggcgttctcctagactgacgtctgaaataaaacggaaagtacaaaacgatttcctaacagcgactgctgttttgtgtatacgcacatcagctgcattcttttccggcgcactcttctagttccagtactacctttttctttcaacagcctggcacaacggtgaaaaagataatgcgcacggttatcggttttttcacgagcatgctgagcgtagggaaaagcatttggagagcggtaagctccgagtgtgtttgtagaaggcgcagacagtgcagtcccgtgacgcatgttatgtgacagaatgtgatactctgtgtagcatgtgttcaacagtacagtcaaacttgcgttgcggtgaaaccgcaggttttccgcgacagtggatttccggtttgtccgaggtgtccgaaaacggacacagaagtttcagtgaatgtcttacacaacgcgtcttcgccgaattgtacattgtgttcaggtcctcagagccgctgtctaaccggatgtaccaggtgaatctcgcggaacgaaacaggctatgctggtctatccgacagtttttttcggtcgccgagaggatattctcttgcatcacgagacacaccgttcatgtttttgttgattggtgcttctctcctctccatttgtgcagtagcttatagtctgactgaatagggtccgtgtcatgtgaacattctggcatgcgatggtgtatgcaaaaggtcgcgtcgggtcgtccgtctgtggtgttcgattctaggggagcgcttctccggttggtttttgttcttcagtcgcaccgcgtctccccttcagaaggaaacccgacaaaaacgtgtctgtcgtcgcgtcctttattctgaaagagaacttggtatactctcctgcctccgctctcgctgcgagtgtctcgcgtgtgcgtgtttgcgggtagaaagtcatctcgcctgtggggcaacacgtagagtggtgagctcctttttgtgaggaccgcgaactttgaatttctttggcgatcattttggctctggcgcaccgtctcgttgcagccttctgccggaaaacgaagagggtggaaaatccactttccccgaaaccacgcaccgcaaacagccgaccggggcatattctgtctaatgatgattgtagacaggtgctttctatacctgaattgggagaagcaaattttgaaacggtgcaaaaatagtatttccatactcttagtttctcatctttgccgagaaaaaagatttccacgcttggtgcgatcttctgtcgctgtttctcgatagcgggcagcttctttcccgtccaggtagaatgtcactctgctacgcagatccgatcctgaactcaagtacttgactccgtgttgattagaaaaaaaaagtctcgacagcctgtgacactggaaagcacaagtagccgtgaatgtttttacatgtctgaacataacagctctcgaagaacagtcgcaaaaacgataacgagtagattgttttgtaatgacggacgacatcctgcggtggtgtctgccttggactggagcaaatcagattcgggatctccagaggttcgcatcaaagatcagttcagtaaaaaggcggagctcccttgtgtgttgctcgtcctcttcatatttgtgtaaaggtgctttccctacagacataccttttccacatgccgcccggtgaaactctgctagtctttagatggaaattgcagaggatgttatgcgctgtccctttttgcgcctagcaggcttccttgctgaaaactgccctcgagttcagaaggacagcttttttagaggtcgctacttttcaccagaggattgagtttacgtataaagatctactggccagcccgagatacaccgtgtttcgtccatctagagttttttacaaagaggacgtttcttcatctcaagggaatctcttttctcatcccatggacgtgtggccctatctgcatatacctattagagcaaagacgtgtctctggaattgcgcacgcaaactttttccaacctgtcggtctcttcgatctcctctgaaaactctcaaaaaccttgccactggagtaaagccgtgcgcatcccttctttgtatgcactgacatatgccctctaacgtttgtttctcacgtgtgtcaccgtccgtttcggtttctcaagatctccacggagccaaaacgcattttgtccatacagcctccatcaggtgacagccgtgctgcctcgttcctgcgaacctttcatgaacctggcaaggagcaggggagaacgtcccccgctgttgcattccgtctttagagaaagttgttgaaaagaagacagcgagaaaaagagcgagttgcagatccctagcaaaca

SEQ ID NO: 1490 - DNA, 2015 bp, Toxoplasma gondii
aggcgtaaatacggttttaggacagaaaagtggtgggcatcaccaacgatactttcggtttctgttccctatccgtgtgctcgagctgtgccagtgacctgtatatagataggaggggaaaatcaagacaagcgagcgaagagaacagtagaacaggaagtgaagagaacggatctgaaaaatcccacacatcgcgaacacacactattggagttcgttgtattgcccgagatgacttaggtggcttacatacgaaaaaccattgcttctcaagcgcacttccactaaatatgtagcgtgtacggaaaatggagagacggcgaaacgtcacagatgttctccaaaacgaagatgacggtaagccgacaaccacggtttgagggtaagttggagactacaaaattgtggcggtatccgatgttgtcctcccttgcggaggtcgtcaagggagagggccagttcgcttctgacgtggatcctcatatggtccaaaagaaaccagcagcactttctgaatcgctacgaccccatcctcttctgccttcaatggcgcacccgacttttttgagggctttcgggaaatgctgcttcccaccttgccgcccaccttgtcagaagtcatgggcctctgcggatgcctcattccatatgtctctttgtcatgtgagatagcccctctggtggacagttatatcactggcctaatggatggacagagacatggaaaacacaaggtactgggtcattaaccttaccagagaaagtctatgaaaattgtacgtttcttaagttttaaaataccagtagtgacccttgtccgcgctagcacgggcatccgctgtggcgttcccagaccgaggcaggggcgacggtctgcatacagcaaagccctgacgcaacgttaaaaaaaagtatctccaccaccagaaggcgtctatatacgctgtgattagccacatactgaagcgttagagaaatataaatactgtcagaggcttgcactgagacttgcgtttccaacatgtggcttgctatctcacttccgatgttcgtcttcttggtaccgccgcctctgcgaaaattccgcgggagtgactagccacatgcaagctgggttcgctggagccataaaagctctaacatcatcgttttgttaatggcacagcaggtgctgtcaaaaaaagaaatcccgatctttccagtactgtggaaaaactgaacctacgcagtcccgccttgcatgctagggcctcatgagacacagatgtacaccttggaaacgcctgcgttgccgcaaccggctacagtcacgagacgtgaatgtgttttcacttttctgtttcgttaataacctttcagacgatgttggtttaatgcgacggtgtgctctgctttttccgcgtatggaattgccgtgctgcagtctgaggtgtacacgtcctgcacactgctgtacagtgagtagtggacgctttacgtggacgaccgcgtacatctgaaggactttacgaatgccgttttgcgcagatgcgcttgtttttcgatgtttcttcccctcctgtgcttcctctgttttctgagaaaaggagaaaaaactacgaggtggcacccttgttcccacttcgccttctaccactctctggtttgctcccggcaggctaccgggtgtgtctctggcccccccgagcctaatagggatcagggtcggtgaaagggtctggaagaacgaaacagtatataacctgctgcactcaggtttcctcagtttttcttcagtgtcacatttcgggtagtggagtgactgtggtagttccggaaaataaatttgcacacgagagacgcaacacaaaactaatgtgagcaatacttgataatccgtgaggtctgaggggcacccgtcgactaagcccttgaacaaggaaactttcacttgcccctcacttacgaaggactccctgagcgtgcatttctttccccaaaacgcttcataaacaaagccattctgctaccagtaa

SEQ ID NO: 1491 - DNA, 1771 bp, Toxoplasma gondii
acacctggtacgttgttcagttgattccagtgctaaaaagatttccgtctctcaaagagtattgcccctcctgtggcagcgaccttccgaggcaagcagaccgcacagcacgagcctccgttgctgggttgaaccgagggaactacgcctacaacaatcaactgctgagacaagaccatgtcacaccctcttgtgcagactttatcattttcagattggtattttaccgttttttccccgtcgcctcctccgtccccctcattcgagtctcttcagtgcccgcggggagtgaaaaggaccccccagatcggtggacttggacatcctcaaaaagaacgacgcccgagatcggcgatgccaccgccgcttcgacccattttttcaaggtcccccgccgccccccaaacgtcacgtggaaggacagagctgcaagacctcaatgatttccgcgtccggagttgcgcgacgagaacaaagcatctgagcctcaagtgagcaagacatttcttcctcacgcactccggcgattgcggtactcacggtgccatcgtagaaacggagaagcctcggcttcccgtgattgttcaccacgataaccgccttgatcatctcgggtatcttttctggtcgaaagagacaaggaaccgtggttgtttttgcgcgataactcgcgtccttcccaccagcgagacgtcgtgctttcacgcctttctctccttcctagtgaaccgcaagtagcaatggcagtgcgaaccgtacgaaggatcgaagatgagctgacagaagatgcacgcggtggacttattcctggacgcttacggaagaaatgcccttgccaccggcggcgattggcgtttggctcacgactccggagtcttccacgacctggaactggagatgtcttaccacacggaaagggatgagacaccgactctcccttcaaggcgcatgcatcgccggcgtcatgacaaggaaaacggaaccgtcaaccgtgttacggggacgaaaatgcgtgtcagcttgtacacggtgaactcgccgtacgcgaggacccccaaactcgaaagccgacacactggagtctcgacgaagatagactttgaagcgctccccaacataaatgggaagacaggtgtgtctgttgaccattgaaaagaaaaaaaacggcggggtggaggctccgaaaacgtacaatgacgagacacaagtggtcaccagacacgcatgcgcggttctagaatacacagaaagtggatgtcgacgtctgtcacgtcttcctgggactcacgagcttgtcagcgaataggttgtgtaccaagtgaaccaatcccgcgagtagatactcgcattgtcccccgatcttttgcgtgagctcgacacgccgttacgggcagttaaaaggcgcagaccagggaaaggagataaaggaggtatctgcctcgacgacggaaaaagcgacatatcattgaccactgccagaatggattaggatagaaacacacacttgtacatcattcgcactgctatctgtgctcgagccgtccatggtgacctagacccaactttcatcgggtagatacgggttgcatgcaaaggagcatcctctatccttcgctgttgcggctcaggcggaaaaactcgaattaataacttggtacacgaaacgttttcaagtcactctggaaaggggagcctctaaaccctgagaatgttttttcgtggcaatggaggctatccgcttatgtcggctcatatacgaactgctatcacg

SEQ ID NO: 1492 - DNA, 1175 bp, Toxoplasma gondii
ctttatgcgtttgtatgcgtggacggactgggtgccgtctctgaaagcggcaggccttcagtaacgaagagggtttttatgtggagcatgaagcagaaactaaaatggtgcgaactgtgatctttgcggattcactgtgatttgcggaagcaagatctgggcaagcatgctgcaccgtcggagctcaacaacatcagcgaagtccttgttaatccctctcggctggaccggaggggaacaccgcattttgctcgcttgcattggagcaaacgactttacttttatgatttatccccgaaagtcaaggacctaatgaagactgcacggggaccgaagacacacacgctcatgtgcacacacgaagaacctcttttcagacacactggcctagcctagttcgccagcaacacagttatcgacaaacatcaataagaaccgacacattcacatgtgattcaacgattgatcgcaagttccaaaccacaagcttcccaaaacaacaaggtaagctggcattcactgcagaaccatcaagtcaagcggaatgcgtatgcatcccttattacatcaatggtaatggagttggtaagggcctgtctgcattcactggtatgcatatcagtcttgtgactgttgctgccggaaccgctccacagccgcatcgagcacaacaggcagggcagcgagcaagaaaggaagctcgaaaaccgtgacagagagacagcgtagagtagccacaagccaggtatagtgctttaactgagacgaggacaaaggagcctacacgaaaaatgagaagcacgattgactgcttttagtccccgcttcacctcgctcgccttccgttcagcaggacgcttttcccttctcgtctcgctgcactgcaagaagaccaggaacagatcccatcgaatgaatggtcaattccacggggaaaaagctagattcttttcgcgtcttttcttggctgtgaatgccttggccttccattcccaccccaggtggccgtagacaacggactgtcttggctagcgatcgtggtaggagttgcgttgagtccctggcttcggctccacaacggtggagaggagagctgtttattttctcgagaaaggacaacctttctggagacgtacagttgggccagaatgaggattctcgagttccagaagcca

SEQ ID NO: 1493 - DNA, 1528 bp, Toxoplasma gondii
aaaaacgcgtggaaatcgtttgtcagtgcctcagtttgcttctggacggatacggatcgtcagatcccttggactggctttcgcctgacagagaatacgtgaattcgtcttaatgttagggacgtacagcggaacaaaacgtcgttgacggggttgcgtgtttcttgaggattttagtagttgtctagccagaaagtgccagcacgaagctcaccaaatggacattcgaaatttcacgtggatctgtgaggctgaaacactgccttgccctcctggaagggagcgtgccaagttcgttgtttcgtcaaaagcatccacgcaaggcaatgacagcaagtcgggaatcatgagttatcggtggttgaaatggagtgtaaaatctagtcctcactaacaatgttgttaaaggatacagggcatgagtcatttggtttcgccacgattacgttgtcactaccgagatccacggaatggatttcatgcaagcaacaaagtcaacgggagagagaagcgaggcacatgaacacgaagaagctaaggagcagcagcgtcgcaagcctcagtctggctggacttctcgaacgctcacagcttagacagtgacggacgcctgcaaacttccccttcttgttcctgagagcgtccccgtgttactttcgcggcgttctctaggtcactaagaagaagcataatccctcgtcagtgcttgtaacaagaagacgactcttcgtgataccggtgactgccttcaagcagactttcggagttgctcggttttgtgtgggtgctaatacagcaaacttgctacgcaaaaatgtgcttttgctgcttggatgcccgttcttcatgtgtcggaacgttatgtcacttttttcctgatgaattcaaccgggaccaaaaatgtcagagcccctcgaaagacagcgcgcttttcaccgtcacccccactcgttggttgagggaattgctggagtgcactttggatcacaagacggttttccacgcgcgtcacgtttttcctggcaaaaagcgggaagggaaacagagtttttcaacattcaggaaccttcccccctccggcttttcgacccgccagttagtcgtggcaagccgtcttggagaaagtgagaggggctgtaatccacttcaatgagcgagaaacaatttgaagaagtctcgaatttctgccgccgcggaactgtccgctctgaagatgatctcttactacctttttttctgggggtgacgacttgccgccgcccccactcgccacagacctcgcacggtcgttgtggcggaagtgatcgttttcaagtgtttaagaagtccatagagatttttcggcaacatgcagtttgaaaacatcgcgggcgactcgcgaagagtactctgtctactgaagcgtttttttttcgtgaaaaacgctgcatgcacacaagcccttctcgtctataagcgtcgcggcctcgcgagcgccgcggtcggacattttcgagtggggtcgacgattttgtaggttctctgttga

SEQ ID NO: 1494 - DNA, 5043 bp, Toxoplasma gondii
ctttgagagaatcactcatcgagggcgcataactcgggatgttgccatctcgtgagaaaggcttctctgtgtccaggcgaaaagacgagccttcgcgctccgctcgcgactccgcgctccccgccagggatctgtgcatgcgcctcgaggccccaggtcccccttcttcgccagcttgacactccgagtggaaagaagaggaccgttcgtcgtacggaggacgcggcctgagagaagcactcagggcggtcgaccgcgacagcgaggccgctcgcatcgtggagactcttccagttattaggggcctggaggaagtcgagacccgagagaacgcgtccgtcgcctcagcggtgggagaaacgggaggatccgttggagggcgagatgtcggtaactgggagcgacagaagtcgctggctgtcgtctcagtcgaaaccagacgagacaacgcggcactcgaacccttgaaataggtggacggccctcccgcgccttccacggcaacagaagactccataagtcacgttggtgaaatcgccgcgcagagtcaggaggcgggaaaaaaggcgcgtgaaatcaaaaacgcgacgccctcgcacgccgagtgcagccgagctcttctgcaaggcgcacaaactacgaaacgagacgagtttgttcgggaatgacgccgatgtcgcggcgggaaacgcggagagaacccagaaaaccgactgtgaggtccgcatgtgatcacctcctcgcaaacacgagggacgatgtgtcgtcccgacgcgaaaacaaaaactgcgaagcagcacaaaaaggttgcttcctggccttacaggttacacatggaaaaggctatgggaaccgaacctgcatcagctgctaaccggacacggaagaggcagctgactccgctgtggtccaggagctcgaaagtggagacaatgaaagatacaccggagatgcgattgcttaagagggcaaaggtccccaagagaaacgtagaagcaaagaaatgacacaccctgccggtttcagagggaaaacgagtgactggggtgtcgagacactcggaggagggtgtagcgccagagaggtgcttggaacagagcaggataacaagcacacaagcgggtagacataacagaacgtccactgaatacgtcttgcgagccttttttcttcgctattcttggcattttaaaagtggacacgggcctagcggcttttctcgcggtatatgcgcattcaacaggaccggtttcccccgtgggcactgtctgtgtcgccagttctgcagtctcagaaaagaatctgaagacacacacttggtccgccgcctttctctcgagcgaaaaagtccacctgtggtgctaccagggactagcacatcgtcaaaaacgaggtgtgggctactgagaagctggaaaaaagaaaaagggtggaattttgcaagacgcacgctggaagcggcctcctcttcgccgagcgggaaaacgcagaggggaggcagttgggggtggttcgtaagggttggaggtttgcggtcgacaaggcgggtagagcatccgcgtgcagtcacaggaaacgtttttcagttaaattcttggaacaggaagtcgcttaccacgatactgcactacccaccggtttgcgtggtggaaaaccggaatacacttttgtcttacaacatctgaaagaaacaaccgcatttgtgaacaccgcttcagatgtgagtggaggtctactcttacgttcccgtcttacccgtgggatcgctttgtgtttttgctccttactccgcctcgtcagaagctgcacacagggggggcttcttacgcgcggatctgtggagaaaaaggtgtccatagagggaagtccctactgaagaggctcgccacagaacgccgctagcgtgaccgggggctacactaatgttacagtttctgtagaaagataccgcgtacctagacaggagcggcctcactgctagaatgcgacgcttggagtagagttctagcaaaccaaacgggtttcggtcagaccgcgaaatgcactgaagtaacaccactgaacagaaagcagtcgatgaaaacctggcgcggatgtctgtcaacgaaagcagggcagggagaaggcgcgcgtgtgcagctgcgagcctgtcaagagcggattttcaagataaaccactagtccaacgcctcgcatctatctacacatgacgcctagaacataaacgacgtggaaaatggtggatgtcgggcattgaagtccaacacatttaggaaccccactgtagcaacctagttccccgttattgctgcaccagtatttcatgttgagctactctgcacttggggctgggtgtccgtgtagcttctcattgctgaaactccccgttacacattataaaacgggattattcccctagataggtatcggtagtctagtaataggtgtcatgagtaacgctgggtttctacccgggaccgcacattgaaacataactgtcgtcagcgatctctacggcttgcatttaaatatgtatgggattgaaattgcttcccttttgagtgggaagcgccaaaacaaaagtactctgtttgttgttctgccactaaagcggttggaacaatgcgatggaggcgccttgtccgcctctcagaaaagaacaaagaaactggagggaaaatgcacactgtcagactcattgaacatcgagaaatccctcaaggaagcagacttgaaaccgtctgcagacgtgttgcgtttgaaggaaaaccaggacgtatacagacgcaccactgaagcaaaacgttcaacatcggcattgtgtgcaaacaacgaaagaaactagaaagggttccacggtgtagcaagtgactagatcctctttcgtgcctgtttgaggaacagggaatttcttgagtggcgttaatgtttctatagatgcgccaccggcacgcgtgaaatgcctttcaaatcaagggttaatagacacatggtccaatctctgtgtctggtaggttccctcactggtgtctgtaagaaaaacgacagacaggtttcttgatatcttctgggaaaatgacatctctcgttttttcccatgaacttcgtgtgaacaagactaaaccggactgtcgctttcggcacgactgcgctaacgggtgtagactagatccacctgcacacagggatgcagaggagctgtcacaaacgtgaaaatgtgacttcatcaaagctaggtcttgtctatacatctctaagcacgccaatctacatatctcatatccatgtagagtttcaccggtttcacccaggtgggtccggtggttgtatgtcaaagccattgttgaaactggtcaaggttcccagggagtgacctggtgagtcacaccgagtatttctacccttgtttttccgactgcaacagaggccttctttggaaacgtcaaaatccggaatgggctccgacacagtgtgccaaagccccatcgatttgctacttggggttaaatcgaaacagcggtgttccactcgcgtcccacttttctgctttatttgcgattcgtgtatgcaggagagagagaggtacgcctatggatctacttgtccgcgtaccacaacgacaattaatcggcgtcccgttggctttctgtgttcttctcatgcatgtcgcgaagctgtccgaacgagctctggtggcttggctactccgcgactcagaaacgatgtttgggtcctccgaggcttgatcaaagacttccgagttttctgcgcgcagtggcacttttgaatcgcacccttttccctcaagccacctctactcgtttgccaacgctgcacacaaagtgtatccgtagtgaacacgaaatcactttcagcaggcagcccttgcgccgctgtacaggctatacaggtgtcttgcgtatgctctacaggtttcgctgcttttttcgctgtctctcgctcccgtgtccggacttaaacctggattgcaacagaccaactacagtttctggaaagcccttttttctgaggggatcttcacaggttctgttgccaccccaaaggcgcctcagcccgaatccgattcgtggctttttttcggtacgactgcatgcacgcagggttctttgcgcgggtgtagacagtgcgcggaacatcgaccgttctgaatagctcgatttccaggtctctagtccgcgagacacgctgtttttcacgaggcaagtcgagaaaagtcgtctcagactggtatatcctagatgccctcgtcttcttttcagtcgcttttctctaaccgggacactttcctgggtgtctgcgagggcatgcacctccaagactcacattgtggctgaggaaactgcgtcttctgcccttcggtgtcgctgtctttctcttgtataggtgaattactggcccgtctcttgcttcttgcatctccctacttgcgtctttttctagccagagcttcctggcgcatttctgagccgtcgcagcttgtggccgctctcgctcgacttctgtatgtacccttgtcacactcgggggctttcgccccttccgagtgaccagaaatggcgtgcttcccgtgtgtgttcttgcccatggtgtcggccaagacaacacaaaaacactttttccccgaagccggtcgtgctgcctgaagtgcacgtccatgtactggcactctgcgcttcactaatacctcggcctctgtgcaccagtggtgatgctcggatatgttgttatgtttgttagaggctaactacccggcgaaacgcccctttcctttgtaacacgcttctcttctcgttagtatatttgacgggatctcctctccaggctctgcgcgtgatgggaagcgctttccgtggcagtcgacatttcgagtaacgctgcacactgcagatatttgtatgacgtgattcacggcggtatcaacttgtgttttgcccgttgtcatgagcaaaaaggcagcgttgcctctttttccggaaacacgtgagcacatcgcattctctggttgagcggaactcgacagaa

SEQ ID NO: 1495 - DNA, 3376 bp, Toxoplasma gondii
cgacgcaaacttcctcttgcgcgtacggtggagcgatcttgagtatccaacaatgaagcatgagtggtttgtcgcaccgatgatgacgtcgcctgtgcacttccgggccgtaggttggatcgcctattacggagtgcccgagagatgcagcatgcaggcgtggcactataggcggacctgcgtcaagcaccacgcaaatgtcccagaacaaggcaggtgcaccaaagagggaaaagacaactttcagtgggtgccaagggtgtcggctgcttaccttgaacgagccgtatctcgacgagtgttacaggatgcgcctccaacgcagcttgcacaatgggccggaaaatggagtaagcagctttcccctccgtcctttctcccgccagtcgccactccctggaccccggagaagggcgacacacagacgatcggcagtgcacgacgtcgaccggcatatgcccccggaggacagcaaggtaaacaggcacacaccgcggagtaccgagattagacaagctcagaagggatgagtcccgaaagaacgcaatcgctccacttgcttgtacgtcgatcccattgaataacctgaacaaatgcgataacacatgtatagaagcgtacttatgttgtttcaataaaagcgcacgcatgcgcaacagctgattttttacgacatcgcggggaggctgtcggtggaactccggacagctctaaaactgtggtcttacagattgtattcggtgtcgtattttcttttcttcagggcctccatatacgttgtcgggacaatgaaagttaacgaagccagtgtatgtgagttcggagcagcttccagtagaaatagtgtgctaatgttctcctctcatctacgaccacatgctgtttgttaaaatcgaactggaactgcaccagtgcgtgagtatatctccgcgtgagaacacaagctgtagtctcttcagcagacgcattcgaaatagcgtttgtggcactgaatctcttcgataaaagaaagcgcatgtgcaacatcaaaaagacttccgaacagcgagttcacgacggtcacggcgactcacttgagagattcgtttgcgaccttgcccggaaaaagccacgaccctgaagaagcgcgtctctgtttcggtccgccattccatgcactgcggtctctcctgtccttattgaaaacgagagtagtgggcgtggacagcaatatctccccgatatccgggcactgttctgagttttcgacatagcctgcgtctactggtttaccaatgcgaccagagggagggacgaatgcttcatagcaaacaccctcctgggtggcctctgtcctttccacatccgcacgaggaagctgtcggctcacgttcggcgaaagcgaacgccccttgtcgctgttcccagtctggtaacccgagggccacggcgggcgggcagttgcgtcgccgggtgcaccagcgataaagccagaaaacgccagagtttgccgactacccagcagtgtaatcgactgcaatcccgcagatgaaaacctcgaaagacaccgctccgttctttcttgctgtggtctactgtcacagctctccgtagttgaggactgccgccgccagacacgggctccgtctccgctagttttcgttttcaccgaagtaaaaacccgtttcccgcaggagaggaaagatgcttgtgatgcgagtctctcggagactctactgaaacaaggggacttaagtgatggagaaagagaaggcggaaaaggaggcagaggcattgtcacaagaagaaaaagaagccagtactacgcggaacataatgcacactacccccctgaaaaacaaaattcattagacatgggaagcaaacagatgaaaacaatgtaggttccagaatatgttgcagagggaaaatgcgtgtgtcttacaacagcgacgaattgaggcagaaatgcagagtcgaatcgaatggacgacccacaaaggagcccgcggtgtctgaagtcagcacatacccgcctaaaggtttccgacgtggaagacctactgcaagagaactccctctttcgtgcttccaaaagaccatccaagaagcaaccttcgctatcactttggtcctttcatcatcaagcaacgtgactgacggtcttatgagagactatctccgtcaatctcgactcatattccgacagaatgccactgcacgagcacctgttcctgtgcatgcacaggagttgaacgggcacagcatgtttctcgcatttgcttataaaattcaatcgcatttccctccagtaatgaggcagcctggagctgcgctgattcttttaagttttcatctggacgcgaggatatttgctgttctgcagctcggtcggtgctgtgtgaggcaggcgggacgacttcgactgccgattggttgcttggtggctgaggaggctcgtgttttttcagaagcacgtccaggactctgcttttggacaatacgcgggcaaatgaaagcttagcctcctcataaagttcgatttccctgattcaagtgcgccgcgaaattgcgttgttttgaacgcggagcggagcagttttctcctgtgatgtcgcactcctcccggttgacaacgaggaggcaaaaaacgacaacgtactcttcgcccctctctgtgtctgctatctcacttcctccatttcttggcatttttgcgagagggagattgggagtgtccgattctacacttgtgacggagagctgacctgtacacgtagcgaacgcaatgcagtttcatgcgcacggaagcggttttaccagtggtaccagcgacaccgtgtaaaataattctaactgtaaatacctgttttcatgatgtgcgccgttcccacaggcgtacacatgcgtgtgtttgatttagttccttctgcctgctgttcttgcccgttgtttctcttttggctggcgttacgcgcattcaggcccgcaacaggctcccgcccgctcattcacccctgctgttctttttcctcttctagcacacagcaggcgtaatgcgttgcatatctatatatagatatatttatttatatatatttattcaagcttatgcgtacataaattgtttttttacccggcacggtgatcatttgcgcccccggccgctgaggcagcggtttccgatctcatgaatctgacgacaaattcttgaatcgccgggtttgcttcggcaccgattactgtggcgaaatttcctgggttgctgaaacaggagaaagttgaagagttggtgatgctgaaccttgctgcgtcgtacccgaatagtcaaacggtggctgtgtgaaaggctgccgtacgcacagaaaaaaccgcgtgtgtcttcacacacattgca

SEQ ID NO: 1496 - DNA, 2067 bp, Toxoplasma gondii
gttgtccgtcgcagcttttgtccacacgcagagtgttcagaaggaaactggacatttcttctccacattgtctcaacgttcgtgtttcgaccttctcgtctgctggccgcgatccgagtccctctctctccctgcgcggttcctttctcgaaagtctcttcgaccgtcctgtctctttgggggcggggcttctcgctctttccgcagcttgaacccgtggaacagcgagagtctgcactggaattgccgcactgcacgtgaacactggatcctctgcacaagtgatcgacgatccagaacatttttcgaatgaaaaagaccttctcgtccttctgaaaggctctgtggagaagcgaggaaggaggaaagtgttcgatttcaggatcttccggcgtagagtggctccacgcgaatgtctacgcataaaaaaatcggcagatgaatctcacggaacagcgaacaaacgagttctgacgacagagttcagtgcgtcttctctctgctggtcctctcactggacgcacagccgttgcgacccacacgcctaggtttatacagagccctgcacaatcgaatagataaatacatccaaagaaactgcagaaaacgacatacgcatgcagtgcttgctgctgagacactttctaaactatctatagacatacagagaaaactacagatataaatatgtacatatctacatatatatgtatgtatgtatgtatgtatgtatgtatgtgtgtatgtatggacatgtgtgtaaatgtgtatatatcggaaggtgaaagggtagacttggaagagatggattcgttctgcttctcgtttgtaggtgcatctgaaggtctgtgggttctgttcgttgacaactcttccgtgttttttggacaggcggggagacgcgaaatgtttgttcgcgtttctcctcggggcgcgcttgaccagcggctgtccctgacacctgcccggaagagtgctctgtgctttcgagatctcaggtgtatctccaccctggagactcctagttgggttgcggttttctgtgtcgagcgagaatgaagtgcgaagcaaggcatcttgcgcggagaaggccatcgacatcgaggaggccggttcagagacgatgcagggaaacaccgcatgttcaggctcattgtttcactccaaccttcgcttttgtgccatttttgccagactcgttccctctccgaaacatgtagaaagaactgcacccaagtgcaccctcgagcgtgtactccaaaaagtctcgggaggcgtctcctttcctttttcgcggtcgggtgagcgtctcgggcatggcagaagttctcgacgtcgctcctactttctgtctcaagaggggggacgagattggtgagaagactttgaacaccctgggtcgtttttccttcctttctcagggaacattccttgattctctgcgggtttccttgcaaggaatgtgacgagacaggaccgcaatcgctgcggcgccgctagctgatcagacacagagcgcatgcgcgagggatgccaagacactgtcggccttctttcgtttctccttttcaggtcgcgatcaaagtcttctttcacttcttttcttctgcagagttcgtcttcacactctcacgttcccctcgacgcatgcagagcgtgagtctgctcggtctgcggcgcgcgtccgctttcttcgggtgttctcgaaagtgtaattgaccttctcgctctcacgctccttcttttcccctcctctagctgctgtgcacagttcacttctctcttcttcacctttcgtctccttttctctgagggctgtcgagtctttcatttgcggctcccgcggtctttgagaacgtggatttcgaggaactcggaaagacttaaggaaaggcgcttctcttcccctctttgtctcctgagatcccctctgctttttaccgtgtttctcttcttcacgtgcatgcgtcctcgcctcgcctcctgctcttttggagactcgctggagtttgctgttcttccgaaatgcatgctcaaaaggacgacgacgcgacggaagagaaaaga

SEQ ID NO: 1497 - DNA, 1800 bp, Toxoplasma gondii
acagtttcttcgaaggaatgctctttgtcgagactgtgctggagcttctcctcgcgccgcgcggactcggcggaccgggcctgcctttcgccagcgccgtcgaggagacagctgtctccagcctgcaagcgtctcgggggagaccagcggcaggcgagggaggactgacctccgaagaagaacgcaaagcagaagatcctgcagccgcagggccgcgcgcagacttttgcgcgccttgggatgacgaagaactcgacgagcttgcagaagaaactcccgccggagagggagagagtagcgaaggcgaaggcggcggcgccggcatcttgaacgaagaaaagaaagcgaggaggaaggagaagaagaccgaggcgaagaaaacagggaggaagagactgacaggggaggggagggaaggcggaggacgaggggatcgaagaggaagagaagaaaaaggtcgacgtttgaggcagagacgtatttttcaccaaggagcttttgctgggattcctcgattgagagaagtctcgcgttttgttcgagtgacctctttcggagcatccacgcagcgaagccaggcgttcataggagagagtctgaagaaggtgtaggcaagttgagttcctggaagaagctgcgtggacgatttttcttctctcttggttcgtccgagaggaccctgtatctttgcgcgagaagccgtcgacgcctgtcagatgtgcagaagacggaagtagtcaaacgacccagtgagaaatggaaatgagcgaaccggagccatgagaagaacagaagtccacccttttaggggagaagcagaagaagcatccacaaggatgtccgtcgcctgctcgcttttcttgtctcttttcgcgtggtgtacggcgcccagctgcctggtcgtcatgtgcagcaggtgaagaggcgttttctttttctctcgctttttgccgaagagacacactacgcgtcgagttctcgctctccaaaaagagaagaagacgcggtgtagacgcagaaaagggaagagtctttgcacagcgcaggcggaaagagcgccacgggacgatgcgtgctcgccgacattcttgcggctttttcggggaatctctcgccttctgagagaccctttggaaattcctgttcacacctggacactgaaccactgtctgacgaagaaacgcggtaaaaaggaatgttggcaagaaagaggaggcgagaaccgatgcgtccacaccaccgaccgcgacaaggcgagagcgaaaaaataggcgatatatggagggagagcgagagcggcgcgattctgctcatcggtgtcgtccggcgcgcgtctgcgggtatgagagccgcgcagcgttcgcgttgcatgcgaaactcgacagaattgactcgagcctttcaaagggcctttgaactcttgtgggaggcggcgaatctcagcagaacagaactcttcgtcgttggcctcctttgcggtccggatttccctctgttctcctcgctgcaacttctcgtcttcctgacctttctccccttccctcccgttcactcgagcacacacccgacaggaaggttctcgatgcttcttctctcgttcttctctttcttccactggactttctttcactctcagccatctccagagagacatgctgagatcacaaaggtgaaaaagacgaggcagatgcttccgaacgcacccgcgcgcccaatctgcttcgcctccaagttgttctctcgccgtccttcttccttctctttcgaagtcttcttccaaaattgttccaggagtcaaga

SEQ ID NO: 1498 - DNA, 3064 bp, Toxoplasma gondii
acggcggactggtcatcaacctctcgaaggtgtttgtgtttgacagcctcaaagtctgtcgcaaagcctggggctcctgttgtttcctctccgcccgtggatttgctctcggcggtcgcgcgggcgcctcctgcgtctttcacgccgttctcttcccctgcatctctcgcgtctggagtcgcacaccctcggccgccagctcgactcatttgctggcgcataaacgcctggagcgcgttctggtcaatctgatcatccattgccgcggcagctgcagcgaggccggcggccatggccaccgccacaccttctttctgagccatggtggtgtaaacgaggaagcaaatgcaaggtccaggaaacctagatcatggaaagttaggtcgtgaaaagctagctcgtggaaagctggccgcaagcaaggaagccagactcgcaggtgaacacgaagtcgtagagtgtgagaagcactcacggaccagacggaacgcagcagacaagcaaatgggttgccggaaagaggggggaggagaagcggggtgaaagaaagagtgggaacgggagaaaggcagggaaaggccggagaaagcacgcgtgtcaggagaaacctcaagagcacaggtgcaatggagtgcttgggcggggagataggcgcactcgcagctcagaatcacacgggaaggcaaacagcagtacagattgtgtacacgaagtgggagaatcgggagagacctcgcctgacgacaggtcggaccttaaaaagaggcaacggctcggctgttgccctctaccgtgtggggaagaaacgccgggaaaggcaagttcgagtagagctggcgatatatccacaagaggcactagcatcaacgaaggaagaaaccccacaggggatgcggagcggcaaacgtgaggcagacgaattggtgaccggggaaaattggaaaagaccgagatccactggtgaaaaccaaagaaatcacggaccctccttcactcccgacacctggacctggcgggctttatcagaacacgcacacaacgagcacggaggggcaagaaactgcagaggtcaggaacgggaggaaatcaacagcgtcgagaagagcgggagagccaacgccgcgctgccgacgtcactcccattcgttcgtaagaaatgcgctcgccggccgcttccttgtatctcagtgcacaacaacaaaagcccaggacgaagcgagactcgcatgtgattgcgaaaaaagacagccaggacgaacacagtggagagagacacgcaagagcaatttcgggtgaatgccttgctcccgcagtgccggacaaacggagattcttcggtggcgtactgaaggatgacggtgaatgcgagacagaggaatgccgcggcaaacgttcaccgattgtgaatactcgacggacaaagaaaggacggcctcaagaaagccagcacagcagcgcggatggtgattggtgtcctccttcctccgttaacaaaatacaggacagacggtcacggaaacaaatgtgaaacagaaggctgagagatcaggtaaatcgcatgtatgcaaggattgcaggcgggtccatcggggaataaagcttgcgcagcctgcgacgaaattggcacccaggcggtgatccgatgcatgcgccactgcctgccgaaggctcgtcggaaacgcctcctctaccattgctgaaattccctagacaatcataaaaaggcaactactcatccgaaaaaacaaagaacatggtgtacaggcagcttcttctttgctccaggcaatagggaactctgcgttccggacatcaactgctccgtaccgcagttgcatctctggcgtctgaagtacaacacaaacattgggagattttccttattcgtgaggctgctacctagcataagctccaagaaaccacccaacacccgtggattgcctttcctgacatatgcgctgctctgcgggaattctagcaagtcgcgcgtcaagagataactcactatccgggcaagttctgaatcacgaaataaatagtgtcggttgtagcgaggtactcggctacagctgacgtgaaaatgggaacactttttggtgtacagcccccgtttaacgtcccgctgtgatcttttcgcataagcggacgggagccctcagagtccagtctgttctcccgtaactcgcttgcaaccaatctgacgcacagagtataaaggagtttcattgctgcttttggttcacattagtacaggagctttctaggtttccaactgtttcgactttgttgcattgagccatcgccttgtggggtgaatgccgtatttatccaagaagcagaagctactgtatcgccaatagtcatgaagttcattagttctagaggaagtaagaagcaatacagcttcgtcgaagcggcgctcgcaggtaagcacggaaaaagtgttcctccacgttgttctccattgcgagcatgcactagtcatgaggctttcttcacacttttcctcatgcctttgggatagaaactggtcttgttctgtttttcaatcagagcccttaaacttgttctcgtttccgaatgacatcgctcacatgtggactgaacgaggcatcgcgaatgtgaacttacgcgtgagcattcttatccggcctcaatgctggtgacaaattagtggcagttactcctgaatcgtgagagtccttccatgatacggaagaatgacaccagcgtctcgaatgcgtgtatgaaaagtgtgagagcacctctgcgttgggaacgaaagagaaaggaacaagcaggccatatggtcgccaagaaagtgtgatgaagtgcgtatgcttgtttatgaccaagaaaatggcacccagggacagcgcgtatgagacggggttgctgtccacggtgttccctagatggtatgcaaaaacctggggtcggcttctctcagtgacttttagactcgaatgtgcactcgcaggcggtgagattgagacggtcttatataccctttcttttagctcgcttttttttctgtcgctctctcgccaggactcgccgacga

SEQ ID NO: 1499 - DNA, 1494 bp, Toxoplasma gondii
tacagcttcatgcatcacttccagagaaataggcaacacacagagaagcagccagagaggtttgctacatcatcacatatcctcgatgcatgtacttacggttacatatatatatatatatatgtatacatggagaaagagatctggtatgaagagtcacgcataattcacatccaaatatttgtaaataagcatgcatgtatatatatatatatatatatgcatatatgtatgtagtttggcttggagcacgcagctgcgtccacgatcatgcctggatttgtaggagtgtatttttgagagtggaagagctgtggggagtgcttggcatttgccagaggggacagacaaagaaactgtttactgcctcgaacgcctctggcctgaaagaatgccaccccccaggcctggcacactctacgcgtacctccccagtgtacacaaatatgcatataaatgcgacaacgtgcgtatatatatatatatatttatatatatgtatgtatatttgtattgtttcgcaagttgtgtagaggaaaggaacacgatggagataaagacgacaagaagaagagaggagaagaaggaaaagaggagagagttgaaaggcaacagcaacggccgcgaaacgattctgtatcgaaagaggagattcctcgcagcgaaaaggcgaaaagcctgtagaatcgctgcattggtgtttggtgcgttacagtgtttccttttcttgtgtaggagttcaagtagaatggtgcattttctctccaagaatgccgctttcgtctgtcactgttcgcgtttgcttttccctgtttcgaagcgttgtcaggtgctctgcttcctcagccgcagagaaaggggcgcttctcatttcttccgctttgagttccctgttgtgtcttctccctcctcttcatcgctagcatctcccaccctgaatttcagactgcatgcgtatacacgacgctgtctgctttttccgctcgacgcagggtcttcattcgcgtctcgttttgcatcttttctcgctttctccctctcgttctctttcttcttccaccttctctcgccctgtcttttctcgactctccatcatatgtgtgcctgttttctctctgttgttctgccgcttcttgcccgatagagactcttgccgtgtctgctgctcttgcggcttttctcgcggcttttcttcgaattctccttctccccgaatctctttcttctcgaatcttcttgctgttctcgaattctatttgccgttcctgcaagagtgctgactcttcttctttctcctcttccttcttttctccttgtccttctctcctcgtctctgcacacctcagtctctcgacgctcctctgcgcgagcttcggacagtcacttccactttttctcgtctcgtcaactctcaagtcttttctctttccccttcttcctctgcgcctctcgttgtctcctttgtttcctccgtctttcgcctcctctctgaca

SEQ ID NO: 1500 - DNA, 3271 bp, Toxoplasma gondii
tttttgacgggcttgcctgaggaaatacgggtgtgcagggaagcgagagcagaggagttcccagtctcgcaattgggcggtgcttattcacattgaacggacgaagtcgtcgtcatttccgcccaaaacattgcagaatagacgacaccgaccgccttcccagtgcaagtgaatggggtcgagtctggtactcacgactagccagatggaggtacattcgaacacacactggaggcagcgtttttttcgtttcaggcacctcgacacctcgttgatcctttctgctctaatgcatgaagaagggattcacaaagtgcttctcgctttgccacataaatggggtgcggtagcaccggaatgctgctatcttccgcgatgaagtgaagaagctggggctccgccctctctgttacagtgccaataacttatgcgattgctggagtttcttatataacatccacaagcattccagacccggggcgagtcgggctttcatctgatgtgaaagctcacgaagctcgacaaacacattataaaatagggtggcacaggcgacccccgcgagccgcccgcgattgccttaataccgcgattgctcttgaacctgtagccgcccacacaacccccgtgggaatcgcgaggctacagtgactgccgacagattatatgcacgtcacgtgacaacatccttttgagcagtggtcgcgatagcactacgacgagttcctcgaggcgccccgccaagtttgagatatatcttgaaccttgaagtgagacactgcagggattcatggtcagacatttttcctagcggaagcaacaagggattctgaatcttgtcgctccgcctacgcggaagaacggcggacaaaactatcggcgtagattccgacactgtgaacatcaaactgtgcttgccattggcgacctctaactgatattcgttctggtggtgagatggacaaagcgccacggaaatccttctgcacgtgacgtcccctaatcgctgttgatgctcacggagaaaaggctgaggatcaaaggcaaaaacagcagagctagcctgctgtggtctacaatgtcaggtcccgcccagcctcgacgaagattttctctcaatgaaacggagtgagccatctgaagagcctcactgcatttctctgaccgaacgctcgcttgttagcatctcaaagactgttcataaagagtgtgaatctcttatactcgcagagaggaaacgcatccatcctttgtggcttcctgggctgcaaagtgtcgcctcggcgcccagagggcttactactaacaacatgatctcggaattgcactcgggttgagtgagctgcgggcaacgttctgcagaaaaaaaagattcagttcccatccggggttggtgtactttggagttcagcatcgtctctatccattgttcagtactatggctattctcagatcaccacctaggaacgaactgaggataattacaagacagattaaaggcggcattctatcctcgagtgtttttgctctacacgttgaacctcatcgcatctaccacctcagtcttgctgtcgccaatacaaattcgcacgtggtacgcgtggtgcaccgcaatccttccccttgcatgaccttccccccgtccccccgctcttgttcccgtaggactcgcggatgcagcacactctttcatcccgtgggcagcggcactcagctatcatcatcttcagtgctgagcagttttgacggcgagctgtgctttgcctttgctttcccgcgtggtacaccgattccgcgatctatttaacattgacactgtgccgttcagctctggttcgcgcgtcaacctccagggtgccacttgtcggatccttaaccctatcgcgtacaaacattccctgccccgccaggtccaaggtgagttcggtttatggtgtgacaaaaattcggcaccgcggagcaaaaagcgcccacctgctttggtgcttgtgtgctggctcaacgaatggacttcatttctgtcccagtggtttcgaggtcaccgactctgatgtgtgtagcgcgacgcttttgcccgggttcaccgtggacactgttctactgcgctgaaagaccagccactttcgattgcgtcagaaatgccagtcgttgtcatacagactttccctagcttacagtaccgcagagggcacttactgcgggtccgggcgtcctcccagatgcgctgaggctgcgccgaaggcatgttcactcgcacaggttcagacacctccgcgtgatgggccagcgctctcagccacatttgaccgttcgcagctcaggtgcgcggagtcgaccttcagcttccgtgcgcttggattgagcatgcccgttgcagtcaggcgtccgcgattgtcttctaaatgctgtgcgtctgcggttcatttctccacggaggcgtcaattgtgtgtttgtcatttctgtgatgagaacaggtgtgttgaagctttccaaaacgcgtatggctgctgtgccacaccggacctcgactctggtgctgccgcggctggcgtcgagttggcggtgcacagctgcgccctggaccacattcgaattttcccgtcgttacagcgcaacattgtgtttcgcacttttgtcgcaggaaattcaaacctttcgaacgaaacatggcataagtgcgtggcggacacgcctcgtctcgtctttgctctgacaacagagcgcttccgacagaaatgcacgccgcgaacccgcaagaaaactccagacactgtagaaaagaggaaaggcggccaggaagagcagggccctgctgcatgcgccggcggttggaggcgagagtgcctcccggcttgggtgcccgcaacgttgcgttttttctccctgttgcacgaggaggaagcagcgactggaatatcctccagtttttccaacgacgcgcggttgacggagaaaactgccgcgtaggggtcgtgtacacaggccgaaggcttgttccaagtcacagtctcacccgtttcttgcggtccacggaatcgcgcgcgcctcaccgtccgaccgacctcactggaagctgagaagccacaaggacgcagcaccttttgctcaagtgctgtctcgtacatgcggatcgcctgccgggctgccgcagtcgagaaacgctcttttccgaaacgtgtctcgtgcagcgtactctttcgatacgtttctctgtccggaatctgtggtgctttaccgaaaggccgttggagattccttgtcctctctcca

SEQ ID NO: 1501 - DNA, 2202 bp, Toxoplasma gondii
gaaggagttctcggagtcaggaacgctcgccgacaacgcgacagtggaggtcaaggctcgtggatgacgcagcagactctcgcgctcgtctcgcgactgctcagaggacgagtcgttgtcagtggagtccgcaaatgcatgcgcctctatcccggccttctcgcccgaaacctccatggcgctcggaaacgccttctcggcctcagtgagcgccatcttctcaagaagaggagagagcggggtaacggaagatgccagcgaaaacagtcgctcagacacggtgtttctccgttttccgcactctctctagttcggtggtactgacagggctgggggtaaagaacccttgattagcggggagtaacggcggtaaatcgtggggaaaggcttcgtttttacgatggaaaacggaaaagggcaccgattgacagaaaaaatggccgaaagacttttaaaatgacagaaatggagcagggcttgaacgaaaaggaaagggtgtcaccaagaccttccaggaacggcgaaagtgcggaagtcaagaggttaaaatggagattgtcgatttatctttttgcaggaaaggacatgagagaaaacaaacgcatacagatgtgcacacaagccgcgaacagaagcatgcctacctccatgcactgaacaggcatacacatacgcttacacacgtattttgaagaagcagttgtgtatggatgaatgaagcgatacagagtggttgaaatgcttccaatttgcgaaactcgcagacttcctgccgtatgcgtcgccactgcagtcggttgctcgttcaggttcgtagtctggaaaagtcaggctctccatcaccagaaagaacagttgcgagttcttctgcgcggaaacgaaaataggttcagcacacgactggcaaatgcctgcgtttcctctcttcggaggcacaaacggctccgatgacaccagggaagtcgagaccccaagactggaaggtttcgttgcctgcccacggcttgtcgcagacatccctctgaacgttgattcctggagtcgcttcgcgacttcctcccgaaggaactgctttgaatcgcctaggcgaacaatgacgcgtcacaaactggccaaatgctgaaaatggccatggtttcgtgcgctttaccacctgcatgcaacgtgagaaaccaaactcttccccatcgccccattctccccaactgaagtaggatcggcgaaacggcagagaaggaatttaacgactcagagaaagattcttttctgaacgcgaaatcgtcagcccgagcgagcatatcacgaagcagcgtctcgtctagagctgcacccgaaactcacttttccctgcatgcgcagtgttcgtacactgcacggggggtgttgctcggattgcacatggctgcattccgtgtgaatcgaaagcatgaatggcacaaacggacttttcaaccgtgagaggaggccggaagtcgtccgcgcggcaaagagttcttcgtttctccttccgactctccttggcttatgccgttctcggtccagctagaagacaaaccacctggcgtccttcgggggatctgtcttcgggcctccgccggtgcaacgcccacctttgttcctcgcccttcgccttcttcgactcgctgagtttctctgccaggccctgcgtggtattctgtccgctttcccgtttttcgtgcgaacctgcgaaaaaactcggaaggcaaccttaccggtttcgtgtggcgcagccagccacgagttttcatcgaaaagttgcccagttttggtctcgacgtcgtcacccgcctcgctaatttttcaggtcgagaaacgcggctatttcgttccagtacggcaggggccctcttccgaattttctcagcagttcctggttccggcaaaggatcgacgtttttagtgtcccgttcaaaagacctggcttctaagcgccggaacgtgtcccgtgagtaaccagttacttgtcaacccgctgtgactggatctcccccgactctgttacagaatcttttcccgcagatgtccctcttcatcttccacatgtgcatgtgttcatatagaccccattgcgtagttccgcccgtgaacatgcacatctaacaatgtgtagaggtccgcatctctgctggtaagtgtacgaacggtctcgcaggattgtagaattcctttttcttgcgacca

SEQ ID NO: 1502 - DNA, 2031 bp, Toxoplasma gondii
ctgatagatccctctcctctgtgcgattcacaatatcgtagacagcggaccacgactgacacagaccctccggtaccacctgggttcttggatacaacggaacataaaggtctccaagttgtcctagtctaacaacctttaactgtcactttccaaacggaatgcagtcactctgaaaagtggaatctgcttccagagagatcccgtggcgtctccgcgcttctctggtttgcagaagatattcttgatcagtatcagccgaccacgtggtccgctgagagcttcctgctagcgactcacttagagatttttcgtggcaaacgggcattaagcatttgatttgctaccctgctgaagaccgcagacttgcatttcgctgtgtacaagcagaagcagtgaccgatgttacgtgtggaaggaaacggtgcaccttgtggtgcacggagtcacagcaagtcaaccgaagttcaccacagttcaattttgttccgttcaggctgttccaaatggaaatgacacagcacttaggcgaattgcttcctgaattctacttgccagggagccggcacctccagtttttaggcacgctttcttcgcggtggtatacaaaagctgcaaaatcctggaggtgatccactgcgtatatcatagcgtcaaacttaggtcgcgtgcttgtcctatctgcacaatgcgctgtaggttggttttctacgtcaacaaatggatccaatgaatttttcacccggccttcagttgacccgggcgtgtgctccgaagtggtggaagcgtttagaggtccagcaacgcgcacccccctcctcaacgagtcagcaaaacaactacttgacgtcaagcgagttacaggtctcacaaataatctgacacaaagccttaggctgctagaggtcactcctcattcttttaagactgtgagggtgagtatcgattctcaactcgcagactgacaagccgttaccacctgccctgtcgccaaataccttggtagggcgctttgcaaacgcgacactgttcgccaaacgatgtctatcaagaaatgtaacgttgaatcactgtggtgcttgaaaaactacctcgatgttccagaagacattctgatttcgcgacttcggttgtcgagttaaacctcagatgggtcttcccgtcactcgcccggcttgttttccgtgagctcttcggtgaccagttcctgccgtccggagttcgtcttcgccgtccaccaatcgattttcgtggttgctctttcctcgtaggcttgaaagttacgcagagaatctgccatgtcttgcagcaaccgcacctttcccgcatgcgccaagcacaggcagcatgcatgtaacgaaaccacgacacaatgtgatttggtgtgactacgtcggacgcaaagtgtcctctaacatgccactctagtcgcctttttcgccagaaataaacgaaaactgataaatatcatttgttccgcgtggtgtggcagatgtttcctttaccagtctaggcgtggaaggtctcacactcagggatcgcatctctcattgttgaggacatcgacgagaaatccctgttgttgttgttttcctcgatcctgtaaacgcctgcttttccttaatttttctgaactacgacagcttttttaccggctgaactgcctgtaaactgcaggtccttccgtgtggaagccgtccggaaaccagaggtactccgaaacgtggtgtcacgctctttaagcgcgaaagcgttgtcgtgtcggccgccagtgaaaacgacaacttccgtggggttttttcttcacaaaatgcgtgcacgctgttgacaagtccgcgacaagtgagccacgcaggagtgctttgaaaaacaacaaaggaaacgttggcgagggcctcgtgcagtcggacgtctgcggagtctgtgcggactgactaaggaggggaagaaagaattttccccccccaacgcaggcaaatagaaggatttcgtcgtcggtttgctgctgaacaaagaagaggaaagaggtta

SEQ ID NO: 1503 - DNA, 1910 bp, Toxoplasma gondii
atccctgctcacctctggaagcgaaactttctcctttcttcttgttcttgctcggagtacggctcgaagtggcgagccaggcgttgctgctcctgagcagtcgggaggtagaagtcggctccctcgacaagcgtgcctcgactgagttgtctcttgtagtccacagcggggagacggtacgctccgctcggcttcagacgatccagaaccagctggttgcgagcctggaaagttctgttcaacgcgacggactcgctgtacacctgcttctcgtacgacttgttccaatgctgaatcatctgctgtcgccactgcgcagagacagagagaaaaaaacagaaagcaaatgtgcaacgtgcagagtgcggcccagacgctggagccgacgagggacgcacccgcgaaacgaggagagagacacgagagaagatccgcgaggagacaccgcggcgcgagtgaaaaagccagaggggagggagagagaaaagaacgtgtgggagagattcgccgggctccgaagccgcagacggcacctgaggtctgccctgtctggtaacaggcgccgagggggttccactgcattcgttcacgatgcctttcttcaggacacacagtcacctctcggatagtaaacgcacgactcgctggctcctttctctgccctgagtcacccctgtgtctttctcatgcctctgatccgctcgctcatcctccctttctcctcagcacccgcttcctcattccgggtcacttcccccctgtagttcccttcttcctctcctcccgttcaccttcccctgtgcagaaaccagtggacagacatctctgtcgcgaggcgagcgccaacagagggtcgccttggtgggtgtcctttctgctcctttttgagtctccgactgcattctcccccaccggggagtcatccctttgcttccttccacctgcctttcttccgcgttgattccctctcctttatctgaagcggagcagagagacaagaccgagctgagacgcctgtcttccactcgaccgcgcacagagcgcgtggaggggagtcgtcaaagtcgatttcgtgtgacgggagagcctggatcgctcgtacctgaactggaactttcatccagatcttgtccttgtatccagggaacagcttgttcagcgcgccgcctccgccgcctcccattttgccaacgcggtggacagacagagaatcgcggtcgaccaagtgggtgtttcgcgagaaaacgcggcactcaggaaagagactctccacgcagagagtccgaatgccagcctgcgtgctccaggtcctcgccgtacgcgacagacggggcagagaacacagtcagagagacggcgaggaaacgcgagatcgagaagcgcacaggaaaaggacgaggcgcgagactgagaaaggacgcgaagaaaagcggataggcgcgcacatgccacacgcacatatacatacatacaccacagatgcgaccatgcccaggacgcctcgaaagatgatttggacctcgaattttcacgggcgcaagcaaatcgtctcgcgagatgtctttgtcgcgttctgagccgacacgcaatttgcacagagagaagagccgacaatcccccaactttttcgccgccaccgactgcgaaaacaacgcacttcaccctcgccttttagtaggggacaccgtgtccccgcgaaccccaggtgacggcctcccgctcgcacggtcgcagaacggagtgcatgcgcgtgcggaaatctcggtggtgcattccgagaagccgctaaacatctacttttaccagacactacacgagcccgggcaaaggggtcgagacccggggagaaaactcgagccccccagaagcaaatacagcgaaagtccgactccacgcggaaaacggtcgca

SEQ ID NO: 1504 - DNA, 1542 bp, Toxoplasma gondii
atattccttttcttcctgagctttccttcgaatgtccgcgagggtcatattgtccttgatcccgaaagatgcggagtagggcgaagccgcagggccctgccccttctgtccaacggctgcatagagagcatttgcttccggcgtcgaaggagagaatcgcgttccgaccacaaagcgttcggcggcatctacatcgccgcctggactcacgcccataggattgggaggagatgccatggtggagagagtcacaaggtgaagcaagaaacgcgcagcaggcagaaactcaagaagcagaggtacgcaggaaacacaggcaggtgagccccacacagaggagaccagactaaagagggcagcaacatagaggaggccaaagagaccggtagtaacgaagaggagcgacgagacggggaaaaaaggattggaaccaccgaaaacgaataagggggagccggatcagtgagacggatgaaggaacccggggagggtggacaaccacgaggagtcaggcaaacaagtgttgcgagagaaagcgcctccgttggtcctgcttctcgatggcgtcgggagctcaagtggtgagaagttatagttgcggagaaacaacgggacaaggaacaggattacgtgtttgctggaaaccggaggctataggattcctcaacccgacaggaagtgcctccaccgagtctctcctccccagccactaattcgaggaacagcacaggccgtcgcatacacaataccccgaaaacagacaatggaggtgacgaaggatcttgcctgagacattctcgcgcattgtgtcgagtctctgtggactcaagagggtccgacaccctgctgccccgatgagagaagatgtgcaggatcgtggttggagggtacagaaagatactggacacaggggtgggtgagaagatcacgaaagaggagcagcaaagtggaaaacagcaactgaatgccttggaactctcatccaacaatgacttcatctcgcggctgcatgcagttccactttttctcccgcttctgtgcaagagcgctaccccgggcaagcccgaaaaaaagaagacactggcatgcgcgtcccgtaatcatctatagtatgtttctgactcatttgtttcaccttcctaccttcacgtcccttcctcactaaaggaggaagaggggaaatcgtcacgctggaaaagtggaaagcactgcatgcatcaatcgaggctccagacagaagcgcccatagcacgcggagagtatctgtttatggtgttcgggagttttgcttggccaaacactagtgaaaggtaggaattagtcaacagaggacactggcaagcatttctgccgttagcctgtcgcacacgggatttcaagcgaggttctggcggagaaggacgcgtctcgtcgcgaggaactcttgataataacttctctttggccagaagacagttgtgcgcagtctttccctcatggcaattttgcctcttttcaatgttctacggaacagataactttacatactgctatgcgtataca

SEQ ID NO: 1505 - DNA, 1858 bp, Toxoplasma gondii
ggtatgtgtttgtctataacaataaatgaatatctttagctctattcagtaaggtgtgtgcacaggagtagggacggagtaggtttttcgtgcgtcttcggagtcatctcagggagcgcatgcagcaggttcccctgtgtgaattcttcgtcttccaggcgttccgacagccggcagttcaaagacgcatcgctctctcttcagtcgatccgaaatgaggtttcaagaatgtcgacgctatagatatctggataccacgtcactgccacagaccttctaggtatctctctgcccctatgaattccgtggatatctctatactacacctgtcaaaccgaatctcacgtattggtgagtgttttctggatgtagtccgactcatcttcccctgtcgtacctgcacaactgcagccttgcatttgcatttacttgttctcttggcacacctagcgactctgcagagtccattaaatcccctggagatgccgacagacctctgatccctttgtatgtctgtcagtttcctattgctcactcgctactgctaagggaaggaatcagtgttactctcttttccgacttctcgactctggatgcatgcttaactctcccaacgagtctctttcttcgagtgagtcccacgtagggagaagggagagaaaagcgagaaaaactaaagagaacgcacgaaagaagcggaacgtcaggtcagaagcccgcacaccacggaaggaacggagaggacgaagatgttgagaagggcaccagagaagagaaaaatcgaggacatgcatgagagggagaaagaacagaagcgcggcaaagtggaagaagacatggccaggagacagagaaaaacagacagaagatctgggcaagacgtcccttttttctccctttttctccctcttcgggccggtgctgggtgcacggccgatgaagaagctgagagggaaaacgtccacaaagtgtgtttcctttccttccacaatcgaagttggaagctgagtgtgaaagaaaaacaaaaaaaaaacgttcttcctcagtcgtcaaaccaatacggggtctacatttttcacagttgttggcggacgttcgtgtcttgtcgccccggcgtctctcgggcaggctgcgtgcttgcatgcagtgtgcactgcaaagttctgaaacattttgtggagagagaggcggtgttcttccttctttcttacgtttctctttcacttttccctcgctttttcgagggcgagatgaaaaacaacagtcctcgtagtgagcggggcaagtaggcctcctcactcgcgctcagccacatcaagaccgagctcgcaaaatcgcgttctccacgacacacagtcgattttctcttgtcttttcttctttcttctgccttcttttctctcttcttctctgtctttttctctgtctccgcgttttcgttattccctctgcccttcttctcgttctttccgctccttctcccctccctgtcttctttctttctcttcggtggacgcccttccttcgctcgttttgatctgcggtcctccggtttctctcctcatctctgtcctgttgtcttcgcattctgcgttttcatctgtctccctgctgtcgaggagaccgtcttttcctctcgcttccataagaggtcagataagatccctcacgtcgatgctcctccccgcatacgctgccttccgtccacgccttccacccgttgtttcgtctcgtccatgcatttcggcgaactgtctcttctcgtttagcggcttctcaagtcctctgccccccgacgcgtctgattccgaattgtattttcgattcctttgcacatgaagtcgcgacacaggcacca

SEQ ID NO: 1506 - DNA, 2528 bp, Toxoplasma gondii
agaacacacagaaggtagtgtaggtgacgaagacgcaagactggtgccagctccgtgagcggaccctgcacacctagtcttatgcatgaatacatgtggaagtatatatatatatatatatatacatatatatatatatatgcatctacacaaatgcacgcacatcatgtgcatgcgtgatgcagaagaggcaatgggatgtgcgttagtggctctcgtcgttgcacgatctcccttcaaagttttgcatatctctgcggacagactagatgcatgcttatactaaatgggtacgaaagtctctgttagtgtgcctctgcggtaaacggaagcgtgtcaggtatctaaaggggagcacgtccacccgttgaaaaaacgacgagacgcaaacacgaatcgcaaaaatagaagtttcgccaaatgtctggctcctaaaaattccctgttgtgttgagaactctctggtgcacgaatacgaacgacgcgacatttgcgggagacagaggacaccgacgactgcctgtcggtgccgattgactggtccgttcgtctctctgaatatttgtaaataccagcattttcccccccacaagaaagttaccggatttgtctagtgaggaatcgagcagcacctaaacaaaaagaaagcaaatcaacagagtgcgttaccggatttgtctagtgaggaatcgagcagcacctaaacaaaaagaaagcaaatcaacagagtgcgatccacagcataaagactgggacaacaatgggggagtataccggtatacctgaatatcggtgaaaggacttgcgtctgcacagagcaagagttatatgaaggtggtagacgtagatacgactgcggaaaacatagtcatacaagtcttcaatggagactaacgacacgcagggtgggtgtttctgtaaagtcctccatgggcgaaaactgtccattacatcggatgtgcatttttatcgttgggtcgagcagaggagtgttgacgacggtgattatagacatttgcctccagagattgcagttggcatgtagcaggggaagttctggaggtaactgttgtgatcccttttttctgtccaaaaccatagactcctttcgttcgagatttgtttgattgtatacgcggaggtgtgaagtgttctgaacccaggtctgcggcttgttgtctgtacgttgttgcctcatcgtttcgtgttctctcggctgtaccgctgctaaacagccttccacggtgtctctcttttctgtgtcaagagaaaccgaaaccatgtgacggcaactttagtcccatcctctcacagtttctaggtcatcttcctccattcgtgaatgctcaatctttaatgttgcgcagacccagatgggtcaaggagtggaagctcgttcgatttccgtcaagttctggatctgtaaacgtggagcctctggttctgtttatacatccacaattttcaatggcaggtcgggaacaaattgtcaccaggtgttcgtaccgcagctcatgcatcagatctcacagtgagctacagctcctaggagaagaacggaggaggacgaacggttctcaggccactttgtaccctggacaactcatcccagatgagacacgactatttcaacacttttcacacatagcattttaactgacaaaggcggagcttctccccgccgtccctgaatgaaacattcccgtgcagccttcaggttgagcgtgtggggtggggaaagcgtgaaaaccaagaacttctttttttttactaatctgaataaaaaggccctgaaagtgacaaaaggttcatgagcacgtcggttctcctggctggcttcttcggttaatgtaccagcgctcgctctaagcagatgtgtagccttgtgccgcgtctcgcagtcgtgtgcaacgtgttaatctcttgcgaatttttttccgttctcctgcgaaatcacgcagaaaaacgcagtctcaccactgtagactcccgcaagtttgcctaattgccatgtctcaaagaagttctcaacggaacaaacaggcctatgaaacagggccctgaggacatgtaggccgcgcttctttcactttcttgccgacgctaataccaagctgcccacaaaaagagcgtccgtttctctgcaccacgccggtgacaatctcgtaaaccaacaggcgccttggcacgcacgtcggtggtgaggaattatgtgaggctctcgagcgtcggaaaggcaatacggcagcaaccagctttctggctgggccaatctgcccgcggaatgctgtcaagatctcgccctctcaccctcttcctccgtctccctccgtgacgccctgcgcacgcgtttgcggggaagaatttccgtgatgtgcatgcgttggccaccctactacagtgatagagctgagattcgccacgacgcagcaagaggacctttgggaaacagtctgtcctgttcttcttttcttgcgcttttggcttcgttccgatcgtccgcgagtcttcccctcgtttttacacaa

SEQ ID NO: 1507 - DNA, 2950 bp, Toxoplasma gondii
gcatttcctcctttgcaaggcaatcaggagtatcggagtgctcatgtgtgtcgcggtgattggatcaagtcagcaatggcttttccccagttgcctttctcgaagtgcctctgtgttgcacgcgccctgcgcttcccttccttgtatgcgtcttctctcctttcacgccgacttccgctcttccggcttttcaaaaaatgcagtgcacgtcttttacgaatcgacggttttcaggggctctctggagagacaccacgcgtgttcatagcaaagctttccacttgtctacatgcgtttctgtttgtctccatttcgctgtcgcgagggtacggcggtgcgtgatatgctgttttgtagtcgcgcgtttatgtggacgacgtcacgtcgcttgctgcttcttcgtctctcggcttcctctccgtatctctcctatttgtctcgtaatggacgcctgatgtaaactgtctcctatttctcaagactttttttcgcctctttgttacgtcttctaggtatcttttgtcgcgtcgacggccgtctactgtaccccaattgtgtccgttggagccgatgcgtttaacctgaatatagggactttctcctgtggtaacgagtgttagcgtcttaaatgtttgcgccagtgcgaattttcgcgttccagcacgcattcgcctgcggcgaccctggcgtggaatctccagtgaggcactgtactgcagcggtcaccacctcctgtctccgaatctgtgtccacctggagcacaaaaaaccaatacttccatctcttcgactttttcgttttagtctgcgatatcggagtcttgcaacgagacgcactcgcgcactcaacggcgcctctttgtgatacaaatgtaccgacgatcccttggcaacagccggggaaatggcaaatttccctgctgatggtctcccagtgacacacgcttagaggcatgtcgtttgctctaaaggcgcgtccgtgaagcagacggttgcttgctggaaaactcagacgcaaagaagttaccgctaccgcaaaagcaggcaaggtgccccgactttgcgtctagtctccggccctcaaactgcagccgactgactggcgagctagatctgttcacgtctgtgctgagcggtaacgccgatacgaattggcgtatagaggttctgcaccaaaggggctgaattcggtagtggtcttggttggacaatgctccccccattaagtactatcttgatggagctggagacgacgccgttcacttctttgaatagccgtttttctttgagggtattccagggcctcatcacctgtcacgaagctcatgtctgaatttcttttttctgtgtggagcgctggcggcactcttgtgcctgagcgaaaacggactgccgcgaattcatccgcgacttccaggaacacaccgcggtgcacgcacacctcaggtccagtggcgcagcacgcatcactgtaagttctgtacttttgcgatttgtggattgccggtaagcgttcgaaattcggacgtgcccgctgtggtacgggtcaacgattgccgtccaacgactcttcaataccgaacgcggaatgtggcaggaaaatcctacgttctttgcggggaacttgcagatgcgcatccagtacgagagtggtcagtagtgacagttccgacagtcaacaaatgcatgaaagctgcgagattacgaaatttgggaattttcccgctggatgccgttcctcaacggccagtgcctcctccctctgcagtaaaacggacgatgcacggacttccagttatgctacgctgagcagcttgacccgttcagacgtgctcttcatgtgagtgggcgttccaccgttcgtcgtcgcgtaacggaaatgtacgcgatgtttgctcaggcgagctttactggcctcccctgtcgagaagaacatttacagcttacaggttcgaaatcaggtgtcgcgtgttttccgccgtgcattccattagagaagccggctagtttttcaaataagcgcgggaggccattgtacttcacgcacttaccatggtggtcatgaacaacacagtagaacttggatattgctcttttcaagtcacttctcgtttgtccttaattctctctcttttatccccgcggcacctttatgacgtgcacgcaggtgttcgtgtgtcgtcgtaatcgaaaaacaacgctcagatcgctcctacgctacgactccaaatttatatacggtgtctaactcgcgtgtctttcactcggttgatcgaaaaccaacgaacccgccggtggaatttgagcgttgtttcgagtgaacgaacagcttctgccgcactctcaaggcggtcgacagtgcgggtgtgtgggggttctactagctctcgatgcattccagtgatgagcagccactcgtgggtgtggcgaatacgtcgctttgtttccttcgtatcaagctgcctggcagtgtataacgacggcagaaaggggatgttgtttgcttaacgccctgctcacttaagtacgattgcgcgagctgtgaaacaaaatcggaactcggctaacttatctcgtacacatctcacgattctctcgagctgaaactcgtggccagacagaccgagagcgaggctgctcctctgtgtttgcaattcagtagcgaacgctggggttgtgcgtccgtccctacataacggagatcatgcctgaagtgtcactgggtcagtgccagggaccagtgccgggcactgttccggcacttgacagtgtgtccggcgctctgcctttggtacacgtctgtcgggggacacctgagctagccacccatccccctaagtgagttttttggagttttctctgtgaattctctaaagaaaaaactatgaggagacacgcgagaagaagttcgggcgcggagtgaacaatgccgccatcatagccacaaaaa

SEQ ID NO: 1508 - DNA, 2958 bp, Toxoplasma gondii
cgcgacatattcacggcttcccacatacggaccacattttccttctccccccgcccttcacgcctacgctttcgtgtgatccccgatatcgactcagacttaccttttctgatgtagacctccgcgtaacgtggaatgtcgtccacgctgatgtcacgaagaaagctgctggggatgcccgtggcggggcggatttttttttggtgccgcgggtcgtttgaccgcgtacagttgcggatgtggtggcctctctcaccgcacatgtggcaaatgtagtcttcacctacggggacgtagccagccgcagtcgggaggttggagcccacagcgcctcggccgacaccaaaggcagtctgtgccgcgcctgcagctgaagcccccagagaaggcgcctggtacccgcgacccgcgctgaatccccagccccgtccgcgtccgaatcccgatgaatagccggcagagaagcgtccctccgaagaagcaaagccaccaccggcgacggcctgcgaggagctggtctgcggtccacggtgctctgcatgctgttcaatgacggcttgcagtagggcagcttcatcttcctcgtcgttatttgcagattccccagtttcaccttcgagagccgagcctccggaggcgaaaggaacttcgcgcgtcgacagagaaaggccgccggaactcgacgaaggatctacttggtcggtacgggcgggggtaacaacattcggggtagctctcgagccgttgagggaaggtgccaattgtttgctccctgattctttttcggcagagacatcgtggaagtctcctacggacgcagaacgcacgatgtcagtgactgcaggtgtgctgtctttctgccgatgaaaagctctgtcagcaatgtcaagggcagcctgtgcctccgccgcactcgtgcgctggagaagcagtgagcacggatgccgcaaagggaagagatctgaaagcggactcgacggatcggactcgaggaaaagaagcgcgtccagctggggagtcgcttccaagcccgtctgtttcttcagaaacgcgcgaatctcaccgcaaaaaaccggcagcggcaaagacaccggcgcatacggcgtgttgctgcctttgaaacgccattgcacgaaacgcagcgaagaagaaaaaccagtagacaccattggacgtttcgaggaaaaagttaggattcgaggagacagggcgccgtcaaaaaggtgccgctcacataagggaacggcactgcggcagggaaatcctgcagtttccgcaccacaaccgcaaacaccaggcagaggacaccttagacttcctttttcagtgacaacggtaagagagcgatgggaataaaaaacaaccctgtgaccaaactcagcgattcttggagaaagggccccaactcgcacttcccacggatgcgaagaattccacgaaactcgagttgacgtggacaacgggaaaaaaactacagacgcgaacaggaaactcacagaacccggcatcacagataatccaacaatgccatcctgcgcctctgagctttggaaaaggattcggctgcccgaacaaatgctctctagttttttttcccgttctcttacgtaaaaccatgggagtgtgagacggaacgacttggtccttcgaagtaaagccgctactgctcctgttttcagagaatcccgatgagcgttgtgcgaaaagacaacacgagcgccgcgactctacagaaacaacctcatagctctacattttcacaaggggcgtcgattcggcctatattccgaaacggcatcgacagcgctccctccaagactctcgggagactagaaaagcccctgcagcgaaatacggagaagttttgcgaccgtagaatttacaggcagatgccacagaaatccataacttacttttaacaccagtggccgaataggtttttatttaaatcgttgaagacggaaaccaaagtgccggggtgtgtacccgagcctctcagctgctgacacaaggtcgggtgcacccgtgtcgtgtctcgcctttgggaaaggcgagacggcgaactcgttccacaggcacgcgttttgaggagttcatctgtgaatgtctccttttgttctttcctttcaagtgatttcgataatttatttctctggggaacggcacgagaatcgctcagctcgcatctctccggcgacctgtctctggcagtgtcttcacggccaagcaaccctcagtgtgcaggcgcacacacagcacttcttcgcgttgaacactggtttcactatcttttctggaggatgtttgtgccttctctcgggttttcattctctagtctgccagcagttcttcacccttttccccggtgactttttcaccgcctcatctctccaatttctagtcgacttttcgctttcgctgttgcccccacgtcgtctccgtcatgtgtcttcctagacctgtctcccgttacagcgaagcgagacaatgtcctttgaagtatatgtgagtgtgtcactttgacacggagaaagtgtgtttcgcgtgcacatcagtcgtttcgacgttcaccgtcccgccctcaaattcgttaaaccatttagttcaaaaggaaacctcactctgtcccggcgcttggactttttctccactgtcggttgttgtttattactcatacagattggaggagacatttcgctctcgaatggagacggaaatcccgaaatttcgtgtttgtctgagtgcaccgaaggccgcatttgctcgattaaccatttactgttggtattcctgacgcgtgtgtgttccacgcctctttctcggccggaaaaagcgaggacatcgaagagacgacaaccacctgcatactttatttttctcttattctgtcccatttacgctttcggactcttcactttttccgcaccaggcctgcctacggtgtattaccgggcagaa

SEQ ID NO: 1509 - DNA, 2159 bp, Toxoplasma gondii
tgcatgcactgcttcgaacaatccgtatcggctgtcgaacttcttcaacgaggcccgcgctggcgaaagtgcgtagagcgtgaccggaattcccgaagatttggaagtttctgtgcatgcacatcgcgttgctgttccatcccacgatctcagtgcaagagaaagcaacaggcgaacggtgcatgggtccctttttttttccgcccgggactgtcgaacatgcgacagtgactgaactgtgcctgttcgtaggatgtgtgtttgcgaagaagcgggtgtctatacaccccgactgcgcggcagccgaaagcgttgcctgctggcttctgtcgagtgtggagttctcaggtttccgtttaaagattcaaatgcgtttttaggcgttctcgatagggaagagggacgtgcaagcgtcgtggcaagcggttgcgttgtggactgaggtcgtctcacgagaggcgcctcatttttgagatcgttggcagttttagagagcgcaaagccaggttgtagaggcagtttggagatactggaacgtgcgtcgtcagacgagacgcatgtgtgagagacttgactgtatttttcaaccattttttctacttgcgacggtttggcaaacgatagccgtcctcagtggagaagggcggaacatttggcgggacacagaccgggaacctacggaggccgcgaatcggaatttcgcgtttgcaagagcaagaggagccgcagaaacagtggaaccatctgtcgagaaccactcttgcatttggtagagcatgcttgcgcagctcctttcgaagaaacatacacttgcacacgttcgtgtgcacggtgtcactggaggtcccgcggttaaacctcaccggcgtacagaaatcgatggactgcagtcaagcgcaaggagcctcggcgccattagttgcacgcttcgttttcaagaatgtttggaggcatacaagaagaggtcaccacaggtgtcacagtgtatatcgaaagcggcgaaacaaagtctgtcacatttgagtgacgcagaaagcgaatcctaccggcagctattgttgtcgcaaaggtttcgtagccaagtctttgactacgccgtagaacaagctatttcaccgcgaaagtactcgcgcaacgggagactcgttaatcgtggctagcacataatagtgcagagtgaaatgcgtcgagaaatgaagaccgagaggctctgttgtcgtagccacgcacgctttgaaccgtatggatgcagacgggaaaaggaaaatgccctacacaacttccacgcgtatgcctagcgtagtcgtcgagaatcgacgcgcaccccacataggccactaaacgcgacagaacgtctgtcctacagctacgtaaactcctgttcaagagacacataattttgctcgcaatgttggagtttctccggtgaaacctatcccgtcgcgggtccatgtttcttttagagacctacatatctcggcagtcttgtatcgtagtgtgtttggccgtacatccggtctgcgattcggtgccgttgaaatgaagcggccatttcccagtcggtcactggagttcatcttcttttcagatcaaacgttctgatgaggacacagttcctcatttcctcgatttcctaaagccccttgttaaccggccgcccaggtcatcggcaggtggagtgagcgccgttcgttctctgccacctgccgcagcctgtgtaccgagacactttccccaatctggaaaacgcctgggcacacgtctcttgtcgcacttagttgtggcttgcaagtgtttcgtttctgggggcggattcacctgcaatgtgtttgcccagcgtcattgaccgatcggcgtgtctacaggataaactcgaagaccagacaggcatcgaacgtcgaatgccacacacaagcatgtctcccggatggtggcgctgctactcacgagtttcgtccgtgattcagaaaaagccccgatatcggagataaaacgcaatgtttgcgcctgttggctacaccaaagtgttggtagcaaaccgtgggagacgaacgtttccctcagtggctggaaaaagcgtcgcatcgacgcctgcaagcggtccatcacgtttcgccctttctgttgagcaggttccccggaaggcgaaggcagcaaca

SEQ ID NO: 1510 - DNA, 2836 bp, Toxoplasma gondii
cgttcaggcttcaagtgctgcagcaaccgtttcccgaaaacgtcttgggtcagaagagacggatctgcggctctgtgaggcccccctctcgatctggactgcatgcaaagagcgaacgtgcgagaggacgacgcgagagagacttctgcgtttcaacagcagcaaaatcatcactcgcttctcgcgcggccgcggctttctcgcgtcgcctcccctcgtcgcccgctcgacgtctggtatctttcaggctctgtgcattgtctccgtgagcctcgcgggtgcatgcgcctctccggctgttctcgcctgactgaaaaattcaatttcttctctgtgccgcttggagccttccccgcgggggagaggagccgttcagagagagacgcacgttgacggaagaggaaaacgagacaaaatggcctgggacaggcccaaaaacggggagaagtagcaacgcagacggaggtgagccgaggagaaaacgagtcctgacgaggagagtgggaaacggcgcgcagaagggagacgaagagagcgtcgttttcagagctaacgaagaaaaggtacacgaacaaaggagaggacaagggagaggaccgagaaagaacggaacgacagacaagagggatgaataaaagatctcttgtttgcagatttaacgaaggacgagaggtcgactgggcttacacggagggggagagaagacaccagaaaaaccgagaccgcgacgagaagaattttctccactctcgccaaaaagcgtcctcttgtcaccgtaaaagcgtggcgtcagatctgccaaaaggcttttttacaggcttcgtcgcgccttctcctcttgaagccctacaccaagaacaggcatgcatgcagatacgcgtctctcgaccctcacctccacctgcgtaccgatttgtgctttacaggtccacagcagattccagacggccctgcgggtgcgtttgtactcgaaaaaatgcattgatgcacagctgtgtgctgcatgtgcgtcctgcggtccgacccaaacagaaaaggtcgaggaccgactgcagcgtccgcctacgggcgaaggtcgtctttgtatcggacaagaaagcctttctgtgacgaagtttggcccgcgaaggaggcgaaaaggccttctcccttgtgcttcgtgcttcccttgggagtcgcgcgcaagcccgagttgcgcggaggcggaacttccgcagctgtcgggtgtacatacagctcgaactgtgcccggtcagcagatcgccagggaatccaagagaagacggagagaccctcctggctcacgactgcgcggcagagagcaagaaaggagacaggggaaggaggaagccgagcgacgagttcggagaggagcagggaaagttcgcgcatgcagcgcaggccccgcagcagagaagcgatggacagcgcgggaacagcggattcacagcgttaaatctcccgagttgtcgcctgaagagaaagagaagacagagaaaaagtgacgggctgcggacgcggagggcaaggacctcgagccccgtgcgaaaagtggcgagcgcaaaaccggggagaaaggacgacggcgcttgagtgggcggagcgcgcggcgaggaaaggtgatgaaatcagaggctgttgtcgcggcgagaaacgtggagtcgttcgggagatcgcgccgaaaaaagagcaagctgacagagtcgcgcgaagaaatacggaaaaaccgagttcgacgccaacaagcgaaaaacggggtgtacctacacaacgcgccttgggggggtggtcgctccgggctgcgcggtgtatgtacacctcacgtggcatgcgaaaagaattcaagacaccgccaccgaccccaagcaggtttttcggcagtttcgccgggggcccagggcgctcgggtgcctcgaactttctttctccggtgtatttttctctccttttctgccagccagctcctgagggtcctcgtctgagtgttcagacacctcagggacggccttgcgcctcgacgcatcgtctctcttctggtcttctgcaaaggggagaaccaagtttttcgcgggccctccaggtgccctctctgccggacgatgtgaccacttgcgaggagagaaaaagtatatttcaagcgttaaaatgaacctgctctgcacgcagctgccaacttgcatagctcggtgcctatcagaaggaaggggcggcgacgctctcgctttctccggcttctctctacctgccagctctctggcgacgcagcagtgtgtgcgtcgtgtcttctcgaaatcctcttataaagacgggtctcctagagaaaagaaagtctcgaaaataagaggatttcttcctcagaagagaaacaagttcttttccctccacgcctccgcctcagcaggaatctggacgcagttcccttcttctccataacggcctggttcggtgcgccacgaagctgctcctcattctgctccccgtccgtctcacgcagcgccctcttctcttcaacattccgtgtatcctccatctctctgctttttctcgtcgccacccgcgtactctcctacttccgagtgtgtaggagcctgaccgcccccgtccacgcgtcgatcgattccgcctcttcatcgctgtcgacttctctctcctctggacagccctccttcgacagcctgtctctcagctctttgcagcccctattctcatctaacggtcatcctttctgtctctcctctctgtctctccttccctccttccttcccttttctctgttgccattctcaccctcctttccgctggcttcaactggcctttctgtctctctgtttcgcga

SEQ ID NO: 1511 - DNA, 4577 bp, Toxoplasma gondii
tactggcagaagagatgatctttcttgtcaagagcaagtccaacagccgtctgcagcgcttcttcaccctgattctggatgtaaaaggaaatacgtcctgagaacaagaaacgcccacgtccgttgtcagagccaagcgcgtcaaaagcgaaaccaaactgaaggaagatcaagagagagaatgctggggagacatgatcaacgctgcttctgctgaagtcgtacttgcagcagccccacaaccgcggatcgacggaggcgagtctctatcaaccgctcttctgtcgcttcgtcaacagttctagaatatcgaggacaaaggacagtccagttcgactacaggttttcaaagaacctcatgaacgtggacgagacagcaaatacaacttcctctctctgggggaggctgcatgcatctacgcagaaatccccagtccgcgagccgagaaaaagccgcagatgtgcctgtatacccctgggatccgggtgcacgtagagccgggaaagattcaggtgtacatacagctggagatttcaggtatatgtgcaccacacagattcggttgtacatacacctgccgaattcaggtgctttccatgcaccacatggaatcggttggccagccagcggcccggaccgggtgcgtcgcgcagcgggagtggcgcggcattttctgtattcagggcacaggcagtcgttgtcagccccgtccttcgttgacggattgtctcacggcgtcaggttctgcgtttctccccgctgcggcgctcaccttgtctctggacgctgtagaacatgttgtcccagatgctcagtttgaccatgaactggtaggcctcgagaacctcgtcattggtcatggggcactgccagccgtccgcgatttgtccgtcgtagtccaggatgcggaagatgggaatgacgggagtttcgttgctgatgttcatgtcggttgtgaactgggtgtgaatcagcccggcgtggtacgcttcctcgcgggggcctgctgcggcgctggagaacgttcgcacgccggcgctgaagaggcggctggctgatttttgggcataaacggaagaggatttgagaagggaaacggggtgctgcccaacaacaggggcagagaaaagccgcgaggcgccggcgggctgcagaagccgcctgaagaacgaggaggccgtgtgcgccatcttttgcgcaggggtcgaggtgtccagaaaaaacggtatgagtttgcagggaagcagaaagcgagagacaaggaccgacgggcgccgccgattgaacacgcgtgaggccggcgaaaagtcgaaacaagaagtcggctcagagggccggtccacggagccttcgcaactcagagcagaaacaagggcgaaaaaagtgttgttcggtgacgaggaacagcgcgagaaaaggaaggtccaagtcgagcgacggcgcgggaggacacacgaagaaacgacggaagaagcggagccgccctctatcgaggcaggcgcgaaaaaccgcatgtgacagcgggatgacccacccggagtgcccgcctgctttggttgggacgagtgcttcggaacagcgtgtggcgatagacgagcaaaaaacgcaaagtcttcgaagatgccaagcgaatgcgtccccgaatttcttcccagtcgatgacaagcacgaaacccgcacgtctccggttccgacccctcagacaaaccgacgacagttgccgcacactgctccgcgcctttcaggcgggtatcaacaacttccgcaacagccaagagctgtctttcacctgacccctcagctctcgttgcgtttctagactagagaacgcattcaccatgaggaaagtcaaagtcgctcacgaattactacgcgaccgcagagagcgaacgagtaacggggaaccccaaagtgtacgcttgcgctcatttctcacaaaccattgatgtcagcctgaggcgacaacctccaaaccgcgctggaacgtctgaagttcaccgtaggaagctcttgagtccgttcctccctccagcgctgtcttgagaccttggcacattgtcatgtgcccaggaaaaggggaaacgacatgctcacactctggagacacggttttctatccgcagctgttcccgttctttgaacatcccgaagaataattcctcttttaactgttactgtctcaccgagacgactcgcaagtgacaaaaatcgtgttcaggactcacgggccgacgcacacatcgggtggacatagtcgaaatgcaaattcgaagaaagggaacccccgctggcagaactggagctcaacacaaaaaggtgtccaggtgcgccagtgtaccgatataaacggagctgttatttgcgttcgcggtcggaccgtgtgacagctatgcagcaggagcgagcggagctaaagaagcctcggtggaatgagcagattcatgagaacgtctccccagaggaagtaactcagagtgctcttcgcttggaccttgttctagagagtcagggaaccggagagccccccgagaaagcgtttctccaggggatctcagtcctacattgccgtcaccattcgtacagactagacagaacaactagcctcttgaagttgcttcttacatgcaacgggcatcagagagaaaagagtgcccacttattcagaactgtgacctgtcgatttccgcgggtgtcttcgcagtttcgccgaacaacgagggttgggaagacccccacttcaggctgtgtctcgccctggctactaaactgttttctcaggtcgctaagtggttgctgagttgaatccgtcgtgttgttcgtggcaagtggaattgcagctctgcggtagtatccagttgtctctgtcctagcttggcgtttcaagcctgcaaaaggtcgcgagtgtcttggaggcaaagaacgttatccattctgaaagtgtcaaccctccaaggcagggattttcgtagatttgtcgagactcctcagtccagcttttgttgtcttaagcactacagggggtcgtggtcgtgagcaatcgtacataacttggctgtcagtcccttgaaatgactgggtttctattcagtaacctaggtactccagtgtcttttaaagagcatctggagtgaaagttgcaaatgaagaaacaaatgcgcctccaggtgaacctcgcagagagggtggcaaagcagtgaggctgtctcggcgtggtcagaaagattcaattattttcccctctttgctcatttttttcccttcgccgtcttcctgcacattcgcactcagaccttctttctttgtaccttttctggtagagaagcgtgccttctattccaggcttatttacagatacatgcatacacgcatcattaatatccatattatatatagatacatatacatacccatgagtacatattttcatacatgttacatacatctactgatttaaatatatcttatatatttgttcaattatctttacggttcgtttgctaacatttacctgttttactactccaggaggtacagagagaggtgtagtcaagggtagtgctggccacattgggagagctgctacaagaggcgggggcttcagtgtaagccggcgttcgctgctctgccccagtctctgtccaacgttgtttgaaatttccttaaaagagcgacaaaagccaaaattcgtgtttcgcttgaatcgtgcacaagcagcctgtttcgcctgtcaggaacctgcggcctcctcctcgtgttttgacacacacgaacatgttcatgcgtgttgcagacgcattgagaaaggcatgcaaacgactgcacaccgtggtttcccgtgtagaagttcgctttgaaagagatcggattcgcggatgtgttagcgtttgcctttcgtgccctttgtcacttgcagaagccgttgccgggtgcacactgcagtttgtgcgcgcatgcagggagacggaagacacccggggaagtctttctgaaaagcgagggggcctttacttttttcagccggctgcttggcacttttctctgggttcttgtgcctcgtggttcactcaacgcactgttttttctgtgcaagtgctctcctccaggtgcgggagtgtttcttcctctcagtctttttatgcagagatgtgcaggcaccggagtacagtccgtgtgtcttaatcgctccttgaatgtgaaggcgtgtgcagtttctttcctcgttttctctcttcttgtctccagttttgttccagaaaaacgacctccgtggaaccctgagacctaaataccccaatctacgtcctggaaccccttgccagcgtcgccttctgtcttccgttcttcgccttttcgttttctgtcctgttgctctctcgtttttctcccgtgctccttcttctctgcctgttgttcgcgtttctcattcttctttgtctctgtttcacatcgcagagagcgcccgttcggtctgggcgtggcaacggcgtgtcttgtgttgttcgtcgcgcctttgtttaagctcgagcagccagcaacctttcagtttcgaccgcgtgcgtttagacggaaatcaaca

SEQ ID NO: 1512 - DNA, 1936 bp, Toxoplasma gondii
attcgtggatcgcttcctttgctggagttctcgaattgagaaggtgcactggcggttgggtcccgcttgagaacctgcaccgcgaaataaagtaccacagaaagttgcttcctctgtggccgtaacgacttgagcgaggcacctcacagagtgttttcttctgtccagagatgccactggggaagggccgacaacatagaagacaaacggtcatgtcttggatcaaactttcgtggctgaacagcatttccctgtatgcacaagatattttttcagaaagcgggactggcgtaccctatcagtcgccttcactggcgtgctgttcaagtgcatgaagtcatagtaggcaacttggtcctctgcgtggacggcgagctcaaggttatcgatgaggacaacctgtggctcacaaattggtgcgcagacctggttcgctgctccacaagaagcggcgtggatccggtcttgatgcatgcccagcccacagcagtaggaaaacattttggtcactgagtcggcaccagaagcgggtcgtctcgcctgcgtcttcaacagcctgcagctcgcacgaagggatccttacggtgggggtttgacggcagactcgcgggtttgtagtcgtgaggttctggcgttgtgttgaattaagacgacactacatatcttatacctaaatgtgagtgactgcaacgccgcatctgggctccggaagacgccatatgtgctgggaacaaccgcagttgttggcgaagactctctttcacccgcaagacacgagtcaccgctcgccatatgcacataccactcgttacgggaggcggggaaaacaggccaccctttgtcacaacattttcttcagcgcaccaggtgagccgtcgttgttgacgaatgatgccaagcggttcgaatcgaagggccggtgagctaccacgcaattcgaaaaaacagatttcagtgttttctaccgaactagctgtcgccgaaggtggcagacatgtcttgtacccgcttctgcgaagtcacaatgtgaaaattcacacggtgaatctaccgtgtcgattctgaggcccgggaacacacactgcaagcttccttttgaggcccgaaggcaaatgctacagaggatatctgacctcaagagaggctgatggaggcgctctccaaactagcccgctgcatgcgcgaccccgttggccgcttggcatcagaaccgtgctgccgttgagtccgcggtctgccaagcgccgatactggaaatacgccgcggattctctggaattttccgcagcttcttctgtcgacagcgtgctggatcagcctgtgcttaatgttgaacattgttgcccacttgaaggcacttcattcttcgcacgatgcagacaccatcttcttaaaggtgacgtcgtcggtgagaaaccgctgctgaggaatggcagctgccttgtctgcgctaactctcgaaagaattgacagtctgagcacgccaaaacgcttttcgcgtatctttgtccttgtcctgtcacatactcatacgtcgactttttcgcctccacagggagttttttcaaaattcgctgcgacgcagtgtgaaccctcaccacaagacggtcgactagcgactggcggtgatttcccgtcggtcaccatgttggtgaggcggatgtgtggcctatgatcaagagacatccattgctcaaatgtgaagcgtgctttgcaacattatcgggtgacttcgactagtaagggttgcttcaacctccattttcaccaggtccgacttgtcgccgttggcctgtccgtgaccatcctggcataacagtgcgtcgaatcgagaaggcagaacgcggtctccctgagaggcttctgcgggcgctcgacgcacaaactacggtctgtgtagcttgaaacttttgctgcgtctctctctcatccaaga

SEQ ID NO: 1513 - DNA, 1963 bp, Toxoplasma gondii
gtcttgcatgcgttgtctcaacagatccacgagaaaacgctctctcggccccgacccgacgtagagcgcagcgagggcgactcttctctctgctctggaaatgaggaacgaagaaacctgaaagaagtgagagggcgtctgcaggaagcggacgcatcgcgccgggactctgaagcagagccgcatgtctcttgcaccggagttagcgaaaatgttaaagagacacgagctccggccctcacctcttccatctctttagcacagatgcgcggacgcacagggcaactctcgccatgtgtctctctactgcctttctagagcttttatgactacatatgcatcgacagttgcatgcatgtaggaatccatgcgaaagagaaagcaccaccagacgtaaacatacacagctatgtgcagaagttctgcgtctcgctgtcgcgaagtcgggagagagaccgtcaagttgcggcgaaacactgttgcctacacactcaaagttaggagacaaatggagacgcgcaatgtctccgggagacaagcgaggcgcgtctgtcgatgtctcccactggacaggtagagaagacaggtaacagcagatgcagagggaacgactcgtgagttcaaaggagtgaaagatgagcggactcaagagctcacgagaaaggctacgagtcgggaaaactcggacgaagaaaacgaatcatcgggaaacagagaggaaaagaacgccgctctttcggagagagcgggaagggactcaggcctgcagtcggacacagagatcttttggcatttctgcaggacagcgaagatgaggaggaaaaaaccgagaaaccgcagaggcgacgcaagagggtcaaacgttgctaaacagagaaaacagcctaaagccccagagaaatcctcggagaaagggaaggagaaaaattgcagacgacgcagctgtgagacacaaccgcagaggacatctgcacatggagagacacgtgagaaacttggatggttttcaaggcctcgacagacgaagagaagagaaaataaaaagtaggaaaaagaagagaagaaaaacgaaaaaaggcgctctcagcgctctcgagtgtcctgagttctgcttttccgaatgcaagagcgaactctgcatgcacacactggctaggcgatatgaaatcgaatccgttttctctgggaagagtcctttttcgagggaataaaccttgaagggttccctttccttccttccttttcctctccgtgagaaacaaagagtctttctcctgtcgatgtacttctgtgcatgcatgtccacgcgtcgccgaaagcggcgacgacatacgctcacaccatttctcgcgcgtcgagaaatcgttgtccttctacgcttttgagtcctaacttcttctcctcatcctctgttttttacggtagttttggcagaagtcctgagcctccgccctcgttctccagtttctcgacctcgcgcgaaggttcttcgccttctctctgctttttctcgccgacgcaagatcgcttctctcttcttccactctctccgtgtcgtttctccgttgttcctttgcgatcgggtgtatcgattctcactcaggcgtctgttccagcgaacgagagatgtcccccttcctcgcctgttcgctgttctctccagatgtctctctgtgcacctgtggattcatatgcagtagcatcacaacgcatccagtctcggtgtcgagcttcatgtcaaacatacgcatgcatatatgctcgtaaatctgcagacatgtgattccgtatatctgcgtgtatgcgcatctgtgtgccccttcatatatatatatatatataaatatatatatatatatatatatataaatatataaataaataaataaatatatatatatatatatatatatggggacgcgcggaggaaggaagattgtcgatttccgtgcgtattgagaga

SEQ ID NO: 1514 - DNA, 2222 bp, Toxoplasma gondii
gacgaacatgaagacgcagcagaccatggaggccatgacgagtttcctccgcgcgcgctgagtcccggtttcgcgtccttctccggcctccgtcgtccggtcggcctcgcagcagctctcccgtctcgccttctctgctccgctgcagcatcgtcgggtgtctccacccctcaggccgcagtcgccgaggctgtgcctttggactgcacgggggttgcgatggccgcggctgcatgcgctgtgcgtctctgcgaggcggtgaggccagtgttcgtcgacctcgggaaaggaggccagttcgcgttcgaggccttcctggcctaggcggcttcgaggtgtggaagcgtcgctcggcgggactcggcagcagggcgcgaggtgagcggctgctgcgacaggtcgacctccggtcgcgtcgggcagaaggctctgcatgcggagctctcgcgaacttccatcgcaggtgaggaaagacgctgacgaagcaggtcggtctcctccatgcctgtccctcggcgcacagcaggtcgcctccgcgcgtcgctcgtggacgcctgcgttgccgcgcttctgcgaactgtggactcgcctggacggggaaacgccttcctcttctgcgagatcgggagacgcaacaactcgaccttcggctgtttgcatcgacgagctgttgctgcgcgagcaacagctcgatgaggcagccgacagctgcggcactgttgtcgctgcagtcgccgcctcttcgcgaagagattcctcgcaagaccggagaaaagaggcacacggacgagaagaagaatccggatccgacggagatcgcgagcgaggcgaagggatttccttcatctccgacaccagagaggagaacgctgagggcggcttggctgcgccgccgcgcttcttggaacgcggcatggcgcgagaaaggcgagagctgaagacgcgaggcagcgaacgcagagcagaggaagcgaaagagcaagacacgcagaacaagagagaggaaacaacaaagtcggacagacgagagagagcggagaaaaaaacagggcgcagagtgcaggagcaatgcagttttgacgagactctcggcgcgcgagagatgtgagatgcgacgctcgcagtctcgttgtcgacggtcggcgcaaagccaggcgaatgcacttgccttccctgaggtgaacgtacagtttcgtcgcctcgagagctcaagacgaaggatttctcgcgtctcgatgttcttccgagtctgcgagcgtcgtcgagcagaaggcacagacgagccgaggagagaaaaccgtcgagaaatctctcatcccacagaacagcgagagacgcagtcggacccagagagaactcgcgagaaatcaaagagccttgcggagaaacgtctccgagaaaaaactcaggtcgcagaaagcgcaaaaattgcgagaaaacgaaacaagaaaatggcatgaacacacccccgacttttctccccgccacacccacccgcgcgggcagacgccgccggttccctcctcgcttttttccttttcgattccggctgcctcttctctcttctccctcttctttttctttcagtcttcttttctcttttcgtatcggaagagtgcagcgaaacgcagtgctcgcgcgtcctcctctcgcgtctctctttgtctcgcgcttcctcctctcgcgtctctctttgtctcgcgcttcctcgcctcgcgtttcctcttttcgcgtctctctttgtctcctttcttcgtcttctgcctctgtctttgtccctctctcgattttctctcttgccttttttccgccagagggagatctccctgcacatctctctgtcttttgtgcaactgctcgcctgctttccagccactgtgtctggactcctcactcctccgactctgtctctccaacgcagccacaaactacagagagattcaacaacatacgccggagttctattcacatacatctctatgtagattcatttgtttttatgtgcatttaaatatatacatatatatagatatatgtatatatatgtatatatatgtatgcatgtctatttctatagaggaggtggagggtgtagaagtagaagtacgtgtatgagtctgtgaagagcaccgcgtcgcttctttgttgtttcgccgctccttgagtgtttgaggatcttcggtttctgcgcgtcaccgcatttcagcgtttcctgaaaaaaa

SEQ ID NO: 1515 - DNA, 3015 bp, Toxoplasma gondii
gcgtcagttccttaggctgttcatttacctcgaccgcgtggagaggcccgatggtgctgcagtcgatgacgaaggcgcggcacaagtcgagggaatcctgcgccttccctgacgctccttcgagcgccctgagaaggccattgtcagaaagcagagcttcttcaacatgacggccgcttggcaacatgctgatgacgacagggaacggcggcgccgctccacatgctgcaaagtccctgttttcgcgcaggatttgattggcgtcgtgctgccactcggccacatgcggctccttctggagagcggcggaatgagaaacagcgggaaagcaggtggaacggaacgcgcggcccggatcggaaacaggctcgacacacctacgcaatacttcctgccgtgtgctcccttcacaagtttcggtttccacatttccatgtgataaaaacgaggcccgcagcttgctgccaaggtccgccacagagcaggcggggacggctccaaactgcttctgcagatgataagaggcgtcggattttccagggtcgtagacgcacaaacggatgccgcgacctgccaagtgagttgccatgggaagacccatgttgcccaggcctagaaatccaacaagacggccggtgtgcttttcagcgacctctgcgatatgcgttgaaaggtcgccgtcacgaaaaggctgcaccgaaggttccacttgctgggggtgactgtcgtgagcagaactcatagaggcgtatgcatggtaggcgcgggtacgaagaggaaacacagaaaatggcggcagattcaggcgagaatgacgagttctggatggaattctccattgtttgacccaacaaaaaggaacggcagatccgcgacgaaaacctcgttggaaaacggaaaaacgcccacctgcccagccatccccacacgccggcggcaggaaggtggggaaaaggaaaggaagaactccctggacaccctttcccactgaaccgaaggaagaggagagatgcgtagctgccatttaccgggggaaatgcaatcccggtctgaaatgggagctaaacgaacgcgacggatattccacggaaggctccgtgtccgcccgttttatggcgacttgtcccggctcaggtgtgcgtacaccctagagccgaaagctacagaggaggcggatggacaaatcaactgaacaatcaccgtctttttagtcatagaagaaaggaagggccaccattctttccaatgtcaccgttttcattccctcctcgtttcgcgccacgtgtgggtccctctaagggcgtaagggtgaacaagaaactcgtgcacataccgtaaacgaatcaccgcctttatggttcaaggtaccttcggttgttgccaacaggcccgcaacggagaatgcgtctgttaaaaagtgaagaaatgagatggactcagctgccagcggctctcggcttcgtcccaccgttcgactctccccaccagcttttggacgggctagtcttaaacgcgctgtctcacgtgtgcatgacgatgagaacgcttggttttttccaggaagccgagaggcggctaggctcatggcggcaacttggagcaaagagcaggctcttttcctattttcccggctcttctgcggcagtcgatcgtacagcagaatcgagaaatgcctgagaggtctcgagggagagcgatagccgagggaggacgctttcgggtatacgccggtcggagaaatggagaaaaggtgtgtgacgtcgcgcaggtggctgatctctgcgtgcgctgagagggacgagtcttcaaagcgggagaggcgggaataaaaggggaggggaaaataccagttgagagttttggaatgtgcgtgttcggcgaagaaactgtcgttttttcggtttcaggccccgtgcagagaaactggaaaaagccgctgtcgggtgcggttgtccccgtgctctgtctttttcgaattttccactttcacagagaggcatccgctctggccggcgctgccacagatgtttccgctttccgtttgaatcctcgcgacgcccctaaaaaagccgttttccctgtttctgtttctccatctgtacggacacttcaggggcgccgcgaggcgagtttcgcaacttcctcaaatccggtccgcttccttgtctcgcttctctgggggcggcctttcgcgcgtccgcagccaatcctcgcttatctgctcgggtttccttcactgccttctttgagttcccatctaatcgttttctccgggattttatcgtcgttgcgtgcggctgaggccgcggtgaggagactggaaaccgacgtcaagaagcccgtgtgcagttcctgcccaggatagaaaagcatcgtggaatttgctgtgaatgcccccgtcgtttttcactttcgacctgccttcgatttgtgtcactcggcgtctcgcctgttccatctggttcttcctcggttggttctatcatcgttttattgcctgttcgtctgttcactgttggaagcccttcgagcttcccgcctcttgcctcgcgaggccgcacactttcgtttgccgtttttcctttcctcatccacaagactcagttgtctttcaaccgctgtcttgattcttcccctcgagtttcaatcgtttcatcagcctccggggcatgtcttctctcttgcgtcgaagctgtgacttgtcgctcagttccgtcaacgcccgtctctctgcccacaacagaccgaggacccgttcttctcaactcgtcagcgtcaaggctacacacacgctcctcttcagcaaacgaagccgtttcctcgtccctccgtcaacagctcttttagtcgataatccccctgacagcgctctcacctcgtggtagacggccgccttctccccttccgcctttcatctcctcccctcttaccccgctctccaccctctccgcggtccactctctctgcgtcgcgtgtgtctgttctccacagcgcgcgtttccgctgtgtccaaga

SEQ ID NO: 1516 - DNA, 2022 bp, Toxoplasma gondii
agagacgagagagagaccgaggcaggctcgtcgaagattcaaatagacgactctcccttgacactctctcagcatcactctttatacaaacatataaatacataaataagcctatatatatatatatatatataaatgtatataaatgtatatatatgtatgtatatatatgtatatatatgtatatatatatatatatatatataaatgtatatatatgtatgtatatatatgtatatatatgtatgtatatatatgtatatatatgtatgtatatatatatgtatatatatgtatgtatatatatatgtatatatatgtatgtatatatatgtatatataaatgtatgtacatgcgtgaatgcacacaggtaaatcttctctgtctctggttcggtccggcgcctgtgtgtgctgcttgcgtcgccccaggacgtttatgcggcgtttcaagaaggccgagtttgcgagggaggaaagttcgccgagtggagacagaacgactggggatgtatgtatagaacgcgcttgaggcgaggaggagacacgagggagccgagtctgtcctctaggagtgtattggcatttctgccagatcagacaggagaggaagaagaacaagcagaaaggcatggaaatcgatggaggaaggcagcactttggacgtcgtgccaaggactcgcgcaaaggcctcacaggcggccttgtctcgcgcttcaaacaggcaagaaaaccagacagttcatggatgaaatgaggcgaatcgatacgaaacaaggtggagtggaacgaacaagaaagaaggaacagactggcgttttttcagctccgcgacatgcaaccgtcgagaacgcgaaaacggtggccgcttcgctcggtcgcctctcactccctgctggagtgcagtcacagatacacacacatctctccttctttcctttcgtttttcttcgtttttccgcgtagcggcaaacagagacgcgacagggagaatgacaagcagggggaaaggagagaagaagcgaagagaagaagcgaaaggcagagcgagagagagcaggaatcggcgaatctgcgcgcagcaagctagaccttcttttccgtgtgtgtttgcatgcacgcctcgcaaaaaacagcttgagccttcagaaacgccaagcttgtcaacagtcgctagggtgtaaaaagtcttgcagaaagaggcgaaagagagacaacgaactctttcttcgaggaggaaaccttttcgtcgctgtggggtctgagagtctcctgcccttctggtgactctcaacggtttctcgacggtcgaggagttccagagttttttctgactgctttttctcctgacgcaagtctgctttccccgacagcttttcttctcgttcatgtttcgaagtcggattctccccttgtccataccctgcgggtttctccctcttcgtcccccctgtttgcatcgcctttcctctcccgctgttgcgactttttttgtcgaaagcgacttctctcccgcttgtctgtccgcttccttttcttctccctttgtctcttgctttgctccgcctgcttcctgctctcctctcttcctttcttccgtttcgtcgtccactcgcacccctgctctttccacgtgactgcgggggccccctctccctgtcgtcgcctcgaacgcgaggcgcgcgcctctctcctgctttgtgggtgcttcttctcccttccgcgctgccttcctttttgaactcctgttcgccttcgctgcagttggtctcctgcctctctgtcttccctgcctctcgccggcgcctgtcctttcgcatgcactcgcgcctctccacctgtcttcgtcgcagagagagtccccgtccccgtcgacttccctctccacctgtctccctcgcagagagagtccccgtcgacttccctctctagtccctactccatccagtccatgcttcggttcacctccttcactccgcgttgttttccacttctcaacggacttgcccggtaattccggaa

SEQ ID NO: 1517 - DNA, 4164 bp, Toxoplasma gondii
ttcaatttcgtcgcagtgtcgcacattgaggaaaacttgactcggagttagtttcaggtaacatattggagcccctaaaatcgacgaggtcgatcggcttgcagctcctatctttgccatccgagccagggctgctgttgctcctgatggtgtcggagaaacgggagaaagtcaacgaaaaccgacagtgtctgctgttggcatgaatcgttccacaaatctcccagctccgaccccgacagatgaggagtggatatgaagcggaagcgaaagattgctagacgggggtagggatgcttaatgcaacgtatcgcaaactgaggtcgcagtgatcgcaggcggggaagggtctctacatggctggaatgaaaggcacgccgtggcgcaaacgagcggcaggttgctggaaaaaaacgaaaaagctgaagctatgtgccggtttccttctttttcacaaaaagaacgcttacccaggagatacgggagagtgtccagacgcagagaggccttgaacttcatcgctggttaccagacagtgcagagatcttggcgattcgcgggctctctgtaggggtgccttgtcgggtcccttctaccaccatgatttggattgttcgtttctcctgttggagttcattctctcgtacatggcgtcactacactacaactcggatacggtttccaccatagacaggcaacgaaatgtgcgtcaaccctaggtttcacgtgggagtgtgcggccaaggcgcttcatcttgctaaggatgggaggcaatggccacgtttttgcagagttcgatccggcttcaaagtacagtgggcgcacagacgcccggaagttgacggttcaacatgtcacccgagaacaactgcaaaagacaatcgaggcaggtcgggaaacacgcaggagtgaagacaaaaacgagacaggatacacaggcggcgccgaaacataaattgctcggcaccttatttgccagttccaaggcagcagacaaaggggaggcagggaacaatgtttgcgatcaagaaatctgcgtacttcccgtcgtcagctggctcgctgggaggttaacatcggacgaacacaaggcggtaacacgtgctgtagccttcaattttacagcatctgaacgctttttcgtgtgtttggcaaagtggaggggatctatcacgtctataattgcgtacagtgaagcaaactgagaacgacaagcatccagtctcgtcagcattgctggtctttctggctacttcacctgcatgcatgcaaaacgagttgcaaccgcttgccaacagtacacgtttttcggcgctccccctccataggttgcatggacacaaaaccgaagaaagcaccagttcgtaccgttataggtttcagggggacgctaagcgaaaagtttggatccatgcctgaacatgtctgtctgtatactgcgtgagggttgttgacaccgcaagaaatctttacgaaaggcatgaagtcggggacggtccacgttgaaggcgctgctgtttttttatccgagatatatgatccgtgtgcaaaacagtgcaattctgcgtgagtaggcctttgccacagtgctgtctttccggtggggaagggctcccgacacgattcggcagagagtgaaaaacgccccagtaaacatggtaaactctgaagtaccttgcgtcaaaatgtgtaggcagtctggcgtacgatccatcttacaaagatgctaaggtattccatgttgtgttattgttagattcttcaaaactgagacaactacctctaactgaccgtcggactgcggtgcaatctggtccaccggcttcttttcaggtcggtatgagacaacccccacaaagtgtcctgaggcatggtgaactggaaccactctgtgttgtttgttgcccatgacgccgttccacgtcacacggcactttgatgagcgtgtgggatttgaggaatatttggtctccggcagacgcttggcacaaggccttcccagaattccagatgtcacaccattcatgcgcagtttggcgaatatgaggatacactatgctgccataaatggtttcaaagggctgcagccattcttcaagcttgctggatgcggtgagcgccattggctcctgtacgaccgttgtgccacattcgcaaagatgtcttcgtacattgctgagacttcactcaccaccagattattggttccagtcgtaggtgcacaagtttacgatggaaaaaaacttgcaagatccgaacaacagcttggcgtcacagcaggatagatgagaaatagcttggacatcggtagatgatgcacggttggtgcgaacccccgcaaaagcaccctactaacagtaaagagacagtgtcttcatgacccggaccacttgtgtcaccgaaccaacgcagatgggaaactcggcgatccttagttcccaaccgttacacatgtgcactgaatgactcatcagctactcacagcgggatcgccgttgtaaccatggagtagttcctactgagcagtggcggttcgcgtgtcaagggctgaagcaaccatctggatcacctatcattctggtagcgatttggagaacatgggatgatcacattcacgggttgatgcgggggagctgcggctagctcgtgttgcagcaggcgaggccactgtttctaagcgtctacatcataacgactgacttgaatttctctcttcgtttaccaaaacgatttcatgaaagtgtgagtgacttgttttgattctgtcatgtctcacatgaaggaatcagtagtccacgcatctatacgaaggtactgctgcgcgacagagtcggtttttaacgaacatgtcaatcgcgccgaattacattacttcacgattttgcaaaggaacaactggtaggggaagtgtattcgcccctagattcgctgaggaaaggtctgtctccgtttcttgttccgtcacgcatgtgtcttttctcacactacagctgtttgaaacgcgaaagctccctctggccgtaggctgtatcggtggtcaaaaagtcagagcatgcaactctctaggcagccctccaagaagataaaagagaaccggaaggttagcagaaccaagaaattgcagtgcagacaattttaagttttcgacgcaagtcgggttggaggcaacgaagaaaaatggatcgtgtgtctgaagagaattggtgtcatacatcgcgacttcgtggacgagtaactcgaaacttcaagcttctgtgtctgcagctgcttgtctagatatgagctatttgtagcgtcgcgccgcgaaggcagccgaaacgaacacagactgttttaaagtgccagagcatcttgatttacggcctttctgacccgcattcggttttgcttccaggctcagcgacgccattgtgtgggtagctgagacgtttcgagagtattagtgggttccgtgtttccgaagtcgcgctactcttcttcatagccaaatctgcgtagtaacgctgatgtacgcggtggttctgtacgtcaagcagtttatgaatgttactgcccccgagacagtccagagaattgaatgtttttccttacggatttaccttcgttaggatacactgtgctaccaagttgtcgacatgggcctcatccgtcgtggtaccaacacggttttcgtggtgtgcgagggaaaacttctggtcccgaaatgggtctggaaccaccgaaccgtacggcaaaaattatgagttttcgtaaaggctgacgagggtctcaagccttgtccatagtggcgactctgctagacgacagaagcctcttgacccacctcggggtgtcaggcgcctgccggaaggggtccacagtaatgtggttccctcaagcgagatttctcattttctgaggagcattgaaatcagattccgatgctgtgaacgcctttctgcagtgcagaatctcgcgcagaaaccgatcggcgtgacatggacattctttactttgtcgcctaccgatttacctcgttgctctcagttttgtccccagattttgaggatattaatgacggctcacgttcacgcagttcgcgaagcccgtggatgttcctgcgggacaggcgagtgttaggctgttgaagccgtttcctctctcgcctttcgatgtacaagaaa

SEQ ID NO: 1518 - DNA, 3380 bp, Toxoplasma gondii
ttagaagcatattacggacttacttgaatctgtgggacctcgacgaccttgtccagatagacaggcttcttgacatacttaaacctctcctgtttgactggtttcacaacatgaacgactttctcttcaatgactgggtgagggacttcgacgaccttttctacgtaatgaacctctgggacctcaataaaccggttctccactctctcctttatcacctccacaatccgttcctgattgagagccatacagaaacgacaggtgatggaaatgcatgaaaaacatattccacaccatcatcagacacgtgtcatgtcatcaccgcacaaggattcgcaggcacctacgtcaagctagcaccacgcctgacgcaagcaaggttatcatacatgcatatagctgggtatctgaaagtatcggcattttgagactctccacctctttaaaaacacaaacctactccagttgtcccttggatatttaatcgtcgtgtggcgtctatgcacaacgcaccgttcactgtcaactggaaggataggggaaacccacgagctcggacgcagctgccggatttcgatcaatcctacgacgttacggcaatcccatacaggctgtgctctcggcatgacaaaacgctaaaccttacctcgagtacagggtcaagaagggttgcaccttcgggtggaggacccgcgcagatgaaagagttcggaggaagagaggtagcatactgcgacgacattggcgggacgccaggagcactggcagccccaggatacggtctgctggaatacattctgagaggaagctttgccgagtcgtttgaaagcgaaatggaagggccttgagggagacaaccgttaaggcgggaaccttctaaaacgccttccagaatggaagacagggagagaaaacggtgaagccttggctacctacagaaaaagaccacacggcacagaaaacgtcctgtcctaacctttttatgtggagcagggacagtagtgcatgtcgtgtttcgtcaggagggcatcgaaggaacgaggatcgcgacacggacaaatggatgtggcagcgtgaatctcgaaagagtttcctgtttgccggtagaagcggggtcaggactctaaatctgcacaatgctgggaacacggatatcgatgtcagcgactctccctccgcttcgatgtacggaagacaaattgataatgaaatgaactggaaacaagtgacgacgagcctgctatagccccaagtgtcgagtgctcaacaccacgtgccgttcggcgacatacacaacaaggctgtgttcacagaggcagaatacaaaaaaagagttgaaagacttctacacacgaacagaaccgaatggtgaggttgagaagcactgatccatccctttatgcgacgcgcacatgagcagaagaaagtcctttgaggtcgttaaacaagcagacggactctatactcgaaggcgccggcctagccgggggtcaccgttagcgacggtttttctcgcaggcagaaaagtccctttctaccacatttgaaatgccaacaaaagacgatatcgcaaaatgtatcacccggtttgcgtttagatcaagacccttttcagatcatttaaaccctctaaagcactaggacgacgtacgaaaaccttggtctttcacctccgggaaagaactgtcacacacacaaaacgaagggtgcttctcaagggcaccgtaaatcgaatttccacgagctgctctgaattatggctattctgttcgctgagttgaagggaaccgacgactcgagagcggcgagacagaaaattggttggtgggctcccttgtcggagcggagcgcgcacaaggcacccgagaaggtcagggcaacattttcttcgaagaagaaatcaccggaagcgggcgttggacgtgcccaggaattcatatggctatcgcaagtggaagtcctctttcgagaactgaagagtgattcggcacccgtgcatctgggtcgattttcgcgagctgtcgattcttagcactgttggcacggattcgcgcgctgctcacctggcgcagcagtcgtggtaaaaagcggacgaaaacagtttttgcggtcgtttctttccgcgatgtctgtctcttctttgcgtgaaaagcgaaacttttttggaggacgagaggtgtagcgtcacacgcttcttttttcttgcggcaggcatacacagtctacctgcggagctgcaatgtttgctagcaatcggctaggtgtgccaggggcaggaaggggacctagcgcactgtgcgttgtaccgtgagcaagagcctgcgaagaatcgaggaagaagacagagaatggcgaggttgtaccctggcaccttcgctttcagctgctaggggtgcgagccgcgcgatacgtttttcttcgctgcaggctgggtgctgcgagagagaatcaaacgcaaataacgccagattaaagcctccctgaaacgacgctgtgcaggctgcgagttcttcgcccggtcttgtggaagaagcaagtgctctagctgacacccagagggttcagttcagcagagacaagaagcgcgttctgttcgaaagctggtaactacctgcgttttgtgcttctcaggttcttctcgttcagcaccggggctcgcttttcagtaaacttcgtatccatttttcttgcgagcctgttaggttccctcaagagcgctgccgcactcttccggacgacctgctcgagttttgcatgacgaattctctcacagtgttcaccttccggtacatgtgtaaagtcactttgcgtccttgacagttttgccacccgatttctggctgcatattcggggactgctggttgtcttgagtccggccgttttccggccttcgttggctacaaaactgaacaccgccaaactcagggtacactcatattttagttattttcaccgcacttagaagaagaggctttccttcacgcggatatgctggccgtctagacacgcggaagggatcacggacttcaaggtagcggattcgaggcctgattgttgacttaccgtttttgcttcgattgctctaagctgatcgcttcctccactcggggagctccccgtacgccgaccagctctggagtctttggtttctctgcgcgccatcgagatgtgtcccagcgtttgtttcgaacacgaatggccttttgttcaccacttgagttggagaggtccactgctgtgtcactgcggcacgtccctccgtcttttcgatgatttccttcttcagttgcgttttctgtccgtgtgttgagccgttgccggcatgcaggtgtcaagaacagctccgtctttctgaaccgctggcttccgaggtaaagca

SEQ ID NO: 1519 - DNA, 3550 bp, Toxoplasma gondii
aggtagcagaacagtgccgttgttgacgcaggacctgagtggcattcgcacgaaagcggatatggccgaaacccgagaaattggccaaccagcattttgatctcgtccctcaccgcttatacaaggactcaaaaaatacggctgcgcttctccagggtgttcaaacagacaccaattttgtgttcgttgccgggagatgcttgtgaacgcaaaaccatcgccaagcacgtcctctgtctccatagcgccacgtaagtgtatgacgcaacataaacggaagaagagaagcgggtttcaaggcgtctctccctcaagatggttcgataaaacacgaatgggcaatgcttcggttcccccttcgccacacataacaagacgactgtttcgcagaccattccagattacttccgtcagcattttgtggacgagcagaagcaggcgcctttgagtcgggagacttgttgacgacaagacactctgggcgaggaagcccatcaccggcggtgtgtcttgtcggagaatgcagagggcagactcgcgaagtcgagacgagcaccgggaaagatcaatagcgaggctgagggcggcaacaagcgacgagacgtcagccgtgccatgcttcgccgctgcaagaagacaagggacgcaacacaggtgacggaagccgaaattccagtcatttcaagaacaacgaataattcctcaatttgaaccgctggaagatgaactgttttatgggcggtgcaaagcaatctgcaacggtcgcgcattttagggcaggacggggttgacactctgagggacctagggaaaggaaagaactgcgcgactacgggcactagctgcatttggggctgctggcagagcgatgccgtcaggaaccgaagtgcactcgattctatgcacacagcttggtcttctgcaactgtggcatcactcagaaatcttcagagtcctactgtcagccaggaggtcgaggagcatttgctggacttccgaagcaaaactcgcagattccgccataacggcgagtagggagagacacgcggctcttctctgtgtggctgcaagactttcttcgatcgaatccttcttttccgtctcagtgtcagcgtctgataagaaacagaacaagtggatacaaccatggcagtcaagagggcattcgctttagtattctcgaagatgctagtgcacagtcaactagcgtcacaagcctatgacatcactcggaaacactctcaggcatttcgtaacatcagcttgctcaattgccggcacgagaaagagacagaaatcaagacaaggggaagatattttaaggtgtgtaatgatgttcctgtggttaggcgggctagaaatttattcatcacgttagtaaacaatcctggttttattccgacagaatacattcttctcgcaccatttgatacggccggcactgcacaaggagatgcgaccgttttctgaagagcttggaggacctcagctttgatctcgtccggcaggtgaattccaagacctgcgtctcgtttgttcccttgctgctgactggagacgaaacaggtttctaggaaggctcccacgaaaatgcatgtctcgctgtacgaagacgtgcacgctcgaagaagagacgggaagtgcactgcagcagaggacagtttacaaagctgtttcgagcgcttttctgaggtctccagatcggctgatgattcatcgccatgattttcgttactgaacacactggtcggacactgattcagctgtgcaaccgcgtgccgacgtagtgcggctgaggaaagaacgaggtaagccaagagctcggcaacaaccgagagtgccatgtcgtccccttctttctgtagctctgcagcagtcgaaatacaagtacctagcaaatctagaccactgggcagcagttctgttcgaaggtgacgaaggaattcttcgcttctcagggcatcgcggaagcagtcaaccgcggcccgaagttccaggacatcgtgccgctgagagcgcaccgacgccgatgtaagagacagaagattttgactgttttttttgccgtaatgccggcagtggggggtgttcgccttctctcgcctgggactcgccccgtcttgcggatcacgcgtggcatagacagaaaatatgctccaaaggcggatcgaaatgccgacagggatcgctgctgcgtggacgaggagtctcgaagcaacgctcaccactgccttccgtaccgtgcggagaccttggtggctacgagctctggagatcaaaacatcagaatgcgaaagattgtcaaacaccgcaaccaaccggaggaaggtcttgcgagcccgagcttcccgaagacgtgccacagccccggcatcgtctctcgacgttttcgacacctcctgcggtgacaggcccttctgcccgttgacgtctgcgacaaaacctgaaattgccgctccgatgaaacagtaaacatcccgaccaggtggcgtgctgaggaaagcacgcatccacgaggctacatcaggatggccaggacgacttgtaagtgtatagagaagcagtacgcatgcactgaagcactgcttcacgtcgtcacttgcgccttgttcctcattgcaaatgactcgacgagcaattgtcactgtttctggccactgcaggtcctgagaaactttggagtacgcacacaaataactggagttgagtgaggccgtatgtttcgacaggacaaaacacagaacacgctcacaccacctgagaggagacacaagagaggaagaagcaccactttcctcttcagcggaccggcggaaaagctcactaaaagctcggcgccgcaccggacacacgcaagctactgccacgcgtctcgttgcgtccgcaaaggccgaactcagcactgtctcccttactttgtcaattgtttctctatcggattccctggttcttgaaatcagattataccctcgaatcatccgctctccgcacgacgctagcagaacctggaaagacgggtcctgtgaaagaggagccaagtctctccatccttttgaaagaggtgactcggaagaggccccatcgcatccatctaacgaattatctgtcatggttttagtacgaacaggtttgggggtgccagggaaaagcacttcatcgtgtgcggttttgtcgatttgtctcgctacacgagccacgtgtccgtcaggggtcgatgccacactccccgcgcaccacggcgtaatttgctgatgtcggcagtgcagttccccgaaattccacagtgcatttacatttaggaagcattgacgcctcaacgatgttcatctcacagcgaagacggttcgccgagaacaagacatagcaaagtcgcgtgtcattacagcagacaacagtagcggtaccaccacatgcagccagctaccgcgctgatttatattgtttgacctctccaacgcagaggaggaagcagaatagcaagcggcaaggccttcaagaccgtgttattttgttgtgtacctgggactaacgatctctgtctcaccgaaaa

SEQ ID NO: 1520 - DNA, 1902 bp, Toxoplasma gondii
gttatcagaccgtatcaaagacggtacttctgctagaagtaggattccacggtatctctccatgcaggtttgctcgcaccactgaaacgcaagtagtaggcatgtgagcccgtacgacaggctctgaaaggcgagccaaactgaaacccagaggacagctgaagaccatgtgtccacataacaaagatctgagagagctgaccatgattttcaccctggagaataagcttggcgtcgtcttcgcggcatgcgatcacctcctcgtcgccgtgaggaccctggagaatctgcaaacttccgtctgcgtcgcgggcgggtgaccactggaccggcatttcgtttttcccctgtctcgaatttccttgttttctcgatcgaagaaggcgaagtgccttctcgcgctctgctcgcctcggaatccgagctgctggaatctgcgttgccgtctgtgtccttcacttgtccgcggaggataactgtcggaaaagtgtctatcttcgccagtcgatttcccagtaaaaaaccgtgggacaggcgctgcgcgggggcggcgccgttgtcagcagctgcggtccgcaggaagtcagtcttttcgcggggcgaaaaaaaattgctccagttcgctggacgacgcactacggagactccgttctgaggaacagacggtgaacgtactcattcgcgtgcggacgaacttcccttcgcttcgattcttcgcgtccgccacgatttcttcccggaaagagccgccaaacggccaaatagaagaatgaccctcgtgcgctgcctccaagaacagccgctgcgacgagacgctgtgcccagatgtactacaccggagggcgaggggttcggaagatcggacgcaaagcgttgagcaaaacgttttctctcgggctctgaggaggttcgctaaacaaaccgttcaaattcgaaagtgaaacggcgtagaacgcatgcttgacgcctgcacggagagtgcactcaaaacatccacagacagcggaaagggccggcgagtcctcaacaagaagcgtcgttgtgtctggacgtttagggagtgggaaatcgaaaaaacagcccgcagaagtcaacatgttcagcatcgcgagactcgatgtggcaaatcgcaatgggactggcggtcggcatgcgcgcatgcgcgcatgcgcagcggtccggcggaaaagccgggccgccaccgactgaaaaagcgtctcccgcacgacaggagactcgtagatttctacatttcgttcttccccttaaacaaagacagccgtgggatctcttctgccgccagcggttcgtacatctcaaagtcggcaccttcgcggttcgcgttccgccccggaactgctgctctctgcggatttgtgctggataccgaggcggcccaagataggtatgtcttgatctgcatatgcattgtccccggctctttgtctgtctcttttctaggattgtgccgggggtacgaccccctcgcagctgcgccgtagacctttgccggccatttgctctcgtcgacttgtgccgtctcccggcgtctggccaagacccttgctgtcgcgttttcgtgaacacagtggcaagaagagtcacctgcgaactttctttcctctggcttcttctcttcaggtcgcacatctcctacttggtctcactcttttccttcgtagtgccccttcctgtccacggacctccaagtcgctttcgcctttccttcgtacctctccttcttccttgcacttcctccacactgcctgttccagcatcctaccgcgcctgcctccctctcgtctctttctcttcttctgcctttctctcctctctgcctctccactcctttccttgctggcggtgtcctctgtagtggcgctcgctctcagacagcaacca

SEQ ID NO: 1521 - DNA, 2501 bp, Toxoplasma gondii
tcgtgcgggctatttgcagttgtaatccctacaattgggcatagtattaagttgccccataagcatcttctgtcgtatagagttgttccagaggggacgacgagcggggcgccgtgacatcttcagtagctggtagcgagcgagaaacttccagagagaatgactgcacatgcggtttaatatcgtggcagagccttttccctcactctgcacacctcgactgtcactcccccacgcattcgaaaggtgacaggcttacgccgtacgaaagttagcttcctctcttgagtttatggaggaaggagtgtagctaatagtgaagcggagcagggtcatctcagcgttgtaaacagaaagcaactttggctccgagtctacttctgagaagtcggaacccgtcatcgcagtagcgtcaggcaggtatggcgaccaggtccctgtggatgctctcgaagaagggtggacatccgcagtgtcttgccaacgcaatgtttcagcacactgtaatttgcgagcggcaccggctatagaaaggttttacagtgcagcagtccgactcgtacaggatgagaacaaatttgtatctatgttgcattagctgcatagtaaggggcaagggatagtagtcgattgcaacggttgcgataagcgcacgtacggtatacgaacatatttcatgggcggtacaagctggaacgagagacaacttgcgtctgattgcctgccgtccatcaagaaaaccgcacagttattagcatctgactaattttcgccacggaccgttgcccttctatcatctgaacacttcagtgtttctacgagaaaattgatcagaaacaacggagagcaacgcgtactgcaaggcatctaccacattcgcattttcactgcgtgagattttgcgttctgcaaacgcacgggagcccagagactcggcaaagaagtgccgagattggatgtacctcaggaggtggggttgagaaaagcattggtgtaagagttgtcacacaagtccctctccttcccgtggtttgccgttagcaaagaagaaatgcagctggctgccgccgagcgtgtgaaagtttactaggagggttaaagacaagcaagtgattcagctaatgcaaccaaacactctgtctatgatcatgagagctgctacgcagacaatgtccacgctgtggggaggtcttggcacgacgtgaattgcgggtgacttgcctctaagagatgccacctagtttgctgggatgaggattcgagaaaataacagaacgaaaaagtatccacatcttcacaaaaaagtgacacggtgcagaggatcacagtcacctgtgcaagaacagatctcagccacctgtgatagaacagatcacgagccagcggtgaccttgatttttctggggtgggagctcacagtcggcgtaagctaaattgcacaagaattgagtgctactaaacgtggcgtactgcgatccgtccacgcttgaaccaatgaatgaattcccgacatccttcaataaatgtcaaacatacgtttgttcgcacggtaattgttgtgcacggaaaatttccctattaccagcgctgctcggatgtcttgccgcatcctcttctatgaccgttcctttcagtccggtctcaaaaagaactctactctacttctcacagtatccagtggcggagatacgtaaattgtgtctcaaaccgccgacaaagtgccagcgcgttgcttttccgtgcagctagccgtattcaaaggcaacggtgtcaggtccgtctccattgagctgggacgcttacagaagcaaaagccttgacattaacagatcgaagaacttaaattttgtcggattactctccttccttgggcttggctcgttaagaaaatcgatgtgtccttttagtggcgtgcgttcatcggggctaacttggtatcgcgttgagcagctgtcagccggggccggcatgcgtagcaagcccaaccggtagggcagcggctaccaagtatgcaagcgtaaacaaaagatgctttgtatatgttttcacagagaagcccttcaaatgttcatacggggtcgaagtcatgattccactgttcctgttctgcgtttcgtaatcttgactctctcctggtgacccctagcgtggttgtgtcttgtcataacaacgctgctatacttgcgcctctgtcttctccaaagaaacaccgtgaaatcttctcttgcgctccttccgagcgaaatctttctcccagaagaactcctatgggcgaggacgttgccatgaaatttgtactagccagttcgtttcgtagtgagcagccggcgacgggagtgcctcctgcggggcccggtgcgcgtggcggacttatttgacggtgcgagaaaaaccgtctgcttttgaaccagcttcgcgatgtggatagaccttcacagctgttgagttctccaagctagaagcgtctttttcgaggaggggaaatagctccctcgtcgcca

SEQ ID NO: 1522 - DNA, 2155 bp, Toxoplasma gondii
ctttcttgatacaaaacacaagcgaaaggcaactccatcccgaaacgccatctgcctgcatctgcgtccagtcccgggtgttacttctgtgactggctgccgtcagtggaacactccgcagttttggtccagtcgcgttagtctttgtttgactcttttgacgattcgcttactttcactgatatgcggcataacttcgaggcattaatccaccccagaacttacgaggacacgtaacgcgggatggaaccaagaagctgctcagtttcctgctaatatttccgaaggcgtagcagacatcctgaagtgctgctggcgacactgttgcggtggtgaatgggagacacgagaggaagacggtaagaactgagacgaggcctaacagcaagcgacggtggttgagcagacaaggcggccggccaccacggcgccgcctgcatgcactgaaaaaacccgcgttaactgctggaaataacgacagcacagaagctgtctgcgggcccggctgagtggcatggatcaaccaaggtctgcctccctcggcaatgcgtggattcgtgctcggacgcatggtgccgcgtggtggactggcagccagggcatagcgtaagacgagggtacccgaagaaacagggagcaaccaagttgctgaagagccccgacacgcgatgaactgagacaacggatgcgggaaaggcaaggcagaaaacgaaaaaaaaagacagggactcggcagaaaggggaccgaagaccacggtgacacatgccaagaattgcggcagctctccaacatcaaaaaaatgagagcacgtgcttggccccctagttgacaatgcatctaccctggtctcatagacgggatgcatggacacttgtgtcgggggaggattacacttttactaggcctacaagtccatcaggctcaccaccgaagagccagacaaacagatacggatgagtcgagcgtggttagcagagaatgccagttgtactattctgagacacaccatcgtgcatgtgctttgtttcttcccagaggctcgggcaacacgtgcggacggcatagtttcccgccatgccgcctcaaaaatcgacccacgagcggcgaggattacctttatcggggaaaacgttggcacacacggtcacaccgcgatgaagttgttcgatgaccaacgcgcctactggttcgttacctctgttcgatgctccgctgaaatgaaaaacagagagccgattccttgagagcaactgcctaggcgagcgccaacgaggagattcggaaactcgcgagtgtcttgtgaatgcgctcggcgtgcggtgtgaaatccagcctgtgagaatccgccgtcatgcaattccatcgagatctgacgaaaaatagcgccacaaaagcgacttggagacagaaattaagaaggcgctgacgggcggctgtatggcatgtctgcgctggagacaaggcgagctaagggggccagctgtctcacgtctgcgaaaaggcgcccatgaaggtcacctccacaccgtcatcccccatagtcattcgacaaggtgctatccgtttattctgttttttttctctggttggtttggacgaacttcaagaatatgtgggaaaaaaagatcttcgccgctgatgccatcacgaacttggagcccgaataaaagacgacgtgtgagctcgtagaggcaacggcttgcctatgaccggctactctttgcacagttcgttccgccccaggaagtgtgaggcatgttgttcgacggttctttgctttctcctgtgtctgctcctggcggcagaaagataattgtttcaaagggcgaaggacgagacgtcgactctgggggaggtcgatatcgggggctttctgcggtgccagctgtcttgtcgctcgcaggaggaaagagagccagtctgcaggatttgtcttattagtagtccaaggccacgttgcacgcagcccaggtgctggcagagttccgcccacagtttcggccttcgtgtagcgggcagctgatatcccttcccgatttttttccataacagtttgtttcccgtggctttccaagctgcagtttccaggaccgacgcgaaacgctgcgtccgggtcttttccacacgtctgggtgagcaaatccaaaggcaaaa

SEQ ID NO: 1523 - DNA, 872 bp, Toxoplasma gondii
agacagtacagcagattgcgatagtgtgcaagaagagttgcgtagagttccctctctgctggctcgctaggtcgtccgtcgcgtccgtcttcgaccccctgaagcgtggaagttgatctctcaagaaaagcaaagctttccgggccttctcggaactcaggaaacgaagcggcgttgcctgagcctcgacgcgaagcctgctcttggacagaagacgcggaagacgctgcatcgtgactgagagagggaggatccccgcgaggaaaggatgaagaaaatccacgaagcggcagctggtataacggctttaggtgagggccatttggaagcagtgaagaggagggggaagtagaagaccgcaagaaaggagaagaggtgaacgggaaaagcgagtgagaagaaaaagaagaggcatggcgaccaaaggataagaatttcaagtcggtagtcaaaggtgagcgaggtgtttgtacaccggaagtttgcgaaggtgacgagaagcctccataccgttttttcgctccgtttactctgcgatggggaacaccagggtcagaaggaaccgctcgatctttgttttcgagtctccgattgccctgactagcagttctccataatgcagggcctggcggcgacgcagccggcagacgaaggtgcccaggcgcaaacatcgaacacaaccttttcagaaaagcgagtaaataggtttcaccagtttccagagtgttgaggaaatggggggaaattcgtttacccagtttccaggagttcgagagggcgatgaagtttgtttaaccagattcctcgagtttcagcccaatctttgatagtgagaggaaacgaggcatgttgaaatttgaggggtctcctta

SEQ ID NO: 1524 - DNA, 2763 bp, Toxoplasma gondii
tgctttctataggatgcatatgacgacgcgaactctgtgtgtgtgcggtcttgcgtctccacgaaggaacagacaggttgccgtttttcgaagaaagcgtttctcttcttttttgctctggtgcgttctcgcagaggtgcaagaggaggatttcgcccaatctaccgacctcgcgggggcttcgtcagaggctacgggcgtccctactagcgaacatgcgtttgcgaaatgtcgctgaacctgagaccgtcgaaattcttttctttttttgcatgagatatgccttatttgcagtggagaaccacgggagcgagggaagcgagcagatgcttacaacgtgctctgtgtaccgacctcgcgaatgcgtcccggaacatttatgtgcatgcactggaccagagacgtcgtctgtctcccaactcgttgacattccgcaattgcttttgccttggaaaaaagagtgacccttgccacagaaaaccactgctgaaacgtgaagcggaaaaagacgacacacgcaccacaaacacactccgccactggcgggcatgtccgcacactttcgctggtcctggtaatgcagcgaaaacgaaacgaggcccatcgactttggtggcgtaggctgaccctgcggtttcctcgcctagccgctttagtctttgaaagagacaaagcatctcgccttcacagaaagttcaaaattcctgacgaagtcggacgtggttggtgtagaaggtgttttgacgaagttctgaaggtgatgactgctaagttgcgtacatgctctctagaatttcatagtcacctcatgtagatacatgtagagatctgcatatatctgtctacatattgttctgtatggaaaactctcctcgccgtcaggcaaaattcaaagtctcagaatctgacctacaccctaaacagatgaggctctctcggacggtggagggtcgcggcgaaatgccgcagagctttttctctgcagctgccacgacggagttttcgtttcttgtagcagaggagtgctgaagctttgcccgcacatcaaggaaaagtacatcatcctacgcgtgagtcgtactcagtaacaggcgaatcttgagcagaactcgtcgcgcccccctggagacaccacgacttgctcaagaggtgcattaactatataagggtatccagcgtatgtttgaaaaaccaacatttttatacaagctgtacaaatatcacggtattcacagaagacagaacctttttgttttacctagtgtgtcggcaattgtttctactcagcgtctttttttcgtccttcgcacacgctgttagctgcaaggaagactcctgaccgcggaaccagcacagcaagccagccgcctagtataggcggagggaagaagcaggttttcacttctgtctccacctctccctacacactgggcaaaacgttcgtcagcaaaagagcagaaagtgcatttgatttccaacagttcaacgacaaccccatcgcgggagggatggacgcgccggttcgagaaggaccctcccgtgtcacaggctggggctttctcctttttctcgaacgacaaatgcactcctactctctgcatgctggagaatcctatcgcgagattgcgactcgaaaagctgagaggaaatcgcgagtgagagggaaacgggggggcacggacggggtaggcactcaggatatcgatagtcagacgggagcgcaccctttcagacgcttttccgatacttcagagatgcaccgcactacaaatgtcgtcctgcgtagagtgtttgccaagggggatccgcgtttcctcgtccactcagactcggttccacgtcggccgttcaggtgccagcggagtgcgttccctcgttgtcgtcgcggaccgcccgagtctgtttactcgcgctcgcgattcctctctgttcgatctcgcgataggaatttccagcttggtgaggggagagagagaatgcatttccaaatcgaaataaaggaacatccagcagggtcctccacagccgatacagtgcagggcagagactcctccgtggttcggatggctgcttgcttgatgaatttccggtggcaagcgtctttgattcgtgattatatgacgaagacgcatgccagtcatacaaggaggccaagcataatgagcaaaccgtgtagggaagttacgaaggggcactgcagggttcttccttcgtcggtcgttttcagtggagagtcgccgatcgtgtcgcagaaggagcacttttcgaggctagggggttgcgtctctcttgcttctcccttgacttttctgcagaacttgaaaactctaccggtatcattcctttcgcatgttcgctagaaagtccgagcggattcgctttttccccggcaggattcataaaaatctcgaggttccaacacaaccagatacacacacaccgacacacacacacacacacacacaccagtggccggcgcaagtaagccgtaaacttggacttctttccgtccctttgtgagttccaattcgatttcctcgtggcacttctcgaatcctcgattgaaagacaaacgggtctttccagctcgcaaacagaaagtgccttagttcattccctcgtttcgcctgtctgccactctcttcggcttggcgccctgcggtgaggagcacccgctgcttgccagccgacagcttcattttattttcgccgttcttgtgcattttcccttacctaccgtaatttaaattcccctcgacaaga

SEQ ID NO: 1525 - DNA, 3257 bp, Toxoplasma gondii
aggcggctgaatacgtttttgatatctccaggcatcgaacgaatgagaaaagcggatgctatagtgcggagaccttcaaatggagaatgcaagccttccacatggacacagcgatgtctgcattctttcgactctcttcggtttcgcagtccacacagtttccgttccccaacagatgttgtggccgcacatgcacgtgttttcaaaagaagaaagtgaacccctcttaccgcgatccctggggctttgcattgttggtgatctcgcagcgagttcagcgcgttgtgaacaagacaccgatttcgcttcgtgtcttgccagggcattgccccgttccccgaaaggaacaccgggtcccccccatgtttgaagctttgagcggaaacccccatctgctgttcgccttctcccgcggtggtcctacagtctcttgtcacctgcgccacgctccccccaaagagcggcagctgtcgctctccagccgtctgctcgctccccgcggcgtcgcggtgtgggcatctctcctcacgcgtttctgcatgcacagacgcgtcgcccttttccccttgcgtcgagagaccccggtttcgcggacgaagaaacgctggatcgatgcgctgaaactggtcttcgtcccaccgcttcgtagcccaccagctgcactggccgctgaggttgtacgcgcggatctccgtacatgcgacgtgtctgcagttctctggggacagttcagcccgtgcgaagtcaaatgcatgcacgagctcgtgaagcaggacccgccgcagctcgaagggagaccaaaagcagttgccgcaaagccacactgtgtggtagactggcgagtaccctccccggtgtggagggggagcagatccgcgacctgaggtttgggcacagtccaccacgatgaggtcgacgggagctcccatggcggagagtgcgtggacgagcgtcttgactcgccagtcgcgaagcgcgaagaaactccaaagtttcatttgttgacgctgcagccacgacagcgtctcgtcgccaaactggagaagcggggaagtcggcgaagctgtccgctgcgactcctcgctttctgcggacttggaaacggtctccacctccgagccccgaggcgcaggtgaaacatgcgaaaccggtgttgccttcttcctaggaggtgatgcgccacctgcggagggggtacgatcctcctcgcagctcgacaaagacggaggcaagagagcggcacaggaggacgcctctgctgctgcgttctgcgtcgcagagacgccgattcgcttgtcttgcgtttccgcggccgagagaggttttgacatggatgcaacagaggactgagaaagtggtgcctgagctgcgcaggcgctcgcgaggaaagcggaacggctgtctggtgaagaaggcggggaggcaggagaggtgcaggcagaagttgatgtagacagagaagagggagaggcagacgacgtcggcggggcagcgattcctgggacactgcagacattctcacggcttgatgaaccacgatttccatattgatcgggctgttgaaaggagctctcttcagtctgacgcgatttaacaagccatgaaagccacctccactcggagtgccaggaggtgtcgagcgccacgggggccgtgggagcgtcagaaagagtcatttcagagtttctcaactttgtgggaggttccgcacaacaggccggaggcaagagcttttgcgaacaccgacgaaaggaagcagcgaagcgaatggcatcgcaggaaacctggagccggtttctacagagaaaggcgcgacgaggggcgagcgtgagccgcccctgagtatcgggtttcccaggcatgataaaggccttcggttgttttttttctgctttaggaactacacaggcatgggaattcgctcgccacgcaggtacgaccgtgcacgacatgtagacagaaccacaccttcgcagtgaaacagagagagttacgaggggagcaacacaagttgtacgtcgagaacaaacagagagtcgccgccaggtggtctcgacacgcttgaccgcggccagatattcgcgcccattcagcgtctggccgcgagtggctcgagaaacgagaaacgcggggggtctgagtggcacatatatcacctagatattatcgttatgtgaaaggctcgccacataagagacatacaggtcactgtacggcaaaggatgggaagtattaaatgagccgcttcccggaaagggcgtccgcagaggctgcggagacagagacacgcggcaggtgtccacggatgttgcgctctcccggttgcgaagttcgggaaacaccacacaaaaaaagagccctcagtggatgcgtgaaatacaggcctcctcactaaagtgaagatacttctcacgcagaatgaagaggttcgctttctaaccagagacagaacattggtcctcaggatggcatttatcgacccaggttgcatgcatgctccggtgagaccctggatagttcggacagtcgtaggtgaagggtgtgttagagacttagactcgtgtcaccgattgtcgccgtttgattcaccgcagcatctaaccttgtttccttttgtgtttaaggccgtgttccgtgttaaaagttgcaaacaggcgtggattctcatcctgttgcgcgtgctggacaggtaaacaactccgtgcctgggagagcgcgcttcgttgttttttcgtatttctccttttacagtcacaagcagctgctgtatgtggcattgaaccctgtagtcgcggatctgttttaccacgttgcaacgctgacgctttttacccgatccagcctctgtcggcgcttctagttcagctgtgtaaacgcgcgaccgcaacatggcaacgctgagagactgaaacgctccagaagacctccgtgtttcacaaaatccccaattgtcagacaggagagtgtgtgtgtacacgttccgacgcgtaaccatttgcgtcagcgagccggtcgggatgatcaggtacttaagcttcctttacatccgagggagtagttgcatgtacacgaagggcgcgcacatatctgcgcgtgtaaacacttcgaggcatgcgtacggttacaaatattttgcatgcgatttttaggcggcttgcttttttgcctcattgtttctctaggtggtctcttgtgacgtgtctgagtgcccccggtgtatggcccggggaactagtcactgcaggttctctccatca

SEQ ID NO: 1526 - DNA, 1144 bp, Toxoplasma gondii
ttccagagacacccgaaaaaccgacggaaagaccctcgagaaaggaagaagaggaagaagaagcgggaggcgcgtacgacgcggaggcaggcaccgcgagaacgaggtgagtcggcggaggcggagccggctgcgcggggtacggatgcacggtgcccgacaccgggtgtatgtacacggggacaggcgcagaggaagaagaggcccggcttgacaaagaagaagcgaaagaggaggaagcggagcgaacgaaggctgcagctgaggcggaggagacaatgaggatggaggagagggagcggacaggagacgcgggagatccacggcctccggcaggcggcttcaggggctcgagaccgatgaacgggaagcatgcagagtctccaagcgccggcgaaggcgaggaaagaggcgagagcggcggaagcagagcaggcagagacagagcctcagagtcggagacagaggctccccgacctgcccgaggcgcccgacccacaccgccccccatggtgagggcggagactccgaactcgaattggcgcggagacacgaggcggcagcaacgcaggaggaaaaggagacgcgggagaaggaaaaatcagtacagagtcagcacgctttgcgcgcgcccgcgtcgagagagagcgaaacgggaagcgaaggagactgtgcagaggagaacgcgtgagggcatcgtgacgagacagaggtgaagagagaaagagagtggagaacagagacggagcgaagagcgacagaaaggaggagagacagggctacacgaaaggattctctggagacaatctggagagctttctttagaagacgacgcagccgcctctggacagaaaggccaacttcgacgcggaaaagcaggcccaaaaaccggcgaggcaacgcagagaggacaagaaacaaataagagagcgaatgagagaacgaacaaaaagaacgaacgaagagaacgaacgaagagaacgaagacaacgaaagaagaaaacaagagagcgattactttgaagagagagagaacaagacacagaaacacccagtcccggaagacgaccggaagtgacctcggcgtctctccatgaggcctcggcttcggtcgtctctcccggtctccttttggcgtgagaga

SEQ ID NO: 1527 - DNA, 2098 bp, Toxoplasma gondii
tcgaaaatggtttctcagacgaggatcctttctctctgatgcagctcgacactgagacactgccgttcctcgcgagcttctctctcctcgctcccccgagtaattctatccaaggcgacagagggagctgcacagaaaggacgggtatcataaggagagcgcctctgtctgtctaccaggtccttctcttctttttcctgttccctcgtctcaatccacttcttcgtttgcgtctctgcaggttcgcgtcgttttctcttcgtcctctctctccttctgtgtcttcaagactcgctcgcttttccaccgaagctccttcgtcttcgttgcctacctttcgcgttcagttcgttccgctgagcctcaagacgtcgcttgtcttgtgttttcgcgttgatgactctctgcaagttatcgattttctgctcgtagtaggtctgaagtccggagctcgggccgtcttcgccttctgtcgcacatggcggccggagaggtcctgcgagagcagacatcttgttttctgctaccacagcaagccaataagcgcgaccggagcattatctccggtgaaacatacatcccccttcacctgccttcacgcagacgcctggtcactcgaacggacggttttctacgaagacacggcgaatttgtgcgcgtacatgcgcaggaaaaggcaggaagacgggggcgtcagtcgacttcagggcgccggagaggaaggatggaagcggaagaagaaactttgcaggaacgagagagaagcaaggaagcaaaggaaaaggtgcgcacagcgcggaggccggcgccggaagtgggagaatctaggaaagaaagagaaactcggaagaaacggcgtggatcccagacagagaagaatccacctgccttgaaacgaactgagaaggcgccctgacgaatcttgagtgtgtacgtacacccgaggagaacgggagaaaagcgattttttgccggacagaaacctcgaacttttgacttttcctgtctgcatgcgcgcacgccggaagtccctggacgagctcgcctccgctctacgcggactagttcatccgcggaaacggagagtcctcacaaaatcagactgatttttcctccggattcgcgccttccttctctccgtctcgtctttgcttcacagacggagggagagccaccggcggcgcacagtgacagcttcagtcaacgaagatcctttaaaagagaaagaggaagacgcaacgtttgtctctagaggaaggaaagagctgcacaacctggtggactcgcaacggcgtctttgcgattgcactcacgctgtgtgtgatgtgagtggagggagagaagacacgcgagacgctgcccggtttcagcgtcgaaaaaggaggagtttttccggtgttttcacctgcaaagaggcttcaagagaaaggaaagtatgtcgtcgaccttcgctccgagcgaggatatccaaacaaggaggcaagaattacaacagaaaaccgacagagacggatttccactcctgcagacagtcccggcggccatacagagggaggacggagagccgtcggtgtgcacatgcagtctcctgtttgtgaggaaaaccttcttttacagaagacgtcttggtccgctcaaaacgcctgtgtgtgaggtgagtttgttttttcgtgagaaaagctgtttctgactctccgtcctcctcctagtccttcgaaggcgcctcgcacaccgcatcgccttcctcggtcgcctcgtgtctcctcgttggagagcactggagacaagcgtcttctctccccctttcattcgcggcatttcgccagtgtctcttttcggagctttttctctcgcctttcctcctttcttctggaagaggcagagcaaaacgtcctgcagctggttcggcctcgagagcgaccggtcgattctcaggcctcgtcctgcgcggctctggactgtcgcgtccgttgtctgcctcggaagtccttctctccctgtcgctcctcgagtcgacttgctctcttctagaagaagacaggccgcctcgagtgcgtctcgcttcctctcctctctttctcctctctgtctctgaaga

SEQ ID NO: 1528 - DNA, 3997 bp, Toxoplasma gondii
gtgcacacaggcggatattcacttcctcctgtctttctgttcacttctgcaccttcagcgacaagtatttcttcctttctttccttctttcaggagtccacttgtcttctcgtcctccgtctgggttctcctccgctccgagcagctgcggcggaaccccgcagagtctctcgagaccaggtgcaagtcggcaggaagactccctcgatttgctttcgcagtcttcgtcgccatcttcatctgttccttctccactaccctctccctgctcgaaagaaaaacgacctggagtgcctgtgacgcccgtatcgctgccgccgccgggcgtcgacacactccagctggggaatcgcggctctgggtttcctgaaccgcggggcgtcaggaaggcgcgttcgttttcttctggaacggctgctcttccacgcgtggagcttgccgcttctcggggcagttggtccggtgcccgagcgcgagaaaaggaaccagagaaagtgcaggaaaacaaagaggaaaagacgcacagtggaagcggtgtcgatttgcgacctggggtttgacagggaatgcgagggcgaaacaggaggagacgacctgccgagagaaaccgaaagagaagcgacagccagaaaatgagaggaaagaacagaaaccaatgcactcgaagttggaaacgtctagaaacgcacaagtgaactgacgcctctatattttgccatattatacatgtttctatgcatagtacggcatgtttgtgaatgctgtgaattcgtgcgagtctggttttaggggtatccttgtcgcgcgaacgatggcaaagtgccagttcgcttcgttaatggagtctttgaaattggaagatacgcctcactagagagatgtcggtttccgcgagatttttagaggagtttcttgacaagcgttatctgtgcttgcaagcgttctgagggaaggcggagaggggccagaaaggaggtcggagatcgcgcttgagctgtcttctgtaaggaaaacgcggacgatgctgttcaacttgcttctgcctcagagcgcgcctccaacgcatgtcacgtggaatattcccgcgacaaagaaacagattttctagagaccttccctcgagtgtcgcgcgactcatgcatgcagataagtgtgagtctctccaaagaacccgtcgaagggaaacgaagaacaccgtcacgagtcacagtccaccaagagttgtgtgccagaggctccatcacgcgtagttctttaacgcgccgatagaagttcgccgggaaactgccggcgttgcagcacatgcaaccgcttttaaaaaggaaactgtcttcacctcctccaagaaaaatcttcggtggtgcagcttccaccgctggttcaggagaagctggcgtgtatttggtgtacacactcctgagaagctcctcgggtgcatttgctcgcgttcaggatctcgcgaggtaaactctttcgccacgtaatggaaagtcagaacttgttggatcgactgtacaggacatcaaaattttagtttccacttcacaactgcaaggtgacagaacagcgaggcgaatcctcgttacgttagggaattgaaagaatctcaatcccagtcggaggccagggaagtttggggacgggggcggtgaggtcttgttgtcgctgaagatctccattccgaagagatctggtgggaagactaaacagtccatgtttagtccagtggggtggtggtgtacagcaatcataaagaacttggttgtctgtacctcataactggagtcatattcagtatcgtaggtactatcatgtctctgtgtattcgatatgagttataaagttctggttcgcttgacaagtggccacgaagagacagttaccaagataaaattatacatcgaagggccggtctcgggcgcctcaatgctgctagaatgacacacgtgtacgcagagaacacggatactcttttaattcgtcttgcgaacggcaaaagaaaaaagacgcgggtccgagtggtgcgcgcaaacagtctgctcgtactgaggtgacagaagacaaaaaaaaggccgacaaggacacagtgtgtttggggtgtttgtgggtagtccggaattcgctgtctctttgcgtgactgtcggtttagaagtggcggacgcacgggcaacttctctgcggccattcaccttttcagaagccactcctggcttctcccgcgggatctcagaccgttaatgttttcaggagcgctagattcatgtgtggcgagtccacgaaagctgctgtacatctcagcgcagaaggacctgagtcctcctgagaaatccaagacgaattcagatttgtggcaaatcgacaaaagtgcaaagtttgccaggagtagaccggaagatgtcccgctcgtctcagagcggtgttaacagaagaggacttctgttttcccagtaaaaagcatgtgtgttgtagattcaatgattcgcagcgtgtgtttggggagcttcgcttctgctgctttgagatcatactaacggccagaaggaagtgtgttcaaagaaaggggatgatgtcggattcgcgtttgtcgtcagtgagctgtcggtcgatgagagagcttcttcggcttgttaggagacgagaggaaagccactcgagcgagaatccttgattttcgcagagttgttctgtcatctgaggcagccgttgaaggaagcgaaacacgctgcagtttgcaggcgcgttgtgcacctctcgtcttggatgtcgattctgtctccagaagatccgctccccggagcgttacatcagagaggaaatggaaacgcagcgtgtctccgtacacgaacgagtagaaaaagaggaacaaggtgttctggggagacccttctgggcactttcctccaccttaccccttcttaggctgggatttagaaagttttcgaaactgcaggatcgaagcctttttcacgtctcttcccgctagagtctgagattccagcttctccagcacgaagggctgacgatgagttacgattacttttccggttttcttttcacaacgggtactccatctgtaggtgccacagcatctctgctgctgcgtcgaggcggggactgccgcaaaactgctgcttttcgctccacagacgccgtgactgaataagtcgccccgtctaaaacagcctggaaaaagcgtgcgaaatgcctgtgccgcatgctggtgaccactctatagacatacgaagcgcggccattttacagaactttcacgcattcatgtccctctgagacctcccggaaaaggagaaaaaggtcgtcgcgaatcggcttctcgtttcccgccatacttctctgagaggaaaactctctgcttcttgattctctggcctaaaacagtgtgtgtgtctgtgtgtgggtatgtgtgcgctccgaacgacgcctgacaagaagtcgggactcgaaaggcagaatcgagaggcagaaacgcgcgccgacgtctctcgttaagggtaacggcaggtgtgcgtggtggtggcaaaaaagaaccaaaaaccttgcgctttcctgcgaattataggcaaacagcgagcaaggctccatggtgggagggtcccgctctgagcggtagcagcctggtgcttctctcgaagttcttcccttcttctcgacttccgcgcacgcactcgtgctgcatctcgtcacaaaagctggagaaactcctgggcttggcacatggcaaaacttcgaaactccctggcggcaaaactgggctctgcatcccgcctttcctgtgcgagacggcacttctcaatacatccagcgaggcgggacacacagcgccagcgagcctcggcggaacttcattatccccgaaatctttcaccccgtttttcgccgtgaacgaatcaacaaagacggacctctgctctcttttcctttcccgtcccaggcaagtccgaagcgcctgtcacagaagaaaaggctcggtggcacgca

SEQ ID NO: 1529 - DNA, 3563 bp, Toxoplasma gondii
gaagttgctggtttaaccgccacagaagggcaagaaacgcacggaaggaactgagcaaactgagaaggcagttacaggaactaggcgagtgtgacttgaagacacaagagagggtggcggtggggcaaatcagttcgcgatggaaactcggaagagacggaggctgaactgtcggaaacaatgaagtggatgacctagggcggggaggaagacccaggagacagtggagaaaggatgtgacgcatgcgtgaataatcgttttcctagtgcgagttgcgtcagggtgacattgctcagtttccgtcgctgtgatttgcctctgctcaaaaacaccgagacgtggtcccgtggttttctacgcacccctttcaaagggaaggcaaaaagagtccaggtcgatgcggtgagcacccgcttagcatgctactcttgaacagtactgtacagctagtgcggttactttttttggatccttcctttctttctttccgtctcagtcttttgttgacgacgagaacgggaaaggtgcagctctggtgtagggatgaattggagggtgagggtacattgtcgaacgccatgtaaacagtaatgaaggaaaaaataccattgtgttttgctccgttctccattttatcctgctgaattgccgtacgttggaaggcgaggcttgacatggaaagaagtgaggctacagtgttctacgggtccagtggctacgcacactttctatcgccgcgaggccgacgacccgcgacacacgtctcattgaattcgagagcgaacagctggaagatgcagaactacggaactggagccgttcctcagttctgagacactttcgtagaagcagttctcaagggaaacatcgggaaaggtgcaacgagacagtacacatcgctcgaaatacgaacagacgtcgcctgggttccaaaagtttgcggctttgacagtttcattccaccaacttcagcaaacaatacaacgcctgaacggtggcggtgctcgctccaaaaagcagtatcaaaaaaaccagcactctatatattgcctgtataaatatcatgagatcgatccttccttgaggtacaaccagcctctgcttcttctatttgagtagaacaattctcgatcgccgaccaactgcgcagagacgcagtcgcttctttcaagccgcgcgtttccatactcccttgtgtcttagacaggaaagtctcagggagaaatgtctattgtttctccctagttcactttgaaccacccctagtgtcaccgcaacgaagtgtctatgccgaatgacataacagagactctcaaatggttttgctcgaaacgttgacaagagccgaattacgctaatgccaacgggaagaaggataaacgtggtggtcctgtgaaagtgggcgaaatgggtctctcaaagaggcacgggggcaatttgcacacctcaagagcagcaacgggttctctttgctcgtcttcacgattcaacaggtgaacgctactcgggaagaaactgagaagcggaaagatgtgtcacttccttcagacatcacatgtttttcacgtatgtccgtgtttcgcttacgggctgttgattctgtgtcgtgtccagtgcaaagcgtcaactgagctcctcgttatacccaccagatatgaggacgtccatgaaagtccgctgagttccgttgtggttcatttctcttcattgcacaaccaacagcgttcagttgaaaattaaaaggaaaaacgtacgatgacgcacacaagggcgattcgcctttctgagccaccctaaacgatccgtcagatgtgcctaagctccgctgtttcaggacaacgacggtggagacctgtttcaacgacatccagtaaggaaggcgaagcgcctcacgagactagcccgctttgcgttttccttgaaactgcaagagcgagtacttctatgtgagcccctaaccacggaagcatcatatgatgaatggcgctcgacatttgcactgatgaaaggaaataatttctctgtgacaccctcgaaagacacatgcaacaagttcttacgttattacgcggttctaccagagacccgcactgcaacggaatgctgtttttcgtgaatttccccccctctacacaaccggagtggtgtcacacagcacacaggcgggttccatagttcaagtttttcagagaaaatgctcgcaagcagcgataccttcgcgcctgaccgacgaagcaatcggtactcctggatagagacgagggaggcccgtagcctagctgtgcaccctttctttatttttggatgttggaaaccacggacattcacaagctgtttcccgttcgcgccgccagtcgaagtgtctggactaacgtaaaagccagtgaacgactctgcattcgtgcacctctgccccgcttggaaacgctcgagagttgattgaccacacgaacttatctattccaatgctgtgcctgcggtttcggtggtgtgatcagcgtggaaaacacccgagcaaagattttcgaatcgagctcgacgcgtaagtatatgatattcgcgtaatgtcagcgaacggctgttccgtgtatgcgcgcgttctacagactttcgggtgcaggaaaaatgcgagtgaaacaggcgtgtttgtgtgtgaaaaagagcgagaatcacgtcggttggagagaaacgtttgctttgccccttccccgtctcatttccgtgcttgccgggacagttacctgccggcgcgccttactcaccatgcccgaactttgaggcacacgcagtgagacacccgcttcgggtttcccgcgcggcaaaacatttccgatcttcagtggcaaaagcgtcgttggatgtaaaacggaactgaaggaaagtcattctgtgacgaaaaagatccggtttgtccgtttccgggatgccatgagacgccgagtttcttgccgcgttccgcgcggttcctcaatacggctgaatgagcccccgaagcacgcggggcttttttatgtcacgttctcgcggtcaactttttttggcggccaataattccgctcttgcagacgcgccacgttgctcgaccgacccttgtgtcggggctgcgtctcgaagtgtcagatctttccgccttccagtttcacaggaacgcctagttttggttggcttaatcctcgccatcgcggggcgaattcattttcttctaaactgcgtgtaaatttcgcggatctttccttgtctgtttcgtcaaacatgagtttccgttgcgatcttcgccggccttcactggttctccaaacgctcgcctggatctcgccctgcctctgcaacatttttggctgactcaccccgctccaggtggtagcaacctctgaggcttttgttgtcatttgtagttcgtctctgttcgcccatccaggtttaattcactcatccagcgccacagcatttctctattcatcttccctggctgcgttagggggagtctcagctgtcaatcaaccgttgccctgatgagctgctcgtcgaggaagcggctgtccggttgtccttcggatctgta

SEQ ID NO: 1530 - DNA, 1598 bp, Toxoplasma gondii
ttccgtcgacttctcttcactccatcgaggcaaatgaaacacatgcgtctccctgcctctccggaagcggcgctgctggactcctgtgacagaggcgtctctgtctcgtccactggcgccgtcacatctgccattctaccccaacacttgacaagacgcgaatcaagtcggagaagaagaggaagcagagaaagaagagacagagctcggaatggacatgcacacgaaggctcctcgcactggatatggaaccagtgcgcccaggtaacgacacccgtatgactacataaaagtacatatagagatgtataggtataaatatatatatatatatataaatatatgtacgtatgcgcttggatcatgtacaagtggcggtgggactagtcatacagggaaagacccttcgtctaccgtgaggtgaaggagcagaaacaactagagagggttgtgcggtccatgaccgcgagtcgaagagaaaggagcacagcccgcgtcgcgcgtggcaactggagaaaaaaggaaggcgacatatcaaggcggaaacgaacgcaaacgcaacggccaacctgaaatgtacgagggaacacctttaggtcaccctgtcacttccagaagcagcattcgcgttcccggggtacatcgaactcaacctgctgtcttcaccgaccgtattcccaagcagttgaccgaacaaatggcttttcattgatcccgaagaagcagactgagaacgccgcccgccggctagttccacaagaagcgaagccgccaggatctgggatttacagcgttccctctttctcctcaacctgagtttcgcgacgaacgcagccacaaagctgtcaggagtgccacacacatgcgcaggacatgccagacaccagcaaacaagaaaaactgcctaaagaaagcagcagtttattagaaaagagactgaagcgcggctgaaagcagcccggttcccgatggggcgactcatctcaaagtcgccacatcgacgaggtaactctgcgatcaatagtctaacgaaagacataaagtgtgaagtgcagcaaaggggacgcaaccatggtgacagcttcagagttgtgagctaacaaaaagatggaaaagtgcaatctgcttcaagagaacgctcgatcctttgctacagcgtttccagtgctggaaacagagctccgaatgcatgcacgttcactacccatccaaccggccttccgaagaaaaccgcgctggaggtttcggagaaaatcgaggacgggtgtcttgattttactggcttctgttggagggtttaggtttgttttcaaactcagcaaactcgtttttcctttcgttttttacgtgtgacacgtcaagactcttctgtgccagtcgtctgctaccactgtagcgtctggggtattcgctggaggttcgtgccacacagagtatgcgcttttctgtgcgcaggttgccggtggaacgctcataacgaaggaactgttctgggttgtcgcctcaaaagtggattcttgcctgcctggactgttctgccgcgtgaaagtaggtttttagcggctacccaccgtacgtctgttcctgcgcgccaaaga

SEQ ID NO: 1531 - DNA, 2057 bp, Toxoplasma gondii
ttatgtgtgtcacgctgagtttcgtgcctcaatgcaaatctctggaatccgttcagacgcataattcaagtgccatcgaaggaaaaagcgcactgggcgttccccgcgacgcttgtggtgggggcagagagcgaaacaacgcaaaagaagacaaatcacttcccccaaccggcagcctctgcgggccaagtggattctaacttccacctttgttgtcagtctttttcgcctgctgtatgaaaccatagaaacgaccattggactggaggcagagcctataagggtgtcgaacagagccaagtaaagggaaaggatgaaagaggcgaagaaaaggaggaagggcaggatggaaaagacgaatccaggcaagtagcggcagaatacacacgaaggacggaagcctagaaggaaggagagacagaattcacggaaggaaaggaagaagcaaccagcgaagggaagaagagaataagaaactggcaggaaggaaagagaaatgggaagatatttaggaagaaagggaagagagatgtagccaggacctcgaaaaggataggaagacgcaacaactcccgaatcttcgcgtgaacgaaaacagacgactatgggccaattgtgagttccaactagcgaggaggcggaaaagggaagacggaagaaggctagaagaaagcagagaggcagaacaacgacaagacaggctagagagagaaatcgagaggcagtagacaagccacttttcgctgttctccaccttcagagaatccgtgaaactaccgactgtggagcggaaggcacacacgccctgtcaatgttttctaaagtctccttcgaatgtccgtgatgcggacttctttcgtgcaacgggtcggcgtctccgctgttctgttgtttttcaacatggaaatgagaaagctgttccacactggctatcaaaatgcactgcgaaaaacggttttccgtgaagtcgcgcaccaccgaaaggtgatacacgtaaggctgccttacgtttcgcggtctcgcaccgctggtgttctgatgaatttttctttccagttctgagtggtaggtggggacctatctgtctttcgagacgtcccagttggacgcccggttgacatcttgggggggtctgcgttcgagggaatcgtgctcgactgacgcagcacagctgaattaattattgcagaagtagagcacactgaaaaaagccagagggtcgaggattggaaaaaactcgctcttggcttttctaacagtgcgtgtgcgggcgacgagaactcggctagttttgctccgtgctcggttgagaggaaggaccttgattcgcccctgttctttttgctttgacagaaaacctgcacgaactaaaagagatttccttcattcttcatggcttgtcctcttctaaatgtgtctccatataccgtggtcgaatcgaagtgaaacaatttcctggactcgacttttcgcgcgcgcgtcgattgtccaagccagctcgggatgtcggcagacagcgacgagactgccgccgctcttccgttgcagcttctctctcctctttgtcttgttctctcttctctggtgtctgctcctcttttgcgctcgcgtttgtctccatctcttcctcttcttctgtcgttttccacttgctttctagaccgctctgttccccggctctgtcgctgttttttctctgcgtctaccctgttctctctctcgtccgactttgtgtgggatatgtgcgcagagcgaccgtgcgactccacgacgcaggcagacgggtgaagcaggattcgctcttcgtttccggcttcccttccttcagccgtctgtcgtctgccgttggacttgagctctgaactgcatcaggtgtgtgcgttccacttctcagccaggagcgtttcgccctgtcgaaggtctgcgctgctccgtccagcgacggtgtgtctagcgcaacacaaaaagacgagagcctccacgaattgacaaaagacgaaggcagcgcgaggcactcgatgcagaccccccatgcaacagcgaaaaaaagagaaaaa

SEQ ID NO: 1532 - DNA, 2241 bp, Toxoplasma gondii
cagacttcttttgcacgtgcttcgattgcaggttttcttgacctttggaggcgaaaaaagataactttccttcctcgccagtcactcggggttccttgggtgtagcagatcccagacagtgtttctctcagcgcgtttttcagactccacttttaggctctcgtctcgcttctgaacggtctgcaacgtcgttgctcgctctggtaatagatctctcgttctctcgcaacccaggtggttgtactttttgctctctctgttctctttcggcggaagctagaaacaaagaaaatctgttgttcgttctggacatgaagaagcaattctcttcgaatgtggaagctacgtttaagaagaaagcggagcaatatgaaggccctaagttccagaagcagtgaagacgtctctccctgatgacacagagaggtcggtctttgggactcctgcgtggaaatgcaaaccttcgatttgtcttggcacagcagcaagaagataagctttagatgcccgccttggtattttggggaatttttatcgaagcagaaaaaagctaaacagagcaagtttctgcacatgcatgtagcgacctccctcgctgtgggtgtgcaaatgcatggcatttctatgacctctatgcatcactctagagtaaacaggactgtttccaggctacaaaaacaggctgtcttcagtctacagaaaagcgagttgtcacattttaaacgaaaaggagtcttctaagtattgaagaaagaactgtgttcccaaaaaatttaaagggggtgttctctactctggaataaacagagttgttctttatgctagaatgaacggacatgttcgtcgccggaatacagcaaggcgctcttttcactctgcaccggaaagaacgagtgctgtcaactctggagaaaaaatcggatcgtccttgcagtaagtcgtcttgaagcaagctgtgtgtgacaaaaaccgttcggactgatggacgtctttgtcacttgtcgctttgaagaaaaggggaaagcgaaaagtagaattgcatctctttttaattggagcaggagtccccgacgtgaaaccgaggattccgcagtttttttccagaaagtcggtgatgtttttctgcacacgtgaaagttttgctggaagaattggcaaaaaacgaaacaaaagtgtaagatggagctgcgagtcaagaagaaacagaagaaaaggaaatgaggcgaacctctcgacggaaacacagcctacaaaagcaagtgcttccaaataaagcgaaagaaacagatcagatgcataccctggaccggtgcgatagcacccatgttgaaaagaaagtcctctagttgtgaagctcctgtcctgagagttgcaaaggtagagttccatattagatcaggctgtatgccgaagttcgaaccgaccggtagaacgcgtggtgaaattccagttgctctgtctgactggcattgttttttcttgaacgaaatgaattcctcatttccgtttcccctctcactctcggctagcgcctacgcactgtcgatttccgggtggcagcgacagatcggcagcgtcgtcgacgcaccgcagatcagtcgaattggcgggcgtcttccgcgaagttgctgttcttttctgaagcctcacagaagacaaaccccacgcgaggtttccacgtctctcacttttggtagcccattcaaaaatccgaaaacgcactctcgcactgcgacctgtctccggatagactggagccgctcggcggcttgaaggcgagaaagtcaggcgagttttttccctgtccggagccgcggcaggcgatgcggtccaggaaaggggcaaagtgtttctcggcttcctagctttcacggttctctccgggtcgtccccggcgatctctctctgagacggagacagcaaaggcgagaggccagctccagcctcactatttcttcttcagtctccacgcacatttgtttacgctgtggttgccccgctgactgtttcttttttggagagttttgtgtgcgtctcgtctagttcgaggtccctctttttgtccgtttttctttgtaaaccacgcgcttcccttccataaagacaccacctcttgtttttgtgtctctctcgaccactcgcacttcgtcgtcctcaccgcgcgtcgtttccaaaatccacgaaacagccgctgcacgcgtttcccgtcgtaggttttcttttacggagacacctcgaaaa

SEQ ID NO: 1533 - DNA, 2487 bp, Toxoplasma gondii
gcatttcttttctccctgtcttttcccttggtgctcctcgttttgccgcgactcttcccttcagtttctctccgattttttcggttgcgttccttcttttccttcccgttccctccctgctcttcgctgacgaagagtctagacccacctccaaaggaacttgtgcatacacaggaaaaagttcctctttttcgtgtgtaaactccgataagaagtcctcaacgtctgataactcgaaggagattctcttccgagctgtgaactgagagaagagattctcaaatgtgtgatggatgggagggagcttttccctttcgtctacgttctaagctggggggaggagtctttgaatggctaatggatgcagaggactgctactccctttttttccagttccaagcagagacgaaatctcactctggtggccctcaaactgtgttggaccgctcaagaacgaagcgacacaggggcattaccacggagaatttacacgagagagaaaggagctagaggagcagagagaaagagttcgaaaggaaggaggaatggaggaaaagagagagaaacagacgtagagaaacaagaggagagatgtcgacagaggtggagcgcaagatatctgagaacgtcgtgtgagagactcaaaataagagtcgagcgacgagaggcaggcagagagaagtggagtgtttatttcaaggacgaatgagggggtgtagaggtcaaggaccggagtgaggcgagatcgcagccgatatttcctattgcagacacagactggagtttgtgtgttatccgagttagaaaacagaaaaaacaccgcgttctctcaactttcttctgcttttctgtttccgaagttagcaccagttcttcgtcgcctctacgaagcgagagaggtgcagaaaaaaagacaaagtgtctctgttcgtctctcatcctacagctggttctctgtttctcttctccctcttggctggtagacagcctcctctccaacgcctcttccttttctgcagtacgaagtaaagtgtgtatggcacctcaaactctgtctggaggaagcaaatgagagtgaccctgtttcttctctcgagctcccctctctctgctacgaggctgtcgcctcaggtccttcggcttatctgcgggtggaagtcgcgtgtctcgctgcgtctccgccgcggacgcggaaaccggctcggaggcagcgagcgccagacgcagagacgcgaccgcaccatgccgaggcaagaagagcgagaacggcgagagggcagagaagggaaaatgcagagacgagggaaggagaggagcacaaagaggggaaggcagaaaatgcaggcgcagcagctgagagctgagggagggcaggtcgcctccctgccccggcagcggaagggagggcggttttcgatgcggcgttaagagagagcaggggacagcgagaagagaaaacagaggcgagaaggttttcagaagacgaagaggagagagaagatcgagagagacagagagagagaggtcgtagaggggagaaggaaaccgatatcgagtcgcatgcgtcacacacggaggcaggagtgagagaggtgagggaggcttggggtgttctttcgaaacttaccacctttttgactcgtctcttttgcttttctctgacgtctgcctgtcgtttacaccacttgaaaaccgagacgctcgagaatctggaggcttaactctctgaagctgagaaaggagagcatgagcatgcatgatggagctcggcgcggcgcggagagaagacacttgcgcggttgagaccgaagacgaggaggaggggcgagtggtgggcggcctggggaaaaaactcgcgaaaagcgccgccttgcctttctctctcgtagcgccgtttgtgtgtcgaaaagtctttctctggtgtgtcgcgttgttttttgccgtagattcgctcccttttcccaacttttctcccctcccaggaaacgcgcgagaagcgaacttcttttttcggattctctcttcctctctttttcaccctttctctgcgctccttcttccatctctgtttctcctcctcgcttggccgcgcccagatagttctcgcctgagttttcctgagaaaacctcgggaactctcggcgcacctgctggtccggactttttgagattttcagactggttttcctgccctcgctctgcccccctttgctgcgcgccgctctcgaggtcgacgtagacgctcggaccctccgaaaggcgcgtctctctgagagagtcgtcctgctcttttcttctgtcgtctctcgcttccgcgtccgtccctcccggcctcctctctttccaccacaaacacacacactcacacagccacctacgcatattcgcttgcaggggatctggttttcttttttctccgtagccttttttcgcggagcgtcctcgcgcttcgttccacgcttttgcgtttctccgttgccgccaaga

SEQ ID NO: 1534 - DNA, 1601 bp, Toxoplasma gondii
ggtagaagatatgatttttctcgccctccatttcgaaagcctcgtcgatgtcttccaggaggactccggtgtctctttgattcagaacgaagagtctccagcgactttctctcctctctgcactgggcgcactgggcgccgcgtcgcgctcgacgacatgcagtccaccctgaatgtgggcgcgctcccatttgcgcgtcgcggggcagagggcgtagacgctgacgaaggcggcttggcaaatgatgcgccgaatgcgcgcgtcgtgtctctgcagacaccgcaaagaaatctcgtcgcgcgcgcgcgccacagacgaaggcactggcggtgtgttcgtcgaaggcgacgcgtctccgcgacccatcctggaaagagagagagaaaaaaaagagcagagagagaaaaaaaagagcagacagagagaaggagcaaagaaaaagagaggagagaaagagagagaggagagagagagagaggagaaagagagaggagagagagagagaggagaaagagagaggagagagagaaagactggagagagagaggagagagagaaagacaggagagagagagaagagagagaaaggagaagagagaagagagagaggagagagagagagagagagaaagacaggagagaggagagagaggaagagactgggaggcggagaggactggaagacaaacttgagacgatggtcagagaggaagccgagcggagaagagagtgagggaagaccggtgccgaggcgagagagcgcgagatcgactgagagaaggaagctgagaggtcaggtctgacgacacttgagacaagagacggttcaggtagaaaacgcgaaggagaggacagagcgcttgacaggaagagccgcgcgacggcttcgacgcagaagaaaagccactgaagagacaaaggccgcggcgacaaagagacagagaggaaaaggagaggctcgcggagcgccttcctctgagcgcatgcaggggaaggctcaacaggcatgaaccgacgacaagtggatgaccgcagcaacgcgctgaaaacgcgagagaagaccgaagggaagcctcactggctgggagctcggaaaccgggagaatcctcttccgtcttctccttgcgaggcgtcgacagcaggagagaaggctgggcctctctgcacgaaactcgctgaggagagagaagacgcggcaggagcagcgaccatgagagaaatcccgtttttgagaggccgacagggacgcagcctcgggcgtcctaacctggccgcggcgtcgagagggcgctcctgggcttttcagagtctcgaaagatatcgcgaacaaagaggcgacggtttcttttcttcagaggaacgcgtttctcggctgcagagagagcctgcgcggcgcgcgcggcgtgtctgtgcatgcagagagtgactcggaaaattcctcgaactcgggtgcgggagacaccgggcctagaggcgtggaaactcgcgcggagaacgaatttcttagtcacaaaaaaaagagctagagcagagcagagaaacagctcgcctgaagagaacagagtggaaggactcagacgcaaccgactgcactgctca

SEQ ID NO: 1535 - DNA, 1980 bp, Toxoplasma gondii
acagcgtctatcatctcactgtcttcgtcttcatctgttgactcctgtattgcatccgaagagccgcgccttcgagccttcccatcggcctgtcgggcacgactcgagaaagcagatcgaagtggtttctctggctcagcgtctccgttctctcgacacctcttcctttcatagcatgaggaagctttaccgttcgtctctgaagaacgatttttttcttcaccacgcttctcggtggaacaactagacggcggaacttgccgcacgcggccctttcgccaggtccacttctccctgcacaaaggacactgaatgactccagtgtctgtacactcgaagcccgctcgagcgagcagaaagggagaaagcgaaggcgggggggcaagccacttttgtgttcccgagaaaaacgactgaagcagctccttgtactccgcagctgggcccctacccccgagcgcctccagatttgcatccgccggccgaaaaacggtactgactggtgaaacgaaagacgagccccccatcatctaattggacagcgaaaggaatatagggtacttgacaacagttacaagggaacacgtcgcaagaaggggtctggtggtaagcggccccctctgctcagacgaaaaggagacgcaacggctccgaagcacccagtctgatcggcaggccccttctgcctagttactatatccgctaccgtaccataaggaagggggagacactttctgaaaaaaccacaccgacacaagaatgcaacgaaagtttctagtgttcgcgatgaacttgatgtagttgctggttcaggaaaggcccgtacctctgaaatagggaaaaggcatacgccttggatctccacatacatatctcttctcatacacgcgagtttttcgggagaatatcgcgagacatacccaacaggtcacacaagggcttcttagggttttcagctgtgccagttactagcgtcggtcaatgtagaagccagagaggggagtcaggaatgacgaatttcattgcaagaccgacacgtactaccagaactctttttcgctgttctgccgagccccaaagaataacaagtcagatgcaaacagagcgtcgtgctaccgctgcaagagcggctactgcacatggaaatacgtacacgtgcatatacgcagcatcttgtctgcagaccgtacacttttcttttaatgcagatgagttaccaagtgcagcgataggggatcccctttccgtctgggacggtcattctccttcttaaaaaaaacgtctttaaagatgcccggcgacaccaacgaagtgggtgcaaaaatgctggcatgtgttgggggtcacgccgcagtcccttgctgaaaagcggccgtgttgttttcctcttgcatgcgtttgagcgactggaattggggggcttttcctgtccacagacggctaaaatggaaaccgtttttgttcgtttgaaagacgtcctgacctttcgcgtatatgacacgcctttttgggaaggtcttttaggaggtccgaagaaacttgccctacacggccgccggcgctcaggtagtgctctcgtgtgtctcctctcccaggaccgactttcgtctttggcctgacgcgtttctcttctgcacgttgttggtccgtgttcgtgcccctctccccactggagttctttttcctaagaagaaacgagctttgcccctgccccgtagttctttgtcgttgtggcgaaagtgtcgttttccagagggttcagcgccgctctgcacagccgttgccttctgcttttttttcgactacttgcctccaccacgtttgccatcgtctctgacacagttctccttttcgccgactccatctttcaagttccccctccagcgtcgtacccccgtcgctcgcggacgaagtcccgttgctcgactaacgctttccgtccgtcgcgtcccttcctctcttctcttcatttgaagaaaa

SEQ ID NO: 1536 - DNA, 4282 bp, Toxoplasma gondii
tgccttttcgtgggagggagactcgtcagtcagtggtcgttctctttgtgtcagctcgaaaaacggttcgcgcgcccagcggaaaacagcgaaaagctcaggcagcgacggcgttggccgtaggcgacttctccatcaaagctgcctccttgtccttcttgatttgctccgcaaactcgggcgtcttggtgcagacaatggtaatcttggggaccatcttgagtgcagtgcgggtggacgagaaataagacgtctcgacttttgtgatggttgccgaattgtcccgctgaagaagcgacgcggcaccaattgcggtctttgtcgccatgcccagacctgtttcacaagagagaagcggcgcaaaaatttgaagtcagagcctgcgctacgactgcactacaaacagcttgccagaacactccccactttcacaaccaccaaactggataaaactccggacgcaacacgagatcgtaccaaccaccccagcccgctgaactcctttctgcgcccaccagatttcacatccagccattctcatccccatagcacttccgaaaagcagaaaaatccacagtacgttcgcctgatccgcgaaaatcgtttgtacacacaaccactgccccaccgtggtctgcccaaagaatcataacctcaccaacaggtggataatgcagtacagggactccgcttcagcgaatgagaaacacagtcacgtcttcattcttttacacacatgatcacaaacttcttcgtctgtgtccggcattcacacgtgagtgcagtggaaatttcagcgcagatccgacttcccgcctaaccacatacattgcagatatttggacgtaagaatacgacctgcaaaagcacagttgttgccactacgttacagaccccctttcacctttaacacgagtatacgagtactttggcggtcgttaacgggggctcagacccgacactattcgtggcttgcttccaccaggatcccatttaccacaccgaaaaccgcagtctcagccacaacagggaaaagacacttgaataacgcacctgtgatgatgacttcatcgcaagcgggcttgtcgtcacggccgacaagcattctcttgccgatgcgggcatagaagcctgggatcttatccatggaaacctgtgaaacgcaatgcacaacaccgtcacatccgagtgagtccgattcgtggcttccatcgtgaaacgcatgcagcacgcgaggcacgagtgaaaggatctgccactcgtgcgaatctctgccactgcttcgaccggtaagcagcacattcgacatgtttgttaccggccgcatcccagtgacccacggtgcgctacggaacacttgctcgctatggcggaagtgcggcacaaaaaaaatctgtggcccttgtccaacagctccacaacagaccgtcgctatcatttgggaagaaatcttttccgggatgctttccatcccaaggaaaacaggagacgaaccccacccttgcgcaggtgtcggtgcgtctgcggtttgagcgaccggccacgcgacgccttgcagcgcagatcacgaaatcggattggttttcaggacacaaaacgccccttccttggtaagaacagtttacacgtttgaaaaggcacgaagaaagagcaagtgcacatttgagtggggggagcagcggccctgcctgctgggtccgcctgcacgcgttgtctacggtaggagcgctcgggcgtccggttgcaggaaggcactccaatctttgtcgcagtacggagtggaaaactcaccagaatcgagttatcagggcgcgcactgcctgcagccgcgtctccttccgttgagttcgcagcttgcgaggtggcattgggagccggggcggcggcgacgtctgccattgtgttgggaaagtcaggaaagttttgagggaatccacaagaacggtttcgagagacacaaatgtttcaaggaatcagagtgatttgtgcagccgattctctgcaaaaatgtccaaacctagggggatgccacacaggagttcacaatcggcgctatccccttttgaaccaggctttttggagcaatccagcgaggcacgcaacatgcatgaacgcgtgacccgcacagtgcgcttctacgcttattcgtccaggtccgccccgaacgacctggaatcccttgagtacacaaaactctccacgctactgcatattctatgaatgcgcgtaccagaaggctcactttttgctctattcagcgtgaccagaactttttccgagtgacccgcagatgccgtgaaaccttcatcaaataacccgatacaaaccccaccgttctttgacgagaactcccccctgtatcacaccccttgcggtgcatgcctgaaccgcctttcctgccagctgctgtcaggttcgagtccaaaggtagaaaactccattccacactgaaacttacttgcctttcctgatgcctccccagcacatcacagtcccccttggaccgcctcacgcaacacccccgacagtggtctcgcacttcactctcgtctcaacttttctttgccacgttttggattccccgatattgaaaaaaaggcggttcgttcgctgagagtccaccctagtcaggtctaacgtgacagagaaatcgagagttctggtattgcttctctgcatcttccgtctgctcggaaagcgcgggtttcgcttgccgcggggaacgcttatgtgttcttgcttttgaggacttcacacgagtcacacacagggatacttatatacaatcacgctcttttctaggaaaccccgtaagatttggcgaagcacgtcaactctgacagaatcaaagctggaaaaccatgcggggccttgcagcaggaagcccgttcgattggtcattcgataggctacgcaggcgccggcttcgcgctccgagggcgccctgtcttgaagactgaagactcttcctcgggtaaatcagtcattaaagtgaaagagagctgcagcagaagagctgtcggatatttgctagagtgtgcgcagcaaatgaaactctgttttcatggcataaccgtgtgacgatagagagctgggtcgagtctcaatggcaagggctatccagtaaaagtcgaggttatctgtgaacattttcctctctaatgtatatccaacgaaacagtctgggattgaacgcctgaaaacgctatagttcgcagattttgacatcatacgaccattcattgaattctcaaacctgcttgggcttcccctgaaggcgttactgcgcgctgctaccctcgagtgcgctgccagacagccgcagtgttgcgccctacgtcgacttcttggggctttctcggcgaacttgtcgacacgggggtgaacaggacagtagaaaatctccttccgcaaacattggtggctttagtccagagacgttggtttctcttacgatgcctccccagacacatgctgcaacggctgtcgatcttctgcgcacgcgctcctcgcgtggtaaacatagccgccgtcgttcgcatctgcaacactacatctttctagtttttttcgcgctgtgtgcaaatgagtaggcgtctgtttgtgcatgtgtgacgatctcctcgtggaaacgaagttgagtctctctggggcattttccaagagggtgtgcacgcgtacagtattgtgcagttgcggttctctgcggtcctcggccacacggcggaaagaaggcttccgaggtcggcacacaaaaagtccagcttggtaaaaaaacgaatggcacggcagaaagcggcagaagaagtggagaaagttcaaagtttccacatttcaaagctggttttctctgtgttcatccggcagacaaccttccccaagcgatcgaggcgtcggtcgccggcggcgcgagccccacgctggcgtggcatagttcttcccctaagtcgagcacgaagaagaagagagacgaaatttgaagttgaatgagcaaggaaaaactgtatctctcctcccttggcggatttcttgttgccagaaaccggagcgcgtgcctgcatgcgttccgtgcggttttctctcgctctcatcgtctgcagcggcaggccgacggagggaaaggaacggatgatatccatctcctcgtcctcggcctccctaaatgcctgaggagagcctttttctcttcaccttcgtttcagactctgagcaaacatcgcggaacgagtatcgcagcggtgtggctttgccggtttcactttccagttgctctctaccacga

SEQ ID NO: 1537 - DNA, 1604 bp, Toxoplasma gondii
tattcctccacctttccaccgctcttcgaatcgagaactacaatttgtgtatgtgtgtatacatgtgattgtacatatatatatatatatatatatatatatatatggttctgttcatttctgcgcatgtgaccgtaagcgtatactttgtgtagataacaggattatccacgcgtcacggaaaaaccacgcagtgagaacggtaaggtgctgcatatccgtgcaggtgaaagcatttctgtctctttgccagtttgactttttgcttcggttccagagagaaggaagtgtctctacagaagcctttcttagattcttctctggcgcccgggcctccctcatcttcgtggcttcctcctgcttgtccagtcgggaggaaacatcgtcgaatcatctttcttccttctaaaacgtttgatttttctctcaaccttcgttttgtgtcgaaatcgttggttctccactaaaccgtttgttttctctaaacgtattgttccctccagaacgttcgtttctctctctagactttttttctcacaaccttccacgtcttctgaaccagctgctttctctcaagctgtggtcttgtctctgcctgactctgcagctcgcaaatcgatctacgccgatcgtctgtcgatctttcctgaattcgcagcgaagccggcgcgctgatgtgcggcaggtgctgttcgagaaaacgaggcaaacgacaagcggtagtgttctgtttatttccttgatttcccggtttctccactcgatcttcaacttcggtgaatttcaggggcgtgtgacgaaactcggatttcctacgctccttaacatctccgcaattctccctcccaccggcagaagtgatgctgcctgggaagttgtgcttttaaccgagttcggtcctcacaagcgaagcgttatggtccggtagtcacttgcatcagagaggagatggtctgccatgtaagaggcatgttgctggtggagaaaaaggcactgcctataactaccgaggagactcgacacggtctcaggtgtcttgcgagcacgggacaggcttttctgcagatcacctttttggtgcgctgctgtctccggaagacgttttccttttccacattcgtgccagccaccagtttccgactgtcgttgctttggctctcagtgcgtttcgtcttgtcctccttcgcgtttcgttccttcgatcttcctctccccccacctcgctgtccctgtgtcgcttccttctctctgtgtctcctcccgtctcgtttgtgtgtgcgtctcttctctttctccaggtgtctcctttctccttgcttttccgttgtctcgctctcggctgtgtctgtctcctttgctttccttcgttttcttgcgtccgacccctcacaaactctgccggtgtctgtcgaagttctgccgcctgtttcctctctgcgtgtctcatggttccctttctcgacagctgctcttgaatgcaagacgctgacacacgtcgacctttctgcctttccctttcctgactcgctgattcctcccgcatctgctctttttttctgccactttctcaagtcctttttgcgcgggcgcaattccttccaaga

SEQ ID NO: 1538 - DNA, 3277 bp, Toxoplasma gondii
actggagaaggaatgaagaaggcaacacacaaggcgaacagttgtgtcaaagcgccttacctgagcagctccgaaccatccgcgactttgcacagagtgttgctgacggcatccagcgcctgcacggcgcgccgggcttctttccacgaagaagaaacatctgaggcatcccctgaagaagcagaagaaggacaagacgacggggaggaaagcttcccttcttcacgactgcctgaagaagacgaggtgggtgcaccgccagtggcgaggaaggcctcgcagtccgcgaccgcttggcgtccaaggcggacgagctgctcaggtgtatgtacacctgggagttgcaggagtccaggcctgagttcgtcgctgcctgcagcgcgacttccgcgagagctgatctgcgtgagcccagagagaaacgagaagagccccggtttccgaggaggcgagggtgtgggaaatgtcgaggagaaacacggaggtgaagaacagaggccatgcggttgcctgcgccactccgactggcctgagtgcgagaggcgcgaaagagaagcaaatggacgtcggagggtcctcctttcaagcgtcgaagatgcgggagggacccggtggaaagtcagagaagaggaatgcgatgaacgcgttccagaggagttgttgcggcagagagatcgaggaaggaaaaaaaccggcggcgaggagacagaggctgaaagcgaattccgcggtggcaggctccgacgagagcgcatcaccaagacagaagggagcgagtcagacctttgatggtgggcacgaccacctgctgcctggactccccgcagaagcaatccggagcgtgcatgcatgttgttgtactgagaagagaattcgatgtaggtgtagggaaattttgaagacgcggtttccagtcgcaggtgaaagacacagacggttcacgagatctgttgcgcggaaggaggttgcgttttttctgacaaacggcaatgccgtttttttctcgggaacgctgaagtttgtgatgagccctctctggaaaaaaatggcacacgacgaggaatcgttgaagagcagcttctcccgagggtgagagacccagagaaaagccgagagaaacgcagcagaaagggacagttggcgtggcgaacctgagggcaaatcgagctacgggaagacaggacgtcccagaaaaaaggtcctgagaacgtcgctgcgttgatgatcagggaaatgcttcacacgccaacgatgttgccgcataacgctacgctctccttctgcaagcgttcgcctctgtggtgcgatctcagaggcgacagtaagccgcatctgaaagacaaaagctcgaaaaatccctttcaatcattttccaggaaagacgcttgctgcggtcaagctctacatgccggtgtaggtgtacattggagagggggaagcgcatgaaaacacccagtatgtcggaagaagcgagttaccatcgatcgcgagtgcttttaaaagaagctgagaagaagaagcagcggaaaaaggaaagccggaaaagcttcagcttgaaagcccaaaatcggccgtggtggctcgacgaatgttcccccacttggaaactcgagtgtacatacacgcggcggccgaggccacagatgaccttggagcggagaaaagctgaactctccttgttttcctgcgacgtttgatgctccccttctaagcactctgccagtttgaacgagaggagatccagatgtgtgagagagaccacttgcatcctccgtgtttttctcaggtcgcatccttctgtgcgactttgctcacatgatcccctctctttgccttggagtcaaggaaacgaactttttcaagcagtttagcggcgctttcccgctttctgtcaagcccgtactgaccggaagcgcgtttgctttcccgtgtcaaattaaagtgcaggaacttcagttttcacgctgtcttcgcgcggctcgtgtgcctgccgtgactctatctggacacgaagcaggctgtctgtgtgtgggtattgttcaggtcggtgagttccggtttcttcctgatttttggggtgtaaagtcggcaaaaggtgaagaaacacagtcgccttctttctagcgtttgtgtacgaccgattcggccgagaaagtgtcgcgaagtttgcttccttctcccgctgtgagtcgcagacacgccggcgacgtccgcgacccaccgcaactcttttcgctgtctccttggcgaccgcgacttcaggttctggggatcttctccagttgcagtagcccatctccttgtgtctcagtgacggaggcaaagcagaactcgatttttttcgtcggatcacgcagagaagttggggaaaattgactgtccctcctgagagcgtgcacactgctgctgcaatctgccttcgctagctccgcgagacgctctggtggatactgtgttccactttgttgaatgtctttgaggccttttctctccacgaaacttgcaacattctgcaggcttcggacagctgaagcgaccgaaggtgacaactacgtatcagggagttgacgacgcactgggaagccgtccggactgtctgcaatgcgatagaggcgctttcgagagtttctttggttcgctgcttctccttctcgttgatctttttcagagacgagtggaaacattcagccaagtggcctgactctcctgagttcccaatcgcgctcagcagggtctttcacacctgcatctgtcgtgtctgaagtctttcggaaccgcgcgcgcctcacgtcagtcgagtgactctcagctttttgcttcctcaacttcacaacttccgcgtctctcccgatctttgacagttttgtcgcagacacacagtcgggtgcaactcattctccgcttctttcttctctgcgtcttttctcggaatcccacttgcacacggcgtacagacacacgagcagcggtggcgcctctcgtgtgtctgtctcccccagtgacttcttgtctgttctcgccgttgctgtcgccggaaaacgcgcaaacgaaggggagtgcagggtgactgaaagactaaaaataagcttaaataaaagtgccactgcctccacgttgtgtgtgggcagcatcgcagaaagcctgtggacagaggagttctccgagaaaaacgcaaggcgtcgaagaaagaagacattttcgccaatcgcgttgtccgtcaacgtgaacaccgaagaaggcagcgcttggccattcgaggtgaaggcttcagacacca

SEQ ID NO: 1539 - DNA, 4044 bp, Toxoplasma gondii
gagcacaccgttcagactagaaagcagaaggacgatggcagtgcacttcacgaagcgtggacagaagtggaatgggaggcggcaacgcatgcgctcgatggagcagagaagaggcccattttaaaccagcccatcccaacggaaacgaggggcaacgcaggttcgtaacctcacacgaacagcagatggctgcgggaatgcaatccgtcaagtgcatcagaagtgcggttgctctggctattgcacttgcagttcgtgctgcgtgtacacagaagaccgtctggctcgaaaccgctgtcgtggaggaagaacgcaacacggagtattttccttcaataaggaatcccgcgtggttaaaaggaaagagacatcgaaggactccgtcgagcacctcttcgaagacggttcaaaacggacctgaaagtgatcgcttttccactacgcaagtgccaatgtggaaccgtccaaaaccgtgttccgttttgttgcctttctaagcggtcgagaaactcgagagtcaggagtagcacatgcaggcgaaggacgagaaagggtcgacgaagaaaatcggtggcggagttgagcacaaaacaacggcgaaacggtgaaaaatgagcagcaggtgtcgggaatgcgggacggtgcaaacgcgtttagctccaaaaatagaaagtcgcaaacaagaagaggaagcggctttccctcagaaagcacgaacgaagtaggtagcagagtctcgcggaacggaaaaaagctggaacgtctgattgatagaagcagcaaaagattcgatgcctccgtctacgaaaacgtccatcctctccagttgctgaatgccgcttcagtcactcctcgtcacccacggtgtgtttccactcgcagcgggaaaaaggaggcctgtaagtagcacaggatctcggaaggttcacaaaaaacagcttcggtatggatcgtgttttgctccagggtgaccagcactcggagcacgcaaaacagtttggtgagagtgaacaggttccgaaattgccgctgtttgttgtctatgagaaaagaaaagcgagttggtgtacaggctcgaccgccgccggccttcgcgacaaaaagaccttctttacacaacaaccgaaaagaactgcggacgagtgtgcaagaaggaatcaggaaaagcccacaaacttccgcggcttttctcttcactgcaaagtgcaacccttgaacagcaagcgaccggaggggagacgtctctgctctctcccctctctcgtccccccactgtcacaacttctccgaaacgggggggaggggggaggagggccgcctctcctgctctgcagatttgacaaaaaagtggggtgataccagttgtagtgtggtgggcggggtggtatgccctcgtccatggcctgtggcggctttttgcctgcaggttctgtgcttccctgcagttgtacatagaaggaatgttgaagtctcggactgccgttcgagcgcgttgtttcgttcgattttctacgctatagcttacaatacattttatttttatgatcccaagccggtttaataagacgaagtgtttgcgtgaaagcttcgggacgccagatgaagagcggaagaccgcagatttagaggaagaggcgtaatgagcacaaaaattctttgttctcgggaccggtgtcagcggtatgggtttggtctaaatagtcgcggggtgcagttgtgcaatgtgccccaggcggcttccaagccaaagaagttctcacgtgcagcttacgcccgagatcgttggtagggaagtttttctcccttaactggtcaaacgtgtcgcactttcagtcttttatgcggtgtgttcccctgattttcgctgtaactctgttggcggcaggcgtgttgctacgtttccgtaggtgagttaaagttgttagtgtaggggtcttgctggtgtgccgcaagaaatttcacaggatgaaacgtctcctttgagacctctcgtttggttccggtacacgtacacagattcgactggagatgtactgctctcgggcacacgacagtgcatttgacggggcagtggactgtcctccgatggtcgtatcacaaccactgcaaatttgtgcttgtggccctcaacaaatgacagaaacgaagcctcggtcgcgaagtgcgcagcgccactgttccagaattataatcacgcacagtgctatcttcagcgtgccgcttcttgaaagtcctgtctctgcatgacaggaacaggcagcttctcactcactccagtcctttcaccggttagatacaagtacaggaaagggtttgtctgtacgcacccaaacgaccgatcgcgcacttgcgcgttctgttcgtatgtacctacgtgcttcgagctcgatgagagagagcccgcggacaccatagaacgcacatctccacaggacacgtgttgttcgcgcaaccgctaccacgttcagtctcgcctgacgttttgtcgcacttgtggcttctcttgtgataatactctcatccaactctcccttggaacgcattcctactgtttacgaactccgggggcctgtataccccgcgacacaagtgcacataagccttttgatatggctacgtaaatggtgcgtaggaatgaagcctgtgttttctggggccagctaatattactgccctgacagtaccactatgcggagcggcacagcacacggattggtttaaagaagtgcccgacgagacattggtgcatttaccatctgaagtggccacgcacacactgcaaactgatgaaatctgagtcttttaacaggggtaacttcctaaataggttacaggcgacacacgtaccttagtgtgttcctatgaacgctttattatgtgtgaaaattctcggccaaagcttgataatcatgatcagctgtttcagtcatccgcttcactcgggttagtgttcaccggcttacactcaacatgtcaatgctagtccacaatcgcgctctcgcacacgtcttcgtcgccttgcaagttctcggagcaaatgcgggcaggtgcgccgtgctccatcttgcttccgctcgttctaaacttgctatggggaaaaaaccggcagacctcctgtgccagatatcaagcaagatcgataagctctccacttcatcgtagaaacatttctcgacaagcggcctcttaattattatcggcgggcaggagtgggggaataatggggttctgctgtctcgcgttcactggccgagtacacagtacgcttctgcctgtttcgcgacggcctcactttccctcgctcgtttattcatgccactgattctcagcgcagctctctgtaagcggatgccccgtgtccgttgttcagaatagctcactttagcaatcttgtggatcaaatcagtcgtatgtggtccaccttcacctagtggaaatcattctttggaatggtattattgtttgcccttttgtggaatcgggtgtgagatcagagacgagtctcattgtctcccactctctcaacgtgtgagagagacacaaggcaggcgaggggttctcttcttacagaaactatcgcgtatccaagctgtgctctgtagcagcattagtaaatgaaatgcccctgcccatcttgttgtgattgtgagaattggggactctttcattcacggaagatccgtactttaagaaccaaagaccacaggccgtgggcaaagcgcaagcccacagcgctgagtttcgtaactaagcgccgaggctactaactaggcgtcgaagctcgtacttatgccaggcgggcgcggctgacagagtagctgacctgccatcgtatttagaatgagagtgtctcggtcacaattgtcattttagtgagaacagctcaacacactgtttcgtcaccgatcccttctctcggatacctgagcgtacccgaacccgcggccgggttccgccacttgttcttgcttacggattatgggacagccgctaagtcacccactggtcgatctggcgatgtttcttgtgcttacaaagggaaga

SEQ ID NO: 1540 - DNA, 769 bp, Toxoplasma gondii
tcgtagaatctctgttacaccaggagacagcagtcggtgtatttcaactctcgccttgtgcgcggactcgtacccacaccgcgcgtcgggtttgtgccctctctgtgtcctggaaactgcgagttttggaaaagtcgcagtcaacacatttgagtctggaacctgagcggacaagaagatacacatcggtgtaaatgcaaagagcgaaaaatacacacaaacaccatcgtacctgggagagtgcgtaagagtttagtgacaccagcaagccatatatgtcgcctcgaacacagcagacgtaaagaaccttgatggcgtttgaggacgtcgacatacgccgctttctgtcgtctgggtgagcagtccagagagtcgtggcggtgcacagcagtcaagaacagcttggtcgccggacctcataactgggtgggctcttgaactctgaattcatctcaaagacttggcgtcttacttgcaacggccttcgtctccagacactcttccaggaatcgctctagcgagaggcatacttcagaaagaccttgcgcattgttgcgggcgttccacatcgaatcagagaagcagcagccggacgataagttaagatgctgcctgctgtatcacgtggttctttactcagggcaggactcctcagaaccttttctggggactctacactacgagctggactgccgcttcaggttgacactgcccaagtcgagccgcgaagttcgagtctgccaagtcgagccacgagtctcaacttgga

SEQ ID NO: 1541 - DNA, 2421 bp, Toxoplasma gondii
cagaacgcgagaaaggagacttcgcttctcgttgagggccattgagtcttctgcttccccgtcgcctccacctttctgctccggccatctgcagtctctcgcctctgttccttccttcttctctgcggagacatccccagagaccggcgcgccggttgcagactcatgcgcagaggccctcgagctcatggaccgcatgcgctgacgctgttgaaaagaactgaaaagtcgccacggccctctgtgggtttctgcagagcagtcacctgaggcgtttgcgccgaagatcctgaccgagacgagaggggagaaaaacgtcggaggagtcacctgtctgtgaagagaagaaaaggagagcgccctggctatcaccgcccccgcccggtccgacaggcgaaacgacggcaactgcggcgagcccaggactctcattctgaagcgagagaaggcagtcgagcttcagctgttgcgaagaaggaaccggtcccacggactcgaagttctaacgcttgacttcgttgaaaaactcagtccagcccagttctcctttgctggcttctcgcgcaggcaagtggagggatgagcctgtgtctgtttgcgctgatgaagaacagcgaaaggtgaagcgagcagcggcgatgagtggacagctgcggtcctcgcacggaacataaaaaggaagtatcgaccgtcgggcgccctcttgctcgccagaaaggaagagatctgcagtcggcgccgggtctcgagctctggttcttcacgtcgtattgtgttgacgtctggaagagctgcggaggtctctgagtgtcttggaacaccgtagctttggaatcgaaactgctctgaagcgaagttcagctcgcgtttcagcggcgcggaccgttgtctccaggtgatcgtcggcggtttcggtcgcgagcagagagaggcgaaaacgcctgcttttgtgcgcagacagagacagagtcacggcgcttgtctcgcagacagcgaggagtcggaaaaccaagggaaaagatgtgggcattctcaaagccaccaaccggcggccagcttccccaaaccttctttggctctgcacagacggtcgcacttcggactcctcatgcgggacgccagcgcaactcacgaaactcgatcctttctttcaccgcagcacgagcactcgtgggtcaaggaaaccacgacgcgacgacgcatgcctgtcaaggaatctcaaaaagctaacacaccgcgcggttcgtacagaaaaaagccgccatgatttcccgtcaacaagtcccgaagcgtcacacacacacacatatatatatatatatatacatagggggcagcgtcttaatggtaacggagtgaaagactgcgaagttgacatatctgtctctcctcgatttgcctccacagtgccggctcgcagtttctcttgacctcaatctcgagcagggtgatcggtctcgaggtcgcgagagaacgctgcagaattctgagggaatttacggttcgcagttcgcggacgtctctctgacggggacagacaaatcggcgagattcgatgcacgcggaaaacgcaagaaagctgtgttgcggacctcacgccgcaccgcagagccttgtgagcgccgagaaagtcgccagcaacgagagctgcgtcgctcccccgcgaaagctgagaaaagcgagcctcagacaagacagcgtcacaagagccgaaaaccgctgcgacttttgcgccctccgacacctcgacgacgagcatctgaggttgacttcttgccgacgcgccgtggaaaaaagacgtcgagagcagcagtgcagggtcacactccgctgaagcgttccacggctcatttgtgaagagatgtgtgcatttcgagtccgcagggaatgttgaaacggcgcaaatctgcacagcgcgcggtctcatgaatcggcgcatgcgtcgatcactgggcttctctttcgatccgagttgttcccaagtctcgggacgtctgaggaagcaaacctttccccccctcaagtcttgatttcgaactgtcaaacatgcgtcaaagactgggagacgggagggatttcgagcagagccacccccagtgacgcaaaaatcgacactcttggccgggtcagcagcgcgcgcggagaacgcccgcgtttctcgggagtacatacaccccagtttctgccgcgaaagctgcctgctcagaacctgcgcaaaaccgtgagcgttctctctcgacagcggatgttcctgcgccgcccgtccgagacactgctctgcttttgccgcctcaagaatgcgccgtctcccccatcacgtgtagcgatttcttgaaccttcagttcttacgcctttctcagtggcctgagtctcgtctttcttcctcgtttccgtacgagctctcgctgcgttgccgcaaa

SEQ ID NO: 1542 - DNA, 3563 bp, Toxoplasma gondii
attgcttcgcgcgtcgtttgtatcgttttcgatgcggtcgatcacgtcgcacatcgcctgcacaaccttttcagtctcttcctgttcccgtttggttgcttctgcggccgttgcgtggacgttctgcagatcgatgacgcgtttcgtcgtgatgtctttcagagtggtggctttgtcaattgcgctgttcagctcgtcgatcacactgagcatcacctgcgtttccttctccaattgctccaacgcctcgcgtttcccctgttcgccgcgaggtcttccaccggctcccacagtccctctttgcgtatcgacgtcacctacgagactcgccacctccaccgaggccaagtgcacctcctcttggagcgcggcgcgctcggcttccaagcgttttatctcctcgttggtctccttgatttgcgccacaatcgccgcgatcttcgcgcgccggtcctcggcttcgcgtcctgccgcctccagcacagcggccttgtcttcgacgacgccttcactggtctctttcagttgcttgagcatgactcgcgcagtggccgcccgctccgattcgctcttcagggcctcgcgttccatctcgagcttcgcctcgagtttcgtcacatgttgctgcaattgattcacgacgttttccgcctcttgtgcggcctgctcccgctcccagatctggcgcctgaccaccccgaacctgcctgtcacagcgttgacttcggccttgagcacgcgcgtcgtgagctgcccggcaccgaagataacgcctgcaaacatcagcattttccccagggacatcagcatcccccccgcaggcaagtttgacaccgacgccttcagtttggcgaccattgtgccgacgagcccgttcacgaactccacactcggcagcgtcggctcgtccgcagcaggtcccggcctctcactcatcaaccactcgaagaatttccggagcgattctgttggcttccacgaggacgcgacgacacccagctgctcgagcgcccgactctcgatttcagtcgcgtctcgatcaacgttctctgacttcaacagatgcgggaagaggtccgcgaaacgcagcggcccacccgccgacgaacgcgccgctccgctctgcggcgccccgagaaacgggaggtgaccgctgtacacagccaaactcacgactgtggcggcaaagaacgccgacaagacgtaatggtcacgagcgagtttcgttgcgcgccggacgacgtctgctgggattttataggaactcgctatttctgctttcgcgtccgagtcttccagcgcatcgtcagacacctggactacgtcgcttgtggatgtcgaggcctccggcacctggtctgtcaccactgcgagggtgacgccgctgtcgccgacaaagttggcgatgcgctttcgattctgaactaacaggtacgaaaccacagagaggagaaccatgaaaaacacagtcgtccccacccgggagcgcggagacgccgtagaacctgtcgcctctgtgctgcttcgtcttctgagctcccgtcgccgtctcgccaacgtagtcggtctcgggaactcaacgttgtcctcctccacggctcctctcctccgccctccgtctctgcgcgaaatcgccatttgctgggccttcactgactctgcgtaggttcactctcgcgttgcagccggcagcctccagcgtcagggtacgacagcagcgaaactgttcggatcgagagacgtttcttgtagcagagatcgccgtaccgcagccaagaaggtgccctctgcctgtaaacaacaatccgaggctcttggagttgaacgcatgcggacgaaagaaaatacaggtcagtctgtggtggctcggggatggagagaaccgtgcggcgacaggaaggacgaccaaaaaagtgcagcgcggggaaattgggcgcagcgagaattcgcgacagaaagaaagtgcagcagtgacttgcgcgttcaaaaggacggaaagcgctgcgtcctctgttggtcagaggaggaactcggacttctgctgtactcgctgtacgagccgacttgtatcagacgcggtaaagttgtggagaaggagaaaaaagcgaggtaggaatgcatcgaaaaggcagggcgagaccaagaagcgagaaaacttggctgctctctcagctacgcacgaccatgcaacgaaacgttgagatacaccaacgagagcgaattgggtctccacctttatcagttttctgacaacatagatcgacaagcggattcgaccattgtcgttgtcttcaagcgctctatttaaaagtcgtgtaacttgtacgaagaagcgtcacctcagaagcgtggactctcgccagacgcaagaaaagctcccgagtttgaccgcgacagagaacgcttgctaaacggggttgggcagacgggagacagtccccggaaaatttattggcaccagatgggcaacttgagctcttcaactccccttttctgtgtcaggcactggtcctaagaagagcctcaagtcgtccgggcgtcgatacggcaaccgtagctacgcatatagcagcgagcgcgcgcgctctgtagaaaaacgctggaaaaaagacggcggcgtattaggcccaaagtgcagataaacaagctctcaaaacaagaaggaaaacccagataacaaccacagtcggcttgtcaattggtttagcaaaaacattccctacaacacatggcgcagtccgtttttctggttttgtctctcggcttcgtttcgtctgcaaacgcggcaaggagacaggcgagagcagcccacagagatatttgcatgcaggcctttcgactgccgtggaagcatgcgtaggaaaaaaggatttcttctgcagtttcgcagctccgttacctacgaatcgaaagagactggcgaaccttatcgctggccacaaatacattcacagcgctgcaaaggaaacctgacgaactttggccgacgccaagagaaaaagccaagtcggttttgtgactttcgcgcgaggctcgtcgagtccgaggcaggcaccacgttcatcttcagctcgaggcggaaatccgccgttgccaagaggcgaataacttgcaagccaaagaatcgtttatagtcttcttctgtccttgctgcagaagtcctcgcgagatcgctctctctctcttgtcgagactcgcgctgccagcattcccagtccaagcgtctcgccacgagtcgcgcaggcgacacagtcttcgtcgtcgtccccgtccgtttcgtcctttcggatcaaaagaaaggatttctcctcctcttctcttttccgtctcgcgtttcctccctgcgcgccgtagcgtcttctttttctctacacctctttccgtcgcgcgaaaccacggtcgctgcatctttgctcaacgagcactcccgtgcactggccatcttgtcgcgacgactgcttcgcctcttttggtttccccctctcctctacgcgttccaccgacgttgttcccctgccgaccttttccttttccgcgaagacctcttgtgcagtcgactgaaa

SEQ ID NO: 1543 - DNA, 1922 bp, Toxoplasma gondii
cgacagttggttgaggagggagagagcgtggactttcttgtccatctcggccagggcgaagcgcacaagttgcaggtctctcttcgtctcccggtgattcatcgagagcgcgacgagggtgtcgtggagctcgatggcgtcgaactgcgagattcctgctttcagcaagtcctgcagagtggcgacgaaggcggcgaactcatccccgaacgcgccctccagcttctcgaagacgcgcagcacagagaccaggttcaagacggacagctctcggagaatgaactccttctcgatgcgctccgcaaacagtctccacagctctttgtctgagtcgccgaccagcgagaagagcgggtgcagagccaatacgatttcctgggcgccgaatccattcatgcggaacttcaccttctccgccagttcgcggcacaactcagggtggcgcagcgccggcggcaacttggagtacgccgctgccaaattcgccagctcgagctcgttcagcgccttcgcgacgaccgcgatctgattctccaggtgaggaatcagcgttttcttcacgtagtccttggggatcttctgcgccgtaaaactcggattcaccagcgggtcgcgcagcggcgcttgctcgatcgcagacgacgtagtcaccgaggaaccgtggggagaagaagacgcgacgtcggagccgccacacgcagccgcagaggtcacccgcacagaagaaacggaggaaaagaaacaggagacgagggccgaagagcgcggagacggcgacgagggagaagcgcgacggtgctggagagagagcgagcgactcagagagcgcgagacgaccgagggagctggcggctgcgttgcccgcgcagggagtgaggcttgaggctctggcggaagacgagagcgaaccggagaggcgaggccgcgagaagaaaagacagaaggcgacgacccaggaaggcctcgagctgtcgaaacgcgaggagcgcgagagaagctgcgcgtccaccgcagcgaagctggggaagagaacttcattgcgaagcgtttggaggaaaagccaggccaccgccactaacgaagagaccttgacaccttcccagacaaacgagatgtatgctctgtcacaacagcgagaggtcgtcgcagccagttgacacacagcatgggggtgaaaaacgccggcaacagcacggctgaaaatgacgaacaagaaagaaagttgcgaccctgagggagcgaacgaggctagcagctccgcagcagagcacacagtacgcaggacatcagtcgacactgggaactactcggcggtttatccacagagtaggagcagaaaacgtttcctcgtgtacacagcgaggtgaacgctcgcttttgcggggatgacgaaaagagaggccggtgcgggtctcaaaaaagagataagaaccgagagtcttctcgctctacaacgctcgagagctctgcagatgtttttgcagagaaacgatgtctttcctttgtattttttggccgccagagcgacagcacacgggaggtttacagagaggacacactgtcagatgatgtgaacaatcgagactttttggatgaatgcgcgagaaatggaatcaacgcgaggaggccgccagagagaagatgtcctgcagactgcaagataacgctaaggaagacgcaaagaaaggaaaaactgatgacacagcgaacaagaagaaagtcggttcggcactctcgagaacattctcggtctctcgctggagatcggcctttagatgacaaagagataactgtctctctctggaggcgtctctgcaactcactgtgcagagaagaggacgcagaataggaaaaaggtcttttctccgatgcaggggaacgctcgaggagcagaaacgagggagaggagagagggcagaaga

SEQ ID NO: 1544 - DNA, 2138 bp, Toxoplasma gondii
cgaaattcaagacggctgtttctcggcgcttcccgatcgcatgcagcttcggctcctcttgactggttctgagatgcgatggcgccggtggcctctgcttgcgcaggtcgctcttcgtctgtctccttggtttctcgggggcctgtcgtggcctctactgatcgctcgttgaggtcttctgtctctacagagaaaacaggaaaggtgacttggaggttttccactcggccaacgatggccgaccctgcgccgtgtacagacacttgagacgcgggaagatgggaggcggccgccgcctgctcgacttgacgatcgcgtttctctgtctctgtttcctcgttgttcgcttggctttccgcctcagtctcatcctgagactcacaagcccgaggggtaccggactcgcctcttgtctggttctcattcaggtgcagcgcagttctgcctgccgcagctcgactagacagtgagagcgcgcgagatggtgcagcaggagagccagtatctgacgagctaaaagcagaagaaccaggagggacaggacaaggcggagggacgacaggcgcagccgacgacaacgcagaagatgtgtggtgagttgcgaaacctcggtactctctgttgatggacaaattgaggcagttgacgagaaatagcgagacgagcgtcgcctcggagccagtgtcgacaagggcaagcagctccgtgccgtgtatgtataccgcgacgaacgccaacatgatgaaggcgtgagtaacgtccgaagcgacaagaaacagaaatgcagtcacgagagcgtgaccagacctgcgccgaaaacgaaacggtagtaggaacagccgtgcaacaggaaactaaggggagagacacaaacaaagactccctgaagtcgtgaaggtgagaagcacgcgacagcaaaaacgccaagaacatgggagaatgcaggcgcagcgagaccagacaaggcaccagccgagtctccggatctcacgcatgacctgcgaggagacatgcgaagaactcgattgagagtaacaggcgggtcaaacaaataatcgcgagcgcctgccggtgaagaaaagtgcgactgaattcaccgacggggcaagacgcaaaaaggtgattttcgtactatagtgaatacgtccttgctttgaacgtgagaggcgagctgatctgccgagcctggcgagcgccgcctcgtcgacgaaccaaggcagcacagcagaccaggaaaaggaggaccaagacgtagtttttttcctcatagcgtcccggtcgtttcttgtctcaagcggcatgggcgcatcatacgtctcacttgtcggcaaaggaagccagacagtgtgtacggcctacgcatgcgcttcgacaggttcccgagcggcatgcagtctcaaacgacgccaagagagtgatccaaggtttattcatagatccgtagtacatatatctatttatcctatgtgcatttgcgtataactacatgtccaggtatgtatttttgtgcatgcatgtgtgttttttcaaggtgtcgcttgtgtgaacgagactgtttccgcaagtgtgctgctgcacaaacgaaaggctgtttgaatcgcagctgtttcctccttcggctttgtccagagaaacaaaggtcggccttattaacacgaggaaatgaagagaacttcttctgcttcgattcagctccctgaagaacgaagcatgcgtgctggacagctgaagacgtcgcccgtgacaagttctggctgccttctttttggatcaagaggacctcgaaaccaattccagaagacgtgaaacgaaagagaacttctgcgatttttagcggggcggttcttctctagacgatcctgaggagaagatgtccgagccacacagagctcgccgcgcgctccttcttggacgctcgtcccctcgctgcgttttcctcttcgcttctgccgtcagctgagcgttcttgccaaacgaggaggcaactactgagtagttttttctttcagcagctcagctgcgtcgatctccttgccgacagtgtttgtctcgcgagagcgaaggcaatctcgtttcttagtgaccagcttgtcggctcgtgttgtttcaccgtcgctgagagcctcttcttcggcgca

SEQ ID NO: 1545 - DNA, 2709 bp, Toxoplasma gondii
gtaagagagtcctcgacgaagagacaggctttgctggaacagaggcgtcgacagcagaaacatcgccgctgctagacggttctctttcgctcggtggctgcgtgggttctttactggagtcggtcgaagacgacggtcccgcgttgggattgcagggaaaggaagaaacacggtcactgccaggctgaagcaaggaattcggagaagaaaaaccaacacgaaggctccgatttcttcaaggtggtcttcgagagaaacgtagcaaaaacgacccgtccagagtcccgggtgacgaggaacaggtctgcgaggaagaccatctgtacgatcagccgcgtttcacttcaacgtcgcaagctgtgagcgacaaaggtgaacgggactgcccaagcaaggtccagcgacctttagcagttttcattttgtgcccttggcccgcggacagcatgcgcggagactttcgagtccaggcttgtgaaagacagattttctcagaaaacagctcgcgaaccacacctctggacacaacgctgtcacccgcttcagagggaggagaaatggtggagactggcgtttttcctagggacacgacggttgccgcctcgattttcaaccgcggcgcgatctggttctgctacggaacactctgcgcttgtttcttggtcacagagcaaagcatacaatgcagatgcatgtaccacatcccagaaatgaactgtgaatcgaaaccaagagacgtttccacatttcccatctccgcgccgtatgccccgtctgacaccggaaggcgcgacgaccgaggaaatcgcgttgatctgaggcatctgtccagaccactagagctcacctgcgcagccgatgcagaagaggccctcgcggaaaaaacaaaggccacgaaaatgaggaatagccgggcgcgagtcgtccgacccgccattgtggtggcgacgctgcacttgcccggacttctccaccctcttacaaatggtagagcctagaatcgcagtcggacagtgcacggggtctcgatagaaacgagaacacgccttggggggaatgacaacgaggaattaacattggacgccctggcgcggagccagtcgaagaagggagcggaaaacagagtcaacgttgcggtgcaaccgaccgcgctcccagttgggtccatccgaggcggtcgcgtgtggcggctcagatcgctgtggcagaagccgacggggtctggaagtgaacataattcgaattgaaaaagactgcattgacgaataaaaggctaagaagaagctagaggcaggcgacttcttctacgggacgcttctgtccggctgcatgcacctgcgcggtcagcaaccggcggggggcaaggcacagcagaggggacacgatgcgacgatgcgtctttcgtgtggcgactctggcagtctgagctcgtcgcgcaagttgaaaccgtttgaccagcgactgaaaaccacggcacgtctgctgaatacagaggaaaaacaattcggaaaccgtgtgtctccaccaagaacatggacgttcacaaggactggacggcacagcaggacgcagggctggcgaagctatgctgccgacagcgacgacccaacaaagtgtaaaagtgtagcgctgcagcgccagaagggctgaaaacgggcacgagccatgcagacacggcaatgataggacctccagtttgcttacttttactctcttccctcgactccgatatagcggcggcgttcacgaaaccgaaaaaaattctggtgccaggacagcatttgaaatcgcagggactctcgtcggtggcagaggcagccatgatgtagctgacaacggagacaaagcacctaaatcgtgttctcaagagtcttaccggcgagagaaaagaaattcatttctcgaggctagcgtttgatccgattttttgtacgtctcatggtatctttgaaacggcgggtgccctagacctcgagcggtctcgtgactggccagcgcacttgacgcgctgagtagaccggatcgctggattgcctagatgagcaaggctcgcattcagcggagcaagacacgtgccgcgaggagtggttggaccgcttctgtttttctgcaaaaacgcggggaaacggctgtttccatttcgggccctcactatacggaggcgcaaagcgacgtaggaaaatgaattgacgtcggtcccgtgccggacagcagagtcgtctgtcttgtgcggccgtagaggcagagggtagggtaaggtttcggtgtctctgtgtaaaaccccgcggaaatatattttcgttcagggcactctgcagttgaggcccattttattgtcgattgttttgctcctacgaaagaaccccggttgttgtgcaagattccaggcagccgctcgggtgtcaagacactccgtagcaggaccgccggcaacgatgactcaaatccctctctcggagcttcgcccgttccgacattcgttccatagcatttccgaaccgcttgcttttctgtgttacgccatttaagtgatcttgagcttccgctaagcttccaaagaacagcaccgaatgttttaggtcggacttcccggcttcacgcggcaccccgcacaaatcgacgcgagaacctctgccacgacagacacgatgcgcaccatcaggtcaagggaacggcccagcaagtagaatgcagtgggatcgagcaaca

SEQ ID NO: 1546 - DNA, 3617 bp, Toxoplasma gondii
ccaaaagggcactcataaacctgatcctcctggagagagccgtaaaggtctgctgagggcgcatgcgacggcggattgtggacaagcagcgcagacgcgtcttctttctttattcgttgtcgagctgcatgtgcccgaattcgcagttccttccggtacgcgtcactagccgcctcgatggcccacacactcggtgggagagacaggccgtctgccgcgctcggcggccccctcccctcccggtctctcttcgccgaactgtccagaacaggacggtttctgtgcttcgcatggttgtcttcgtcgacccacggtgagggaaaagaggcaatgttgacgaaattgtcgtctttttctcctttcggaacagtgcaggtgtctccactctgccttcgtcgctccggagcttgctggatgctcactcccgccgacagaggacgccgagaggaggcgtcgtaaatgaccttccgctcggaatttctccgctcttccctcttgatggcacttcgttcttccatttcactcttcaggtgttgccccctcccgctctgctttctgcgagcttttggactttcctggtcttcccggtgcgcggcttcacagctgtctcgcaagcctgtcggcggtcgagaggggacagaagcgacggtcgagcaaccagacagtgatcctgaagacgcagcagaagtctcctcttcctgtctgctttcttcacctgccaagagagttcgagctggaaacgaaggccgaagatggaaaaacgatcccggcgacggccgggcttgagcatcgatgaggcgcgcttgctttccagcgagaacttcagatgagtgaagaaacgcgttcgaaggaggccgagacgcagcgccctgaaacgcttcgcggcctatcgcctttcgagaaaaagactcgacaaagccgtcagatttacgcgctgctggaacaccttctgggtcctcacgagaagttgcagcgaccaagcctgaaaacgcgaaaaagaaggaaggagcagaaaacgtggcgtgcgaggcggtggtgaagcgacgtcgtcaactccgtgaacagtcgcggtttcactgagttcactgcagggggcaaatgcacttctccggtctgtttttcgtggatctcaggtcgactgtgttttagcagagcacagttaagacgacgcttcattgtataaatagaatcagtggaacgccgtgcattttgaggtaacaaaaacggtcagggcattcgcggatcttgctttgtacacgggcaagaactcgagttcaatacctcttcaggcctatgcgggtacgtctgacagagactacgggaccttagccaggactcgtggattggtcgagttctgtcagtgttgcctagtcggtgcttggaagcaggacttacgcgttccgggcaaggcttttccgggctgaaaccggtggtgagtacccttcattttcgccgctatgttcctccctcagcctcctgtcttctccgttcctcaggctgtgcttccctggcgaccacccttggcagcccactgctctctgcttcttctggcggagtccgctttgtacgaggtagaggacggggacgcttcgaggcaaggcacccaacactgtgtctgtcacttctgcctcgacagctcggtagtgttcaactccaaactgattatctatcggcaacacttgaatacacacccatggagttgtgtgtgttcatctgcgcgtttctcgactgccgaggaaacctgcaaaaatcgattttgaagaggtgaggatccctttcacgtccacgtcgacgcctaaacagcagtgtgaaataatgcgagggagagacctggagagttgctcacgtggcggtcgcacatgcagcagatctagagaagcacgagagagaaacagagaaattgtttttcaacggagaggaaagtgcaagccgccccgacctaagacgtgcgtaactggagggacgagcagagcgaaattgtgcagaccaacaaagacacatgagaaaaagtcggcaaatgaagacagctggaacaacctagcaaaaagactttgtgctgtgccgccgcggcggcgacaaggtaacacccgttgtagacagtccaatcggtcgtcctgaacggcagaacgatgaaaggggcaagaagcttctgtcgttgaggaagaaatctcgacaaaatacattcagaaactgtcccgtatgtcgtctccgcttgagcgatagctgctgctgcgtagaccctaaactctcttgactcgcaggcgggcgttcacgtgcggttccccgtttggggccttttcccgtgcaaatgagacgcaatctcttttcgtggcaagaccgcaaccaaacttcttttgcccttgcgattctacacgcatttggccgcgttctggagttgctcggcctctcgtcccaagaaccgccgacgtcattcaggcgttatgtacatcccagacacggaggtgatcacggggcttcggcagctcgctgcgacgccaggctccatgcacatcacgtattctccactttttctgccttttcctccggcggatatctccgttttcagatccacgtgtcgtttgcgcgtcttactcgtactcgtcatccgaaaagccggcgttccgtctgctgctgcccgtgagtctcgcgttgctgacctccgactcaagaacggcctcccagtgccagatgaccgcgcgcgccctctcgtcttttcgcgctgcagctggcgctcgacgccagctcggcggaaattgtcgaggactttgagcgtccggccccgctttatctgcctggtgactttgcagataaatttgtcgcttttttgagctgtccgcgggactttcttcggcggtcttcgtctgtttccgcgcaagcggcggactcgctaactcgcacccgagctgcgcggccatcgtagcgcgccggcaaagagagctcaaccggttcgtgcctttgcgtttgttcctcgcctaccgagaaaatcgagctgaaaacgtcgggagaacatccgcgaaagcttgagagcaacaagtccagagacttctttggtccactctctcgattctgcagttgtcttttcttgctcctctcgaactcgagtcggtaaaatctgtaggttcgggctcaccagtccacgtgagtgtcttgactcgcgtcggcggcgaccctgtccttcacgagacgaagaaattctcccctttccttgccatcgaaagaaggcggacacagcgcaaaagttcgcggttaatctcgccaaagcttccggcttcgctgttcgagtttccccggttcttttcccccaacaagcgacgacgcctcgatcccagactagactggtccctactctctctgtgtctctctgccttgccgtccagcgttttccccgtgtctctcctttctttctttgctcctttgcatcaaatctgatccctcctctttcgcgggctgtggcctcagtctgagagttccgccgggctccactctcccgtagctcgtggtctactccatcacgttgattcggtccttcctcgatttccaccggacgcgccacccactgtccctttccttccctctcttcgctcactcttgcacctgattttccctgttgttcacga

SEQ ID NO: 1547 - DNA, 2522 bp, Toxoplasma gondii
tttgcatcccacctggagcgttgctcctcgactcatctctcttctctcttctcttgccctctcacactgcatctcttcttcctcttcctctctcccctcgtttctgtctgcgtgtgttcttctgggtgcttcgcctccatgctcatcttcgctggggtgtacaaacaccgtggagaggctgcgtctgcgcgaggcgtccactcgagcagccttgtcgaggagctgcggaagagactgtgtgcagaggacagcgacggcgtttgcgagggctgaaagcgagtgtggagagaggagctcgaggcctgtgccgtctcgtttctgctttttcacccgcagggaaacacgacgaagcgcgagaacgaggagcgcactcacgacagccttatcaggagtaaacgcgaacgaagacgcaaaatcgcgctcctcatggtgcccggcgtttctcgcgcgactttcggaatcccaagacgtctctgaagaatcggaaagtccctgcgagttccgagagagtgcagaggcatccacctggttctcgcaagcagagagagaaagacgctgtgtttcgtcttttccttcatgtccctcttcctcgcccttgttcgccgagtcaaccgacgcggttgacggcgttcgcccaccgcaagaggtggatagctctctgccggctgcaggcgacggaggagtccagttttcacagaaaggatcctcgttttttcttgtctcggattcgcttccttgagcgtttccctccctctctacatgcgctgcctgagaacgcgaagcggccgaagaagagtcgaaaggacggggagaagacgccgcgtcggaagcgaatgacctgggcgtcgccacgaagagtctctgtcgctctcttctcttcttttgcttctttttcctcgcctcattctcgcggaagcgacggcggtgttcttcgtcttcttgaagccgaagcgcgagcgctctgccgcacaaacgaactcgagaggccgaggaaggaaacggaagaagaggcagaaggcggctcaacacgctcgtcagcatcacgagctgtttgacggaacagagatgcaggagcgcaaagctccggtgtatgtacagtgcagccacgtgcagcaacagcacaccaggaggaaacgcagacaggaggccagacggggaagaaggcaaaggagaaagagaagaagaatgtgaagaagttgaaagcgaagatggcggaggcgtctgagaggagctttcttctcggagaaaggggtagagaggcaggtgtctccagtccacgtttgtcggctctctcaaaggattctgtcttttgtcgactgaaacgttgtttctcctgggaaattcgagttcgcgctgagacagtaaagtcgcgcatgcatgcaagacgacgcagcactggagaggagaaggcggtttctctttcgcagtgctggacgaggaagaaggccgagactcagaagcgacagacgaggaagaagaggaagaagagatttgcgacagagagaaaaaagacgaaggagaagaaggccgatgacgcgactcttccttttccctcatggccgccttctgggcgaaagcaacgagttccgcgaggattcttgcgattcgttcatcttcctcctcttctctcgtccgctgcgttcctcttcgaactccttcctctccactggcttcttctcgccgcctacgctccaccgcgagacgctgtagagacagcgcaagggcgcacgctcgagaccgagctgccttcccttctctctccaactcagaggctgaagacgaggagtgcacaagaaccagcgaaaaaaaagaagaagcgagaggggaagagagagaagaagggagagaagagagaggacaagagagaggagaagcgagagcagaagggagagaagaggaagacgaagtgagggaagagagggaagagagagaagcaggagaagagagagaagcaggagaaggtgtagactgggcaagacagcacgaaacgaagagtggagaagtgcgagaaggagaatggtgaaagaaggaagaaagagggagaggggaggaggacagacgaagacggcggagttccttggggcctcgtcgcgggaagctcgcgccggagctgatgtacgaagggattgccatctctgtcgtttcctttcttgtcaccctcgaatcccttccgctgtcttgtttcttccttcctatcctctcccgattgtcttccttgtctcttttcgttccacgcctcgtggtcaacaagaaccgcctcactgcgagtttccggacctctttcacgatctccgcgttcgtctctgctctgcgcctgctgcattaccttctgtcatccttttctcttcacttctcttcctccgttttctcctcgctctcgggtcgtttgttgttccacactatcggtctctgtcgggaagctgggcggtgaggaggagacggagacgggaggaacttttcagcgttttctccgcgcacatcttcggctcacgcttcgctctcgggtccccgcgttctctcga

SEQ ID NO: 1548 - DNA, 4425 bp, Toxoplasma gondii
tcgcttcttttcgtagcttttctgtacttgtttcttcctcccttaatatccctgaactgccgcgctgtcctccgtttcccccctgtttctcttcctcctcttttttgttgccttctgtcgtttttccacttcatccgctctgcctgcttgtcaaggagctgctcttcccccacagcgatttcgttttgcacctttcggacgcaacgaaaagctccacgttcctttcttgtccgtcttgatttttctgaccaactttctgaccatatgtcgattttttcccgttttccgggtctcaaatccggttcacagtctcggggcgcacaggcgcgaagtttctactcttctcacaaaaaaacgaactgaaaacgcgtggtctccccgaggcgatacccgcttcggttgccgggtactggaaaaagagagacgatagttagagcatctgctgggatatgaaaaaggcaacacactgccactgaatagacacctgccttcgtcgagaatgttctgctccggagttgcgaagacagactttgggtgaagttttagaatattttcgcagcggattcaaatcttccgacaacgatattgttgcctccgcttccaagatctgtatcagcaataaagtgaccctgcgcttgttacaggcttcatgtgttattaatcgtgactttctcattgaaaggtggcagaggaacggagcacggcgtagaaaattcaaatggacacaacgtctaccactgacacagaaaatgagtctgtttcctgctactgacttctcgttgtctaatttccacgctgtcacaggttttgaaacaacaatgaaacgcggttttcccgctcttttaccgccagtaaacaccagagccgatttcgctggtgtgtcgggtttcctttcaacacgcttttggttctgaccagtcatgttttttctgtttgtgtttaaattctttccggagttccctaatcgcggaaacaggaagcatcgtcagaatcaggttttggaggaactatgcgctctgcgagcttcgaggatagcaaatgcggataggggagaaacttagaaaactattttatgctgtgtctagatatgtagtaaactcatggctacatgaggcttgatgatgctgtagacagttgtgagcactgcatatattttacaggttcctgctaccttcatgtttgcctcagcgggcagatttcatgaaacgcctttgtgagaatcagacttctgtccaatgtgttgtgggtgccacatactgtcacagtttcagaatacattgatgctgacccatttgattttctgtcgatgaaccaagagatatgattctgcaagctctttaatatggtcactaatgtgtcgccgtcgtcctcagaaaagcgaacaggagaatggggggcttgttttccactgaagcatttcaagctctttttttattggcaaaaggagccgcaaatacgagagtggaacagagacatggatcgctggtccataccgtatccgggcgagaatttactcaacctctcgagttcacctcagactcatctccagaaacatccacaattgcacgagcttgaataacggccttatataaagtgttcatttcttctgtgcatcctttcatcgacaaaaacagtaagcagtgtgcacccttgactaagatcgtcgcgggatgcccggggggccacgcagcgcggcacgcatccgccttgccatcgagtcgccccagaaatccaccaagcaacggctcgggcgatgttccatgcgctatgtcaggcggcggatgccttgtaacactcagaagcaatctgtattttcgagcttgcgtcttcggctcctatcgcgttgtctgtcactttgacttcgcctcaatttgtcttcaatctcttcacaatggcgaggacagcgagggtcgagcagagacgtggcgggttcaagtccaaggcccgaaagttcgtggcggtgtgcgtgggtggagtgttgttgctctctggcggacaagctgctgcagattatttgcgcgaaggagctgctcagcgcagtttagaaggcttacaacaaggtgcaacccagactggaccggtgttcagcggccagaccgcatcatgcaccttaacaggtgatacgcgggctcaggcgcaagctgctacgagtttgacgttgtcaaaagagaagccgactattacgctgcggtgctcgggagcgaataaccaggcagttcccaaagatatgcagcaagtatgttccgagacgagtggagaagcgacggtagctaattgcaaggatgctaatgggaagcggaccacgctgcaatctctcttggggtcaagcccggaggctgtgtggaagaaatctaacaccacaaccgaagacaaaaataatggtgaggagtggaccttagagttaaaggagtcagacctcccattaactgacaaggcattcttcgtcggttgcgacaaaagtacctccagcgcaccgcaacctgaatcgtctgtcaaggagacatcggcggagtgcaaagtcgatgttaacgtgaaagcaagaccctcttctgttgcagacaacaacgttgtcacttgcgcctatggtaacgaaagcaaccctgagcccttgaaggtagagatgacaacagtgaaaaacactctcacaattcagtgtggttcccaaggttctctcagtcctacgacctatgaaacccagtactgtgatcctcaggaagctctggagaactgcacggagaagaagtttgaggaaattctgccggcatttgtgaccagctggtggtcagaaggggccgacaaaacttccgtcaagctggaaattccggagacagactttcctcagtcagaacagcagttccgtgtccaatgcattccgaaagatactgtggcggatcccccaacaattcagggaaagaatgaagacgacacggagacagctgctcgtatgtcggcttgcaatgtgattgttactgtcatggccggcagctctgcatcatcatctggtcaaatggtagctacagccgcaggtgcggccgctttgacaggactgtttatcgggttattgtaactaaaccgtgctgatgctgtattggctgtttgcctctacaggcaccgcctgtgaaagctacctctattttaacattttttcagcttttgtgtgttctcgcattcctgaaagtcttgagaaatgtctacaagatgtctctcctacgaatattccatggcttcctacccagcgagagcattgccacgggcacattgtcacatctgaacttttgccaacttggagtcacgtgccgcagaacgacgggtaacccattcagaaacatgtagttgcctctgtttcctacaacgtggtgtgaggaaaatgcggtgcacaagggactgtccacgggtacaagtgctcctggccagccactatttgtttgaaccgtgaaaaaaactgtgggatgtttctatgaagcatccacagtgtgttgatgttgttcaggactaggtgtcgtgaatcaaaccctgaataatgcattcgaaccagttactgaacacaagcaggtcgtcgtttgcacattagtgttgaccgcgaaaccgagacagtgcttaaaaggctggtttttcccgaaactgtcatctactgctcgtttcacgcagtcaccgcctcaacaacgcgtcacgcagaactgtttaacttcagcagaactgtcgtaccacttctcagggtaacactgccgcacgtgttgcggcgtcgcgatactaggattcgttttgtcacggcattctctcccccactttcgtatgggagagggtggcgtattcattactctgtttacggtagagcgatctgaatgactctcagcactcaactgatacggcctctagagtgtcgaagtcattctcacacaagcgttcgcaaatccactacttgtttttagtgactctctgaggcctgtatgtctgccgtgggataatgccacagcaaaatccagcgtgaacctgttagaccaaatgacttaacattcctgtggaagaaacgtctttaacaaactcctccagtgcaccacgctcacacctccagaaacgtccagaatcaaaatgccttgaaagacggcatcgaatgaagccttcactttctttgtgtaccctttcctcagcaacaacggtaaatagtgtgcgccgccgactcaaaacttactccagcggatcgcccggtgggtccaacatccgggcccgcggccgcgccgccagcgactcgcctctaaaattcaccgacgcagcgaaaatgtatcgacgtagtgcatgccactgtgccaggcgatgctaccaattgatacgaaacttgccacgtaaatttgagttttgctggccgccgctcgctttctggcctggtgtttgtaattctccctcaattcgtcgtggatttcttcacaa

SEQ ID NO: 1549 - DNA, 2665 bp, Toxoplasma gondii
atacaatgtcttgccgtaatttctgcgtacaacagatgttgtcgtactgcacgcccatgcaaggggacgtgacatgttgatgattctcagagaagaatcagcacggtatctggtaggatgtgtatttcccttcttcaaaagatgtgagcggttttggcaggctccaaccgcagccagtctctgccttcaaaacaggaaaagccaatccgagcaccggatgcatttggtattgctgcagtgcaccttgatgctgctgtgccgcgccaccagcaaagcgctgatttcaagagtcgagtgcctgaagtgttagtatggcgccctttgctgatcgtgccgcgagtccattgtagatggaacgactagaatgggcactaaaaaagcaaacggtcgaatacaaatttgcagaactcagtctttctgtagcatgctgacgaatgaacgcactccgtgatggacaggctgtcctagctctgctatattccaagcaaacgcagtacacctgagatacgattgaggaggcgcgtttaagtttcgttagtgacggagtccagccaatctcgaaacagatcgaggtcaaataagaatccccctcattacgttcgcccaacaacagaacttccccttgctaccaggggccgcgacgagcgtctcacatatccgtatgctgagagacatagcaggctttttggagctttatgagtgtgcgtgctcggagggggaaattgattctgtcatgacgcaaatttaccgaaaacgcggcctcgccgacgcggtgatgtctgcgcatcatgacaatagactcttttataccaccgttgaaaaagatcgtttaaacgttgctacgacgagcaaccacagagacagatcatttggcatgaatcagaacgccttgtccactgtaaaacactttgcagatatgatttacactactctcattattgtgtggagatcgagggcaaaactcccaatcatccctacattgatcgagtttcgcaatcactttgctaggtacgtttttttcagtaggtcgaatatctatgaggccgtgggcctgtttcgttaatgtctagcaaacggtagccgtgtcatgacgttacatgttctacgtcattccccgaaagcagccgtgatgggagcagaagacgtttaacccatgagagtgtttgacgacaatatgctagcgtccacaatatttgagatgcaaagttttctccgtagcggcaaggaaggagtactcttggaacgttgtgtgtgaagtggatgctgttgtatgtacacccttcatgacgtgaatttttgggcggccccctgcctgacgactgcgtgtctttcccttttccgtaaagttagttctctgttccgcgcgtaactgcaaatagcagacgaaaagcagtgttgagttcctccatgcaacagtcaacatggagtggcgcattccacgagcggtcgaaatagggttcttgttgtgcatatcgttcgcggtgactaattgctgcgccctggaacatgaggaagctgccgatgctattgagaaaacatacatcagaattgcaaccgcggaggcgtcctcagtttacccgaggtatgagtaccgtacgtgctcgaatgtccatatattgttcaccgtgtcctcgtcagtgtcggacccaatggcatgcgagagtattctcccgacaaagccttaaccaaaggatctggctattggagctcagagggaaaccacaaaaatgaggttgtgagctggacaggaattctgaccaataggcgcacgtttaatggaatcaacatcaactgggcgtacgctccgggaaaaggtgagacaagatatcacttaatcccagaaatgcacacttacttcctttcagtttcgatagcggtcagcttcgatggtaaagaacctttccacgaggtggtaccgtttcaagacgtgaacggtccaagcggtacgtaaatacttcgtctgctcagttttacgctgcaataaaactatatgacgccatcgcagctgctttcgaacagcaagtaaccttcccgcatccgattcgtttgaaagcggtccgaatcttgatgaaaaacgctcgctatgagtatttcggaattaaccttgtccaacttgttggagctgggaatccgatgcttcggattcacggtggtatcaccagtcctcaccaggtttgctatcgattgcaatgcgtgcctgtttcttcagcaccacacaaactcatcaggatatgtgcttgcaaattgatgaacacgatgatattgtcctcgacggctgtcttgcatcgcttacagccatggatggtagagcgctctggaaatacaatgagcttggtacggtacagcatcctctcgtttggctgaaaacgtaattgtatggctttcttatggtgatcgtttcaggacaactatacaatccaataaaaaacaaatgcatggcgttgaaggacaacatcgatttggatggcggtgccgttgtggctcaagactgtgaacagtcttataaatataacgacgggcggagcatctggcaagttggagatacagatttgttacctttaagaatgcttaaatcgatgcgtcagggaactacaaccaaataaccagctgaaactcttaaagggaggcagtttctgtctatcacaggagggttcaaaggctggaa

SEQ ID NO: 1550 - DNA, 3544 bp, Toxoplasma gondii
tgtgtgtgtgtgccatgcaagtaatagtggcgaccgtgtagatacgcgtctcgaggcttttctatgcgccggccgttgtttctcaacgtagctgagcgttaggtttctcagtttcacaatgggatcgtggattggcatcatgtctcccagtcttcagtcgtaggaatccgatgcttctgtagacactagagtgcaagcatatacagagttgtgagagaacaccgtgttctacacagagaccatcgcacgggctccaagagcaaagtgcttgttgaacaccagtttttttagggatgtcctgctggcactgacatccaaaagctattcgcctagacccagccatcaaaagttccgtctccttgcaattgaacgctgtgccagccacttctacagacagaaagtccactctgagtttatgctcgaggtaactggcagcgactgactgaccgcgcatgaacgcggcagaagcttcaagctggtggcaggtctcatacacttcttagtctggccaatggaatccacaccagaaagttgtcggaatccgaaaacgaggaaaccctgccgcaaatgtggcatcacaagttgaagggatttgtcattcgttcaacgtgtttatatcacacattcaaatggacacaaggggatgcaaaggcactcgacgtgggaaaaagatagaggaagatcggaaattggtgtagcctgcggctggaatttgtttggagtaagcgagctcgtgagccggcacgaaaggccgtgtcaatgagacaactgttttccgtaggtaaagtgaaacaataaacaactcttgagcattcgttcaaagatggagctctgtagaaagcgtcttgaaatgcagaagctgtatgaaacacaaagaagggtggccctcagaagcaggaacgtaccatcccaagaatgggaataggaagcgaatgtcttcgtcgcaagcgcattcttcacgagagcgatcatagtctggagagtgtaacagacagcgaaagatgacgttaagtgttcttgtattttggcatctcttgtcgagagacctccatgcaattgttctctgccagtctcaccatatgtgtgaccctgacccccaacatgccctctatatacagtgtcaaggggatgtggtcgattccagcttcgaacttctgctgtgtagaatggtatcgatgaggctaacgagaacatacgtcctgtggcgtgtttggtttacgcacagagttagagatccgtcagtggtcagtttagattgcatcgaattatcgtttgtcactttccgtcttctgctatcggtttgtctctctcattggagcccacgtatctatgccgtaacctgacgtcttacagaaccgcctctccacccgttgtcattgctcgtttgtcgctctgtgcacgtttgtgtaatcaagaattgtcaggttgttcacacatagctatcgccggaattctttttcgaaggttctgtgcacgttttctctccttttagatgctcctctggtgcctcttgagctcgaattcggaacaagccggcttaagaccatcgtatgggtctccggatagccaatcttgtggccctggtgagttgaagggcgatgcctcgttttgacggagaaaggacaggtgtgaaggacacgccttgacttcttcttgctggaacaaagactgacaccttgtgtgctttctaaaggggcattctgatgcagaaattttcatgcgtcgtcacaatgtaaaggcgtttgatagttcgcctttttacgacaggacgagaaacagacagtcacattcagtaatcgctttgtaattagtccatatcgtcattgttttatgggcggtggaagcctacagacaagggtattgttttcatcttagcaggaaagcctaattagttcgttgccatgttgccctcatcggcgttcgttccactgaaacacggaaccacggaaatcttgtggacgtcatccttgtgctcatcctagcagaagcacagtttccctcttttccccgttaattcgtatggcaactgttctgaaatgcagagacggcaacgttgtgttctactgactggcctcaacaaaggaaacagtggagtgacacagctctactgctttgtccagtttgtgcgttcacccgtgtaagagaactagaaatgagaccattctgaaccctcatagtttcgacgccaaagaccgaaagtgcgtggaagagacgcgaacgtagttgacccggcgtgctgacaagataattcatctcggagatacagaaaaatgaagacgacttacacgtacgattatcgttgattttgtgggtatgcatctatatagccacaaacacatactcacagatcagcgctctgtcatgactcgaagaggtgtacgtagacccagagagaaaatcgcaaactgaggcggaagtatgactcgtgccattcggtttcagtctcttagcttctctttttgagcacgcatcggtttaccgtcgcgcgcagctcgcttttccacgtacagtggaccaaagttgcaaaagaaaacaaccggtctgtcgggctcgttcctacgtacgacggccatacatgcattgtgacatagaagaggtgttcttcacctatatgagatgcctgaaaactcgtcaaatggaagctctactcttctactatcgactagattgcttgcttattcaccttcgccccgccgcctggcacacgctcgaagaaccggtctgttcgcccgcgggacgaaacagcggccgagactgtttcgtaacgaaggagaaagacacgtcgcttgccatgtgaaccatgaagttgcatctcaggcacatttcctgtttcatgtattcccctgctgcacgtgcagggtgaaaacacctcctctgtgccactcggctagccgtaggcgagagggtgcagaacgagaacttgtccgtctccttgtggcactatctccctacaatcgaggaggcttccctttgtttcttcgccctctgtcccgctgtgggggagttaccggatgccgcatccccctttttcacttcatcacatcttaatccccgtgagattctcgcgctgtagtccacataaggaaccaaggtactacggcggtcaaagggtcttgcagtcaccgcgcatgtggcactcgaggtcaccgcggccaagtgagctggttcgctagttgtcttatcttaaagtttccctcaactaaagaagacaaatcacattgactgatgaagcgtttctgtctcccttccgcctccttctccttcagcgttcttccgttctccctggaatcttctcagcgaagactgtgctgccacgccacgcccgagcctgacgagctgtgtctcctcacacctgtggcagttcgggatccgagatagaggcggatattcctcaagcagacgcacgcgctcttctttccatctgtttttcttttcgccgtggtgtaatcttatcaagtcttttgtctccgacgaacgcgcacaaaccctcctcgcgaaaggctcccttgtgctcaccgtccttcccaggcccaggggcgccgga

SEQ ID NO: 1551 - DNA, 1903 bp, Toxoplasma gondii
tggtgcgttcacaacgatctataatatgtttctcctttttgtatagaacgatgctgtcaagtgggaaccaaagtcagcatttgagcgtcggtcgaacattggcgtccatcgcttcttggacgcctgttttttatcctgcagatagttcggcgtctgtgtggagtgtccccgtgactatcgggagacgattgttgtgtatacgtgtttgagttccgggtgacaaagtggacagaatgtctcttgctttttcgctctgccacatcggagaggaaaaccaggaaagcacgccgacggcagtaacaggagcagaagcatgtatacgacatcgcgaccccacactcgtcttcgtgtcattctatgttggaagctccgaagtctttttccccgaaataacgctatcgcctatttcctagccccagacggccacgcggaagcagatgaccaaagtagttccttttctctgttcagctcacggcgtgcatgacgatcggacctcaagagcatgcggtgtcaagactcattccactccacaatggcggttgtttggaattcatgtcatcaacacgcatgtgcttttgcctcagtctctgttctctgttccttctccaggttgctttatcttgtgtactccttctttctcacagtctctccacgtacacatatttacggaatttttgacactgcaccttcacgggctcttctacactgccaagcgaatgctttcacgggtctcatgtggctcttgaaagtcacagggatctgcgcagacacctaattcgtgttttttctgcttgtcgactgcacctttttgtctcacatctccctcggtccatttctactccttgctgttccccacctgcatgtttacctcggtctctttggggtctttccgctgccttgtccccaggtccgccatgcctgcgcctggactctccaggagcgttaccagttgctgtttctttcctcgcgccctttctgtgactggtttcatacttacctttttcaccgttgtaactgtgctctcgtatcgaaaacaggcttgaagccggtgaagaaaaagtgtagatctcagcagttcatctcggagtcgagataattctctcgagaaagctgcccctcgttctacgtctggacaaagtcaatgggctccctaattgtccgccctaagtaaattgacggttcctttctacaaaataaagaaatctcgtctctaatggagtcgacaagtgtctcagtcgcggtcacgaacaggcagtgtttttccggtccgggtcacctcttctacatcgattgagagaaacagactgcacagtaaacacgtgaaggaaagtcgccctttatttagagttttctcccatgtttcttgtttcctccaacttcaagtgcatgtgaaatgcgcgacagtccggttttcctttgtggctgttgtcttcctcagagcatcctgttttctgtgcagcttgccttcgcactgcatgcggcgtgtgtctccggacctttctcatccacgacagatacaaacacgcctgacatctctggaactgcctttttcgttttagtttttgtacgcgcgccattcgctcctcttcagaccttctacatgcacttcctgctgttttccgctttacgctgctccacatcctctggcgcatgcagagccgaattcaattttgcgccagtttcacggacgctttttgtcaaaagtgaaaaataaacttcacatttctgctcgttttcctatagaagatatcgaggtgtttagtattctcctgcttctgcgtcttctgttcttcgagtttccccttctcgtaccccactgctctccgtctcctccggctttcgtccgtcctctccgctctcagaagagtttccttttccttttgtcggcgtttcctcaccgaaa

SEQ ID NO: 1552 - DNA, 2651 bp, Toxoplasma gondii
gttcagaagcgctttggtgaggtgtacacgcaggtgacagaagtgcggggaagcggctgcatgcatcagccgcctgacaaagaagtttagatccgagattcacctcgctctcactcttcggtactctctgaaggacgggtatcctgcagacgtccttcaaaaggtcctgcccgtgtcgccggtgtcagtgagtttctcgtcacatctttcgactctgaagaagtctaagggaatgcggaagccgactctgcttccgcgtccggatagagagagcgacgggcggcggcagccttttcctttgccggtgaagacgcctcagaagtctcggactttagcgcaagcacttgcgtgcgaacgaaggcggatgtgggccgacagtccatacggcgaaacgcgtcgcaaaacgtgtctgaagtcttcactcaacacccgagctgacgccagccagacaccgtctgtaatgtagtctacttattaaaataaatgcagtcgagaaacctgtcctcagacgccttgcgctagccacggtttcgtcggggaaagccgcagaggcatcccttgctctctgtcgagttcgatgagagcgaagtgttggaagtaatttcaacaagttgaagtcgccgcaaagtccgcgtcgttttacatcagcgagaacatgactgcacattgggcggcggatagatggatgtgtggattgttcaagccggacattgttgaaatatgacggaaactgtgcatcaaattatttgaaagaatgcaccagcggatctcagggggaagatcgaggacactcattggggacgtttagatttttcagatgcgggcgacgcttttccagcttcgaaagacaaatcgacatgtagacgatgtggcgctttcagaacgtctcttattaccagtgtcttcctgcttcgtttctagtgtacggatttgccatttcttgaagcggggcttgcgacacaagtggtcgttcgagagtggaagagttcgtgtgttttttcaaaaacgcgggaccagacgattttctcagtgtcgttttatcaatgaaagcaagttgcttgtggacgctcgacgcacaactgcttgcggctgctgttctgagacacaatttcttatgagcgtcttctagggagttatcctacgaggttgccccgcccgctgataggcagccatcttttatcagagaagtctacagtgcgtctttagtgggaaggaactagtcatattgatcagagccgcagctgagtattcggcgagtctatttgtcgacagcccaggtcctcgacgtggagcctagatcgttgacgtagccacattcttgcgttcgcgatacagcaatgacacagagttcccttattttattagttcagccaggaatattcttcagtaccttctttatcggaggggctcgtttttgcgtgtctccaaaagagcagccatccaaatacagatttgaagcatttcttgtcagtgatttctttcgtagactctttgcgcaacgcggcggctttttctgtgattcaccgaagggggggaggcctgaaagagttggtgcggtcagacctcctgcggcaacgctcaaataaaacaaaacgtttttcttctcttttgcgggacgatggctacacggaacatccccgcttctcagtggcagaaatcgtttcgttacaaatgatgtgcgaccctgaactgtacaccttagatggactgaacagagacattgcggtacctaggacacttaatttgactccagttacaaaacagagacaaccacgttcagggtgacactgatcctacgcgaatatccctgacgcagttgtgcttgcagcactccgcgacagcatctagtagaacgtacaagactgtaagattatcgtcacccagacgacgcagcggcggcgccagtcgacattatggcgtgtggcggaaaacaatgcagtcgctcttcatagcttggccagtagaagcttttttctccgaaaacgttcaaaatcacgggtgtccgtgcttcgcgggaaattaacatcctcccgacacggaccgtttccacgggtagagttccacgacgcgactaccaactaaaaagaaatgggaggcacgtgcttctgcgaggaacgttctgttaaagcaactgctgcactcgctctccatctctgtgtgtgcaggcaggtgatttcggataaatcgcatctgtggatatccttgtgggtgagacagcggtgcgggttcttccggagattccgggaagtcgatgtggagaaaaggtgccgcaagaagagaaacgtgcgagcgattgtacagaagtcgaagccgtagcgaaaggagagactctcacagtagagagacgcgccgtatgccgaccagagactctgacgaatgaaacgcggccttttgctgaggtacgaggaaccccaaaaagagcccggagtttcggactgaagttggcgcccaggtgcaaaggctaggacggccattaccaaccgagcattctgggcaggtgaaaggcgaaatgtgcgaaaggttctcaacagagtcccccgaggtcgaggaagttgaaaatttgcggtgagaaatcgaagatgtgggaacaaattcaccgtggcacttcgctgcgcgcgaaatcgagcgcgactcccccgagcttgggtgta

SEQ ID NO: 1553 - DNA, 3264 bp, Toxoplasma gondii
gacatcctgagccatacaaatgaagggagcgacgaataagggacacagtggagttgctgttgatagaagcctcgacgagaacgggtctgcagagaggacgtgaatgccgagcgttcacataaaacgaaaacgaatgaacaaaaatgctggcgtgcacgactacgtacatatcgactacatacagccacacgtgtacgtgtaccttcacgatcttaagtttttccgatcgataaccagatctgtatgcatagtagcacatcatatacacgcggtatgaatacgcacaaacacaatttagatatcggcgtcagatagtgtctgttaccgacgcacgaaaacaaccatggccggggggcggtgggtcacagcgagaatctgtgaggtaaccatattgtgtgagtgggcacgtgccccaacaggacaaagtagaaagccagtttctttattctaatagaacaagacgagcgcaccgacgaagggagcgaaaatctcacagtgcgtgcacggtatcactccatttgtcatccacgatacacgatttctcaaagtaaaattggtattttcaaccgcagaggcttcacccagaagtcctgagttgcatcttaggagactcctcaagactcaactcgagcagacgaaaagatgctttcgtgggaggacaatctgcggcatctgacttgtgaaatggcagggcgacttctaaagtggaaagagacgccgttcacccagcttcaaagacatcaatttgcagtctaagaatacggcatgctcgtccttctgcgtttctcccgaataattaccatagggtgtgaatttttggggaagtactcgaggcatgctttaaggctaggcggtagtctacgagctagaacaagttcctggtgctgagcatccaattcctgcttcgtaggtagtcgatcgtgcaacaacagaaacacgacttcctcgaaggtcgctttctcagtcaggtcatcgatgcgatatcctcgatatgtcaggcctgcgtcaaagaatgcgaaaaagacatccggacgaaataatcacctcacgttcgtgctacctggcaatgctgtggccttcgcgtaggatgccacagtcttgggcgccacctctgagcttttacactcggttatacacctttactcccaaactagaaacagccctttcacacatgtatcagtgctcctataagtacgcatactatttatatatatacatgctcagaagaggatgaggcagacgaaggagacttgctctgtacttccgataggaaaacactattcgagatgtgcgagttactctaaacgagaaagcacgggtgaagaaacatgacagtcgaccatgaaaacgctccaagtgtcaccgcgttcttccctttggacagagacgaaaacacacgcaagttggatttactcggtggcttcttgactcacctgctaaactggccggtccaacacttgaaatggccgattctcccgcaacgactccttctaacccaggagaaaactctgagtccttgcgttgttcgtatgacgtttcaagtggttgtctcgccattgtggagcttagaaacgctgtcgtttgtcgttgccacgtgggtttcctccgggtaaggctgcagagcggaggatcgacagatccggaatgtaagccacaacggtgcctcaaaagcaaagcgaatccgaaacagttctcagactcagcgttcaggcattctatcccgtttttggaattttctttggtaatttgcctttccaacgtggtagtgctcacggcactgaacgtttgggaacagcacaccgaacgccagtcgggggaaaacgcgcagtctgacggtgctgtaggcacgtgcacaccagactgggaacggctaggagcaccgctacccgaccacttccgagtcgaacctgatactccttgtgtcgccgagcagagcggatgaactgcaaatgcaggaagcagacttgctggtgctggatatgaatgccagtgaacgggatgacccgagttaactttggattttctccagtgacaagaagcgctattaaattgtccgatcaaagaataattcgttttgaggcaagttgaaagctgtaggttgtgcagtgggatcgctcgcaagagttcgagggcttgaggccgggcgtggaatgtctgtgtgcggaggagaggcagaccggttctagcggcagccgccatcaggatggcgagcaaataaagcagccagtagcaaaatatctaaacctgacaaggctgaagagggtgctgaagaggcatacgccaagcgcgcgatttccttctcgtcgtgctttcaatagattcttcgcttgactttataggttagagacgcgcaccaaacacacagatcagaaaaggcgtgcatgcgaatactcaaaataacaacagaaaccaatgcgtaatcaacacttcgtatgccttcaaacgagtgcagtagagtaacctcgaccagtccctctcggcatgacaaacatggagaaaacatgcagacaatgaagaccgcctgggaaacccagcaaagtcgtgcggaccgggaaaaccacaacggtgattgcttggaccgaaaacgacgcaagtacagacaacaaggccgctgatggcccgacacgtccgcaaactgggacgagataaagcaattcagagaattggagtacgcactctaaccaacgagcactcgcctcatacccgcctcggcgcatggacaactgacacgtgccccaaaaaacgacgaccaaccaacagaaacgcgtcaacagagtgagggacgactcctgccccccaaaatgcggcggaatgaggaattcagctgctgggaatcgaacgaagcccaacgctgttgccggagattatagccgacacggacactccactgagaagtatgttcaagcaagcaaactggttctaccacgaaaccagttgcatcgcagttggtacgttgtttgggggagatagctgaaagtggggaacaacgtgcagacttgcgtttgtctctacgatgcagaaaaaaggcacaccgcctcgtaaaggaagccggtttcgtccacttggcaattgtggaaaccttttgacatctatcccaggaacgaaaccgcacctgccaacagcagtatcttcaggtaatgtgtggccaatgacggcttttacctcagtgtcaacaaattatccgctccaaagtcgacgactgctctgataagtgagcgctctaggatgggctggatcacacagtcccctgcgactttgaagtca

SEQ ID NO: 1554 - DNA, 1957 bp, Toxoplasma gondii
tgtttttctgtgcttggactagagacgcgagaatacatggttgatcctttgtcttgggaagagacgtgtatgcgttgcgcaccgaggccgagcggcaggtctgctggggctgggcgccccaagcagcgctgaggagactccggtttcgacgtcattttctgcgtctgcactccggagaaaaacggtgaagacgaaggcgaagccgcgggagagagaggcgagaatggtgcgacgaaagcgcgaaacggaggcggagagaacagagaaggagagacacagagagagcaaaaaaaggcaaacgactcagatccgcaaaccgaacgaagacgtggaagtcgaggaaagggagagaacaaacgcatggcctccctggttgtgggcttcgtgacaggagcgacgcatgcgtcacccttcctcgctggacgcggaagaagaagcgggagaagaaggcagtctgaaaggcgagcgctgagcgaagaagaaggacacagtcgaggtcgcgaagaagaggactgcaaggaacggaggagaggacgcgaaggcgttgttagggatgcaagagaggagggaagcgaggcaagggggaaggacagtcgaggtgaagcgcagcggggagaaaagcagcgagcggagaggagcaaattggcggtggttgtgggagtgcaaagacgagaaactcgaagagtctccacaggaggcgaagcggaagcgcggaggagatccggattccggaagagcggccgcggcgcgagactcactggggtcgatgaagaacgcacactctctccttgcgtcggagccgaaaggctgacgagaagcagaaaaaagcaagaaaaacaaatcactcgcgtcgtccagagggcagccatccactgcacagagagagcggaacaaactgtatttgatggggagtgtcttgttctgtctccgcttgtcctccacgcgaagggagacaaggaagacgacggcagaacccccaggatccaaaacgaacagacgagaggcgaaagcagcaaaaaccaaacacgaagaggcagattggaagcttgtccgcttaccagggaaaacgatttcctccatatacgcgtcgagtgtgccgaaactgtgactccgaagcctcgtagtctgcgcatgcaaagaggcaggagtcgctttcgacgagcctgcatgcgtttgaaacgcgaaaagacgaacagcgaaacaaaggggggttgtctcctttgtcgtttgaaaaagcagtcgatctgtgtgccaagcgatccgcggaaaatcgaacttgcttgtttgccgggcctcgctgttgcgaagcgaatgcagctagcgaagggcaacgaggtgtacatacacctctctgtcagtgaccttgaagggtgtgtaaatctgcgaaaagttgcgaacatggctccgagtgaattgctagggaaaacggcttcgtcaattcgttttcatgaaggaacgatgctagccagaatccctttttctggaagaaatttattcctcgcctcgccgtccttacaacttttctcgtctttctgaccctctcatactcctcgaaatcccctccgttcttgatgccattgccgttcctccttgcttcttgtcttgcttagtgcgtagagactctttacgttttccttctctctgaaggtgctctgtctcgtcgtgtctccttctcctctgtctctcctccactcgtctgcgcgctctctctgacctttttgtcgcttcccgttctgtttccgctcctgagtttctttctttttctcatcggcatcgttgctaatctctctcgctctccttctcggggtctccttccttccgtgaaagcatttctcctctgcatttcgttccggctctatatttgtccactattcttcatgtctccctctcctcgcccttgcctgcttctccttacttcccccgtcttgaaaaaagacacagcctaccgcgtcgagga

SEQ ID NO: 1555 - DNA, 2219 bp, Toxoplasma gondii
ctctccttcaaaaatttacaatgatgcgcagtcgtacttacgcgtgtacaaaggtactgagagtcggggcactttgccaatctcttcttgttccttcacatctgatacgctggcagagtcagcctcttcaaagcaatccgcggtaaattcgtcttgtcccttccgcgtacggaaggcattcggacacgagaaccaagctgcattcagcagcgcaaccttgtttcggatattcacgtaggtcggcgcaaggtcctcctgtctaggatctgccgactgcatccacgaaggcagcggctgcacaacgaatccaggcacgggctgctgggacagagagccccagtcaaactctgctgtgggaggaaaggctacaacacaaatggcgcacagacacgggcagcagtgtttgtccttcgctctgtaactcagcacactacattaaaaactcgcgattcctagcgggggctggaacagtgccacgaaagtacagtgaaacaagtgtgcctgtataggaggcgaacggcaaactgccactactgagaaaaagagcgacccttcctgcgttgaggctacgcttgttggacaccatctgagtcgcagcgggaaaaacaatccagaccgtcggcgtcttcaaagattgcctctatggaaaactatcctgtgaagcttacacctctgctggcgttcgcctggccaaaggtccccaggatactccagaattttcttgtaagccggacttctgagaaggccttctagccgcgtggtgtccagtgacttcggcagctcagcgccaccagagcgttgcgccagcagcttccttgcatagaaaatccggtgatacagcgaagaactggaagggaatgagtcctccggtacaacaagtttcttctgcatagtcttcaacaggtgtggagcacgaccgctacggtgagaatccacgtgagacagagcagcttcgacgttcccagcagcctctgcgacgcagtgttctgtcgatggtgacagagacacgcaggagacgaacagaacaagaataccgagggaaaccatgggaaatgcaactgcatgatatagtcgcctctcagcatcgctcctgaatggagagtcgcaccaggaacgcgtactcagtggacacacgcgctgcgctcgtagccgcagcgctcctgaaacagatccgcagtgctgcatttctttttctcacgaagaggtaagtggaactgaatcgaacaaacagactctcacaactgcctagtttgctccattacacttggccttctgtgacgccattgatcattcaggaagactactcgaagcggtggacagtctagagacgcgccgaatgactcagtagccggctctcagcaaagttcgattcgggtgtgtcgcagctttgagtcgccgggatgtggaggtgacccgggacccgagagatggtgaccccagctagggaaaagcgtactgctggtgcttctagtgcaatccgcgcttctgctcgttgctgagttacaattctcatgtccccgccacttaccgaagaaaagttatccacggcaatggtgattgatggcgcagatgcttctgaagtctgtgcaagcaacattgcgttgccttctgtaatggcattcgccgcaagttgccgtggacgagaagagcagagccagttccgtagtcgtttcgctgtgcagacctggtgacatcgagagacgcgggggcgaaaaccggagagtatcaccgtttgctggccacatcgatactctgtacagagcaaaaacaatttccagacacgcggggctgccggtcacaaactactctgaataagactcgccgaatttgttttctaggatggcactttcctaccaccagctttttaggctgcacaggcacgtgctcagtggtagtagagtggggtcggaaacagcgaatgcgacccgcctaacaactgttcgtgaagcgttttcacctgaaactgatgcatgcacactccagtgactggtgctcaacaaaataatttctttagcatccccttttcgaaaggcgacctagcatctttaccgtattgaacagcactcggcgatcttggcactgcgtgccgagcgcatcgttgtgtgtgatatcaacgattgcaccatcatcatcctccatctcgtggctccgcacagcaacaagacctactctgcgtgttcgaattctaccgcctccctcgactaattccccatgaaaga

SEQ ID NO: 1556 - DNA, 941 bp, Toxoplasma gondii
catatgtaagaccgcaaattacgtttgccacattttgtgttcctcaaccagattcctgctcaaactagtaacccttgtcatgaacagcagtttgcattaatgtgctccacagtgtccgtgagcattccagggagtttcaagttttgggatttgagaacaattcatcgaacgcgtctttggttatttgccgtgcggtatggaaactgagcgcaggacgaccgtccctcaatactataccagtttagatctgctttgaaagcaacaagcaattcaggaaacgcatctgggtgctgttgttttcacattgagtcaaccgtgagagtccggttagcatattttctgaagggatagcaaaacagacggcatgtactctgcctctgtggtgagtcatagtgactagctggtttcacataagtgacgtcatccagcttccgggaaaaacagtcgtttgttggctcccggggactgtggactgacgtctgcgatggagcacgacgcggttactattgccgctaagaggtaaccggcacatgattccactgtggcagttttggctccgctagaacgccctacttggcattttcccgtggtgagtgtggctcaccgtcactgaccttacggggaatatcccggtagttcgttaatcgatgtcttccgcgccatatgagggtcatcaaaacgaagcttccgcggtcggctccaactctacgttgtgcaatttggcctattttttgaaaaatgccagactctgtgctgcatgatccattttcctgctgaagcgttgtacatagagcaccgacttgaaagatgctgtgtatagacaccttggggcaagtctccgaaaaatcaggtgctttccacagtggtgatatcgtcaggaggcgcacacggataacacggacacacaggtagtaatctcgtcgtgtaacagtaagcaacaa

SEQ ID NO: 1557 - DNA, 3003 bp, Toxoplasma gondii
gaacccaggtatgtggttagagcgactgcgctcagactccattcccctttccgtccttcgaaaggggcactcgaatcggatgtctctgcaggtcacattactcagtccccacagataactcaaagtcaacaccacagcaacacagacagcaacacagacagacacacatgtgcattggcatcgacgaatgtatcgatatctgtcgacatctctctatagaaatagatagagttgtgtcggcgccgcgttgaaattctccgttcggagtgagcgatgaggcgatgatggtgtgtgaactgcggttctgttttagctgaggagtttcttttcgctgcaaatctgcgcggccgcggtcctctccatctattgcgcggagagcgcagccgacgtggaagaacctcgataggtacgggcgttcgaaacgcgtggagagacatgcgcctgtctgcgtttgcgggtacttttttcagtctcctcggcgacgcgcgtcctgctaggtctctgggaaacgctccgtttttctcggaaccgcccgccgaacgaagcaaggcttctctctttgagtccccgacagcatctaggcagcaactcgaacggcactgcgtcttgccgctctcagatccgccatgtgtccagacacctgcgtcggcgcgagaagtccggtcttccttttccgcgcaagtctagaaaagatggagtttcagagctccttcacgaagccaaaatccccctcagctttgtttcgcgggactctggcagggcccgggaagcaggaggaagtgcactggacaccccagaccgtgtagaaagagctggttttcagtccgtagcttcgctgttttcgcatatcgtggtcttgcatagacgtttgtagattacgtcgcttccggcacacaatgaggccacaccaaggccgcaaaggaaacagtcttccaaaacagaaagggatgttcttctgggaaaggcggaggcagtgcgtgcatgcttttctgcaaaacggtctctcaagcagcgatcacgccttcttgggttttcaggattccatgctcagcgaattctagggtacggcacgtaagcacgcactgagctcaacagacaaacaccgggaacatgacagacatttgtggactggcctgcatgagatacatctcgacttagatcggtggacacagatctctctctcggatggctgaggctctgcagaggctctccacgggccgcagtctctccttttgctactcaatctctctcgtcgaaaggggagtatctgtgcttccctaggtgtgtgtgcgtgtgaaggttgaagcaccagttttttctgcgaactcgcaaaactgcgtttttttcttaaaagtcaacctgcgtataaggctcacagatgtgcatcaaccggcccgggaagaaagagctggcgagtcagacattccctttttcgcttttctcgagcaagttcaccacctgagttcgtttgtgagcacgaaccaacgagcgacgttcgcgaggaagcagaggccctcgagaggtggaagccacggacagcgcgtagtctgtacttccccgaagaggtctcgtgcgtcaccttgaggcgactgctagtcgcgatgtcaattccacggaacacactggacagagaggcacccaatcacacaaaacccccgaggaagcaacgcaggactcgatgcgtggcaccgcgcacacacgaagaaacgccatttctgggaactgcaggtcaccaggctcggcggtcgtgtcagcggtggaacgcccgctggcaccggagagacgcacagtctctagccgccccagacctacaagttgcaaaagccgcaagtgcgtctttttctttgaaatgtttctctgaaacgtgtggatccgacgcgttttgaagagtctcttggcgctctagggcctctctgtgaacgcccagctggagtcgtacccccgggggtacaacgcgggctacctccagcaaagagagacatcgaccgagtttggctgccgtcgttcctggagaaagtgcggcaaacgctttttaccggcttttttgacacgtattgacacagagcggctctgttcgttgttccttgcactcgctttttctcgcggagaaaaagacgattctccgcccgctccgagacctctctatactacgcacaccacagacacccttgctaccaactccgcgaggcctatatccccgggaggtagagctagcctgcagatatacacagctgtgtgctacgagaacgcttgctgagtagcagacggccaatcgcggatgcgggcctcagatccagcttggttcgatggtgatctttctctcgtctcccttttcctcccctaccccacgttttctctcgctctcccctctcccactctgtcggggtaacgagacgctgcattcgacccctggtcggccctccccgacgctggggcttgtccagctttttcttttccacttttttctgttcccagtctccgacacacactttgttttctttttctcggcatctccagggcaatcgacgcgtttctctctcgcgagtaccgtcagctcgacaccgtcatcacggccttccaactcgaggttccttcacactcgaggttccctatcgtggcttttgtcagctggcctccacatcgacgaaaagtctctcgcaccgttctcctctcccttcttggcgctgtccgcctactctcgtcaattccgtccgcctgttttttcgtttgctggaggccgccttccctgaagttgccctctgcacactgccttcgcgtgggttgcttcattgcctcgtctctttgaatggtcttgtcgaccgtctcaagtgtctcctgcagggaacagatgcctcatcctcgtctcgtcgccgcttccttttaggagcgacctgggttcctcggacttcccaggctgaaacgatgtctctgcgtctcctttctcttccctctctgtaactgatgaggaggcgtgtttttctcagctgaaaacgaccgctagga

SEQ ID NO: 1558 - DNA, 1650 bp, Toxoplasma gondii
tttgctgagtccttcacgacactctcggcaggcaacaggcgagcgcctgtacaagagcagggcgacattttttctcggaatttccctcgctttactggggcatctcatctcgtaacaccctgcgagtacatcaatctcgagtaagtgtgcttgcaggtgtgacgccaatcgcattttccttcacatctcaacgtcctggcgcctgcttctttccaagtcgttcaaaacttctacagtctggcctccaccggttgacgctcgcatgcacccattcgtccatgtgcatgcattcgcatacaaacgaacgcgtacatacaaccagacccatgcagagacctacgcaagtcgtttcacctcatgtccagattttcccccggacgcttggaaccacatgcatgagtccgtgtgcttaagaacacctccaaatacgtacacagatacctgcatatatgcatgcatacagacatgcatttgtacatatgtatacacagagaaatacgtgcagaaacactgctggatgcataatcgagctcgtgtctccgagagctgctggcaccctcaaaagttgtttttttaccgtctgtacatggtggaccctgcatgttgggcgggcgtccgctgtcggtctgcatgcgtttctctttgtcgcgggaagttcccgaacgcggcgagtgcagaagcgatcacactcgagcgcggctggcctcctcctgaagactccggaccggcagcagggcgcctggccgcgagaacaggctctgcatgcacggcccggagcgtcggactgtcgccgaggccctgtgcgtttcccatgcttcggggaaggccgagaaaaggggagattcgcgctgaacgcccgtccggaagaggtcccgcgagcgcgggaaggcgacacccagagccaccacggcaggcggtgggcggcggcgcagaagagcctgccggaatggatggggattctggactggtggaagtcgcgaggcgctcgcgaacgggagcgggcgagtcggtcggagtcgggaagacgcgaaaggcgtccaagtttccacgtgcgaggccggctggctttttgggtggcggggcgcgggagacgggaggggatgggcaagcggttctgcgcgactcgccgagacgaacgagccgcgagagcggagaaactgtcgcagattcgcagagaacgcagcggccaaacgccggggctgaccacgcagaactctcgggtgtatgtacagctggtggcgcatcagattcgcgtttttctccggaatgcgttccaagtagctgacgggcggaatcggacgaaaaacgcggcggatgtccgcggtgaggacaagccttcgatccagcagacggaagcgacttcctcgaagacaacgcacacatcttcccgttttttccacggggaaaatggccgtttcctcgactccgacgcgctgcgccacgcagtgcaacacactcgcggcacactgcgaaatcgctactcttcttccacgcgcggtctctcacgacctgttcaaggcgctcgaggagtctggccgaagaaactcgagacgaaggcttcttcctcagaccgggtgtttgcgcacaaaaataacggccctttagtgtcgtggacgcgcgaaagaaaccgtggaaatgcgaagaagctca

SEQ ID NO: 1559 - DNA, 4921 bp, Toxoplasma gondii
caaaatctccctgtccctcggctcctctaggagatgcgaactcaaggcagagaagccggtgtcatgcgcagacctgctgccgccctccactcgaaatggaagacgcggccggacgaagtcaaattcaatttgtgtctcagaaagacaaaaagcgccgcatgcggtgagagaagaaattccaaaagagagctgtccagctcgcgtgtatgcagacaacagacgcgcagacgattctgaccgcacacgttgggagagcgacgtaaatcgaagagcgactcttggtctgtgaagcggctgccgtggcttctggcttccgttgaatttgagtttccgtctgctgccacaacggcagcactgcggctgcgcgtatctttgcgagggaatcgttcgcctcgattttttccgcgcgctctgtcctttagcctctccgtaaaaaacgatacaggaggcgtcccgtcgaaagccaaactgaggtcgagaagccgcgtcgcggagtctcaggttagtcgcgcgctgtgcagcaagctgtagtcgaggcggcgtacgcagacgtaccgatacacgcgagacgagggggggaaagccgcggttctgtttcgtcgcgcagcggggaggaaaaggagccgaagcgtcttgatatttgcgggaaaaggagagaaagccagcgtcgccaaggtggctccacgggaccatgattcgactgcaggagcggctacgacgagcagattcgacacctccgcgtcgggttcctcaccaggaacgccagtcgtgggacagacgcagccgagaacactacggcaagaaactgacggactttgtagcgggagtgtgacgaagagagaactgtggagagagacggcccgtgggattcctcgaccgactcccaagggtgccccgtaggcgaggacggccttttcgcagcaacagtgacggctggaggggcggaaagggaaaaaggaaaacgggtgaacaagaggacggcgaaaggactgagacactaaggcaggaatcacgaggaaaaactacacggagtcggggacgaacagtggaaggaagcggactggcacgcgacgcgcgggtatgatgcatgccgcgacgaaggcgcctacaggaagcgttctaaaacaatcggtgaacaagggaagtgacactggattggacatttgaaaagggcctgcagttagcaggtagcgcgagcaaggagaagaccatccaagacgaagctgtgacggccggcgagcagaggtgctcagcagagcgcatgcgggggaatctcatttcccgtggcgggcgagtgcgagtcgaaaaggcaacgacgggcgctggaggagctgagagacacgcgttacgcgcgagaaagtcctagaaggaaggtcgcggaagcgggagacgacggaagctcgagaaaagacatcagaaaccggcggctttttggcgtcgagaaacacccgggacaggcggcgggcgagcgaaatggccactgcaacgagagcggcagcccacccctgtgcacacgaaggcacagaaacaaaacgccgccaggaaccccggaacgaaagcgaacgccacgcagtcctctctgccgagcaagtccgctgagaaaaaacgcacacgcttcttcgttaacgacactcattccagtgagacaaaaacaagggaacaacgggaatcaagccgggaagctaccacgcgcgaggtcgcgctgccgcgtcccgttcactgcacactgctttctggagagctgcgttttcctcctatatacagtagccagctgcgcaagatgagtgggaagacgcgcgggaaaaacacgccagacaccgtcggcggctttcctaagaagccctggatttctccgtgaaaagcagccgcagagaacgggccccgaagttccatatcggactcgggttcctgcccaggcagtctgaccaaggtaacgcgaaaacggacgcacgaggagcgatcctcgatgcgcgttcaactttttagaggggggctgatttcttccagctcctccctcgagaaaaagtgcgtaccgaattggtttccagccatccaagccggtttgtagacagaccctcctacagcagtgttccctcgtggggagacaggcgctcgctcgtggcggaagcgacgcctggaaaattcatcttctttttgtgacgccaacgcacgctttctccacaacacgctgaaacccagcgcacagcgtcaaacttttgacggtacggaaccgccgcccaccgagggaagggatagtagacaaaaatatgtctggcactcagcgggacagctacagccgtacaatcgacgctgtacgcgcagctgagcagtgactacgctatagatgtgtcgaacagagaatgaagggtccggaggaccgctctgttcaaggcatcggagtggcgtaccgccgccgagagctgtctcggacgccacgtaattttcaaagaaagacacgccttatacggcgtctacaagtttcccgcagtggttcacttctcgctgcctgccttttggtgaggagctggctgtgtgcaattgcctttcaaggagccggaagtcgctactccaccacaagggtacaccgcgtgtaagcggaaccggcgaacctaacgcccgacgcttctccaggaagaagtaacagccggaatccgtgctggggcgccttcacaactgcacctcatggagtcaaaggactagcctgcgccacctcttcgcgtagataaatatccgagtgcgctagcgtgtacaagcgtgtagtccacatcccgaacagtaacaccgtcgcaacaacacggcatcgtgccggtgtcatgcagtcagtccatgctgaagtggaagatagaccagcagcctgaagcatatccagcactccctgatgagttttgtcctctgcttgtactgccgtcatgggcagagggctcttcgtccgaggcctgctatagggaaaacttcgtgtggcagtagaggttacacgacactccggtaaccgacagaccattcctcgtggactcaatcgatcaccaatagtgattacgatagacttgcgtctgcgacgcaggaaggaggaaatcggtatttttgctttgaagaagacgccgtacttgagaggcgtgtctgtccccatgactacaagtcgctccttacgcgttaaacagtcactgtcgtaatgcggtggtgtagtgtgtgccaggctcacgtcgaaacaaacgattttctacccctagagaaagcactatgttgttttctccccagtcacgcgccgagtattagtacaggattagcacaaaggaaatgacttttcctttcaagaaaggcatcgagtggcaaccgctgtctatgcggtgccgtcaccctactggagggcttccaagcacgatcgttctgtattcgtcagtacgcggctgtgtgcggcgacgctgtgccaggtctttgcgtccacgttttgctgattttgctccgttcttccctggaagaagcaacttcgttcaccgctgtccctatttagaagcagccaccccacagaagaagatttccatcgtcggtgatgtttgaacattgtccctggcgtagactgcaacgcttgcaaaccggggtggtgggctcttgagtgtctagacagctggatgaatgctcccaaatctccaggacgccactaggctggcgtaatttcatctgtgtttccccagcactgaaagggggaaagtcctagggagggcaacagaggagcggaaatccgatgttccctcgtgacgtgataggctggaggtgggtatcgaactaccaactctgttccaatagcgaatcggacgacacgggtgccgtcgcgagacacgacagagaacagcggagcaaatgcgactggtcacatggcaaaaagcaaagagaaacagccatcctccagttcgccagttctgcagcttcacggtaatgtggcacgcccagcctttttgcgcctccctgtctggcctggcatcacagatacatgtgcggatctcaacctcccccgcccgttgatgcctacacaaagcggtatgccaagctacgtacattcatacttccatccgtcagagtagctgatcttgcaggtgctgaccagcgcatggctgtcggtctccggctgtcgaccagggcggcgggttccaccggccttttgcggcagcagcagcagcaacgggtctggggtagagttctgggcaagagggtgcatgcgttttttttagcttcgctggttcctcgcatcttgcacagaatatgctgctcgaaaccgcctcctcccctcaagcacacttcccctttcttagaggggaattttattttcatacacgtcctcaggatccctcttccgccgtttgtcgtctccgttttggcaagtcaaaatccgcgccatcgtgcgtccatcctagttctctgtcgcatgcgcaacaaagaaaggagccccgcacacgcacactcgagacaggtttgaactgtcgatgtcgtcttccgtttccgacgctcaatgaccatgtctgtagccttcgcgcagcatctgggtcattagtctatgcgcatttgcagacagagatgagcgggtgtacgaagcaccgcactgtccgccccagacgggcctttaatgtgtcgacggctggcacaaatggtgaattctgaaaaacctggtggaagaccatttgcaggtcgtgtctcgctaagaaaagggcacaggctccatcggcagcggaggaaacctgaacagagagccacccctcaatgctcgaaaagagtcgctggttgcttcacggctccccgtcacctcacacggcaatccagagaactcctcgcctggtttcctcgagtagcacctgagttgatcctctctgtcgctctccggtctcctcgtgtcttgtgtacttggtcagctttggcgacgaggaatcagaaa

SEQ ID NO: 1560 - DNA, 1881 bp, Toxoplasma gondii
tcacatttgcatcgttcacgaatctttgcatttacgcgacagcatgtacctgctgaacagctctgcagagccgcggaagctccttgtacagattcgccgcggtctccggatcgaggtcaaagaccgaagcaacatctgcctttggaatgagaagggagtgaccctcgactgcaggaaaggcgtccaagatggcgatgacatgttccgtctcgaaaatctggtcaaacacatttcagacgccatggggaacatgtgaagatcatttcacacagcagctgccagtgcgttgcaacccaccgaagaacgacgcgctatcggtgcttgttctctggttcaaaagtggtaccaagtgccggtgattctaaaattgaaaatcggcagtcctcgtgcattcccgggtcttcggctctgctttcattccagaaccaagggaatagcacacagactgtagatggcaccgaaaatatcttacatagtagacctttgcaagtactcaaagttgtgtagtttcgtagaagtacgggagagctgacgggctgaagcaatgattcaccgtcttgtgtgaaggacgtcagctgcgtctacaaatggtttttttcctatctgcaagtcaaaatcgtggcaggtggagcgccaaactagtcctttggcttttctactcggcttttttagtgaactatttattttcgcgtgccaccacgaagcattcggtgtccgcgcagtccataaccagtttctctgcgtgtttttcattggcctactgcacccccaagaagctgctcaaaacagtgtacgcaccttatggcaggggattttgccgtcaagaatctttttgaacacattttctggatcgtaggccacgatcttatggccatcctgcgccttggtcgccatgtttctcttggtctggtagcgccgctgaggaacgtttcttgtactctgtctagagccgcacgcgccgtgagtgagcaggaaagaagtaggaatatcgaaattcagcgctgaaaaaccccggttgaccgaagcttgcggttttgagtgcgagcaaggaaaagcgcagagcgcgcgttcgcgtcgacgtgcgtgttcctgcgtccgcagagacgagacacccgagagacggtcagaggccgccggaccggaaaagggtaaattgaaacggcgaaaaggaagtgggcagctgaaaaatgcagaaagtcttggagtttggagggacaacatggcagtagagagagttacaaacttcaaacaccgcgtcggaagcatcgcgacagcttggggaaagggtgactctcccaggtccgcaacaagcgctctgacttttgcccggacgcagcgtgtgtagatatgggaagctggaaacaaacgcgtcgaaagtcgcttagtaccgaccttccatgattcaagagacacacactacacacgtcaggggagaggagttcgcgcgtctcgttgacgacaaagagcgactacaccctaaaccctttttggtgacaaaaagaaggtccaccgcctgaagccggaagcgcgcaagagaaacaccagggtatgtttcgtttttgcgcaatttgcggttcgctggcaaaaactcatgtcgtgcagcagcactgctcacagtgggagtttggcttcggcttatatttgagcccccacgaaatcgtccccacaacatgccgacgtatgcgccgatatgtgagagcgccgcatgacctgcatggggggcagaaaagcgtattgggaagggcctcgagcaacaccggctctctctattgacgagaacacacttcgtgtccttttctgctctcctgtttcctcttgcgtgtctacgtgtggtgcgcatcctccctcgttgttatctcttttacgtcccttttgtaaaga

SEQ ID NO: 1561 - DNA, 1335 bp, Toxoplasma gondii
ctgaggaaagccaccgtttgagaaggcaaagcagcttcaccttggaggagtcccatccgaaactcgacaccgttccactcgtcgaagaacagactgctgaagctcacccattttgatgaaggcgctgttcttgtgcttgccagtcgccttgtcgcggatgatcaccgcctccttgacttcaccgaactcctcgaagatcgggcgcaacgcggcgtcttccatcgactgaggaacgcggccaacgaacaacttgatttcgacgcgcggcgccatgtggccagcaggacggggtacgccgctcacgggggcgccgaccgtcgcgccgttctccatttcgcctgcctgtggaattgcgccttccattttatcgaaacaaagtccaaagggaacgcctgcagacacaaaaacgcgcgaaaaacactgtcgcctctacgggaaatcgagctgcagcagacggcttctgcgtggtgcgctgcaaagggcgagaacaactcagaggttctgagacgagcggagcgcatgcacctggaaacagattctcaataaatgcttaaagcggggaccacagaacagtgaaacgagagaactaacggagcgcgcgacagcaagaagggagtgctggaacggcggaatccgcctcgtccggcagtgagcttcgctagtgcgtaaagttgaagcacaaacgacgaagagcgagaaacagtgacaatacaagcgagcaccacgcagtcgagactaccgactgatgttgtgaaagactgcgggttgcacggaggggcaggggagaatgccacgcgtgggagaaacgaggggaggagccagtatcgcgagtgaacacaggagacagacacaaaccattcaacggaaagagttaattgagaaagaaacgatttcgggacaaagcggccgaaaaagtcacacggggaaacagagcacagagcacagagggacggccgccacccgacattctattgcgcaagggaatcatgggtacacaaggagcgaagtggaggtggacactgaaagcaaaccctaatttgcgattctgtgaagaaagcaagcgaaaaaaacgagctccctttggatttcctacgtaaaaacgagtatgcaccagaatctggaacccctgcgacaaagtgagaagtcccccatcacctgtcgttctggttgtgttcgcccgcggaaggcacagaaattcccgatgttaggaatagaaaaagaggtcgaaaaatgcagatcgacgaatcacgggagagcgttccctgcgcgaaggctctctgagcccagggaatgtttcttgcacgaaactcgcgaaggaaacacaactgtcgaaga

SEQ ID NO: 1562 - DNA, 1491 bp, Toxoplasma gondii
aacggcggtggatctagggagcattctctgttctcttgacgaatatatatatatatagtcaatgatacgtcgttaatctgcatgcatattcgcaaggctgcggttgtacgaaactgtggaagaaaggagtcccacagtgcatgtgtttgcaagggcaggtgtccccgagtgaaggcactggcgtggtagacattccggagttctgcacgtgtcacacgttgagggaacatctcattcagttagctgtccgttctgagaagcctgcgagtgacaggatagtcgtgacaacgtgagcgcacgaaactcggtttgccgtagtgtcagaaacagatttccagtctgtcgattggcgggaaaaaacaagaaatagccgaagaggcggagttctggaagcggcgaaacgttccggagactcctcgatagaagaaccagtcgtttcagatttagaaccatcaatctaatacttaatgaaaggtacatagtccaaaccaggaccctagtgagttcagcacaagtacagtgagttacaaacatagaagataatggtactaggaagtaggaaatcgcgttagttcttccgttttttgaggttggagagtcggaagcctctggctagaccgcctcggcgcgcttaaaaagttgttctgttcgatacgaagcgtgggcgagcgttcagagacggaaatcaacagacattccgatatgtgcgcctaattgctggcaattgtgagtgtatgtgtttctgtatgcaatttcctcggtggtgcgcgtgggtttcaactcgacaagtgcttcccgtctggccagggaatttgtgtgaatcgccctgtgctctttgcgtgtctaaacgtgtgcacagaggccaaaaacagcgtgctctccatggaaaaccaagaaacattttcggtggtgttctttaaacgtgcagcaaaaactacaagttcgtccgctcttgcatcacgtttctgccggcgaaacgcgtgtccttgcctctccaaatgctgcagtgttacaagtccgcgttatggtgccttttaagtccaccagtcgttctgcgttaggttacttctacctcattcactttggtttcggtgcaaacgacttcggtaccttgtgaatgtcttcgttggtagtcagcaggttcatatccacaggtttcattccagttttccgttgccaggtagcctcctccacaccccttgacgctagcgcctgcaggttcgctctttctactttgctgtgtcagtagtttcggggaagccaaacgagatcgcgagacgagtatgtccaaacaaaccgctccttgtccaccggcgagctctccgtgcataccactttaccctctcactcttctgaagcagacgccgcaggcaactcatcgaagaagagaacccagaacgtgaaccgctccggaaacgcggaaaaagtccaagattttcttatcttgcaacagattccgtccggtctcgtgacatgcattggtcgtcaaga

SEQ ID NO: 1563 - DNA, 4895 bp, Toxoplasma gondii
agatccacgacagttggttctcgctcgcggttgctgtggctctctcgagcgtcgacacagacaaggaaggagcaggagcccggggcctgcggtgtgtgcgcccctccgaccacagaagcaggagactgtgctgcggcgcggaggaaaggagcctgaccagggaaggcctgaggctcccccgcttcagaaaccgttgacggaggcgacaggtctctctctacgggtccgagctgagctgcgagtgagctgggcaacgcagccggaggacagccgacttgctggtggatgattttccggtgaacttcgtcgaagaggacccgctgctgagtgaactgcaggggactcgaccgcgtacgaacaggcggtgtccacgagtagatcggcggctggaggtacaccggcggaagggcggcgtagtatcgcagctccgcctctgtcagcggaggcggcggctttctagccgagtactccaggtgtccaatgccggtcccagaggagtctgaagagcgacaggggtcgtcgcgacactggttagaactggggaagtctgtgtagctctcccaagaggatgaaacggatgaagcaggtgcaggaggagacgggggatccccggagaaatgcacctccgtggtagccatgctgctcagagagagggagtgcgcaggcgcatctgatgcggagagaaaagacgtgggaaccggccagaaaagacaacgaaaagtcggacatgaggggaaaaaagatggaggccgcccgctagatgaaacacgttatggaggagcggcgcctgccacaaaaagagcatgcctacgcacggtccaggacaggaagaaaacggggacagaaaaagaaagcaagactcagggtacggtgtgcgatgtagagatgaagctgcagtgagttgacgacgtacgacaaaactggggtcggagacccagcggagcttcacaagaccggaaacaagagactgcgacgcatgaagcacggaaaacatcaacaagacaatagtttcccacaatacaaatgtagcgagacatcaacagaactgggaaaacggtcaggaaagtgtggccgaggtatccgcgactgtgcttgtaaatgaggcgaacgatgacctttttggccacacgctgcatgcaacaaaaacgcgcctcctgaagaccagccttcagctttagacatcgtcctgctctgacgagagaaaagaaacggtcagggtttgacggggtttgtgagctagtgttagcggcttgttaggggcgaagtacggtgtttgtacagaggtgaaaccagaaagcctgtgacactggacttgggtgtgtagggaacacggtcacatctaggagtagacgggctgatactaagccattttgcaagaaagaccgagaaacaaagctgcacagttctagtgatcacaggaacaaagcgacggaaatccgcaactggacaagttaccaatccccgaagtgtgtgttcacacctgtcagccaaccaccatccgatcgcacagactaactgtgcctttatggcagatacacaagtgaactaccaaaacacacacatcatcagacaaaaacagaaagactcccagtcgtaacacgcgtttcacaaagtttgggtccgcatgtcgatttgcctccaacgagtgtagagcgaccagacagccagctgctctgcatgcacacacgtaacagcaccagaagcagcactcggcattcggctgctaaatcgacaggcaacatgcttgaggcagaatgtcctatttcacattttcgtttccttctcaccgtcatgttgcgacgtcctcttgctggagacacgtatgacttgtcgctgtgacagtcttccaaactgctatttcgcccctctatttaaagtcgtcatctggaaacaggaatctgtgcggtgtaaggtgctaaggtgccttcgtaacgacattggcgaggcttagtcacctgcagcagaagactgtggtggtaagcgaaatatacgaactgctgttttcactcaatttaacaactatagaagactcctcagatgatagcatgatccgtatcgtcgtcctgggagtcattaaaacctcaaaaaccggcaaacctcccggctgaaagttgggtttcaaaattgtacggcattaatgttattccacatcgggtacattgtacaagtgatatgtgatttactgttaccactcatatttgtagtgagagaaaaggaccactcagatgctagtaggatcagtgccatcgcaatgcgagtagtcatcgttggggcacgattagttgtaggcttgttcctgatagtatcttggtctggtacttgggatcttctctgaggtcagctgcaagcaaaggctctctgacacaagtcgtcacagctcctgcaaattgcgccaccacaaaagtacacgacgcatcagtaatggcagacgtagccggctgctcctcgctgagtcttggccttgtgttgtttaatttctttggaagacatgttcgggatcgtgcttgtttgcagtagacgcaagacaaattacaacgatccgtttcgcttagataactgccatcgtcatgttcaggacgacataacaaaaaatgaagggtgtagacagctcttaggtagcaacctgcaaattttgccgcagacgttccacatcatctcccttactaagaaaaaggggtggcggcacggtcactaaacatcgaagccacagaagccggatgcgtgctactaagagtcatatcatgggccaccaatcatccaagaccgatcacaaaacaactgaaggtaaactccgtgctacacagtagataacggtagctatacctgtatgagaactatacattgtaggtagtgtacactacgagttcgaccattggttcaggcattgaatggttgtttttgtcggatgggagctcgactgcttttctagggcacattcaagatgatgaaaacgaatgtagaaccctctgacgaccgtgttttaaagttaaagtcagacacatgtgagaaattcaaaaattcttagccagtagcaggacaacccatatgattgagtaaagtgaagaaccaaattcgccaagagttcatgtatgacacgtttctggaagagggcttcgctataaaaaaaagcctctgaatagggcaacatatcacagcattctcaagggtgtcagtctcaaatacgtttgttatttccagaaactggtctcagagaggctgttgtttttcagcttatgttgtctagtagcaagctcccctgagactggaattagtgcgacctcgccggtgaagaccaagatgtactatcctggtgggggtggcgaacgttgattgaattcacactgttggacaatgattggaggcaggttttgccatactgtatctcaacgggtgcttccactcttcatttcctgtaagcatacatgaccctgggcaacagagccatgctcaaacacatcacttttcagctgtgaatcttcttggaagagaagaattattgttctcaggcaacgtttcggcaattcgtactcgattatatatgttagacgccaacttccctgcgaaacactgacatattaaaccaggctgggatcataaaactaaagtgtttggttagaatgactggctgctttcagtacttcttattcggcttgttgtttacatgaaagagaggattaccgtgcctggcaactcggcgtatgcgcggcttgcgctttgacatcgactgtccacaaaaatgatacggaaacaaacatcaaaaatcagccgacgatgatgagttaaacgatgtcaggagaaaataggacattgtaaggggggcggcagttgccaacttgtagcgtagctctggtgggggaggattttagtgtctcgaaggcagcacagcttcagcgagatccgtccgcgccagcaacaaagacacctttacaggcaactctccttaaaattcctttctttctccgtggactgccggtagatcaccttccttcaagcataagacggactcgaggaatgcgttgagacttcacgctgaatacccaacttgtgcggagaatgcgcacacggtgtttccttccaaaccagttatagatccagcggcgctatttcagcacttctgggttgacaaccacggcatgtggacgacaccagcatatgaactactgtccctttcctgcaaagcaaagctccacaagaccttgtctcttgtttcttaagttcgagaccccaagccaacccagaggttattattctcattcacggtctccctgtgacaagctggagtggtcacgaacgtcgacagtgaagaagctccagttgcgaacagtaaagagaatttctggatctgttttgttactggcgtggcggcgtcgttacggaaacttcttgccagaggcactaaccaacgagcaacggatgagatacaggagctgatgcctctttgggatggatggtctacgaatatgaataggtgcatatcacacagaactaaaagagagggaagcgtattggatagcgacaaggattcaaaattgtacactgccaactgcgggaagcgcatctctcacttgtgtggaacgagaatgacgcatgacttttgcgtttagcttcgctatttcggcaggcgtctctacatatgcgtcgctgtgggcaggaaaagctgtttccctgtcatttttgtttgttgtgactggccttatacaggccacttgcgagtgtgatgtcgaacagcagcaaatgaatttataacgggaaaggatatgccgtgtcagttaggcggttggtccgcgtgattggataaacgtcgtgaagcctacgggaacatctggttggtttgtgaattccgtaagccacttcgcccttttttggcttgtcacctttcggcttcctgttgtgta

SEQ ID NO: 1564 - DNA, 1805 bp, Toxoplasma gondii
ctattatgcatataacagccgatgcgcagtaatcttgatgtcgtaggggtctgaaattcaactccgtacgttgtctttagcagtccagtggtgtgcggaggtgtacagcaataacaaagaacgtggttgtcctccttcctcgccgtccctcatttgattccttctaagtacatgtacaaaaaaggttgcttctctggatcccgctgcagtcactaggcagcgcagcacatatccgcctgtcgtacggtgacaacttacttcttgattcgtttccttttatggtctggcggtatttatccctcaacctgtatttccgtttctttcattcttgcttgtttccgctccaccttttctctagagctgctcgcctttttctgcagctccactccgggtgcctctgcctttccctttttcttgcgtagcgctgcctcggagacctcttccattttattcgaaggagcaaacggcaaccactgtagtgcacagagggcgtactgctgacatagaatggcaaaaacagatctgctgaccaacaggaaactgtattcagtgtttgggaggtcgatagcctttaggtacatgtagtcattgaggcctcccctttttactcttaaatattactttaccccgaagatcgttgtatgccccggaggaagaaacgtgggagaagaaattgtccgagtttttatattcaagtgtgttgctcgtctgcgttggtgcagaaatcgtgaatttggttggtttgagtttcctgccgtccgccgatctgcttccgtgtaagtgaaggaggcgtactcacatgacagacagacgacacggtagaaaggaaaagaaagaagaagtgcggaaatgtaattagtgaaaaaactgtttgtccgttgagaaacaatttcccttctccctccacacgagataaaacgtcgtccttcactggatcaagagcggattgagtacgctgtcttggcaaaaggaatgagaaacaaacttccttctctcacatcatagtcccgattttataaatcatcttctcaatcgtcctgtcaatgtttttacgttaacctaagcgcatgtcgttttcttccactacatgcagaaacagtgcatgctgcacagcacagtctttccttttgacgaagcagtcgcggtcacttacatgttccacctctttctcgcttctcgtccttgaatttaacaatacttttaccgccaaaaccttttatctttcgcgccacattctgctcttctttctttttaagctctccttaagcaaatgtctcgtgctcacggttcttttggatgctgcatgctcctcgtcgatgactcgagacgcaggcggcttgctgtttgtccccagtgttttttcacagaagccgagccaactactcatcgaatctcccctgtagttctccgcagattttccaacaccgtacaagggagaccacgaggggggaatagccgctgcccttctcaagagcggaagcctttgggcttgcgtgtcaattaagttcccgagttagacgtcgagcaccgagaccgtttttgatggctgtgttttgcgttctttctcctcaaatgtgagtccacgcgtggcgcatgtgctagttggaattctctacttcgggagatcaggtaatgtcttttgcgcagcactctgttcgtgacccggcactgctcggttcattgtctttaaaagtcctcattaaaaaatgttcagtaaaagtcgccgaaaagaaacgccttcccactctctccccaactaggggcttccaaaaagctctccacggggggctaggcagatcccggta

SEQ ID NO: 1565 - DNA, 3514 bp, Toxoplasma gondii
aaatgcagttgtggttattaattgctcgtctacgctgctcgttagactcgctttcttcgtggaaacacacttttgcgtgccattctgcctcgcgaatccgtgtttccaatggttaacagcggtatacaatcctctcaaaagacacgcagcgccacttgtcgcggacgcatgaaaagttccatgatgccgctctattatggaaaaaagaacggccacagtgagtccacagcataccccgttgctcgcaactcgtgaacccgatgagcgtagtgacagccgggtatcgtgcatgatcctcctcgcttgacattggggcaaagtgacgttttcctgagatctgggcactcgcgcagctccgacaaaccgtgagcaaattgacaggcgagtcccctgtcacagccgcctttgtgataccatgggcatattttggtctgagaacagcagaagccgcaaaactcgtacgccacacaccctgaaccagccacccccactttcctgtatcgttacgtaaaagcaaaccacagatcgatgcttgaaatgttttctcaaagcgacgccacacgacggacagttctttattgtcactctggagatccaggaaacactccaagactcgtctgtttatgaatgacacattctacccgatacagcgccacgactgtcgcacactgcttcaacaacgacagctgtatcaaggaatcatatctgtttcacccttccttctttttagctgccagcctatattcggtccagctttgctgctctccactttacggcctccgtctttcaaaatgtcaagcgttactaacccgtactatacagaccccagaaaacggtagtttctgtaagcatagggatctcattgacaatgggcaatggggagtctagattcattgttatctgattgttactgtatgtcctaaaggctattcacactgtgcgtccatccgcgaagcacctgacacactcaatccgcaagcacgcaactagctcctttactgatcctcttccttaccttgaaaaactgaagcttccggggtgtttgtgcacactggaatcgagctgcgtcagagtcgacggagccacggttcgtccccgaatggagtggaccccgcgtgcctttgcccccgtcccttccattagaatgaactccgtctttgaccaagttgggcgtgaacgaaggtgtttgtccaacaatattccctgactgatttgccaatgtctccattcctttaccgctcatgaggcgactacgccccgctactgatgaaggcggcatcgcagttcaccgctagcatgtggaaacggagaaacttgctgagaaatgcaataccgttcgcacgaaatctgcaatgcctcgacgtggtacggtttacgaggaactactacacgcagacataacaaagaaagcggaggtcccctgtctttgcccacggaaacgctagagcagtcagggagacacttcgggcagcctcccgttaaaaatgcacgtgtcggttgagggacgcacgctctcaaagattctcacgtcaggtgcatagtttgcgatgcaggtgcgttctgctgctgtgcacgatgaacccactctgtcgtggcaccgacctcgaagccgatgacttccgggaccactgagatcctacggttatcagggcatgatatcccgcgacgtcgtctgcagctgcaacgaacttcagtctactcgaaaaacaaagtctatggtcattactacaaaccgaggaatggcagctcgggactgttgcgaccccgctcacaacaaacatcttcttagcttcggcacctgtgttcctccacgcttggtcctggagaggggggcggctttcgcgaacacgggctctggaacctcaacgctccgtgttactgtctcaaaaataaaatacatcggtgcctgaaccggactcctttgctccaatttcacagcggcagacactgtcgacagaggatcgtgagacggttccctttgagctacctatacgtgtttacacttcgttcagcgtgtgccgctcactaacgcgtttgcaatttgcagatgccctttcgaggtagagacaaaaacgagggacgtcacttgggtacacgtacccaacgatgcccagtaaatcccggtgccgtgaggcggagcacactgccgtccgataaagcgctgcgacggcgaggtcgccggaaagcaaattggtacgggttatgcacgcgaatgacggaaaggcgtaagcagcaaaacagacccctctggacacagacctcgcggaaactgaggaaaaatcggcactcgacgtcaaaaaccgctttctgccacttagggcacggtacagacgccgcggtggtgcttccttccacactgctagtcgggggaacctgcgtggatatgacgcttctagaatagacaaacccaccacaggtgtatgaaaaaaaagttgaggtgtgacagcaagactcaagagacgcccgttacgaagattgacggcgcgcgccgcccctccctcaagaaaacggagtttggtggctgtcgctcagtggtgaagcgtcggggggtcgcggctaaaacctagcaactcgggctcacagaacagctattagagctgctgaaaacgcggaaaactcgaaccgtacccatgcacaataaattccttctctgattcggtgaaagcagtcaacgttctgaacacggttccttccatgccagccccggcagctgccgaccacacagcccagtctcatgttgacgcggcaatgccgcgccgtcgcatggcggctccgaagagcaaccacctcatcttgaacacttgcagttggcaggcaagtccgcagaacggtcagagcccagaacctaaactcatggcctaccttgcagacagtgagggcggcctgtatgactggcgggggttcctctaatttccattgcagcagccgggcagtcagggggtttcctggagcctgttcagtggaagtgacaccgtttctatcctaaaatcttcttgagctatagtttgagggcgttaaggcacacaagatgcccgcgcccacataataggcgtccgttgaagagacgaggtggaaaaaggtttctttaccacagcggggtggcgactttcaactcgcggctgttacttggggggcgtgagcacttacacgtcatgtctaggtttcgccctccagagcgtctgtggggtgccctgtgacacggaaaatctagaagaaatacacgtggacacgcacaaaagacttctgggaaagagccagcttgtctgtctagattatcagctttatcattttgcatagaacaactcaaccaaggtgtggaggacaggaaggtggacccctggctacgtgtgcggaattctgtctcgcgaaaggtcgttcaagagggggcacggcggagcactgatgacaagcaggcatagagactgaacagaagtacttgagccaaggaacttggccggcgtttacagctgaacacagtccggcagcattccaagataacctggcggatatcaga

SEQ ID NO: 1566 - DNA, 4205 bp, Toxoplasma gondii
tagagaagtcagacgacgtacgaagacaggagaaggccgaagagaacagaagaggaaagaaaagccgggtggaacggggagactcggagagcaagcaggcgacgaaaacggtttgcactgaagaagagaaagacaaatgcatgcaaaggatgtgcgaaagtgaaggtgaatttccggagtggacgcagaggacaaagctttctcaggaaaagttcaagtctcggacaaggagaggagcaggcaaggcgacgcgacagccagcaaccggtcagctgtatgagaacgatacagagagcgaggacagttgttggcgagttgcggtcgcgcggcagttgtctcacgtcctctgaaacgctttgacgcgctcgcgaggtgaatttctcctgagattcgccgcagaaaagtcagcggtccggactttgttacgtcgcagaaaactcggtctattgaggcgctgaacgtctcgcacactgctcagccttctcctcgccttttctttcttctttcggagcttttttcgctgttctctggccgtctgtttcatcaagaagcgaacccatcaggagtctgaaaaaaaacaattttcggtccccttgctgccctgcggctggtccagacgcttgcaaagaacttctccggggaacttgtgcgcgcgtcagttcgctctgggcagatcatgtagaacggggagagaagcctcactgcgaggcgagaaaaacgaggccagaaagagtctctaagaaggcgaagcgggagacgaacaagcaggcagcaccggccgagacagggaggccgagcatggaccgcgagaggaaaacgacgaggggaagaggcgcagagcaacagctggctgcggagaaagatgaatgcgcaggcatcgcagagccgaccttgcagaaggaggaaaaaggaaacttagggagcgcaaaatccaaactttctcccctccctctcgcgtgcgcttgtcgagaggtgagggtgacgaggtgaacgagcagcagaacgaaggcgccttcgcagaaacacacacaaaaaaaacgaggacatgcgcaattcgacgaaaagaaaaagtcacagtcgaccttcttgcgacacgggccgcgagctaccggccagacgaagcgaaagtgcatgcgtgggttgagaaaaaaggccggaccgtccgtcgtcctcaaaaaacctgagtgatggctggcgcacgacgaagatctctccaacttcgaggtgtctggcaacaagcgaattccccgaaacgctacataaaaaataaactgtcacatgcacatgccgctcacactctaacagaaattcgcagacggaacctcagccacatacacatgcacatgaacggctcggctgcatgtgtcgcactgcggcccaaatacactttgtatatatacagacatacatgtctttagtggtggtacggcaaccagcgcgatgagatgacgcgtggaaacttttcactcgcaggtgttgcaggaaatcaacgacgtcgaatctggtcaagatccacacttgcctcctcgatgaaagtccagtgggtccttcccgtagaccttaaacgctcttgaacagatacgtataaatttgtgcacgcatcaggatgggcaaacacacagcgactcatctgtggtggtgtgagcagggaagtgaagttcctgtgaagcgtttacgtcgaaatcaggtgtatgtacaccggactgtcgccaccgccagacggccgagcgcgaaacagacagaagcaacgcctcgacgcttcgttttccgcgcatttcctttcgctccgagatccttttcgaacccgcacgttcgtctttcactgctcctccacggcctgaattgcgaaaaagcgttcactgctccggcaacttcgcccggtttccagttcctggacagtctggcgtcgccgtgcacagaccagcgtcctctacacaacaagacgcagcgaaaaggcgcccctgagaccacaaaacgtacagatagcaatctccgaagatacaagacaccaaacagtcagttaagagtgcaaaacaaacgtgtgtttttccgagcttcatggagggacctgtgtttctacgaaggcgcagagacgtttttctctttgcttccattgtgtgacagaaacagtacacagtcagagagcgtcagaaagtgatgcagaaccgcgcgacaattgtcacaagaatctgtggaaccggtttagatacagactttgttcgtcattttcagcgtctaggcgtgtacttctcgactcctgcaagcagtattattccaccaaatttgctctcttccttattcgcttagatactgactttcctttgttaccggatacgttctatgcttgttctgaacaagcactgtcagacgatgcacgagagttgcatcaagttcttggcctggacgtgaggaaccgctcttaaggagagcggttccttcacttaggcaacacgacctcaggtggcgtcaacaccgcacggtggtggagagagaaaaggtattcgcacgaggtactgtagatgctttaccttttacgcgatggagacagtggggaagagaggagagaaaggcggaggaaggtgagagacagactaatggcgagaagcgaaactgagaggaagaagagaggagagaagtagaaagaggaagagcaaaaaggttcttcttaaatcaaataaaagatgtcaaactgagtctgtctgagtttcactccaactcttccagctcacgataactcgttcaggtttctttgttcgactcttgtccttcctcgcctttcttttttctgagagaacgggaggcgtttctcttctgcaattcctcgctctgcgtctgacagagagacaacgttcattcttctcgcggatccacgaacttgttttcttgaaagagaagcgagtgttcttctctgcatgcatctgcacttgaagcatcgagctaaaggtgtctctgcatctgtatgcataagccggaaatgcgtatgtgttggagtacagagacggcccattctcagagatgtaggtatatatatacacatgcgtatagttgtcagtgctcactgctactttcctcctgcgcacatggatacgcataggcatactcacatacacgagctgctctaagcgaacgaatctatgcgtataaaggaagcgttgtattgtatgaaattggcaatcgacacaagtacatacgcatattatatatatctatctatctatatatatatataggatattatatataaatagatattacagatattatatatatttatatatagggaagtcgggcggctgtctctgtctgcacatatgtgtgttgcacttgtctatttgtcttctttcttggagagaaatgcattgcttggccttcgcgtttcctgttttctttcagaaattcgaaagaaaaacctttttctggtagtgagagaagaacgcggcaattcgagagagacgctggtggcgtcgggggcgcggggggaggactgaccggcctctggtgtgttgccgcgaggcgagagtgcaccctttttttccgtgagaaaacctggttttctatcgcggcccaaaagtggatttgctgttcgctgcgtgcttgattctcttttcttctttgtgtttctctttcctcccggaaggttgctctccagccggtgtgagtgtgtgtgtgtgtctctagaggattctccatatctgtctctcacgctccggtggccgtttttcgtctgtcttctgcccgtttccctgaaaagacggacagagtgttgcagtctcgttctctgctgtgtttcttcaggcgaagtcgcttgtatctcggatttcgcggaagttctctccggatgcactcctgcttttctgcgtttctctagcagagcaaacagacgacgacccgcacagcgcgacacggcagagctgcggcggaacaagtcttgctcctgagtcgctctgaaggcgaaaaaagtgacgtgcatgcatcttcgtcagacacaagcaacgtccgattttccaccctctcaaagcgactctctgcgcgccggaacctctcgccgcctgctggtttgcccttcgcatctcgaccttctgtctcggcgcgtaaagagccttttctgctctcgtccttcttcgccttcttcgttcttctggcctcttcctcttgtaaattctgtcacctgttcccccaaagtgtctgcctgcgctctccagaaa

SEQ ID NO: 1567 - DNA, 3380 bp, Toxoplasma gondii
tattcgtttctgctgcgaatgtgtatcgccggagtcatgtgtataaaaacaatcatatatatgcatatatatatatatatatgtcagtgtgggtatgcatgtatatatttatatattaagttggtgtttgggtctggggatgtgttccgtgttttctgtacgatttgtgttcgctgatcttgtttcgctgtacatgagctctgttcattcttgtcaaagaggattaatcccaatttcctccaggttccgcacattcactgtcgagtcgacggtcacgaagtcacttcccttccgcatagttttctgcggcgctctaaatcgcaaacgcgagccggagcactcgatgagaggagcgaggacaggtgaattgctccagtgtttcgtcgcctttcctgcctccactttctcttgtgtcagtcctttctctattccgtccgccctttctcctctgaacctcaacacgcgcactcgcatctatttatatctacatacatttggagtgagcaaagtgcttggaacgcggggtagcaaatgcagttcgcaatatcagcagatgtaggacatatctgagcaggcgggctatgctctcaccaagtgatcgaagagtaaatgcgtctctgcacagatttagggatttgtaaatagccagcgcataagaaaaagtctgcgtaaagcgtgagtgagaggaaagcctgagcgcgacctgtcaacaatcgacactggtacctcaccatgttgtctggtctgtttagtggaacgccgagtgtcgaacacgggaatcttgtttcagttccggaagtggcgacctacagagaattcttttctagacgagaagggaggctccagagagaaatgaggcgtttgaacactctccttgtgcttggggagtctgatttgtcgctatcagcttttagtcatctttcagttctacctttgaacctgtagctcttagtgtaaattgatgattcaattcgaaggcacattactcaattgtgtttgatgtcaaaccgatcgctcggtgcacgttatctgttagaaaagctccacttccctgtttacgttagcttctttgcgacgaacgtcttcaacagcgagcgcacctgttcgtcgcagatcttctccagatcgactgggcggctcaacagccaagatacatattcggaacgttcgtttaggtaaacatgcatgcattcgtgtgtgatttatgtggtcgtctgtatatttgcgcgtaagtacctggaactgtactcgcacatacaaaaaaaacatttttgactctatttgtagagatacgtgtgtgaccgtgtggagagcgaccgacgggggacggcgcagatgccttgccagttttgactgcttttaaagaactttggaatttgttagatcggacgactgcagttcaacttccccttcatctggaagctgacgcatcccccaggcttttattcaactcaaattcgggtcttcctttctgtcgagtctcgttcaccgtgcatgccgggtgacttacgctaagatttttactagtggggaacatagatgccaagaccgcttcaagaggcgtggattcttgtgcaagaggtaaatcctacatctaatgcccgacatctcacatgttttgtcgatctgctgcgtgcagacgtaaaatagaaaggcgcgctttcatgtcgagccatgcacgagcagcagttgacacacagtccacttttcaggacacggcagcccgcaaccacgagacggcggccattcatgtggggtgagactgtgggggccctcgcctgtttgcggagaattattccaagggatttgcgcgagtcgacaggccagcagaaagaggtgtttccaagtttctgaccttccagcaaagattctgctcgccgacaaagcgtcgcggcccggacgcgatcggcagcggtcccgctccagaggaacggctgcaggtatctgttttccaccccctcgtttttccgttttcgcgtttccccccgattccgtagaacgtttcgcgggacggagacacagctgcccgtgtcgtgctcggccgacctcttgcctgtgaaaagcgttttcgtcttgttctttctagcgttcacgattcagcgttatcgaagaaaagctatccttgttgcgcacatgaacactggagagaagcacccgcacggatgaagcgccttttcctcacactccaagcgcttcctcaaacacacaagaaaacactcaaggggaagagctgtgtggtgggtggctttgtatcgtgggcactcgctctatcgtgagaagttcgtagacttcgctgatagaatgacggctcgatcttcagcgcgtgactccagaaagaaaagaatcaaccgtcccttgaaagcatgtggcacacaaacatcgcaacaaaacacctggactacgaaggtaaagaagcaattccctaggcaagcagtttttttccatctttcacctttcctctgtagaaagaactacaaacagttgcttccctacaaaggggagaccggcgcgaaacgggcacatttgagaatcatggatgaaagcatttcactgtacgcgttccaacagtttcatcccttaggggagagacatcgatacacagagaaactacgtaagaaatttggcaaatgaataaaacatttcgctcattcaacggatcacgcatctatacacatcgagagtgacaaatagaatgattcacaggtatacgtggatgtgtcaagctacatacaaatatatctatagtgttctagctcagactagagctattcatgtataaagatgttaaacaaaatccacgaaaaaaaactgaatcagcgcgaaacgtgtcgtgtgtttacggggcatctctgttgtcattcttcctgtgtgtgggcaccgagaaggttgacctctgcgatctataaccggttggcgaggcgctgtgctcgtttgtttcacctcagtttcacgctgccgtaaacggcgcttcacccgttagtcgtctctcgagttttatcctaaagatccagttttcgaggggatcctctgcattgcgaaatgagttcgaagcccctgcagggtttctaggtgtctcgtcagtgctgtaatcgtgttttccgtgccagcgccgctgccccttaaatgtgtcaagccttgcccctcctttttctttgctataacgagccatcaactctgtgtctccacgtttcaagacttttcacgctgtcgcttcttgtggactccaaaggacttttgccaaagtgggccttacctttcttgtcttagagagcaggtcctcagctttcgggctctcccttctttgacgtttctgcctttcttctacctcgttgactcgcagtgcagctccctgtctaattttccaagcacagtccacaaaa

SEQ ID NO: 1568 - DNA, 2347 bp, Toxoplasma gondii
acgtacgctaaatccagttgagattcctgaacgtatgtgcctatatgcacctcttagtgaatgcagcgacatgcatgtaaaagcagagccgccctgtatacgtgtgctgttcgtcctccgtgtacacatgtgcacttccggtcgtctgggaaaacgctactcatttcgcgcgcctgtttcgctgagttgagttcagcgcatcttaccctgtttgggatcgggtgtgatgagcttgctcatctttttctcgcacttttcgcagggcatcttgagggtggatacatgaccagcgctgcggactgaagacatgcatcccgactcacacaggcactctagaggtgcaaagcacgctttccagtccaagtgtatttcacaatgcactcgccgtggtagacgtcctcgtgaacggaataattagcagtctgctgccaggggaaaaacaggagaaaagcagccacagtgcacacatacgatgcaaagttcgacgtgggagaccgaaaagaggagacaagcgtgagaaggagtagaggtcgacgtaaccagcagtcaattctcgaaggtcacccgtccgtagtgccgcgaagaatgagggctcgagcgcagctaacaagaacatgtaacctaatgaacccacctcacggtcctgatttaacgcaaagggtcggctcaaacggataggcgcctcttgaaaacacagagtgcctggcggcgcgaggggtcactctctacgttacagagagaaataatgcaaaccaatcagggggtttacagtcttgaggaaacatcgtgggatggtacgagaagtgactgctcagctaacatcgagtgttttcagtggagcagggcagaaacgtcactcatgaaaaagaagtcgttccttcaggttcgcagacgatcagagtgcaaggagtgagccataaagcgggggcaggctgaactcgcggacacaaacagtctctgcacttggtggaaggagaaaagttcaccaacttcctcagaatcatggatgtggaaaactctgctgggaaaatgtgaatttcagggcaactgaagaccaaccaccgtaccgagaaagcagatttgcgggtccgcggccggccaccgagtgaactcggaatcttttacggcagtctgttttcgataagatgctcatatacgtcaagacagtgctggaggagcaggaaccgatatatccgatagagggaaaaactgttttgtgctggacagaatgccactttcttgatgaggggtcaaggagctcgtgggccaacgggtgccttgagtgtgaaaagccagtcgcggtagaagcaatgcggacagctgagcaatgtcattcctttttctgcactttcagatgtcgtgagaatatacaagacgacttccacagaatccgttagacacagggtacacagaaagcccgttatcacttcactcccttgctccaaaaagagtaggtttctcctgtcgacttgctcgttgcagagctcaaattggtggaggctgtctttggtgattcatctcagttttctcatgcgcttgtctgcccgtcctgtatcttttctaaagacagtggtcactagatcttcccttttccccttacggtacatcttctgtttccttggtactggctgtatttttttcattggatccaaaactcatttctcaggtttttcgggagttcttgtgtcctctctacaagacgtgcaacgatcgcttctcggttcctaccctgggccctctcccgccctgcggtccagcgcagcattgcctctctagggagcattaatgaatgaaattaaccaggaatcgccagtcttttgcgcgtcgtttttactctgttctcttttggtgtacacatctttgcgttcgtaacaggatttaattttcctgcagctgttgctcgctcggtgagaaacgggccgtctcaagccgagtgctggttttttaccaacaaaatatttgtaggacaatcccgctttttcgaatcttcgtgtagcttgcgcaacttaactccccttcaacccatttgacggacgagatcccctgtgtccttccgagcggcaacccccttgctcgaagccacgctctctcgtctgccctcccagtgtaaaataagaggcgtgtattggcttcgcctcttttcccaaacgcacctttcctctccatttgcttgctcgtctggcgtgtcgaaatcaattcgcctctttccttcactcagaatttcctcctcattttcgcgcccaaggctgctcgcttgcctgagctgtctttgcttcggttcgccgtccgtttctgcggcttctctgccttctacatttggcctttttttgtcgagcgtgttccaaaa

SEQ ID NO: 1569 - DNA, 1699 bp, Toxoplasma gondii
tttctgttttgtgtcgccgagcctttcatcttcccagcttgacgacggcgacagcttgagtcactttctctctgaagcctgccgtgacgcgtggaaccggcgcccttcggtgcatctcgagatgcttgcagacttgcagacttcggtaccaagcaatgcctgtgttctgcatcaagttcatgcacagcgcagtcttcttcccctccagcagcagtcctttgctctcctgcagacgccgagtcgagacacagatccagacgcgaacctcgcttagcaccgaaccgacgcagacatgcagccaaaacagagaggtcgacgcccagccgcattcgttcgccggtctccccttcaaactctatgtggagacacacacaactagatgcatgcacaagcagacgcatgcacaagcagatgcatgcacaagcagacgcatgcgcgtgagtacgcgacgcagagtccctgatacgcagatccagcttctgcagaggcctgcccacagctgtactccccctcgggacgtctctgtctgctttctgcatctttacctctcccttcctgtatcttcactactctcagtctctcgctctatttatctatctggacgtttagatattgacaaatctacaactatatacaaatatatcgatatatacagagagagatacacagatatgtgcatgtagagaggaagacgaagagaggaaataaagtagagacgcggcagggaggataaataggttcagaacccccagaggaaaaggggagaaaaagtttaccttcatttttcgggcgttctttgccgcgagctttgtctgcttcttcgcctggcgatattggtcactctgcagcagggaacagggacagcgaacagcttttcagaacgcgagaaaggaggtgcaaaaagaagcgcagtacacgaggaagaagcgcagaagaaagtcaccgaaagcaggaggccctcttgcaggagacgagaggactgcagccggaaagccttctggagaggaggcgctggaagagctggacgatttgtctctcgcgaccgtttctctcggcgagaggaactcacctgcttcactccatacggcactcgcattttgtaggtgatggctgaaagccaccgtgaaagaaacatcttgtctcggagagagaaaagaaccgccgttatcgccttccgacgaaagttggctcgaaacgccgtctcctggactgtgcttctcagcgatttaaattcgagagaagaagcgcagcgcctccgacgccgacgagacgaggggggcaaggcgcggaagcgagaaggaaactccaaacgcaaacgtggactgacggagcgtcactgcccaaaagaagcggcaaagagatacacctttcgggcgctgatgaagagttcctaaagcagctggtacaacgagagaagcagttgtctctgaggaaactttcaaggcaagagacgatctcttgtcaacaggaagttttctttgtcagtggcgccctcccccgtctgagtcgaccccagggtccctccctgaggactgaccatactcacactcgttcctttcggaatttgttctgaatcgcgattgacagaccaaagagaaataaacggcgaaactccgcggagaagcgaggaaagtcgaaaaaaacaggacgcctgcccgcctcgcgtgagaaaagccggacgcgcgctgttctcgagaca

SEQ ID NO: 1570 - DNA, 4372 bp, Toxoplasma gondii
actttgaaagaactgttcgtgaaggtgtgagtctgcaaggctcgacgggtgaacctccaggtgcccctgtgtggaggaaagcgtacctgccggaaccgggtcctcaatggggacgttgtacacgatctgtggtccactctgagtgttccccatcttgtcttagccgctatctgagacaaaatgcgaggaactgaggaaacggaggttgcaccggaagtcgttcttcctcgaagtcgacaggtttcggaaacaacacagtacgcagttgagaaacactctctccttggcgagacagcacacacaggcgacacatgaccgacaagatccggtagaaaaaggtactccctgcatcgggaataagcagagaaacaggttttcacatgaggaactggcgacacaccgtgtgcacaagaacgcctctcgtgtcgcgcgtccagactcagcaggcaagaaaagatctacactcagagtcagcgtacaacggggatttttaacgcgaatccacttcgttcgcgccttttgcaggacgaaaacctacgcgtttgctgcggaggatctgtacaacacaacctaatgagatgtgaaaaggcaagacagcccacagttctactttcgtctggcacacacgggagatgaaggaaccgaaacgggaagagagagtggtaaaagagcgcgggacgcagtgcagggggaaccgagaaagaaacgacggaccggacgcgtaacgcaagagccacagatcatcggtacttcctcgacggtgcagtgtacggatacctgggcaaccgccagaaaaacgaacgaagccagactggcaattccgaacggacgggacgaacagctgggccgaaaccagagtttggccgttttctccacgaccacctttgcgtctttgtgtgctggttcgccggtattcgttgtcccttcccctcgtttaccgtggacacacagtcgccaggaaaacgcttaccacagaaaaaggtcccttcgagggagaacaggaggaatgctgagatgccagtccgaggcgcagcgatgcctgagaaaagtgccccgagagacaaggaccaggaagaaacgagagacggaaggagaaacggtactcgagaaccaggagacgccccggggaagacagcgccagggaacgcgatctgttttcacacgtgcgagaacgcagacgactaaaccgtatccccagactgggtgcgctaaactgggagagagctgtctccccgggaaagaacctttacgggcatctgtcggctcagaaggaacaaccaagactggacaaaagcagaagaatctgacgaaaagaaggcgaatcgggtgggccgtctccgtcgaaagcagtgctgaaccagatccacaaaagccaggttgcacgaggcacgaatccgacgtcgtcctggttgggaaaaaaagcacagccacctggaaatggcgatattgcccctcttcctgcaagaatgagcccccttttccaaacgaaaagcgtttcccgaaacttcttttggccaaggactcgcatctgtgcagcccctgctctccaccatgcggttcgctgtcactcgcgcgacatcgcagctgcatatccgcggccctgttccacctctccgcggtcacgtgtgtcacctgtcagtggcgccagcaagacacgtgcaacgtagaggggcccaaccagaacaaggagcttctccggaagtttcttcagctgacagtctctctgcagaaagaggtttggcgttccggcccggcttctcaaggagctggtccgctctgcaggcaaactaccgatgcagcgataccatactcttgcggtgaccccacatttcgccacatgtctgtctcacgatgttcaggaaaaaacacctgttcttctcaatcacggtgcgtctgaggaatcctgcgttcttctctcgggaaggccgtaccactttatgcgttacttagaaaactgtgcggcaactacacaccgccggggaactgcggtagggagggtgcagaattggaactggtgttgttcactcgcattcgaaatcaaacatgtttgcggtgttctgcgaagttgcctctaatgacttagatacagtgaatctgttcaactgaaatggcaaaattactggaggaaattcagcactcaaatgcaggagacccagcacagacgccttgccccatttgagggtcaccgtgtggtgctggcgcattctcattccagcctgtgagaggagcgacacgaatacactttgtgaggagcagtgaccgagcaattaggctagagaatccgtcggagtctctgagagtctaatatcttccttacagcccttgtcatctgcacccgtaggccaagccagatgtgaactgcggtggaaatctggcggtgtctgttgttggcggaaaccgtaaatttggttcaaaggaatcgctgggatacagaagaaacatgttgggagtttccttttcgtgcagggttgccattttcaacagacttcgtgcaatctactactaggcgtcgggaattcctgctgcacaaaaggggtgtgtggcacactcgaaaaacccatcgtcgacgcctcaattcttccgaattccagcacatctgtgcgacagcaaggcactggaatttggcttcgcagtcggtcgctgcaactagcacagtctcgcgaaaaagtgacccgcgaatctaaacggcgcgtgtgcctttcttcgtccaagcagtatcttgtttccctgaaaggctggatgtgttgctgccaccacgttgtagctggctggttatatgtggacatacgatgctggaaagaggggacacctatttgcagctgggaggtgagcacgcgctgaaatgtttcacacagtcctggccctttttgcttcgaagtgctcattctgtttgacagcgcaggaagatcaggacatcagtgtcgtttcgacttgcgtttcttcccgcggctcgggtaacgcccaatcccggtatcccgttaaggcatcttcacttgaaaccacactttgtttgcccacacgcaattcctacattctgacaccataagttcaaattaacggaaaatccaatcctatctgttgcacatctagatcgagcatgtagctgcagagaacgataaggtgcatttgttgaacgcccttttgcaaaatgttccacggcgatactcccattttcctctcctctcatggcttcctcttcgttatctttttatatatacaatgccaggcccgtgtaaaatcttgagttcgacaagccgaactgaagtggtgaaactattaaaaaacaacgagtgtgttacctcgtgctcaggatgggcagcacaccaccaatcagtacagtaagcctggtatcgtatacttccgagacagaggcagcgtcatcgcggttctaccccttttgtccctttcgttgagccacaaaaatccatggcgaaaaggcgcgtcccgaatgtacacacccttgtgcatgtaacagtgatgccaaccggcctcgtgaaaacgggcaaaaaacaagtgttttgaaaggtcgaaaacatgcacagaagttgcaggacttcgaccgtagttattccgcaggcttcgtaccactcatgagttcctcactctccaggacgaatgcagaaactctctggttttaatgattgcttgtcatgcaagtcgacaaaacccccttgacaacgaagcgaagtcagtagcgttaccacagtattgcaaggaccacgcatttaagcaagattccacgtcgtcggtgcattgaaaaatatagtgcactgaggtctggctactgtctcctcactggtggctagtggaactacgagtacaacagacaataccccctcatcttttgcagtcaaccgtcgcctcccaacctctgctgctggcggcttgtactgtcggatttaccccaccttggagcgacagactcgctcattaatttgttttctatcgaatcgatggtcatttgctattccctctgtctgtgttgggtttctgttttgacttcggtgcgttcaccaaaccgcgacaaggctcgtctcccggttgccgatacgagacatgccctcttttcgcagtggcggggaaaagtttgcgtcgagctagcagctggttaattcccctggcgatcttcgcgtctctcgagccttcctgcgctgcttttccgtgttttctccaccctcatcaaggcggcaaagtccactcctagtgtttttctctctccccttgccacagatttcacatcgtcccgaaacgcgctggcgggtgcttggccgaaactggaagcggcgtgtcaattcactttccggcggcttccgtggttttttttctctgcatttgtgggaagattttcttgtcggcttcttgtccgacgaga

SEQ ID NO: 1571 - DNA, 1936 bp, Toxoplasma gondii
ttcctacagaccatgcttgtcttccttggattctggcaagcatcagatgtggcatcttcccgacagagaagagctgactctccaaaccgcctcaaagtctatgcagacccttcacataagaggctcacgattttgggccaggtagaaacacgacacagcgatgactctgcaccgcggtgtcggtgaaaaccccatggcatgagaccacaccaaagaagagagagtcacccaagtagcacagttttatcggaaacgtcccggatgacgccagtccctgttcctgaagtgctcgggcctcctacaccgaccatcacaaggcttatcgcttatcgccctacgagacctcgctcttcgctatgcacgcagagctgccttgccagctggacaagttctgtgtaccgacctacctccttcacccagtccttgaggtcaacagcctcattcagttcctgattgaaagagaggaatttggctgccattttcccgaggaactaaaagaaatttaggagagggcactcttcttctaccaggtggaagtaggcgcctagagacggtagacgattggaacttgacaaagttccgcagtgagtcacagcgatattagacgtttacaccccggaaaaaagactcgaagcaggacgacggcgcctgtgggcgtcgggatccactacagtcgattcgaacacgttgaagccttgtcgaggacaagtggcaacgaagaaagacactccaaatcagcattcagcagcaaaacgtcgtcctgaacagctgctcggttgaaacactgaactgtgtgacacgcccaagcctcggactatatgctctcggcgttgtcgcgctcagcctccacgcgactctgagaagcacagagaaggagcaattccaaatgaattgccagacaagcgaaagaacaggacaggagctaccgaagcgagggagggggtcggagaactcccaagcagacggaagtcgattgacgccaaaaaaaaaacacgcggtcccgttcgcgctgcgacactgtaccgatcaaaatgcacgtcgaagaaaccagctcccgctacagcacacgccgctacccccgataaacgagaaaaaagaacatgggggttcactgacatgcatcttctcaaacgtaacacaacagcacgacagattttttgctcccttcaacgatgcagctcgtcggccgctgtcctccagagtttgtgcgcagctccggacgagacctcggcctgatgttcaagatgaccttcgaaaaagcggtctctgtgctttttctctcgcttggcccccccatccccccacggcggaggcgccactaggatgctgataccacagtcagccagcgaccaccttccaggccttcctttttctcgctggtgcatgcatgcagctttgagcgagaccgatcctacagtcaagtattgccaacaggggcaatggcaggaggcccgtcccaaacgcctcaatctaaaaagaaaggcaaactcgaatttgcttcgcttaggcacagggacaagctgtacggcgggatctgtcttcccaaacgttgtctgctgtaccgcccttgttgcgacagcgtatccaattccgcgatgtacggagaaccagcgctcgtctgcgtgagcatgttaaccggcttcgcttacctcgttccctctcttgtacgctgatgtgaagattccgggtctctcgggatggaaaggtgttgaacgaagttgtctccaacggggcagtgggttgctcaaacagataaaggtacaagacaatacttccgcccgccgcgaaaatgcccctccagcactagccaacacgcgatcgattatgtctcctgtcagcgtttctatgatgtcaaagactgaagcacaattgagtctgttctgaagcccatcttttccagcggtgcttcgacgcctctgacgaagtgtctgctgta

SEQ ID NO: 1572 - DNA, 2097 bp, Toxoplasma gondii
atctctaatggtggttcggaagagtcactcaagaaagatgtgaccctgtttatcatttcgaacggtcgctcacgggggccaacgccagcagaatcagttacgatttctgtacattcacacgtacacataggtctgtacttatctactatatccataaatatatatacatatatacacatttatatctatatatatctaaatctatctatgtatctctatgcatctttatatatatatatatatgtaaatatatgcgtctatatctgtctagtacatatctatttatacgtgtatgtggtaacacataaatgcgtgcgtttgttgaagggatttgtatttccatgtctttgccgacttttaggggggcattctttaggagagacggtgacgagcagcgatggccctgtttcgattagaacgaaagctgaagaaacgcaggagctcccgcgtcgagagtgttgggtgccctgagacttgcctcggagttttggaaggaaagacaattcaagacctggaagcctccaggaaaagcggtccccacagccagaaaagaggcacacaggttaaagagaacgggtcggcagagacacagatataatttcaggagacaggaagaggaagacctaagcatgcagatcgccaggtagacatgaagaggaagacctaagcctacagatcgccaggtagacatgaagtggaagacctaagcctacagaaatcgaggcagatatggagaggacgacacagatatgaagacgaatgcgtaaatggatacaggaatagacagctagatgcatgtcgatggttcggcgtccataggtagagactgtagaagagagagccactcagcttgaaaaagacctgtccgtaaacgaggagacagcacaccttgtctccagttgatgcggtttacgtcaaactcctgctttaagtttccctatatcctcgtgtattctcgcgaggcatctgtggaagaagatgaaacaagtatttctctatcgaaaaacaaaggtggagcacgaactttcgctgggtctgcgtcggagccaggcgtgtcttcggtcttgccttctgttcacttgtctctgctttctttatctgcattcgtcttttcctctccactcaaaaggacttgtctcctttcagcggaagtttgaacgggcgagtctgcggatcgaatcgtcctcaaaaacgtctccacctgttcatcgggacgacgaaaaaaacgcggccatttacgcctgtcacaactgcagcgttgcaacgctggagctcattcctttctctgcaagaatcctctcaaatgcgttgcggctgagtcgcaatcaacctttcttttcgtcaagaagcgtcactttgttttcatcgttgtcagaagtacaggtgccggctcgaggggggagtctgtaggcggtcgcggcgttcgactgcgcgccgctgtctgcatgcacatcgagaaactcgcggttgaaccttcggtggaaatctctcggaaatcccaagaacgcaggagtccttaaacacacgagagcatcctcagtttctcagttgctcgtctttacggctctcctcgctttttactcagaacgaacgcggtcggaaagaacgcgactggccgagcaggggggagacagaggaagatcggaagacaccgagtgtgttgatgatgtatttcatggaaggcgaggagacacagaaacgagcaacgagcaactcaggaagaaagaacatactttctcttcactttcacctgcgttctctctgctggcgtcgctccgagcagacttttttgcgcctgtttttccttctctgttttcaccgtctcctcgaggaccgggtctcgtgtctctctgcaaattaaaaaacgacaagtcaccttttcctccgtttcctgctcccaatttccttctcctctcgccctaagaagaacaatttctcagcgcacacaacgcacatcaatcagccttttccgtctctccaccgatcctttcttctctcttctcttctctcttccctcctttctttctttccttgcctttgtctctgcacgaagggaagccaaagttcttcgcagtctcttctttcctctccgcgaga

SEQ ID NO: 1573 - DNA, 2529 bp, Toxoplasma gondii
aaggagtgcaagcaggttgccttccaggttgataagacctgctacaaggccgtgccaactcaggaagcatacaagtgctccaagactgtgtttgagaaccagtgtaccacccagtcgtacacggttcccaagacttgctataaggatcacgtaaaacagcaggcatatccgtgcatggaaaccaagtacaggacccagtgcaaaacgaagaaggcagtggcaccccctcctcccgttatgttgtctaagaagggcatgtaaccgattccttgattatttgacctgtgcacaagaagggcatgtaattgtgtcgaactgcattatctccattgtgtgtctgcgtaagttgatgtggtctcgttgcgccttctgcacggtgcttgtgattcacaactcaggtcccttcagggatgtaaaacaggtttaatgatttctgctttcaaggtcggagacggtcatcgagctcgttcttgatggcggctgcgcaccgcagtttccttcgcaaaatagttttttaccaggaccgggcgaaccatggcatgagcaagtggtgtgaggcacgtgataatgagtcgtagcaggacaggcagttgcgtgcaggcagacagtgattatgtccccatagcacagacgatagccggcttcataagcacagcaagcacagtatggaactcagaccaagaggcatcaaccggttgtcagcagttggtttcaagatgcgttttatggctgctcgacagggactaaaggaagtcaggaaagaagcgggactggaacttccgttacaggctgtctagcacacgcatcagaagacttcgtcagccagggcgacagcctgccaccactgtgagaggttctttgattccctttccagacttttcgcatgcccctcaaaaggaaatttgcgccttttcttttttccattagtggggcatcctctgtattcactggccacgttaagaaaaggaggtatcttaacagattccctggaatcttgggctacccgtactccgcatggctgacgggacgaacctacgccgtgctcgcccaaataagacttggcgttgtggctggtcaaaggttttcgatacctcgaatgtttgagtagcacgggtgtactgctactcccggtagtacccttttaggttattcctaagaagtaccttgcatttgcgacaagagatcgggtgatgtggtgtctatgaacaggatcatcttgtgacaaaaatatttcaaagcagtgaagtcaagaatagtttaagctgaagatgatgatgctgccgattgcacaaggagacacggcagtgtccggagtgaacggcttcgaaaaaacagttacagcgaaacgaaggccacaatttaggcatgagaggccgaggggcttgtgtgtgtcgaactggccaatcgcgatacatcaatcatgctgtgtatgcctttccggagccatccgtttcaaaaaatagaggtgtcctggcatgtatcccttgaaaagaatcccggtggttagaacaactatgctttcgatatttgtaggtagtagagctcgttacgctgccggacgacgcgagaagtggctgttgctcatccgccacgcgagtgacgcatttctggactgagatcaaaggtagatcagaaccaggttagagcacagcaagtctctggaggagatggaaatggaacacaaggaaaatccttttgttgctggtttgatgtcatcctacatgatgccacatttgtgtatgcgcattcactttgtaccctcttcgaaggctaaatctaggcgtacgtgcttgctggtctgtgaggcatggcataatcggagaggttctgtttctccgacgacatcaagcgttctcccagcgcaggagactgggtgcatgcggagatagacgtggctccatgcatgttttcggaaacaatggaccacgctaataccaacttacggggggaacgacacccaaggaccctgttttcgaacaccagagcttcgacagacttgccccgagcatctggttcttccatttcctatctgcttcaagcgaccccgcgaaagctgtctcgttgcgtgtgcccatgtttgaagtcgacaaacgctgtccagcattgctagacccgtgataatgcaaacatattcatttggcatgtattccaatgctgattgtaatcgtaaagggcacttgtctcggtttctattccgaggcaactcaacgtcgtcctcaggagtgtctgacatcagacagtcaggtggcacagtcgaacctaccggggagacgaaccaccaagagtgagagacgtgagtgagtgggcagacttttcccttttttgtcaactacgaaattacattacgctgaccggcctgttttcctggtggaaaattaccgaacatcccctcggcaaaagctgtgctcctacctctggttgaaaaagaggcaacgggggactgcccttctaaacaaaccctgcatacgccataatttgaatgggcttaagcccagcgtgttcatctggactccacatttattataaaca

SEQ ID NO: 1574 - DNA, 1579 bp, Toxoplasma gondii
tttctccgccagttcgccgttccgagggattctcgacgaagtcgaagggggagagatgcagaggcgttcggcatgtctctgccgcagaaccatgggcgagtggagtgtgccggcgcccccacaggtttggcgcctgagaagacccgcgcagatgatggacggaagcctccgcgggggtggtgccaacagctgctgtggagaggagcgaagacttgcggtgatggcatcgctgcgcctccggagacactcgcgaaagcgggagagacgactcgttcgtcgtccctgagagccgcctgtcgctgcctgcgggggtcgaaaacaggcttgttcctcgtctaggaaaaagagcagaagaagcctgaacgctggccctcgacaacctcccagagcctgcctccacttgccacaggcgcggatccattggcgctgcctgtgacggttccctgcccagggaggcggcgccgccaaggaaacgcatgcagcccggtctggaagggagaaaagactccgggggacaagacagcatcgacgcaagtgcgacggctcaacaaatcgaagtgcagtcagcagttccgtcgcgccttggctgtagactgtggtcttctcgcgaggaaggacgaagagggagagagagaggacagggaggacgatggagaagcgagagagggggcgcgtcagtctagcgggggggaggggggggagcggcggcggcagggtcagacaggagcgtcgaaaacaaataagaaatcatctgcgaacgcgtcttggttggtccatgaagcgaggagctcgggaacgagggcaagacgagatgccatcaggactccctctgtccctagctcctcgtccaccgctctaaggacagagacgcccgatgtagagctctgtcttccgagagagtccccccgcccctacaggagcatcttcatatatgcgcatgcacatcgacatttatatttatacacagagggaggtgtagggagagtcagagaggtcggatgcagcagacggagagcaagtatcgcgtagttgtggttcccgttggcagcagtgcgcagcgagaaagcgaaggtaatcttgcaaaggacggtcacctggagttcgagaagcaagacggaagagcattgcggtctcgagcgagagcggaaaacaccgacagcaaaacggatgtcttccggttcgttgggccgttccgagcagacacaccagagggacttccgtaccagacaggttcgcgcgtggatttcccgatcgcaagttctgcacgcaactcatgtagaaagaagtagcagcgtaggccgatcgatgctgaagtcgaagaagcgcggaatttctcagagcccatgaagactcccgaaaagggtctctctgcgtagcagaccatgaacttgggtcgatctcggagttgaaagggagtccggcttccaaggagtgcacttcaaaaaacgagacgagacttccagaacagagtccagcgtttcaactcccgacggttttcacgggaaagcggccactctttgggcttgcagacatcgcgaacagatcgcatctaccgatcggacagaggcaggaattccga

SEQ ID NO: 1575 - DNA, 4118 bp, Toxoplasma gondii
cgtcacactgcgctcgtcaccgagtctggaaatcccagaagaagacggagttaaagggcgtccccttcctccgtcacttcctctgctccgacccgcggacgcgtcctcgcacttccttccgtgagacccatgacaagcaaaaaagaagggtgagacaaataccggtggggattctccactcggtaagtagtcatcgccatcccggtgctgtcggtctctcatatctgccttttgtgccgtgcattctccgtccacagtttcatgtggttcgcgcgtgctgtagaaaagcgcctgacgaatcgttgcgtctcttgtttctctgctgtcttgttcgcttcggtcttcgtcctccctctcgctcttccccgcgttcgcctcgcgatgacttccctcccttgtcttgtcatcgcgaaacgtgtctcggctttggtagtcgttgtgctggaaattcctcctggagtcacagatcaggtcgccattcaccccgctgctttcgtcctcctcttcttgcgtcgcctcgtgggttttctgtggaagtgtgactccccgcgaagagcgcgacacagaggaagttgtgcaagagagaaatgatctgtctgttggaggggcgtcagaggtgctggccagcgttagcgggtccccagagaaaggcattaagagcggtagcacttgcggtaagaggccgcaagtgacaacggtcgaaaaaggcaggaagaggagcacgtcgacagaaatagagaagggcggacaagagggaaaagattggagttccggggcggcagcgaaaagagcgttcctcaaagaggggatccgcggcgaacaaggtattccaaagagcggaggtgcagaagacgcacttgtgggaactgacgatgtcgggtaaaagccgtgagcggccaccggaggattcgaggaagaagagcggaggagcggaggctcgaagactgtggaagcagatgacattagcgaagatgaaggggcggaaagccgtgacgaaagaactgtttcgatagcagagcaaagccattctgcaaaaacgcccagtgtcgccgtctcctgtgccattcttaaagtgaaaaactacatctcaagtccagctgtagataccggcacgtgtgtctcgcatcaaaacggaagccgttcctccgcagcaagagcgaagatcgcgggccagaaaggaatgcagtgatgtttgcgaaaacgaatggaaactagcacgtacggcggttgtctgagagcacagttacaattagctcaacgcgatagaaccgccagcacggtcgccagtgattcgagtctggaaaaactcgcgaaagataagggactattaacaacggaaaactccagcactagtgcgaatgccaaaaatggctccagtccatgaacaatacgaaacgtgaatctacatggcttcctgtgaaaacacgcaggcacccttttcactctactaaaatccaacgcgggaaccgagtcgacgcattgtctgagaccaccctttgctacaggggaaaggaagcactgaaaacattccagcagtagttctcttctacgaaaggatatctgtgaaggtgtctctaaatggtgacgtttctttgcccagagaagctagaaaactgcaaactagcgagttcggatgagtcgccttggcgccgagcaaaaagctagacaagcagtgcgcatagctgacaaacgcttttccagtaacgcgacgtgtgctggagagacagaagcttcgagacaggaaccagaaaacaattatgtttcacaccattgcaaaacgccgaaggaaaaggcttacacgtgtatggctgtgtgcgctttcctctggaggtctcgtctctaactcggggggtaatacggataatacgctggattgggaacggtttctgtgccaggcgaagacaaagcatttctcctttcgcacagcaacacaatgaattcacaaaaagcgaggataattaaggacgtatcggaaacacacgattcttttgcaacagcctgcgagccgtgtccccggtgtaggaaaaagctgtgagggctcactctcgagcataacacagcctgtcaaggccctctaaaaatattgtagatgtcgcctgcatgaagccaaagggaatggatttgggctgggcataaaataggcaagaaaatgtccggctcaatccataaaaaatgcagcttcgtccacgtacgaattcgtcacattcttcagggcgatagaacgaaaacttctgcccaagagcggactgaaaatggaattcaaagaacaatgggagaagcatctgcattacaacgaaagcagctacgaagtctcttaggatcgatatcgtagcgataaggagcacgtgtgttgtgtatgatccgatagacagttctctcttaagtatggtgggacggaaccacagtataaataaacgaatgcgcgtacatggaaacaatgaacgaagtattgcggcaaagagatttgcttcttagtaatttcgctgcgttcgttttccgttgtaagttactttcccgaccaagtgactctgggtccactcttgatacttcgtaattgcttgagctcccgctgcagctaaccagtcttccagccttcaaacaaacatgactcctttgtcttcgacagcgggatgggagagtatgaaaaagttagactgacagagagtctgtcgttgctctatgtgtgtctacttttcgtccattgcaagaaacaaacgggcgaaacatagaaaactgccgtgtgggtacggaacgcctacagccttctcagcagcacggcttatacccttttgcagtagtgcaaacataccttaatctctgtatgctgtaagcatatcaaggaaattgaagagtgacgaaattatctttgtccatatacctatttaatgtttgtaaagttcatactcttaaccaggtccgcatacgcgcaacgatatataaaatgacggtacacacccgcagacctcgctcgacattctatttgccacatgccctgtgctcagctgcacattttaatatatttctattcatttatacacgtagttcctagctacaccttccgtataaagtatgtgaatcgtgcaggcgacggtcatctaccgacctacataacatccggtggatgctgaaacactcgggccgccactttgttcggaaaaattcggacgcttcgtgtttcaaaacgcattaacaaataagaaagtaaataaaaggccgcgatttagctgaaagcctctgatgatgcagctttgaagatggacaaaaaagtagacagatagagaagcggtatgtttcgtgcgggaggagctgttgccttgcattatggagagtagggactcccgtggtaaggagcactatcgcgaatggtaggtgaaatgaagaagaaaactaacgctgaaaactcctcctgttctgcctgtcttcccacatttcactggtgtttcgtttcttcccgagacacacgacgagacttgccgcgtgcgcatgcagccccggaattccgaatacgcacctgtgaggctttccttaacttttcaagacatggccgttttgcccgttgttgcttgtcgaaaattgcaaagctaaaaggaaaaaactccctaacctgtacttggctttatccttggttctgttccaagtaaattagtctgttccaacggtcaggagacacaggagacagaaatgtgccttggtgagtcaaagggagggcgacgtaacggtcgatagagcagcgttttccgtgagaacagatgcaggaacggaagtggagacgcgaggtgatccaagaattatcttttctcgtctttcgcatgttctggcggccttttttcttccggcgtttccctcgatttctcgcggttccctccacgtccacgcagatttcgatgtttcgctgacccctgctcttgctgcgtctcgcctcctgtctcgtctccgttccttccgacgatctttcccccttcttctctcgttatttcctgcattcgtctctaggtgtttttcttcgtttctctttaccccgtctttctgcctaggcgcattgcctgagacttgtttccactcctcgacccgcatgtcaagtccgcgttgattcggcagtcgccgtccctacagaagga

SEQ ID NO: 1576 - DNA, 2945 bp, Toxoplasma gondii
gaattagtgttacgcgatgtatctgtgtctagtcggccgcagaatgttcggcgctgactgaggctcttgtttgccggtggggtgaccagagaaaacggcgcggcacccgagttctggctcacttgcttgctcctcggttagagtttcttctctgaggctgcgaatgacagacgcggccgcaggcggcgatccgtatcggttgacatcgttttgcatgatcatcgtgagaatctggtccatcgcatcttcgccgacaccgagtcccgccgctgccccgccagaaagcgcctggttcagagcttgcatgacgaggtttccaatctgaatgaacggggcttgaccggcattctgcgccggtccgtcggcgccttgagcgccgtgtccaagcggcctctgcccgattgacgtcccgaagacagagcgcatcattcgccgcgcctcttcttgttgtcgctgttgctccgagccgaagacgacgcgcggacagagcgggtctccttgcgaggcgcgcctgggagacctgccttctgctccatgttcttcaaagtctgcgtcgccgtagaaaaaaaggccggtgtcctcggactgcagtcccgccaaaccgcccatcagttgagccatgagctctcccacgggaacgccaaacgcattctcgaccacagctgccgggtcagaagtcgcagacccaggtgctcccgtcggaattcctgatgcagtaggtgggacagacgaacttggagcggtcgccgtctccggcaaacgttcaacgaaaccgatcgcgccgcagcctccacacacgagatcgccggacgcggaatcaactgtggccggtcccctgacatcgcatgcgtagcagtgaccccgcaggagagacccactggccgccgcactgctctgagagtttgcatgggaagaagctggcgctcctaacgggcgcgacgccaaattcgacgaaccacctgcgtcgccaggcccatgcggccgcgcacccccggtgctgttgttgttccccatttccttgtcgggaatgacgaagagaggagccagacaggccgcgaactggctgcactcctgcagacgccgccggaccagaacccagatgtagttcctgaaacgtcagagcggaactcggtaagccgagaaaggtctgctactgtagtgcggagaaaactcgcgctaggtaatcctggcacatgtccggatactcctttccgctaacgccaaccataatataccttggtcctggtaaacgaagaaatgaaactgcggaagacgctgacagtccgcagttggtttcgaagagctccacgccgctgcagtgtatgctcagtcggttttggccagtaggtcaacaaacttgtcccgtgtgttgtggtgttgccactaaggcgctgctcgcgaatctcaactcttgctgcggaccagagggttctgcgctctgcgacagaaacagacgtaacgcagcatcgcgtaagggttgatagccaatggtaagcgcagaaataggagaaaaaatcggaaaacagcgacagcgacgctgactgcagtggctcaaggtcgacctgggggacccacgcccaagggtcagctgggaagctggctctgcctttttgattcgcctctcgtcctcttctcgtgctggaaaaacgcgctaccttctttctcttaaagcacacaaagtgacgggtgggtggtcgaaagatgctcttttttcgacgcagaccaaatgtggccggtccgcgtgtcgcgaatggcacgacgacggagggtttcttcctgaacaaagaaaatgcggtgtcctagaagcattgaaggagacggggacaaaaaaaaacagaatagttgaagttgcaaggcgtgaacatgcagtgctgttttttccagtgtgtcctggtacaagaatagaggtaaatgcaccacatgcctgcatgtaggactgcacatccccgctgttggaaccccccatcagatgacactgccttacagtggcaaactgctcaggcaggaacttttttcgcattcttttcgcaaagaagtgcttaacccagcgagctggttcacgtggcttctctgctcacttagccactgcggcagtgaggcacaaagaaatcattccgtggcgccgactccgatggtagggtcctttccttttagtgattgggttgtggccgccaggctcctggacaagagtgcagtttacagacactgtgcaaatagctgtctctcgcgatcaagctcgagagaagtggaggcggtatgaggtcttttctcgactctttttgtcagcttccttcttccctcactagacgctctttcgcgagcgctatttacacggaggcacggtcttacctcctcgttttgcgtgttctctctcggtcggttctcatcccgatcggtcagcagctgcgtgttggccgtcaaaccgcttcgcagtccggcagtcgcggacttgacacgtttggcgtttcgtgtccgttttctaaaacggaagtttcatctctatcaagacatgacaaatcctggtcgcctgttctgtgacctgttgtatttccgtgtttttttttcgtgaggcaagcgtgtggcctccacgtttgtctctcacgagtcgatgcctgcatgcgagttcctctttcaagtgtccacacttcttcgagttttcctcggatgtttcccgtgttttctaaacttctccgcttgttgcatcccatgagacactgagctcagacatctgcgccgcaatttgctgctctcttgaggtgcgcgtccggtctgactgcttgagtcgttccttttctagtggacggtgcctgtcggtagattacccgtttttctccggtgcctatcccatgatattcaggtatttgctttaccagaataggctctaggtgccggaaatttcctttcaatcttgccttcgttttccggtgaaattcaagagtgcaaca

SEQ ID NO: 1577 - DNA, 1649 bp, Toxoplasma gondii
tacaaaccgagaagggagctgcgttttctggccatttctctacatggagttttccccgccaaccgagaagttagcatctatgagacagagctcttgttcttggcagtggcgcccccagacggaaggacctgcagtagcacaccactgcaacggtgtatttagatgatggaactggaagaaacttgtcaagaactcgtgactttaactgcgctaagtatgcgttttcctctctctcctaaagtcaacagaaaaacacaaacaagagattcaacaaggacgaaagccggcgttcgtattccgataactcgtagtggcaggcgtatcgctagacgcagggacaccgagaagactctcctgtccaagtctagacatatatatgtacaaatatatatatatatatatatatatgcataatatacgcgtatttggagtattgaaatgactcgaccacgtaggtttacgcatgtgcatttacgtatatgtgcttacatatttatgaggacagcgcagcgagtgtctgtgtgaggaggctctttgaaaagccgggagagagaggaaacagaactcgtggagatgcggacagcaagttgagacgcagccttctgtgaagtggagggtggaaaaacggagttgctccgcttgggcgagggctttcgttttcttctcgcatggctggcagaagggagagagcaagggtgtgcgtcttgcgcctcgaaagagaacggatttattttcgcagtccttttcttacgttttccgaaatatgtgtgtgaacgtaaatgactcccttttcgaaaataaacacaagccgttgtacacggcctttgccgccttttccttatctctccggcctgtcgagacctctcgcgtcagtccgcgagaccgacaagagggcaagagacgttgagtggcgacgcaagtgcatctgaggagaacgccctcgtgaaacaagaaagggagacgaaggcactgaaaaaagagacgattttgaaaactcccgaaatacggtggagaccgagcgacagtcggtccagccgtctctgcggtgttttgtttgtgcatgcacaatacgcacgagttcgtcgagcggtcgatgaagaggtggatttgcggttttctttcgagaagaaagctggagagaagaatgagccgatttcttcaaaagatttcctcttccgggatgagagcgcctgtcgcgaaggccgtctcgacgaagtaaagcgagacgcgcccctctcttctctgtcgtgtctctgtctcccctgtggtagagcgaccgccaccatttttccggagtttcttcgttttgtctctcttttgtctgccttcttctccctctttctgttcgtgtgttctgttctcgcttcctctccgtcttctcttcaccgtggtcgcttctttttcgcttctggtcctctgtctgcgtctcctgtggtctctcttcctctccatcgcgcgccttcctcgtattttcctcttcatctggattcgcgtcgattcttcttcctcttcatcttcttcctctccgcgtctttcttcgtgttcgcgtcgcctctctacgtctcgctgcgcgtcctctcctctctgttctcggttcctccttttttttgttaccacttgcctcctgactcttttttgagatttctcga

SEQ ID NO: 1578 - DNA, 1674 bp, Toxoplasma gondii
cagtggagcatgaggtacaaagaagttgtcatgtcaaagcaggtgcagcagagatacgagcaaaagccaggcgcatgcaagcagtcgtttctgtcagcagggagagatgcgcgagaagcagaagaggcaagaaacaagaagagaagaagcgagggaaaaacagagaaaagaaaaagaagagagagaagagagaggaagacggagagagaagagagagagaagagagaagagagagaagaagacggagagaagaaaaggaggaagaaggtgttgttttctttgtacctggactggtgacccatcgcgtgaggggaacaacgaagaacatgtggaagatcaagtcctccatttttttcgcgattctttccagagttggggaagctggttctcagcacagacgtccgaggcggaggcgcgggaaggccaaagttcccccgcagacgcacaggtcgcgaccttcctgaacgactctagtaacgagacatgtcttttcgagcagcgccagcctcctcgccgccgcggcgtctgcagtccagagacagaggacgttgtgacgccttcgctctgcgaaggcggcgaacgagctgcaggcgacagaagcgcggagaacggcgcgcgacgagaagaagaaggcaaatcggcaaggtgagggggatggaacgcttccgaagaggacagaaggcgggggatagttttttcgaccgcgccagaaaggaggaagacagcgaaggacgaacgcgagaaaaaacggtgtgggcacgagggaagtggacgccggcggattgagaaaggagagaggcgtcagaggtttggcggcgttccaaggcgtccgagaaggaggccagcagcaagagcaccgtttttccagagaaaacgtccgaaaaaaagttcagcggcagctgcgcgttgtcttctgtgcatgcgctttgtcgctacactctctttcctgcccgagtccgacagcgagctcggcgcggaagcgagtctctccctcgagttctctcgttttctctacagacctttccccgtttttcgaggcgaatttccggccaatactccaaagcggccgcgtcgcggctcgcgaatgctcagagtctctttggtgattgtgcgcggcacagcagagaagccgtcgtcggctgttgcgacagcagctccgttccgtccccgcggcgcgcgccctccgcagacatgtctacggccttaattgcctttttcttcaactgcttctgtcttctgcttcctcaccgtcttctctcctgagcctttgtcttctcccttttctccagcgtgtgtctgaaggcctgtccgcggtcgaagactctctccgctcgagagtctggcggccaagaaacagggagtcgagcggcgcctgcttccttgcggcgcggcttgtcctgctcctgctccaggttgtccgttccagatttctcgagcgtttccttggtttccctcgcgcatgtcttccgcgctcttcgtcgacgaaggcagtcttcccctcccgccgtctctccagccggtctgagagtgtgcgtctccggcctttcggtttcctctaaagaagaaaagagacgcaaggaggcgaagaaggcggcttcctactgcctcgtcctctgatgtagacctgtctccttttctcgcctcggcccaggctctaaaagagctcgcgcagga

SEQ ID NO: 1579 - DNA, 2570 bp, Toxoplasma gondii
ctcgttggcctgtggcacagaagaagaaggaagtctgcaatttcaagtcacaaatgagagacagggcctccttctggggacctttctggatgcccggatgtgacgagtttccaaattccgtatctccgggccagcttgtcaataagattcattttggtgtggaacgactctctgcttgagaaatcagtgatcttgtcgcagttcgtgcttcgtggtgcctacttgtttccctgcgagcgccagttgacgaatggtaacttcatttgaagaaagagaaaggggaagagagccgatggtagcgagccaacagagcgtagatgagcagagatctagtgcaggagtcgtgcgtcttacgacgaacgcggaagatctggtggtcccgcgcagccacagaaactgcacacgagtccggttgagacagaagcatagtgcccaagacgcgacggcgaaaatcggttgttcttcgcatccaccggtacactccgatctggcaaagtctagctgagacaggaacggaggaagaaatgtaaactgtgacgccgcgcgattcaagtgccgcgctaacagcgacgtacaatgtcagacgccggcgaacgtgggtgcacatacggcacgataggcgtgaacagatttcgggacagaaaagttgccgctgtcgacttcttgaagccaagcccggtgccacgagagaggtgttacgatatgtcagtgaacaatcacatagaagcgagagggagggattttattactagttttgtgcgtaggtggttgtgatttgttctgcttcccgacccatgatgacctagaatgctgagggcactgtcgccgtgatatggctggtatttggtgccagtcctgcgggcataggctcttcacgcgctcagggttacggaccaacagagatgcatcgggacatcgtcggacacagtattgtcacttcgtttatggagccactaaaagcgcccaaagcagaggccgtctcaaagagtggctcagcactgacaggatataggaaagattgaaagtgtcactacgctcggcagacgctttgaacgtgtagtccttagattccttagatcgtgttgccggcccattctcccaggttggctgttcgttgggttctgttgtaaaaacatggtggcagtggtatgctccttagagaaaaagttgtcctcagcagctgtcctccaaactcaaggagtttcatcaccgtcgtacaagagatttgcgcaccccattttgctcgcccaactggactatttacacttcttgcgacgttttctgtttctcattcttgcggagctaccgatattcggtagccggtttgcttctgcctcatttactttgaaagggaatattcattcccagagacaatagtagcaaagggtcgtcagcaaaacggctcctgccgaatgctgccaccgttcttttctggcatacgttagtatgtattaaagcaaatatcgactcccgggtgactgagcggcccgtgcgtcgcaattgtttgagactgcatcgttagttaagcaattggaaagggcacccttcgcaattgtttgagactgcatcgttagttaagcaattggaaagggcaccctcctgtcgacatgtgttttaggagcacgcatccaggttcgcatttgtgttacgctcctagacatcagaaccggtatgtcttaaccagaaatagacagggttcttcgacgatttcgaaccccgtccagtctgcgggttccccttctgctgagcagaggcagtacagtgtatcaggaacagtctagcgctttgcgttgcattttagcagcgagcttgcctcagaacgataacacatagacagccggcgcagctatccgtcatgagacgagctgcattcctgtgtatttgccaaacgcagcactctaggacaacaccacatgtgagactgctcgtctccaaaggtagcaagcaacgcgtgagcaagcactatgcctcaagcaccacaagcgacagagggtttcgacgcagtcagccctgccggaaaaatccttgcttgattgacatcgaaacagcaaatgccggtccagtcgccactgcgcgctgatccagtgagacacgtaacttccctccatcacagacatcgtaagtcaaatagaaagtttctgtgtagagcttgtgatcgattcccggggaactcgggggggtggctgactaaaacagcttttcgacttggaatttgacgatgccacgcgtaagtcattcgcctgatgatgtgggtttttattcatcgataacactctacgttgaaacatttcctagcaaaggcttttgagcttttttgagcttctgcaccgctctgggagctgtcacagatactgaaccacttaaactacaccttggctctgcgatgtcgtcgctgatgtagattcaaggatggtgcccgtaccaagtggccggatttttcagggtcttcgttggcaagtattcacacagtgcgcttgcctttgcatggttttggagacatcacagttgctgtccactgtcgcagccagcgtcctttcactagtctgtggcattccctacttggccgcata

SEQ ID NO: 1580 - DNA, 1592 bp, Toxoplasma gondii
tcgaaggaacactcaaaaggtactgccatgctgcaaaccaattagtctcatgtcactgccacactaatttgctcgatgccctcctactttcagcctggccattacaagttgctttagatggtgtttccgagcacgaagaccagcacactgtggcagcggtcgcagactcgggctgtttggaaatcgaaactgtaccagtggtgctgcactgtttgcaatcgtgcttcctacttacgatgtgttcgctgcataaaggtatggaatgtccagtcacgccacctgtatctatgctgaaaccgttagaggtaaaaatcagcgcaagtgacccttatagacgaccaaccttagcatccgttgaaattgaaagcgaaatccaacgacagtgtgcattagagcacagcagcaccacataaaaagccagcgatggccctccattctgccgatcagcggatatcttagccaaaagtgcaaatctttcgtgacgctaggggcgcggtacagctgggccgacactgtacatacagtacaccgttatacaggaagcaactctatttggattggcaacgccttttaagaaagcgcaggcgatgctaacggtggtgcgtggcaaatcgccacaatgcaaacagttcatgctgtgatagaacgtgcctcttcggtgctgggtgctccaccgcccctgtagagacttgtacctagtgcacaagaaacgccgccacagtcctgtagtcgtctgagggtcaatgaaataacaatgtaaattcacatggtcgcacagatatgactcccgcctaccgtgagacagagtaattgatgcttgaactagcagctttagagggaaccagaccccgcgaaaaaaaaaaacgggccgccggtaatcatcctgacgcctttaacagttcaactgtcctcttccacttacgctccttcaacgatataaacatgatctcaccaaacacaaaagtcctgctgtctcccttcgggatgcatacgcatgttcttgtccatccgttttcccaccaggatccagcgcaggtggactccaaaacaacgcctctaacaaccagtagtaccgtagattacgccccccccccccttgtcgtagtatcgatgaccgtgccagatgttcgcaatggacgttcttccagtttagcgggcgcattcatttttcatacgaattgcaccagctacaacggcatcgtttctctgcagctgctgcggctgcatgtgagacgcggttctcgtcaccacgcgacgagtccttggcccgctgtgcgatgcaaagcgcaacagtctctacgtacgccggaagtcaacagttgcaattttacgcatgcgcatgcacctacggtccgagatggcgccgtaggccccacatgccgcatgctgcctccaacacgtcggttggtttcggcgtacccgcaccccaccgcacgtgtccttttccctacttgcaacttcgaccctcttgttcgcgctggcgccgaattattcctttcgtctttccaagcaagtgtggctcgtgcagagagcacactgttttccgttttccatcgttgcctgaagtgctcctctaccacagacaggaaaaa

SEQ ID NO: 1581 - DNA, 2538 bp, Toxoplasma gondii
aaatttaattggaccgcaaaagagcaatgtggaaggaacgtacaaactcgagccgctctttccggtgaacgcggttatgcgagggcgtggtctgcccctgtgagagtttcagtgttcaaggcaagcactggactggatgcccaggaaactctgttcccatcatcaagaactgcaatatacgtcaccaccaccaattaagtaacagctgaagctaggcattgtgacacaccttttaaaatgacattgccaagccttgcttccttcggtaagaatcgtagttcaagatgctatgcatgaaataccaatgaagtaacaactgaagtcagattttgcgggggacactatttgtaacgaaactggggtcacggagaaatgcccacggaacgcggagtcgccagaaacactaaatctaccgtaacatcccctttctgcggacttgagcgagagatttcctgacgcttaaaagggattggacacgcacgtgttgtggcacgtcagacgtgtactcgcagatgccgggtgttctgcgtgtccgtcaccggcttgtgcgtggctcgagtcatctgacgaaaggtcagaacaagggttttcaccgtctgaaatgtatatgcgacttgagttttgccaatgaggacgcgtcaaatggtcaaataaaacgtgcgttcgaaggtaacggcgcacggctgctagaatcgcactctcgagcaaacgaaaataggacaccacgaagctgtaaaacgggaacccaggcgaagcaagtgcctgtacggggtcgctgtttccgggcacgccccagacgccctcgttttcacgtacaggaaagcgctcggaagaaagagcctccaggaaaaaacagaaccatgacaacgagtttaaacggaaggtatgatccgtcgatgacttgtggaactacctttttctggggcgtataatacagtgcgaattcaactgcggctttagaagacctcgacggtcctgtttaccggatccaagagctcgtgtgttagaagaccattcttggtggtggctattggtgaaatagaacagaggcatgcagtaccaccggagtcaccactgaagaccgactcgcggttgttaaacgccagttacacaatcctcgagtcatctgaactaaaatatacatgagtacgaaaggagctgttttagcatgcaacgtcctaaactcccagcatgccgctacttcgctaactagatgttgagcgctagcaaatgcacaagatgcttcagaagtacacgtttcacaatggggttcctttgtaaaggtgctcaaggtagaaccgccgggccgtcccgacccttttttgtcaccgagagaaaaaaaatcgagaactgagacgcggcgacgtgagcgtgtcaaactcctctcgttgtctacactttttctgcaacgagttcgcggttctccgtgacctctatggctcttcgaactctcctggcccccccagtcgacttgaaggaagcgcccagtttttctctgtttgtggtccttaccgaagaacgcaagctttcgacgcagtgtgtctctctgcgttctgtaaataaatgtcctggagtgctcctgtcgcttgttgcagagcaaatcgcacgtgaactcgtctctgcatgcagcgctttttcgtttgtcttgtcttgctgctgtttctatacaacacaaaactcgttggcgtacccgacgaagctcaggaccaaacagctgttccaaagttcacttaactaactgtgttcttttccagatcccccttcctgtttttcccgtatgaagacgcgggaccacggcaagcgattcctccctccagcttgcggagttgccggagccttcggtcccgctgtacgtacatttcagaaccgcctgaatgtttggaatccagagtctctttttctttcgaaagtcttgaacatctgcaaataggctttccttctggggtccgaaaccgcgcacatccgctttcctctctccgtcgggggtcgacgacacgatccagccggggctcaaaccctcggctggaaagtgagtggcttggcattttgaagtttcgcgttgtacgcccagaatcaaccaaggacacgagcgggaactcgggatctccggacatcgtcttgtggcgcacgcccaggactctcagggattcgtgcgaccccagggaaacccgctgtcgagaaatgtcgttcgcagcaaatcgttttggggacgcggccgtttttacgcgtagccattgaggtcggtttttctctccacgcactcgcttcctcggtcgactcttggcagcgacgctgtacatccctttctccctgaagccacctccttttcttcagattctctgcatagatgactcggtcagttcgcccgcctattcgccccatctagtttcgcggtactccacccgtattctcttcttgctctccacctctctccttccttctcttgcttctctccctttccttcaccttctccctccagtctcctcggagcctcaccctacccccctaaccccccggcaccaaaagcgtttcccctca

SEQ ID NO: 1582 - DNA, 1974 bp, Toxoplasma gondii
cgtattcaggtctatatgtaggtagataattatttgcttatgcatgcatacatgcgtattcatgcatgtcaatatccaaagatatatatgtatatacgtatattttttttatgtatatatatatatatatatatatatgtgcgtgcatgtgaaaaaaggcatatatatatgtatatatatgtatatatatgtatatatatgtatatatatgtatatgtatatatatatatatatataggtatatttatgcatgcaggccttggttttattctctgtctgcaccttcacacagcagaggcaaaagacaccgcgaggtgcaagccgagaactttaaggcaggcgtcgcagagaagagtttcgctaaccggacggaaagctggactgcggcggaggcttcttggagaagacgtagaagagaaagcaggcgccgccgaaggctgtggcgcccgccagccccagcgccgtgtgctttgacatggttcctgtgaagaagcttggacgaggagaagaaagaataaaagaaagcgagactcgggagctttttgcgaggcggctcttgtgaaaccttcagagagagaggaagaggaagcgagaccgcgacggagcgaatccacgaaacaagaataaaggacgagatggcgaccgagaagaagcagttgttcgttttgccacagcgtcttttgaactgggcaacgactctgagatcgagattcgtcgatctccgtttcttcctctttgtctcggttttctgatggagtcctttgtctttcgtcttcttccagagagtccttcctgtcggtgcagtcttctcggtgtctcttctttcctcgtttatattcggcctcacgccgcagtcggccgtttcccttctcttctggtaccgagttctctcgcgcctctcagagcgttttcgatgacgccttcctgccggacgcgctcgccttccccttcgctgcagagcaacttgcgtggatctttactttgttccggtgttcagtttcgcttgtgaagagattttttctcggactttctccgcgtctgcctgcgtcgccggcctgccaccgcgcgcctctcgccgcggttcctcccggcggactggaggagagggagtaaaagcatgggcgccttccggaccgcctcggcttctcgaatcgaagagaagacaagaaagcagagaaagaaggcacagcgcggaagaagaaacgtccaaggcagggtggagaagaagagaaggagaaccaaagagagacatccttgtctccagcagcgctcggttcgaagaggaaggcgaggacgaggaggaggagacaaaattgtgcgtttggggtagatagacgtcactccaccgtcgcagatgaaaaagaagaagagaagactcaaagtcgaaacgccttcgatccttcttttgtcttttttcatcggtcgccctgcatgcaaccaggacagttttctggggctgctgtcaacaacttgcacacatcatctcagccgacgagagaaacctttggcgtctctccttctctcgctttttgtgtatttctcgccaaccaacattttttcttagagtccaacgctttcgttttcaaagcgacagactcacacttgagttctcttcgtcaggttcccctctctccatcgagatcggtctctctcaactcaagctcgacatcgccgttcttcacttcttgttgtctcagtctccttctgtctcctccagagctcctcttcttgtcttttttctggtcctttcttcttctagaaagcggcctttgcctcttctcctctctttctcgtacctgtctcccttcgcttgtttgtctcctttccttcgcttgtttgtctcctttccttcgcttgtttgcccgtttctctcttctctctgagagcctcttttcttttgccttggcgtcgcgccgagaaacgactcggcgctggagacgtgtgtctgttggtgaccttccgagacgaaacaaa

SEQ ID NO: 1583 - DNA, 2370 bp, Toxoplasma gondii
gctttacagctgagagatagaacgtttacagcgacaggcttgtggggcagacataggcgtagatgatggagcctcggacgcgcgggctgtgacgtcacaagctctcggtatcgcacaagttaaaaaagcagacaagagacggaggatgcgagccatttgtttacgaacaaaatcacttgttggaaacgactgagggagaacgggaatgtgatacttcgccgtttcattgccgacggaagtcggaggtgaaatgttaaccattgtgtgttttgtcgtgacagtgagcatttgcgttgctttttcacctgttccgggaacgcataatgagttaaggttgatgtattcttgagggcagtggtacatgttacgtcgtgactgacagcagaagcattttctacggagatggggtttttatagtgcctcgctcactggctttccttccccttgttatcttgccaagccaccttaacttccggtttatttcgaacgaagctaagcaacgcgaactagccgcaacagtaaacgcttgctggaggctcagagagttgttgtgacgtcactgaaagtgaactcgcgctgaacaccagtggagatcctcccgtcgcgaagacgccgctatgagtcgcctgcatacaggttggatcccacttgtgaagacccgaatttgagtttgatctgaaaagaatcgcttgatgcaatgcctgtctgtcgacaacacaggggaacataggagggaggtgcctccgacgagactgaattatccagttgccgtatcaccggaatatgcgtggtctactgttgagaatagggcccagagtataatcggagatgccaacctaccgtggccatccgaaggaactatccttgtcattgagatttgtcccgtcggtaccgtaggcttggtggcaatattaaaaaccatcgcttccgcttagacgatgtgcttttatcctgctgctgcaacgtgcgataccttatagcttccacgtctttctctgtaacgtccatcacatgcatgtcaataaattgatacttctgagaaaactttatccgacgcaactcaaaacaccttgttctatgtacagagatgcaaacagactgactgcgcccaatacaatacctatcgtgctttcatcaacgcggacaggaccccctcttccggcaaagtcatcattcagaaggacgcgggaccctgtcgccattccttagattcaggtactccaataaagtcgtcttgaagcttgccgaagcttgagaaaaggcgcaagaatgaggcacaaagacatccagagaagccgaggcacggtggggcggagagcccaagagaccacgggttcagcagcccggtccccactggaggtttgttcacgtcttcgggtctctgcttcttgaatctggggtatctgtgaaggcgttgataatacaagtactaaaggactacggaatgctcgaacacagcagacgaagtttggagaaaacttttggaaccttgaatttgtctcgctctcagctcgattagggggcgcgcacaagctggcgggtaccggttgctcgggccggcgtgcaccgcccttcggagcgggagaagtgtttgtccctcgctggctgccactccctaaagccacaaaaatgaccggatttcctgttatctgagcatgcataaggtatacggcattacctgtagtatcgttttacaaccggagtgcgtcttgcattgtcaatgaaggagacagctgctgtgctgaatttgttctggaccttccgtgatcgagtcgccgattccgatacctctaagtgagactctttttgattgtgcactgttgatgctgctctgacacaccgcgtacggaagaagagtgtctgcatcagtttcgcagattcacggaggagtttgttaaagaaattgagccgactttctgcgagacttgagtaggcggtgcccgttctgtactacaatcgaggaactcgtcactgaaccctccacggtcatctaccaactttttcacaacagactgatgccttgctcatcttgaactgactttccggaagacgtgggtgtgctgtaccaatcgcttgtcaggcagtcccctgctaggtgcattgccccagttcagtctacggccgggaattaagtggcgccttgtcaaagcatccattattgagcagtttacagctcgcctacaagatatctaattctgccacggactcttccttgcctgtgcatggcttctgtggccgccacctgcattcgcgcttgataattgccgagacctacgcccgcaaaggcatacttgagtttttcgagggccgtcctggatctcctttagcagggccaagactattgttggggccgtccactcctcaaaaaga

SEQ ID NO: 1584 - DNA, 2939 bp, Toxoplasma gondii
ccatcccggaggaaatccaagacataagtgaagcgttctccatttctgtcaacaaatatgggtttgtcctctgtgccgtggtcacgagaccctggactcgagtcccgccacccagaggacaacagcgctgtgaagtagctgtctggaacactcaacaaagtttcagctgtcgtttcgtggatctttcctcccacatttaatacgacccggtcggccgactgacctcgtgacgcgcctgtcgcagactgcgcgccaatccgcggtagagacccttgaggggatcgtgggtcagtgggtggatcgagcgaagaggcacacaacattggtgaagaacgcaacaagagaagggaagcgggagacgacgctgaagggataacgcacgctttcaccatcggtcatgcgtttccgtgggcactgaggaccgctttgggggacgaatcctcgacgttctcaagcgagtgccgaaaatcggggaaaacgaggtgaagaaacgtttctgaaccgagaaacagaacggaaaaaacagaagagggactcggaagacggaaagtttctgccgagggggaaaaccgggagaaatatctgtttttgcatccgagaggcgcacgcgttttccgtggctgatgcgcctgaactaggaaacggtacctcaggatggtacagacgaggcactgactgggtggcggaggttttcacagtcaacagacacagggactcaccaaaacacgacgaaaactctcattgcgacggcggctcaaaactgtacacgggacacgcatttatcttttctatgaagatttggctaactgagttcgcctgtacatacactccagcatctgaggtgcactgacgaccgatttccctgagaccgcacaaatcaagaacactcgctgaagcttgctttgatgacactgtttttcccagcagccatttgttcatctctttcggtagagtgggacttctgacgctccaacaactccggaaaactgtatcgtttaagctgtcgccgcgagaaagtgtgcaaaccaattgagtttcaccggtggtgtagtggtccatgggatgtacagagctgcgactgctggcagaggaacggcagtgtctctcagccgccactcagtggtgtttgctggttcaagacccacgcaaacaggtggcgcatctgcttcagtccatttcaatgaacgggaagcggaagcaggccgacaactggaggattgtggaggagtctgggacccgcaagtcgccgcagcactcgcgggatacggccggaaaaagtggaaagcaatgcctcggaaaaatatcgaaaagaagggaaacagcctagtcgtaagaaaggcaaaaaagtgcaagcagccagaaaaatgcactgcgccttttctcaaacgatcaacgggctctcgcagtccggtctcaccgagtcaaagtgtcacccacctcgcactgacactgagcactagtgccaaatggctggatacgcaccactccgacgccgtccggcaaccaaagactatggaagacaagattgagtcgcgctacatgcgccacaattgacaccttgagtgaaaatcttgtctcctgaaaactgcaatcccctagattcagtgcacactgagcacaaaagtgaagcgcagggaaggagcgtcatcgtttacttcgagggatctgcgaccaggcggctcctttgtgggaaaatccatttcctttatcagataagagagacgtggggaaaagtgcattttctatggttgtttcctagaagcagacatgacactccgtacgtttggcggacgatgtctcccctgaagtatttgggttcgtcgtaacaacgcaccatgcggcgctttcctcggttttcgcgaggctcgctccgcaaggctacgcagacacatccgacgactttgcggaaacgccctcgctgttgtattcgcgcgctacactttagacaccagatgaaccagaaacacgagacaaagacctggccgtttttagtcaatcctcagcacttcctgatacagagagactggaagaagctcgtgccacggttgccgtcgctatatcgactcaaaacattgcactccaagagccgccttacgatcgggggtcagctagctccgtcgcttcctttgttgggctaggcctctttcgtggctttctgtggcatgtcttgtcgcgggaacgtaagtcctcgaaagttgcacgttctttgtccggtttgttgtgttttggagctgtgcattgtttcggccacatcttgaacgcggctaagactcggcactctgcgacggaagaaagaaacatggctggcttcggagggccgcttaccacggaatttctccaggtctgaggttgtcatgccccacgcgagtgtggccgcgtgctctcaggcatgtagcatttactagagagcggttttctgtgcctgcaaacactctgtcctcctcataatagctacctcgctgcgttgacagccgtcagtcagttctgtcttgtgggaatgtctttccaactactgttcgtggctaccactcgtacctcgaaaggaaggcttttaaatgctgccaggcgtctgtagtttcctccagtttccttctccgtcgttcttccgagtatttgtcctatgcacacaggttcagaattcgtctacttttggtgacacgtgaagcacgcatttcctcgtcaactgcactctccgtagaaaccgctgttggtcttcgtcgatacatgttcttcccactgctttttctgcctctgttttttctctcgtgtgttctttgttctgtatcgtaaccgacaacgggtgtcgacgtctccgcagagctctaacgatgtcatagagcgcatcccgaggtttcgtagtcccacgtcggcgtaggaaaggatcgtttctttaccctctttcctaccagcttctccttttcttgtcttttttctggtca

SEQ ID NO: 1585 - DNA, 4555 bp, Toxoplasma gondii
gctcaagatgagacgctgtagcgtcgcatgctggattcacaaggagagggtgttctatgcgtccaagtgagtctgcaaatgcggagatgtgccagctagtctctctggtgtcctcttaacaggttggtcgatgcgccgtggtccttactgtgtccaggaactgtatgtacaccgcgagacttctcaggaacggatttgggctagcactcattgcttggacctcgctggggtccaccttgccctgcgtctggcgattctgcatgagccgacaggcgtaaagcattccttctttctcttgttgggcgagagtccccgtcacgtgtgtgacgccgcagcgcgcgatgcacatgtcatagaagcccacataatacagagcccggcactgcagacaaaagcaaggcgataccacaaaaggacttgcaagaaaaaaaaggaaaacggcaccacacatcgacctacacctgagtagatatgcatagtcacatctacctaaaaaaatgcattcacgtgggtgcgcttcactgagtcgtgtgtacaacatcatcggcgtgtgaaacgcatgcgcatcgatacgtcttcccaaccaagcccttcgaagcagaaaatagctctgttccccggctgcagtttctcgggactggagttggagagacgaagtcgcgtttggagttgcgtgggtcgcaggagagagggtaaaacagacacgatgcctccgaatattgggagtgggacgatcaggaatcgaagctgacacggaaaaatagaggaaactccggttgtgagtgaacaaagagcagtaaggcattgccgctcctcgactctatcctcgctcctgcatgaatacatttcggtgaagtgtgtctgcgcacggtataccacacacacttgcatgcgtaggtgtatccagtgccgtttgttcaacgcattaaacgcactcacttgagaaagttcgtcttcttccattgtgcagacaagaaatgcagacacagctcagaaacaggtcacagagggtgttcaggacagcgaggagggtggcgagagttcgaagtcgcttcagctgaaacagaccgacactgcctccgtccaatctcagatcagaacaaacagagaaaacctttagcacatttttaatggcgaaagggagtcagtgtgtcgcgagaaatcgaggaacgtgaagcagtcacgtgtatccgacgcctccggccacggggaaatgagaaagacgccgagagatgagcgccacgaaagccagaagtgtctgacttttcgacgagggtttcgaggagactttggatgcagctgaagaggaaacaaacgctcgcgaacaaggagcaaaggtggcttttgagggctccaggaggatcgaactcgcagcatgcaacctgaagactctgctgcgctggacacgctgaccccctggttgtgagcgcagatactcccaaggcgttcgcgtggtcacgaaagtgcattctatcctccgtaaaaaaagaagaacgacaagccttttggattcgctttccattcactggaggacaaaggcgtcacggaggatgtgcaggcatttcggcgtttcgggtgtctggtggtcgggccctcatacgcgctcgccggactcccgtagaaaaacctcgttgtgcagaaggaagaaacgattggcttttttttctccggataagaagaaagatcaaccgagagcttaccttctccaatatccggcgggcacgggagcgaccgggaaatcggtagaaggtgtcttcttgagtacgagaacgtaaccacgtgctggtggctgcgtcacttgtaatcttcgtttatcaaaaaatcctgctctggcctgatacacaactgttcttacatagagacttcgtctgcatttgtcgttgtctccctgtaccgagttcatgattggctgaaatcctcgcctgtcgtttgtgtctgttttccggagaacacagcgaatccttgtttcacacgaaagcttaggactcgtcgccactcctgcaaggcgtttgcccatttaagagcaacttttgtggatggttttcaggattgtgatccgaggaagatcacgtcttttccgcactgaccaccgacgtcacgctttactaaacttgaagggttactgcctgctatgggacagggtggcgatttctacttctttgagggtggaaaactggcatagtgtgcgccttcatagaggaagactaagcgacctcttgttgttcttcgaaaaacaaataggtctgtgtgagtgtcagcgtcaataccttgccctgtcacggccctgggtggtggagatcgttttttttttcggtagcatggttcacaattgtactttgctattcgcggtgacaaacatgtctttgtatgatttattcgacgtacgcaatcgagagccaagatgctttggaccacaggttcttcactcgaattcttagacaagaggtgtcatgctggtcgtcggccacagtcactgcttagcgatgtcacaagagaacatggtggtgcattcacacgcttcaaaagttgcgcggatggaagtgtccacctgagatagacacttactgaatgacagtgcagagctggacgtcgaccatcagctgtctttcgtggtacagataaaggacaaagcgttcgcgatacctatacatatatatatatatatatataaacacaagtgtgctttaggtgatccttgttacagaaaaacgggtaatagttcttgagttgtcttcagtgcgggtgaaatccgcagcatcgtctacaagcagatgcgccgctgttcttactctatttggacaggccgcccgtctgacgcagcttcaactctctctgacttactgctacagaacaaaaacagtttgccactggtgcaaatttaaaaaacaatcggtatcccggagttcaaatcaaccatcgcaatcccacccaaacctactctgctggtgtaaaagacttcacacggcacgccgtacctcgccgttggatattggtgtcctgagtcacataatagcaggtgtctggatattgcgcctacaatgtggccgatgtgcaaagacctcagtgtcgtaggatgtggaaatcgaacacttccagccatcttaatcagtccaatgtagtggtggtgtacagcaatcatagatcaagtggctttcaggatcttacaactggagtcatatttagagcgactaacttttgaaggtttttcccgtcagttcgtccttggcaaagatgcttcagcggtggtgctccactcaccacagccacggtgatcagtcgtcagagaatcgctcttgatacagaaagacctatagcgttgggcatttcttgacatcgccgctctcaatgcgcggcggtgctcactttggattccaacacaggacatcgattctgtgaatttgagaggtttccgacttccaaaaatgactctcaggttctacagtccgtctactgcctccatgacgtggctgccaggacattctgggcgcacgccttgctcaggctgcgggcgccactgctgtggtgaaggcttgaaccctagctggccttttgtgtcgttgaggctacgggagcattttctccgtgaaacggcgtgaatgcctccctttcatgatggcaatgatagtttccttatcagtacactggccggaaacggccatcatctgtcgagtcactcttagccccccgggaaatggctacatccgtggctagcgaacccgattttccgtggggcctgtagcgagtcgctaaagagggttgaatattgagctgtatgtgcttttctgaaggaaccaatggtctttatcaaagtatcaaccgcatgtcgttaggatcaactgctgtcggaaatcgtgacgacacacttttgttgcgcgaaagcgcatttctctttgcctcgtgatgccagcacacggcaccgtccggtcgacgaaggcagtttatgtggttgtactcgggtgaattcgaatgctcaccggagcgttttgccgcagatcaccacgctacgagtgtcacactgatgcgcctcggtctgcggggaattaaactcagtcagttttctagtaagctgtgcctgtcattttttgcgtcgtgtttggagcgcggacccagagaatccgagcaccgtgcgttttaggcccctgtatacagtgccttccgttcgtgaatataacaggtgctgttcgaaacattggcatttttgcatctttcctgctgggtgactccgggactttcctcctcccaaccgtatactcctctgtttcgtctgtccgtgaatgggtcttgcaccgcaagcgttcgtaaaagcgcagtgcggcagtcggggcggcgatttgcgagccctgaagatttcccgaagcaaaccgtgagatttgtagaatgaagaacgcaagttgtgcctcgtacaacgaagttgggggaggtaacgagagtaattttcaggtgtgctacccgggtttccgacacctggggctgaaggtcgatacgggagaacggagaccctgaatcacctagctacccgaggtgtcgcttcctctatcttccactgcagaattaa

SEQ ID NO: 1586 - DNA, 2064 bp, Toxoplasma gondii
atttgtctgtcttctttgttgaccagattgttgtcttcgcggtttgggtgtttcctaccgcggcgtgcggaattccgtctttttttgctacggtttttcgtcttcgactgtttgttcggcacacctgaaacacagagagaagatcgagaaacctgcagggaaaagctttcgaccatccggttccactgcgttgctttctcgtggaaatgcgcccaatctcggaactccacgtttcgcgtttggatagtcgatttgagaacaagaaagggggaggatggagcccgagacagcgtgctacttccacacaagctggaaaagacatgaccatgaaattcgcgcacatatacgtgggcaaaccagcaatttattcacgagaaaatgtaagcgactaagagcggtctccagagatcctcatctccgggtagaataaaaaagcaaagtcttccggaaggagcaggactgctacgggcgccgcacatgcttcgcgggccacgatttgcccgtagaaaatatcgactggttttcaccctacatccacataactcgtagactctctctctggaaggtgcgtgcagatcacttgtgaaaccaccgttagctccttttgtgtcctacgttttctgcacgactatcgataccgcttataaactcattccctggttcgtggtagtctcgagtataaggaaaactactacatctacggtctacatcagacgcacattgaacacaaaaagcactactttgtgtacgttctgattcgaacgcacctttaccccaatccctgcagttttggtactctagggaagaagcaatggcactaacgcgtctgtgtttagaatcaaacgccacgctggtttgctgtaaacgtaacgccagcactctgtcagcgtagaaacccgcaagtcaccgtggggagtcccaggactggggggcgagaaacaaggtgcgaacttcactttctctcagtcgtttcttccccgacaaaaaactcaacgtactgtgataagacaaccaagtgaagcagtaccgctgaagacactgtgtgctgtgttccattgttttgccaaagcgcttttgtcgactgccgaaaaaaactgtcatccttgatcatccacatccaggttatctgcacatcgcacacccaaagtctcagaaaatagcactcaatctctctgacgtggagttcgcttgggagcaaagccgatccttagcgttgagagcgagagacagagaagctggtagggctgttccgaaaatgccctgtaccgcctgcgaggaagtttttcttctcagcggtttcttcgagaaggatggagtcattgttaatgcaggatctgccttcttccgagccacaccagtgcgggactaaagaccctgcagtctctggaactctacgtgtggagactgaggcagaaactgcttgtgcatgcatgcacacacgagacaagtgattgcgaccacaggcgagtttcgaagcctcttggtgaaaaagggaaagaaacttcgacacgcttccgtcttgttctctttcttgtcaaggttttgctggctgctttctgttttcttcatggaccaggcagatgcgcctcaaaaacgtcgatgagccggatgccctgacgagtcgtgatgaaccgcatggaacgcgttccccaagcgaaaccttgaggcggtattgatgcccatgacggttgtgcacctaaacgagcgtttaaacattaattgaagtcattttgacctcagtgtgtaggtgtagttgacgtgcctctcatcgttatatggagccgagcgattcactccgctgctccgtccaaccacaagaggttcaaagtatcattacatgcagtgatacctctgcctccctctctggttaatacttgtgtcttcgtttgaccttttccggtttagtatatactcaactgccttcgtaggacgggagccttactttggaaagagtgttctgacgacccgcttggcgcgagtgtttttatccatcgtcaagacggaacacgtccgccttaccctgatgcggcccttttcgtcgtttttttcttcttacgtgaagaa

SEQ ID NO: 1587 - DNA, 3675 bp, Toxoplasma gondii
accgtgtcgattagatattcaaacccatgcacatccattcacttttgacgatgtgtaaaacaaagagatgtcagaagagaacacgagggcgttcgcttgtggctgcgtagatacgtcgtccggagtggtcgttagttttctgtgaatcttcgggtgtcgtgaagtgataaaatgccaggcaccagagacgaaatcgcacgcggtatagggtatagtgtgagctcgagtttttcgtcctctgattagttaagcggttagaaccacttagaaaattcaattcaagaacactctgcccttgcgtcccagtggaaatactgcgaaggcgtctccgacacaatggtgtcgtacgtcatggaagggactgaacagcagtccttgtttgcttggtgctttccgtgtgtaaaggtctgcgagtctggcaaggttcatgacgtgagcatcaaacagcttctcctggttactgatatggccaaggagttttcgaagcccggtaagcgttcattcaaaaatggagcttctttcgtgtctgcggcactatttccccagccacaaaaatagagggaaagttactcgtaagtctacagtcgcaggatcagaaccatcaaaccactctacaaaactaacactccaagcctagtagtttcatgggtcaggatttcggcggcacaatggtagcattgatggcgcggtagtgagatgtaactgcagagtaacagaaattgttcggtaaacagaggtagtggtcacgcactcgtgaccctgatcagaagcgctcactttgacatgcttcgaacattcctgtttactaggatactcgcaggtaaaatgttttgtcattgccgacaaagtccggttgtgcttgtgtcttgatgtgacatactgtgactttcaggtcccatcaaatgtggcccgttccttcagtgcttacacgattgtggctacgaggggagttatgacccaatgcccttctgatgcgttactcggcatgaactctttcgtgatttcagccatttacaccggtccagtggcagtgaaacggaacggcgaccgcacgtcagttgtcgtttgctctttttgtcaaagacacaaaacttctcaaacttttcacggagttttcgcccttcattatttgtattaccccctctgaagacagtctggcggaaggtattttcaggtgaacgccggatgtttccgaaaatttatattcgtagaggcctttacccaacttcagctgtctacgactactagttcagttctccaggaatcgctgacaggatgcgttccgcgtcctgcattcgcattattccccccatgcagtaaacggcagatcttcctttagacggctttcctaaaacacagcatccacggtgttggtacatacgaacaaggccaagaaaacacaagcgctcctcccacggatagaatgactctgtttctccatatttaacatcgggcccaaagaaattgtaacagacttcgacgctttcgagacgaccacacgatttcaatctgctgtgaacgctgtagtgaagtcgcgttacttcctatttttctgtagcaacgcagatgaggacagacatctcaccgtcttttcctgtaggtcagcagcccgttgtgaatgaaaggtcgacaggtcctgaagagcaaatatgtttgcatgtagtggtacattcggaaaggtcaacggcgtagggcaaaaaaattatcaatgaagggccttaaaaagcagagtacataccaatcagcagtcaaaaaccagtgatccgctgtgttttatctaaaatcgtgatgtcgtttatataacgctagtaatgcttgtcaagttccttgtaccctaacgccggatggtactcatgtcttcccgctgccaaacaggacgggactgtagtccaggagaggaaggggacgggagtatgtggatagaaattctgagtcgattgcatccttgctcacaattcattgtgccgagaacttgttttgcctataaagttgttacagggccacctactgcttccgacagcccgtctacggtgtaagtcgctaggggcaagagacttgattaaaaccgaaatactcgccagtctacatattcatgaagattaggggcattgcgcgtccattgtcgaatggccacataggtttctccaagtctataagaagtccaatatgtgtgttaagctgtgctaccacttcagcagaagtcaactcagcggtgaaacacacacacaacgcaccgttcccccgtgtgacgagtggactccacgtcttcctaaacccctccatggaggctagacactacaaatgagcattcctttgaagttagaggattgttacaatcgagtattggagtgaaaaaagagctgtcgccatgaaagtaccttaaggtagctgaagcattcgacgcaacgcgctgtggagcccccggccctaagtatctctcgaagtcccaaggcaggttcgcactacaacactgaattgccgagcaacggatcttgtttcaaactccaaaactcttgccattctgagtacaaactgtcgggtaactaattcttttgctataacgcctttttctgagtcgaacgacgccagttttccggtcaattccctaccatctagtcctttgggccaacatacttgaacagctgtttgcatcacgaaatcctcttgtgcctcgaaatgctagcgaaaactctagttgtctctactagcgccagcgagaaatgccatcgccgctgatgagtctgctattacttccgttagacccctccccgcaaaagctagctcagagttgagatcgactaaacgagtacaagacatgatggataaaaattcagtttgccctccaggcggccaccgtaagaatttagcccggcatgcagcgggtggacgagtagcgaggcgcccgtgtcaatgtcttcccagctcgtgtgtactacggctcgtcggtttggtgactgacagtcggtcactgcattccagtcatgcacgtatcgtgaacttttgcgcttgagtcctcacggaaacttgctgtttatatcgtgagaaaacaacgacaaaataacaagagatcccagagacttctcctctcaatcggcgccagacacgccacaccggaggcctgtccatcccgtccagctcaagcggtcaatcgcagcctagaagacgccgatttcgggggtggaaggcacatgctcaggcgagcgagcgatgtcgagccgaaaccccagcgagcccctcgtgtttctgtcgttccttggggtaaagcagtgagtagtcgctatccgcggcattccctgtccattgatgacgcattcgttttactgtggcgacaaatagccgcacttacgtacctgtttcgccgataataaaggccagttgtctatacccctcccagcgaacgagatctggtgccgctcccaggcgcgcgaggatacccctcaggacagacaagacccggcctgcctgcaattttcgatgacccgtcttctgaaactgcgacaacttttgcattttctgtgaatcgttttttcttgttcagttccgtattctttctgagtggtctgggaagggcatgtaacccctctgagtaactggaagactgggcccgtctcgcgtggcacccggctccgaatgtttttcgccaacaaggagaccctgctcaaggcaccggcacca

SEQ ID NO: 1588 - DNA, 1909 bp, Toxoplasma gondii
aaaaagattgtcctcggcgcgttcattcacaacgaaccaattttggaggaacgggaccagaaaaaacacgaaaaacggccgttctatctattatgcatatatatatatatatatatatatatattgttcaagcttgctaggttcgtttcatctgagacggtctctcagataacggctcttgagcgaacacctcagcatcatagtcagccgtggggaaacaaaagtgccttgtcgcagctacagccgcggttgtttgtgaagaaagatgaacatcatcctagttgctcgagtattcccactgtttgtcacatacacaccctttaaaactcgattgtttacctcttagagggcgcgaaagcgttgtttctgtctctgagggatatgtcacatacatattcgaacctgtgcatactatacatgcatatgtttatacatctgtccatcggtgtatacagtttcgaactgttttgggtgcatgcgtagctgagcaattgccacagcgtccgcctctgcagggtctcgattcagtgtctcctcccgctgatacaaacgatgtgggtgttttcgagagatcatgttttgttccgcagttcctgagtgaaataaagagaggcacctgcagagagaccggaaaaccgtcctggggtatttgaaatccgccgtgaagaaacgcgacccccggacttgagtttctctcgacagttcactctcctgtgtgtctactccttcggcagtcgctctctctattcgagagagatgtccacgtgtctggagtgcctatctcagaaaggaagattcagaaaagctggttgcccagttgctctctaagccctattttctacatcgcctcgagatacagctcgcgtgtctctaggcgaattccccttgagcgtagacgcccgaagagagaaatagcaaatgagaaaagagcagaatgagctagggggacagggaagacactgacaaagggtcgagaaaaatcaaggtgagagaacggagaacacagacacagcagagaggcgagggaaggaagagagtgcaagcacgaggaaaacagaccacaacgtttcttctttgacgagtcgtctgctagcggaacaaagctcgacggtgtcgctgtctgtttgtcgcatgccgaggaaaatttcacgggatgagaaaccacgcgttttttcgcacgtttgcatgtggagaagtccagctcgcgtttttgagttgaccctggcaaaggcatcgtgtggggctcgacggcagacttcgttttcggaataagatgcgctttctcgtcgacgttttcgtgattctcttctctctctcccccttttctccttaaccccccatttcccctctgttgttacgccccaggagcgattcgcggctcgctgctgaattgctccttccgttgaccagcgctctttttgcacagacccatctgttctcgagttcgtcgtttcgcttgtttagaaaattcattttcccgcatttgaattgagttctctccttggtttttctcgcttcctccctcgtacacaggcgttccatccccgctgtcctccctctctcttctcttccaccgtctcggtctcagcggctccgtctgtccgcctctttcaaaactcacgacgcgtcttttttttctcccagtttcctctttttctcagaggaagcaacgcgcgcctccaagtggacgtgcactgcacaagcgttgctggtccactccccccgagggttgtcgactgacgcaaagttccgacactcggcttcttcgcaagcttctcgcttcgttcacgcgtttcttccttcacagctgcatgcggcgtctcttcaactccggctctttctcctgaggagcgtcgtgcgagttctgagcgctctcttccacgttcgacgaccgagccgtgagccgcca

SEQ ID NO: 1589 - DNA, 1812 bp, Toxoplasma gondii
agtgtgttatcaccgtcgaactggcactacatcaaaggtttaggacggtcccgccgccctgcgttttactagcggaatggacatgccatgtctaggggaggtttacggtactaaagtgaatcggtaacaaagcaattagggagttagtggcgaatgtcccccacactacaacgtactcaaccttgatcagtcctagctcggggcaatcgtgaagcaaaaatcgacgacttctgttctgccgtttaccactgacaaatttggagtgcggatgcgctctaatttttccgaacgaatgccacaaaacaatgacttgtttcgacttacagaggtaccgtgactttcgctccgcgttacagagaacggatatcacctcgactcttcctcggttcgccttaacgtgctagagtcacattcctacaggaaaacgtttttgcactgtctctcaaggttgactgaaagctttcggttaaagaagtgtgtaatgtctgaacaaaacggtgttttttctgtgtccgcgagattcggcgaagcgaccggcacgaagtggaaaggttcctagcatgttctctaaacaggattaaaatgcgacattcatggtgccagtaccacgaacagagccgggaaactaggttgctcagcagtaatcggttatctcaaatgtgcatctgtcgctgcatggcgtatgcgtttggaggaaacaccggggacatcgaccctagataatagagctgcatgaattctaactggtgcgtgatagtggagctacattgtgtcttgccatacctgtggcgggaatgaacactcagattcatcggataccagggcacatcgagaggtgtttggagctgcgccagtaacgtggaagagcgggtgaaggcggcatctccactgagccgttggtacatccacgcaatccttcaggtcgcagcaccatcttcgacgctgtgcatgactggggctcttgtttaacctacttttgtgtttgatctatccacgttatattttatgtctcatgaagggtaatgtgggtcccttttccgcaccgcattgaatctcagactgcgcttcaagctgtgttgtgtcctcgcatgtgaatggcgcatgctgggattaaggttctaaagcacgcgcgcgccagaaaactctccctccggatagagctcgaagtaaatctacttttcaatgtccacaaaacaggaacacgtgttggcatagtacaatatatcccgtgttttccagcttggctggtcagctccacatctaatgacatcccgccggaaagcgtatctgcatgcatgtgccccctttgtctccgtttggcgcgacgctgttacccagagacctgatacatgacaggactgttcacgacccctatcctcacccagaggctgtactagatcgtctgttcatcaagatcagggcggtgtcttccagaataccacatgtcacggacgcatttatcggcgttctgtttttacgtcggaaggagcactctcttcggcaaatgtcgccccggcaacgtatctcgacgcgcacgcatctgtatgttcgttgcaagggttttcatccgcctaaggtcttgcgaatcaattgttgtctcagaaaggaaatttctgccctacggttatccttccatcaggagtagaggggcccaagtccgcatatcagcacgtacacaggcaaagtgtggtagtctgcaagccgtctgcagcggtacctgcggactccatgtccagcccgtgcatttccgcgtgctttcattttgcagtttgactggatgctgagcgctggatgttcctcctccctacctaa

SEQ ID NO: 1590 - DNA, 2561 bp, Toxoplasma gondii
gaggtcagacaattccagggtgaaaagatgacaaggaaacgtcgatatacgacagaccgcagacacacggacttccggcctcgatcctcaggctgactatttgacagtctccgcaccgtgtgacgcatcctctctcgtggcgtgcatgcaagaatccacaagcatctcctctcacccagatgtcgtcttgaaatgcacctcaaacatatatatatatatatatatatatatatgcatgcagttgtgcacacaaaacgatgcatacgtggatgtattaaccacacacacagttatgcgtggatgcgcatactcttacatataaataaataaatatatatatatatatatatgtttgcttgcgtgtatttgtgtgggtatgcatgggcgtccagatatgcctgtctaggtggcatgtgtttttggtgagcactgaggctgcggaagcgtcctttcctttttccattttaaagtctcacctcgagtgtctcccatgagtggaagagaatcacggtgtgcagcgagttttgaaaagacatgggcatgaccccacagcaagaggacttatgtccctccgcagcgacgtgggcggttccttccgcagccactgctttcttctttttacagcaggactgttttccttcactggaaggtccctctccgcccgaccctccggcagcgcctttcttgtcgcagcaagactcctcttttccgtccgcctctctcgcagcagaagcgtcgtcggcagcgcgcttcttctgtcccttgcagcagtcctcgacatcttcatacctgtttctcggccgctgcttgtcatgcgtcttatctggcgtagcatcggaactggaaggttttgagctgtcacggtttcgctgagggtcgggcacctcgttgtcagaagagacgggagagttcgaggcggaggacagagcgccggggagagaagacacgcagtgaagcgcgcaaacaaggaagaacgtggacactcgcagaagagaggcctttgattgaggaccggtcggaagacctcgccgtctggaactggggattttgcggagggacagaaggtaggcttccgtctttctctgtcctccttcgcgtccagatctcggagaagtgctcagagagcaggaagcacctgactgagcgtgcgttgccatcttgactctcttggtctgccctctgtaggtctttctcgaacgcgttctctctccccacggagcgcacacacttgttaatcggaggttcgcttcagcctatgattcttgtgaagttttctttcctctctcgcggagagtcgccacaggagagacacgcggcgtgtgtctttgactcgcgggggggccctcggcagttgaaggcttaaaccctaaaagtccctaaaccctcgactcagaggcagcaagaacgcaggaagagttttgccacctgagtcagacaaggcagacgggaatttccttcgtgaattgccaaggtgtcgtgaaaggagacgcttcctgcatcgcctgtgcctcccgcggggaaacagaggcgcctgccttacacgtctcctgcaatccacagcgcagaacgcgagatcaaggtggacgcgtgcttgcacggaaaaggagagccccccgcgaacgggacagaattgccaggttgacatccacttttccgagaattcttccgaaactctcgcttccttccatcgaaaacaaccaccaactcaattctgtcaagggttgctgatccaccacacagaaaactcactcgcgagacgggtgagaaggcggtggggctgcgggctggggtggcagcgaagcacgtgtgttttctgtggctttcacagaagaaacccttctctctttgcaggggttatgtcggcgcaactcactgctttctttcacgtctttcgagagaatttcctgcccgagatgtgcggagaaaaaaggggaagtagcgactcattttactgacgcgttacagctgaaaaagctgcgggtaaaaaacctagcctgacctactctgcaaacaattttagttttagcggcagaaaatgccactgagagcccacaagaagcctgtttcccatatgcactcacacacagtgctctgttcgagatcttgtttgaaaaatactcacacggaagcgaacaaggcaccgggtttgccgttcggtgtttgcagacgcgcggcattttaccggtctcgactttgcaggaatcgtacttccctctcctcgtccgtgcttgttttttcgacgttcgttccgagctggagtgccttgcagcagcgacacgtagttttctcgagggtttgcggtggaagcgaaacacacgggccttcacagggttccacttcgctgttcagtccagtcgttctaggtttgtgctctgtactactcaagactggatctgtcggtgactagaaggcagaggctgtcgcagaagtacctcttctctggagatttgcgggtggagttgcaaaggggagaaaacgacactgcagagcgaatagatgaagaggagagttgacgagaaatggatttcttcagaccatcttgagtttcagcgttactcaaa

SEQ ID NO: 1591 - DNA, 1369 bp, Toxoplasma gondii
agtgcggctgtccaaatgttagtcagggtaaagcgagtaagttctgcggaacgctgaattacataccatgcatattggtgcattcaagtgacagacggattcatttgcgagcccctacacagtacactgcttattaccctctcctgaagaggcattatcctcgagtgaaggactccgactgacttgtgaatattccccgagcacgaagaagcactattccctgagtagacggtgcatcattttcctatgtttagctctgttgctactactgctccctcctctttccccatgtctcttataactgcgctttcttgtagaaatttcccaggttgccaaaaactgtggatgattaatcacgtaatgatcggtggttcccgactgttgccgcaataggcagctggcgaaaaactggggaaatactgccagcttttgacgctccctagtcttgctggattctccagaaaattgtcgtagataccgagaacctcgactaacaaaacagggttctctccagcaacattagcaacaactcatttttttcgcgcaattgtaaaaagaggccaaggtttgcagaagtccaggagccgtccactcggcagatatcgctttggtgaaaatgctcgcttccgaagtgactcactcgacactagcgttgccgagcaaaacatcaccagagagcacatttcgacaattcaggaaatgtgaatgtgtggtggtgggttcttttcacctttcctagccgagcaaactaatgtgatcttgaattcatctccggctctgagaactctcagtttttaacaagaatttgctatttttaaagtactgaaggttgtttcgaagaaatatggaaacgcacacctgattcacagaaacgctctgcagactcagtgttcagggggggacaaagatcgggacagccaatccgtgggcggtctacccctcacgaaactcgacaattctgagggaacctacaacgcattagatcctgtctttctctccaaatgtgaacgtagatattctgagcagttgcactagttttttccagtgtaacttagacggcggctgctgaccaatagaaggtgcatgcacacctgccctgtcgcatgcaccgacatttttacgcttgaaactctgggacatggaacgtctttacaggatcaaaacctgaagttgccatacccctttttttgttcggataattttagatgcttcccagggtctcttcaagttttcgtctgttgctcgtctgggtggttttgctcacctgcatgtcaatcaccgagacccttgcgcacacgaacgcgtgaatacggcgcgttctcgattgaaacgaaggcatcacaacatcatcctcgccccggacccaaca

SEQ ID NO: 1592 - DNA, 2204 bp, Toxoplasma gondii
ttcctccaggtttggagaaggtgaaggaagtggcaaagaacattgcggcggtgtgcgtggaaagtcgatacattgaccccgtagggtcttcggcgacgaagccgtcggagaattccgcctctccgtgcacgcagacagtggacgattacgtgaataaattccagcatgcaattatgtcgcttacgtaccggtgggcaaaaggcgagaaattcgccgatgtcctcagcggcacctcgatctacgaaggaaccgtcattcgctgtcttcgtagactggaagaactcatgcggcaaatggcctgtgcctccaagtcgattggaaaccccgaccttgaaaaaaagtttttggagggaatcaagaagatccgtcgcgggattgtcttttcatcctccctctatttgtagacaggaaagcagtcttcacggggagcatttttgccgacgtttcaaaggggtacgaggggacaccgattggggagggctgtcttgcttgttttgtttccgagtcttgcaaagaatccgtaactctgatttcgaacggcggagacgaaatccaggaaatccgaaaagaccgtgcacgcttggcaaacagtacgaaaggtcgttgttgtcgattattgccgatgtatgtccggcgggaaatactaaagagaaataccagagacggggaagtgatcctcgtttccttttgcgaattggctccagagaaaaaggggatcttcattggagacagacactccaaagttgtcactgaagcgacctcggtggtcgtttgccatttcacacatccgataggctgagcgtcggtaacaactgcgagaaaccgaatccacaaagacatgtttctggttggaaagagccgtacatcttgtcaggagttctgcagaaataccacgccgatcgagtgttgagtgatctttgccaatcacgttcggtggacggatgcatcggtacacactgaacacgcaggcgctcgtgggtgattcacaaaattgctgatatccacaggcctccggtgaatgcagctggaaatcgcagcgtatgtgaatgtcctcccttacaatgctagacaaagcaggatttgacatgctgaagtagtcgaacaggcaaatgtgcctgcttcatagatagtctaggtggagtattgcggtgaacacttattctgtctgtaataccgcatactgtgcttcgtttgtgtcacgatggcgacgtttaagtcttccaaaatcacgccatcagagccagtgacccgtggtaaagatagaacggaagtgctgcagtgagtgtttgtgcggcacctctggccatttcatatccaaggtcttccatccagcgacaacgttggccgcaagcaagagcatgtttcttcgaaatgatggaactcgtgggagcgcacagaacgatggttctgtgtagagaaagccgacctagtcgtggacgcaaaataacttttgagcgaactatgtggaaggaaatgagcccgtgttctctaccagtgctcagagtaaggcttggctcgatcgcagaaaaattaaggtgcccttccgcagaaaccactctgctagctattggagttgtttgacgacacaaagacgaattcctgctgtacactagttgtacaatggaacagatttgttgccagaaaggtccatcgaggcctgccagcattgcacacagcagagttgtcacccggatcgtcttgtaggaaaacggatgagaatttcggaaagattaattggtaaacccggcagtcggctgaacaatgcagtgattcctcttcggtttcttatttgaatatccaggaagatgcactttgggaaattcccgcgttagcatcgctgcccgaatctaccgttaagagtccggaaatgcccgttcgaatgctaacaacctggagcgattgacggcggtgttgattcattttgagacctgcctacttgctgcacacggttctgtcgtttggttgtaccttgtctgttttgtttcgttcctggatcatcttcttttcaaagaagcaatacatcgcggtcacgtgttgtggaattccgtctactcgagacttctctgcatttcagttaaggatacctcccttcgtcgacagttggcccagtgcatgtcaaatatccgtttttgttgtaggtccgagttctaggagctctgtacaagcgctgtgacactggtttcttaactggcttcgccgatcta

SEQ ID NO: 1593 - DNA, 1763 bp, Toxoplasma gondii
gaggagcatggcaagacgcgcttcgacaaatacacaagtttctgaggcgtttcaggtacaactggccatcccttctccctcacccctcgcacctcttctctctgcggtctcttccacgcttatagcctgaggcaggttctcgaattaaaggatcaataatgttcttttccgcgcttaagtactgcccagacccaccctgtacaggcttggcttcctctaacatgtttgtttctcgttttcgaggtttgtggcacatcttagagcactctcagcaattcagatggtcatatttatatttactcagagataatatgcaaacccacatttgtatgcgtccgtgtacatgggccatttcgtctcgagctcagactacgtgattgtaatcggtcatgtctcagtttcagttagagctgtactggacggcgccgctggacaatttttcaaagtgaaaagtaaacagtacagaaacgccttctctggcagtctttcgcagattctaatccgtttataaacagtgtgtgtggagaagcacttggcgccattgtcggcaaatgccagtccagtcaaccgcaacatgcagcaaacgaactggaaaacgaggtgcaagagaaactgacgactaatggtctaatgaataaaggagagggaataatgtagttttcaacgcgtagatgcatacatacagatttgagtcgtctcctgacgtagtcaccgctgtatctcaatacaaacctcttccagacatccgagaatctgcacaaacagttctatttttgtatgcgggtatttacatgctccccctgcaattctgctttgttagggggtatttgaaatacagttctattttttatggggatgtttgcatgtgcagttcaatttctaaaagggtgcctgcgagcattccaacgctcttggtgggccagtcggcgtgtgtctgttctacgcagtttttgcctgtttcggtgtaacgcgggaacttgcaggtttcgctttcttttcaaattccacgtcattacgctggcttccttatcgggggaattcatctgcagaaagaacctttccacgcagtctgctgtcttgtccaggacggttctcctctatgtgctgttcagaagcgcgacttcctcgtcaatttgtgtttcgagggggaacttcttctcagtgcgttgtcaaggaggagaagcgttctccgcaattccttctcgaaaaaggtttctccgtttcctctacagagggaaaccttctcgattcgctgactgcagcgagagtgcctgcatgcgtcaagcgcacatcgatgcttcgtttgtgcggttcgtcgagcgttttcctctctgcatgcggaggcgagcgtttctttcctcggactcgtctttgtggcctggagtttttctgcttcgctgggattcctccgtatttgcacattcacacggtgctcgcgagacttttttattcgcgccgcgcgaaccacggcccttcggcgcgcatgcatgcgcagaaagaagagagacaccgagcagtcgtcctcccgcagaaagatagccgtttctttcctctttctccctccaccatttcttctttgtctcgactttctccacgaacgcgccaatggctgaagaagatcgtcacagtcctttccctttacccagttggcggacatcgcgctgatcgagactgcagggaagcatcgcgaaaggcagtgtggctggtgcctgtcgtcgtctccctccctgcgtctctcgagagaattcatgatgtagagacca

SEQ ID NO: 1594 - DNA, 2270 bp, Toxoplasma gondii
cgttggaggcagagctttgcctgtgctgccggcccttctttttctgtgggctggcggggtttacactttcagaagaaacctcaaacacttcaaggtcgacagctctcacaaacattacttcgtcctcctcgttgctttctcccttgccggcacctcccgcattgtgcaatcggctgatgtccggggacctctgtctttcctcatcactctcaataactattctctgtcttccgagaatgggcttcgcttgctcgccctcgttctgcatcgtcagctgcacattttagtcacttctgctgccacctgagaatgccagggtgtgagctccgcaactcgtctacaagccgagtctgtcattgcagctgtgcaacaaagttctatgtctctctcgcttcctccagaagtgtctggaagcgatccaaatatccaccccctcagaggggaagggtctgaaaggaaaaagagctgaagaattccgcgacgagacttgatgtcaccgacagagtcaaaagagaggcggacgggcagcagaaacaaggaacatgagcacggtagatttgaggagagcgacgcttctgaatcctaataagccgctagagtgacacaggttgtaatctgaagtacaaaaggcactgcaggtaagaattcgaaagttccagggtttctatatacagaagcatgcgtcgaagactccaaggattgcccgttggagcaaaggtaaagaaacgacgatcgcgactgaattagaatggacaaaaaacgaggggaaacacgggacaggggcacagacccacatcagcagcaagaatcgatcgggagcgcgggaaaacgcgcaaatactggccgaagcgagacgcacacggcgtacagtttttctttgcaatgcctcggagactccacaatacatccatggaagagccagagagaaaataacaacgggacggatgaaagtagaactggtggaagcgggcgtgtcctcaaggcggatctactcgtgggtctcgtaacctagatgcgccaatgacggggaaaagcgagtttcgacaagcaaaggaaacaagcgtaaagtgcaatggaataagagagacagaaaacgactaagacaaaggtacatggtcagcagctggggactgtgatgtgctgtgtctgcgggcgaggcagcggctttcgttcatcacttgggcgaatgccctggccagggactctttgcgcccttctaggtctatcgaaagtggacgttcctgatctcctgagagttcttgccttctgaaaaccaagacagggagatctgacatttttctccccgtttgtcctcgaaactttagtctccaacgtgcggttgcatgcactgcccgtgcatctgcctcggaaactgcgcatgcggcatcgctatcgagacttctgaaagtctctcgacgtgcagcgataagttttcgtgacacgcctgccagaaacgttttaagacaggaaaaataagtgatcaattgcttcagccaatgaggccgtgctgccaatggccggtgtcgaggcggcccgtgacgtgtgctgctttttttctgcacgcggcatgtgagcagccggtttctcttaaaagaatcatttgtcctgtgaagcagacaccaaaacttggacatgcctattttactgttgaagtctaaaacgtggcttctcgtcaacaccgatgacagaaacttgccggcaaattcctgtcttcaagcgctcaagcagagcagtcgctattgttctgttctcatacggacccaggtctggacgatgctggtttcgcatgttgtactttttgattcccaaaacactgcctaatcctgctccagaagtccttgaagttcgccgagagggaggttggggagtctctgcggaagaaagtcaggaaaagtgtgcgttcgttgatcgtaaacccgctcctgtgaaagagccactgcctcctcggtttcaccgggaagacagagttcgttccaaaaggcgcatttcttctctgtccagcacttgcgtttcttcctggtgattcttctcattggaagttctttgcctctcaaaggcttttaacccttgcctgcgggtcacagccagttgctctgaacccgtcgcgcaccgttccgccgcttcgaaactcgaattcgcgaatttgtcgggttctgagttgcgttttctcgagactgcctcgtgtttcccgcatacgggtcccctctgtggtcctttatcaatttcgttgctgggttcttcctcctttctcagtggcaggttccaaaaaa

SEQ ID NO: 1595 - DNA, 3178 bp, Toxoplasma gondii
aagttgagaagctcatttggagtcatgtcgaggcagagaagaacagacagttcggcagattgcaaaggtggggagaaggtctggaagccacgaaggagattgcaagaatcgatgaagaaagttcggtttgctgtcactcaaggagatgcaagactctgcaggattctccttctctttctgtcgctgcgactcgccgtggtggcttgttcccttgtctgtagtcgcctttacggtcttgacgcacgcagccagaagaggtagctgttcatagacatttatcaatatttgaaagtcgcattcagcgtcggtgtttcacggcgcctccacaggtttttcttcaaacacgacaaaaaaccgcgcttcctctcttcaacttgttgcggagctcttctctctgtgcctgcgtacctgctgtctgtacacttctgcttcgaccccagttcgagaagcatccgcttgttggcttctgtccttctttcgtcaccgagcctccaccttgctccctcactgattagagaggcctaggcatctgtctctcttcttgcactgtgcgtttgctgagaaaagacgccgagtcacccttcggcctagccacgattacaaagagttgcgaaaaatatgcatttattcggagaactgtgaatcacatgtatacagcacgccgagtccctctggagcggcctgtgtggcagaggaaactctcgacagaaacgttcccgtacgtccgccttttgtggtgcgttgcggcttaaacacccggtgaagttcagctgggagcgctggtcacatctgagtggaatgtgaggagttcttctcgcgccgcggttccttccagacagctgggaggtgaatgcgcgttccccctcgacagaaagacgcagaaacagtagactcgatgacgcgtacgcacactcgttgagggatgacagagtcgtcttgtgctcaactcacacttatgttttcctctatgtataaatagttacatatatacttacgttattcacatgcttatacatgtatattggcaaacacctgccctagcgcacgagaggtagaagggagttttcgttggccggtgcagaaagccgagaggctgggcaacgcagatccacaggtccacgaaaacagaggggagaaagcgtcgaagacaggcgcatttgagcgctacccagccacgcatgtgcgagaacgcgtgcacaactcatcagctacaatgatccaataattatttataaggagacatgcagaggccttatgcttatttatttatacatatatatatatattatatatatatatatatatatattcatatagatagatagacgcggcggagagaaggaaaggcgtacatcgtgtttgagaggtcacgggcgagacgcgagtcccttctgctgagatggggggatggctatttaccatttttcgaaaaaagcgtcagctgtggagatctgatttgcgcgaagaacgtgtgcttgcttttggtgtgacaagagagttgcatcttgccgcctcgacgaaggcacgagaaacagtaccttcgcggcaggcgcgaaagcaacacgaagatcgacgtttgcgtggggtgtatctccgaagtgaatttgtcttttatcgctgggggggggggggtcggcaagtgacctagcgttcttttcacgtagctgcactgcagcgcgaggagagtcagagaagaggttttcgcaagttctagagagagaagacgagagctcatgtttgtcgacgcaagttggtgtgcttccgaatcgccaagaaaaaaagagttccttcgtcactccttggctccacagagagtcacacgcatctctctctctttaccatcgcgtgtctgctctgaccggaactaaactgccaaacatcgagcacctgtctctacatctactcgtggggaacgtgggcggtcgcagtacacctgcttctagatgtctactccagacacagagaaataaagatacgcgcatgcatgtgtatactttattgagaccgagatccccggagccgagtgtgcagccgagaagaaggcaagtccggaagcgcgcgaaaaatacctctcaaaggttttagaccaccccccactcttggttcatgtcgaagtgttgtgcatccggacttcgtctctccggagagtcgctttttcttagaaactgcgaagcgacaagacggcgttcgcggctctccctcgctgccacaaaaaaagcggaggtgtctgtagacactcgacgaagcctgcagtcgcacgccgtcgttcattacggcactctcctgaacccagtggcgcagagtcacgcgcatgaagacgccgcggttttcttcccctgtcttgtatggaagcgtcgcgccaagttcctcggtctctcaaagtcgcaaggcgtcaagtgggagaaactgtgctcgctttggagacctcaacaggcgttgtgtcgcgtggtggcgcgcccggttctttgcataggcaatatatggcccctagctgcctgacctcgcagcgcgcatgtgtggttgctacgcgccggttggcgttctgcgtcgactaagcttcttctttttccttttttttccgacttctgcgcactgcagtcttaagccggctgacaattcttcgcctctcatgcccggctgcggcgtggtgcaagtggctttccaagcggcagaaaagtcttgtgcatctcatcattgctcaccgccgccacggccgttgtcttctctcttttccgctccgttcccttccgctttcaactcgagacgacacacggcagcgggctctcacagatttcttgcgtttcgcggggcgtgagaactcgccgacggtttgcggcaacgcgaagactctgctttgtcttcctataaagagcaaggagacagggcgcgagcgacaagagcggaggaggagcaggacgcagcagccacgaggtcaggctgtcggtgatccggtggaacgaaacaatggatcagcaaccgcgtttctgctctgcgcttttgccgccctcctttcgatatcttccgaggccgcgttttagtgcgtaagacaggggcgaggagaaggacggatagacggttgaaaaaaaacgtagctgctctttttctgatgcgaggcgtcgaacaagactggagaaccgacacacgccggcgtaactgctggcgacgcacatcctgaaaa

SEQ ID NO: 1596 - DNA, 3432 bp, Toxoplasma gondii
gacaatgtatgtgcttgggtgcaccgaaacgtcccagttcctttctcgggcatgtacaacctcttttgcagtttcctctgtcatcagagaacgcctgaaaacgcgtaatcttgaaacgggaaacgctgcgcggttccgtgtgcttagaaaaaaacatccgcacaattcagggtctagatcagtcgcactccgacggtctctacgtgtcactcttccatatgcgatttcgctctggtgtacgtgcactttacagaagctgtgcggacatctccgcgagcaacgtgaaaatatcaaagggagtggatcgccgtcgagtgtgttcacctcgctacagcatccaggattcagcatttctccccaaacagcatatctttgcaccattcctctcataagcgccgaggaggcgcccccgaatcaaactgaaagaacagttccagaattgtagagcaacccaattgtccgactcaccttgaatagacagtcagctaggggagagtctccgtctgcatgcacaaataaaacaaccttgaccctgctcctctgagttgcggcattgattgccctagtcaatcacgttgctgtctggcaaacaactggttcacttggcggtgtctctgcagctggcgtacgaaacagtgaagcggatgccaatctctttcgactgcgtctcacgtcgtctttgctgtcgtgtgtagctcctcgaggaaccggaggacggctctgaaatcaggctgggaccgtttacaaccacaaatttccgtgcctgtgggttgggagtgagctccacagagagagtgatctgactagtgggtgctgcgctatcaccgcgaggagcgtcagcttctagacagccgccagcacgggcggaagttccgagcgcgcgagtgtgattcttctttgcctgaaccagtgtgatgttctcgagaccagaccgatgctcagagagaccaagcgctccgcagtttcgccggagcgaaaatggctgcgacacggctgccacgggacgcgcaagaaaagtagacgctcgagagaacgcctctgtcgacacgagaaagtgaaaaggattcttcaacacccgacaccaccccagaggggataaatgcgtagagtaagccatgagactcacagcattacttacacagggtgctctcgcggagtacggcacagatggatacccccaaaatcggttgcgggaaaagacacagtcacctgaaaatggaacacagcttctgttgcggcggcggagaaatgggagacgcgttttcggctcttaagcagcttctcgagtcaaaaggctggaaaagtcgagcatgaaacacggcacactgctgttctaccgcgtaagatcggtttgtgactctcgctagatgcaagttgaaaagatgcgctgtccgccaagacccgaaacgcatgcatttccagccccaggaatgcctggcgatctctgagtcacgagctatacgagtttttgctcccgccccatcgataagtagccactggtttcgaacttcttcaagcgaaaaggcaccgtgtcacgtgagaaaaaacggacgtgttgacatgccagaaaggaagagactgactctcacttccggtggatgccaagcacacacgcgtgtggagcgtcaggcgcacgacaaacaagaacaggcgaccccgagcaatcaaacgcccgttctgtcaatttccacttgactgagaaagagatgacactcctagctttgaggcagaatggcgtcctcatgcatcgatcagtcatatgctaggaggtcaaacagtgcagtgaaagactccagtgacagtggcacacctgacggtatcgaacctttcttgttccccatagtggcatgcctgggttgtttgactaccgtggcgtgcgggcaaaaagatggagactttattagtcctgctgagtacgctcaaggatgcacggaatctccgtacgagactaccttgctgttagccaacgccgaggcaagagttagaaaatgcacatcgtcccctaaacttcaaaaacaaactgacactccgtactctccctcgggatgcagggcagagccgatggatgcaacgcatgtggcgaggatggtaaacgcagcgacagaaggtgaaggttcccaactgccatctgcagggaaggacggaaacagcagactgcacaggaacgctcaggcatcgccgccttccactggggtgcagaatgccgtactccaggatggcaaggaagtgagctcatatgctacctctttccgcggcgaaagtagcaagtcgatgcaaagcgtgcacacacctcacgacggccgtactgtggcgtaccgtgtcatcatacacccttccgtcttaggtatgctaagaaaagggctttgtcaaatttttcccaagacgcaaatgctgacttgccgcaggaaactctattgaaccgaatgtagagttcaaatgagttcggctttatttccttctggaaaccgtcggcctcacaaaaggctcttaagcgaaccatgtgtggcctccatcaaattttgccacacatccgctcaagagcggggaaaagtgcccttgtgaaactctgtgttaacagagaaccaactggattctgctttcgcttgggagagcgccggtatcggtagttatttctcagtctcgtttttcttgatctaatgaaaaggtggaaagccccgaatgtacaagatcagaatacaaaatgcagctccaactctagtttccgatatgtttaccaaagagctgcgcttgtcgactcagacgagttttcctgtagtgggtttctctgttaactcaaagaaaacaaaggctcctccccctctgtctgaaaatactgcagcgccgctgtatgatcggagttcatccgcaacaatatggagagtcaagaacaaaaccgatgcataatagccttgatgtcaacagcaccgtttcctgcacccgacgggtcttcattaccaacacctgggctgcaacacctcctatgagtgatctgccgatgcaacgtgggtccaactcagcttcgttatttcactaagacagtatgcgtttgctttccccttaaccaactgtcttctcttagagtcagtctctaacggaccaagagctactcgaacaaattgtcacagatttctctcttcgagcagttcgcttcgatgactcggtgagccttgaatgcgatatgcgacgaatgggatggaatcaaagacacagcggggaaaccttttcggttgggagatcggaaggctagcgaacaagtgttccaaagataatcgaatgacagctgccggttttgcaaatatgcaagatgtggtccttcgcttcgatacccatacagaaccttgccgggccataggagttgctactcatgcacagttaagtaccactccctgaatgaatatctacactatgccctaactcttccttgacgtacca

SEQ ID NO: 1597 - DNA, 1454 bp, Toxoplasma gondii
gaggttcgcggactagcgtgtgtacagtcgtattcttcagtgttgaatacgagtgatagtaggataccgctgtgtctctcgagatgtaccttttatgcgttgtgaaggaagtggtgtctcctcagcttccctgttgaaacactccgaaagccatgagggtcactcgatatgcgcaagttcggggtctccggaaatgccattttctagtagagttttttccaagaggaaaggggaagtggaggaacgaataaatgatacaccagtgaaaaaggaatggttaaaatcacatgagacgcagggatctccttctgttcgtgtatccctctcgaagtgaacctcctgcaggagacacgcgaatttgctttttccaaaagcagtagtgacgccattgaaaggagaaaaaaggggaccccctgacagagaggacagagagaagcacaggggtgctggtgtgccgcgcgctcgctgtgtgctataattgttttttagttttactcaactgatagaatcaccgcgctgaagatgagggaagccgtgcttaacggcattgcgccaaagagaacgtagcgtgatccaagttaaaagaatggagcgttgcactcggaagcaggaaggctgcgaggcactggaaaagattccccgtgcagggtctgtgttcaggctaaggcccgagacgccaggctcgtgatctgcatgtttctggaacagaaatgtgaattcagcaaaccaacgttttcgccgaaaactagctctttgtgaagcacttgacgactgtgacgccgagaaccgcttcgacgtgctgcttctcgtttttttgacaccacgggcttccccctccttttactcgctttcaccttaaagcgtatccgctagcctcctgcctgttcaatcctcgagtctcttcttcatgcttctccattcttcacattcactcctagacgagcaccagctacttgcgatagcctccggatcccgaggctgttgatttgccgcctcggcctgaaacaaagagaatatggcagcagacgttccttcctgttgtgatacggttgctcacgaacggcaactattcccctcctcgtaatccgtttgtgcattatgcagagaacatcagcaaagtcaagggtagggagtgcgcgttgcggagacgaccgtgttcgtcttcctttttatcaccagttgtttcttcctctggcgtgatgtttagatttgttcctctgctagctaagaaaagattcatccgcattattaagagaactggacatcttaatttcagaccaattcgtccagagacaacacttttttgccttcagcgttctgcctgctatttcatccaaacatagtggaggacagtccgtttctcgttattatcttcgtaggcgtagcttttgctcgtagccgcatctacatagcaacaagcgtccttccgatatctgcccaatgtctcgccgaaa

SEQ ID NO: 1598 - DNA, 2736 bp, Toxoplasma gondii
aagtccaacgactttcaggtgcttcctatcaagtttatttattcacgtgtggtctatccagcaggagagagcgttgcttgccgcgtttgttgttgctcatttgtggggtccgtcatctatgcagacagggtacaaaagttcgactacactgtctgtaccctttacattcattcgccggcgcatgtgtgagtctctgcggtcccctaaaacagagagaatagatgactgacgtagcaatgaccataaaagcacagctttgccgcatgtttcctccctatcttctgtaggtgtcgcttagaccccaaaactaagacaaaaggagttcagattatcctgtgaactcttcgaaaacataacggcatcggaggggttatacgcctagtataattccatttgacgcagccaggcgttatgaaaggagaagaaacacctgagaaagcaggcttcacttgagcttaccgagtgattcatgaataggaacaggctcagcctttccagcttcttcttctgcaggagcaaacgaaatcgtgtgagtagtacaaccggtttgctgaggaagtgcatctgagtaacaccgtcctgatcagcagattcgcggtattttgtgacaaagtcggttccagtttcccagacaggcggcagcacaggaacgaagaaaatactgagggcagttgccgcttctttccttcgaaacggtgttttttgcgctgcagtattctcgtcgctggactacgcagcatactccggagggaaaaactgttccgtcaatattgtcacaaatgtaaacgacacaaacacacgacaaaatgtccgtttaattagccctctggtaatctaccttttttcacaccctgttctacctccacagacgggtaaccctacaatgttcccctatggtctgaaaacgcatttcaccagcggcgtcttgttcgaagacaaaacaaaacttctgttcgagaagaggcccccgtttcgctgcctaagttgacataaactgttctggctagagaaatcgccccccatttgaacctttcacagctagatgcagtctgcggagatagctcattccaaaggcaacggaaagctcagggacctgcgcattgaccgaattttaagagcaaagggtcttctttccacactcctctttacctgttttgtcgcacgggcctgtgtgagcgaggtctacattcgcgcagacacgttcgcattcatttgcgtaagtcttgccgttgaccccacattggggatcaaagatttttggacacatgcagactgcgaaaaggacaaagcatcaaaccaaagagcgggattcgattatgaaaacacatccgacactctaacgcgttcaccctaaatggccgtctacttggggcggcagaggggggggacggatttttctgccgtgaaacgaagtaggagacgggaatcctcagtcctttacggaaaacgagactgcgcgagcataagttttttaccgaaaaagaaatttttaccgaagaagagataggaagaatgacagggtagacatgtgtcgatgagaaacccttgaggttgagttagccagactcaatagggctagtcagttctacgttccagttgttcgtgcggtgaataaactgccatctccctcctcaaaaccttaattcagacttagaacgtcgctagttcgtcgatgttgaaagtgtattctgttccgctgtaatatctttctcacagtgacgggcaagggtcgcgcacgggagtatcgcgatgcacactcacgagtttgtcgttccgctgccatgccattgcacctgagaggcagcaggcaggcaaccataagaacggcagtacatttgctcttcatgttggcaatgtcgctttaaatttacaagggtcttcttccaggatagagccaagttgcaccgaagactgtagaaaagggatttacccgggcgggcgctacctcggctgagtgcggacttgtgacgctctcgacgagaggctttgcttctaagaaccccacgacgtctttgaggaggaaaaataactcctgtagaatgtgtaaggacacgagtttcacgctacaggctccacaagagctgatcttcatcgcttcctgctggataaatcgaggaggtcatgtttgcatagcagcgcttgtcgtcccttgttgtaggcctttgacccgcgccggatcaagcaacggagcggggtaatagattcagctgacggtgcgctgtgcaacttggcgcaaattgcgttggcgccctgcgaaaagaagggaccggagtcaggcgggccaagactgctgaagtgactacgcaaaacaggaccatcacgctctgcccaaagagacaagcacatgcccagagggcggcagtgtacctgtggatgggctttgttgggaacgagtcaacgaggcagcaagaaacatctctacaaagttgaggaaagattcgtgtgctgaggggggactagctcggacttttgtctaggggattctggccgctggggagcacctgagggcctgtgtgattccttttcgacgacaacggaagcggcgcctggtggaaaaacgttttgttgaagtttctcgaaaactacgactcgcaactttcgtctcaaggagtgttccgttggtgacgtgtgctctttctcagcttcagatattcgcggcccatcgggccgaaaagtctccgccgtgtgtgttaaagtggcaaatctgtatattcatcgtccacgtgtcaacgaaaa

SEQ ID NO: 1599 - DNA, 2816 bp, Toxoplasma gondii
gaagtattggcagacgccgaattcgtcaccgtggtactccaaaaacgatttggggggacaggaatcatcatcgggaccaccttcctcgcgtaagtccgacaaaaaccgaccggactgtagataacgtgcagaagacttgtccttcgtataaacggcgagggaactcggacctcgaatccctgccgagtcactcaacgtacttgagctggtactgcaaaccgggtgcagtcctggcgctgcacgcctgttggcaaagatgcagtcgtcgttttcatcactgtcctcctcactgtcctcatcactctccgtaacgaatacaattgaagggtcggacttgcaaacgagcataggtgcttctggactaccgtgctgcgcgtcacgtggatatgtgtggacaaccatggtcccaaagtgcacagacttcactctcgataaagccggatccgactgcgtagccgtaacgggtgccctggggttcgaactgtgaacagttgttgtcgcctctttccgctttcttcccttttgtttcctcagcagccgcctgtacatctctctgaaagacagccgacgtgaaggtcgtggcagcagtgagtcctgtctcgcgcgcacaggtgttcctctcaagttttcgcgaggcggggctgcctccgctgcgctgctcgccaggctctctgctgtcgccacggcttccggtcgggtccgtccattgtcgccagcttctcttggcggagtgtccaacgcggatgaatgcgtgctaattcctcgcttgctgaacagcgaggtaaagcgactggacatggggcttcgccacactgtgtctctcggcggggcctggccctcacaagaaagtgccatgctcagcaacacgcgagaccagcgttgcaggagatcgaccggagataagcaggttagttaaactcgtttcatctccatgccggggactatgcggtatcaagaacaacgatgccagccaagtgaattcctgttcaactctgaacttctcctatcgtatggcacaggagcacctggtcagtccaaacacaacacgctaacgcacaaccaagcccatcgaacaacattcaagctcactactgcagaacttgtctgcggcgcgctctgaacgagccaattcgggttcggcgtgcaagccgtacactgccagaacagtcgctgcctaggtgagaatggcgcttgcgaagagagttgaaacaacactgccaacgccttttactaaagcgaggacacgtacgaacaaacttgagaagagccgaaaagacgacccacagagtcgaaaggaaccatcggggccaccgcacacgctgggcaacgcacatcactgaaacgaaggccaacggcatagagtttggcgttcggtataccacgcatatgtattgcgggcgggaggacagtcaaaagcacctcagccgccagtcgccgaagcgtgatcgcatgcgaccaaaaatggcagtgttcccccctaatagagaagtgacagtgccgtatccactgaaggctcagctcatgtctacgagccctggagagaccgccgacctccacacagagagggaactgcgggtcaaaactgcgaaccccgtaacgacgagtacgctacatgttttttacactctggtggtgcagtgctcgcagcagcacctttcaaaaaccagcaaaagttgagaaaagttctcatgctcagcgtctcgcctcgggcgaccggggaactctcaatatcggccttcgcaagtctgcatgtcggcgcacaatcaacggtgtacagcctctcgacttgggtgggaaggcgatgcattctgtgcgcagctattccccgtttgtaggccgggcacagtgacggcgcgcatgcttgccaagggcaacgccttcggctaatggaacagacggtctatcaacacctagccgtttctgctttccctcagtgacctagcattacgctgtgcgtctgtgcgggacacggccggcgccggcgcagatcttcgggccgcaagctggtccgacttccgttggcgcgaccagcgcacagcgtggaagtcgctgcgagctggcggaccgcgcaaaaggttgcgggacacgcgcgccaggccggtggaaggtgaagtgagggtccgcccgttgactccttccgaactgttcgtggaccaggagccacctcgtctgcgtgcaacttttccagcaacaacggctctatttcctgccagaaagctttatttctgaacgacttcctctttcgtggcgcaggcgtctgttgctcgtttctgactggctgttcgtcggtgtacgtacacggcctgaaagacgtttttgtgcacacaagacgtcgggcgtatttttccctcccaaattctgtcttgcggcgttgcgcttagttggccgaaccagtcagcgcacattcggtttcgcatacaattcgcgcggcaaatttcaactgttctcttgtctttttctaccagggtgtagacagcaattatctcacctgctctttgtaccgtcctgtgtacctagtcacgctgctgcagggacagccgcaaaaatttctacgcgcagcaaccggcagccgattcgcccagtcgcaacaacgttggctttccccacttgaatcggacacgcaagtcaatttcttgctgatttctgttggggccccgtcgttttctcgtgtgtagttcaaatagtgctgcagttgtgtctgccataagcccgctgcagccccatcgagttttacgtcagctcggcccacacggtgcaagctggagtctcgcactgggaagcttcccgccgtgatttgtcctcgaaacattttaaaa

SEQ ID NO: 1600 - DNA, 2058 bp, Toxoplasma gondii
caatgctaccgacggaaagaagttaccgatttcacagaaatatgcaggaaggttctccatgcttctcgatgccttttctggggaacatagactacgaggtggacaactgttttgcaccttgaaggtctctgtttgcaggatccgagctccactgtgttagcagaaccttcccttcacatctcgtgccctcctttagtcgtcactctgaatttgtcctaccttcatgcggttgatgtccgagtttttccaatcaagtggctctccatgttgcctcttgcctgcttttctaatcttcctgtcacctctatactttgttctgaaacaacgcgacggctgaatgctaactccggagtcagaagaggagcagcacaggtaccggaactgcagctcggtgctcttcacgccacaattttctgctgtggtttcgtcgaagctttcccttcgaagtggaagatatcaattgtgcactgctatgaaacagtggcagccgcattattcctcatgcatttcacaagtagaagcgttttctgatacgctagaggggttgcccgagtactgtactgcgccggctaatgtcggctgtttcacgaacagcaactaccgcgaggtcttcggtgcagatcggtcagttcctcatacctacaacggagacgtttcactctaaagagaataaaaccacaagccaatcgagaaactgcggaagtcgtcggggacttcctccggctttcagacagataatccacttccgggtatagtgacgtattattgttcaagttgctttgtggctggattcaagctgtgaaaccagcacagggcaatctggtcaccggcacttcgcttctcctctttgcagcatagcagaagcatgcttgtggcttgccccctcaagcgtggtaagttcctccagacttgtttgtttatacttcttgcgtgtccggctgagtgtacgcgcgagatgtttgctgaggtccttcccttctctgcggctgcttagtcttctgcatgtattgcttccggcaggctggtttctttctcgcctaattacactcctccctttcggcgcgagttgtgcctgtagctccgtcgcccatcaattcgcttcagtatcttttcattcaatttcatgaacagaaatttttcctttcgtagtcatagttaaaggtcgtggtcctcttagactcaaccggtgacagcaggcagatgtgcatggcacgagtgtcgttcgggcaggcgcctcggactcgtcgacggggatgtatttgagagtcactattttccgaggtttgcgttcccagccgcaatgcagagagcttccatctcacactgcaaaaagaacacaggcgcggctcaagggtgaagcggcaaaagagagccgtcgccgtgtgcacacgcacctccgtaccgctccgctgacaagggttccaagcgcacccgtggaaaaacaaactcttctttttcctgtccgttccagaaccccccactaactcattgaatcaatcctcttgatgccgtgaggaatcattacaagttgaaactgtagggggtttgactcgaaaaaattggcattcccgctgttccacgagcgtgtctcgcacgcgcatgcagctgtggaagaagtttctgcaaaaaagtggaactcttctgttgaacgcgtgtttgagccggaattccgatgaaatggactgatccgtctgcactttcacattaatctacattcgttggtgtatgggtcacaatcagtttttttactttgctttttccccgggtgcttccccggtcctgtttgtctcccgattgtaggtcgtcgcgccggaagttagaattcagaattcggctgtgctgcttcccttcgttcatgtctcttggagaagcatcagctagaaaggtcggtttcaaaaaggaggcatttcgttgttcttcgcgtctgggaggttgagaggagcccctggagagcagaataaagctggcactacagccagtcttacagagtggcgagagaaacgcgcagtcgattgtggtgtctcgaacgcggacgaccaccatgaccaactacgacca

SEQ ID NO: 1601 - DNA, 1358 bp, Toxoplasma gondii
catcttcgattctcccgaactcgcgcacagctgcattgactgcacttcgacctccaggacaagttccatagacatgatcgcgaggatctgtgctcgccaggagggacgtcagtgccgcagacgcggacttccttctcggcttctgggcagaggtgggacgcgaaggccctggcactcccatctcccataccagggaattccgatgctcctcgtcgcaagttgagagagactcgagctccgggtcgcgcagtctgcgcctctcccgtggacacgcagcctccgagaggggcgaggacctccgagacatcctcgagtcggagtcctgaggtacagaagtctcgagggcgtgaagcgcgaaaccgacggagccagagggaggacgggactgcggcaaaggaacgacaactagagagggctgagtgatggaagcaaccgttgaagcggatgataagcacgagagtcgcgaggagccgatgaggacagagcagtcggaacccacgtgacagcaaggcaggtgacagacagctcgacgacgacagctagtggcatgcagagacggcgtcgcactgcgcgttttcattccgtaaaaagcacagcggaaaaagccgctggactcacgtaggaaggagtaactcctcagggaacattggcttccgcggacgaatctggaagtaacgtgcgggaactgagacagctatgcaggcacgacacctcgagaaattcgaggcacagcgagacacggagaaaaggacgacaattctctccgaaaaaaatggcgaagaaggctcctggcctttcacgtggtacgacacggaaatgaagcagaagtgatggttagccggaaggtaaaataaatatgcagtggcaaggagttcgcaggcaggggagccgtgcgaattcacacccgttgcgggaagagatcaaaatgacggctggatagcagtccttcagagaatagagtttgagcatgggcgagagcaaaaagcgagagacgtgaaatcgcaattcaaatcgaggttgaacaaccgaccagctaacagaactctttccttttacaagcacgaattacccgccacagatcgcttgacgcggtcagcccgcgaccgcagtctgcagggcacagcctgttagatggcagtaccgtagcgcaaaggacaagttacctgcacacggaaggacctggagagggaaaacatatgaaaaacctaaacctcaccagatggcgcggtggtcttgttgactcgtctcgaaaaggtgtcttgttcgctggcggtcagcagcaagatcgccgcttcatcgaagattgtccgaagtcctgagagcttcgtttcgttcagccagtggatcctcactgaaaa

SEQ ID NO: 1602 - DNA, 1948 bp, Toxoplasma gondii
aacagccgctcgcagcagatggagattactagtcttagctagtggtgacggggatcactctggctcggctgtgcatccgtgtcgggactgacgctgtgcttctcttgttcatgcctcgtttcgcagacttcgctaaaccctattgtggttccccagtttgctcgcgggtgactgaggaactgtaaaccttttgaatctaacgcctccgtacgcattctatccgttcccgaggttcaggttggcggatgaccctcggattgcctgtcggtattctctatcactgacatgctttttcgcttccgctttccccgctaccaatatgcgtgcttatctctgaagggagaactacagtttcttgctttgggaagcagagactatcttcgtagcgaggaaactcgtggacgcgaaaccccaagtaccggcagtctcaataccaaacacccgtaggaatagtgtgagatgctgtgttcccgttcaagtacatctctagagcggagttatatttggagaagacatggttcgttcttggctgcgcacttcagactggtccaagtggcgccgcacatcaacggcttccaaaactaaccgtacagagttcgacttacttgcatcgcagggatttggacttcgactctagctcttccctctctgggtgttcagtgtttcaggcagaaaaatacagggaaaaaagatgtttctctgtctcgttcagaacaaacctagctgcatactactcgatgtgataatttttggagtgggtggctaaaatagatgcacagattattcatagaacatcgcgctctctggcctctcagatcgcaggggtcgtgtgtccctatcaattcgccggtttgcgccgacgaactaaatacggaagctgaagcctcgctcttggtgtacacacttcggcagtacatctttccatggaaaacggcatgttttccgaggccgagaactcggatcagtggaacagaatgtcgagagcaggaacggccataaataaacgaatttttctggttctgcgtgaccgccacgataccaggtagacgtactgacactgacaggtagcttcggtgtctttttttcttgttggttacaacggaatcctctccgtagtcaagggccgttacgcagcgcgaattctcacgggagcgcacaacgagtgtctcttaaacacatcgtttgagcatggtcatggaactgccagtctctaactgacggcggattatccgccagacatgtgtgtactgcgcatatacgcagacatgtacttgttcttacacaagtttgcgtgtacgagcaagcggaccaagaccatgacgatgtaacagtggcaccgtcgacgaatctgccttgctcgatctagctcgactcggtaggtcggaactctgagtatcacgaagtataccattgcaaatctattttcctcagaaatggaaattcaacatttcgtactgggtccgatcatgagctctgccatcaatcaaatttctgcctgcacgcacactccgattcctgcaaaacaagggtcgtcccctctctggctgatttttgtgcatgcaactggccccgtcagggcgagaggcgctttaaagctttgtgcgcctctagccgtaaaatcttaaagtttaacgtttaactttcgttttatactgtcgacgacaagcacacaaatatggagcctgcctcttagttattcgactcttcccagagacggcccactctgcttcagtccccgtttcgtctacgcctcgctttcgttttcatcgcagcagcttccaattctcaaactgccggcttctgcccgcgataatcgcgtagatcctttattccgccagagcactgtcacaagtgtgcatctctgtttctgttcgttttttgctcatccgttcaagctaccagggctctcagttgtcgtgccaagctgggaaataaagacctttcaaga

SEQ ID NO: 1603 - DNA, 2723 bp, Toxoplasma gondii
atatatctgcatgcttctcgtttctctctctcctgtctatcgatatagatagaaacatgcgtgtcgattcgaagtgaatgcgttttagtagtagactccggacgagaggagaaggaaggagagagcgaatcccagaagaacggaggcgacggctgaccatacaatttcctttgcgagacttctttccctgggagagaatcgaatatggtagatgaagaaacttgcgctggcgactaggccgaggaaaaggaggacgagagaaatgacgtcgaacaaccgtggcgcgatgaaaatgggagtcggcacaaacttcggctcagtcgtcgagccgggggcttggggagacgccggggacgcggctgcatgcgcgagaagaaggggcagacggcgaaggagaggcatcgtgctcgccagcgaaaacctgaggctcggtgcgcagggtcgcatattttcttctgggcgtttcaagagtcgaagagagggcagaagacgacgaaactccggagacggagacacgacgtcgacactgtggagcacacagagagaagaacgcagagaacagggacgacgcgcactgcgggcgagcgcgtgactccgagaagcgactctccagaagctcggccaaacgcgagagcggcggacagagacgaaagccggaatccagaagggaggcgaaaaagacgctcgcgagcagcgacagacgcaccggagagacaagagaatgcagatcgggcaaaggggcgttgaagtgaggcttcgaaaaagacacgaatgcgccaatcaaggaagcgcggaacaaggacaaatcaaacaagttcgacgcaccaggcgtccgcggagagaaagaactgggacgcgtcagaaaacagttttttcgtggaaaaatctgcgatgcaacaggcaaaaagtcttcaagagttccaccttctcatgcagacagaaggcagagcatggcgaggagacagaaagtcaaagttcccgcggagacgccgtgcgcaaacaccggcgacaaccaaagttctaagagaaaacactaatcgacgcaatttctgacaataacagactaggcagacgccgcgacatccaaacgcggcaatactccactgcctgtgattgacatacatgcacttaaggaaaacaaatacaagaaactgcaaataaatatatatatatatatatatatatatatcgaagatgaactacgcttgtattgcatgcacctgtctacacacacactcttcttccttgtagatgttgaccgatgcacatatttatggacgccgttgtctatgaagagcacagagacatactacgaatatatatatatatatatatatatatatatatatatatgttttcacaagagtcgacacgcatgaggagacctcggtggtattgtccgagttcgagaagagcgatttggggagagagactcttcactgcaatgctggaaaagtcgattttcgctgcaaaaacagacgagaaatgatgagcacctgcagaaggagcgaatggacttcgcgaagaattgaaaacgaaagtcttttcttctcagagagacgggaagaggcgagggtgcctcgtctggatagacgaaaccaacctttatttcgcttttttcccacgaatctttccttctgcacatctgcacacaaagggacaagctgcgagcttttctttttctcctccttttcttccctttcgtttcttttcttctctttttcttcgccttttctccgtgttccacagccgaaaaagagggcgcatgtaagctgacggctctcggttctccgctagcaaagcagtccgaagcacactttctcagtgcgccagctttttcactttctccgcttttttactttctccgctttttcactttctccgctctaattcagctttttgtgtcgcggcaaaacagcctcgccggatggagctctcacgtctctcgacgtctcgctcacgttctggaaaagtgacccgggaagtgaaggacgctctggtgagttcgcctgccgctccattgagaaatgcctctgagccaagcagcaagagagcaaggaacacgagggagaaatccggttctcttctttgctttccatgtctcaacgtttgcgtctgaagaggagtttcttcgcagccgcgacgagggggcccctgcccgccttttcggtcgcctctctgcggttcttgcgcgtttccggactccaccgcgtctataaattcgcttcgaaagcgaggagacgcctgtctcctgagacttctcttcctgcagactctgcagggcgtttagctttccttctctccagaggaaagtgcgaaggcaactcgcgggagcacggcgtttgccgcgacgtgagaaagcgagagaaaacaggaacaggaacgtcttctcctctgcctccgaagacgtccgtccgttgcggtcaacttgtctttttttctcggtccgacttgtctcccccgtctcctcgttgccgtcgccttgctgtgtgtggtgttctctcttgtcggcatttctctttggccagatatgaagactgagcaagcagtgcagctgtcgcttcgttcgcgttgaagacgcgcttcccatccgactcctgagaggcctgagacaggacgaagtggacgcaggcgaaaggtccaagtgtgcagagacgcgtcgaactttcgagccaagaagacctgaacagctttctgcagagacaattggcaaggcggcgcga

SEQ ID NO: 1604 - DNA, 1666 bp, Toxoplasma gondii
cagcactgtcgacgtcgcgtcttgtcgactcacctgcagtttgctggcgagttgttcgctctgttcctgcagcgacctcgagtccgactcgatttcaatcgttgcatgcggcgacgcgccgccgacggagaagattccactttcgaatcgcttcgaccgagcgcggggactgcaccctatcacccgatagcgcgcagccgcaaaggcctccgcgaccgcgccgcccagcgcgcctgagtgcccgaagaggagaatcgatttacgcaggagactcatctctcgacgaagcgagaaacggagacggctgctgacgccgggagcgggacgagagaaggaacgaacagaagacagagagggaagcgcgaagagacggttgagacgttggagggtgctgccgcgaaggcgttggaggctttcgtggagagcggaagtccggggattggagccagaaacgagaaaaaagcagcggatgtcttctgtcccagtgtgtctgggggacgcggaagcagagagaaagaggagagagaaaatgagggaaaacaggttgacgaggagaagacacacaccggcgttcatggaactgacagcaggttcccggggaacaaacgccgcgtagagacgcgcgattgcggcgtccatgaacgccttaccttgcgaaggagagcgtctggggcgccgaggtctcctttcaggtcttcacacaccgccaaaaagccgctcgagactcacgtgaaggccgctgagtagaccgaaaacgcgaatcttcagaaaaaacgaagaagcagaggaagtgcagcgaattaaggcgacaactaaggagacagctcggaggcccgctggggacgcacccacgcagttgtgtgagttgaaaccgcaagttctttttgcagaaaaaacggattttttgagtcggtgtgtgtcgcctttttcacgcgtatcgcctgtcaaaaacggagagccgtcgtgcaagttgactccccgtctttccttcgacgatttgaacgaaaacgcggcgaaaatcgctgaccctcccgtctgcatgcaactcgtcaaaaatgcatggcgacaaggagagcgaggcagaaaaggcgaggtaaaatccaagagacctacagggcgtttccttcacacaaaaaaaaattcttctcgcaggcaaaaggagaattttccgtctccgaaacgcgcgcccacgatctctccttaaacatgccttaacgcttcttctggtcgcgtattctgtcctttctttaccctagaaaaaaaactcttctttctctctccttctcttccacggcaaacgaaatctcttccttctcctctctggttccttctcatcttaaatgtttgcccttctctgccgccttgaccttccaacgtcttctctgcgattcttctctccgattgtcctctctcctctccgaagtcacaatccctgcccatttcactctcttctttctgctcccttgtctctttattgtctcctttcgtcgtctccctcttcttctctgccttctccttttgcttctcctccttctcccgcttcttctgcgtttcctccttctcccgcttcttctgcttctccgccttctcagttttcttcggcttctccgcattctcagttttcctcggcttcttgttctccgttttcttctctcttttgcgacca

SEQ ID NO: 1605 - DNA, 2034 bp, Toxoplasma gondii
ctcaggcatgacttgttctgcagagtcacgaaaaagcagcagacgcgtctcactcgccaccgtggcgcgccgatcctggcaacagctaacgcacaaaagctctcgctccgcaaaggcggtcttgattttttctcagactcctgcttctctccgtcgggtgactccgcggttcgcggatgcagacgccctggacacacggagggccgcaccgcatgcggcggcaaaccggatgggaggcaggggaggaaagcataattcgcctgcataggaacttgaattaaacagaacgaaaagccttttcctgaaatgagacatgagggaacagtgaaaagagaaccttgcggctgcgcgcttcgcagaagtcacaaggcctccgtgcaactgctgttgaaggcctacgttgaaactcctaagattgtctcgtctcgcgcgaagcgtccgagcggaaagaaaactcagcgagtcgcgaatcctcagagaaagctcgctactgaaacaatcattctagccttaaactcctaaaacgcgagagagtcgcgcgcaacgcggaggccaaaacacatggggtagtgcccacggttggaggtcccggtacagtgtgagagttcgcattgccttttcaagactcagggctgtcgacctttctgtggacgcagaagaaaaacgatttgttccgggcaaaaaggaagaaggaaaaggcgcatgcaaagccgaaccgcagaaggagtgaacgggcaacctgctcagccacagagaattgtccgtcaacagcaactctccctgacacactctctgtgaaaagtgagagtcgtaggcttatctaaactgcgttttgtgcgaagtgcatgctacgagttggacctttggtcgaaaccttgaggtccgtcggttcaccggcttcaagttctcgtttgtagcagaaccagagcacgagaaaacgtttgctctcaaattcccccaaagcacaatgactctggtgtctcctgacctgtcaaaggagactcgcagttcgaagaaaggcctctgtacgcccttctggatttgttgagattcttcttcatcgagtgcagcgtgctgcgtccaccttcgttggtctgtgtgcgttttctctctgcaccaaactatcgatttggagaactctcggtgtcgactgacatgccgatgtacctcaacctctactatcttcaattcccttccacgtatctatatccccaaatacatctatacttctgtctcgctctggagatatctatgtcttcccctctctccgcatatatatatatatatatatatatatattatacagacatgtatacacctccctctctgtgtatacgaacacatatatctacgcttctctttcgtacaaaatatctacctctcactctttgtgagtggtaatctatcgcggattacgcatttctgtagaggtctgtcaaacggccactgcggcgtcgctgccgcgattgatgtcgcccgtgctggagaaaccgaaacatttcgaaaactgaaaaaaggaaacaaagtaacagagcgagacggctgtccatttcagaagcttcgttcgttgtggaggctgcggcaaagggtgagaaagaaaagcgaagagaaaaagctgtcttttacccttgcatgcgcagggcctgcttctcatcacaaggagacgcgtttctcggcgcctcaaccagtcgtgtggggttggccgactttgaacctttgatttcctctctgtgtctgactaatagaagcattttcttttaaagggttcttttcattagacaaaggtcctctctgggattttaaatctctgcacccgcttcaggctgatatccggagcttgtgtctccgaggtcgcggtgtctcgtttctttcttccggtctccaacttttttcttctgttgttctcctgctctttctgtttttctcgcgtctcgccgactcttcgcttgtcgtcacttctcacttttctccttctgtctgaacttcgtcgaacgcttttctctgtcgagacactcgaacgcggctctgcgcgca

SEQ ID NO: 1606 - DNA, 2434 bp, Toxoplasma gondii
ttcttgaaggagtttgtatcaaacaatcctgaatttactttggctaagcgcctcgactctccttcgatgacgcaggcaggtgtggtgactgtcggacaagaagcgctttgtcaattgcgcgtgtacatatggattaaacgagatgtgctgtgaacgtcaaacatgcaatgtgagcaaacggcaaagatgttcacgaactaaccttttcataaattattgagcggtccaccaagccccatgcattcgttgtttgtactgcagacataagtgaagcgcagttcctcggaaaacgcatttatttgtggacgtagcctactcaccccttgaaggtgttaacaaagactaatggtgccggttcgctgatacgatcctatttgagcaacaaacgaatataaggtggtgatgtaacaatatatattttgaaaagacatttagtggtgtgttttgctatcaaggacgttgtgatttcagatggtaaggtctgtgatctggcgggatgtgtgcgcaaactggtgtgctgaacgtttatcttgacgaagggctccctttcaccgatgcgatggaagtatgagcccgatggaggacatccgattgcagttccgaagcatccatccttctgcggtgctgaagtctcctcgcgtgtttttactgtttagtccagaagtcaacaatactgttgcagtgtattgatgtatctgttcaacccgcatgaatgttgcgagacaggttgctacccaccgaatgcagtatcgacttgagatggaaacgactccgtcacagctgcgcagttttcagtaaaacaacactttagttattattctgagacccacgaacggtcctgtgtatttcaggaattcggaatgtacttggtagtggtacgccttggatctggaggaactgagtcccccgaccgcaggtgcagatcttacattcggaacacaaatacaactagtattgtagaagaatcacgcaactggcacatcggcatccttctagaacaatactggttgccggggaaagtagcggcatctgacattggcacgggcaggaaaaaacaccggtggtagaagggacttcccactagtataccagtcattgctcagagtggacacccagcggtctgcagttcgggtcggtaacggcaggagcactcggccacgaggtggcactcacaaattctaaactccaccatgtggggtgcctcctagtccatgtatattggctgtgcttttctgagggagcatgtcggcatgaaaagcacattactctaagagggcgcctcaaatgtctcttagcggatgtcggtacacgtctaagcataacgcctagaggtgtacaacaacgggagttcagcgggtgttcgtatgaagtgcatctctcataaatcaatttatcaaaccaaacacacggaagtctcttgcatggccaatgaatgtggtttgtcctgagtgcggaatggaaaccgagaggtgttgaaatgtagcctccttggtgaagtgagaaggcaccgcgcgttacacacttagtaacaaactagcttcaatgcaaggagacagactaacaggatgccagagacagaagtgtcaactgatccattcatcgactgtacagtcaactcgtgtctggcctgcagtgttcgttaggaagtgaatcaattcggcgcaaccgctagcgcacaactaaagctgaaatttgcggacctcagtacacggtgcattactggagagaaaatctcggtccaataggttttttgtttcgatgccagcctctgcgtggtaatgcggatacagttcaggaaaaatatgttgatgtgaaccagagtaattacatcgctaaagaaaggcgcagagcgagttttgttctctcgtgttttgagcactgccgttacgccaggagccccgcctgccacgcgggatacgtgcgagcctatctggttcggacaggtgctggtacggaagctgccgattcaaacggctttgtacaaggcacgttccgtctatggaccaggaacggttccctaagcatgtagggacggccacaggagatcgtctgaatagccgtgtgccagaggcaactccccagagattttgttttccgctagagtgtttcgcggtcgcaataatatgtcgcttttttcctcacgcgaggtcagggttctgttctcgagccactaggaagggcggtttgtaacagagatagtcatcaggcaatgcttttggttgagttttgagtaatttgtctggcgtatgtcggcgccctcgagaggttgcaagctttagttgaacaaatattgtgatcctggacaaaaaattaacagcttcaacaccaagcgcgccctctccgaagactctggaatagcggaccagagatcaaacagagatccaagactttttgccgcaactttaaacgccaacaagacgataatttgagacaa

SEQ ID NO: 1607 - DNA, 2517 bp, Toxoplasma gondii
actgtcgaggagagcaatggactgcatgataggtttgtcctgcttccgggggtcttcctgcatcttggagcggctgtagctgtggccgagtccaacctggaacttttcgatgggcagctcacccagctgcttcgcgagcttcttcatgtgttgcctgcagcctctgtgcagttcctggacgtttgagttgaacacgatttggaagcctgcgtcggcgagactcttccccaacgcagggtcgcacacccccacggcggcctggctcttggctcggccgccggcctctgcatcggcgcccttcttcttcttcagcgaggaaggcaggttgaagttgagaaagttcagcagcgcggggcaactggtcccgttcgtgattgcgagttgcacctccatcgcctcctctgcgtccgagaaggggtggaaggcgacagcctcgacgacttgtttgaagcgagcaaagtccagacaggcctcctggactgcgtctgtgtcctgtgcaatctggtcccagcccttgacgcgagccaagagcaggcccggcgcggactcaaagagaagaaaaatctcgttcactgccatcttgtgtgagattcaggacatgatcaccggagacaactggggaaaaaacggggaacacacgggcagatgccaaggcagatacgagcagcgaagccagcgacgcaatcgcggcgttgttcgtgagaggaatgggacagaaatggagaaaacaaggagcgaaagcaggttgatggcgaacgacggcacaaaaaatgcgtggcggaagaggagagaaaaagccagcgttgtgagagctatttacaggaaggcgaggagagtcagaagggaagttgtggcggcagttgcggtgcttgaagttatgcgagagagacccacgtcaaacgggaaacgtccacgggcggcagggaactggaaggcgaaggggtggcaagaacccggaaaaacactggggaaatgaaaaggacgacgccgcgcgtaaacctgagatgtgcaaaaggacgaaaaaatggagagaagataaacaaaagaagaaaagaagacctcgtcgtccagaaatgccgaacgcttcttgttggtcgcagaaagtgacgccggaggggcaggtggtgacttgccgaccgattcaaaagattggaaatgaaagggaagaaagaaaccaaagaggaaagacgagaaaactacccacaacgacgaaacaagagaagaaaagccagttaaaacgaacgaatggctagagcatatatttgtgtggggcgaatgtagcctctgggctactgtcgcagtgtcgacgttgttttgccgtcccccattatcttacaagaacgccaaaaagaggaaatatctcaagggatgaaccgagtaagcagacgtgggtcgcgagatctctcgcaccttgcaagaacgtcagtcccagtcaactttttccgaatcgaatttttccggagcatgtaacgaactgtgccgtcgcgcgttctcgcggccgcagcgagggctcgcagacgccaggggaccaaactccgcctgtgcctaaagtcggtccagcttctttgacagggtccctctgaagacccgaaatttgcccttacctcccccgcctggtacaaattgaccctacacatggatgttaatcgtcagttgtcgcagaaaaactctcgtcgtttagagaaacctagcggaaaagaggagttttcctgaagaacgccagtaactcgcgagtcgcaaggataaggtaccgccagagtcgagtcgccagcgtgggagcgggacaagaaaagtggcatggtggcaaagaagccctgaaccacgcgcgctgtggaacgccgcatggtaaagaggggtggacgcgcattcgtgtttccgtttccggggtgggtggcttcatgtcaccggtgtcgacccgaggtctcgatgtgtttcgatatcccatactgccaagacgaaatccgcggcacgcacactcgcccaaaccgcagcttctggcgttctgtccatggttttcgtctcgtcgtcgaatgcttgtcagcggcgcaccacaacaatctcagctgtatgtacacttgaacatctgctgcgcaagagaggcggcttccaccacagctacgcccaccctcccaatgtggctggactggtgttccacttttgaagttgtcttgcgttctcctggccgtctgttttctcctttcgcctggtctaggggaagagagagcctctgaaccctttggtttgcttacgtcgtccgttgtccgtctgtctcttggcacgaaacatcccggttaccccgtcgatcggcgtgtgtttcgcaggtgttcttgctgcttgcccctccgtctgctgtccatttcgtcttgccttgtgggcaatcacgccgttctggcggttctgccaccgatttgttttctttcctgcattgctgcgatttattccgagcctattgccctcgctgggctctcagcgactccagttcactcctaccccgatttttttttgtgcccgcgaaga

SEQ ID NO: 1608 - DNA, 3349 bp, Toxoplasma gondii
caccgccactcacagtaaatgttcatagacatacagttatctttccctgtggagtctgagcttccgagccccttttttggggagacctcgccgtaattgttttcggtagagtcgcgtttccctgtaggtcttccacgttctcttctccttgtgcatttcgacaaaaggtattttcttcagacgcattaacttcttcttgtactttttcttatggaatttacgcatcttgaaatatcgtcgccggcacgtgctgatactgcggacaaaggcctcagcgacaggctgattcggcagcacggaaaaaacaccagggcaacggctcaagagaacgatgtgcgtcagcgatgggagagtgccttgatcttgcaaatgcaagccccgctcttcgcctttggagcggcagcttgtacaacagcgtgcacgtgacaaatctgctgacgccgctcggcctcggcaccgtacattcacatgacgtagatgtgctaacggaagagttactgccctttcaccagccgacatgggatctgacaggccagcctgtacagagtgctgacgccaaccttgcatcagcctttcagctcctctgatcgcgcaagggccagttccagctgggcgctgtgacagggaagtcacaccaccgctcctaaaactttgtgtggcgtgccaccgcctacacgggagaatacgaaattttgcaaggagcacatcggttctctccagacagctcggaagtggagcattcgcacgtggtgcgatgcctctgggcaacgagcataaggacgccatttctgcccctgcccaggtgggaactttacaaaaaactgccattctagcgacgtcactccggtcggtccctgaactcttccgcgaacttcacctgtttggatgcagctgcatgcgcacaccaggtcagcgccttcttttcagtctgaagctccgaaaaattactcctgcattggcaacgtcatcgatgaaaccttgtcgtgcacatctttgtggagcgttcctggggtgaagacgcgttacggaccggaggctacaccagtaacaactgaagtcgcttcagatcgaagtccacgaaatacacgggagaggtgacggaaggttgccgtcgaagagtttctgtcagaagcggatatcccgcaagacactgtcacgaaaagcgtacgctcgccacgctgaaaaaaaaatgtcgtggcggagacatcaggcagcacgaccggaaaatgatgcacatagatggagtagcacagagcacattgtgaagcaagtatgatgccctgaaaaacgaagtccttttctccattttccactggagggtcgctgcggtgacgtatttctctcttgacccgcatctgcagtggagaaaaatggcttcgttcttactctgcatgccctggctgatgtgtgcctctgggactgcatgcagcaatcaagaccctgaggtaggctcactggctactaggcttatcgtacgacttctgttcttgacgttcttcgaatgcctcacaagacgagccgtacaaaggcattcaaacgcgaataaaaccatgcttgcgcgcacactgctgtgcaaaagtcacctccggcaaaaataaaagactacagaggttcggagcctggtgtacatacagacggagccacagttcttcaagctccttgacacattatgttctgcacgttgtagtggcatcttctttcacctctctcacctagctgttgtttcgctccaagtgtttttctagacaatgaaacgcctgttactggtagtcagtgtggtggcttgtttggtgccaacgacccttagtctttctcagcatgcccgatctacatcggggcaacctgctgcgcaggcggcggctgctcccgtaagcaacggaccagttccactactccctgtgcaggatccaacacaagtgtgagacgctgcgtcaagttttgatgaaccaacagagacttcacagaactgccttaccaggccttcccttgggactgttaatgttttccgtagtcacagtctgacgaaagctgctcaggtcgaagttcacggagctcacgaggtagataaggagcaaagcaaggaacgtacgtgagtttaaaggcgtctaggcattcactcttatacgttgttccgtagccagcgaaacagccgatttccaacactcagttctgcaaaagcaacaagaggccctctctgcctcagactggttcagccggcaggtacacttcctctgaatgcgtttcgaaacgtggcgagtgttgtcacaaacatctgtggtgtagctagatgcactcgagcatctcaaaggtaacatgagacgagattgatgtagcatgtgtgtgtaaccattgaaacatcagaacacgaaggaaaaatccgacagtacattcaagtaacggcttctatagattctgagacgagtgtgtgtcatattactactgtgcaacatttcagaaagccccggcgtctgaagggcgacgcatcatgtaacgggcggtcgcggcgagacgcttcgtggacggactttactttagcataggggttgtcatcttcacctgaattgttaccaacgagtcagccgttccaacgtggaagttttgttccgtacgtggattctctcccagcgcaaacaacagagcgcctcctcatgttgatgaaacgaaacagtagcagctcgaactaagcgggtcaacacactgacacaggctagcgggaactgccactatattgcggctcgtgccatgtaccattccaacagacggcgatgccctcataacgaaacatatcatgtgggttgcacattttcaaggccattacatgagaaaagaacccacattttccgactaattggcgtctgaaatctgcttcaggaagtgcgtgtgtgacccgtgacatgtttgtgtcatcgcgggagactggcgggaggtaaacgcaaatctcccgctgtcagcaaagtggccttcgctttgaaattgaatgtcttttatactttgaatgaatcatttcaaagcacgcaagcgcgtctcagtatcatttggtacaaaagcacgcaatccaggggtaaagtctcctgtatatttctggccgttaccgcaaccacagatgggccagttcgatagtgttgatgtgacaccgtgggccttttcatatttccgtgccaacacgcgggttttttgtcttcctaccagacacattgtcgcctggatgtgcttgaagtctaagggcatagtggcgcattctcccgcagtagactcctgtgacagtgcgtggcagtgacttcgtatcaccgcgacaacacaccggaaccggcgttgtgtcaagatgcgaaagtatctccaccttataaaa

SEQ ID NO: 1609 - DNA, 2945 bp, Toxoplasma gondii
gtctgtagaggctgtggaagtaacgcacagcacgaagttggcgacgcacgtcccttgagatgtcaggaatacacggagggatgagctttctttcaaggcgggccagtgtacatctggttaactgacaccaggttttattgacccgttgtagtgtacagtttcccgtcgtgtgcctaagagggagcaataaactgttcatcataggcgccttttcccagcggttttctcgtttctccttcctcccgctgtcacaacgcaaattgaaggggtagtgcaagtattacggtagtacagttctgtaacaaaaaagtgaaatttattcccgcgtgtgacttggcgggtagtgtagggtcagggtgtgtgtggtggggaagtagtgtatgcgaagtttgcgcatttccaatggtgcctggttggaaagtgaatccgtctcccgaagaaggggtatttctgttcaacataaacttagctacttgttacactagtgaacgagtactgcgcatgaactgtacctcaatatcacacaaactatctttaaaaatgtgtcgtttcatcgaaattttgacggcagcggatcagggtaattccgggcagtggtagagaactgcctcaggctctgtaatggagagtgctttccgacaccaggagtagtaaagaggttcgaagcgaacgcacttgccttccatagaacgctcgcacatttcactgacgtgaaaagcgccttggcgcgtgcagatgtcttgcgctgataccggagcgtatctttttctggaagtttctgagctaggtcaacgtggttgctgttgtggaggtgggtcttgttggtagaaccatgagggcctcgtagatatgtggaggcttcgtagctgggtatgacgagaaccgaggtatgatgaaacccgaaaatcatggcctgcttccgtcttcactaaatatattatccaggttttgcctgctccccttgaacgacttaccctgttcgatctttcccaactgaggcagacttctttcagattattcagtgtagtagcagttcttttaggctttcacttttcgtgctggggaacctcgtgagcccggccttgttccatttttgtctcagcaaagcgtgacatatcgcaccttgaactcgccatcctacgtgtataaaagggattactcattgtacggcgtccgtcaaaaacttacgtttttctgtcgttggcgattggacacacgattatattgctaatttgtacgttttcacgggagtctaaaacagccgtttacttggggaagacttaaaggtccccatttctcttttgctttctcgattatctaagcgactgggtaccacttctgcctcttcccacgacgtagagccagtccacctgacggcgtagaaccttccaggtttttccctgcccttcccgcgtggtcgagcgattccaacacgtgtctacactatcaagctgcaccactttgcatacattggtttgaatggctccgccctttggtgggagttgtacagatccacatatcatcgatggaaaaaagagtgtgtggtgtgtcactagattagttacgaaagacccttgtagcacagtgccccattagccacacaaaagtcttcagcgcgcgcccgattcaacagctgggctattcaggactaggcttcgatccagctaataccgcggacagagggtgaaacatcgtcaacgcctttttcttgtttccgtttgttccaagaggcaccctcctatccaacgaaagaagaaaacgaagagttttctgcgttggaacaagaataccatcatcctttgaaagggagctcgcgcggtgactacaacgagcgacgtagcacgccattcggtgaggacaacgtggctatcgccctttcgtgttcctaacattttcccctctcaagtaagcggagaccgggtgtatcgaattttctgtgtaagcaatcgtcctttcggtcggatttttccccgctgtacgctctgacgagagccgtcacctctcgattctgggagtaagccgtgagagtctgctgctgttcgtgcgcgttgtcacactgaggaaccgccgttgaccagtttcttgccgtctgtcgtccgcgtttagaccgtctcgtctgcgcatctccagctttttctctcattcatcgaacacagcacacagctgtgtcctctcatttttgctcctacgcacaggtcaagagtttttttccgtcttcagctcctgccgctcgacaccctgcctccgcgcccgccgagccgcgagtcaattgcagctcccgcgccgatttcccctctgcgactcatcgcctttgccactgcttccaagaggttgggcttcgttctagatctttccaagagtttaggcttctttccggagccaaaaacttgtggtctcgaccctgtgcaggtggtcgattcggtagatctgtcaaatccccatctgctcactcagcaggactcgcaatatgtgtgcgactgagacttcgtctgtccacttttgagcaaagaaaggtcgttgaggcgtttcaattcttgccgcatctctccgccggtagggtaacgcacgactgtaatgtcctcgatcaccagcagtccatgcgcttcttctgagggaagaacctagggagccgcgttacctagcagtcgacctttggacgctatcggagtctcagcctaccctaggttctatgatttttttcaaaaacaggagccgaagtttttgctaccgcgagggtacgatgcgttacgcctttctgtgtgtctcagagcgtgactgagcctaggccgcatgtgccgtatccgcttatggcggcaacttgaactgtgttgttcgcggctggaccgtgagagcgccatttaatgaaatgtgttttgcccctgtgtcatttccttcttcccaacagcttgtcgttgaaagaactccagaactaacggactatacaa

SEQ ID NO: 1610 - DNA, 2096 bp, Toxoplasma gondii
agacgtaaaacgtgagcatccagttataaccaggtaccaactaaaatctggcccgcggcgaaagaacacgaatggggtaaaaacagaaggcgaaaatgtggacctcactgccgagaagtggtgcctcatgtgtgtgtgtgtgtgtcaaccacggctgccggctgggaacctcggtgtgacagtcacgtctgatcagcacccaagaaaaaatgttcgtcaccaggaaaagaagctgcgccagacgtggccactcactcgagcgcgcgcattctgtgactgggaaattccgaggtccacttatgtatgcataaagtagtctttaaccttgtcctcgagctaaagcaaaaaattgatatgcatccgtctaaaaaaattgatgtagagtattttatctaaagctttcgtagcggaaccagcaaaagaaacagtgtgtttgatgaagaactggttctacctaataagtcacgagattctaacattatttattttgggaattcgttttgctgtgacagctatttggctgtttaagcatgcgacaccaacactcaaacatttttttgcatggggttggaaagctccggcctcgtttgtgtaaattccaaaatcctttggatttttgccccacagtacagaagaaagcttttgcgtcgggtatcctgtcgatttcaagagatgcgttagcagagagaaatgacccccctcgcgtctcaaaataccggattggttctatgcttatactaaaacaacattgttaatgactacagcttccaagcaaacatacatgtttagcacggagacagaatctacagctgcttccgagaagtatcgcgatccaccagcctccacgtcgcaatggcttcgtgacgggaaagagcgccgttggcgtacctgaaccgttcgggatacggcgttgtagtaaaacgcttcacttcgatttctttcttcagaatgtcaagaaaacgtcggcgcgtacagatctagtgaggcatgaaggtgcgaaatgcgaccgtgtggacggcagagaatttgccagtttggaaagcacacgaagcacacagcacacccttggctgcgaattgtcgtgtatgtcgaagtctgtttatggccgttcttcgttcccctcccggacgaaaacacaaggaggaaatcgtcttgcgaaagtcctcggtcaacaactgagagactacgacgaaagttagcacgcgcacagtgactcttgcgtcgcccattcgaaacgagaccaacggttctggaagacgccaccagccgaaagacaacaataacatacaaagcgcgacccactcaggaagaagttgaagaaactcaacaaagtgccaacacaccccttgcgagtgttcaagttactaaaaaaaagcacgtccacgtcgatgcccggtcatggctgtatttacgcgttcactcgcattcgagtcacaacacgcaactggcaggtatataagatagtccttggcttcagattcagcttaagggcacaaggattttcgagactcaaggtcaaaaaccaaatggtagagctttaaaagtggagcttcagctgggaaatgcgacggaagagaccggtcaacgaagaaagcaaaagcacaagactcaagcgtggcaagcgctcgaccctaaccgggctgacccgaacataccctggtccgacgcaggaaacaagagcagctaaccgaggttttttcggagcctgtttccaggactttcgcacacaccgcgggtgcaacgcctttcgcttgccagaaaaatcggggctgacaatgacaacacaaagaaaccgactcgaaattgcgtaactggacgcctgtcacgcagcagagttcacagcgcccccgctgtctcgattctggctcgctcaccacgaaaaaagccaacgcgagcccttgtcaaggtgccacaactcaatcgacctcgttccctggggctacggctatgccatatatttggtcggcttatattccgaactggggaactgacaggctccgagcgcctggagactgcgcaggaatcccactggcgggttatattcggagcggcgatgcccatataagagagactgctgtgtcaggaggctgggagga

SEQ ID NO: 1611 - DNA, 3650 bp, Toxoplasma gondii
tctgaacgtagaacgcgagcaagaagaagcgttcagagacaagacgcctgtcccgacagccagggccagagcgggcacagactgtcggagtcacgagtgaagctggacaagcaaccgacgaagcgagcacatgcgaacaggcgcttacgtgaggtagtgaagaccaggtggagcagccctgcgctaaacaacaggaaacaaggggagaccgaagagacgagagacacgctgtccccagcagaaacgctggcgtacagaaaaagagaagagacaggcggccgaagagacgaaagaaacgacaaagggtcgtcacagagaagggaaacacagagaagagagacagagcaacgaaagagaacgagaagagagagcgaggagagaagagaagcgattcacccttctgcgtactctgcgactgtgggaggtgccattgggtccggctgcctttgtccgtgatgcacagcgaaaatcctttccaatcaagcagcctcgctgcctctgtttgtagtctccagatttgctgaaagcaagccgggcaagaaaggtcgtgaaaaactatccaagttcgcagtggggagtttgccgcacgaggagaggcagcgtgacgcgagacagagcgaagagatagcgacgaatgacccggtggcagacatccgagaaaacgactgtttcaggcgcgaacggttcaaaataaagatcttccgatttcgagcagggaccgctgaaatcggagcacaagccgcaggaggggaaggcgtagtagcttccgggctgcaaagcgtcaggcaagccagctcacctctttgtcagtgcgtggcgaagaaaaaatcaggatagaagctcccgcgtaggaaaaacaggaaccgctgaaaagaggacagacccggccacaaaatacagactctactggagagaggcgcgcacggcttctcagcagcatgcacaaaggcagtcagagtggcggcgcatttggagcggccagaactcgccgcggcgttccgtctcgtcgaattttttcactttccatgaacccctacggaaagcctatatttaaggcgcctttggtgttcttcaggagcggcgcggaatcgcgtccgtcacaccgcgaccgagaggcggtctgaacgcgaggtggatttccacactaaagagaggacgccgtcgtcaacgcaggcttttccctctctcttggacaggggagttaggggctttctgaaatgcagcctttctgaatgacgagccgagagagttcccgagaaagagacggctgccttgccggcgccgcaaagcccgctgtgccggttgagagagatcggcggcgacacactcgaagaaaaggcggaaatttagttgcgaaaagaattcgttcttttctgtctacgtagagagaagtatctgcggaaaaccacaaggaacggtgcctctcggtctcaagaaaactgagaaaggggagcccgcacttcagtcgcttgcggatccgccaagcaaccaattcgcgggggggtcttaacccgaattcggcgcgcgggagtttcgcgtgaccggccttgtttttcgcaatgcttctcgagaatttgcaagagccagtggatatgaaagagttgtgggaacggctcgcactcatcaggttccgtctccgcagtcggttccgctcgtagatcctcaaagcctggtttttcgcacgcattcggtgtcgcccgctacacagcctaaccacccgactttcatgcgacacggggacccgccacagctgcggcacagacgtgaaaacaaaactgcagcccctcacaggtctgtcctccgtcgtttctgtcgattttgcgacctcaatagttaagacagagacgagaatttgaggacacagggatgaaaaagacgaccgatgacacatgaggcagatgggagcaggtcagcagtgggcgctccctgtgtttctgtcgtgccgctgcaccctggaagacgagctgagaaagctccacgtggagaatccgacgttcacgactcgtctcacgcactgcgaagtttcttcagaagcccgcagctcaacgttgtttgagagactcgcaagaaaacgcggtgtgtgcggcgctctatctcaactgtgtggtgtgcgggaacaccctggacacaagacgaggttcgcagaactcgtctttttcctgttcgctggtcttgtccccagatctccacctcgtcagttgcggaactcggtgttttagattaatttccaagattcgtcgttagaactgccaatgcggtggcggcgagtcgacggcggctcctggtgattcggcttatattcggtgacagccaccaggagacggctgaggctgttttgcaccagagagagtacggcgctcgtttttctgtggatatttaagtgtgcaggagacgccttccgttggaaaatgtttgccccgaaggccggttcgacgcgaggtagtctgctctgctcgtctcttgttttcctgctctgtcctcagttctcgagtgcatagcgtgcgtctgcatttatcgcgtgagaaacgaggtcgcgctaacgcaggtggcccgccggacgagttttcgcatgtcgcgagggacatatccgcagcgaaaagcagcacgggaaaaaatccatggcagcaccgggagagtcgtgcgaacgggatatgtccgctgagatcggcgcgtgctactgcctggtgtgcatttctctgtttctctgaactcctggttgacggcggtcgcctgtccacgtgtctttctttgctagctttcgccttcgtcttccacctcttgcgacttctccactggcgccaaccgcacgccagaaccccacgcaacctctctgcgtctgctctgtgcgttttcccttgctcggagttgggagagtcccgagcacttctggcatcccaacctattttgtttcgcttaacgtgtgccgtcttttcctcgagcttttccagttttcctcgaagattccacacagttccggtgcgccgcaaccgagagacccgcgcgcgcttctcccgacgcctggtggcgcaaattacgctgtgtcccaagagattcagtctcaagaaacgttgattctacacagaaaactcccgagtgacggagactctccactttcgtgcgaacaggccttcgcggaaatccctctttacgcccagtattttgttctgcgcccctcggcagccggatttgcgaggtttcaccggcagcaaaactaccgccgtttcttttcctttttttccgcttgttcctgttgttccctgtccgtctcttcaggcgttttctttttcgtagttccgcaacactatctccgtcgccttgccgtcgtcggccacagcagcccgacgaacgctcgactacagcacgaatctccctacttcccggcagtgatttgttttcaccgcattcgttcccttctccagaccgctttgtttctcgttcacattttcgatttttggcgcgtctctcactttttctctgccgccgtcgccgctctgtttctgcgtcggcaaccctgcgcctttcgttccagtgtctcggccgttcgggacttcgtgccatctcgtttttttccttgagctagccgctctcccttctttctcgacttttgctcctccgcgtccaagtcttccggcattcggtgttttgcgaga

SEQ ID NO: 1612 - DNA, 1583 bp, Toxoplasma gondii
aagaaagacgcagacagggacgaggaagatgcagaaaagagaagagaggacgagcagggaagagagaggaaggaagttacgacaatcacagagcacagaaggaaggaagacagcagaagagactcgaggagaaaagaggaagcagcagagaagaggagaacgcgtgaaggcgagaaggcatgcagcggtggaagcgagttgagggagagagccggtattcttgagagaagactgaagaagaatataattagtcaaaaatggacaagcataaaataattcgttttcagagagaagcacagagagacgaggatgaaagaaagaagcaaaccacagagaggaccggagcagaagacagcgcggagacaggcgaagagacaagcagcgacgagaaactgacgaatcaaggagaggcgccgttgaacagcaagagagagaagaaatggacggggaaagtagaagggagaaagataagattgagaaggaaaaggagagaaacaagagagaaaagccgagaatgaagctcactccaagaattaaggggatagactccgcttggatgggcgtaggcagaagccagtcatcttcctcaacagctttgatgatttctgggcagacgccgagttcctcgaaggcggacattcttgaaagagtagtgagaaggatcgaaacggcgaaaaaagctaatgcagcagctgtatattgtgagcgatactgcaaataagttggaaataagtgaaggaaaagacagctggaagaaaagataacaaagagagagtagaccgtataaggaaaagaagcgagacggcggagacaggtgaccacgacgaggaagaggggcgggtgaagagaggtacaggagacaccagcgttgggaaaaggagaggaaaagttgtgtgtcgcggcaaaacggagaaaagatttccctgtctctcctttctgctactgtgaagtaaccgtagaaacagaaacgctgttgagcacaggcacactcgaggagaggagacccggtggagacttgccggaaggaaaggcaagaaagagagccatgctttgctcaggagctcttctctttctccacaattctcttctttccttaccctgtcggagctctctgttggaaaaggcttttttgtcacggtttaaccgccgcgcgtcgctcttgtgcctcttgcctggctgtcgcatgcacatccagaaaaaggcgcgggaggccgtcggactcttccttgttccggtagagcaacgattttcacggagtccctcttttgcttgtccgcgtgaagcaagagaaagaagtcgacattttcgaaaaggagtcaaagcataacttctctgacgctgatccccgccttcgcagggaagagacacccccgccatcgtgtggttcgcttctgcttcggtctcgggtgctctctgaagttttccccggattttctctgtgtttttctctctatttgaaccttgcattttgcttccgcgctgttttctccgatccaccgccggggttcgccttcgttggcgtggccgcctctcgatttcctgacttcgtgcggcgccggtgagcctatacagtggaagctgca

SEQ ID NO: 1613 - DNA, 2394 bp, Toxoplasma gondii
cttttcttcttttctggtgtccacgcaccgaccttcggctgcttgactgcctgcgatgcgagcgtgcacgcgcggtccgcggtcgacggaaccgtcggttttgctcgcgatgccgttgggaatgccgcacgggccttctagccactcagcgggcacacggggagactcagaaacatctctgatgcaatccggaatcggcgcttggtaggcgggacctatgcgcgggtgcgagtgccgctgcgtcatccagcgactgggatcgaacggcattttgaagactgttgaaacacaggcttcaagcgttaggcttaagcaacatgcgtcgtcgtttcagtccctcgactgagcgcaaactttctggttgtttagaactgcgttcagcagaaactgccgtcttcgagagcgaatccaggagtgcaaggcggcgtggcgacagtccccggaaaacgaagacaacgcagacacgcggatggtgccaacaactctcaagtgaggtcaaggaaaagagggggaggtgcagagagagaagacagaaaggtgctctgtttgacacgctaacctggggagcaagtctgttcacacaggcacgacacacagaagcaaccacatgcatgcaaaacaaaagagttacttcccggaggaattcacttgcagacctcagtttctaaagtgaggaaacgggattcgccttgggaaaatgaagcagggggcgttacacagccgcatgctcatcgaaccccgttaaccacagtgacgacacagaggcggcgaggttgaacggcctgatctcttctccgcccccttctttgtgtttatttgtccagaaaactcgagtcagtaaaaaagagagggattttgctcccgaaattcagcgaagcacaacatcgtcacgtgagagacaagcattgtgtgtcgcccgcgtcccgacagggaaacagagtgcaccacgagttttcttcgacgtctcttccccccccctgtacagattttcagttttttccacttcgcgacaagagcagagacactgaggaggaagacactgtcacaaaaagaagtgccactttaaacgagacgcgcggaacacgcacagaccggctctgctgtgctgcctggcaagaaattcaaactcactcacaacaagccagtgtgcatgcgcgcttagacgctcgagtcacccttgcttctatattgttacattagttcgaacgtgtgtgcgctcaactggacgctacaggcaaagttcatctttaatgcaaatcaaccaatccaaataggccgcgagatggcttgcatgcgcagttccctttacgaattagagaactctgtgtccatgtacactagtagtcaagttcaccagtcgcgccgtcgggcgcgtagcgcgctgctcgcgtcctctccccttgctgggaatggaaaaaccgagtcagatgcaagacagaccggccaagttgtttgagaggtgctctttcctctgtggcagggacacgccacacacacagggtctgtcgtggatttttccccgcgttccggtcttctccgtcggccgcacaccgcggtgtggctgctgggcctgcatgtgcgcgaggtcgtgccctgacacggagaaagctcttttctcggacgaaaaggtgcccctctgttgagcatttggtctctgtgccggcaaagacaaaacttgttctgcgcgaaaacactgaatggatcgcgagggtctcgcgagtccaccttgccgctcccatccgcagagtgtcggggttgacgctggtctgtgccgagtcccgaagcccttctgcgttccttgacagatgcgcgtttcagtgtgtgctttgctttgaagaaagaggagtcattctcacgctcacgtcggccaagagactggtttaatgtctgggcatttccgctcgactttcaatggcaaatacaggaaacaacagtgtcaacggacatgcagagagcaaccacaaaaacaacgggacccgggagacagcagagaccggcgaacgcgcgcccgagagtggaatggagctttcttcgtcaagtctgactgacctgtggaacacacgacttccttgtctgcttcctcggcttctgcattggcgtggacgctccatcgtgccctccttgtagaacttgcctcaagggtccccgctgcgtgactctcacgtgtctgctggtcgcagttcttctcgaagaagatcactcgtctccgttgcccggaacatacgcgtctcgctgactcgcgcggagtcgacggaagcggcgacggcctcgtcgcgtgcacctctccaaggccggtttcgcttctgtctgagcttgcgcctggctagccacagtcgaccctgtgtacgtacacccgaagactccgccccccgccgtcgacctctggactcacaa

SEQ ID NO: 1614 - DNA, 3280 bp, Toxoplasma gondii
cctttgccatgttctctttcctcacatgctggttccttcaggttccggcggactgcatcgaatcgtggattcctggtggccaggccaccggcgtgtacgaccacagtgcctactgggcggcagaggcgaagcagtttgagtgctacatgaagtttttgcaggaagaatttattgggaagtcacagcagcagagaatggtcgaggcgcgggcctttcaggaggcgcaggccgctgggaagcagggcgacgaagcagtggaagctgcgcgagccgcagcgaaagacgacaagaaaggcggcagtggcgccgcagactcagacactttactcgagaaagaggagggagaagaagacgttcaggacgaggaagacgaggagtcgaacgccgacctcaacgaagacgaagaaaagaggagaatgttgcaagaggctctgaaaaaagaacaaggcggccacatggccgacacccagtctacgggggcggggcggtagaccagaaaaccaagccgaggggcagagggacagagaaagagacgataacggaccgacggagagagagagaaaaaaaaagagacagagacagaaagagagagaggggtggaaaagactaaaggaaggtttgacagttgtagagggaaaccgcaggtgggagaggatagcaaagaaagggagagtgacgtatcgaatagggagaacacaggaaaggtggaagatcggcgggtgcctttgtcataagacgtgaaggagaaaaagagggggcaaaggcacaagggtggataaagaagggatgacgagacatatgcactacgaggatgtcgacttgtcgagtgagggaaggaggacgtttgagagggaggcgaagagaacgctggggatgtatccgtacgtctttcactctgctgtctctctatcgtatcttctgtctaccgtcagggcattattccgactcgatcatgccttttgtcttgcgtgtcactctcaacacgcgagcgtttgtgcacttttttatccgttctttccacttagttaaaacggacgaatcatgtaggacagagcggtgctctggccacgcgcaacgcctccggtggtgtcaaggagcgggacaagcgttgcacaccttcataaggaatcgacacggtcttcgaacaagcacgcaggtagctactgagagacgcttacgtcacactaaaaccctctcgtttttttccacctttcttttttcccacacgaaacagaggcgaaagattttcgaacctgtgaacgcgcacgagagacgtcagacgtcccgctgcatccacgaagtttttccgccaaggcagtcgatgaggcaagtgtcaactcagctgtgaacgggaagagaagatgcgaccttatcttcctccttttgtgcatgtgtgcaccatcgagaagaattcgagaagtcaacagagtcaaggagttcaaggaaggtctgcttcctcactttggcacgcgtccggccgttgcagcaagacaaagggatcggtgagactcttgtcggctctcagctgtgctagcatcaggcgaattcggcgggtggctgacacacggctgtcacaccctttcgtgggaacagcaaggcgtgcagaacctcctccactggtgtaaatgtggtacttccttttcattctttggtactgaaaattgcaatcgcaagacagtgagaaaagcgtcggagaccatctctacagtggaagctccgaaggcaccgacgggtgcaccactcactgttggcgccgataaaccatgaaaaacagcatacgcgttgtcagtctcgtgcaaatgtgaacattcgctagagttcaagttgcaccgtggtgatttcgtcgactcatgttaaacctccaatggacgcgttcgcacaatggtctgctggacagcagcagccaactaccgcacccgtcttctggccggtgacagaatcgcaacgctctcgaagctttcgattgctgtagaccacagagcgagctgaagtatatcaagtacgaaccacgcatgaagctgtttgcgccacataacggttctaccgaagcagtcttcggttctcgcctcggagaaactgtgtccgccctgccagggattcaagcagtgccgtcatctgaaggtggttgtttgctctatccgatgccagacgtaacgtgcgcattcgttgctgatgaggaaggcacgtcaatatcgcgtgtggatttgaaaatgctgaatgaaggggcttttgaccgaatcgtgttccttgacacgtggggaaaatggtcgcgtaggcaaagagcctcgagggtgattatcccgacgcagtgcctttgaggtcaattctccagcagcgcacggctgaagaatgtcttcgtgaatgcgtttcatcacgaacagctgagttttcgcttctacagttcttgcatgttgcgataactgagtacgtagtggggcactcttcactgtgctacacctgctgccactacgcagcgccggtattagtgcacgaccatatcctcggaacgagacattttttatgcagctaaccaaaaagttgtctggtccggagtcgttagacagactctcaccttctgcgtttctggcatcgtcgtttgccgacgggttctcagcaggttgcatagagactccacaaccacgtaccggagcacatgtgaccccgaaagaccccccgctacccacaatgcaaagacactgagtgcggcactgcttgcttcccctcagacaccacaggctgcagccggcaacctactcatcaaatgcgagttttcaggagtgctacttccgcaccgggacgccaggtcgcatcggacacacgccgtgcggcaccacacgtcgtctccggaagaggatcaagaggaagttcagttcatgtggacggacgcagaggagaaatacgatctctaaggctttctaggggttgtgtcggccgcgttcgacctggtgcggtggatgaggcacatcttattctaagtgagactagcgctgatatcaccgtatctttcagggcttgaggacggttctctcgcgagcggcgaaacctcagaagtgacagtccctgcatgaagtcgaagatataatctccaaggcttcccgcttctcttgggatgtgcggcacagcgacggagagcagcgtcagcccgcgacgccttttctccggtgtacatccaccttgccagtgccacacgacgaggaagccgatcttccgtgccggtgcgtttcttgcacttgtcattggcgtttctatgtggcttaggtccgttccggcggaaagaaga

SEQ ID NO: 1615 - DNA, 3991 bp, Toxoplasma gondii
caagctagtgtagtccatattttctattcgcttgtggacgtgcatgaacacgaccggcacatcatgcaactcccctctggcctacaagggagtgaagctgattggaaactgtcagaaccaccaaactccagtcagacgtgttccaaccttattgccttattgtctatgtccgtgcgtcagacgtgcacacatgcctgtttgttaaaagagcatatgcatacaaagaaatgtacacctgaagcggcgagaacggggaatcgtccaagagtttcaggataaagagcgatagaattgacgcagtctacctgtttcggcatcatagacggcagcggtctgttcggtgaggagatggccttgcgacagaggggatccttcacgcacaatgactttctgggtgtcgttttctgcgaatgtgacgcgagggacgtaggcctgcttgtctgccttcgccgcctttatttttgcgagttcttcagcagagaagaaagtcttgaatttcgcgacgacgttgacgtgcggcttgccgggcttgttgatacggatgtcgaaggagtaattgtagcagaccagctgtccatccatgaccaggtatacgacgatgtccgattcactcgttttcttcgcggtgaggacaaagtcggtttcgtactgcagggacttggccattttcgaaggaaactgcaactgcaccgtgatgaacatgttgggagggtgaataaccatcgcgagcttcgagttcccgcctccgcatagcccactcttgcagatgtcaatgtgcttgggaatgatcaggaggccccagggaaagtactcgatgaagaagtcgttcttcgacggtcccggctgctgcggcagagcgagggtgtggacggcctcgggaattgagaaggaaccgtaggacacaacggtctcattgcatggatcgaggctgcagaagccgcgtccgtagctcacaggggtgacgttccaggcagtcgagttctcgtcaggccgagtcagaatcaggacagactctggaatgtacctgacggcgatgtagcatgcgttgagcaggaaaacggatggcctccacgacttcgtgagcacgggcagacgctcgggagacgtccacgatacaaccgtagagatcgtcggcaccttgaggtatacggccttctcgccttcgattgacagacacatcccgcctttccgccacgtgcgcacgtcgtactgccccgtgacggtgtctgtgaactcgggcggagcagaccggccatcgacagagtccaaagcctgcaaccggccgtcgctgaaagaggtaagtctcagtgcaacgtcgggggagacgccaccccagcccttggagtcgcacgcctggttcaaattccacaccagggtaccctcgggaactgtcagctttccactgggttccaccaggcgcaggcctgagtcaagggggagaaacggcgttgccattttgtctcgtttcctcgcttttctgcgcagggtttcccaaggtctcgacctcgattgcgacaacggctggcttcgggcgcgcggaacgcggcaagctcgattgcaccggctgcacaagggacgggaggctgcaagggaaaacggcggaacgttgcggacctagtatgatgcgcgacaaaatcatacgaaattgaaagttactggacaatgtaggacgtgaatcggggaagcaagtggaacaaaagtgggaaactgcaccccgccgcgcttcaccagggaagaatcatctttcggctggcgcatcgctcaccggcgcaagacagcttgccatggtgtgagattggagcacgtgaatttcaacacaccggcacgctggcatgaatgccgtggcgcatgccgggaactgcacgcatgtcgcaaaaagatgaaggaacgaatgagggattttcctgtcgacgagctctcgaaaagcggcctctcgcgaaaagaacagatgcagtgaaaacttacggaaaacccggccttcgagacggacgccaacactccgtgcgctaggtcgatacagcatgttccaatcgtgttgcgcggcagcaacagccgcaaaacgggtagctttctcctgctcaccgattcgaggcaacgtgcatttgacactcctgaagatttccaagaaccataaacaacacaaacgcccaaacggaaggttacaccggcgcactgcgcggaattgcggacctcggtgtagaacatggcacgtaccacgggaaggatcgacggcatccaggtctagtattccagaggtcctgccagtcgatagacgttagccagaacatgaaactggaggaaatgactgtttgctttcctgtgagactgaccacgtgtcccggcacacctgatgatatgtgcgctagaccacaatgttcttcggcagaacgaacgagaacgagtgacgtagaaaaagcggcaccaaaatatgcgggctgtcaacaccagaagggaatcacagcttcactaaaaatcttcgtgcatgaacaactcatatggagccgggaagagggcagtagaaagaagagaatgagatccggcagcgcacggaattcgcttttgatggaatgcgagtagaggtctggagtgactgcaaagtgctttcttaagaaacactttcaccgtcgagcgctggggtagtgggtgccggtgcgagtaatccaaatcttgctgacccgattggaaaaacatcccggctggcctgtgatgcatggtactgcttaccttctgactcttttgtagtgaatagtgaacacggtacacgtggttctttggctattgcggctttgggagcacagtgttcactcgtaaaaaactggcatctgcgatttgaccgggagaatcctgtctaagttggaaaaacgcacaagcagacttcgggtgtgcttgtttatactcatgaactgcactgatgttgatcaatgtgcaactggatccacatgcttatacacacaggcattcgcatattacacgttttgcaatgttcgggacaacaagggatataactctgtttccgtcgaggagtaggtttcctcgccgttgacagcagcacttgaggatctacgcagacgtaattcttgccgagcacttggtacgacaatgatggcgtcattaggaagcggagacctcatgaagtgaagtggcctctctgcacgtttccgctcttatagaaacaatgtacaggatttacgctgctgttttggtacttggtgaaaagccctccagacaccgcgtgttaagtaccgaactgtggcattgtatataggcagacacagggtttccccgtgtgatcccggtcctacagaagtgaagacaacaaacctttctcgccatttcctctgcttctcttgttacctaaaaaggtaccgccaagctcggtgcgtgtgcatgaacagcgagatgcgcgggttccgcccctttgtcctccctcgtttttttccttctgtgaagggaacgttgcctagacacaccggatgagttcagcgaggaggatttgccttttactttggatttcgacggggcaaccagccattggttcacctctcaggctgcttgcatcccagaaacggtttaagatcctccaaccagtgatttctccatttttttaggcaagagacacacgatcattctggggagtggaaaccttcggttggtggagcgcatacgaacccctggaaagctgttgtgtctgctcacacatctgggttaatgctgaaaaatctcatctggccgacagagattcgtttacagagttttaaatttgcagacgtatctacgtctctccgcatgtacgcttttagtaattttctgctgctttacgcggagagactaccgctgtatcgaggacgttaggccgagccactaaggggttgccttttcgtgcacttttaaaattcttctttgttccgactctccttcgaccttttcctttgtgtctttgctctccccattcctcttggtcttcctgtctgtctctccgcggctgacaaaa

SEQ ID NO: 1616 - DNA, 3943 bp, Toxoplasma gondii
aacagcactgcctgtcgaatgtcgtgtgcgacttcgatgaattgataaaaagcgtcgaccatcgcgggtgtggggccctcctggagaaaaaacgggggcaggggctcgcgaaggaaaggcgagacagacgaacctttgccaccagcgtcgttcgcgcccggcacgcatgcgccgcttacttctcctgctgggcctccgctgttctttcgtgccaaccggcccaacgaggcggggccacacggagacaaggaagaccacgacagaaggttcggcgaagatccacaggacaagggcgccgagagaacgtaggaagaggatggcgagggcggagcagctgaagagctggcataaggtgactgcagcgccgacgccgcggacgaaccgcgtttgacgcaagtgccttcgagcggcagcacctcctcggccattgtcgacgacagtggagacgaagggggcgagttggtggatgtgagtggagacagatccagcgtgacggcaacaaacggctctgttttgaacgaaagcgtccgcgtcggtctggccgccagaccagacccccgtgggagtctttgctcagacggggacagttggctggatctgcgacaatctctgcgtgctcccttgtgcagactcggtgccgcgttttgtgtcggctgcacccgtgcgtcacaacagcctaggtcctcgcccccacgactgttatcaggcaacggaatgtcctcctcttggtctgcagagaaaatcggagaaagtcgcggggtcttcgaactggcgggcgacaggaaagcgtccggcagcacgagagccggcaggtggagagtgcgtggagaacaggttagatcggacgaaaagtgctctgcggggtctgatgacctgccgcgcgcatgtgctctgtcttttaaaggtagatcaggagcgccttgcgctacatctgtctcctccgagtctccaaaaccgaaaggccatctactgggccaagacaccgtgccaccgatgcggcttcgccaatcacatcccgaattttctgtccaccgttgccaccgggacttgtgtgccgagagagaaaagagcaaaccgaggaaagattcctgcgtcctccctcgaggtgcatccgttgcttgactgtcattgcctccgtttcgcgtcgcctcggtgcttctgtatcgcctccgctgtttttggtgtacggcccgccgctggcgaagctggagttcacgctgtcgaacacttgcatcggcaagcttctctgcctgtgcacggcgctcgttagagcgaggcgaatcgagcgggtgagtcgggggaggcagaggctgtggtggactcggttttcctgtcaaacgccgccctagagacagatttgctccttcagtaccatcgtgacccaacgatgccattgagtaggggagcaatggaactcgcgggagcgaacaaaagaaacgacgtgcgcagagagagacaagaaaggggaaagctttcttgggactgaggcattcataaaaagcgaacggcaatgcagatgggatcagggcagggacggtggcgaacgacagagacgcaacgacaagtgcgtaagggaagagtaacgccagaaaacggaggggtaaatggtgatgtgaaaggagaaaggaaaaggagactgaatatcaaatgtgaagaatgaaacacaagggagagcgtgaggaacggtgggcttgtacttgttgtacttcattcaagctgacgccaaccacggtgggtaaggaagacgacctccattagaggcaagcaagaaaattcctacactgtttcctgccaactgcccgcgcataagaaaggcgaagtcacttaaaagagaaaggtcactcagtagaacacgtgtagccaaatcttcctcgcatcctcctcatttagtccagaagaggaagaggttctgtgtaagtcgaggaaaggatggcagacacgcgcggcgcctcgcgctcaggaggccatacgaaaaccaggaaatgcttgcatcggaacgaagaagcaagactatttatctaaatggaagaacttgagacggagggcagtctgttcaataaacaagttattcctcagtatggcgcggggctcctggacgcaaaggggaataaaccaaaaattcttttcgcgacatccctctctacgaagccgctactttaccgctgactcacggggtacgacagagtaaactggcggcataggaatcccatgtaaaaagccattctttgagaagcaatacactgtcgtgagcgtaaaatcttttttgttcatacggcaatagagggagaggcttgaagctgttgccttgatcaacacggaaaagggacagttgcagagaccctccagcgagcaaacctcgtccgttttgttttggtggggaaggcgccgtgttgggttcaacgcctagtccttttaaggaacatctccgtgactaaacgaaggcagactgagcgccgacagcaaaacgtatctgcacagtgccgtcaaggcaaaatacgagaagtctgcaaattctttccagctcactcgctctccagacattccgcggcttcttaactcacggcaatcgcagctgtgtgtaagcccttcagccacgctgccaccaggcacataagaaccacagaattcacacttgcgctacactccgggtttcgatctggaggagacattatgctgctatgaggctcccttcacctaggaaaatactttagtagatgtaggaacgcccgtgtcaacagcaagcaataatatgggtgcaccaaatggactcatgttttcagcgtcggtatcctgagaatttcgcagacacagacacacgtacatgagcacacagctacacgcacagacgtgtggtagaatctgagccaccgcgagcagcaagaggcacctgggtcagcaggcttcctcgtagcgtcgtagtcaaaacgtctctaccggtctcgtacctggatatcgggagtcaccggaggcagtggcgggggcctcgcaaacacattaccattactacggaaacaattttcagttgatgacggtgcagcttccgggacccaacattggaaaaggattttacagcatcgactccgacatatgctgaaaaattcaaatcggcacccagattcgacggtggatatcctcatgcagcaggtagaagctaccgcacgaacccagtgcatgcccgttttgtgtttgtacaaagtatgttgtggaaaaattatgagatggactcgtcatgaatcacagttagttctcggtttccctttcgctagctccgggaatcttcgcccccctagagtaccgtgttgagagcgatcccgctacctgccgtgctgggtgcagatcgttcgtgcaaaccattcatcaatacgagcagaactgccgtcagccattcccgcaggagcaagtgatccaactaacgcttcgcttcagagaggttgttcttctattccgtcgctcgctcccacagatgtagcagatgaattgctcctttacggtgcacaaatttctcaactaacaaattccaaacaagaccgctgtggtcgtgactcgaaacatcacaacgctttcttccgccacttcaacgtttctttccaaaagattctaccgaaaacccttccacggtagaacaggcaacactgtcaaggggctttgcttgtgtaataacgccacgagattgtccagtcgctggttcaagagagataaagaaggtaagaaaccacacaagattttgttccgtgcagaaaagggttctccgtcggtgtaagagtcacttgtccacgaatatgccctcttcggctccagtctgataaatctttcagtgtcatcgttgcgatttgctaagtcgttcccgatgaagtttaaccaatgtgtttttttactgcgtgcaggtccttatgatattcaacgctgaacagccagcagctgtcatatcggatgagctccggca

SEQ ID NO: 1617 - DNA, 4624 bp, Toxoplasma gondii
actgaaggctttccagttcaggaattccctccgttcagtttctacggaggcaggagctgcgaacatgcctttctgcagttcagcgattgttaggaaacagcgagattggtagaagtcgctagcgaaggaacggtaacattttcggaaggaggcaataattttttcgaggagtccgccagagagcttgtcaatgacttcaccgagttcgtggtcccttctttgtgggaacggagtgaccatggaggagtgcagaggctttttttcaacggaaaatcaattttgtgtactgagcgactgcagcttgtctgccgtaatgattcaaacggcaacctaagttttttccgcacatcggcgaagcataaagtgacggtttcagcctacggaggctctcagtactacgcgaatcgagttcaccacaacggcacttgtgttcacacacaagattgatgtatgtttacggatgctttaatagcgtagttgacgtcaaagatgggtcatgtatactagcgggtggcccaaattttcagggggtgtacaacggcgaagcacgtcacaaagggagagcattggtaggcttcgaaataatttctagtcgggagattcagtctccgtgtggttaaatgagaagtgctcttggtgcagcagaagcgtgatggccagtgcaaaaggaaataccgttgtgatatcgagttccatgtttaacgtaaaactcgaaaaggtagatcatacaagcattcgggtactcgcacatctctagaaatacgtgcgtgcttgggcacaacgcattaggagaagtgcccacgctgtttgaaaaccccacgatgctagtacagagtgcagcctgtagcgttgttccacgggggcacgcaaaaatcgtcttttgtagagagcgtgagtcgtgtcactcttcaaggatacggtctcacatgcagccagtgcggcattgctctgcgtcgtaagcacttaactccctgtgcaacgggctggtggtttagagggagcaggaagaaaacctagattttcagtgtatccgtcacagaaaatggcacagaaagagacgctcggttctgtaaggccaggttatgctggaaacgatgttcagcagggtattggggaaataagaactgacgtcccgtgtcctttctatttctcgtaaggaacgaatgtttaagcagacgttgagttttcgaaaacctcaacagtgtcctgattccaaccactcaacaaaggagtcgggcactcgcaagcacttgttctatacaccgctcgtaaggcttgtaggcgtacatgataaattcctgaattaaacgacctgcagtggcgtacgtccatggcgttgctgctctctccaagttcccacgggttagctaacaactgcagtttgcaggctttttgacggagcgtcgctgttgtctcttgccgcctcgtggcaacaagagaaatagcagactcttctttgcgtgtcaagtccaggaacttctcaagctcccctctaacatgtaaggcggttcccctacgaagcctttccatttgcgcttaggtcatttctttttgcgacaacgaggcaacactacgggagattccccactaatgttgcattggttagatgcattgccgctgcagaaatcagaagcatgaataatagcctgggggcccccactctttggctttccgtagtgcatgcgatgtcgaaagaggcaaaagcaatcgatctcggcgtctgtaggataaacaggctgttctgccacctcaactcagtaccagactcccgatctccacgccagaccgactcttttatcgtggcaccattctgctggagttgaacgtggtaactctttcgatcctcgagagaaacgcaggtcatccaagttgaagacaatacccagcagataacagcagatgctagattccctgttctacatcataaaatgcagtgacttctgatactttcagatcgtcctaacggcaagaaggaaagtgtgtgtcgaaaaggggggtgttcagcggaaaaaaaagaaggcaactatttgaagctttagttggaatgaggagttctgtggaacggcctttcttttatatcgacaccagccgatcactggattgagctgatgacctacaatgtcgaagagaggctgcagaagtctaacggacgagcggatgtagatatgtggaggaagcctgtgctcgtcgtcaatttgaagagatgcgagccacctcctttctttcaacacgctgagggttcaatcggaagataattgaactgtattcctctccgacttattgaagaggcaagaagactctttcacgtggagggtttccctaggaggaccaagcgtcatgaatccttaatcatactaaagtacgactgaaggtttgttaaaaccagcacaacatgcagattgtgcgccgtggctattcatttgctttgacagtttgaacgaaaccggacaacaagctgatccagagcatatagcattcacagcaacttgcccagtctgttcgagagaacgatcgacagaatatattcagcctgccgtccttttatcccgacactccacggatttgcatgcgactgttcttggtattgtcgaaagcggatgtatcactgagacagtcgattgatgtttgcttacccacgtcttcggcagtggccatctgcgtccacaacagtgcagtcttttttacgacgcacttggggttattattgcagccagaggtgccagcaaaagtatacagtgaacgggataacgttcttacatttacgtaagagaaagtaagactccagaggagtcatgtgtaagcacctagcgagtttcggccaaatctctggcaaaccagacggacagctttcgaaaaaattcggtcctccgtttgtgcacaaagcctctcttagaaaagaagtcaagacttttttgttggcatgtaaccctatcaacaatacgtcagtacagactgttgccaaactccactcgtggataaatattcaaactgcgaatggcacccgacacagtgtcgcattcgtttccccagtcctgacgcgccaagaacgaaaaccatttcccatgtttatgccagaacgcagtaaacgagatatgctgagtgtatgagcacagcacaaaaacgccagcgtcgactgccagcgtgttccggcggctttgacgatgagaggtggttttttcggtcgcgcctcgccgtggatgtcagtctctcagatgctctcaaatgtcttctgtgttttaggttgggagaatcgtgtcttataatactctgccgtcgcccctggccagcctcgtcagcaaggagtgcctacaaaggaatgtcgtaaaccaggttctaccaattgagagaaacagcctcccaatgtagaagcaaagaaattccgaggcaacgcttccgcgcggcagggtaagctcttagcaaatttcctgcctgttttgcccacagatgcacatggctgaaatcttcttctctgctgaaagagctgctcttttgaggcagggtgaccccgcccgataacgctgttcctgcgagcacacctgtgtccaggggatgtcttcggaattgggagcgtcagatgcgtcggcgggcgcaccctttttagtcttcttgcgtcgcaaagaattgcgatactttccacgtagaaggagtttcgatgccattaaccacgggaataacaccatcgtcatgcaagcgcttccttacccttaacccgacaccagcgcgtatgtgtctagccaagacaggtcgtgctgattcgtgttcggtcgttctgaaattaacggattttcccaattccaccagaaaatggtgagcagcagttcttcatgtcacgcttgaagtacccgggcacccaagtccttgtcttttatgtgttggtgtcctgtgagttcaccgtttcctcgcggccttccaggctcgcttgatcgaaaagccgcccccgaaagctcagcaaaatgcgggaaatccagcgcagaatggacccgcaagatgtgtgtgtgaagcatgtgttttacgcataaaagcctaaagtgctcaaaagcaaaagagcctgcttgggtccacgttgtttcccgcgattcactgtgcatgctcgcaagctctttgcaactccaccgaccctgggcgtgttttctctcccacaagacaacccccaacgctttttagaagaagtgacagccccgagaatccgttgcgtttcacaaaatctcgtggatccgcggaaatcgctggatcccctgttctccgtttcacgacaccgcgacactccggaggctctatcgaaaggagttccgaaaagtcccggtcgtgccttcatcctcttgtagaaagttgtgccagtcctccttgtctttgaatcctggcttggactgtcgaagccgccgcaaaatatttctgaactcgggagtgtgtctacatgtcctggtgaagctgaagacagcttaagttccgttctccaacgtcgcacgacactgcggctctttcagtggactggtcgcagtctcgcaaagcaagcggccgtttgctgtgacgcgtttttccttgacgatggatcgtctactcgctccgagctgaaagactccactcacgccgtgcttcagaaagttgtccaaatctgctccagcca

SEQ ID NO: 1618 - DNA, 2328 bp, Toxoplasma gondii
tttcagcgcctctcggttacgggagaaaattcatgcattaaatgaagtgtcgttcagccggctgacgctgagtagaatccttcacgcgactgtaatcactggcagtgtctgattgtaaagttagtggggtttcttttaggacacgagaatgtatgcaatcgccataggaaatggtgggcaggtagagcccgcggttcccagtcactttcgcgtcgagccaatgacaaggaaaaaagcaaatctccttaaccagactcggtcaatagatcagtgaaacgttcccacagaggacgggtgagtctgcgatgagtggaacacctgggcacaagaagtggtctctactatccttttccacccctgcagactgactgttctgtccttccggctccgggtttgaagcacgcaaggcatgaccagagcgtttgccacaggcaggctggccaatggaagttgactatcctacgttgtcccataagcttgctgtaagagggtttttctctacgcatgcatttagtctatgggatggagattcattaccgacaaaagtcttctaaaatgtttgttggtttcctagaacctcccgacacagcaccaaaagagcgagaaatctactgtacttcacgggcagggacgaacaaagttttgctttgaatgctaaagcaaatcgaataggtgtatatgaatgtacgctcacatgcactgtttacttcggtcgtttcacagtttgtggttcaactgcagatatgtcaaaactaactgaaatcgtgtttctgaatcactcatcaacttgtttactgttttcagggaacgggaaccattccgttcgcagaacaactgagccaaggcgttgcttgaatgtgagactcatgttggttcgttcgtgactttgatgggcacatcttgtcgccacgagcattgtcaagtctgtgcatgattgaaagggaaacaatggcaaatgcgggggttaagggtggcggtcatgtaacgtacggctttcccagggtgtctatagttgttgacttaaccatatacgtttgtccaaacttgcattgtagtacattacaacaaatgcaaagtgagcagcacgttccaactgcaagagttatcggttgacactccaaaacgacgaaccacattgttttttgttccttcaaacgatcagtgtgttccttccgtgcctctagcggatggtgcaactgtgtaagtttagaagaacaaaaaagaggagtgatatctgacaacatgggtaaaaagcttgtcggagcccagatacgtgagttgcgaatgcagttctgcatgcgcaccattggcaagcaccgatgctgtttaacggcatttaactcctcgacccaaaaggggatctctcctaaagcgtattgttcttgaaagtagcgccctcttggatgttcttctatttcatcaggcccagtattttccgcacacgcttgctatttttccctattcccgtatttcctctatcacgccttggccgcggttggtgtgtgcattttactcggctgcgcgacacgtcacaccaacgggctttggagagcgtagatacctttcttagttaactttcgcattgaatacatctgacgtacggagcatggtaggtgtgccgtttgtctgtcgaattccactactgaacaatgtgtctacgcttggaagcgacgtgctgttgacctacattggcgctagtcgagtcaaagttgtccaacggggccaaacagaaagcttgagtgtcttttttagtcgcctctgatcatcgtatggttacatcttaagagcaattgttttcggatggtactgataccattttgggctcaacttaaggaattcggtttcttcttcgccgctctgcccttagccttttgtcgcggtaagcggctactttgtgagaactgaacagtgactcgacaaacgaaggggacactgtagtatagctcttcgtagctcaagcactcggtcaagtcccatcatattatgttcaaagttacgtttttccgtgactttttgtcttctattccccctttctctcaaaactctgccgaggaagaagctggcaaagacttgcgtatgtgctctccggggcgcaaccacggcaacccagcccatcatctctcctctcatccacactttccgttttgtttacgagttttctggtcgtttgccgcaaggctgtaaggaatgcatgacggcagagttcgggcagaggtgcgcttgtctcgttctagctggattaattcagcaacggaaagggcatttgacccgcgtcttcacttttagtttacctgggatactttcagagtcttttttccgtctccaaga

SEQ ID NO: 1619 - DNA, 1439 bp, Toxoplasma gondii
cgcaatcgattgccttcgccttccatcgtgagactcgaaacatgtttcacctcctcctcccccagcagcatctccgatctccatagaagcgtcaacgctccctgctcatttgctcctctttctccgctctgttttgtatcatgaacgcttgggcgtcctcctgtttgccctcgtccccttcgactccgcatctgtttgttctccttcttttcttctctgtcttccctctgcccaggtcgtcgtggatggccgctgtcgatgcgccttctgcagcaaccacagcgacgtgagctttcgattttttcgccggaaattacagcagtctgacagaaaaactttaacgaagaggacgggggtcgctgaacataccttcgcagcaaagcaaggacaagcgggaacgcaagaaacgagcgctgacaaaacagagggaaggaaagtccggacgcatgcagcggagaccgagggacggcaaggagagcgttcaagcccaggtcttccagctgtcgaaccgagtcgatgaacaggcggattctctgacaaagcgcggtattgtatctcgcaaacgacgttgcattcgagttcctaagttttcaagcagtcgagagccgcagcgacagaaaaaaaaggcggaggagacagggagaacgactggaagagatcgatagagaaagaagtgacaagcgtgaagagatgcgcatgcaattgacgaagaacaaatcaccacaggggacggagacaggacggaaaacagagccagcagaagggcgcgcgcgcgttggcgaaaggaagacaccgcagactgctgaaaggagacaagtgaaaagcagagagacattgcacttgctctactgcggcgggagagcagaaaaggagaagaacaaagacaggaagaagcggaaaagaagaaaaaaagtgaaaaataaagcaacggtgtcttcatgtggcggctgctttgcccttgcatgcgttccaggcctgtcgtctcggcgcggctcttgtctctgcatgcagttggtttttgcatgcgtgagaaaaacgagcctgcttgaaaacttttgcagaaaacttccacacttcctcatttcctgatcgcttcctggccaatgccgtctcttttttccttggatcttccttctcgtcctggccttttctctgtttgcaactccaaccgatatacacctcgtttcttcgtctttcctgcctactttctttctcggttgcttcgctgccttcgccctcctcgtttccttcactcgttcttaacttcctcctttctgcttcgtccttttcttctgcttcctctctctcctctctgtctattcctccccttgctcccttctccagcgttaccttctgctccgcgtcattccttgctctcctcgttttttccttccctctcctctttttttccttccctctccttctcctttctttctcta

SEQ ID NO: 1620 - DNA, 1523 bp, Toxoplasma gondii
agaagaagaaacaagaaactggagaaaagagggaaggagcagcgaagagagaaagaaaaggaagagagcaagagataggatgagaggaatatgaaaacagcactaggagtgaaaggagtaagatcagaaggacaagagaaggaataaggaacgtgagaatgaaacggcgacaggtggacgtagagcagaccacaaccgtgagagaccggttctcttctgcagtctctgaacaaagatcgacacttggagatctcctctcacttcacttacacaaagaagagaatatagagaaaccgcgacgacgtatgccatgtttggactgctccaccctttttcttcttcttgttctgcttcttctcgtcttggttttcctcgttgtcgtccgtctccttctcgttcgcttcttccgctctgtccaccgcctgcattggaagttgattcaccttgctctccatttcttctaattcctgatcaactgccgccatctcttccagagggaacaggtttcgccgcgaaggctgagacgcgctgttggcttcctcacaacggagactctttcagagagatctctcaacaagcgcgtctgtcgaactcgacgcgaccgaggcagcagagagaagatccactttccttcgacaggcctctggactcaagagaaattcgagctcgatgagagtcactctctgcttctccatgacttttttcttctctcctttctttctggtcctctccgtcatacttcgtctctcccgttctctcggcttcttctctcgtcacatcgccctgctgtctcctccgggagactccgcgcctgctggctccttctgttgagttttctctcaactcccagccacggagacacaaacaccgagaaagatggcaccggaagcgaacgcttcagctgcaaaagacggaaagaaaaatgcctcgccggtgtctcgcggaggttcttgattccagcgcaaacgcgcgcatgcagtgtcggtttcccgacgacccaggaagtgagagacgctgcacgcgagcggtttctctaccttttcaaattccgactctcctatttgaaagtggagaaaatctctttctcgcagacttttctcttcctcgttcatgctcgcgttcatctcctccttccaacggcttcgggaggttctgcctcagcgtcaacggagacatagaagagaacttcgtcgtcgctccagaccacggcgccgaaaggcagaaacagaagaaaatgcagcgcgttgagtggagacgaaggctttccccctctggcggtgcttctcaggtgtatgtactcctcaacgagctgtctcggtcgcagcttttcgaacgggtgcccgcagatgccttgtcgggtttccgtcccctttgaaaggctttgtttttcggatgcggtttctccactccatctcacagaggcggacgaccttttctcggtctgatctacactccctttcctcaaagacacccaggaagggagaaacagactcttttttctccgtcctcgcctttgccaacga

SEQ ID NO: 1621 - DNA, 2423 bp, Toxoplasma gondii
cattgacgagcgaaaccgaaactccatgctacccattatcaagcaaggttcttgggtttatataaacaaccttttgctgaagactagatggtgaaacacgcagaacggtgcaaggctatcggcatcggcagctcaacaggaaacccccgttctttggttgaagaccggaacgctcccagagaacacaacaagagcgaaactgttagacaggcacgaaaacaccagcatcgtcaagccgggtcgaagtcccattacggtgcatatgcacatacgtgtacacacatatatacatgaatagctttgcgtggggttgcacatgcacgcgcagttgcacacagttaagtcgcgacgcgaaactctaaaaacagacagaacacaaagaatgcgaatgcactgaccatggtagatctcgtatttctcctcaagttgactgatgtcgacgggaagtcgccgatcagatgcgcaccacatggacttacccggagaggccctcctcttctgccggtgcgcgagggtgagctggaagcacccggcgagaagggttcatcacgtagagcgttcaagcgagaacttgaagaattgcttctaggcgcgacatggaaagaagctagcggaaaactctggctttgactggcctccacccgggtcacctgtttgaggtccgagcccccgtgttgctcaactgcgacattttgtaaatggtgtagagtagaaaaagagcaagagtttctcttcgacaaaactccgacggcgtgcacgggagggcacggggcagtcccggtgctggcgcaggaaagccccccggctgttcttccacgcgagaactgcacagactccactcgtggcatcttcgcgactgaaggcgctacgaagccgaggcgtctgcagctcacggcctccgactggattcctccatgaagagagaaggggacagtggatgcagactgagaccggcacaagggtgccgagttgagcaagcgggtacgcgagagagaagacagcatgctaggaagctcaagcacctgggtcctcgaagtcgcaggcccgccgctaagggcaaagcagctgtcgggacacaaggaagagatccacaggaaacacacaaggagggtggaaagaagaaacagcacgggacgcgggcggcttggtgagagggagcaagaggaaagaagacaaactgatccggaaggatgtcgctcggaagttcgcagtgacttccatgtctcctcagccctctcaccaaggcctccacgcgctcgcgactgtgcagccatagagacaaggggcagaaaggaacctagaaaggaccagaagcgggtctggggaaggcacacgaggccccggaaaagagaggaacgagcaacaaatgaaagagacaaggtacgcagaactccactggatagggaaaataatggagagagcatgggggacaatggggtcgtcgttccttttgtcgcgtgtaggttcggagagacaaccggcgcaaagtgcaaagagacaagcgggtgtttactgccttcactcgtcgaaacaactttcctccacatatcctcctgcgacgaagaaaaagacccttgttcaatcatgcaaaatatatcggacgtctgtacacggcgcactgaaagccgccctctcaccgggggtcgattcgcgacgtctccattgctgggattggggtcagacgacgaagaaaagaactcgagagcaaacaaaagagacggcgaaacaggaatcggaagtgcttgagtcacacacacacaccaaactgggcgcgcgtttttgtcacagtttcgtgaaggaagaagccggatgtggaatagcagtcaacttctgagggctgcagcaaaaggagacgggaatgatgtcggagcgaaaacacaggcggacagactcggtagccgcgacacagcggagaatgcaactctcagaagaaggaaacgctgcgagttggtgttttactctgtgtattcactgatcacctgaggagaggaactcagtaaaaactagtgggcgggtgcgtagcaaccagaaagcttcctctgcgaccgtctgatcatgtgacacgccgcgggtaccaacggaaccccacgttttgtctttcacacacaaccgtgtaatcgtagtggcgttcccagtcaagaatcactctaaaaacaaagatgcagtacagaacccaggactgtatttcatgctcctcgaaagaattttgacgttgtcaacgactctcttgattggccaacagttcgggacacaaagtgcggtggagcatccccattggaaacacatgtagacatggctgcttcgcgacagaatcgccacggaagggaagtttcgtaatatggatacacactaaagagtccgtggcgggtgctgtttcttttggaactagtttgtgacgcgatgccgaccgaaacgaggttcaa

SEQ ID NO: 1622 - DNA, 3681 bp, Toxoplasma gondii
tcagacctcatctgaaatcaaagggaagataaagtatttatgtcattggaacgcacatgtgtgaagactatcacagggtctcgtattgcctgttcgcataaagtgttctctaaactgtcctgtgagattggttgaccttatcgcaggagctaacaagtgacagggtagccaacacgaaaagtagaacaacgaatgtcgcaacgccttagccggtcgccgccataacgaaacaatgacatgcggttacgcatctcacctgccccttttccaccttcctctcagcttcttcgatgagctgcttgacgatctggatcgacagctcttcatatccgtagcgtctcgttttccttgcttccatgtatctcgctctcagttcttcgctgtgcgtcttcttgcatgggcccaaagaaaatcgctgaaaaaatccgaatatgcagaccagaggaacacgtttatgaagacggtgtgacagaacatggaattaccgaagtcaaccggcaactgcatcagtggctcggtcacgactctaccttgtgacagtcagttacttacgtagcccttgatgtagagaccagattcctgaacaaaaagaggacgcaacccccagcaagagtctcattgatcgttgaacgacctgaaaaaattaacactaccgagcacatgcgtaaaattaagaggaatgcttcgcgattaacacgacatgtgtgccctcgacggcagtggagtagaattcggtatggcagctgatgttggttgacttgactgatttcttacgcattgtgacacccataaacgcccggcatgcgcaagtaacccatatagtatttcgctgtcatcagcaccacttcgcagggtgaaaacgtccgcaataaagcgaagtggtaaacataccgtattctcaaacagatcatgagggcagagaccggtcaagaagtacttgcatacttccggatccgtgaaatcagtcggttgggccttgatgctttccatcaaggccgcgagttgtgcccgcatctcctccatggctgccaaaaataacaccgggaaacgtcaccaacgtctccttttcctatgaaagaacaaagcgtaaatcgagtgactaagcggtgacggtacaagctggtggtgtcaccccaacaagatggggaagaggcatatgagacacactgaaccacagaagacgaaccagcagagcaggcaaaaataaagaatcgtgcggcgatggtattccccaaacgaagtaacactgccgccaataacgagtcatcccccgttatagctatgcgcaggaataatggcaaatggcatatagattcttcagtgcaaactaattcggctgccggactcttgtctcatcgacaccagtacatgcgcatgcctccgaaggtgaataatgcggcggagagatacagcgaaaacattcagtacgagtcttggtcgtacagtgctacttgttcgtaatttccgaaagttttcacgagaaaaacaaactatggttccctatgatattacccagccccatctccgagcgcgctgtgctgtaggcgaaatgctggctgcagccctattccgtgcagctttgccggtaccccagtaccacggctccctcgtgctaacactgaagccacgtagccgtaggattttgcttagtaaaaattcatcgaattccgggttacatcctggcgaacacagtagcgagacaaagaaccgacataaaggaacatctccagatattcagtgatatccccgcgagttataaataaattcagtgacgacggggtatacaaggtgcagcctttgtgtcgtgtccacggctatctccgcaacaaagcaggcgaggaggagccttgtataatccaaagctacgttcataattcttatccttattcccctgccacacaaggaaaccacattcatgcccgcccaccccgctctatccctcgcacagggaagtgccaagtgcctgagaagcgtgcgatgcttatttgacgagctcatttacaagtgataccagcgctaattgatccaatggacagctcccttcactctttggaaacagtgtattagtcgaatgaggtctagatctcgcgtctacgctaaccatgcgtacaggtcgtctgcattaatctgggttatcgtgggggaaatgtggagtcaacgttaaccggcgtggatgatggcgtactctaaaacgctcgctgtggcagatcttgacgcctggaggtagtttcgtgtgcttcggtgttcaccgtaggccattctgttagcgcagctctccgcacgctcgaatcaactatcactgctagttcggaccgaagcactggtaacccacgtgttctgctgctcttgtaggccaaataccgcatgcacgcggaccatctgttagctgcatccacacaacccttgctttgttaaccaacaggatgatgtggccaagaaaattcgaactaggatttaccttctttggtagttactctgtaagaaacggttcgctcggtggcgtctacggatgtcgcggattgctgacggcctgaccagcaacgcggctaagtatattaatgctacggactcactagcctgtgggtcacactcaacacactcgccatggttaaaagctctacggcgcccggtagagtcctgaggaaagctgcaatgcgatgccagcgccagagacgcgattcgagcagccagcaagtgccaacggcatcaggcaccgccgaacagaaaactggccgtggtcaccatccttttagcggcaaccattgagacgcctacactaaggttggtcactgacagggccacgctagactcaaattgtcaacagaacatttctgtacgatgctctcgcggcgaggggaactttttgtgccagcgcgagatgtttaggctcgccaatgggctatgtaattagggtttagggcgctgtcgtcatccggctccagaatgtgtgcgcacgtggtcgtcgcctgacctgcaaagtgtgtagagtgtctggaagtattgaggggagctgcctttgcggggaagtatggtttttggagtcctatgggatgccggctggacatttttatgatctaccgtatactttctcggctgtctggttaattctggcggcaggccgcgtggttagctatgatgtaaagggcggtaccgtactggttccgttgagacgctacactgccattgagaccgactcaggcaagaggccctcaaaagtaagttccacgcaccagagatgttctcggcatgagcatgacaacaagaacatgccacacgtgacagtctgttgttttcgatacgtacctatatacggctagctcgtaggcgtcctgtgtgtcttcagcccgcacgctacatgagtgaagggatgcacatcctcttgtctctttacaaatgaaaacggacaaaattttagcggactgcaggtggcgtttgtcttccgtgttcttgtgctcaaacagttcagaaacgaatcgcggatgcgaggtgcatccatccaaccgttttgccagttggaggtgtgatgccgaccggccacagcttcagttctttacgtacgtgctggctctcctgggaggcggatctggcaattaacagaatactgagaggagttccggtcagactggagtgacgagcgtcgcaaacgccgattgttgcagctccaacaatcttcgtgcacta

SEQ ID NO: 1623 - DNA, 1861 bp, Toxoplasma gondii
ttaaatttcgacatcttacgcctcctgttcggcctcttcctcgtcgcaaaaacctttcttcctccctggcctttttgcctacgtcggctcctccctatcctctgcttctcccttctccaccctcccccctgcctcgcactcgcgttctctctctctttgccagtctcgcgcgttttctctctctttgccagtctcgcgcgttttctctctctttgccagtctcgcgcgttctctctctctttgccagtctcgtgcgttctctctctctttgccagtctcgcgcgttttctcctggcgcctggcctgtctctgcctctgtcgtcgctcaccgttgtacagagaatagttgaagaggccaatgccaccggccgccgtggcgagggcagcggcgccgaggccgccgagccttttgaggacgttggggtcgacgttcattgcggtttctcgcgcgttctgcgcagcggcgactcggccggagaagcgacagctacgtcgtggacgggaccagacggaggggagaggccgagaagcagccgagcctgaggacgcggaggaggcggaggcggaggaggagagacgtaccaacagcggtggaggctggagtctctgcttctccggccgtcgaaggagaaagagagtttggaggggaggaaagaaggatcggcgaacgcagtcgcagagagagaagaagtctgtctccggaagcgtaaaggcgtccagggcgggaaacgttcgaaaagagagcttgcgtccagagagaaagagggatgctggccctcgagagcaagacgcggaagactggcgtggaagaaggcgtcgggttggcagactggcttctgcctcctcaggaaagaggacagcgccaaggaggagacttttcgggggaaaacggggagcttttgcagagaaaagaagaaagagaagacagggagaggcgaagcgccttttcgcgtagtgctttgctcggtcaaggccgccgcaagcctggcgggagacgcaaagaggccgtcggagcgggggctgagatacagtcgcggagaggcagggaagaagagagaaaacgaggcgtttcacagagagaaaagaggacgagaagaaggtcgcttcccacacaactgtgttcaccgcgtcaccctgcgacaagcgtcgcggcgaactgcgcgagacaggcgctcaaagtgcatgcaacggaagctgctaataaagtgaactcctcctctctcttgcttggcctgtttccgtggggtacgttttcagcagacaagctcagatggcatcgagagggccccgcgccgcggactcgacgatgcggtcaagttcccccgcagcttttttcgttttttttcgttttttttcgtttttttttcgattctgcgcgtttcttgcgacagaacaactccccgccgaggtgtgtatgtgtgtatgttcgcttcgccgagcgcgtgatgcctcgcgtttcttgagccgagagaggcacgagacttcctcctgctgtgcacccgcgcgcgggcgttttgacgctgaaactctctcctcccgcaggtctgcgtctctcggctgcttttctcatcgagcgtcgacgaaccgtgagctgcgtcttcgctcatttctcccccgtcctcactttccgccgttcccttcagagaagatccacctccgtgaggtcgggactcttcaatcgctttcttacagctgggcgcccgcgaaactctgcctcctcctctcgaccgagaccgcgcgacttcacactcgagcagcgcgcctgcgtcgtttttgcctcgtggctgtttggcttgtgggtgtctttccagttcccctttttatatttcttcttccgttgcacttccccagcgaaacaaaa

SEQ ID NO: 1624 - DNA, 2383 bp, Toxoplasma gondii
gagagagcagcagtacgtcttccggattgcagctcgcgccgtaacatgcaggaccacagcggcctcctgctccacacggtcaaagaagagacgcgactcaggcgccccgctctcagcagctcccccggagagcgggcgactgtgacggcggcgcctctccgtcacaagggagaggaaacgcgaacgcgtggaagccagaagacgagggaaagggaaacttcgactgcagtgcatgcatgcttctttcctccccttggaaagaccggtcctcgaaagcctgtcgcgcggttgacgctgtcgcgagccgtcctcgagaatccgaacactctgatccttctcttcctctccccgctccttcctccgattccatatcatccctcaagcctcccagcgccagtgtgaccgccctctccctgtctctctctctctcgaggccggcctcccctcctccctctcctgcgaagtcgctccttcgctctcttgtccaggcgcgcgccgcggccttctgcgtctgcagcgccgtgtctctggaccggcttctctctctcacctttttctgggggagagggaagcagttggtgacttcgagtctgtctctgcagtcgattccgaggagttgtccgttcacgggtgtcggatagttctccttgcagtgcttgaggaccttcatgaggacgaggctgtcgacttcgacaacgcgcagcggatacgaagccttcgcgcggcgggcgcctgcggagacgcctgcgaggacctgcgcggcggttcgccgttggtgggggctcacaccctggggggagacttcgtctggagagactcctggctgcgaggagactggcgaagccgagagcgcaggacctgcggcgccgtagggtgaggccggaccgggagccgaggcggaggcgcccggaggcgcctgggtcgcctgcgcagcgccgcgcatgctcggcgggatgtactttcccccggagttcattttgcagagaaagaaggcaggtagttttgcctgtggtttagagaacaggagaacggctgtgaggccggaaaaggggagaggcgaaagcgagtgtaaaccgtgaggagacagcacaaggaggagggtgcagagaaagcgcgcgcgagagctggagacggaggaggggaggggaaacgcgggagagagaaggactggagagacaccggaggcgcgagacagaacggaccgaaagagagaaaaccgacgagaaaaagaaaaagagaagcaccccgcagagcacacgcagctgctggacgagtagcaggcggcaagagacccggttttgacacgggagagagcgagaaggaggaggcgcgaagcagcgagaacaaggagagagaagacagccagacgagaaagagaaagaagacctatgtgagccaaaaccgacgaaaaacatttgggcgctccccgtgtctcttcgtcgctctcgaccatcacgcaaagaagagtgggggtcttctcgagcctcggcgcctttgcgcctttctctctggacttctctccactttcaccctctctcttcgcggcttatattccgttccacccgccccgactgcatgcggcgggcgagctggcggccgcgcgggtgccacagcactcgtcgagactcggcacaatccttgaacttctctcggagaagagtcgcagaggcgagaggaaaaacagcaaagcgccaaatgaacagacagagctttgactgtacacaaaacgcgagggatgtatggataaccgacccagtcgctggtctggacagctctgccgtgtctagccgttgcgcgaccgagtgtgtagactcgttcttgtccagcgaacgaagtcagcggcgagctttgcatcttcctcctcttgttctctctggttcattttttattgtgtagaaacgcgctctttcctccttcctcgttgttccgctccggtggctctttcgagagcgactctttcaaaccgcttcacgacaccccgttgagactctgcgcctcaacgctgttcttttgagtcgcttttccgcctctttatttctcccaaactcttccttgctttgtgaaagcgcggcgcccaagttgtctctcttttcgtcctgtcggtcagaaggcgtcctcccggtcttgcttcttccgccctcaggtctgtcgagttgagcttgagggcgtctgagctggcagccacggctaaagggagtctcttctctcgttcctttcctgtctcctccctctcctccctctgctcctctgctctccgtcgttgctcggctgtctgcccgccatacatgcgagttcgcaggtttgctggcatttgcaactctgggagctctgccggagcttgcatgcgatgcgcgtctccgcaaggcttcgctgctcgccgaga

SEQ ID NO: 1625 - DNA, 3899 bp, Toxoplasma gondii
gtcgtctcacgatcgctgcgctctcttgaccaaattcaatcaaaactaactcgtcctgctctccatggcaatgcaacacaggtgtcggcccctccactctcttctccttttcttctttcttctcctctttcttctcttcttccttctcctcctcggtcttctcttcctctctcgtctgcagcgcctctttgcggctctgcgtgtctcgcttcccgaggcagcctgcgctgactctgagttcctgcgcgagaggcgtccaggtggagagtgcgacgatgccgcctaggcggaccgaggcttgcaagccggtgaagtaggcgagggcgccgccttgactgaatcctgcgaggataattcgctcgggagcgacgccggctgcgagctcgccggcgagaatggcgtcgatgcgctgcttggaggcgaggaagcctggcttgtcttcgggagcgtctttcgacagcgagaagatgtctgtccacgcgggcgccggaaagccgccgttcagtgtgacagggcgcacaggcgccgtcgggaggatcacccgaagcgcaggaaaacatgagagcgaagaaagcagcgaaacgaggtcggcccaccccgcggccgtatcgcccagaccgtgcatgaagacgagagacgccgtctgcggtgtacagacacccgggaagcggtggaagccttcgccgccgtagccgtcgcctggctggagagacgccattttgcgcagcgccggagggagagaagcacaggacgtcgagctggagtgtcgactggagccagcttccgagggaagcaggggacgagagacgaaggaaaccgcagaaggcggaagagaagaagagagggaagaacgagcgagaggagaagagagagaagaagagataggagaagagagagaagaagggagagagagacgagtagatgagggggggtaggcgttggagagaggagggaaggtaggaagagaacggggagaggtaggagtttgcgagagaaaggcgcgaagttgagaacgagaaactttcaaggacaagggcggcatgtgtgaatttccctccaggacggggcggcagcgagaagacacacccgagacgggcaagggcaggagaagacagagaagcagcagcaagcgcgagaggctgagccgcgtcttgtgcggtgcacagcagccagcgcaaatctctctgcgtttttcagaggaaagcctttctagggaaagagtggagccattctctcgacgccttgcacaggaagaagagatgaaattcgtcgaacgcccgagagaagacgcgagacaccgcggaggtcgaggcagcatgggtgcacacacctcactcggaagaggactcctgcgccaacgaggtaaaagtgcagcgagaaaagaaaagcgggagacgaaaagaaggaaaagaaaaggtgccggaaagcggcagcgcagagcagcaggagacgcaaaggggaatagcggcgccccactgctctcggagactcaaaccgtgacgcgttcactctcgggggggaggaggatttccacagcaactgcatgcgagcgcaaaaaagacttgtaaaaagaggaaaaacaaataaaaaggcacagacgatagagaaagccgggagaaataaaagagaaagctgacgaaggcgaaaaagggataaaagaaggacaaaaagaaggactcaagcagctgtgttttcgagtcgcgccagcaggagagaccaagaaggacaagaaaggtgtgtggctgtaaacgcttctcgatgtcgctgcagactgcctctgtggactcttagggaagaaaggaatttctttaatccggcaaaacgagaaaactgcggtcacggcttcgacagcagtcacacttccccgtccacccagtggagggaggtgaagagatgttctcccgaaaactccacagtttgaaaacgctctgaagcgtctctccagtatacagtcttcagcacttcgacactcatcacttatgtatatgtatacatgtgatatatatatatatatatttatatatatttatatatatatatatatttatatgcatatatgcatatttatgcatttatatgaatgaatataatgcatctcagtcgttttacatgcgcagatgcagagagcctctctgtaagcgagatcatgtattaaatctgcttctatctgcgataaaaatctactgtgtttgcatcttcacacatacacgttggtattctatccaaatattcatgtatccatactcctataaatatttaggtctactatatgtctgtgtgtgtgtgtcgtttccaacgggtgtttcgtcgttccaccggataaacgggggccaacatccgttcttgataaatacgttttctctgggtgtgcaaacgtgacagacacacacacacagagttcaatctatctccctagccagaacgttttcgtaaaattctttttcgctgagtcctatcagcctatctgctctaccagtccacttcttcttctgtggaaactcgtctcttgcgggatccacgattttctattcgggcttctctctcagtccctcactgcacacacatttatgcttgtatttacccaacgagtaaggaagatggctattcatactgacgccgtgtttaccagattcccatctagacataatatggacctctatatggagagagagcgagaaggactgatagatacacagtatatctatacatatacacatacaaatatatatatatatatatatatttacacgcatatatatatatatatgcatatatatatgtaaatggatagaggaaaaaagagagacgtcggatatgcatcgagagatctttgtaaattcatatttcgcgacgacggagtacgtatgtaggtaaccagcagtaaaggaagacttgttctttcctaaaagctgtatcagaaatgtgtaaaagtggagtttggaggtatctttcaagactttgaagatgtgtgggtctcgtaacaaaagcactgcggctgggccctgagcaaacagaacgtctgaaagcgcacactgttttcacagaagaatggcattggtgtctggactctcaaacggagaaaattctctgatgtagatacttgcatgcgtctgttttttccgggatcgtctttttctgcgcaactgtcaaagttaaggaaaacatcgacaaacaaaagcaggtagacccatgttgagttcgaaggatctctcttctctgctctgtgtctccgcctcccgtctgcctctctcttattcgccttctttgtcgctcttccacccgctttctgtctctctctttctctctcgagtccccgttgccctctcgcttctctttttccgaatgtccactctctgtgtttatgtgtgtgtgaaaactcgcgagtctcctcgaaatgccgactcacctgggaaggcgagaaaaatgtgtacgcataaagcgcagcatgcaccaaaaaaagacggcgccgccgttgagtcctgcagacaaatctttgcgttttctgccaaggcgtggaaacgcctttcgtcttcctttctttttgctcttctttttcctggaagccttcccctgctttctcttccctctcgaccgccttcgggcggctgaccagacggacctcgggccgcttcgatattggtcctcgtttgtcttctttttccctcgcttctttgctcagtttttggtccacgttttcgcttgctttgcggtctcttttcttgcattctccgctccttctctctcgtctttcaaggggaaacaaggtcggcaggaagacgcgtcttgggcgtaggtgcctgcctgtctatacagcgcagccgagcacccttttctttccgctcttttcttccaacctttttgtgtcagctggtctccctcgtcccctgaatttcgagaca

SEQ ID NO: 1626 - DNA, 4719 bp, Toxoplasma gondii
tttgacgtggtttcctacccaacctctgcctcttatcagacacaacggtttaggaaaccaagcggactgtgggccactgctgtctctgtgacgccgtcttagcaaggtccgtgaactgcccagtgaacagggacgtccctttagagcgtagacatgcgtctcctggtgcgacaggaaaacagtccagttccccagacgattttgtttcattcgtggattggcccatctgaactcaggtttcccagaacgtactcaaacgtcaagagactcgcgtgctcggggcgcccgtcgtcctgcctcagctggaggaaggaaattgctctgaccgggacgttgaaaatcttggccagcagctcgcgtgtatcttcgaaaagttgctcggtgtagtggaaatgctgcagtggaaccgcaccacacctgacacaccgatctgcatgcaactgcgccgtggggacggtccgttcgtcgacgctgtaggattcacgctgtacaagcaagcagatacgaagccagacttggctgtttcgagcacttaccattaccatctctctcagaggcaagtccccgaatcggagggagagggccttctgagaagggaacgaggtgaatcggacggaagcttcgacagctgggagaagaaacccgctcaactgtccatctccgtttcctatcaagtgtgatgtggagtgaaggcccaccaacatcacgcatgcaaccaaggcgcatgcatacaggggtaaattccttctgtgtacccgccggcgcagagaagtcgaggcggggactgcgaactgaggtgtcgccttcgccataggcgacatccgcgaacagtggacagcggaagacccgcatgtgcggtgcgagaaactcgaaggaagggaagaatcagataagacagagacgcaggaagacgcggacacggcgccagcgcttggcttcgacacggcggtggaactgcctcgttgtgctgtcaagcgcaaagccggggagaagcggcaccgacaacttcgtcctcccgtggtgccggagccggaagagccggtgtatgcacaagtagacttcattgtggtagctgtcgtgacgcgggaaagcagtggtgcgtgactcgagacagcgcgcgagtcctttattgaaatcaacccaggggactgccctgaaagcaactgaaacatggtgcgcttaccgacgaggcgcacaaccttcgcaaaggccgggtcacgctgaaaaggaatgcatccagagaatcactgtagatctgacggttttctaatctaactgccgggtaaaccaacttgcactgccccggaaacaaaaacgtcggagggaaaaaacgctggggaacaaatcggacatagaagttgccggacgaatgacaggccgaaccgtttaaatcgggcagctatccttggacgtttccgaacgaaaacggaaatcgcgcgcaagtcgtagcaggagcgtggtcggctactgctcattcgatgaaaacaaatggatcgaacgaaaaaggatgccctgtcgtaggttcaaattccaactaaatggccttgtctgtcgggaagccgccaggctcgccagtatgtcacagtttcgaaacaagggcgaggtgtggcgaatggcaagggctctgacgaacgcggacatccacccgaaaggaaacgcttcgtaaggcgtacgggaaaaggatgaaaccgtagatgaacgtgactgggccgtatctacggttctgcctgaccatgggtcgtccgggttcgtaccaagtcgcgtattctacagaataccccgcctttcttcactgttccaaacacttaacacactgagatgaagtcgatgaatccagccacctagaaactggggattcgccgtgatgtttggcatttaggcactccgacgtcagtttgcagggcgtcctcgttcccctttgtagagttgtcgcttccttccgttcgcactcgctggcgacgcagtttcgcggaacgggtgcgctgctggcagccgagctgagaaacgggccgagaatgagtgaacgatacggaccagtgaggacaaagaaatacagcgagaggaatgccttaaacgcgggaaaagcgattaactagggaactcgcgacatggttcttcccgtccgcgtatatttgtgtatcgagcaggaggaccgctccattttcccgactctattcctcaactcgattctttggtggagcctgctggcacaaaaaagcagcggtttccagtgaggaatgtcttttcaagagtcgctttgtgccacgtattcactgatggcctcggcattacaggaaagtttgcttggcgagggcaagctgccggagacgcccttctggcaagaggcggaccggtgccgaggagacgtgcaggcgcaaatccgtccttcgctgtccgcagattcatcgcgtagactggcgatcttcacgagccctgtcttttttacgcattcgcactgttcctgagcatcggttcacgcgcgtcgaacctctacgtcccttgatgaacgtgcatgtggcccagagtttctagcaacccccccctccgacgcactctcttctctgctgccctccctctctttcgtcatttgcgcactctgcctgcccgctgctcgaaggtgagccgtcgggttccgggttctttcgagtggccgagaaagcggagaaaatccggcggttaaaggttgccttcctctaagtggtgtttctactattgccggcgttgcgatcaaatgctcctctttccctgagctctagcgcaagcagattcccttctctcttttttccacgcaggggggttctcgctactagagacccgtggccggaggggctcgagagcactggccactcagaacgcccgcgcaccggggagagacccgaagggaggccggcttttctcccctcgttgtccgacatggtgcaggagcaaaaagacagcgggagatcctccggggtggggctgctcttcgtccgggcacccggcgtctcttggcacacagcgctcttttgctacagaaaaagagaaccgagggtaaagagccgcgcctagggaaagcacagaccagcgtgtgcgcggcgttacaagaagctaatccctctgtgacctgagttttcgaggtccagctgggtttcttaagaaagctaaagccagtaatttttttgccgtggacgaactccaggtaggcgacgcgcaggcgcgagcgcccaacacccgctcgcgccccggagcgatgacccatcacttggccgcgacgaaaagggttgacccttaggaccgtctctctctttttccggttcctgtgcatacgtcggtcttcgttcacgtcatctgtggccgccagtcgcgtgtgcgacgtcttgggggcgaccaggagaaagccaagtaatccgtccagtgtcctgccctgtggtatctctgggtgcaactgtcgaacgtattccctgtgcatgagctatttttttctcgcaagctgtacgcctgtattcggacctgtccacgatcgtcttgcgcagcgtttaaacaaatatctcttcttttccggattcagccgcccgcgagcccgaagcgaaagatcccggacgcatttgcgcctggcggcgaagcttctcgggcgatttcccccttgtcctgctctttcgccacggtattctccactgttgtctgcactgccttcccaatcgttttctccacgcgttcggcagggggcaagctgagacttccagcttcattgaaagtctgcacccgtaccgagccagtcgccgacgacacagagcgccgacgcctgctcctgcacttgcattgccccgcagttctcgaaagagaagcgcagcttcgtcgttcaggcacgctccggttaccgtttcctgcgaacttccagaagaggggaaagcagattctgcttctcgcagccgaagggtgttcatacggtgggtgtgcagttccacaagccgacaagtgctacgctcttcgcttcgatccttcccctacgtgcctggcagttttttcttcttcatcgctcttcatgtttgttttccacgtccagtccctgctttcgcataacgttttcttgctgcctgtctcagccagccggcgtgttgcccccgttttcaacttgtgccagcggtgcaccaccatcggcgcgttttcttcgttctcttccgcgccttcaccgtcacgcgtttcatttcacaaccacagcaacgcccgcttgctatgtcacctgcgctggaaacgagaatgttccggacacggttcgttcttccgtgtgtcaggcaagcatttacagcccttcaggaggagttccggtacacaccacggctcgctaagaagaaagccgtggcaacggagcgaccgacccgtcttctcgaaaacctgagcgctattctttcgttaaccccttccagtctgtcgaccaacgcccagaatacacatctgtaggagtctgcaaactgacttgcctttacctatcccgtcggctcccctagttcgaagagggtgagaaaggtacatggttaccccgtggtgccggtcgaactgttgtctgcacacatgctgcgttcctaagtcctcgtggaggttcttcgtcttcagcgggctgctcccaagaccttcacgctcacattttatccttcctttcttgtcccgctcccgaatttgcccaccctctttttctgttcctgcccgccccccccccctcccccgccagtggagaccgcaaaa

SEQ ID NO: 1627 - DNA, 4939 bp, Toxoplasma gondii
agcttcgtcgttgtcttttgtcgcggaaggccactctgactctgcgtaactgcgcagccgtcggctccgcggctgttcaagcagcaggcgcagtgacacgcgcacggcttctcactctgcgtcgctcccagcgaactcgtcggagtgccgtccggcgaagacccggacggagaggcgacggacgcggtgtctgcgtcgatctccgcatggcgcgccttgccgtctttcgcgtcttccgcgtccttcggccccgaagccggcgcggccacggacgccttcaccgagtagtagatgttgacaaaatctgagggacgcacacacacgcggcacgctcccccaggtgtacatacactcgagcggcaggtatatggttatatggtcaggtgcccggcgccagtcaagaggtccggaggagcggtgccgcaaaacacaagggggcaggaagcgcgacagagttctcctggaagaaagacacacagaggtttttccgcgagtgcactgctgcgttcaggctaacgtggacggacgaggaggagcggtcgccatgtgacgcgacccgtgcatcgccaagggaaggagctatgcgggctacaggcgaacaagggtgactctgcggtcacgcaccgacgattcgctgaaccgtaaggcggtaaatggtggcctctgtgcaaagtttttccacgggaggtgtgccggtgactccaggcggcgcagaaggggcaggttctccgttgtccgccgcgtgagcagggccgggactgctggatttcagcgcttctccgtcgaactgctccatctctgtgggggcagctgcagtaactctgggcggtggaggcgagttttccgcggcctctttcgcgtgggcaacgtcccccggcgccaggctacgggaaaacgcgtctcgcgcagtggctgggtactgacatccaccaggaaggcgtctgcgaagattccgtcgagcgcggcgaactgccctcagatgcctcgcaaagcggttgcacccggtggcattgcagcacacgaatggcgaaatgtcttcgacggttctgggtggcactctcgcggcatggcacgcgaaaaaggtgctttctgccttgtcgggaatcagggaaagagcggacgggtggactgcagacgtcaacagtcggagagcaagggaggaagacacgcgtgcgaggctcggcaggcgaagaagcgaaaagtgacttgcagggagcagacaggaggcgaatctgcgaagaggggaaaaacgcgaactgtgacttgagaggaacggacgcgaactgcgaaagcaaacgccgcgcgcgatctgcgcaaaccgttcgaggaccggagacctcgaagaaaggcggtagaaacgggcgtgcgttcgaaagcgcttcacatgcgggagcgtcgtttccggaaggcgaagttccaggaaacatgcacggccgaaaagcacgaaccccggcgtggacgcttttaaaaacccactgtatttcagaagtgtacagagaggcgtcgagtgtcacattgtgaaggccgaggagcggagtggacgcgctttttttcgcgcttcgtttcggaaatgcgcaaaaagaagggagcagagaagccagcgcagacacaaaagagaaacgtaaaacacctttcttccgttccatttcgctgcatgcatccattcaatcgccaacggaaaaacacaccgcccggacaccgcgaaaattcccagcgcccttgcatgattcggcacactcacaagcggtgacttcgcggtctcttcagatacatgcacgtcgttctcacgctcgaatggacgcatgtgtgcgagtcccctaatgtgtaaaagacgtgcgcgtttctgaaaggcgactgcctctaaaaaacttgtggtttgtgtttctgacacgaacacgcgacactaacgagaggctctgccggggccaccaagtagagaggaagatacgcagcgaggcgcttgttagcgcaactcagtgaactttagtccgtgctgccagcatgtaacgtgctcgtttgcgttgcgcctccacaggagcatttcaggaagggaaacgcctctagcagcgactgaaagacccagagaaaatgcttttcgcgtgtcttgcaacaaccacaacgctcttgtgagcaagagtcaagaggtcgtaaggacgcttcatctgttttcctcgcaactgaagagtgtgaacactcgtcgtgatcatccggatgagaaaccgtgacccgacgcacagccctctccatatatccacgctgaagcacaacggcaaatctcgttgtttctgaggaagcgagtggaaactgttcactagccgtttgcgtcgtgacgttggcaaatccgagtgccgaatatggcggcagagctgtcctagactcgtgaggcctcatgcggcgatccggtgtccgtgtcgtcttcctttgtgcacagtccaagaggtaaaaaaatctgggaagcccccgaccgtatatcatccgtgaatgggagcatgctgatgtgcacatacatatgctgatcttgaaacacacgcaaaacaacagagatggaatgctcgatgtcgaggcaagttggtgaacactggggctcagcgcagacgcaaaagcaacacagcagattattatctccaccgtctccccgtagtatatgcacctcgaattagcgcttatccagtaccctggggattcgtgacatgtgggatgccatgttgttctgttttcgctgacaggtgaaacaaaaaacccacccgcggatggaaaagaactggtttgctcgagagctgtatgcgttcctcgagactctgcagccaggtcgggcaaatgaaacacattttttgccctcgctctaaatagcgtctctgtagcttaaaaatgccttatctacagcgctgtgagactttttccaaccaaaccaccgggtgtgaggcccccaaccacgctgccacaccttgcttctccgtgtttaagttaactacgccagtttagttgcttaaacgaaaaaagaggtacggtattacggcaaagccaaaacttggaggtcgtacactagtccattaacccgattcaaaaaagcagcactcttcctgcatagagtgccgtgaaaaaccaccgcctactccctggaacgaggccacgcgatggctgtctttctgagtgtggcttttctcccttgccaccaatacgaaggattgacaggcctcagcagacagtcgtatcatgccgttctttcaggctgtcggctgtggttgcataaaccaggtttcctgatataatttatacgcgtatggaagcccaactatgaattgggaacaggacaggggtctactcgactctatttgatggcagatgttatcgaataacgaggatacctgcaggtccttccggcttaggcaatgtggatgtagggcttagagaacctgaatgaagcgatgaccaattcgcagaaaatccatcggattggaggcttgcaaggcaccagaaatctgtccagcacgcctggaccatagagcaaggaacttgatattctgttctggttccccgggagcgaagataatacgtaactccacttggggacggaagtaggacatggattactgctaggaaacacgataggcagcagacctccttctgacgtagctgtgtgcctggcattggagtgtctgcaacaccctctgtggttcgtatggtttttctgcacccttccacgaggagaactgagatacatagggacctagcagggtggcgcaaaccgttggtggtcgatcccgcgatgtttctggacagcgctaaaacaagctacgcgtgttgtcattcagggaggcaacaccgttctacctcggtgtcgagtttcggcgttccatgaaagtttttgtgaccgcctagcgttgaccacctgtttttgtgtgttcctcttgcggctctacttcggtcggccttgcgatcacggacagagctgaggacgggcgttgcaccggcaaagcggctcctcgcacagacaggcgcacttcctgtgacgggaccctgttgcacgtcgaggcaatgcgcgaaaaaaacagtgaggccgtcgggtgtctgcctttcccgcttgtcaaagaaggttcgagaccgtcggagctttgagtgtgggtgtatggggacacgccgaaaaacggaaggcggcgtagatgagcactcggcagaaatcagcgtccggtttttgcatgcgacccgcccccaccgacacaccacgtttagacggcgcatatcgcttacatcgttcgacatccggtaagcaggcgatggcgagagagaagcgggccacgagcagccttttgcccagtcacattctcaacgaatgcgttcagacaagaacaaaaacaactcccatccgtcttgcgcggtagacaaacagtggtcggctcgacataacatcggtgcactcggccgaaatttttctcgcgggcaacagacgaaacgcccacaggtgcgtgtttttttcggagagaaatagcgcgcgattcgggcagatgcctctgtcttctctcgtcaaaaccgtggcctttgcaggtgcgactgccgttctggtctgaaggcgggctacctagagtgtctgctgcctcgctggtgggaaacggactctattcacaccaagtgaccgtaggatgccatttgtgctggagggttccagggtaggacgtcccgacagatctgcgttgcctggtgcaggtgtttcctggtttgaggtcgtccgtactttttctcttgacgtttgcagtgtctctttgtcgtctggtggtgtctcacatccgtgcggcactctcgaggccgttgtgtgcgcatcccgtcagtctgtaattccatgtattgcctcaatctacggtacgtctttcgattcttctgtgtttgctcagcggtgaatcgtagatcctccttctcaagttcaaccccttccttgtcaacaaaa

SEQ ID NO: 1628 - DNA, 4485 bp, Toxoplasma gondii
atgccggatttgatcttgccagcctctcctagttggagttatttgtatttaccaagtgggaggggagcccctgttgctagcgatatcattctgtactttactcgaaatctcttctgcaggttgacgagccaaggtggttttccgcttatgtgctgtggttgtagatatcagtggtttctcagagcatctgcttttgtaggcgattactaccatggtcgatgcatccgttgtgggatataactgtagaatttctacatcttccatgatatgcagtaaaccttgtcctgattctggtgactcagttttttacattgggaagaaaaagctagaggctgtactcgcaagccaatttgattagccagtcctgctgtacctccggacttgagccaggcgactccacatggtgggtaaaaagcaacagacaagtttgaagggaagacatccgcggtgggctcattgcttctcagagtcacgtcgtcgcatctgattcgcccagtagtcactccatgaacaagaagccgtcacaacaacgcacattcactctacttgtcgatttgtaacgccgtgtctgtcatggttcgcaccccgggcctcacttggcggcacacgagggacggcgaggttgtcactttctgctgaaaagaagcagttctactcggtcgatccacgtttatcagaacacgttgtcagcggatagtcgggaggcgaaataatcttcggatttctacagggttaccaacgctgttgcggcatgtgtctactgtatccctgtgtaaaggactattattattcagttgagaaggcacgttggtgtctcattacttttgttcctggatcttttgaggctccgcacaacaaagcaacagatctaccgtactaaagcgcgagcccttattgaatacaactgcggtactaggacactttggacaggaacgtcatgagaggctgcgtcaagggcaatgcattcttcgtgtgtgtagtttttggacagttgttacatcgttgcagaaccgcaggggagtttagggaaactgtgcgaatgtacaggcacgccgtgtatgactggataaccagtgttcccgtacgccacagacaaaagcagagacacagtgtagtgacacccgaaatattgagcgcgcaccgctccaataacggaggcaagcaccgggcgcaaggggaaatgcactggtctcgcgccgttgacaagccacaccggtcaacggtggtcgtctgtgttctacgtcatattcatatcggcattactgtagtggcatgatgcggctctccacagttttatcagttactttgtttcctcttctttgggcggtattgacttacgaatcatcttggtctgtagcttctcccacagcgccgggcgaactcgcaggttagcccccgagagactcggttgttcacgtcagttgcccgagatcacgtagcaactgaatatagaagccaaactcctccctcttattaagcggcacgacgtaccacacacccgcgtacttctggtgtctttgcaaaatcaccggaacacgcagtaagtgactgaaatctgctcagcgaccgtacatccgagcagcagtgccatctatctgagcatcagttccataataaatgctttttcaggtatttcggaaaaatctcagtcggcaacccgcctcaatcgttcaacgttgtgtttgatacgggtaaggctttctgtttttgccttcttgactggtgacaagatctatttgcaacgctcaggcagtcaccacttttggatcccttcaaacgagtgccaggcttcttcatgcagagctcattctcgctttgatggcagtcgctcgtcaagctttcgccaccacagcaacaatgggtggaacgaatgtgtcaccgtcaccttcggaaccgggcgcgtcgtttaccggaaggcgctagaggcaatcagaatcggagatgctgcgtatgtccgttcaattttggctcgttcattggtatctggcgatccgcgaattttcaggatccccagccaagcagttggtcttgtggttgatcagacagacgagccgtttgtagatttacgtaagagcgctaaatgtgtggtggatagtcgagctgacgctgtttactgatttattcagcgtttgatgggatcgttgggctcggtgagtactttgtcgtgtacactggcatgtgcttgtcacgtagttcctgcttagccggatcgtacgaacgcagcggacaaaaggatttgctcgataatctcaaaaccgagcgcgttatagcagacaagatcttcgccgtttacttgtccagacgccgcgttatgggtggtgtaattagttttggaggatttgatccaaggttggcacattcttctcgagtatcattcggtttatcaatccattcgtcacaaaacggcgttgtctcagatttgttcagcaagggaaaaacatccagtggtttgccacgcttcctcaagaaggctgggcaattccgctcatcgattttaaggtcgatggcgtcagactccacctttgtttcgattccgccgagagcagatgcgtagctgttttagatactggaacctctagcattggcggccccaaggccgacatccatcaggtgctcaccgcgctcggggcagccccaagctgcgaacgaagagtcgacatgaggcatttgacggttatactcgagcaaggaacacctgggcaggagatcgagttcgaactgacgcccgccgactatctagtcgaaaacctaaaaccatcagatgactacacttcatgccccgcggcgttcatgcctctagagttgaagcaacatcctgtccgcatcttcgtaagcagattaaacatttgaacactgccaatctcaaccggacgtaggactgggagtacagattcttggtgaggtattcatcagacggttttacacaatcttcgaccgcgagaatcagagaattggtgagcacaggagacgccataagcaggtgcttgtctggaggttatcattactactacttcacaggcattgttgaagccgctagtgacgcaaagcctagcaacttgaggagaaaccctcgagaacgctgggatggagttgtcaatgcagaccgcagcagttggttgtctccggattaaaagtacctggagctgacgacctgctttttaattggttgggaaacgggctttgttgtgttgtcaagcagagacttgctttttttactaaccctctgggtgtttggatagatcgtgctgttgacattatgatttcgtgcagtacatggacttatggtttatccttcggcaacacagtgtccgtgaaggcatgaaccccatgtgcaaagaactatgcatgggtttcagaagtgatattgactcctcccaattcctccgtggacgccagcgatacgctaccgtaggatttgtagctggatgtcgatgtttgccactgttttaacatttcgaaagtttttggaaagctgatagcattccagatgcgggcgacattctgaaccttctcggcgacggaagccaataacatctccagcgacaacgcaccatccgtgtgttcggttttgcaagctttggagcaggacaagttgaaagatatgctgttgctgagtgtgttgctcttgtctgagtggcattagcatagtcgaacgattccggcgttaatattctgataatagtgtgtatggcagatcggccttctactgcgatgagcaacgataggacaaccgctgtgatggattcgcttgcatggcattttgtccaactgttcaaactacccgtgtttaaaattaacgtacttctgatcacccttctgaaacaagcctctaacggaggcatactcattactgcctaacttgggagaaacattcctcgatcactgtgtgggcaccacgcggcgtacgccgtgagaagcaagaaatctggagtctggatttaccttcatctcttacggcatgaaatattgactggatacatacacttgcagaacctcgacgaggaaatgatgagtattttgaggcaccactgaagaaaaagtacagtcaggcagccatacgatgcgtttcaataagagaactactgtttcgacgattgtcaccagaaaattccgaaatttgctcgcgggtcaggcaaaggagacgggtatcccataggtatgagggcagcctctcggtagtggcgctggtgtcgtgtacctgctgaggaatgtatttcggcaacatgctcacacattcaagcgatggtactgcgcggctctcactcaccagttgacaacggcgacacacccgaatcataagcgcttcaacgatggttggcgtgtgcggcaaggttcactgtacagacactggtgtcgcccggcaatgccgcgccgcttgaagccactgctgtttcccatgggtagatgctcaccacaccttaacattctagaatctgaatttgtttgtcacaacatcgctactttagtaatcgcacatcgtaacga

SEQ ID NO: 1629 - DNA, 1881 bp, Toxoplasma gondii
tccaatgaacttctcgaatacctcctcgctgagggaagtgtacactgtcgcttggccctctccgtcctgcttgcccgacggcgaagagggagaacgagcaggagacacagcaggcgaggcacgagaaggagagacaggagagacaggcgagacaggagaaggagagacaggagagacagaaggcgcggaccgcccaggacctgtgggggctgcagtcgcggccgacggagaggcgccacccttgcgccagcgacgaaacatcgcgggaacgtcggacaagaagaaaaaagagaagaggaagaaagaagaggaaaagtgcaggtaagaggaagaggaggggggagagcggaaagagaagccctggaagagacagaagagccaaaggagagaagaggaaaagacgagaaaagaaagagcgttttgagggaagcaagcgaagggagagagagtaagaggaagccgagaaggagcagaagacagagactaggtagagatgaactcggggacgaagacactaaaatggtgaacagatgaggaaaagatgagatgcaccctgtcgcttccaaacgacagggaacgacagccagaagtccaccttctgctccttctttcgctcttatctgcgtcggcttatcttcggagcgtccctctcaaccagacacctggcgacctgagaagtgagtttcttggattcgtcctcggcatgtgcaggagggagagagaggcgcttctgtcgccagagccgactacctccagagacggccagtgttcttctctctccctccctctctgctcttcttctctgttctttgctctcctctcctctccctctgcccctctgtcattttctggccgcctcttcggtctgctcctctgcccaggttcgctgcttcgtaaggtagttcatgcgtgtgcctctgacgccttcgcggagaaggacggatgaagcagcgaggaagcaggagaaagaaagcaggctccgccttccttgctctcgcgttcgcagcggtgtacagactgcgcagaagacacgacagagtagacgagaacgaggagaggagacgtccgaaaccgtcagagggcagaagaagatgcatgcggcagaaagagacggagaacgaagaagggagaacgaggcaggagaagcgagacggagggtgacaacaagacaccggagaccgaacagcccgggagaccagcaaaagatgcatcgaaggacgaagactccacgcaaggtgaggaaaaatccctcacgcagaagaaggggggaagacgaaaagctcaagaaagtgtgtagagagacaaagaacgagaggaaagagaagagcctttgagacatatcggctgtacatacacccggctcctcgcgtttggagctcacgcggacgaggcaagggagagaacaggtacagaacttggggaagcagaatcctctcttccgcgtagaaaagaaaaggaaagcacaaggagaaaaagaggacatccccagttccccagagaatgtaaaaacgtaacgaccaccgcgccagctagctcaccgtcgtctccttgcttctttctcctcgagcgtctttgcgcagactacactgtgggtctctgcaaaggggaatgcaccgtttctcccgagattgcaagaaccgtttttacctgcatctgtctcggtttgctcgttttctcggcctcctttatcgaggatcgacaactgagatgaaacacgcgacgagaactcaaaagccgcgtctcttgatcgtgtgctgtcgcggatctccctccttctcgctctctttcctctttttcgtctgtccaccgcggctctcagaaagggacgagaaacaacgaaaggcgaggcactcttctttatgagaaactctttaaaacgaa

SEQ ID NO: 1630 - DNA, 1748 bp, Toxoplasma gondii
gtgaaactggcaacctggttgtcatgcttcctcacctccagcagttcagccagcgtaggcggagcgggggtgacggcgtaagaatcgtcatgctcctcgttcttctccaaagattcatcctctgtagaaagcagcaccgtggtgccaacgcatccgccaaccttatcttcgtgactgaatgtatggtgcgaatggaggcgcaccaggatgggcggagagattcgctggctgctctgtcagccaccaccgtatgaatcccggaaacactctccggaacacacctgcgaagtgtgtcttgtccaagaaagcagatgaattctacgcgtttaacaaatcgaaaaattagggttcacttcctacaactgccccgaggtgatgaatggcggcttaactacgtagcacttgctacaaggcacgtcagaaaagtcgtgctgcgcctactatgtcatcggatgaagctaacagtacctgttgtgcttggtctgtgtgtgacctccaaggctgctttggtcgtcagaccaagcgcagagtcctctgctgtcgtttgctcatccgtccgaacttggtccatgctgatgtcgtattgacaatcgttgatcggcacttcgtagccttcaatctacacacagacgcaggaatcacagttggggagcaatgatgcctacatcaacgctggatatagagtcttcctagaataatcgtacgtaatgccacgctgacctgaagtactgaaagcacgtcatgaaacatatgagcctttcgaattgcggaattcgacacaacacctcaccgacctcatttgatctgacatcgagcatggtctcggccgacgcctcttgctgcgccatcatctcttcactgccttcaaaatggtcggagatcgcgtcggaggaaaattcgcgttgcacgtccatgctgttagcacggaagggaagaagtcaccagtggtcgaaagggatgagtacgcaaaacgctatacaacgtcaccgacacgctccgaggattgtgaccaaggggacaaaaccgcgaaagttcgaaaacagaacaacgcaaggggaacacggagaagaaagtatccgtgaaagcagataatagggggtgatattcccgtcaacggttgctatacaggagtgagaataacatatttgtggcgcacccgaccctgggacgttgctaagctagcggaagacgaatgaagcgggataaaagacaataaccgcacagtcgtccgacagcccgttttcaactcgaccggcacgcggggtcccccggggggcgtggcagacgaggcagcagcggcagcgagtgactgttgtagttttcgaaagagacaccgtccgcacgaaaaacggtcgctctgcccttccgctattttgttgctcagctgttcgatgactgctgaagtcacgaagggtagtgttaaaggtgtggtgtttcgactgtcatgaatggccgtggcctggccgtggttgcgagctgaaaccggtggtgcatgcatcgagtaaaacgtcttttggcgtaggctgggcgcactcacatgcaaccagtagggggaggcagtgttgtaggcagatccgcaaacatcgtttttttttaaacgcccgcgcgaactgcgatacctgtgcgaagcgtgcagcttcagacacttatggacgttctgcaagttaccacctccaatttaatttctgttgtggaacactagtccgttgtggccgtggatgaaacagaacggaccgattcaggcaaca

SEQ ID NO: 1631 - DNA, 3157 bp, Toxoplasma gondii
caatttgccctgtctccctgttcgcgtcgctccacctgtccctgctccttgtcactttgcggtccacctcgggtcagttttggtggtagtgtttgctttccagatttttttcaggacccgtccctctgtcgacttcgttcgttcgtttctgtgtaaaatacatttttcatgtcgctgtgtcaatggagacatgcattccttgcgttcgctacaggaaaaagccttgtccggagagttgttatggaacttccagagtagacacgaaggcgacttccctgagtagtctggataggttgccgaacatgaaagacttcggaatgaatgcttttacggggattttgtgtgtcgcatcggagtttcggaaaccgcagccgtggagaccataaatgctcactgtggccacactcttgaaggtgcaccttcgttttttgggtgctgtcgtttggcaagcgcgacacgcaagcccgttgatatgttgagcgatcgtgtgctgactacggagaaacagagttttgagcagcattgccatgtctgctaaacttgtacgtctttgttgtaaaaaatcaatttttctcgtttcctgtgttcaatgtgttcacagcaaagtcagcgattccacaaagaatcgtacctgacgccattacaagactttttccctaccatctcaagctctcgggacgctgcatcccatcgagcaggaccgcatatttctccgtcttgcgcatacttttttcctacgccagaattcacagtgacacccaggacgttcttcccgttatctgctcacccccttatcaggcgaattcaccccgatttcgacgaagagacaggaaatgaccataatccatatgccatgcacaagctgcaaatgcaatggaatcactcgttgtttatccaggagcgcatgcaggcgctcaggcacttcagaaatgttgcaaacgtgtaggtgccttcgcagcgtttgtcagtgtcctaacatcgaagccagcaaatcgtgtccttggtttgaaatgccatcctctacacagtattactggagctgggcgtatgaaacgagggcgccagtgccccgcctatccatgaaaaaattttaacgagtccgacagtttagtgcatgtagtggcacacagaatctgtggcatgttctgtctcctgaaaaggagcatttctcgggaagaggggtcggaacgccagacaggcaggcgcagtgtctcttgagtgaagcgtcttgtaacaacgccgtgaatgggaattatcaaagagcatgccagtgttcttgaaacaagtgtccagcaccaaccgtttcggaatgatgggtttgaggagctaagcatattctttcgtggaccggtaggaaatcgagttcacacttcatcgtcttgtcggtcggtttcatttcgtgtgcgacgagtgcacttaacgaatcaagaacaactctgaaagcaactggtctgtctctcccaccaacccccccgcggccgtttcagcaacgtccggagtagagccttaacttcataggcgtgcgtacacgatcgtattgcagaatggtaaaggcagaaggccctgcgtttccaggttcagcggtgggcccttcctcgccaagcgacaatgcttggttttctgtcgcaaatcgcgggctcctcaaagaaattgactccagacccctctttttctgctgcttacacggttcgcggactcgtccaaggacctccgaaaaaatgtcactcttcgtaccacacatgtgtggcaataaacaaactatccggactagccggtcgcttgctctgtgagtagcacatcaccggatccaacataactacggctgcgaaggctgagatgcgaagcgcaacagtcatcgcagggtgaggtcacatgtgaaacgaggcgaacggacgacggccagcgtccagcgagtgttgtgcccgttctactagtttcccgggcgggctgtccagctggggtgtgtattcgaacgaacaccagaaaagacgggcaagacctgtgcaagtttcatttaggtgtcgccgacttacagaaaccattgacgactgcgaagtctatcttcggggatccgatcttcttctgtcgatgcgtctacgcgattgtcttgctcttcaaccctccactaggtcgatacttgtcacctagatctgtgtagaaacaactggtgaatagctgcgcgccccacatgtgtcgcgtcgctgttgcttgacagtctacagctatatgctaatatgtccctgagagtcgcgacgccgaccgtgccagagggcgtcagagtgtcgcaacgcgacacgtagatgtatgggcagtttaacacccatcatgtctttgctatatccgggttttcgttttcggggctccagtgaagcgagattatatcttcagcaagtcactaagcctagtagatgtatgtgctcgtactgcaacccccctcctggcatcttgcgtcgcatagcagacatacatcgtggggttttggcccgctaggttaccatcacgctcaacggcttccagttgaggaaccgtgttttccccacattttcatgattttgtccaaaagttgcagagtcgacttccatctctggataaggtaaacagcagcactgtgggcagcgcctgtctccaagtcttgtgcgacgaggaacgcacgtcgtctgtccgctggcgagtcgggacacagtgccattttctttctagcagtggttgcatccccctaacaggccctaagaagacaaaacactcaatttactgaaacttcgttccgcctgtagatgtttatttgacaatgcagcgatgcatgtcgtataaggtctcacctggattttggaaagtgtaggatgggctgctttcaactaacgagttttacgtcagctcgttgtgaaatcttctacagatgtgttattgtgagttttaagattttcgtttcctgtttcccttcgatgaccgctttgcatcgttccaacaaatgttagcagttcgcaccagtggctgcttcctgccatcagttgatctgttctcccgctccgttccagggcttgagcagttgcctcgttcatcgtgtgtccgatttaaacagaacattttgacgccgtcgattcgacagagaccgagcatgcctcgttttgatgttctgagggcttgtattcaggcaaca

SEQ ID NO: 1632 - DNA, 1688 bp, Toxoplasma gondii
atcgtaatcacgttgacagctgataacgatagtgaaaacatacgatagatgcatactcactaccacgcgcgtatttactggagttcaggaggcacacttggtgggaagaggcgaaaaatgaaatcgctgactacggtgaactcgctggagaagggtattttaatcattttcagacaggtagcggcaaaatgttgctggcataggtaagtgaggagttcccggtcctgaggcatataaagtccttgaatgagtgaaccttccagtcgcgtatcaacttcgcaaagccaacaaaggtgaggacagagtaaagcaactcaaaatttcacttcttctgtgaccgacgtggcgaactggttgaattgacaactgaacagatgcgggtaaaggtgaggtccaaccactgggaacacgactggtaaaaacaatttactcgcctgttgtctgcgatggtacatttattaactgcttaagatactgccaccgtactgaatgatgtcgttgtgatacgcgctgctgaagcctcctgttgaagcagtgaaggctgcataggaaagaagccccgcgcgaacactgctcacacggcaaaaagtcgccttctttgcgacatccctccgaaagagccttacttcacccagcagaacacacaatgtgtcagctgagtagcaattttcacgtgtgtcgaatcgagccctgctcagcctccattgcgtagctcttacactttgacaagctcggcaaattagttgtagccggcttctcgagcagtccatctctgttttctgccgacgatgggcagtgtgaaacaatcccaaatcttaattgacgcggaaagggaccaggcacgtcttctcagacagcagacggcacgccgttgtcgcagcagcatcacagaatacacttccttcgtcatcccctatattcgtttcgctgttggcttctcatgtcggcatataactcccaagcaaataacagtggagaaatctatagcaagagaccgatctttatgcgagccactaaaggacacctgtttcgaggctttccctgatctacatcaaaacaggtgaatcgactctgctagcgtatcatcctttataaaaaagcaccccataaaaaattcaccatcagcagaagtataatacatgcctatgaattgtgtgtgaaaactttggctggtttcgatcaacccgtcgagcaaattcttcctgccatgcaatcgcgtgacgtctctcctgtctgcatgtggcggcatgcggcccgcggtcaaaataatacaactatgagcacgatgacacatacacacacaaacggggatgtcgaagaaaatcttccaagcaccggtgtcaggttttttatgagccagtcttgaatgaaaggaatatccctgcaccgtttgcacagccgatatcgccctctgtggagggagacgccctgtgaaaaatctcaaccgcgtcgcgtctagaggtatcacgatgagtcgggtttctcacataccgttgtgttggactgtgcgcaagctcacatgcgacggctgagactttcggtcgacttttgtgccacagatgatggaagagaaatattttgttccgtcaagtcttcagtagacaccgcgtttccaaggagaggcttttcggttccttttttttgttttatttgctctttctaaattccacttaacacctgcgaaaaga

SEQ ID NO: 1633 - DNA, 1174 bp, Toxoplasma gondii
gtgtgtcttctgagctgagaagaggccagattcgactcggcgtcgttttccgaggagcgagagagacaggaaggatgtgcagacgttgagggaaggccgcgaatgacgccgttcgcctcagagcctggctgctgggggggccggtcgctcttgtcttcgccgagagaggagacagcctcggtgtctcggctctcgaagaaagaagaagcgaacgcctctccagcagatccagaaggcggcgccagaggttcagagaaacagcgaaccggagacgaggttgacatggtacagcacagggagagaaggaggagaaggagagcgcaaggaagaaagaagtcggggaagcgaggaagagagagcgcgcaaggaagaactggaagaacaagcgagagaagtagggaaagcgagagaggcaaaagatagacagagacggagaaaggaaaggaaggaacgacgaagaaggaaaaagaaaggacaaaaagaaaggacgaaaaagaaaggacggagggggggctcttcgaggcgagacgaagacaggagggaagatgacacgagagaagctcggagaacagaggagagagaggagatcgctgcacaggagtgaagcaagaacagaaagcgatggaaaaaacaagagagagagctttgaacttggacgaaccttcagaaaaagagatgaatatcgaagtgcaacccaatcgagaaacaggcgagaccttcgcaccacagggagagcaaggagactgccgcagccttcagaaaagagagaggaggctttccgcggaagagagcaaggaggcgaagccgcgcgttttccagagaaaacaaagacaagaagagaggtttccgtacagcaggccgaacgaagaagtatgcctgtgtgcgtcgagagcgtctcggacggctgggagtcgccagggaagagcggcgcgtctgcttctcgattgtccggattctttgcttgagaaggttccctctaaagagacaagaggtcgcagagaagagagcgaaactggagagagaatgcgcggcgagtcagtcctgtctttcagtgtcttctgcagcgactccggagcaggaagtgcttagaacctcgcgcgggaccgcagcttccagccaagttccattttcgtcgagaaccgcgccaaacgagcgtctctctgcatcctttaaa

SEQ ID NO: 1634 - DNA, 1919 bp, Toxoplasma gondii
ttcatcgtacgcgtttggaccgtctctgcatccggagggtacggcgcgctctcgtcacttgacttcgcgagggaaacagagccgttcttctgccgcttcctcgatacgccgggtcccggtgcctccccagagtcaaccgctcggtctctcgaaattccatcttgaacgggtatgctgttgctgtgtcctagagctccgacccgccgaagggtgccctttaagttgcctactcgaagctgttctgacacctcttggagaagagcgcgaacaaggggaagaagagcggctgcgatgtccgcagcaacactggaactctcagaggccatgggtccttctcaagctcccagggtacccgagagcattcgttgcagaacgaaaactgagaggcagaagctcgaatttcaagaccagacgagaaagtgggtgaccaaaactaaggaccggttcaacaagatagtcgcagagggaaagcacagcggacgagtaagaggtgataggcagggttattccggaaatcggctggttcactcgcagtgatggctgctgtgccaaaatgagcgaaaggaacacatgcagtaaagcagaagggaagagctgaactctccgttcagactaagcgtgtctacgcaaggagtatcaggggtatggaccgcaaaagtctcagtcgataaaacccccacatcttcggcaggtaaaaagacgagaggacgggggcagcagggggaaagatttggaacctcacgtaggcgagagaggaacagtagtgtattccaaagtttcagacacaacgcagacacgcatgacgagggagcctcactggtcgctctggctgcgtggcgccacggagcagtcgcctactgccaaagcgaaagaatggtacactgatatcgccggtactgcagccaagtgaaaatagacggaattgcggtaccggatgacctgaaaaacacttaagaggagccacagctccggtagctgagatgcgggagcctctggtcagcactacaatgtgagcgatgcaggaacaaaattagtgaaacagtggatacaaataggcgtgatggacggacaaaagacaagagagctattgtaacgtctgtgaggctttatgtataaaattcttcaggtcttctcttattcacaataacaatcatcccgcactgtggggcggccgagcttgaaagagcggcctctgtttgtatttcatccatgcacaatttgccagagttaaacttgccaacagcatatgagtgccgaaaaagggtaccagtgattgagtataaaatggtatttcatgtggcttattcccgctcccctgacgtacccgtggccgttagaagatagacttgagtgtcgatgctagcgtgaatgcatgccagcatgcaatttggaaaattcacgcggcccatccgcgagatattttcgcatcttttggagttccttcagtaacttcgtcaatgtggactatgttttcaaccacttgagagtaagatgtaacggcgggtcgccgctactcgagttctttcctgctctgcccgtaccacttcgtgccgcatgttgtattttacgtagccagcacgcgtaccgcttgtcttaaagaggtttcaatgtgtggaaagacacaggcttgtgccgggactgtatcattcactttaacgtgctaagaggacgtaatccttcgtgctatttcgccatcaacgagcactgctaagggttctttccgacataaaaatcgaaaccactggcgccggtcgttcggccaggtcgcaccttgggttggacagtcgctctgtcggcgcgcctctggaggtttcttacttcgtgaggcaggcgtatgggccaagcaaccttcccgaggctgtgaaacccgtcattttgtattcttttatctacctttgtgttttttctgggcgagaaaa

SEQ ID NO: 1635 - DNA, 1794 bp, Toxoplasma gondii
caagagtttgggagagattaaatacgccatacgcccagggagaatacatccacctaaggctctgattggcccggagactgctctgtgttagcaggctgtaccagcgaatttgggaattgatagtcccggattcgttttcatccggtttcccttctctcattccaacatgctgctgtgttgggacgtgttttttcgccctatggccgtaggatttattacgctgcgttggcacgggcaccgccgtccgcaaacaggaggaaggagctggatgactacgtgcatagaaaaaaggcaaagaagaagacgcggaatatacggaagaaaggagacaagtagatcgacaaatagagcggagatcctaggtttcgaacaaggacgaaggggacgctgaagtttggcaaatcaaaaactatgttttagctaagtccctcgaaatgtggaacctggactacatttaggctgaatccttcgaatgtttggaggttttttctcactgccgttttatcttacactggaaggttgcccggttccttgttggcgtaacaagcacttcatatcagcttggtgatgacgaaaagctcggacagaatacacggggacaatccacgggcatatcgaaaagacatcgagcgaaaaaaaagtcgccagcgttttgcagtgtccactcagctacttcggaaggcgcagagcgaggatggattgctgaataaaaaatgtaccgcgatgagcaaaacaatcgcctatcgttaatgacacaacctttaatcaccaccaaatctggaggagatccctaaaaaaattgaactgattctggaaaacctgatagggacctgagcctgcaacggcacctcggcgtcgccgtatgattcttcggaaacgggtgattgatagggtggtatgccgcaggtgagcttgttaagcttccttcttgtatatacaaataaacacacctcttttcggcgggatgcgttaggaatttgggactaagctctgcatattttaaatacagggcattacagcagcagtgccactcggcctggaagtgcttggaagctgtttctagcctgcagctcctcctgtcatgatcactgctgttccaccgtaagtgaacaggagagtcaaccggaccagtggtgagaaacgaccgaatgttgtgtttcctcttcgcaagaattctaaacgcagagacaactctcatctgcctaaacttgggaggcaaacacagccgaacatttttcagtcgtctgtatgagtgttatcacatgggattcccgatagcacgggaggaaaattgaaatggtggagaaacgacagcgttgttttgggttggccagttccgcaagcaacacgagtagtgacaacgcaaaagtgttgaactggcggcgtcagcggattcagtacgtttcccttggctgagcgtcgagctgcagcgcggaatgcatgcaacagcagtgtgctccagagctcacatccactataaggcgcatgccgcgaagttccttcgacagtcatccggacccggtcgccttgagtggggagacagctgtaagttcggctggttctcaacgtttcgaagtttctctagaaaactatttatctgtcaaatttgtgtcgaacttcttccctcagctttctcggttcgtctgacattatactaacctcattgtgtgttccgctccagttctgtccgtgaagggcagacgtttgcagtgcgtccggttttcgcatattgcatccttttgactctgtgctttatcattgatcgcccattcgtttttcgttcatcgcacaaca

SEQ ID NO: 1636 - DNA, 2986 bp, Toxoplasma gondii
aattcacttgagttttcatgacaggtacacacaggcctgggctctgctgttctttttgtcccatgcaggcgctgccgctggcactgtcgcggctcgaggtccctacgctggctgcagcggtgttggacagtctgctcagtgaccaggcgccagcagctgtcagtcagttgtcgattcacgaactgtcaaaccttgcttatgcaatcgcatgcgtctccaccaattcccaagttactgtagacacgcatccgtcctctgcggactcaggctcttgtcatgagcagaggccggagcgtttcgaggttggttcatcggaaaaggagtgtcagtctgggatgaagatgcaactgcatccggagcatagaagcgtacgcgagcaatataatgcatctgaagttgatccgggagaaaacagcgccacgggtggaggagttggagacccttttctcggaaacaagagggagaataatacttcatttaaggttcttgaatcccggtctgtatgcacacccgaggaattgaggcgtcggtcgactctgttaacgaccatcttacgcactctgtctcgcagttccctgaggcgccatccacttaactcgccgttcgaacgcgcgtggagacagctgaaaattatcgacctgtatcttcagttcaatgtaggacctctgcgtgtagatgatgaggaagcgcttcagtttctgtctcttgctcggacgaagaagctattgaacctggttcatgtgtcccaggtacagaagcgtgttgggcgcttgcttttcgatgaaggactgatgtctgaaatagacgttgagtacccactggggccttacgtcttagactttgcaataccgtctcgcaagcttgttgtagaagttgatggggaagcccatttcttctttggtacaacggtgccaactgctcagacgcgaatgaagcgcgaactgcttgccgctatggggtggcgcgtggtcgtcgttccgcaggaactttggagaaataaaaggaaagggaaaattaaagaattcgtggcgagaaaggtgcgagagggactcgagatcgacaacagtgacagatagaagccatgggagaaagacggtttgaagcagaaggaaaacgcggggtgtcatgcatttccagaagaccacaatgaagttttaggggaaacaaagtttcttgcacatgtacattttgtattgtctggtggagcgggtaggctcagtcggggaagggagaataaaacagattgtgtttccactctaaggtgcttgtattctttttcctggagagacccgtacagttgtgaaaactcgacaaaccaccgtcccttgcgcttcaccggcaccgatacatttatcaggccctgcagagctgcttttctaagttgttcatggaagctcttcaaagaaaaagatagaccatatgacagtttgctgcagcaagttccagccacagaattttgctttaccgtgagtagaagtgcatcaaacagaactgctgaatgagactcgcagtacatccttggtcatgtcaattagcaggttggacttcaatcaggagcaagcgaccttgttaaacgctggaattcagtaaggtcaatcctttgaagaccgattttaggtgcagtcctcgttcctccttcccatttgaggacgttctggctttatacgcctggggactctttaatgaatatcagttcgggtttcgtgactcgccagaatcccgccagaagtctggatgtacagatagatcgaggcattcaggtggtggacaagtattttcgaaggttttcctcggtgaacgcttcaacaacaaaccgactatcgaaggcagaacatcggacctgctgcggagcaacatgcgtcgttgcaacaggggggaaagccataagtaaagcaactcctgccgtaaactccaaaggaaacacacaccatttgagcgattcatttatcccatctacgagaatcctgtagaacatttcggatggtctcgtactacaagcaccgtagctcagtgggagagtggggggctcataacccccaggtccatggatcgaaaccatgcggtgctactcttcttttccatccgcttttgagcattattcgctttcagtggaccgttcatcaaatcggattgattgacaatatttgcggattttacatatctgtgtcagtttcgtttttaccacctttttggcgctttggggtttatcacaaagtcacagtcactagtgcaccctcctggcgggtacattcgtagtcggtgctgcacggcttttatggcatgccactgtgtgaaaagttgcctatcaagatgaattcataattcttcaggtataaagtccaattcctcacgaaggcaattcatcctcatttcctggaaccctgccttcgcccatggcgtaaggtcgccagccgcagcccctcttcaattttcagtgcttactgagatgctgtgacacatggcagttccctgttattagtttcccgtgtaagccggacgacagcacaacacaccttctaatctatgacagtggacaactcctgaggctgggaatttctggcaggcagggtctagtacagcgtgcaatcagcgtgcaatggtactccgtcctgaggttgcttcagacaccagaagtagcagcccttattgcgtcgctcatgaactcccacgatccaatcacattccccttaggttttacattaccaaaacaaaatagagtgctgctgttcgctggcaagcaaaaatgaggccttgtttctccaaccactctcattgacaccggtgccggttcctgtaggcacctagccctcttcagcagttgtccggttggaatttctgggataaaacgcacagatttgtcacgtggacagtaaacattctctcaaatgagaaaagaacgcattagaagagaaaaagggactggggaatttttttatcccatacggcgttattgccactggttatatgaaagagttgaccatgcaac

SEQ ID NO: 1637 - DNA, 2745 bp, Toxoplasma gondii
acatgggcaacgagaaaacagtggacgattcaaaggagaggaaagagaagagagcgacgaatgggaggaagcagaagaagaggtgcgaagggcagatgaggaagaagacgaagctcgaagacgagcagaggaagaagaagaggaagacgaggaagaagaggaagaagacgacagacgaaaagaagatgaggaagaagaagagggacgaaaagaagatgaggacgaagaaaccgaatgcgcgggagatgaaaaagaccgttttgggatgcacaaaagagcagcgagagagggagaaaaacgatgtggaggagaggacgtttgcagttgtgcggctcccggagccactctttgccggaaaagatcagcctctccaaagagtattttcgctgaacagaaacgtgagaggaagaacgagagaaggatgaaacaggggaggagacccgagagaggcggcatttggagaacagagagagacaggggaaagaagagaagcgtcgttttccatgagcggagacggctttgctcgtccttcttctctcccaccctttcgcctgcgacgacatgccacaggttccatcgagggtggaggctgtcgtcacgacaccagccggacgaaagtccaaagtcgcgaggaaaatggcgaggaagagagaggaaaatggcgaggaagagagaggaaattgggaggaaaaatgcgagaaaaggggagacacttgagaaccagtggagaggcacagagagtgaggactgaggaaaaacgaaacaagcaacctgccgaatggagacatcggcccatggctgaactgccacaaaaaagcaagatatcctgtcgtgtcggaagaatacgtgatggtcttttactggattcttcctcgaggtgagagagcgggaaaggaggagcgcatgcacacccttccgtccatgttagcgaacgcgagaaacgtagacacaaactaaagagtacttttctttccagaaaacggacaataaacacaccgcagaacggcgaccgcgcagcggcacacacacttttgcgccagcggagggaccacccgctggctctgccggcgttttcggaggtgtacatacacccatacagctgtgatgagctggaagacagggatagaaagccgagaaagaagagaacagggtatggtcagttgtgggcagcaggcagaggaaatctctgggtcccattctcctctcagcgtattgttatcggaggcggaaaccttttttcaggagcgaagagaagaaactcgaggggtggagcgggcctcgaggacggcattctcgacagaaaacatggaaccagtcccctgataaagacaggagcacgaaggaacgaaagctttcgcttctctggttcgaaagagagaaaagacgcatctgaaaaagcgcgccacgaaaacgtgtctccttccgcgcgctgtccggagacacgaggagcgggcgcggtgtacatacaccgcacgtggctgggatcgcggaggcgccttttttgagagttttcgttatttcacatgtggtttctcgttcaagcacgtggacgcgcatgtgtttcctctctcctcaggtctgccgcgaaaaccggagaaaacgcgcgcagctgccggatctgttcagcgcgcccacccccctctctgtgtcgagtcgagactcggttgccgggctgtggtgtacagacactccaaagacatccgggaagaggccgaagccttttctgtttcttggcgtcggaaattcgcctcttcataggagaaacatcgcctttcctctcgacaaaaaactcgccggcctcggtcctcgtactgctctcttttctgtcttgcacaccgcaggggtgtgcatggccccgcagtccctcctcagacggaggcgtatctctcgcgttcccgtgactggacgggcagagccgtcgagagttgactaggatccgaaactcttcagaagcgagggtgctcctgtcttttctagaagtccgtttgttcgtcgcttctttctcctctcgtctccttcactggcggtctgcgcgggcgcgatgaaccgcgtcggatgaaagacgagacagaacacggcacacacgcgagtgtctacggaatcgtcctcgccgacgcatgcctcacagtcagtctcgatgttcttcccatgttttaatctcttttcttccgcgctgcaatctctctgccctctgctccggcatcttctcgctctttcctacgccgtacagtggcagctcgtcgtccaccaggtgcgctttctcctcgccgcgaatcctctctagccttcttcgttgagtgtttccgtcttcgtcgcttcaaaagatctcgaaaaagagtcgccaaggtacaccaaacgtaatggctccactcctgtgagctggacaccgagccgtgctctccacggagacaaaagccagcttcacttgttttctttcctccgcttttcttcgcttcttacctccataggttgatccaaagagagacaggacgccttgagcgtctgctctcgctcctctgctctccctcaaagcgctccgtctgtctaccatgaacacttgcgatatttacggccctctctacctcctgtagaactctctcttcttctcccctccattctcgttttttctctgttcttctctttctccttctcctccctgctcgctttattcctctctactctttccccctcgtctcctccgtgcgcgcgcgttgccgcgtttggcgtctgctccccgtcgcgcca

SEQ ID NO: 1638 - DNA, 2499 bp, Toxoplasma gondii
catgtactgtaatatcacatcataagtagatagtgtctcgctgcagttgttgcctgattggtattgcatgccttgagtgcgtaagggagaggaaaggctacgagttggactactggtgtagaggtcattgtttaccagatccaagttgtattgtgctagcagagcatcgttaaaatgagaattattgtggaaatggaacctattgagcaccatgaactaaaaacatagataatcagggtaatctaggatctttcccggcaaactccaaatgttatctgaacagctgtccgtggatgggctgcccttgcttttgtttttctttctattatagaacgtacaacaggtcttatccactccgactgattgtaattgctctaaatgtcacttcacaagctttgaaagaagaggcgtgcctccagtaagttcccttgggagggacttgtagaacttccaagcacaaacgggaactcagcgactgccgtgttgaaattaacgtgatcgcacccagttgtcagatattaaggcgtgatgattcatggtatcaatcgcctctgaagtctctctgtggcatagagaagttgaggagcaattgcaagaactgtgcagcacatttgtttttctgaaagcgagtgcagtcgaggtgaatgttgtaacttgttgggaatggacgtacaaaaaacactctagcacaccctttgcccttctttgtcagtttcgtacgagctccctaagtgcatctaaaagccatttccattttctggacaagtgctgtcggggcgctactttattatcagaaagagaacatctcgagctcaagttttctactggcccttgacgcagcagatagcgacatatataaaggggtcggaggatgaagaggcgagatcataattgctcccctcgtcccacatgtcgcagcaggatgcgctttgctgctgtacatacgtgcagccactgaatgaaaaaagacaagtgtttttgatgcgtggaagcttcacggtgtctgacatcacaaccagcatacatccagtagattccttccgcgaatcgtagaccagctaggtgtaggacatgtggagctatcgaatggtttttgaatcccactgtattagaaaacgaacccagaaaagcagcgggatggagactctatccccacggacacgctgcctccgattcagattggacagtatattcgcatccttactaaatggcaggtggaacaccaacagagacgacatgtaggatatgagtatttgtctattctgaatagatcgctactttgggcatcgcttgtgattggaattggcgattgattgcttcctccggtataacagtccctgctatattggcaggacggagcagaaggctagcactggagttttccgcccgaattgccagacgggtttactagaatacctcgaaaagccgttatcgaaaacaactgtcggctggacggccgtggaggctgaactaaacagcttgcccccggcattacgcgtgcactggtttgtgaaagcatgaacttatgctggtgggtttgcacaaagtggtgcgtgggtattctatgaacacgccaagcaagcacacattctaattacgatgttgtggtgggaggtatccattcagtaggaattcattggttgggtgcgggtgccccatccactgcggacaacgccgaggacccgactgtgaaaatgccttgggttccactctgtctcgtctccacatgcgaaggcaacctggtgccaagaggcggagaacgacagaagtatctctcctgtttatggtgtgttcacactgaactgtttcagcggcgagaaatgcccgcaggttagtgtaatggaggggaggcagatttgcattttgaagcgtaattggactggggaattcgttttctctctgtacgggcggcagcttgtcacgggattgaaagctgccagtgtaaagtcgagcatgctactttccgcgaccaggcactgagtccctcaacccagccactcgtttgcgaatcctttgtcccaatattgtctctttttcgttttcatcactggcacattcgggatgttacctttagctctgatcggataggcacttaagagaccgagcatgtgttaatccggactctctcactccaaagtgtttagttgacggtgtatccccaaactcaccagcgccttcacactcgcgtctcccttctgtaccacgggaccaaaatcatacgatctctatttcagtctggaaactctttcttccggcttctgactttgccagggctgaacccccctcccctcagttgccgtcggcgatgcatcgaagttctactgtgcaacttcccgtgcagaaaacacaagccgagagcaaacctccatcacccgtctgtgtgaatacctgaaatctagaactccctagggcgacaccccaggcatccatcctgaaaagacgaaatccttcgattcgtcgcggacgcagtgtcagaggggatcgcaaggcgtatcataa

SEQ ID NO: 1639 - DNA, 2418 bp, Toxoplasma gondii
cgcaaggttttgtcttgctgctgaagaaactgatgttttgagaaagccattcacaaacggggcacactcaaggggtactacttaaggtggtcctaggttgttttgagatgatcgctaaattcggcattaccagaggaagcactcgcatcagaatctttcctgtaaagaagagcctcatagaaccgtttgccggtatactgatcttaagagaggaacatactcattttgattatgggaagcacgaaattgtcacactgtagtcggtgctgttggagattctcgtacagagttttgagattgtccggttatttaccacaattcctattacgtctccaggatcgcttttcagcgttcagagttcagtatgcctttgcttggtttcgattccctctacagggaaaactcgtatcatacccagagccagttcagacatgtgccctcagcagctatgttgtcttttcaagagatacacacgaatctggagtgacaaaccgttaacgcttccgcagtaagagaatgcaactttattttctggactcgtggactgtatgccattgaatttattgaagacaattcatgcaagtttttctgtatgcgttcctgcttggagcaaacatatactctgttgccaggtaacgtagagattggttgatgtgaatttgctacgtggacgacctgtttcttattttttaccgacctcagcttgcaagaccatcttaccacatttgaacagtctgtaatggcgtctccgtctacaagccaccaaccggttcacaaaaaattcggtgttcaaacatactgctgagccttccttctgacccttttgtacaccttgtttgacagtttgcaaataggaaaatgtcctcgggaaacgtcgaatgaaaatgacagtctcctactcttagctgacaacaacttcggaggtgctgtgcaacggcaatcttggcggatcggctacgtctgcctacgaactctcgcatctgccactgactgccgcggggtagcctttgtccgggttatcccaagctgtcgaagaggcatgaaagattttataaactcgggaaaggtctttcagtgcgtttgtcctaccttttctcgtcacccttcccctgttgattctcgacttcacttcctgttgacgtcgcgtctgtcgacgatataccaacaaaagagcatcgtgttcagagtcaattaacacagacgagctaggacttcccccacggctaaaaaattaccattttcacttccagaaaagaatctgtgtcaccgttcttagctcccggccctcaaggtcgattctcgagtgcgtcacccatcacacactgcactgctttgctttcagcgcatatttaagtccgtgctcaagtgactcagccacttctttgccttgaacctagaactgttcctcaaatcatgcactcgcaggtcttctccggaaggtcgtctgtcaaagtcgcggacaaattccgaagtgaggcaaaattgaatgtgcgctaaagcagcaggggtgctcggaggaactcggggaaagagactcggcacatgcaacgtcggttccgatgcttactctgtcaagccagaagcggtcaccagctattgctcggtctggttcgtgtgtttcatctagtttttcaaaccgaaaagaggtgtgccctgtctcacgtcgaaaggacggcggcaaccagaactcgtagaagcggaattcgcgtgttcgtgcgttactttacgcattgtcttgcgggtggtggttccactccctgactgtgataggtctttttattttctcctttcgtttgttgctttctttaaagggttttttgcttgtctgtctctcctggctttttgcattatttccaaggaaccaaccctgcgttggggactcgttgctgccgcctcccgcggtctttagaacacgtccgttctgtccatgtgcgaagcggccccggcctcgacttcagggaattccctcttttgcatccgtcccgttttccatgttccatttcctcttttcctagcgcgtcgcggaacgcccgctttcacgcggtggctgtgcgacgaatggcgtgtcgtttcttgcgtctgtgaggctcggtgtgtctcgaacgtgtatcaaggtcctctcggtcgaattcgatttctgtgctttttgccgtctttcctctccgatgctggaggatctgtacgtttctatggtttcccgtctagcgggaaatgagtcgttttcctcgcgtgccaagcacggggggtaagccaccgtagaagtctctcacgggccgcgctatcctgtctccgctcctgcgtcatcctttggggctgtttccttccgtctgttattttgctttcgatcttgggaacgcatacagcgaccctgtctcatttctgccggatggggttcctcccgccgctcttgaggcgcga

SEQ ID NO: 1640 - DNA, 2652 bp, Toxoplasma gondii
ctccttcaggagttcttggaaggtcggaatcggcatgtcgtagtcattcgaaccgtacttggcctgcactgtgggcacagagacatctgttgcaggatcccaagacggagacagtgctttgccggcaaaaggtagctgcgggtctgaatttgaagcggaggacatcgaagaaatcgacgaactcagggagggggctggacgcgtctggaccgaggagctgggcgcggctgcagcttcaaggcccctccactggaggtactcggacagcgggcggctcttggggaaccggaggggctcgaaggtgccggtttccgagacaaacatgaacttcttcttgcggtaaaaaaagaaaatctgctccggacgacgaatcaacggacagagcgtccgcgactcgaggggcctaccactggggggaatgacgaggacgctcgtcgtgtcgccgacggatgacacagccgtgtaactcaccaagcagtccagggagacgaaccagtgagtgctgaggtgcaagagcccgccgagaaaaacaaacaacaaacagtagaggaaatacacggaggagaacaaccacgccagcgtcgggaagagctcttcgatacgcttcggcgcctccgtggtcgaggatgttgacgtttcaccgaacacttcgggcgcatcggagccgactggaggcagggtttcagcgttttctgaaacctgaccatcaagctgagactccagattccccttgagtaccgcgtggcgatcctctctcctgtcggaggcacctaggtcgcctgtaggtgccccggtgggatccggaagcgacaccggggcttctgaagagtcggggaaaacatccggacgggaggcaaggtcagagaagacaagaaaagcacacgcggcaacgagaatcgcgaagggccagacatcgtagcgaagtggccatggcttttttcgatacagaacgaaacgccgggtccgcatgtccgaagaaggcgaacctgacgagtctcctgtctttccgtcgacaggtgacccgcccatcttgacacagcccggttgcaagccacaggggagaaactcctggacagcgcagatcagcaagacagtaccgaaaaaacaaacacacacgtgcacagtctcagcttcaggaggaaggcaaagtgtacagacgagaatttcgttcgagggaccaagactcgatccgggccaggtaacagcggccgacggactgaaccagctgcatgcagagtcagctcctcgccagcgtgaaaccgacgtaccaccgcgccccgaatgctacatgactaactcaggacagtgcaaaagaatggaatttcgcggctcttttccatcccttgcgaatctccctatgcttgctatctttttacacatgcgaaagatgtcttggtggacacacgctaccatcaaggggcctgcaggcgggctaccttccgtgtgaaaccgcctatcccccgcttccgagactcttcatgcccttagaaccgcctgaaataaatgcagagaagaccgggactgtttgaagaacagaaattcaggtaaatggttggtggcaccatggctgccgtgcgtgcagaccaccgtgtgcgaccgttttgatgcctcgcatgcagtgactacagcatgctgcggttgaaagacttcgaaaatagcagaggtgccgccgtgcgtcattgcgacgcatagtttgttgacacatgcactgtagttcgacggccattgacactttttctttacggttgtggtgtccaatgatgtcacacgttttagggaagcctgcaacaggccgtggttggacgcatcgcggtgcatcaaaatattcggggcttcctcactcagacacctcaagatagattttgggcggtagaacttgcggctaactaatttggtcatcacagaaagcgtctacaactgtcaactgtgtgggctgttggtgctcttcataagtggagattggtcgccgtcgtgtcattcggggaaacgcttggcaaccactcgcgttcatcgccactttgtgtattagagtctctactaggaggaaattgtgacagcagcgccacctggaaggaaatcgacataaagaaggtgcgaaatgctgaagctactgggtggcgcagccgtcgaggtagcctggtactaccacaggttcattgacgcggcactaccgttttccacattcgacagagaagttgcgagcagcgtacgttattgcttgaacctgataaaagtattagatacaggcggggactgattagagtcagatatgaaatttagcaaatgtggttcaccggaatgaaactaacgtggagcggtctcgaccaggataacaccaaaaacggaaggtcatgcgcgtcagcatggatgaactcaaaaaagtcagcgctcaaaacctcttattcatatgtggggattcgtgattctttcggccttcagtttcctggcatcacaatagtaacgccgtgtttgaagtatgggtgtacgtacactccggaaagttgtttaatgtcgttcgagatcatgtcacttgaattggagctctggttggtgttttgccacaacgttactggagaactgtatgaagtctctgaagagggtgtagcttgttttgttcatctttcacacttttgcagagtaccgacgaagcca

SEQ ID NO: 1641 - DNA, 4286 bp, Toxoplasma gondii
aaaacaacggaatcaaggtgtgatcgcatcgttgttgttcgttggtgtgtgtctccaatgaatctgcatgttgatgccgaccaaggcttctcagcctggaggcatactattagtcatcgtttcaggtgaaggattccggagcagtgatattggacttgttagtctgttttctgtattcgggatgtgccgttatttcagacatacggtgtctcctccggtgaaccggggtacatgccatcgcttaacgactaactgataggtgaggagcttgtcacataaatttgagcgaagcatgattcctcgccataaacacaatgagcctgtctcttttgacttatggtcttccatgttttttccggaagaagacgaatggtattctgcaagtgcgttgacagcgtttcatcttctctgtcaaatgttcaaatgaactgtcgattggctgggcacatcgtttggtgtcatttatcaagattagcttgtgatgtgtttccacatgagccggtacagaccgcagcttaatcatggaaactggatgggttgagaagactgccgagcagcggccgaggaggaatgaaagacggaggtgcatctacgtgggtacctgagattgtacagtattcactctagctctcccccgatccgcctcccatacacgccgcagtttcccagtcgtgtctctcgtccagctttcacacactgcgcttcagcggtagactgcgccgtttgacacaagatgtccctttctggcaacccacactggcaaatcactacggcgacgacgctagagtattatctacgcaagcatacaatacaaacatgccgtagagtctgtttcgtttcacacccacaccggcccactaggtgtctaacgtttgctttcgttgcctcggataatatggagctgttgctgcttcgttaccatggaactcgtagctcgtggcaatgtaaacgaaacatggtattgttgtattacaaccttgttactccacccttaagaaacaaatattattagtttcggttgctccgcaatctgtatggccttcctccttgcactatacttgtatgcaggttcggagcccaaaaaaggtagtcagttcgacacagcgctcaccagagaggaatgcctaaaccaggaaggcttccgacgccgactgtttgcaacaggttgttagtgtttctagccagaacgttcccgaggtcgccgaacccccagatatcgttggcagcagcgccatctatttgtcctctgaacagggcttgtggacccgcagctagcgtctgtaccacgctatttgcaatgctggcaagcccttcttgaggcaaagcgggcgtaaacatgcttggcgttcctcgttgcacccagtcggcggctcccggataaactgatctgcccggatatgtcggcatgctcatgctgtttacaatagaggccacggaccctaccggatctgggaaagggaatacggtccctgatgaaggtgtctgtagctgttgcgaatatggtgctgcacttcgcgagtaatcggagtggccattatacgagggaacagttccatagctttgtctggaagagtaccgcggtccttgagttgcctcttgagtgaccggtgtaaaagtggtctggagccgccgcagagggaaaatgttgttcttcgtagcatcttcgtcgccgtccacaacaaccgttgtctggccaacataacgcgggcgttgtttcttctccgactttgttgtgccgtgcgagccttcggtttttgttgtaatcgcgtcttccttgttatgtgcgctaacggaacctgatggacgcagtgtaccgagctctaaccctttcctgtcgaacaaagctggtcgacttttatgttgctgtcggctgtctctgcttaggaactcttccaccgctggaacaactgccggttgttcctcgttagtagaggggtgggaatccgtaggtttgtgtccccctgattcgcgtagtagtcgaaggcctgtctggcggccaatccggcggacagtcttagtcacattgcgtcccaatttggcaaccccccttcgagctgctcgtgccagtggaccgcgaattttcgcagctccaaaaataacgagaggtgtgtccgtcaggccctcttctcctgcgaggctatctatgtcaaaaggtcggaacgaagtgacggcaacactgatgaacacaagcaaggctgcacccgatagccgtacgagacgcgccatcgtgcacagaaaagcaaatcgatgaaatccctaaatccgcagagaaaggcgcatagaggggaagtgcagaatagaactcgcgttgcacttgcgccgcggcagaaacgtggtttcaatctgcagtctccgcgtttgctaggcataaacctgattggaagatgtggcaatacctgaacgaaaaacgaagttcctgccaaaacgtttcacagcatacctgcaaagactagcgaggtggattcgcatttcacaaagaagcggcaggtatagaagcgcgtgctgtgatggaggaaccaaagggagttctcagccgcattacatggcgatgttgccactgcgctattgaatacccccacctgcttaaaaacctgagtaacggaagaacaaaagtaacacgatattcacccccaatgagagttgagtttttggacgcctgacactgtggagcctggggttccttagtcgccagcgcaggtaacagacgattccccttttcgcgcgctctctacggcttccatcttcagcacaaccccagggagggcttgacgggaattacgagagaataggacacctgacttgccgcggtaacgcctgaccaaccttttctccccccattttcggacacacgcgcatccacccaccgggagagcgtgtcacttttatgttgtagaccagaagtagtattcctgccctttggggcttggtattttgagcaattagaacgacagacattggtatctagtgacagatctgaatatctgtcagcgcatgcgctagaaccaatgagaatgcagcaccttgccttccacctctttttgctagaactcagagaacagtcaaacaatattttgcgtcattctttgtccccaataaaggcaggtgacaatcaggagagagctaacccattttaatgagtgcttttcactctgcacaccataccaaacaaaagcacatccgcgcttcccttgcagacctgctctgctgttatggcgatggcttcgcggacatgggcagctcagtatttattcctgttggaacaaagttaactctccgaaacgtgcgagtgaacactgtttatttacagacttcactaactctgtagtgatgtgtgtgatcctagaaaatagatggatcaagagatcacggcacaccctttcaaacaggcatttttcttggcaggtctctacacacacactgacaagcggtaaaacacagattcggtctatgacacagtgcacgacatgtgcgtggcagcatgctggatcaggtataacgctttgtccgtgtcgcttgaggagcaggaagcaacaagagagacgggattcaactgtgcgtggatagaacgatgtacgatcttcaggagacacagcggcaccccaaagagaattacgtcttcccagttcgaaatgaatatccttctctgtggtgacaagctaaaccttcacccgcatcactgcctcagtgtgtagcgtagatccacactgcacacaccacgcatagcagttattatcccaacagtcactccgtgtttgcggttcaaccttcagaagtttaagaggggattctctggactaccaaaaaagatgtatttcttccactttcgttgcgacaacggatattgcgtgaggggatctggattcggctttaaccgcaaggtatgtatcagtgacccgctcgtagtacagttcgacttggcctcccaccttcgaagacgaacatcggcaactcgaagcatgacaaaatcaacgtgagctaatacaaaagtcactctattttccagaagacactagtgtctccatccccagaaagtacaaagttgtagaagaggccctccgggggaccctttgctgcagctccacacacgccggggtctccatggcttgtcgctcgcacctcgtcttggaggcccgagcgcgtcacccccaacggatcagaccttccaaaagtcccagtcttccacagtgtggtcgaagtacgaactgttttactcttgaagtttgtgattcttgattgttcgcagtctacgaagacttaagtctgtgacttgatacgttgtaacaaca

SEQ ID NO: 1642 - DNA, 2271 bp, Toxoplasma gondii
atacacgtatgagcatttacccgttgtagctctttacgcactatagatgttccttcatttgctcgttcatacagatgcagatttatatcagcattttcagtctcggggcattgagagatgtgtgttgaacagaaagggaggtggagggaagcgcatgcagatgcatgcgactttgtgaacatattcatgcgttccgccttcctctgcagatcgacgcctcagcgccaagaccggacaaccgccgttcttcactccagagcccctgcgaagtttcctttacggacacggacaggaatgaagaccggcctctccaaacagtctctgattttacctcaatatgtatatatatatatatttatatttatgttcctaacaggaagcatgtgcacgtatgcttatatcaatacccgtaagtctctgtgccgatggttagacacatacatacattatcagcccacaaatatatatatatatatatatatattcgttagctgcttctctgggtgtgcatgctcatgtctttgtcctatagttatacgtttgcatgtacggtttcgtcttcaggtcgacgagctttcatccttcgcccgtgaactttctgttctgtgtctgaatattttagacactgctgcaatcttcctcagagatgacgactctctacctgttatcctcatatatatatatgtatatatgtatatctcctttttcctctataatactgtgtctgttacgcagatatgcatgcacatatgtcctttctaagacgctctcttgttattgctacgcataattgtctgtctctgtgttcctgtacgactctctctgtctcgtcgccttcaacagaactgtctgtctgttggcatatctccatcaacacagactcttcactatttttttagaaggctggttctgcgattccagcaggaatttctctccacctgtcaaacactcccgttcaaagtattgggcaacaagtacttgcctctcctatatggagccgtagtcgctttctcgcgttgttagtgcggccgataaaagtgacgcacacgtactgttattggtcgtgtgaatactgggctggcgaggaagagccacaagttttcaggatatagttagaaagtcacgagttaaacgacaaaacatagcggtttcgcggtgtctccaccgccagacgcgcggttagatgtggacatcgatttgtctctccgaaagaaatccgttttttgtatttagctttccacttccgtcgctcttttctctgtgtaacgccagctgaaaagcctgtatgtggcgctgtccaagaaaaccttcttgtctgcgtttccaactcctctgaagtgagcctaacatttattgcggcttttcgactgaaacgactgggcgcatgcagagcaagagctccccggaaacgggcaaccggaggacggtggcatttctctgctgtcagaatcagacactttggaaaaagtgcaatccgaaagaacgaaaaacacagctctggagagaaaccgaggaaagacttgccttctggggcgcgggagaccatcgaggtggatgtacacccgagcaccgacacacacacacacacagatacagctgggagtggattgtctagcagcgacttccgtcgcttttgtcgcctgcttttatcgtttctgtcctttagcaaagaggctccgagttgtgcatccgaatgggatttctttgcgttccggctttgcaccttccctgacttctctgcttcctttccgcccttcgtcctcgagtctgaaaagcagcgagtcatctgtcggaagggctggagttttttgcggtgggtttctggttgtttggaaacatccgtccacttgaaaactcccgaaagatttccacttctgtgcgcgtgcgtacatctctgccactaggagttgcaagtgccttcttcgttagaacgttcgcatctgcttgtttcacagttgagtatccctcgcgcgtctcctggcgcgactgcctctgttccttttctttcctgtctcgctttgctccgcaaaagtcacctgtttattcacacaggcggaacgcgcataagcgcgccgttcggctgttcgtcctcgctctgttctctcggtcgggctccgtctcgctctcctccctgcgtctgcctgtttctcccttctttatgcgatcctctctttcctcgctctcctctcgcgcttctgtccgttcccctctccgatcggttgcttcctgcccttctctgaccagaactcctcgctgtcgcccgcagaaaga

SEQ ID NO: 1643 - DNA, 2703 bp, Toxoplasma gondii
agctcgttgagcgtggtctgcagggtgacggcctttgtgagagacagctccccgtgtttctcccaacggttctaccgaattgctattaggacagggaatgttcactttcctcttgacaactgaaactcccgtcacgccacgattggtacagcacaccttacctgagtcaggatcatgtcctgccgcagccgcagtgttcgaaagagctcatacgcatgacgagagcggagcttgccgctaagttggggggaagatagctctgaacgaatcatgcgctgaatgtgagacacgtccagctcgtttacctgagggcacaaaagagaaatgcccagaggagtgagtcacgcaaattcgacgactgtctctcggtgtatgagtggcacagtgtctcgcatatcgcgggacgctccgagtcggttatttagatcctccgccgaggtctggtgcagtgggtttgagtgatttcggtcttacaagtagtgtctgactctggcgatctgcatgtagtttggcttaccgcgagcgcctccgtcagcttctccaagaattgctgccagatcaaatcgactctgtagtcagttatcagctttctcagcaacaaggaaactagcactgcgcacaggatagtcaccagcacctgagggaacacagcacccacgcaaatggccatgcccgttaaattacacggaagatccaacgcagtgggcatgtgaaaagcgagaatcgagcctcatgagtcaaagacgaatggtgtagtttatacctcttccaaaaccactctcaggcgaatgcgtcactccgtgaacggaaaagcaactgagtagcgcatgctgcaagctgtcagtctgccctcacgcgtcccgccggcaacttcacacgtgaagaagctcacctgttcgatcaagctgtttccttttctcgaccgtagcgccagcggcaaaccatatccactaagaacagcatcgagaagacggaggggccgttgccaccaagtcaaggagccgctttggtgcgtcggggggggtaactggttctggattctcatgttgatagatactaccgacgtcagctttgttgacccttcagtcgcacactgcgtcagcgacgtggtgaagcaaccactgccactgtcaactagggcagagatgaattactatgcatgccataacgaggttccgaaggagcaaacgctccagaatcgggatggtcttgatgaggagataaaatatcctgacagtacgcgtacgataagagacgcgcagagctgcagtaccgcacagaagagaatgagaatgctggctccgcgaaaagtgccggtgaataaacaaagcaggcattcaacgcaggctgagtagccttcagcggctgagtctcgttgacaacctgccgcgaaagctccccgtccgcctcgtccgctcggattgaaccgcaggagggggaaaacacactttccttcgcaaaaatgtagcagtcgggttcggctgaggcacctcagatgaatgctaccatggattttggaaaaatctgagatccacagccaggtaaaattgaatcggcacatccgtgccagctgcatctagcgtcaacggcatgccatggtgagccaccctgtcgatgtttgtctgctacgagagacactgccatagcgggttcagggaacgcacagcgcgaggtagcgggtgagcgcttgtgagaggtgcgtcaacttttctcacctagcaactctacagaatattttttttacccgttgacctccatttctgcaaatattcttccaaacgaactgttaggagtctatggtccatgcgtttatgctcaggaaaagtagggcgttcaaatttaggcgaaatcgacatgcggacggtgcccagagtgctcttgaggttctcagaaacagtttgagaatgagtccactatcgtgtatcctgtaattcgatgcctaatttaccgggaacaaaccgaggagttgtttaccggctgtcgagaagttgacagcagtgcgaagcggatgcgttcagcggtggcacttcgcacaccagtgcgaaggcaggcaaaagtagagctgcgccatgcagaactacaaacaggctcgacgcaagcagaaaaaaaggctgtcgtgggttacggtcccgtgcataagcataggaaaaccattacttttgcggattttctccttcggaaaagggttcagagaaggacatgtccaagttgagttcagttaagcaacgacctgcgagctggtgcacccaactcaaccgttagcggcttgacagcgtctgtctgcaaagagtagggaaacaccgtgtacagaatatcttcagaaatggtgtcgttatattactccgtcaacttgctggttacttctttctaaaggcttattcaacgcgttagacgtcgaatatccactcatttccgggaacgaacttcacctctgcggcacacaaaatgtaatatggggcacgcacaggtgaatgttctggcctcagtcggcaacgagtaagcaggtatccgcatatactcactccttgaacagcaccattcagagatcatttggtgactcagactgttacgcaagtctctgtcagatactcgaaacagcactacagctcttcgcggctatcgagcgtcccgcacacatagctccttacgactggcgctaacttgtggaacgatgcgtcagtgattcgcctgtgaccggccgta

SEQ ID NO: 1644 - DNA, 2656 bp, Toxoplasma gondii
catttctacagtcccactgactgtctaggaagaggagtcgcgagttgaggaaggtggagagcaggtggcagcagcagacgctgtctacttcaggcgtgcagaagacgaggaaggcggcaggacgacggggagacgggtcattagcgaagtcgggggcatgagagagagtgttgaactggaagaaagagcgggaaaactcgtcaagaggaagcagcaccattgtggcgaagaaacgtcaaaccgcaacccagtctcagggcgcccgcctcaaggctctgacacatgctcgacaggcgacagtagcgatgcaggtggagagaaatctggacaagattcaaggagcaggaaggcgcgagttgttgagaggcactcgcgaggcccactccgcaactctggagtcccgccggtctgcgagagacccggagaccttcaagatcggaacgaacaggccctcttgcagaacgcactgcccagaagaagcgcgtacagcatcctgcctcagaaaagacgtgtcatcccacgacgagggggctgcctggagcggcagacctgcgagcgaagaaaaacgtctgcgccggaagtcggaaagactgtcgagaacgaggtgtcgaagacaaaggattgagagggacagagaagacaagacggggaaggaagcgagaaacttagaggagacaagagatgaaaagggtacaaacggcgaagaagacacgaaaggtggagaagataccggaagagggggaaacgagttatgaagaggaaacgagagctacggcagacacaagaaatgcggaaggtacaggagacaagaaacgagagctctgaaggaatacggaagatgaggcagaagcgagagatgaagatgcgaggaagaacaaagatacagcggatgaggaaggcacgggaggaaagaaagaaacagcgacggaggcgcttgacagcgcctcactgggtgttcatgcggtgttggccttgattttttagggaaatccgaggaaaaaaatcaagacgattcctgtaactcttcattaggagtgtgcgctgctgatgacgggcggcacaaaacacagagacgcttggagagccgttccagaagaaggtgcggaagaaaaggcaaaaacccgtgacatcccggcaagtgctgaacacttgctgctgaaggatacaagccgaaaaagggaaactcgtagggcacactctgctcacgcgctcttccgccaccaagtccggcaccgccggcccactagaaacttggagggtcgccaggggcgacaagaaacgcgtgaatttgctaaggggttccggagaaaaacgcggaacgggaactacctgtgcacggaaagtggtttgagaccggctgtacatacacccggctttgctgcgcggaagacaaggcggtgagctggttgcagctgcacacgaagtggcggttgcgttttccggctttctttccggaagaaacttcgggacggaagtgagtgtcgctatatggagtctcttctgttccgctccgaaacacaggccgacggaaacccggcgggtcacctcggcaaagtctccaacaagcaaggccgatgcgggataatggacgcacactcggtggtaaacacaatcgtgggggtcgacactcttctcgtgcagatgagcggaaaagcacgctgcatctggtacgggcaacgcatgcagcacgcgatgctcgggaccgactgccgaccagaatccgcctctttgtctcgttgactcggagcactttttcgccgccacgaaacgcgggagagaccgcctgacgaagaatcgacggcagaatgagacaaggggaaaatgacctgggtccagggagggcttagccagagaggagaacccgactgaaggtgattctgcacacaagtcgccgcccctctcctcttgcccttggcttttttgcgcgagactcagcttacaaatcacccttcctcggagcgctccgtcttgctgaaacctccaagaccaaacgagctgttcacttctttttcgggagtgggaactgaggcaaaataaccgcgacgacgtcgctgtcgtggctaaaacgttggggcctgcaggttttgccgttctttcccgtagatttgcctctcaaaacgggacgtggcgagaaaacgcatacgcgcttggcgtcttgccaagtgggtccgctgctctttttcttgtcttttctcattccgcccgcctttctactggaaacagacgtttcgtggtgttcctcttaaaaatgatccgtctgctgccaagacaattgaaatttccttaaacaaatcaaaggcttctcaggcggccgcctttgtttcgtatcagcttgactccggatttcttgtccaggccactttgccagtccatttatcttcctctccgactcgtttaccgcgccttctttcttccggcttcttctctgacagttttgtttcaaacttttcaacgcatcgcgaaattcttctgtgagtctcccggttgattgcccattccatccaagtcgcctggtctggtcgtccttttcgtgacccccctctgcttcttcgcttcttggtcgcttcttgttcacccttttcgacgcttcttttcccctgccgccttcacgtttacactctgtcggcttcaaggtgcttcctgctctgagactcaa

SEQ ID NO: 1645 - DNA, 1965 bp, Toxoplasma gondii
ctggcaaataatcaggcggacaagcagcagtatcggtcggaaggaagtgagcaactcagagtgcagcgaaacggaaccagtagctgaatatcagccccgacttacctaattgaattacctccggaagcggtgtctatggtaccggacagaggtcacggaggccgtcccgcgactctgatctgccttcatacgcacagcgcatcatcagtagtctaccgcatagtaccaaccctcagtttgtgaagtgcaactcaggagcaggtttagcatcccaatggcgcacgcaatgacaaagcagttgtcatttacacttggtattgagcatgaaggacaagatcttgatattcatgcagcgtatccgctgacttcagccaactgtgcgataagttcgcatcacaacaccggagcaaaaagcttctacaagacagctggatcacacagaactggtggtagtgaacacgttttgattgtggatctagaaatccgctaaaggagcaagtggatctgggtgttctacaatcattactatcaaagtgacaggatacttcacctgtgattattcaggagggctctgatgataagtcactgtattgttgttgaagtttgctgtccaagatccctgaaaggactcgactcagcgttacatttagatctgtgtcacctgaacaatactgaaatgtaagtgctgaataaattgtgatccaaactgcctggagcactggcatggagagctgactatatgtccaatcctgctgaaataaaaaacagatttttggacagactctttttctgagtcaaaaagaagacagccagactccagcagttgcatcttactgttgttcccatggtattttcctgctgatttttcccagactgtgtgctctttctatcggattcatccccatggtgttgcatatatggtatggagggcttttacataacaagcgctaaaaaagaagcatggcactgacggagtttcagcgagtgcctcggccgagttcttctacagcatattgtaaaagaaatattaaatgctgccctctgtagccatacggcgagtcattcagggtatgcatgctttctcgagagctgacgcggcaactgcatgctgtcttgagctccgctcgcgcgcgttaactccgtgagtccctcgacgcgctcaaccagcttgcttgtatcagatctgcccggaactccccgtcatgtaaggaaggcggttttctgttgaacagacattggcgccttgaggttgaaatgcacttcggagtaggcatccgtccccctgtttctttgggaaaggagcatcctccctccctattattaccaatcaccataatgactgtcggtgtttgcggtggcgaaagactacgatttctgagattcattcagcacaacctcccccctcaaggttctccgccgatgttcacgtatagttaaatcgtcaagggattcattattcgtgattttcttcttctgtgaggcctacttcatgcggcgattgccttagtgaacgactgatataatcacaccccagacaacgatcgttagtctcgatgctggcccgtcagcacgggaagcactctcaatcagtggcgtttgccatgcgtagcgcttcatgacgtgaaacgcttgtgcgaccaggttccttttaaacaaaaataaaaggttttctctgttacgcatcttattgtctcacgcactttgtagacttcaaacccagtcaatcgggtatgtatcctttctgaccgccggaaaagtcgtcttctatacttttctaacaccccggctcaatcgatttttcacccatccattaacttttttctgtttttccctcattcggattactacatgagataaataacgtgtaaccggacaagtaaccgcgtcgtctctaacccctgtctagcgcttcgaatagtacacgcgttccttcgtttttcaaggaagtgaatcgcccggtcaaaa

SEQ ID NO: 1646 - DNA, 4630 bp, Toxoplasma gondii
cggagcttgtacaggccatctggtgggagcactgcgagtttcttttcgatagttttgctgtcgatcaggagcctgaaagagatatattcgagaaaaaaaatcaaagcgcagaaagcaatgggtgagcggaaggggctgtgaccttttggcgctggagcagaaacacatggaaaatcggggggagaaccactccattctcagtatggacgccatgaatgagccccatcatgcgaaacagcagacgcaagaggcgtaacacattcacattcttggatctcgccttctttcttcacctggaaacatgatcggtgtccaggaggtcttcgcctagcgtcgccgcaagagtccccgcgcacaagcgccttaaaaactcgagttggaagggtcgttctgtgagtggttgtgaaacagttcagaccaagagacgtcgaacggctttctggcatctgctgactcctgtagaaccactagcagcccggcgagaccacgcacgcgcgtattaaatatacatacataaattcggatacgcatgcaacgtttaatggagaatgtctgacggtgcattgtagattcgaatgtctgtagaacagcttgtaaagacaagttgtgtctaggcggagacagacatttcagtaagttgatgatacgcttctatcagctgttttcccccgtatttcctcgagagaagagggtgggcagttccgaagttcgtacccattcatgcgaagaaccttgcgctctctaccgctgcttccttctgtgagatacttccataagttggacacgacgcctgttacctgtatattcgataaatgcttgaacgtagccgacatcgtccgctgaaaacgaacacagccacaaaatagaggatgcgtttcgatgacgacatctccagccatacaaacaaaatctgtgaacgaggaacagataaaaacagaatagttgctacacaaaaaaatcggaatggatcgtctgatacgatcgttgccacctggcatatttcaagcaaagggaccgaaggtctcggcgacgaggcgccgctgtcgcttactcgtcgatttattttccacgggaggtcaccgacagagggaatatctgcgaatcaaagagatctgctgtattgaccccatggatacagcatgcatggagcttccttgctcactgcactattcaccggcatgcctgtgcgcgtctccgccggagggcaagaccctgcatgtccttgtttggggtggctgagctactatgcttcgaagcaggggaacggttaccaggcgggcagaggagagaggatcttaccattgtgaccgaagacatacggaataccatggtcatcgcggtagacatccacacccgttttgatcccttgcaactgaaaataacgaagcaccggcgactctgcagaactgcagtactttccttctacaaaggaactgctgcaaagagaaaatacacttttcacttgagaacagagaaaaacggagtacagcacttcgttaatcatcaacaggaggggctccaaccctctggaagaaggcacgtgtgacggcgggcgcaatgggaagatgcgggagctacgaaaaaagaggtggcgaatggaggagagagctgaatcaccgaagaagagagcaaggaacatgggcagaggagaagcaacgaaaggagaaaatcacaacggatttccatagaggcacacgttgaacagaattcaaagcgttacctcgtggtcgctatcccagtacgcttcgttgatggtgaagaactgccggatgacagggagagtgacgaacgagaggagatacgagagaaagtcgatcaccttgcttcctggcctgtgtacagggaactacatgcgaagagagaaaaggacaaagccgacgcgtggaccacacaaattagggataaaaaacgactaaacataacagaagcttaggccttgcttcgcgaccccacgacggggtccttcaaatgaaaagtaatgtctgtcaaaagtaccgtgaaaacttgatcccaaatataagtttttgccagcacgaggggtcgatggctgcggtgcaaactgaacaagacgcttgtcggcattttctgtcgctaacagtgacttccttggcatgcctagcttcattggaagcgggcagagcatcaaaaactgaactgttctttcttcttatcgcgaaaggcgtcgcctcacttgggtgtggacgtaatattgcacgagggcggcgaacaccaagatgctcaaggcgctactcgcgaggatcatgtgcccgccacttcgagccatggcgacggaggttctaagaggttctgaagctgaagcagcaaaaacggcacactctgccaccgtgagcgaatttcctggaaagctcctgtcaatcgagagtcgtgttgtcggactgcctgcaagacggctgccattcgagaatgtgtggagaacacacacacacacacgcataaacacacacacacacacctggtgggtaagggcagcgaaagcgcgaaacgtcctgaatgaaggaatgcgatcgacttcttgttcaagtttaaaaatggggtctcgttaacctctccactcgcacgatccggactgcgataccttccaaccgaagcgaaggacacacatgccagctaggcagcacatgaatatctccgcaattgacaattgcgtgttgttactggacgccgctacatttttcgcgaaggcgtcaacagtccgccccgcgtcttgcctttcctcacctacatcccctctcggttctttctataagccccacacactttcgagcgacccgtcgtaggttcatctacaggaagacacaaacacacagacaagcccgtagagattagagagatgaaagaggcagctcacctgttcgctgcccccaggctacgcgctctttcgccccacccgtggaaagatccactgaactgagccctagacagacttctcaagcggctaggacatgaaaggctcctactttgctgcaacaggaaggtgtgtggaaaatgcccggatgataaaacggttgaaaaaacctggaccccatgagacgagggcgcgtgcggtccggcgttcccgtaccggggttcctgccgacagtgtgtatgcacaagatcttgtccagtctcgcacagaccaaacaaccttaaccagtctcaaaccgagactagcgcgagccggccggaaagcgagaaacggttcttccggtcaatcgaagaagaatgcaagcggttccatccaacgagaacgaacagagagacagcaccattcattgttagcgggtcacgctctcgaattttgacgctgaaaagtccgtgccgatgtggcttccggtgtgagggcgccagtgggggcgagggcgagacatggctccagggctcaggctcaatgagccagaagccaaggaaagatcttgtcgacaaagtgcccagacagctggcctagaactcaaaattgaagggggtgaacgtgggagaaaccactaaaaaccaggtggaaagggagaagagagcgtaccttgacccccgtccctcgttgttgttctcacgccgcgtgtcccagtacgtgcgacagcctatgagcaggttttgtctggtgcctttctgtgaaacctgtagtactctagccgtgtattggaatggttgttgaacagactaaaaggtgccataaacggagagggaacacggtagggaaaggacgtgtcactagatgaaactggtctctgcaacaagacatgaagaaggcagacaacgattgtcgattggagttacaggatcgttcgccagcacattgccatctacgaaacgcctcgagacagacagcgcatgcaaagaagcgaatacaaacgactgtgcagggtcgagacatagagatcagatacaattccaatgtccttcagaaagtaaatcattttttactggagcaagctccccgtgaaagctgcccctccgccacttcttcttccgcagttacctcccttctttttcctgcatctttccggttgcagcccgtaggggagcgcccggccgtcttcctggaggtggagaagaagattttctcaagaaaacaggaaaatctcctatcgttactgcatttgcttcttccaatgaaagccttttgagatagcaagtttttcttccaccataaataatgcgagagcatacctcgcgtcgtccgctctcccttcggtaggttgccccgctcaaacgcggacgcggattgtggacctcgcattactgttttgcctttcgttgtttcccgccttctttatcagattcgtccctctaatttagcgtttgtccgacaaactctcctggggaaggtgtgggttcactgtgcatccaacttgaaaggaccgaccgtgtagagggaggagttgcggtgatggggaagttcgtcttcgaaaccttttggctgtccagccctctgcgacgctgcaccatcgtaaagctttaacgtttgttcacatttgcttccttattcgaaggcaccatccctttttctcttgctgcctctccgccgttggcctctgcttgtccgacctacagtccccagttgtaggacgggtgcgccaccacccgacgtataaacgggtctctttctgtttgctttgtctcgagaaacacacaa

SEQ ID NO: 1647 - DNA, 4212 bp, Toxoplasma gondii
tccctctcgcctttgtcgacagacgttcgtcaaccggagatgacgcggatgaagaagaggaagaggaagaagaggaagaagaggaagaggaagaagatgaagaggaagaaggggcagaagcagggagggaggtcggagagggcgaggaagctggaacagagacagggcctttcagacgcgttacagcttctgcaatcaactgagaggaaagaaggcacatcgcatgccgacgagcggctctagcgagaggagcggaagccggaagggaaccggagggcgagagcgacggagaaagagctctcgatgcaccacagagggagaaacagcgagactcacctttcgagtgacccaacagatctggcgaccacgacagaagaaaggaggggaagataacgcatgcacaaatgcgcgtttgccgctcctgatggggaaggattggaggcggcaacggtgagaacaggcacttcgagatgttcctggaacagagaagactcagcgccacgcaccaacgccccatcatcgacgcctacctcttgctgcttcggtctcaacgtttcgataaatttgtttattttcgcttgcgcgtaagcgtgaggaagctgcagcatcaagagtgctgtgatctcgacagcggcgctgcgaatgtcgccagaagcagattggaaaatttcttctagaagagcaaggagaggtgagaggggaatgcctccgggagcccatggctcgaccaagcagaacgccgagagcagcgcgacaaagagctgaagcagctgcgtggtcgatctgcgcgaggcaagccaacacaagaagggaatagagttctattgtactttgtgtttctctctggtggggccgcaagtagcggagacacgactgtgccaaagtggtgtgtgcacagtcagaaaaacgcaaaggaaacagttgagttatctcgaggtcgagctcgtctccactgcggtgcctgtgacagaactccaaacatcgacaaccagtaaaacaaggagacatccagacacagcaactgggggctcgtcagtagagaaacgagtgccgtatctcccaacaagacgacgcaagggaagaagccacacgaaactttctgtccatcaaatctcgtcttcgatattgttccactcgacttttcagacgtgattccgttctcgctctcgggggcgttgccttcctatcctcgctttcccgtggtggccaatcgctagctttctcgtgctttacttttgaggactggatgcgatcgaaacacccccggtttctcctcgcgttctcaacgttgtctccgtgcgagtgaggccgccccgacgtctgcctctgcctctgccctcgttttgcctgcgcttttcttcttctttcctgtcgacggaaggagtgcctcccaggctcttagtggccgcgaagccagacgtctctttgttcaccggggccgcgacgcggtgcgcagctgagagcctgtcaaagatgtccaccgcgaggggtcttgcaacttcaggatgcgatctgcagagcaggagaagcagacgcttcgctcggtccgagaaaacgcccccaatccgaagcagtaactcttgccgcacaccccagaagggagacgaaaggaacagccgagaagggaggctcggcgcgtccagaagcagcgacaggagatgtgctccgccgaggaaaatctatagaaacgaaaaacaggaggactgacagcgtagtgagagagcaggacaggggatacgtgacggcggagacgaggacgggatgaccgacgagcaacgtagaacaagaggtggacatcaggctgacgaaagagacagaacgtggatcaagggcaagggacgactcaatctgaggaagaaggtgatgatgcagtggcatccgaagacatgagaaacgaatgtgcgtggaagacgactctcgcgtggaaggctgcgttcgtgaagaaaaggaaaaagacttgccgtggcacacgatgagagacttcggttctcaccttgagcggtttatccgccaaggcgctttggataaccgggcaaagagcaacaaatacttcttcgctgaccatctctgcagagcaaacgcagactgcgtgtgaggagtctggcttcactttttatcccccgtctcgccccgaaatctcttctgtgggtttgcttatcctttccttcactccccgcgatctctctccttcttcctctctgtccatgttcgctcttgtcctcccgctctggctgcagatccctttccgtgaatcgtctcttcgatccaccaccccctgcagtctttcttgagtcgcgaacgcagagtctcatttagactcctaggccgtagacacgcggccgtcagtggtgcgtcaactaaacggtgccgttgtggcggtccgtttccccactcgctggtggaggctgcggacgcagacgccctgcgcgttttctccgcttccagtgagcgttagactgaacagcggaacgtgtgtctttcgagggtgcgtctcgagtttgacgtgacgcgaacgaccgtcaatgcccgttgaggaagtctccaagcgacaggcacttgtgaaaactgcgcgaacgacgaggaggctttctctgtctctcactgagttccagagcagcgcagtggtcgtacaaccatcgctctgcctcacgggggattcttcaaacgattctgcaaagtgtatccctcaagaaaggaacaacgcgccacagtctgacatgcatggatgcatggagaaacgcgtgagaagaagagcgctctttccgtccccagttttctccgtcctcaccggggtgagcttcgagctctttcgcgaccgcttcatgggctgcaacccgtgttggaatatctgcggcgaagagggcaactacgatgtctctggggaagaagggaagcagcggcgcggcgtcttcttcatcttccagtctcaacgcgccgatggatggcatctgacgcacagagacacgcgctacatccgcgatcctgaaaaaacgtcttccttctcccagcgtggggagacaccccgctcagaacgcgacaggtacaaaagcacaggcgagtctccaagtggaacagatgagagacgctggagatctgcgcaagggactgatcgtgtagtagcgcgtctgtcctggaagccggaagaaaggcttggaagcgctcgagaattcaactgaggatcccttgaaacatgccgcagataccctcagagagaaaggctgctaggaacactgctcggtcgtcggcagagacgcgaaccgagaacgcacagagccggcaaacgcaaggggtgcgaaggaatgcaacgcgcaagaggagaagagagagcgaacgaatacggagagaaagagaaagaggagaaggtgaaagaggtgaaagggacaaagagacatggagagaaggacaggaatggagctgagagatcgatggcacagatcgacttacggggggaactgcagcttcgcggctgctcatgtcactttgctttggagactccaagaggagttgtcgctgttgctcctctcgcataggccgaatcgggaggtcgtcgagggagagaggaggcgaatcgcgtaggcagcctccggtctcagagcggctatccgttcttgcctgagaatcgtgactgcgactttcctcgcaaagacgacgagcatagtcacacgggcagagcggggtcgcagcctcaggaaggatttcggaaggtcgaagcggcgaggcagcagacggaagctgaaccgggagcgaacaaagacgggaaacgacagacttggcctctgaaagtgaagagagaacaaccatgttgttacgacaaacgagcagggtgtgctgttgggtttctggacagagaaggtgtcactctccgcggaaatggagacgcgaaacagcgacgcagaaggaaagaaatcgagtccagaaatgaagcaatagaggcggaagagacggtggtggctgcgctgcatcttccgagactccacagcttgtcgagaacggatgacgttctcgttccctctctcgctcgttctctttctctgtcaccttcccttctctttattccctcctctatctgttctcctctctctgtccgcctcgtcctgtccggcttttttgtcaccaactcgcgtctctctctcttttttccgattctccgtttccttgccgtctgtgttcagttttgccgctggatgcactcctctcaccttctgcgcaaga

SEQ ID NO: 1648 - DNA, 2304 bp, Toxoplasma gondii
atacaggtacagtgatctcgattccggtatgcctgcatacgtctttgctggtgctagcggcttggcgctagactccggcacattggttttattttggccctctcgaacgtgaaacgagtagctctgcttcatgcacattccgcccaggagactccatgctttgcaactgcctgcaataaaaagaagtgctctactacagtgaccgacaaattggctagaagcggtgaaacaaacctcatggatgctctcctcgttccacgcacatcgattcgatggggtgtgcctcagagagcgtgatgtcctgactggaacagaggcactttgctgcagcaacgaaaacacagacgctctcgagtccttgaaccgccactgcaggcgaagtacaaaacccaagccaagcagtctattaccactgaccgccttgtaggcagatcccgggtccattttgcgacacatggcacagacagtatttacaccacagaattggccttttgttccccgttgcgaactagaaggcttgcgccactccacgagttcttggaacttcctcgcctccactgtcctctgtcgagaagctacgcaatggttggcgggaaatgccgagctacagcagaggactcgcagaaagacacggatggccgacgaccccgtgtgaggtcagggcggtttttccccgtcagaatcatcaagtgcggtggcagttgagttcgagaggcacatgcgtcggatctctcttcttttagctgtgtggttcggtgcattcaagctatcttgcgagagcgtattacatcgagatctttacgaagatgggtcgcatcctggagcaagtcaacatcagccgtgcgcatgagctgtctgtaacgcgtacttgattggtcttcctttttgcttgaatgtctcttcattgttgtccagtagtctctatatcaatcagtgatagtagctgaaactgaagtcaaaaatgtggattaaatatactgaacaacctccgagcaccgaacctcccgaaagtcgacgtcgaagcttttccatcttcacagagagttacatagcaggatccttggtatttgcacttcgtcgcaaatcgtgcctctcgacattgccgcgcttcacgaagcctcatcaaacatgtgcagtcgtggaaagaaccgtagacgctgaaaagcgctgcaccctccacttaggcgattctcactgaagaacacgttagagttgcagtccaaatacatatacatatatatatatacatatatatatatgcgaacaaagttatgtccttatatgcatatgtccttgcgtagacaaggcccaacacgataagcgactagattcaagaggcagtgtaagcgagagactccagggcgtcggccatgattcctggcactgcgacaatcggactttctgtaccttctctggtatcccagcagacaaccctttgcatgcttgttttcgtggacgacccagccgacttgtgagtgtcttttttctcgttcaaagtttttcttttaaactgaactttcaggtgaaatatccgatgcattcacctgccttcttcgtctgttattcgttttgtggagcttgcacacggttgagtctcgcctgcatgcagtgtggaccttttcttgtctttgctacttttcgcgtcttcgacgaaaagcgattgcttctcgcttctttaatcgtggtttttccttgacactctttcatggacgaaggaaacgagcaggttttctccttcagtgtgcagattccaggcgaatacccgaagtccaattccagcctttccgacccgcctacgtcgtgtcttcaactggcacacaacgcgcagaaaaacagagagactcgccagtgactcgcgtcgaccggtgcgaaggcttctccatgccttcttctgtgggcgtcaaaatccgtttgtctacttcatctcagttttcctgacggccctctcgtacccttccttccctggcgactctccgttaacacccgctgggattccgctgtctcgcggctgcttcggttccccagcttcctcaacgccttgactctgtccttcgcaccacgtgatttctacctttctaccgcacttgcagttccttgctgtcctcctctgtccgcctccccccctttttcgcgtccgcttgctgtctgcgacaaaaacgccgaacgcgccctctctgttcgctcggtacgagacacaaagcgttcataaaatgtgagtcttccagtgtcgtctcggtcgacaaggtcgccaggaacggcgcgcttcttctgagcgcagcgattcaacctgcaaaccaactgaaa

SEQ ID NO: 1649 - DNA, 1861 bp, Toxoplasma gondii
atgcatgtatatccacgtcgatcagtggatatcggcaactctacatttgtgtctatattcataggtgtgtacatgcatcaggtagatttgcatgtctccacaacgatgtgtgacaacaccgtgcagatttgtttgtatttatttgtagttgtttctgtctccctgtagcccgtgtgctggcagatttcacacttgagaccggttttttaagaggaacgcatctctggcaatggcttttttcctgtggcatcgcttgactcgagaaacgagaggtttctgagcaagccgtgaattccgtcgctgttcggatttctagcgagttccctcaaacttttccaggagtgctctttatctggagcgcgttccctgcacatgttggtggaaaaagtcgcgaacggtaatcccctctccagccttctcttactcatgcgctgcctgtacattcgaggcttctcacagaagttttcagattagcagaagacctcgacaccgtcgtctgagtcttcggcctcgcctcccttccttttcttcctcctttccttttcttccttctttccttttcttcctcccttccttttcttcctcctttccttttctttctcccttccttttcttcctcctttccttttcttccttcgttccttttcttcctcccttccttttcttcctcctttccttttcttcctcccttccttttcttcctcctttccttttcttccttctttccttttcttctttcttcctcctttcttcttcttcctacctgcgttgcggctgcggctgttcctgactgcccagaggcagaggcgagcgtcttcgcttcttgacgactcggcgttcaggccttgtggcgttcggaagtttccgccgaagctcgaggccgcgcagaagaagcagttcggccgacaagataaatggaaagcaggaaaaagacgaagacggagacgcagagaaaggcaattcgaagtgtgaacgcgcgagttcttccactcgcagcaaagaggccggaggaaaaatcaaagagactgcgaagatcgcgacctcaaagtgcatgcgcatgcgctcgacgactttcttcctcgccccacattctgctctgccggttttctcgagttttttaccagttacaacctattcttccctggagaaagtctctcgccgtcgtacgcttctttccggctcggtctcgtcgcagaagcgtttctcctctctgcgatttcctcctcgttcaggctgtgcgactcactggagaagaagtcgttctttgtttgaggagaccgcgagcgaccgactcgtcgtgttgacttttcgcgttacgtcaacagttgctcaatatctttttctcttctctctctgcgcgtaggaagacaacagagtctcccctctctttcctccttgtggggattgcaaaagatgcttcagcgccagagagacacgcagcgcaggacggccggagttttttcgagagagtttttccacgttcctgaattcacggatgaggcaaaaggagtcggaaaacgaaacaacacaatggaggcccctggtgtacgtacagtctggtgaagagacgcccatgcgttttcaaggtgctctgcctgtcgccttcagcattcgttctgaattcctcgtctccttcgtctcgctgcttgccttcctcgtctgttcttctctctcctctccctttcctccctcctatcgtaatctctttaacgaatcgctgtccttcctgtgcacctcctgcttctcttcttctcgtcttctctcttcttcttccccttttctctttttcgcttctctttttcgcttctctttttctcttctctttttctcttctctttttctcttctgtgtgttgtcctga

SEQ ID NO: 1650 - DNA, 3488 bp, Toxoplasma gondii
gcgttattgtctcgatgtggaccatgcggcgcacactgtttgattgctccagtcagggtggtgcatttgatatcgcacaaggagatcttcccgcttattccagtgacagtccgaccggacggtcagctgagacaacagtggtcaattctgttttggcgcaactcggaggccgtcgctatgctgacgagttatctgcactgcaggagagtgtgcaggacctccggaacgagctcgcggcagtcacgacactcgtgcagcaacatgcggcgttcatttctcaattcgtagaaaagcctacaacggtggggcgccgccaaggaggaggggctatcaagcatgccatatctgcgtcagtagaaggtccaccactgccggacgttccgcagctgcggttcgccttagccgatgcagaggtcgcatcccgaagtgcacagagcgcgaattcaggaattgagagggagactgccagagcaggcgacggcaacaccatgggggatggcttacgtggcactaatcataacggtggtgtgctctcacagaagtcttttggggcgagtgttgcgttagaaagtacagtgcggggttctggagataatatgctggacggtgagacacgcggtaaaactgcagatgctccagaaggtgttgagagagttccctcttcagctgcagaacgtagtggaggcgcaggcaccccagatgccgacacagcatttgtcacagaccgaggtgtagacactcttcgagacggtatcccaagcgacgatgacaagaagaaaaactccggtgaggcggaaaaggagccactgcgagcggatgcaggtggccgacctgcggacaatggaaaagccgcagatttagcaagtagcccgggcatcaaaggagaagttgaaatactttcggcaagcggagaagttgtggcacaagattccagagaagctcgtgtcaaagggctggaagaagagactggggccggccggcggggttttctgggcgttggaggaaagggccatggcctgactggaggaagacttgacagattgtgatttgcatgcaaactgcacggtagcaatctagaaggttagtgtgttttatcgttcgaagttagtttaatcccgggtgcacccccctgcccacctctcccgggtacctcgcgtttctgaaatacttcttttttacagtcgcgcaccctggaatgtacgcctgtgctgtcgcaccttcaaggaaaggagagtgctgtaatctgacataaaacgctgtgtagtatgttggaacgcgcaacgacccacgtcgaagaccacattttagttgaatctgaaatgaggacattccatattagagccgttgttcagtgaaaaattcgtacgtgctataccccttgtgcctgtctccagcatcagctgatgtgacagataagaacgttctttgaagtaggtcgtattgccagatcgttctctgtgtacttgcccatgctcatcaattttcctttgttgtggctggaaacactatcgcggttcgacaaccaggactaattagtggtcgtaatgagcgactgtgaaatcacagcgctgttttttctgcgacgccgccgcgtgtaccaccatcgaatacatgagctttgattttatgcgattcggtgctctttacatgattcagctgtgactgcttaccggaatacgcgccagttggcgcgggggagagtaaataactagagcctgtccagtgtaccaaggcacatgcttgcctcagaacaaaacggacattctaaccgccttcacgctcggcgaaacaagtgtcgcaccgtggcagggtgtattttatgcgtatagatagctagaagggaactccgggcaatttcctacgtccatagaattcctagaagcacgaacttcgctttccttctactagaactctcctagggttaccagtggtgtttcacggcgctcgtgcatcagatttactgtattgacaagaagggtgcgatagtttgctcagtgttttggtaagtgcttaggaatgattcactacgtgtcattctcgtgtgacgtcttggcactgtttgcctgtggacgtagtagtccccgaacagcagctccaaattcacctggtttcgcaggacaagcggtatttcgctttagcagtactgccactacccggacaactaacagaaaagccgacatcccttgttcaacgaaccatgttctgaaattgaatttgctctttctacgttaggcaagacacatggtgatgggttatctaactaacatgatgatgtcaggtcgctaaatcgaagcggtgtaacttcaggggagctggtcacccctgtcgacgacttgtatagaagacaaaagtaacgatggtgaggaacctccacaatcgtcatgattatacgcgtgctacagggctccgtggagggaacggcaggagaaccaagactggctgctcagaagaccccagtggtttccagataagaagaaaggtttcttgaacatgcactttgttttcaatgttttgaatatacacaactaggtaaagtcgtctaaaaaacaggtggtgctcgcgacagcctgtcaacctctttcaataggatcactgtctctaccagccactgatgatgactgcatatatgctccttcgatacgctccctggtagttcacattcgcacaacgaggggatctgaatggaactcaaactgcaacgaaatttgtgtcccgcgtgtttttgtttttgatccccaaggatcagttatacagtttatttcataagatgtgtttcattgaaaaataacatctggtgagctaaaaccatactttgatggtgtgctgtgtcaaccgcaacaacttgcgcgctggtttgacgcagccccaagttctctctcctggaggctacgattgaatttatgatcccacagcaatgcatgaggaaaaaataggaagtttgctgggagcaagccaattccagacccttaccacagtccctctaggtagacgatgattgactctggaatcactttgtgatagtgtctctctcggatagacgtaattcggaagagggcgtattcggctttccggatgctacctgtgtagacatgctttttcgcctcgagcgcaaagccgtcgttgtatccttttgttctgctgctttctgtatgtctacttggcacgtcgtcactttcgcaagcttattcttctggtaacgccggccgggtttgccgatgccgatcaatctctctttccctgttttcctccgcacacacataggtacacactagctgtgacgactcatcaaaaacgtttgatcgcctggaattagtaccagtctcagcagattcttttataaagggatcatagtcgggctgagaaccgtccattttggccatgaaagacctcgatatcgataatgtagagctttctgtgtcgactttcgcacaccgatgtggcttttcgttccaggtaatcgctgacactttcgttttttcctctcgcta

SEQ ID NO: 1651 - DNA, 2715 bp, Toxoplasma gondii
tggtgggttgtaagatgccacaggcgacggaaagaggaaatgaacgagacaggagctaggcggcgctgcacaatgcgtctggcgtgcaagggagagcgcttttagaatgcatgtgaacatccagccgaagttgacaaaccaaagaattgtgcatttctttttcatgtgcgaagattccaccaattcagaaatccccacagggtagaaaacgggttcaggtgtttttcaagtgcattttaaagcatcactgctgaaacaaagtcgcggcattcattcaggaaactcctttctgagaacctgcatcgtgaccagcatgaactgaggaatcacaacgattgatcactgcaagcccaaagtgcaaacaaagagatgtggatgttttcctcctgcctacaaagagctctctacaaatagagatgccgtctgctctcctcttgtacatatgggaaggacgtggcgcctctctttttcttggtcccaggaggtgctcataaagtcacctggtccagatctacgaattcctctgaaccatttgtctgctgccatttggcagcttcgcgtctcttgttcttctctgtcgctcttatttctctcatattgtgaagaggagttcgttgcactccctactgtgtaagaccttcgcatttctcgttcacttagatgtgcagcggcctttagagactttgggtaccgcgagtacgaaacagtcaagatgaaagacgtcgcctttgtgcacagctctgaacggccgcacagacatgaaagcttctgaggagtcctgattgaaaaaggacccaaagctgagaggtgctacgcgatttgagacctctcccgcaaaaaagtggattttcagtgacagcctgatgttgtggttttgtgtactagcggcgcaatcacacgcgaaattcttcacaactcgaagactttcctcatcaagcgcctcctagagttctcttcagagtgccgttcaagacacgcattatgccacgaccacttcaccatggctgtatatgcctatacatgcgtatacgttcatttttggatacaaacgcggatatgtcttatacttacgtacaagagcagaagagagaagtgtgatgactgaaagaggaaacaaactgtgctttctagaagagaagcacacactgcgcggtgtgaggcatgtactgtgaatcggggatggggattttcgcgtgttcaagaagtgaacaagaaagccgatcgcacatgcgctggttcccgcatgaaacgtctcgcgtcactctctgtttattccgctgtctgttttccgtgagtcttctgtttctctctttttccgcgttcttccaaaaagaaagtccaagcggcaatcgcggatccgccaacacgcgagactgagagggggttgggagaaagtgaccccagcgatcaacaggggtgggatcctgggtgttcgacggtggaaaaaactctcgttacacagtgttcccctatttttctcgctcttgcccgcctttccatttttgccaaagacattcgagttccttaaaaagtggtggaacggaactgcgtctgtccgggcgcttcctccgctaaaactgtcgcgaatctggaacacacgcgttccgccctcacctacacgcagctgacctcggttctctggacggagtgcagaaggaggccggggactgtggcgcgacgagttttttttcgttttttttgactttctcgagagtgacggcttctctgatcgcaggcgggggtgcgtaagcggcgttctgtgcagagaaatccacttttcgcgtgtctgccacgccctcctccccccacctccctgcagctggtgggtggttggtgctaaacgggcagttttcacagcttaacaagcttgtcttctgtgcttatccacaggtttcaagttcgctgcagaaccggatgtgtctttcggcgtgaacgagaaccgcgaacagacgtcttttccgcggaagaaggcggcatcggctcggcgagtcgttcagccgcaacacctcgcgtctgctgaggtcccgcgagacagcaaacagcgagggcgcgacagaccgacgaagaaagagatgatgcagaagagagcgaaggcgaggaaagaagcaggcagccagaactggagagcggaggacggacccaaggcgaaaaagccggagacgaccgaatcaaatccgcacgggagttcgagaagacaacacagtgtgttgaggccccgagagaggagagaggggagaggggagaggagagcgcagccggtgtgagaagaaacgggcaaaggacgaaaagtacgacggcgagtccgaggactcacgagctggaaaaaagagaactcgagagtgtatgcgcagcgaggaagagaaggtgaaaacacgcgacagtcgacacacacaagagaggaagaggcagccaacaggtgacccccgagggaaaggcgaaaacgaatgtttctttcttcgttgtcggaactttgccgacgacgcgggagagcgactgtggcccaggtgtcttgcgaccagcctgctttttcacttcctggaccgtccttttcttctgctgttccccaggacgcgttctcgtcttttcgtctgcacctctttctctcttctgtcgagagcttttcttccttctgaaaccttctcatttcttctcttcgttcggtttttttcgccttcttccacgagccttttcctcgaccacactgttcgtcgacaa

SEQ ID NO: 1652 - DNA, 1479 bp, Toxoplasma gondii
tgcaaacctgaagagaaagcgggacagccgacacaccgctacgatctccttgctgttggcgtaggctccgcaaggccgacgtggcttgagctagaaatctcttacctcctctgcaacgtttaccgcacgctgaatcgtgtccacctgcggctcaaattcgtactccggtctgccgtaggtggtgtccagaaacaccgtgtcaatgtggcagttggccagtgcagggtggtcgaccatatgacgatcgtagcgaaaatctcccgtatgtaagtacgtttttcctcctttcgtcttgcagaggaacattacagctcctaaaaatgcacattcgtctcgaaaacgactcacccattcaaccaggaggaatctttccagtccgtctagcaatcaaatgcacaccgcatgagcggccgtttacgatatccagccattaaggacagggtagaaggcacacgaaactatgcggtgagcaatatcctccagttaactaccaggatggaatgaccataggacgacctacctgggcagtggtttgcatccagaagcgtgactcgtgcgtcagcaatttcgtattcggtgtcgagatctaaaccgcggacaagcgctttgtttacgcgaagaaatgtgatgattagccttgctgcaaaaacacacggctgcacatacatgagagccatgagctgtgtctccaaaggtgtatcaggcacaatttatgaaaaactcgtactcacagccgaaaaccaactgcggtctgtttcatgctacgttgcttgcgagtctgcaagtcttaccggtcagcacagagcaatacacaacgcctctggaccaagaactagacagcccgctgtaatgatcagcgtgaaagtgagagagaaagaaaacgaaagatccttttggcaccttcctgaacgtgtcaactaaaaccaagggctctgtttcaggaacaatatgggaaacgtgccgtgatgcggcaatagacacactagccatgttacgccccaaacacctgcgttcgaaggagacgacgggaaattaactacacataaaaggtgaacaacgtctatttaaagagaatgcaatggctaatgcagccatgctataaagaaaacgctgaaaatgaaaagccagcgattgttcaaaaaaaagggtatctgcatgcctccactgctttgtcggttttccgtttgagtcccgccatttattttcactgaaattgaaagtctctacaacacacttgatctgatcaaaaagtcaaacagatacacaacgattaatactttgactgctgcctgttcgtccgcaactccttctagcaaccgcatgcccgagaacatcggagggctggttgcatgcttcaacgttgctgcgctgtctgtacagcacgacattgtatatcagaaagccgtggttctcgtcttacttcagtcaaaactgatgtgacgaaacgatcggtgcagtagaacggctcccgagtcaaaa

SEQ ID NO: 1653 - DNA, 2133 bp, Toxoplasma gondii
actcaagaggagcctgccttcgactcaggctctttgttctattttagatatacgcatgcccccgcttgtctcttagtcgccgacacagtgtctgcaagacctaacgagcgcatgtcggcgccacacgtttctagaggttgcgaagagacaactaacggctgcacaaagcgagagatcactcttttcgtgactcacgcatcgagcgctgtggtctaccgaactcacatgttcacgactgtcgccgtcaattcgcagaaatgtctctggcatccagactgccaagccggctgatatggaggtgtctctagtcactcaaatgtgctaatccttccgacgtgctactttggtcaggaagtcgacggtcagaggagtggtacgtactatgaagccaggagcgatggtctggagagagccacgactgggcgttaaacgcttccactcagaatgcacgtgcagatcggagtgaaatcgaaaagacataagccaggcagcagtgtcgtggatcgaacaaaatttaatacgtgatcccgcttacggacatcgaaaaagcgttcactgattttagttatggaacgcgcgtactcttcattctcagaacaaggaaatgcatgctctcagtgactattattccctctacgatggtacggatcatactaacaaccgagtggtagctgtctctcgtttgcggcttttgctttgttgggagtatgacacccatacaacacaataccggtcgagtggctcgtcgatgcgagtgacaaatggtcgttccttgtcacagcggcgataaatctgtgtccctgctttacatctctgaagatagctgttaaatcggaataggcggacgacttcgtggtaccagtgtgaaaggtttccaaagcgaactctcacgcctggtcttgcaggcctttattaaaaagcggggaaattcgtcctgtcgcggcagagctcccaaaaagaatagagagcctccggcatgttacagtccgttctgtttttcgagtcgttgtttctcagccgccttccactgctacaggctggccgacgctagtagcgttggcctgggggtccgcgccacaccccttgcgggatggatgctctggggacccaaaaagatggagaaagtgtagaacaggagagaaatcaacctcttctcggcgaacagctacagttccgtgtgttaacactgctttctttccgtatcactgtttgaagcttgtttcggcccgcgttcgtcaccgtcgtgccgcgttgttctaggcgcgacagcctcaaaggtcgtcaacgcgattcggcgaaaaaggttgtgtatagtggtttccttacgttgcacgcactcgagttttttgtcagttgggttctgcgcccaaaaatagccacatatttgcctgagaatgtttgtggaacatcaggacaccgtgcgcggtacaccggaacatgtctgtgttctgacgtcactctcgacttaaaaggtaatggattagccctactgagcagcaatagggttttcgccacgttttgggtttacagagattctgatttctattttggtcacgaataactcagactcccagtttctttcaaggcttttcttctttgtgtaaacacaggtcgagaggtacgaagggcagacatcctgtttatcgccttctcgttccgaacttgggtcgagggaagaagcctctggtcaacgctggaaaacagtttgtgactccagcgctacggtgtgtttcccgtggtctcatctgttgccgtggcaaacggatcccaacttttttgtcacgcttagcccgtcttttgcgagtacgggcaaacgcccgttgttttcatgttaactcttcctctacaaggtgtgtcagtctcgtgcttttattcgttctctcatacacagacgctcccgctgaatctacatgtttgcctcctctttctctcgatagcagcagggacctgggcacatgaaggtcgcgaagagtcattgtgttgagtgcagaaaacgttcacgggacagaaacgttcacgatctagcagacacaaggtagtgtcggtggtgcgccgcttacttcgactttccacatatatgattcaactgcccgtcaccgtcgcctttcaggcattttgcccccactgacataa

SEQ ID NO: 1654 - DNA, 3304 bp, Toxoplasma gondii
agccagacagtgactgctcgaaaacagagtcaggtcgacaaaacgaggaggacagaaaagaaccggagagaggttgccaagggcggcatcgtagagactcgcgaggagctgacagctgagcagcagaggcagacgcagaaggcaaatgcggacagtgaagaaagacaggagagaaggcgctctgttttcttcttgcgcgagatggaaaaggaagaaaagaacgcgcgtgaggcgacgccggacgaggtgaggtcgacagtgcaaggcgaaacgtgaggggcgcaagaggcaccggcatagcggcctgttcagagggcaccggggaggagactctcgacaacagcgtgcgttgctcgaaacgttttctcacgaagcgaagaggccgtccttttgccttcttcttcaactgtctcgcgtccggtctcctgtgggtcgagagtggcttgtcttttcttgcgacataagcatcttttcttgttctctccccacttggtccttctcccgactctcccttctgcctgcgcctcggtcgtgtacagtgagtgcatgcagaccttatgtcgcttgctgaggatgtctcctctcggtgtgtctccgtcagagggatgaaggcctaggtccgcatcaacctcaaagaaaggacagttctgcagacgctacgcgcctcgcagagttgctgtgagcgtgacgacgaggaccgagaagaagcagaagaaaaggagaagcagagaagaagggcagaagaaggggagggaagaacgggagaagaaggggagaagaagaggagaagaaaaaaaaggaggaagacaaaaagagaggaaacgaaagaaaagagagaggagaccacagagttgccgggcgaaatctagctgcagcattgagcgacaagggatgaagaaaattggagtcaagtgtaggcaaaagaaagtacgacttctggatacgctttaggagggagaagaaaaaaatctcagatatatttaaagaaagaaaagccgttattctgtctttcttttctccctgttttacttcttcggaagacaagcacacagcgtgcatgacctgaacaacttgcgcaacagctgtgtcgcacagcgcgcctctcgagtttctgtccgttttttccttgtctatgagtaacctttctcgcatttcttttcggtctcatttctccttctcttctgtctgcatctcagctttgcttctcccaacagattctgctttgtcgcctttcaccccgtctatatctcgtccctaatcgtcaattggcctagtgttttccttccctgtgctccagatgtctctgcgctcagagtattctcgatggcgggcgttgtctgagaagtcgttttcgagaaatagaacaagatatcactgatttgaagctaacgtcgttgtgtggcaaaagaagattcaaagagtctcgcgtctcacccagccttttggaggttgaggagcaaacggggatgtttttttcaatctggtcttgttttctacgtgagatgttgactcttctaggagacgttctgttctctcctcttgaacctgctacatctgtttctctctgtggctcacgcgtctctccctcactttcgcactgctgtctctgtctctcgtctcaacgcagtgaatatgcgtacagctcatgtctctcggagagttcggccgagttaattgacagtgctgcttctagttagcgaaaaaatcgctccgccggcgagacgaacactggacaagaagagatcggttgtggttttttacttcagtctctcgttcaccgtttgtctcctgacttcggagcttttcttttcattcgacgatctctcgtgtttttactttgttgggtcgccagtttctctcgaaccgccaactcgcgctgtgagcagacccgtgacgctccccagaaagaaagagctggaaaataggtaatcgcgttcgttagttaccttgcttcaagaagagaatgagcgagagaaacgtcctagaggtcgttcccctgtgcctttcctgtctggcttccggcaataagcaggaacgcccaaagttcaccgtacgcagacacgcagaaaagacaccgccgttggaggtagagaatcgaagagcctagttttcgcttggggcgcatgcttcttctctttcttctgtagccatcggagttgtctacgctccgctgtccgttagatggatctgtgatctattataatacggttctcctccggaagcgtctactgtcctggactacctggaacttaataactttttatgcagagacacaggtccgacaacgcaggcgggaagctcggcactttgagaatcagaagaagcagaaagcgaaagtgtgagggagtggaagtacccgagagaaacgagacgagagcgacggtggcgaaaggtacggtcagagaggtcgcaggtcgagacaaagagagaaaacgaccactgcgagagaccggacgttggcacaagccgatgacggaggtaaaacgcgcgatacgctagagaaagaagtccaccatgaaggaacaaaacaggcaagtagggatcacggagcactgtggcaaagaggtcgaattggtgacgcggatagagagagagagagagttgccctcgagtaacacaaccccgtgatacgcagagagggtgaggcactcgagttcgacgcatgcagaggaattcttgaatgtgacagagagtcagaggaactcgcggtatttacaagggtgtctgaaaaaggcggtgtgaaaaaggcgcagtcccgcgcttcttcaggatgtttccgtggcagaccagacgcgagagctcgccgcagagaggaggttccggcatttcttcgcattttttttctggcggcatgccccagaaaagcacatggcattttttccttgtccaccgcatcactccttttccccgcgttgatggctttgccgtctcccgcgagctggatgagattcacccggttcgctgtagcttttctcccgcgccactcccgtgtgtctgcgaggctgcgtggagctcgacgcgccgacgagttttccatgagcttcttcgcatttccacggtttctttcgcgcgtccacgacactaaagggccgttatttttgtgcgcaaacacccggtctgaggaagaagccttcgtctcgagtttcttcggccagactcctcgagcgccttgaacaggtcgtgagagaccgcgcgtggaagaagagtagcgatttcgcagtgtgccgcgagtgtgttgcactgcgtggcgcagcgcgtcggagtcgaggaaacggccattttccccgtggaaaaaacgggaaga

SEQ ID NO: 1655 - DNA, 4881 bp, Toxoplasma gondii
ttcgatcaaagccctcacgactctcgctcgacacctccagcaaaaagcagcgaaacagcgtcgtggaaagcgcccgcgagagacgtgagggcacggtacacttgtccaccagacgagcgccgagaccgcgtcaatgctgggaaaaagggaaacgttgatgtaaaactttgaaacccaaccactctcctcgtgctcagaaactggagagaatatccacagaggtgagagaaacaggggaacaaaaaaatggaaacgtattttcttcgtgcgattgaagaagaggcgcagcaattctcgtcgcgcccgtgttcccatcaacgagaagaaacagagaccgcagtggcagactcgctccttggtcgcatgtactgcgtaggcaaaaaaaatctacgaagagagactgcatgtacatgaagtcaagatgacgaactggggtaaacagccgtggagttgtcctgcggaggcagccggagcaacgaaaatcaagacgtgaacacgttgtctcgcaatttgttgacgagagcaaaccgcctcgcatatgttcgttgtatccggcggtcgcaggggattccatgaatgggtcgaactcggtctcaccgacttcctctccgcttcaagaatatgactgggaaggtcttggaaccgttggagctgctcttgcgaacggtcaatgcctgatacgcacgggaggagcagctttactccttggaagtgacgtcacacgcaaaagaaaacttctccaaggaacgtggacggactgcaaagttgcgctgaaaccaggacccggcaggctgtcgatctccggggtcggaatacgggaaaggttacacacctccactggcgaagcgaaacggcgattcgatgtcactccgcggcatacgcagcacccagatacgagcaggagttcttctggactgaaactttccggtgaaacagaggaacagcgacaaatatggtatagctctgacaagacaaagtaacgagtcaaacacagcgatgtgacatcgacggcacgcctttgccacgcgctccctgagtttctttgactggaaacggccgaaaaggtgtgtttcgaaaaagtgaccggaaaacttgagactccgcgtctgcttcttcaattttcgctttgaggaaagacgaagaagtcttcagaagcgagggtcactcaaaagcgtgaggcaatttgtgagccggccaagttctcgtgccactatcaccagagagcagcgcccgtcgaatacaaacgccacacagttccgccacctttggagaagcgaatttccacgagacaagcggaaaagtgtgatccaagattggctggcgcgcagtctctaggaaacgaaacgaatcgacgcagctcggaaacaattgctaactagtgccgcggaaccatggcggccagcccgacttttcgtcggctggcatgaccgcaaagctcgatgttcctgcggcgctcgtggtgtctgcagagaacttcacggagtaaatgtgtttgtgtgagttttagagactatgcattttaaggaaaggaatgaaagtcaggcggggggagagaactttataggtttctcctcagcaactccagcgagcttgaaccgctcgcagccgcgagtcacgcgcaccagcgctgccaactggacaaaccactgacgagaaaaacgccgatttgtcgttggtttcacttaccaaggaaaaagccaaatacattcttccacttgagtctcgaaaaggacgaatcgcgagcagtcgcggcgctaccaccgctgtctaaggccgacactcttcgagttgaggcttgtctcaccgggtgcgactgctggctcacacacggcgaatccggacggtgaaaatactgtgcgtgatttgagttttcgaagccttcggttcctccaggcttcttcaatcagtttcgaatggaggttactactttgggaagctgcaagtggaaaggacatgtctcgcttcccaggaagagttttctgattcgtgaagaacacggcatacggcagttacgtagtcgcgcgagaaggaaaagttgccaccaattgaccgacagaacggaccgaactcgaaagactggctctaaaagattcgtgaaaaattgcttttggtggatctgaaccacggccgcagtcgatggacctagatgtcccgtctagagtactggtgtaatcttgacggccgtggtttacgggatagccgcacacaccgacaccagcgcgacgacaacgaagtttatcttttgaaaatctaggcaggggaagttccagacgtctcatctgtgacgcccagcgtcatagaagagctgagaatcgtcagacgagcagatacccgatgcacagacatcgttccatcactcgaccttcagaaaccgtagctgaaagcaattgtacttgctcgattgccaatatactcagatccgttgtttcctcacgaatcacatgggcaaaagacccttcgacagccacgtcagctgggcgattctcttggtttctttactggctggatggtcagggacgtacacgatatcgtcgtttgcgagtccatggacctgtggcataagcacagggatatctggtggtaggcagtttgcaaggaaagaatgaaatttctggtacgaagctgctttagcttcgaggctcttttattggatctcagggaaaaggtcgtgttgttctggaccaagttgcttccaacgttgtgtggaacgcgggcagttttccactcctgaccacctatacaaattcgatgaagacacgcgccggagctgcgtgcgttgacaataatgaaaaagcgcgccatctaccctgctggcgtttgttgcactgaggttcagaaattcataatcggacgaaaattgccaagtgatttgagctagcgaaagaaaaagtcggcgaaacgttcactctgtcagctgtgctgatgtaggatagatttccgcgcgcattttgcggtgccttccttccgcttgtttgaataatgtaccggtatggcgaatatccaacacactcgaactggttctgggcttcagatgtgtgtttctcctgacttctctgttcgtgcttcacgttaaggcgacacgtgcgtctcgcccgcaggtgataccttctgggcgtttcgtttttaatcccagtcaacaactggtgggtgttcttgccttgtcgagaatttactcgggacaaattcgctgcggagggacatttagcttattgttacggagtgcccttctaactcgtgtcacgagaaaagccacgccgcgtttgcgtccttatcttccccatctctatgtggttgagttacacagttctggatcgcggatcatttgtgcgaagtacttgcaatgtgacggttacagcatatgctttatccactgtgcattttcctttcgttcctcccttgtatttcaactggatgccgttgccctgttttttacgttcaacaaagacccaacatccgcatcgattgtcgactcgctgagacacgcataaagtatcaagcgtgctgttacgggtattaatcccgtgagaaagcgtccggattcgcgcttgtcgcatatcggtccgtcatgaggagaagcgttggtgcttcttacttcctgttcgttttcccagggcattcaatcgagatggaggacgccagccgcattcccgttgtgttttagtccatgggcacaagattccatacacaccggcgccgatgaagttagtcgaactaaggatatccttattgccaagaaccgcagattcaaagcacgccgacgaaatacaagatgagcccggaataaactcacagtgaagcaagtcttctggaaaccaatccaaagtgtgctaggtttttgtcacgcaaagctgctgtggagacagcagcagcggcgtctcgttactgccagcatgcgtccggtttttcccgtcagaaagaaatgttcgcggtaagcgtctatttctaaagagtttctcgtgattctcctttcaggtaactgtgattgatttctgcgccatgcgtatgttttgtttcctcggtgacggctgaaatatcttcgctgtgcttccccggctttccacgctgttcgctggtgcgtcctgtctcagtttaacgtcactccccgtgaagaatggctttttgaaactagctgcgggctttctgttcgtgcagaccatttctcttccggtgtatcccagccaaaggatgcacttcgcctgaggaagttgcgccttttctatgccgtggtgaactacgcacgtactaaaacaactatttacttttcaagagcagcctgcaattcggcttgttcccatcgttcgagagagtcttaaaattcacaacggtaaaagagacttttgcttgacaaaaggccgctgttttgtctaacacagagcgccggcgcgatggcagcgccatcttcggccgtagctatccgtgcgtgttccagtttttcgctgcctcggttttagttcgtcgtgttttctgagacattgtctgtcttcttttctcagtctgtcataatattcagccgccatctgataagagtcactccttctgaattcggaatccctgtcgtctgcgggttgtctccaccagtgaaacacgcagaagattttcgattaaaaggcagggcaccaagcttttcgtctgcctatggaagaccggcgcaggagtctatacaacgaggtggagtaccgattcagatcttgaaggtccgtgttagctgaagccaaggtctgttgcgagagcaatcgacgttcttcttgagcggcgtaccttttttctgttatccacagccttaagagagctcagtagttccgtgggcggcgcaagtgcgtttcgggcagtttctgaggaggacggacaggcacaactccgattttttttcgctgctcttca

SEQ ID NO: 1656 - DNA, 3726 bp, Toxoplasma gondii
agaacgaggtattccgccgtagtcgggccgtgaagaactttcgcttgcaggaggcggcggctgaatggcgctaggaagtcgcaaaactcggcaggcgaaatgtagctgggaactctgggggcgacgagcacgcactcttcctgcagccactgccagacgtcgcagccgcacgcgttgcacttttgtttctgcgagaaaggcgcgggcccggcgcttcccgacccgtcgggtggagaaggctgaatgagacgaccggcctgtccgatttctccacctgacgggaaaaaaaccgacgaggccgcagtctggagtccgctggcgggggacgcagcagcgggcggcgggagattgcgcagcagacgctccgcagttgcctgggaaggagtcaagaaataccgcaatgttccgctcagacgctcaatggcaggattgccgcaccagaaggaaacgtcgcgtgtgagaagagatgctgtcaaggatgacgcaaccagtgcaggagtgggactcggcggcgctgtacacacacccggcgagttgggaaccagcgacgagacggcgggagagagcgcgggggattgaccagaagaagtcttcaattgggcgctcgtaagctgttggagtggaagggaggacacacctggacccccaatgaaaggcgtccctgctggcgtcgaaaaaaacgcggaaaaaaacgccgcgtcacaacatcctcgactgtgcaatggcggcactggggaacgaagcggggaggaaggaacagacgcgtctggagtagaatttgattccatagcttcacaactgaggtaacgaaggagaaagaccacggacttatcccgtttcggaaagctcacgggcaaaattggcttgcgtcaccactcggccactgccgtagatcgttgacgcttaacagttttcgccctttgacagtcggctgtccgcctttcatgggtgaggaaagacgtattccgtatcagcattttggatgccagttcgaattctctccaatgccgtctccagtgcgtgcgttgaaacagcttttcggtcaccaaacggactcggcatgcaacacccttcgcggtgtgtttcatgccccgtctcacccgccgcgctccagcgtacgcgttgtgatacgcggaaactttgaacagtcgatcgacaagaaagtgcttccggtgaagagacaaggctgattattaacgtgacagtgaactttgcatcgctggaattgaaccgttacctcgtgtgaggacaccgccgaagccggctagccaaaacaaccaaaagaaagatgcaaactgagcgtagtcgggacacttggacactgtgcaaagcgatgaagttggcaaagaaatataaaggaggaaaatgatgtcttaccggaaaagaaacagttcgtttgtttactcaagatcgtggccgcccgctttgcgtgcatgcgcaggcagcatacgccgagactcatctggccacaggaggtttttaacttgccctgtgcctttccagtttcctttctttctagtgtttttttcagtttctcacagcttccacgcgatccgtagtgtgtgtgactctggttccgtgtcaagcatagagaccaccagcgagtacgtgagaaccaagagcgtgtttagttgcgtatcgagacaagcgcgggcggtggtttatcatcagtgaagtactgtggtcagcagacaggaaagtggaatacagtgcatacgggactaaacggggttttaaagctgcctgaagtacgccaactcggagacagcaactaaaatgagaagctgccccgtagagtacgctaacatgcctgctgcgagtcagcgcaccgcaaagaattcgcgtccgcgatgaccaaccgccaactcccgcacgtcctgaaaaacctagcgaggagtcgaggggaactgctcgtaaaagagaaggccttggactctgaaaagcatgcgaatatgtggcaagacaacaccgatgtttttcaacaacgtggttgctaaagtgtgtaacattcccttgtagaaatgcgccttccacatggtgttcggtattgctgcctctgcaagctcttctctcaagtgccactccaacacggctgtggaagtgaaacttggttcctgaaaactgcaccagctgaaatgttgaagcagctaaccagcccagggagaggcgatcttttctaggcgccccatcaggttgcctctcgaaacgagggcgatgtgttatagacggaagcagcttctcttacagaaataaacgtagttttcttgtgccgatagaccgggacacacacaacacacaaacgatacgtactgcgagcgacaaaaaacgacagaaacgtgtgctgactactgaaaagttgccgatactacaggtgccatatgggtttaggactccgtacgcgggcatcacgaatgttcttcatcaatgaaacgctgcatattcatgtaaatgcgcagatagactggatggtgtggccagttccgacaatagcgatatagtaagcatcccggaacgggaggtcctgcccctgcacagtaacgcgtcggtcattttccttgtcgcacgcaatgccggccagtgctcgcagaaaaaaaacgcataaaaccgtctttgtggccgacgcactagtctgtttccttttgtgaccgcgaatagaaggattgcgatcacgagaggttttgcgagggctgcatcgtgccgtgcaatccggaacgagagctcgtttcgacagttctctagaggggaggatgcccttccttcagcgaagggtatgtaaccggcgacatagaagggaaatctgtttctctgattcctcttttgtttaacccgtttaccaaggtaatggggacgcgtgcaggtaccacgttcctttgtgcacacgcctgtcgctaaggctggtacggccgcgcggcctgttttctgagccagaggaccacccacgtagaaggcaatcgaaaaaaaagtgtcgtctcttgtgaacccttttcaacgcgtatttgtttcagtgaaggaaacaaattagtcttactgtccgggggagaattcggaagcttggaaagtgcagatgaagttgcatttgcaaggcaaagcgtggcggcagagcgattggcgaccatgttggtgtctagatcgatgtcttgaagttggcgggcggccgcgtgcggaaccctgtcaccctcctagtactttaccacagagcggctggttccgctcaaccacactttgtgttttcccctccgattttttgcccctttctttgattcgaacgaccttcgtggacttgcgggaactttaatttgttcgcaccggagaactctaggctgccacattgcagtgttccaaccggagtggagtgcagcgttctggaacctaccaccacggtttttcgcgcagtgggggacgtcttcctcgcttcgttcttgctacctctctgtgtttaaagcacaagtgaatcgttgtctccgacatcttctcttcgatttcctttggaaggtttgtgactcacacaagccggctctggcggtcatctggggcacacaacgccgcgtgcgtgtgcgccaccccctccaaccgggttatgaaaagctagtcagtcgcatgcggagaacgaaacaaatgattttttccatgaaaaacgaaactgtgtagcgacttttttctcacgtgccctcgcctcctgcttacacacctgtcaggacttctccgcagctgtctgatctgcgaaga

SEQ ID NO: 1657 - DNA, 2171 bp, Toxoplasma gondii
gaagatgaacagggtgatgtagagttcttggaacgaagtgttccattttccccaatgtgttttacgtgttcaagggagttgtgcggtgtgagtaatcgtcttgtgcagcaagctgtgcagcttttgctcaatttgccttgcctattgggaggttctgcacaattagcgaaactcttgtgcaacttttgaacatgcatccggtgatattcagcgtttcccgctcattttcaaaactgtttttttgtcccggttattgcgtggtgcgtgtcgtcttggaaaggttcgcaccatgcgggcgcgactgactaaatttgtgggtgcggtaccggcgcttcttatgtttcgaaaacacatgtcgcttctctgaggaaagtagcggagacttcctatagcggaccatgaccaggaggtttttgcgacaactcattctattcaaagggatgccgcgtggcgaagccggggctgacagtcacgatgatgcggagcccactggaacgtctgtgtggcaaacatcaggtgctagaactgttcccactctgctatcatccattgcaactcaaagacttctccttcctcgatcgagctgaatcaccagtctgcaagcgaaggccacgagttccatcgcccccgacagctgtttggccacagtgaatcgctctcgagcgtgcaagaagatagggatgttttcatcagtgagtgcttttacatgtaaatagggtttagacctaggtacgcttgggctttttgacgtagagggatcacccatgtgctgacatgtattgtggcaccgctggcatcgtaattttgcatgtcctcctagttcagcaccgtctgatgttctcgaattcgaccgagtaacgcagatattgatcatgtagggccatccacagtaggagaagttttagcaagtggcacgcactgtccatcagcagacacctctcaaggacgttactgacgtttacgtcacccactgagcagcttctgcatgttctgcgcgaccactgacatagcgaaaggattgtgaagctatggtgaactattgagttcacatttagtcgctgattcagggattcagcttgaggacgctgaaaaacgccgagattttacaaagaagcctgtcgtgcaagtgaaagttcgttgcttcacacatgacgagtctccgtggaggtggaacggcacgcttatttccccgcacgcgctggagcctacagtaaggcccactacatctttttcgccagataaatcggcgagtctgaaatagttgtgcttttgggcagtttggctctgtctcgttattgtcgagcagcggtaggcgtgcatgcaggccctttatctgtagaccgtttcgctatttaagcttccaagcgtgcaccaatgattgaacgaatccagaacattattcgaaatgcagttcccagttttcacatttaccgctgttcaggagatgagaacgtttcttgtttttcttcgcagcactgcgattgccggaagtagagaaatgcatgcacacatggagtttgccgacgattcgtcgtgaaactgataccgcttgatggctccgccaacaaattgccagttctcggagacgaattaatatgatttacctggaaccgtcagctttgaagacttgtaggggggggaaaccaggtacacatgggcgggcaaatgctgtcgttaccccattttttctctgcatgctgcttcggtcttgtgcattgcattcgccaggaccaaaggacagggtcgatgcagagttgatgtcgttcaatgcgcatactcttggtgcgtgatagaatgcctcaaaaacgagcgtggctgcatttgtccgaaaaggttgtcatctcctatcgacgtgtaacaaaacccctctggtcttaatgagtagcctggtgcccgggcgaacaaggctctctagtcggttctcccggaagtaccgtatcgtcggggccgagctttatcaaatagtctttgaacgcgtttctccttttctctttttgcaacgtagttgaacgcatgtcgcaagttggcggcggggtcattcaaattggagccaatgcccggaacgagaaatactcgagtgaccatgtcacctctctgcatctacactggtagtttcacggtctgagatttctctagtgtatctgtgactttcattgccactttgtgcggta

SEQ ID NO: 1658 - DNA, 3333 bp, Toxoplasma gondii
tgatgccaatcggcaagtcttgagtgcgtggattcgcgtcgagcgcagcgagaacaccgacatttgccgcagtgtctccaaagcggctgagaggggactgcatcagcgcgggaaggagcccacagtagaaacgcctcacgccccctgcaagcacggacgaggatcccctgataaaaacaatgatccattctccgctttcacaagaggcatcaaacgttgtcaaagcagcactaccagcggagtgcaaccgcgtcatagagaaacggcacctgtccctattcaagttctttcccacctgtatcaggaaatgcatccttgcacgccaccttcttcaatacattgacccatctgcgcctacatctccagatgtgcttcaccgtagaaggtaaatgtatacatgtgcattcatatttatgtgtatatatatacatacatatttgcgtatttattaggaccggtattgtgcttggtaacatcaaacacaagtatgcagctttccctgcaaaagtgcagagcaaagggtgaatgcgtatcatacactttgtcttagtagatggtttgtcatcctgcgtaccttcacgatacagctttttgatcgatccgaaagttgttcctccgtaacggtactggtagttcattgtcgttcggagccacatgaaggcgaggacattgacaacctgcgccgaggcgccagcaatgcctccacggaaagcctggtctttggaatacatgatgatttcgagaggtgtttttggttccggattcttcttgttggctgtcgcgggaacagcagcagacgaggacggagccaacgacgttgcagcagacgacgccatgttgcacggttcgttggagagggaggcgaagaagagggagtaggagaggaaaacggagggaaaggtttcacctgaaagaatgtaagatttgcctgggaggcagaccgaacgatagtagagaggaaggtcggcaggtcggggagtgcgcgcaagagccgccaacaacgaaatgaggggtaactgcggaaacacacactcctcctaatgagacacagacgacaaaagaaagtgaacggaagatgacggagcgaacgaacaagaatatttgctggtgcaaagaattgccttactgtctgaactggggcagacggtttcgccctccacatctattttcactcgttgcgtgcaaatgctcaaaagagagggagggcacacgcgccggcagaatcgagaacgccgttcactagtgggaagagtggcagaaggatttttggtgaaagagtgaacgcaaattgcagaattgctgtaaaggctgtcttgccatctgttgtctgtctgccgttggaggccaactgtctcgctttgcgcagagcgaagggtgctgactagcaagcacgacgagatacgaacacgggccttcctcctccacagtaacacaaggggagaaacgcgctcgtttccaaaacaggcagacggcgacaatgagaaagctcacttttgctggtgtgcacagaggatgattcgttgactatgagaatatgcaaaacggaacggctgcaggtacgcatacagccagcaaaaagtgagtgtgcgcctttccgagctgccaccctcggacgactcctgaaacatcgagacacattatagacggcactttggcggggtatttcctggcaaagctatctctttctcttgtgccgtgtcccttgtacatctttctactccagggtttgagatattcgctccaatatcacggtgtattttctagctaaaagcgcagaatatggagcggagcacacagctttgaattacagctatgacttcctgttcttctgcaccgtcagacgttttcaactgtaaggagttccctacgcaaatgaagatgcacacgacaaataaaggcaatccagaaagagcctcattcctacagataaaaatatggcacttcttacgcgctgctggtatggccgcccaaacgcctgcccgacctcacttgttcagttcccgtgcagcaacgcgctgctgccccttcccgccgaacgcagagccacgttacggcggctttttagacaggaatgccggcaactaaagacactctcctccgcaaaggaaacacttgcctttacagctgagttctgtcactgtcatccagacattatcacaatgagcgatcttgttgcataaagaggacccagaaccggtctcaacttgcgttgtgcgttgacgcaggtctcgctcgacagcaacgcccatggagttgttcttcctcgctcagcacttgcaagtggcaccgagggtgttcagcagagtccagttgccacaagagtttcctttcgtaaaaaagaatgcttggccttggtgacttatgccttctgggcacgatgcgtttgcgaggcggcgaaatacaatgaacatccggctcgtgaaaggagctcgcgtcacttgctggggacgctgcgcgcagaggcccgactcggcatgatgtcgtaagtgtacagagatcctctccagcaaataatacgagagaaacttaagaattctcgcgatgaagagaacagagaggagatacacgtcgacaaggtcgaagcgggctgtagaaacgtgctggttcctcgcaagttaccacacacaatggtgtgcagagagtcgcaaggttgagcgtctgctgatttctcgagcattccgcatgcagaaatacagaaggagacgtgccgcccagaggcgcgtccattctgtatatttgtctcccttagatgatggccgtttaaggctacttttatgcaagcgccactgtgtcaacctccgaaggggccagaagacgtgagaggcgaccacggccacggcaacaactccgaagcgcttcggcgcccacccagatatgtgggaattggagcgagtaaaagacaaggaggaaatatagcgaacccaagggattgtctcagagtgaaaatgggtgaaaggaacggttaatcgctcttgttttctgcaacaatttcgagaggggaaacagcgagaaccgcgaacccgagctgcaatgaggaaacggccctgtgaaggtaaattcctgcgctgagggccggggcccctagtttcactttttcagtcccattcgcgtttgcctcctgtccttctgtctccgttttttgccgctcgactgccgcgcctctccatcaattcgcgcaaccgaagtggttgtgcctgtcttggcttcggcttgcctcgtttttttccctggattgttcactgtcggcctccactctacgtctgcttgctggcgtcgttgctggcttgcccttttatgcttcttcagactcttagtgctcttgtggtagcccca

SEQ ID NO: 1659 - DNA, 2271 bp, Toxoplasma gondii
cgtacggctagacctacttttagagtcacaaactgaaacgcatgcagcaacgcggaaacaagatccatccaaaacgcatgcatgcttgtgtggcactgtgttacaagtcacctcaccagcacactttgacgcatccacgcggcgaaatcgactacgaggttgcgtccgtgtttctacactctgtaaccaacgaagcagagcctcacctctcgcactgcagtccagactgctcgttcctgaaacctctctcatccaaaaaaaactctgcccccgtatcctcatcccctcttcttacgtcttgcatgcttgtccgactcctccgaccctctattgctctcacctttgctgggatccctgactgcgagttcaacagcctggcccttggcaggactcttgacgatgtctccggtgaatctgaaggagcatccggcgccgcacttgagcagttgaggaaactcgccaccaatacctgcctcgacgacgacttggaggttggaggaagtgcttccatcgctgagaacgacgaagcaaagactgccaccgccttgtttgcggaccgagcgactccagccgcaaacggttacgggtgtttctcggttcacgaacttttccacggacgcctcgccaccgtcgaggagcgccgcgagccgaacgcgcgtcgatccacagccaaagacaggaatcgcctgcttgcagcttgttggaacctggtcctcgagatgtcctggagtgaaggacttgctttcaccttgcggctgcgccatggtaccaacggaggcgaagtggcgagagagaggcggcagagtgcgtgcgcacagtggaacggaggttgggagggcgagacccgagggaacaggaaactgtcggatcgaacgaggcgaggtacccgaggcagagtttcgagaaagataagcttggtcgggcggagtaagtctgacgggaaaccagggcctgtggagaggaccgcgaaatcgacaccctgcagacgagaaggcgagaggtgcggcagacgagcgaagcgtcagagccgaggaataaagaagcgcggagttgcgcgcggacgccaggacgaagaggagaggaaggagcagccgcgaggcgacagacaccggaaattcacggacagaacagcagacgaaaagttgccagcaccgacgaggcattgagtgacccgtcacaaaaaaagcggcgccaatggaccgtgcttcgtacaaatgattcgatgccgagaaacgttggactgcacgatcctgtgggtccaaacgatgagagagaatcgcgttcttcagaaaataccgaattaccggacaaagtccgcaggcagacccacgacgaccccagcgcaggagacagaaccgaaccccctgtcgccccccacagttgttcggttgtgaaaacgcaagcggacgcaggcccagtcgcttgctaactccctcgtgtgccgccgcctctgtctggtcatttgtccagctctgctctcaccggcggctttttaagtccctcacgagtctatagatacagcagaaagttcgatgaatcaccgtacgtacttgcagtcctgaaaaatcgccttgcctaaaataatgaatcgaccatctgcgtgagttcttaaacccgcacacgttgagacttcgctggtgaagaagcaacggaagcgtggctcaagggcctgaatcgcgaggacgcgcgagacgcggcacccttttttcgcagcgattttgcgccgcagaaaatatgtcgactgtgctgagtcccggcttgtcctcggaaaagctccggcagtggagtggagagcaagtccgacggcacatgaacaccttagcaccgctgcaaaagaatgaatgcctcgactgactctggtgcgatatttttgaatcgcgccgcgaaccagctgtacgtacactagatgtctaacggaaaaccacggctcttctgctcggatttgaacaagaaaaaatcagaggcatgcccacacatcgtgcacactcgactggagcatgcactgcccttttattgcgtctcgagtgtgcgctgacttctcgtatacagcgacagagccacagtcgaccctccacacacccacacagagttccagccccgaaaacccgcagccataccccactccggcgctgacaaacggcgcgccgtttctccattctctgttcactcgtgaacagataaaaggggagcttgtcccgccgttatttcggaaaatctcacctcggactgagttgtaattccttccactttccggttgtgtccgctacaaaa

SEQ ID NO: 1660 - DNA, 2892 bp, Toxoplasma gondii
tctggcagcacatcagcagctggccatccagacacattggcggtagcgccccagcaaatatccagatgcggcaggtgcgttggcacaacactgttgggggtgtttccctctcgactcacatccattcgttccacacacgaatttcctgacagaatatctgtttctgggaatgccaaaaatcgtggtagtccacattccggggaaccattttggttcggagagacaggatgaccgggctgtgactgaaccgcgacggtatctgcgtgcccattttgtgttggagataagtccgatgtgaatgtctgttcgctactgaaaagttcagaatgttggtcaatgctgtttcttagccgttgtccagcttctgtattgtcgaatactgatgaggtagagacaagatcggatgttgaagggggtatttgacgtctttgcaagtcagcgggcgcctgaaacgaaagcaggtcatccaaccggttttgcgcaggtggaagaaaatgccgaaggagaccgccatttactggcgtcgagattagccagtgagttccagtagcatttagagtgacgtagctaatcggccgatcttgcttgatggtgaggtcgacagacggagctccgcatgtcgccgaggcacttggcacagccgacaccgcttcagatgatccttcttccagggacaactcatttgctgaagaggggcagaccacagatggagaatcaacttcgccaacacgtggtcgttttcgagtgggggaaacaggatctgttctgtccccagagcactcttccggcacctttgcgggagagactccccgcccaagcaagtcgactaatgcagggatattgacaggtaagcaagggacagcgaactgtgatgcatattgctgaccaagcaaatttgcccaagcaagcaagaatgctgtgtcgggattgacaggatcagcgcatggtgtagccgagtcgggtacggctgtttccgcgccggcacagagttgtgacgccatggttgaagaatctgaagcctagacaaggcaatgtatccacgcgagtctcagagtggctagacggtcaccggcgatgggtctacaagacgatctgggaaagaagccgaaataagagtgaaccctgcctttgaaaactgcacattcgacggaagaaaactggcagtaaacgctgatcgaaatggatttttttccaggcttcgcagccagaccggcttgcgaagaggacaaccggtaaacggagaaaaaccgcacctggtccacagtagggtgacgcgactgcaacccgttagcaggcgcttctccaaatttcaagcgacccgcctgcctacgagtattgttgtgccttctagatataatcaaacactgtctaggacgaaaagacacgaagcctcagaaaacggcagcgttctgcaactcatgaagccgcgggcactgcgaagagtgactcaaatcagccccgtcccccccgccgggagtgacaccactgctgccaatcaaagccgggtcacactaccgtccaacagaggatcgttccttggaaaacaatgcactcgctgcaaaataagattttagaccaaccgtgacggtgattcgaaatgaaagctagcacctgcagtgaaggccaagaggcagtcgtcccggctcaacatgagaatgaaggcgtgcttcgctcctcttatcccagcagcggcaagacacagtgagtggcgagcgaacagacgcgcggctgcaaaagcatgatcgcatgagtttttctcttggcgtgagtagggatcctaacttcggaaaaacaaacagacaaggacgagaacagggcctcaaaagcctcaaacagatagcagaggagaaaaatataaaatattcgctttcttctgacggcattgggtgaccgttgttgtagcagttaattcctccgactcactggcctgggagagcttttttagatcactcgagtcccgccactgagcggcagcgcgcggaagcggacggagtggcggacagtcctccacgcgtaggccgcctcgtttattttgcaacctatcttattcgtgccactatgtctacttaaaatagagggcctagggttctgttttgatcggaaaaattgtcttggcactggagggctaacaaggaagggccttcaaaaggcggggttcaactggaacaccgtcggctgcagaagagggaattgtaggtgctgcagacataaaactgcgtggaacgtgatgtgcgaagagtaccatgcatggtgctccacctctacgctctttagactgcgaaaaagtacatgcctcacttgcactctgcataccgatgaactggatgtttgcgtacaatacgcaatcaccacacaaactcatctgtcaggatttcttgcttcaactgcgctaagcaagaagcggacatacacgacaaacgacatgcttgtggggctggcagaaggcccccgatattgcgctgcaaaaaacgatgacacagttcattctcgccttcggtttacccgcgaacaacttctatggtccgccacgtctacaccatttttcccttctgtgaattctgcccgctgaacattcgtaaacttgctccattcaaatttcttgatctctagttgggacgtgtcaggttgttgccaaaggtcccaattcagtaactgtcttcctcatcgactgcagatatgcttcgttgcactttcgtctgttattgttcagttattgggttccagacgcagcagacaagaagttcgtttcacgaatttgtgtcctgctagcagcgtcgggggacaacttttttttccgcacaacacgaccatcgttactctagcggcagcttcctcctcggctgcggcgttttgctaaagacgatagtattgtatggaggaatttgtaaccaa

SEQ ID NO: 1661 - DNA, 1277 bp, Toxoplasma gondii
ttcaaagcgagcgaatcctcgcgagtctctccagagaaaatgttcctcgaacacaagccgaagtgcgaaacacgatgcgttctcgaaagagacatgcgaaactttcccacctacctgtatctaggcctcgtagccttttcattgccctagcaagaaaacacgaacaacagcatcagcgaaaccgagatcaagactatatatatatatatatatatatatatatatatatttattttgatgcatgctggtagatctgcacatacacaagtgcgtatatatatatatacatatatatgagtaggctctagtggtatgcatgtgtatgtatatatatgcaaatatatatgcatatgtgcacatgtttagacgtagggtaatctagaaaagcagactagaaattcgctgtgtgttgtgacagtcgtttcggaggaggtagtcaacgcgagtgcatatggagtgaagtttggtcaccatgtagatgtgaaggtatgtagaaagaaactttgggactcatcgccgcttgtcaagaaagggagcgttacctgctgtccccgctagacggctcacggtttcttctgtcttgagatcgcgtctgaagaggtctggaaaaatcgccttttgtggagatttggagagcagtgaatatgcgaaaacccaagcttcagtgcttcacgttcaggcgctcacgtcgatgtgtaaatcatttgaaagagcactttccgctgttagattcgtaaaagcctgcttcctatgtctgagcatgcaaacaagccgcatgcagttgccgcgggcatttctttcgcgtgtcgctctctgcatgcgcgcgccagttcccgtttttggtcggcaggaatttctagaaagcgtcgattttctctggaaaacggtttcgcttccccgaccttctctccttcgagtcattccgcttctctgcgtttcctgagggacctcgcatctttccccgtcccaatttttcgtttccgcgcgtcgccctatctccgcgttgtcgaccgaagtactttttcctcactttctcggcagctttacccccccgtccatcgctcgcatgtcgcaaagcgacagaaacgggagacaaagaggtccgaggaaagacgcagcgacgcgcagagtcgtagcgcgacaagtagcgagcacctaagcaggggcgcaaaagtagagagagaagcagaggagggaaggacgttttttggatgctcgctgggcgttcgttttgggccttttcacaccctcttccagcatttcgtgcatcgacagaa

SEQ ID NO: 1662 - DNA, 1643 bp, Toxoplasma gondii
ccttacaatcagcgtccacgaaggatactcggatttgcgcagtctcccgttctctccaggagtcttctctgcgccaccggagcgcgacatgcggtttcctcgctctcgcgttccttgtgtttcccctcgattctccttgtgtgggccatcccctttcgtcggatttccaccgtctgtagggtgttcctctcgccgttctcggggtgcctggtctctgtctgggcctccttttacatgattttctggctgcctggctgcgttgccttctgggttgtttgtcggagctgaagaggcggttccgcgaggagcggcgtcggccaactctgctctgccccccgccaggcttccgccggcatcgggcgccgcagagagctggtctggagcccaaagacaaatgcgcctgtcggagccgcaagtggcgaggagacccccgtccgggcgccaggccgcgccccaggcgcagcctacgtgcgcccgaaagcgagcaacgcggcggagacgccaagtggtaggcatgtggaggcgaacagcgttttggaagtccagagaagagtcctgtgtctctcacgcggtccgtggaagtctgttcatgcattcacgacttcaacggggaactgggccaggacaggttctcaagccgcagaggtgacgggagatgggagaatcggagacgaagagaaagaacggcggaccctagcgcgatagaaaccacttgaacaagaagagaaggaaagagagacgacgggcaagagatcggtgtgtcgaaaaaaggccgaagtgattcaaagttcttttacactcggtacagaaggaccagatgacagagggagactcgcgggggaagagcagcttcgccaggaggtttgaaaaggagtaagagtggcaaaaaagagcaagaaagagagttaggagttgacgaaggagaaaaaaataaagaaaagagcacactctgaagcgttgccgtgtctcgtctctccatgcgatgtcactcgggcctcgccctctgccgaagaaattggagggacagaaaagacagacggggacggaggaaaaacaggcaagaaaatctgttctgaaggggcagacgaaagggagacaaaggcgtgaaacacttcgaaaaaaacgttttccgtcgatttttgctgcatgcgacttttcccttcctgctttgactccggtttctcgcttgaacgaactctacacggacacaaaagacatctccttccacgcaaatggagaaggagaagccagcaaaaaaacgcgagaaaaagtcgactttcgctcctctcaggggcaaccaagccatccgttttcgcgctcttgctcaagcccgtgccgctgctctggactagcaggttttcctggatttaacggaagggcaaagaaatgaggaggggaattggaaagtttgaggaagagagtatcacctcgaagtcaactcactaaacattctttgtctgttttccatccgcgctttcaactcgaaactcaacttctcggtcgaagggcgcaggggggctgcatgcaaaaaaagtattcgttcggcgcagcacgctgagtcgggaccagtttgcttggagtgactgcactttcgctttttcatagatttgtttccttgcgcaaaagagagcagtcagatctta

SEQ ID NO: 1663 - DNA, 1632 bp, Toxoplasma gondii
agctactcatttatacacatgtgcacttacagatacaccaatacttcacaggccaacatgtgcaaaagtatctgcagaaatatataaagcaatatatatatatatatgtaatcatgtatatatgtatatataaatatcgcatactatgcataatcatatatatatatatatatatatatgtctatacagctttctacatcacagtgggaagaatcgggcgagagtcgactgtgctcggtttctcgcttcttccactttttatagggagacggcaacagcgagagatgcagactgttgaaacactttgtggaaggattcctgaagaagccttctctcaggatacttgcaagcactgtaaaagcgcatgcatgggcgtgtagcggcgtttgctacgggcgcccgtgcggtgtctgtacactggggggcccgcgacgcggcttcgctgcacatctcgtcggtcgaaggaatgccaagaggatttcttgttcaagcggaagtttcttctttgcactttccactctaggtttcctttcttggccctttctgtggggaacgacgtcgcaggtctcaacacatgcaaataggcaagtcccgtttcgttttctttcggagactggagatgcatccaagctgcgatccccagagctgtgaagaacgcactgcagatgtttcagcgccattcttagagtagtcaccgattctgtgtgaacgccttcacgccgcgtggaaaccctcccaaattatgcacattttcttgcgtaacagacaagactacggcgtctataaacagtagaactgcagaaaacgcttgtatccatcgggcactcttgagacgagctcttccatcctgtactggagacagaggacagacagccagactcttaaaaaaatatttcgcagatcttgcctttaaattcgacacctcggatgtccaaatgctttacttgtgacatctaaactgttcaaacgctttactgtgcatcccaggtcctgaattgtgttcagtcccccgctgcacagacgcctggcatttttgcagtggcatttgccttgccttcctccgggaaattcaggaacgcttgtgctcgttacgtgtgtctcaaaattctttggatccgtagggcgcctcaaagtctttcatttcttttttgttctccacttcttctttctcgtcctccttccacattgtgcatgcaacggcggtcaccctcgcccgcctcatccccgtgtctctctccacagagagcacgcgtctccgtctgttttcgattttttccttggcttgtgcatgcgcatgcgccctgagtctctgaaaagattccttcctcaggttcacctccaacacgcgccaagcacagtgccaaatgtcgatttttgcgcatgcagttttttccctcacactttgcagtgtggacggcgagtgaacgatcgccggcaggagtttctctcttcgttcctcgtcttcgttctgctcgttcgtttctccaggtgccgccaagagtctctcgcgccgcgctctgttggtcgccagggttacgtacagctgcgcgcgagcgcctccaactctcgtctttttttcctcgacgatttctgcagcgcaccgttgtcttgctcggactgctctgcccacca

SEQ ID NO: 1664 - DNA, 3835 bp, Toxoplasma gondii
tactggcagcgaaagagacatccaccgcgaaagaaagaaacagaaaggatctgctccagattgtgtggacgcccgcaggctcaaccgagaaggagggccctgccacgaccttttcaaagcatgtgtgtgccgagattgatctccggccaaggaaaacgggacttcggtgccccgtacaaatgcagaacatagttagcgaacaccaggaggagcctgtggaaacacgagaaagctgcgcatctgtcagagctgaaactacagactacggtgacatacacgggtgcatacatacggacagaggaagagtacggctcgagctcgagcacagaaactcatgcacagattgtagcagaacaagacaagctgaaagacgaggagaaacacaggagaagaaacgatggagaagagaggagatcaagacagagagagaggggaaactggagaagtacggcaggccgatggtcatagataacaaaggtacggaaggctgagcagatccgtcttctcatctggagaaaggtcatggagacacgatacagtgacgggaccgaaaagacgccgtggagcaaacagaaagaaaaacgcggggagaacggaagtgaagaagcgtttccttgtgtctctcgcgagaagggattaactgcggcaaacggcaagagtcacgaggagagtgagaagagcagaaggagcaattaaaaaaatgtagagacgacagacaagattattttgagtgggagcccagtgacaagggaaaacgaggtcgcgaaacattaaaaggtgtatgcgcagacgaggcaaggaagggggacccctaagaaggcgagacgggaggcggcggttctcccgcagctgcagatttcaagggaagcggaatcagaggagacggtgaaacggcgagagaaaacccactggtgaaaggcaaagtgcgctgcatggcttttctgccccagaaaattactcgagaaacgcagcctgggtcgtggcttctcggccgttgtctggggatttcacgcccttttctggcgacgcggaaacgccgaaactgtcgcgcctacctttattcttcggcatctgcgagaacgaaacagaaacttgggggttgcagggcagaagaaagagggaagaaaaaaaagtgaagacggcagcggccgcgcgacaaacagtggggggaaacgagagaagtcgccctcactcccgcgctcgatccgtccctgctgcagctgaacacgaacctgcgcgaaggtgctcgtcgaaaaaggccagtcttgcccctctcaaccgaggcgcgaagtagaacggcgtcactctctcgtctcggtagctagagagcccaagagtccgaaaagtgtgtctcttctgaggggaaatgaccccgtactcaaacacccgtatgcacaggcggaacggcgtttctgcccgtctcgtcctgcttcgcaagtgtctcgccgtccgcgatttgagtcttgcgtgtcagtgaagccacactttccacttttcctcaatgaaaacgccaaagaccgagctgcccgtttcgcgtttgaagaaccaccgaagcagcgacagagcgtcagacgacctggttgtatgtgtggtgtatatacacctccagcgtcgtgtgtacggcaagtggggaattcatttctcttggcgtgtagagggaagtggagaaatcgccgaccacagacctggggatgcaacacacgagacaaatgcgagcaaaaacggcaaagacgagcgtcgatgccaccagaactccgcggaaagagcgcagcagttgcggtgtgtgcccaggcctacgctcataattccacttagatgtgttgaatgctgtttcagaccatcaagcgtatgcaggcgagtatctaggcgaagcagctgagtataccgcagaccagcttctcgatagtacaatagtagacgactgtgccgctgtactgacgtttcagtagagaagcggggcaagaaatgcgaggcgtttcgagagttctcacccgcgtcgagatgctcgcagtgaaaagaatgggtggaaactgcagttgagaaactattccgaaaacaaagaacctgttagaaccctagagagggcaagccagttgtaaggcaaactgtgcggactgacgttaggagcaccacatccagaacgtgtgcgaatctgaaaagaaagctctttctgtgttcgaagacggaaacaggacgacgcgatttacacagtatacggttcagggagcagagatttctacatctgatctggctgcacgagcatacttttcacctatgacacgtattggtattactgcgggtactaagaccttcagtccctcctccctctaaagtgattactcgttgtactatggcgatgaacaagaaaaaggagtacgctcaccggtcttgtgggttctacgagccgtgtgagaaggcgtgaaaccgccatttgagtaacgctgaaactcaagatggtctgaagaaatccatttctcgtcaactctcctcttcatctattcgctctgcagtgtcgttttctcccctttgcaactccacccgcaaatctccagagaagaggtacttctgcgacagcctctgccttctagtcaccgacagatccagtcttgagtagtacagagcacaaacctagaacgactggactgaacagcgaagtggaaccctgtgaaggcccgtgtgtttcgcttccaccgcaaaccctcgagaaaactacgtgtcgctgctgcaaggcactccagctcggaacgaacgtcgaaaaaacaagcacggacgaggagagggaagtacgattcctgcaaagtcgagaccggtaaaatgccgcgcgtctgcaaacaccgaacggcaaacccggtgccttgttcgcttccgtgtgagtatttttcaaacaagatctcgaacagagcactgtgtgtgagtgcatatgggaaacaggcttcttgtgggctctcagtggcattttctgccgctaaaactaaaattgtttgcagagtaggtcaggctaggttttttacccgcagctttttcagctgtaacgcgtcagtaaaatgagtcgctacttccccttttttctccgcacatctcgggcaggaaattctctcgaaagacgtgaaagaaagcagtgagttgcgccgacataacccctgcaaagagagaagggtttcttctgtgaaagccacagaaaacacacgtgcttcgctgccaccccagcccgcagccccaccgccttctcacccgtctcgcgagtgagttttctgtgtggtggatcagcaacccttgacagaattgagttggtggttgttttcgatggaaggaagcgagagtttcggaagaattctcggaaaagtggatgtcaacctggcaattctgtcccgttcgcggggggctctccttttccgtgcaagcacgcgtccaccttgatctcgcgttctgcgctgtggattgcaggagacgtgtaaggcaggcgcctctgtttccccgcgggaggcacaggcgatgcaggaagcgtctcctttcacgacaccttggcaattcacgaaggaaattcccgtctgccttgtctgactcaggtggcaaaactcttcctgcgttcttgctgcctctgagtcgagggtttagggacttttagggtttaagccttcaactgccgagggcccccccgcgagtcaaagacacacgccgcgtgtctctcctgtggcgactctccgcgagagaggaaagaaaacttcacaagaatcataggctgaagcgaacctccgattaacaagtgtgtgcgctccgtggggagagagaacgcgttcgagaaagacctacagagggcagaccaagagagtcaaga

SEQ ID NO: 1665 - DNA, 2675 bp, Toxoplasma gondii
ccaattggtcccgcacccacgatcaggactggcacgtagaggtattgcccgccgtcgcgctgggaagcaattgcgcaaccatccgatccttgcggagccgcgttggtgcaaagtctccttgcacagccgccgtgtgtggaaaaatctcccgcgtggaacgagatgctttgtgcagatttccaacagtgaggtccaaaagcaccaggagatcgtatcgtaggttctgcgactcgtcgcccgcaggttcgcgtagaagcgggagcccggatacggaaaattggagggggagagggaaggcatgacttcagcgttgtcagcggacgatgtgaccattcatttttctcagtctgtccaaccgctgtggccggaggcgtttctaaaggatggacgcggtcgaactggtgaacccattcgatcgacctcacagatcgcgagcgaaacgctccaagcaaaaacgctgtggcaccgtggcgccttccagctaaaaacggtgccatcctagcaatccagggaaagagtgggtgacgacagagccttaggaatggctttaaatcgaaactgcacgggaagggagtgttaacgcggggaaacacgtggacgttgatacactctcatctttctctattcagatcgtacatacacgagcatagttctcagagatgaccattatgattgctattcctacaggtactaaaatcttggatagatgagtctgctgcgggattggaactcttggccaaacggcagggctccgaaaagctccagaccggtggtgtccacatctgccccgtagtattcttgggggttctcgtggcataagtaagcgagtacggagacagaaaacttcttccactcgacttttctgtatctatttcgtccatgttctccacaaatcgccaaaggagcccgaaagacgcggaagtttctgccaatcccaaatccacatgagacgggtgcagacgatgagagtttgcggtggaaaaaaccgtggaatgtttcaattgcaacagtcagtgtctccgagattgacacatgcgtgaagttcaaacgtacgcagaatttgtaaattgatgtagacgaagtctacgtggcccgagtaatcggggctgcgttagtttagcagagtaccttctgaccatgcagttctgcccaagacttctccctactacattcatacacacatgcacatggaacgcgtggagaaatgtgtctcgggaacagaaggtcagacttgttaaaacttaaaaaacactggaaccaacagtctcattcgacaacgacgtctcccaccaaggctcacgaccgcatgtctttcccctactgcggttcccttgggcgtacgccgagggatttaatgccttagtagccatatgatgctcaggatgcgagaagcgtgacttatccaaagaggagagaggcagtttccgcattttttcatcaaggaccttcacctctttggtgttgctcacacggggggtttcccgtctccagagggggaccagatcagcgtaagcttgtagtgcagcgccaggtcgccaggagtcccatgatgaaaattactgcatttacgtctaatcgaggtctagtaaacttcgtttcggtaccaaagtcccttcctccctcactgattaacctcgtgcaccagtgatttctttctttttctgcctttctggttccattccagtccgcgtgtaatgtaagggtacgacgctaaccacgagttcacagggaagtgcttgagtgtgttcgatcgttgaagtaagctgctcggccggttggatgtctgatttctcgtcagattggcgtatgctcgtttcattcagggatacagcttcacgcgtgtccgttcgttttccttattcttgagcgcatttaagcacacatgtgggtacacgtgtgtacctgcgactatctgtggaatgtcttgcccctctgggctaggaggcctgtccgaggggagtcagagagtctgcgcaaagaccacccgcccgcagcctaagattttgctccgaataaaaaaacacgatcgaggtcacgccggccacaacagaagcagcacccgccgctgcacgacaaacgctgaagaaaggattggaaccagacaaagaaacattcgagagtttactgggttttctacaactttcttctctgcacgatttccaagagtttcactgttaacatcctcgattttttgtctttgcacaggcgcggtgggcggcataaagacagaaccatgaacaaccaccgcgaatttcgttcgggtatcactatcggatgaggacgctggtcgatgaaagcagaacagttcatctgatgaattgtctgttcacctgttccaagaaatatcgtcaggatttggattaaattcctcgttgtcttgaacactttctcgtggctgagtagactgcaacaagaaagtctcacactggaactatttttctcgtgtgatcccttgtcttcaaaccgcccaccaggttgctccgtctctgttgcctttcatttccctgtgcttgttgtgagatgctccacgttgcgggctcccgtctacgctaggagtttcgtagggaagcacacgtcagcgtggcaggaaaacaggcaccccgacacgcgggacgaacggagaggagccccttccagaatctttctctgaatccgtttttccttttccacaaaaa

SEQ ID NO: 1666 - DNA, 2461 bp, Toxoplasma gondii
ttgtctcctttcccggtctctgcttttatccaggcggctcaccgtggcccatcgatcctggcggaattccagcgcctgcagatacactgtctccagcacgccccacactgcgagaaaaaacgaaaaaaagagaaaaaaacgaaaaaaaattgaaaatgaagaaacggaagaacgaaaaaaagagaaaaaaacgaaaaaaagagaaaaaaaagaaaaaaagagaaaaaaaagaaaaaaagaggaaaaacgagaagaaaagcgtctttgcacacacacacacacagtgagacaaagaggacgcagtatagacaggcgagagaacgcttctatcaccgtccctctctgcgggggcttggccaagaacgagacacggtaatgatttgccatgttcatcaggatcagtcttcccacaaacggctttcggtttgaagcgtgcgaggcttgtagcgaacagcgaggagagaacaagaaagagagaaacagagagaaagagcaacggagagagagaagggaggagagagagaagacgagagagggcgaacatgaggcagaacggaagagtgagtatgtagagagatgcaatgaggggagaggacgaaacgcgttcgtgaacggtggagagactcacaggcatctccaagtttgtctctgaatttcctgaggagacacgagccgtacgcgagcagaagatctccgcggccttccgtctgagaggaagacgcgctctgttgctgcttaacgaggtcggcgaaggagagagaggcagggtcgtccagggactgaggcggtctcatcttcgtttgatgttctcttcccctcctgccttcgttctgtgcatctgcgtctctctctaggcctgtttcttccctaagagagttgccgcggcgaattgtcaatacgcacagggcgacgagaaaaaacttcttcgttgaacgaagagacctggcgctcggtgacggcgcagaaacaagcagggcaggaagaggggaagacgcggcagagggcaaccaagaaaggcggacaagcgagacagcctcgtctctcgctgttctgcgagatacgaaaaaaaagatggagaaggagacgcgaggaaaaagaggcgaggagagaagaaacgaggcggggagaagagaagagaagtacacgaagaaaggagaaaagaagagggaacgagaggagaagaagagaaaataagaagagaagaaaaacgacgacgacttcagctgtttttctctgggtcttgccggagagaggagagacacgcctaaggtcgtctcccgttttctcgtcgtttttcctcctctctctgttcgattgtggacctagtctctcctcacacactgttcatcttgaaaccggttccagaaattcttctgctgttcttctctcggcgtcggtttcccctttttttctgtcgcctctccgtcgtgcgtttctcctcttttctctccgccgttccactggcagaagggtcggtgcagaaagaagccgccaacgaaaaactttttttctttttccgtttttgtctttttcaccactcacgccgagcctccacactcgcggcggccggtcgcgttgcccagacactgtcgccggggaaaaacttcgcgggaggcgttccttggcgtttggctttacgacgaggaagaaagaggaaaacgaacgtggagagggagaaaacgaggaaaaggcgcgacaaaaaagaagacaagaaaggcggcgcggcctcacgccagttccgagaaaaaacgcgcgtagagcacacagcgaggtcggggatcgaagcgagagaggccgcttttttgcacaccgtgaaggcgcgaagaggctgtcgcaattgagcgccagggaaagtcgacaagaatggacgagcaacgggtgaaagaccgcgaagtgtaagtctttcaaaaccagcgaggaaaacgatgctgttttcgtcgagcgatgagaggcagacgaccccaaaggcagtgagagaagagagaggagagagagaacaagacacgcagaaccaggttgtcgtcttttgagtgcggttgaggcgcaggaagttgcgcatccctctctcttcttttttctttcgcttcttctctcttcgttgctcttctgcttctcttgggtgtcattgaaacgtccttcctcaacgcacacgcaagctcccttgtacttttctacgagttgatcattgtgacggatgcgaaaaccgtcgctggggactcgacggaggactcacgacttccacgcgaagtgcgcatcctttctccctgactacctacgagctccgaagcgaagagcgccttcctggaaacaagactttttttatcctgaggcgaggaggagacagcggagcgttcgccggcgtccaacacccagctagcgatccttttctcgcctccccgagtacgcgaacctggcgcctcgaagcagagactcaaccctgacgttcttcaactcttcaaga

SEQ ID NO: 1667 - DNA, 1403 bp, Toxoplasma gondii
gttttcacgctatctcttgtgcctgtccagtcgctcagggaagatttgatcttttttatggtataatggatgtgccaaaattaaaagatgaatttagatttaaagcacaccgataaaagacaaggtgtgcccggaagagactccgtagaagagcttgcgttcgacagcctttgatccattttaggctcaccctacaacggtcacatcgcggcctcttgaggaggcggggccacactggctggcggcaaagaagcggtcactcttaaagtgcagacttcagaaaagggtaaagttggcttctgaacgacggacggttttccgtatccacgctctagccccgaaggaccccgatagcgttgtccttcgcacagccggaaagcgcgaggcgtccaacaacagagctgtatctgattgtcacaaagacttctgaacaacggatcagaggggaaaccgcagccttctatgcggctatcaggtatgctacactgaaaaacctgaacagccttcaagactgccccattggccgtcgtactccgccggcgaaaatgtcacggctgcttgtccgagatcctctctgtgtctcgtctcgcctgtttttcggaattctggtacttgccacgcaccaccatttgttttctcgacctaccatgaactcatcaagtagacgacaaccagtggaaccatgttgacttgtgacttgttccgtgttccttctggtcagccgttaagtcaacgcaatgtcgtcttttcgcggacagcgaagtaggtcagtagacgcctcttgttgaatgcctttcccgtcttttaccctcgtgttccgtagtccgactgaattgacttccttgtttctggaagggtttctgtaatcgcatctgtctacccaaatgaccctctgcttcgcgagcttgcagaatgctctagaaaactgcgtctgagacggctcagaggcggcgctcgatgggggctgttcaccgtctgagtccagcacaacgacaaaagcctttcgtttgtttttaggacagtctcccacgtttttctctgcgtctccaactgcgatttttcgccgacgagtccacggttcccgtgcctcaagtagcgtctcgcaccgagacactgttcgagcgacagcggctcccatccctttccgcgctagcttcccatgcttccgtgccactgtctggcttttcttgttcacacgggaaaataagttcaagagcagtcttcgctgacgcagacatttcctggactccgaaacgaacaccctcgtctgcgaaacaatatctactttcaatggtctggccatgaccttccgtgcttcacgccggcgttgtccggaaaatgtggtaacttcttttggacgttttccccctgcgtctagttgtcccactccaaatcactcaaaa

SEQ ID NO: 1668 - DNA, 4978 bp, Toxoplasma gondii
agagaaaacattcacccgttaccaaaaataatcctccgcgttcctgtcacagccggaagaaagcaaacggatgattgcgcgcttccgagccgatgcctcgtgcgagcctgacatgctgggtacatggatcgacagcgcagtcacaacagtgcgtttcatgcgcaagatgctggatgcggtgccgtcgcttgtacgggagcaatgcccaccggcactactcacagtagaagcttgtcaccgtattacctataccatctacggcgaaatgtgcagcgctctcgtgtagaatatgcccccgcaacaacgtcctgttcacgtgtacgaactgctcccatacgcgaccagagagtggcagggtccacaaaaaaggcgtgagccgtctccacctacagtcacgctctaaaaacaatactggggaagtgtgttttggactgcagttctcagtggcgcaaaaatcttaattctagagttcaccgcatgcgcatgtcctacctctccaacagggacagaaacgtcgtcttcttgcgcctcggccttgatcagcggctcgtgtacctgcgactgcagacagaatgtttcgcaaaacaccgcaagagttttcccgctgaatgagtggatcttgtttacgctgtcaggatattgtattcctgccgcatctgtaaaacggcgatattccggcacggagtgagtacacacatctaccaggcagagcataacaagtaagtattgccccaacaattcccacaatgctgaggaattttttcgacacacacattaccgaccgtcgcaatacgtcagcattcggttctgaaacccacccaccttccgcttggagaggccaacttcttcgtggggcatcgcgggagcgctgtctgcagctgtcgccaaatccagggaaactccaccctgattggcgttagatcctacggcagactcaacgggtgttgcacaagcagcacctgcgccgtttgctgtcagagtcgacatcctggaacagccagctttgacgaagggcgaagcacgagggcaacggtctctccagtaaagcagcctggtggtccgaagtggtattttgtttgcctctcgttcctcgcaaagttcacttctgcgaaacagggtttcgttgaagtaggcttgacaacgctacgagggggaaaagaatgccattcaccctcggagagccgaccggattcagagacaaggagctacgcgatcgaggtacccgccttcaaagtcgccggttttcacgtgcacttttgactgtctccctcgtcagaaatactcagaacgccacatccgtggaaacccattgaaattttccgacactggccaacagaccgtctaggtggtcagacaccgtgcgaaaagtgtcgagaaagagcccttccactgcatgcttgcgaaacgtctaatgctggtggcggctgggagtcccgcgcgaatagttctggcacatcacaaaaaattcttacggattcctgatttgcaagtgaacatgggggggcttgtcgacttacgtagtccacgcctacctgtgtggggcgcatctcgaaaatctgaacttcttgttttcatctagcttcgtgggaaggaacagtactcggtgctccgcccgtgccggacacagccttccaactacattcgggcggagcagccgtgtgctaataattccagccgacgggacggagagagtaactatgcggctccatcatctaagcgaaactgcattctcaccaaaaatcaaagggtatggcgaggaactgtcgtggaaacacgactggataatttttcagtgagtacctcttagtgccacagtacccctgtaagtctcttcgcttcaggggggtgacctctaggacgcatcgtggctaccgtcaagaagcatacactttgaataccctccaacccgcagaaatccctcttttgttccaggtttattgggtttatagttgttatttgtagtattaacagtggcagaaagctactacctgacgcggctacgatcacgaatgtaggacaaaaagtcgacgtattgcgacaccagacccagaggagcctacaagctgccacgatggtggtcgcacatcttgacaatcgctatgcttctgcagcccccaaactgcatatttctcagacggaaagaagaaaccgcatgaacttgtgatcgctgacgctgagcacttcatccacttgctgtccacgatataattatctatctcgtgttcggtgtagtgccccgtttccatatatatcacacgtctcttgtagctttgagatcatgctaacggcgataagggaagtgagcaagaggtgacggatccctgttctctggagagttagtgtggtcttaaccctgcaatccagtggatcgtgcatatgagtgttcccgtgattccccaacataccgttatattctttcgtgtgcacctctgtataaggtactttttgcctcttatgctaccagcagcaacaactgggcagacctgcgaagacgctgtccttctgccagaccaagcacttcatacgtaacgtttttcttcaaagccgtgacgccacagcgataggggagagggaagagtatttgatgcatggaacctgcttcacgaagatgacgtgtagcattagagggcaagcgccattttatccattcgtgatccgagttcaactgccaagtagacctgtaacaccagtctccgtgtacgacacggagggcgagctgcaactccctccaggacgactgcatcggcgaaaagcgccagtagagatgtatgaatgtgtgtttcaactgaatacaatctaatacgttgaaatcgacgctgcttcttgaaacttaacgccatgttggggacctcggaggttcttttctgcagcttggctttgctggggaagggtgcggcgcaatagcgtactaccacgttttatcttgcgttgtgtagcagctggaatcctttccagttgcgtagctggttttgactccgagcaaatagcttctaggcacagaaaactcctcggtggtgacaattctggactgggattcacgcagcttcggcgggagcagtatcgaacaaacatccccttttacataccacctctgcagagaagaatctgaaaactccggagtggcgtaccccttcggattcattagtatttctacagtcttggatcatcgaggctgatggcacttggtgagagacgcttcaacaagcgtccctctctgacgacccaactactgtttctcccctcgtgtttcctcataccgaatctgcaaaatgagaactcggcatttggctcaacgctccgtgatatcttgagcatgaactcagcctatctgtcgaatcataacacagctgccaaaagcagcatatgggaacagacagcagcgccaaagcatacctggcgctatcgcctccaaagagcacgaagcccgtcaaacaggtaaagcgcaacaagactccgttcgtttgattctgcgcagtgagctaaatagatacgagaagcttgacaaggacgaacgatcataaaggtacttccacccaaaaccggtgatttgtcagtacacatgtcttcccttaatagtctcggattttcatctgagccaatgaagctaacacaggagcgcttggatccgttgatcacagaccttcaaaatatgaaccagtggtccaactcatgacacttcattcgccacaaaaagcagagtcgtaactctctgtctctgcacggctgaaacgatccaatgtgacctttggaaaaaccgcaatgatttcaggacctccagggcggtagtgtcgcgctgccgcaacatgtgccgcccccgtgtaaatcaagaacaagacactatattgatgatgtaagcaagacttcccgacttctattttatgataatcctcttcacaggacattttcgtgttgccttctgcgctaaactgttctagcagtacgggcggcagtgccacacacaatggtgactgtaggtctgtgaaaaagtattccaaaaaagtacccgtattacaggctgctttttctcaatcaaaggaatatgaacggcaccatatagcatcgtttttttgcgcctggaagacaaaggaacaaaacgctgctttccgtcactgcggcggacctgttgcgacaagcacggcattcagctgcagtggaagttgatcctgaaactaactttttcgcgcaagaaaaatttggagctcacgtgaaacttccaagtttcagtggacacaaatgacgactagcccagacagaaggaccagcaagcatcttctgcatggacttgtctttccttcagtcacaaacgaatatgccagacacagcatggcaacacctccgctgtgcccggttttcccctgcctgcttgcttctgttttaaccgcggactcaatcgaactcgtgcatgttctagtgggacgactgtcgaccttccaatgaataaaggttgaacaactattactttgtgtgaggagagaacctcttctgaagttctggcacctgcttttgtctctgcgatccttattcagcgcaaatgacctacttctgaacacacagttcggggtgggtgtcttcacctcactcgcaagagaatgtcgcgtcggctgcaaaactacgggaatgtggcttacaataaacgtcgcgaatctgtcgccgtttcccccctcgaatcgcccggtttcttttttgcaggctgaaggaggggcaccatttttcaagctgtcaagggatagcccacgttccttcgccctcaagaactcagcttatacaagggattttttttaccagtctcttcgttctcgttagctttctgcttcgacgaaatcgcggactgaggtgtgtgaagggacctacacgtaggccgcctctgtgttcgtaaaagaaaattaaagctcaagatgtctggttcattctccaccttcttccgttgggctccatgacatcaatgtgtcacgtcctgccggcgagaccgctgctacaa

SEQ ID NO: 1669 - DNA, 1780 bp, Toxoplasma gondii
acggtagaattaaggtaaccgatcgtagtcactattgtcgctcaattcagtgttgatggctgtgagtttgtttccgcagccgtgaacgtttccttcctgccaactgtctgccatttctcatatgctgctggagcgagttgttccgtggcaggaaggatggtgtactacgctaaacggcgaaaccctgctacatactgtcttgcttggttcactcttcattctttcgtatgcttgcacttttccttctttggagcaaattgtgacggtgattcttgcgatgccacgttgagcaaatgatggtgttaaatcactcagctggttcaaactgcctatactcgtgagactcttcgacgctgatcccgaccagttcttctctggagtagcaacattttaccgtcattcatgcgggggctgtcgatcgccatatgagaaaaaagtgcccgtcttccctaccacgataaaaggaggtacagctacgagagaaaagcgcaacgttgcggagaattgagcccccgtaacgcctgagatgtcggtgctgcgaactcgttatctgctactctggccaatcctggtcttcctttttgcagaagcagattctcttggtgttgcctgttttgcaacgggactgatttagtagtgtttcttctgtggctgcaattcttcacggcataaaggtctttcctgtaagtgcccagagacgaggtacgcagagcggaggtcgggcgcttcccaaagtccaggcgccagccgagaaaaaacatctttgttacgtacagaccgctccatttttgtcacgaagtgactcgttactctcgtcacactggcctaaaaacaatgtagacttggcgagaaatacagctgagtggatcactgctcctcggcaggtagtccgaaaccaactcgaggggattgactgccgaagacccttcgtatataggggagaatgtgcgacgaacaaggggattaagagtttgcattcatctcaggagatcacatggaagcgtcaagtgtgctatggcctacctcagacaacgtctatttaccatgttcctatatttgaactggcggattgcggttcacgggttttatggatagtagctgcggacaagagcgcttgaaatggtgcacggaaacacgcatctggatcgtcttccaccaacaactgtgttacccgcagagttgtaccaaagaaggcagtaagccagacacagccccgcggaaagcatcagcggatcgtgaagaagcgagtcagctggcctcgctgcatgcgcggaagatcgccttcgcaggcaaacttgtggggtcaaaatggtgtgaaagatgctgccctttaccgatgagaaataccgtttgccgaggtgctaaggcgcttcaaggatacatgtaaagtcagactggattcggttttccttctttttccctctgttcgtttatcgtggatcacgcccgctgttccacacgctttaacatgacatgttgctccttcgacgggacgaacagggggaacacgatacagtgcagtgcacggttgtgtcgctgaaagcaaattttcgtgaacgtttcacaactgcagccgtctgttgagcgcaaacgcggtctccaacccggacggcaaaactcaggactctcgaaaacactcatttggatgagagtcaactttgcgactcggctgtcttcaccagctgtcgattgtggccagtctctctttcggtgttggcagctcctctcctgcggagttcttctttcttgagacgggttttctctgataaaaaggctaaaa

SEQ ID NO: 1670 - DNA, 3778 bp, Toxoplasma gondii
ccatggcggatctcaagagcagaggcatttctgtcgtatgccatgccggaacccaagtggttcgtcatctgtccagggaaccaccggagtggatgcacgtgcgtcgcctgcaggctctcccgttttcgctggacaggtccctgctcaggtgaaacaggaaggtggggaatgtgggcaaggctatgcaggaatcgccgccacagaagatggtctcgttgatcacgggaattctcagacagaccgcagtgcagggcaacactgcatgctaaacgcttcgggaggttcggagcgagctcacgcagccgcaaacacttcgacatgtccccaaaggaaggaatccgacccgcagccaactgtatcttgggctgccgttccctgccagtgattgaaagcgttttgttcggagtccgaacccacaagtgctcgtaacaccactcgtttctctttgtttacatgcgggaagccatgaacagacggggtcatgacatcaaggtcagcaagaccccaaccattcagtagcttcagaagtcagaactgtcaagccagtacttaatgcacaacactattgatgagttgcccttgcaggtttgtcaatgcaacgggtctttgtctccgcggacgcgttttctggggaacagcgagaaaaaggcaaagtgttttgtatcgttgaagagccgcacatgctatgggacctctgaaggcgactaggttgtttcctagtggtacaagagccgtccgtgctggcatgtgtcggggaaatccgagtctgctcggtgtcgcatttttacggatcatcctcattgtctgatggggtgcagcttgtttgggtgtgtgtctcgtgcgggcgtcgctgaggctagggtaaactctcaacgctttagttctggacgacagttacacaaaacggaagatgctggttttcgtcttttttgccaagcaccgtgccgctcatggaacacccaggcatgttttgcggtgccgttcctcacagatgtgaggagcggctactcgcgagtgttgccgcaccggagattctgtgggaaaacaaactcttgtactatgaatcagatttccgcgcgtcactgatatgtacatggatttacagtattccaaagaacacctgattcgtctctagcccgtccaaggtaattcgggagtttcgtaccgtaagttcatttttggcttctggggtctgtaaggcttatcggacgaggagttgtgcttcactggtcaattctcgagccctccaaaaagtagcaaggctcacattttctccaaacgcacttcttgtccaaagacaacaaagagtgggaagcaaaacagaagatgctggctttcgaaatatcggcgccgaaaatccctcgcactttgacaactccggatcaggacttgtttcctaaagacagcagacgtgctttttgcttccagtttagcgtgcggaacagactacaatagttttggttatgtgagtccacattaaacacgctgtagcaagtgttttcgcgtgggatgcgtcaggcggctgaaattttgtgtctgtagtgtgcactaagaaaacatacgggatgcatgccgtttttagtggcaaattcggtcagtgaaggtaaacactcagaagagtatgtcaatagctacagccgagcgaatgagtcgtgttttttagggtagctgggctgtcacaacgagaatagtcgaaggttcgtatctgaggaggctacaaatcatttactgaacagagcggcagtttgaaatacattagacggtttgcgtcgactgcagggggaaaggccaagcgcttcttttggagcgcggatcatcgttttagtgttgcgatagcgtcgccagtctttccaattttcttttctcagcatcgtacagttactctcacttcgcgttctagctgaagatcttcctgactctactcgacagcagcagttggcgaagcgtatgagagattgttgcatggttcgacacatttactggaaaagtgatgtgtgccaaaccaccatcagtgtcttcatgagatggtggaacatactgtcccctcggctatccctatcgtcctcaaagacacaaaatcaacctaacatcttggtttgcttaaggtagcgtgctgtttttgcaattgagtctagcaagcaccccgtgttgcactaatatctcctcgcgtttttgtcgctctgtacgaatatgcacgcgatcgccttatctgtaaaaacgataacgggacctttcacgatgtaagcttgacgtttttcatccagtgctgtaaggcaaggagcggaactatctgcaaatgatccaaacctttacgtgcagaaaggtcagctgaaattcactatcataacggaattctggacagcatgctgccattcaactgcgtgatgaagtcttacaacacatttatcgtcgcatcttttcagcggaccgacggacgccggcgcatttacactcttctatttctgattcttctcgagacactttgtgaagttttctcgcccaaatgcggagcttacgaacatgcgcgcgcaaaacaaaaaacttctagcaaggacagtccagataaatctggaaggaaagggggccttgtagaaggtttagatagtgaggcgctctgtcaaatcactggcggtaccattaatgttctggtgagcaaacaaccgacaaccgacctaaaggcagcggaacgatgcttttagcgccgacggccccacaggtccatccgccgggaaagtggtgtattttcccttgaggacaaaaacgacgaaagtactttcaacagaagtgctttcttgtgatgcggagtctagtgaaccaaccaagaaactgagaaaggaagaaaagcctgaaggtgaggcatgagttggcgaggatagcctatcgttggggttttgttgcacgtcaacgaactcggtgactgttctgccatgtaaagcggacgggctgatccggatatgtgagacactcgctgttccttccttgagtctttgtgcatgcattgtttccccatttcttccttcacagcagagacacagatccgccgatctgaaacagacggcaaatacgttcgactttcatcccctagtctagagactctatcgactcttgtcacgcttccggctttcttcgttgtcgaccccttcgcattatcagaaaacacatgtttgtctccttggtaaaaacttgatgatgttttcagggggaatgcagtggcacagtgaacggaactgttttgtcttaataatctctaagcaggaggcttccgctctggcggcatgtcaccgcaagtgttatccctgttttgacaaaatattagcacctccattcttctatcgcaaacgtttctgacatatctcagttgttggaagtgcaacctctaagggtcagcgctcacaactggcgtctggtcagaaccctcgagttttccagacgaagcattgcgttgcaagtcctccactcgacactgggatgccgaacacgatagtcgttttccttacctctcctccttaggcttcccgaaagagctgtggacagagaggcagtgcccatcccagtttgttttctgtcggcctgcattcgatgccagtttagtaagagctgggtggtctgacggctttcccgcttccgtgtcgagcaagtcacgtcgtttgcctgaggtaagctgcatctctcgcaaattacctcacgtttctagcggtggcaatgtcgagttcagcccatcacggagtcggtgggttcagtccaccgtccggcctcggtggcagtggcagcaacgcga

SEQ ID NO: 1671 - DNA, 1834 bp, Toxoplasma gondii
agtaaaacggagcaccgattttccagaaccgaatatgtccgtttccagcttccagacacctcgttgcgaggaccgcctctccgttctctctgagccgatttgtgtcggtgcctggtgcgtctgtgtctcctgaggcgcagaatccattcgccttcgcaccgacgaagagaggggagagacggtgccgtgtctcctgaccgacgatcgtttcgaggaaacgaggaaaccagacgagaaggggaaagtgcaacatctgtgacggggaacccacctctccccacacagtggctttctccgagggagagacaccgtcgccactcctcgcgtcgccatcggcgcagcggcgaggaggagaaatggtaaatctgccaaggaaaaaactgcagtcacgaggcgaagaaaacatgagacttgaaaagagtgacaaagggacagctctgaggagcagaagcaaacaaaggagttgaggaaaaaaagaaaggcaaagatttgcgaagacgctgtgtggaggaacgagaggcgacagagagaaaccgcctcgtcgttcctcctcagttctcagtctgccagtgcatgtgtcgctccacaccaccgacagaggcagaaaaaaagaagtcaacgaaaagagaggaaagaggacacagagaactcaggaacgaagaagaagagacgaaggaaaagagaagaagtcatttcaggctcggtgagtgtcgcttttcaggacggaggcgcgtccgggcgaagcgaaggaaaggacctgagaagaagacaaccgaatcaaagcgcgaaacgtggagaagaagaccaagaagcgacgatgcgcgtacgaggcggttcgagcgccttcaaggctggcttgtctcggcgtcgagagcaacgagccgcggcgcaacaccctgagcatgcaggccggggagattctgcctctccagctgcgagaagagcttagcgacaggaaggaaccgcgacaagagaaagaagaagccaatcccagctctccctcttcatcgcaccgttcactctgaagacggggctcaaaaacaagccatcgacgagtcgttttgtctcctggggagaatggagcaactcggggagggaacggcagcagaaggtgagatcttcaaaaaggtgagggtaaaagagctcgaaaaagagttcgcagaaacgttccgttgacgaagttcttcacacgtccagccccgctctggtcatcgacgctgaaggctgagcagagaggctgtcacgctcgcgacttttctctgtgcagagatgctgtttgtttgcgcttgttctctagtttttctgtgaaaaactcggcgaaagcagaaagcgtcgccgagcaaccttcaccccagagaaaggcatgtgtctcctgtcgcagggcggcggggcgagagaagaatcagagcgcaagaaaggagaacgcagtttcgtcggaagcgaacggtgcctcccttttccttgcaggctgagaatctccagagagcgattgtgtgcttttgccggcggatgggcctcgggtctccagaggggagacaaagacggagggacgaaaggcaacacgacggggacaatgcatccgtggggagaaagaaagaaaagaaggaaacgagaagataaggagagaccgagacggctaggaaagcgacttcgtttttccccttcgtagatgctcccgttcgccgcgatcttctcgtcctttgtctttcgtcttccccctctttctcggctccgattgtccacagccacgtagtgtcctctctgttttcttgccgcaaaggctgcgtgtgccgatagggcgtcagttttttgtttccttctccctgtcgcaaca

SEQ ID NO: 1672 - DNA, 2011 bp, Toxoplasma gondii
catgcagtgcgataaacaggcgaccatatgtagggtaaatgtgtggacacgagacataatcgctcaggggttggtagcttcgtggggtactgtcgtggactcagacagagtctgggagtggtggcaggcaagaagccagtagttccccatgaaaagcgcaggcttgtttctttttccgggtgccagcaccccgctagattgactttatcgcggacacaaatgccgcttgtggtgccgtgtctggttgcgaatgggaattgagagtcaggaaaaatagctttgtaacacattctacgcccacacaaaaagatgtcgagttgtaacgttgtgacagaagagcctgcagtaatctatagagatctcgataaggatctcgcccatatcacccagtagaaaaaaagtgcgtctttcaatggtcctagatatgccattttgtacaaaagcatccaaatgcagagtcaatagatccagatcaacttcgtttcggtgacagaaatcacgcttgacatcagattagatctctccgccattgactttgcagcggctcagtggtaaaaacgtgtagggctggtgtatatttccccataaatcatgggctaggacgttctctccacgtccaaagcacatatctcagaggcagccataccacctgcacggcaatgaggaattcccgctcctacggtgcaggtcagtcgaaggacagaaatcgatctcagtgaattgcgctgcgttccgtaatgttgggagtgactggcgttttgagcccgatctgtccgctggctgcctcaatattttttcgtacggccgtaaatagacctccccgaccggggaagctgccgacatctaaatgtgccggggtgaacaggcagacagaagtgtggtcacgacactacacgtccaccgtcccctaatcttctgctttgtcttctccaatagtgtaaaaccagacgcactgacatgctccacggcatgttgagattccaacgacagtcccccacatttgccgtgggtgatcgggaacgctttgacaagttgtggcgctatcggttgatgcagacgagtcttggacgcaacagcgactctctttggaccggatcagataggtctccggctgtgaaaaggtgtttcaccgttgtcaagaaaggaaacagccttcaagtcctggctctcattctctcacgccatctcacctccgcgtcagcgccacggaaactttcttcctgcatcttagtcattgatagtccccaaaatcgagggagtgtttgtagtatctgtcgcgataatcagaagagacacgttgcctttctttgtgcgacaactggttccttctgtgcgcaaagagcggcatttttgacatgcaacgcatgcatgcagcgaagaatgcgcaaaccggttgacagaatcgattcctgtttgcccacaagtcttccgcctaatcgcgtccacgcttcacagcaactaggagggattttccgatgtggaaaacatgcacggtttccgacttgttagtacatgaggagctccaagtccaacaaaatcccactactcgcgctctgtggctgtcttgctgtgattactggggacggagcacgacacttcgattttccccgctgcaactcgtaactctttcgggctctaccatcttcttcttatgcgtatttacataaaagaggcctggaaactcatatctgagaaacgaaagttcccgttttccttgttttcttgtctgtgactgcttcttgttagcagtgaaggacttggctttgcagcctgcttgagttattcgctgccgcgccacacgcagccttcccaacatttggagagcaggcgctcccgatttggaactgaatcggggtagcgttgctcgataagtctgggccgtccaccttttagtattcctttgcgtttccgtcatcttctgtgtctccctgctgccttttttgacggctcgctgcccgcctgctccgtcagtttctctcgcactccgacgagaaagaaagtcacacggaga

SEQ ID NO: 1673 - DNA, 2211 bp, Toxoplasma gondii
cgcatatctccattcgacgatgtgggaaatcgggacgactcaagagagagtggaggtctgtgttttcgagagagcgaatcaggcgaagaggaggcctgctccactctggacttgttcctgacaggggaacgagacagagaacggggagagcgcgaagtggatgactccgaagacgaagaagagcgcctccggtggcgccgcttggtctttttgcgtttctcctcgtgacggcgcctcttgtctttgcggtccctcttcttcgacttcatttccgcaagactcctgcgtacagcctgtcagttgcagcctcacgcgagacgcaaaacagcagaggagggagggaggaagacacaaacagcaaccttcttgactctaaaactcctctccccgcggcggcacggcgctttcaacaccctcggcgcggcgagtgcagcaaacactttggcgaacggacgaaggaaaaatcgcacgatcaagtgtcctccaggaatttcacaagcggaagccggtgagcggtgacgaggcagcgctccacgtccgaacaaaagaaaacgcagatcttcacatttgtgaacaagtgaagagatccctgaaaacgaggtcaaggcgttgtctgctggcgcgtatctgaaaaagactgccggatgtgtcccggaagaagcggggacacaagcaaccgctgtcggtgttcatgtggacgaaattcaaaccaggggaatttcgaaccaggcgtagccaaaggtatttttaagccttcggagcacttccatgctgctcgtgtcaccgtgctgactggagttccgcgacgtcgaggtgagacctcgttttctgtgcgcaactgtctgccgaaacgggatcgaaacacgccgacccttctgctttgttttccgccgccagacacaggctcgcttctcgaacgggagcaaatattcaaaagcgcatgaatgtgccaacttcaggtatatagatgcgcgaagatctaagacagtttaacgttggcaatggaactgcccactcacgaagtcactaaccacggaaatctgccggattttctgccactctaacaaaaaaaatgcacacgcttcggaggagacttggtcgctctggcagaaccgccgcgctttcgctcaccagaccattccctggaggccctcagctgccgtttgtttctgcggtttttgggcgaagccagctacccgttcacacatgggaaacgatgaagctattggagtgtttagacactcggaaagactctttgtttcgcgtctcgctggcgctcgcgagtccttctgtgtaacacatgtgtggcttcggacctggctacgcttgtggctgttattccaaaccctaaagggaagagaacgaaggatacagccttgcttcgccaggattcgaggaaacactgacccatcttcacgtattgtgtgctgacctccttttgtcgtggctagggtggatccgcgggctgagattgccacacgtgtagcggacgaaacgcaaatcgcgttgtcgagagcccaggcagctggttcccgttggctttcgaaacggacgcacacgcagaggctttatagcagaacgcaggaacggagcaatttctcgtggagactcaaaccgttccgatgaactgtcgaggagcgcgtccccgacttttgttgcagccgtcacagcagctgtggtgtcgcatccttttttggcggctctcgagctcgacgctgcttcaggaagacactcgctgagaaaaaaagcatgcgctgcgccagggcgtctcgcggtatagagagaagaagcggggtcgtggggcggaaaaggcgcgtgcgaatggcatgtgagcatgtgcaaccgtcgccaggcgccaggccacacgggattggagagtgcggggggcgacaaagggttcccagcgagaccaaaatttctcggtcgagatccccggcccttcgcgtctttcgctatttttcctgagttttcgtgagggtcgtgactctcggcgtccttcgcgcatctgcaaatcgccagctgcgttccgtgacagttgtggagagcgcctttcgcgccgtcgcgggtgtctcaactttcgccagtcaactctgcagctcgtccccgaaccctcttggtttgttcacctttggcgcggcccttcttctctttcgcggcacggcttcgctctttcttcttgtccgttcggaggacttttcacactcgtcaaaa

SEQ ID NO: 1674 - DNA, 4952 bp, Toxoplasma gondii
cacagtggatgctagcgccaacgcgatcaaggaagtaagcaagtaggaagccggccttcggtcagcatgagcgaagatgctgcagagagtcaagaaaagtgccacgaccccggcaggtgcattatcaaagacgaagcttgtcagggcaaagaccgcctgcatgcctatgagtccagcaagcacctctctcacgagccgaactctccagatgcgccgatcgatatcctgaaggcgcaaccactccgcctcatttttcgttttctctccggtgaggtcactaacagggatccacgtgctggcatgcgccagacgatgctcagcacctctgtctgctggagtggcgaatgacggccttaacaaggggctcaactgttgggactcgggatcggccggggcagcttccaggatgccggaagaagccacaggttgctcggagttgtttgaaaggtcttgcatcaagtggtgctgtgatgggaaactgccagagctccggccactctcgtgccggggagctggaaagagcgattgacttacgtgggaggttgaaccagatacacagcgattagcctcaatggcgctgctgcaccggctatctgcttcagagcctcgcgcgctgattccagtttgctgttctgtagtaggctggcgggaatcctcttgtcttacacagctgctcgttgagtagactagggaatcggacgatatcgtacatgagaggaatcctggtcgcgggtggatacctgatgagttgtcgcggatttcgtccccgcctaagaaaacgccagagctttttttgtcgttttctgatgaggtctcgtggatttcgtccgcccctgggaagatggcggcgtcttttctgtcgacatcgtccttcccagcactaaaaatcgcgtcgccacgagattcagaagaggggatctgtgcatcgggaaacggatctggaacagcggatcgatcagatacgattctctccgctgacaatgagccttcagacaggtagacaaggttcccctgaccatcaccggtatccttccgtaccacgttggatccagaggtcggagctagaagcccaggaacattcgtttctgggcggtctgcaggatgaaggaaaatcgattccttctcacgagcagagtactcttcctctcctttgccatccatgacagcaacaacagaagaacgggccagggaccgcgggaaccccgactcagcactcaaatgataaatcagaatgtgggatttaaacttgttccacttggtgacggctgagcaaaaaccatgcacgtacctttctgaaaagatgaatactggccgaaataagaggaaaacaacggcagcgagtaggcaggtctctatgcgggttctgtcaatagtacgtgagtccctctattttctgagtctccatgtctacttttcgccagcagtatttgctagttgcataaacaccgttgccatacagaaaaaagggagatccttccacgaaaacggatctcttccacctgcagcttgagccccgcaatgtgcctgttgcaagacactctcggcccttaaccatcgtcattttccccgcctctcgagtgtcggcagctagccggaagttacctaccgtccaagacgttgccttccgaagggaggaacaatatctgaccagagccgcacaaaattctcatgatgaacggaattgtttttcgctggtatgacatttaaaattgagattgcagtaagacaagtcgtggggcagtttggtaagagacttggtgtactatatcgtgcatacccggtactcgttgacccctagcagcaccgacgtccaccgtgaacaagaagcacgtccacggaaaaaaaggttcagaatcgggcttaccaacacgccatcctttgtctaaaccttacaacatgatatgtcagactcaaccaaggctggaacaacgcagccttgcggcttagctgtcaactacttggtgaagtgttgctacaccaaagtcagggttatgtgcaacaggactgttgaccgttaacgatgaggcctctcctgcgtcgaaacacacgatgaatcattcacgcatccttcaccagttccgtgagacgtatttatgcatgaccaaagcgtcatcctcaaccctcggtcgtccaattttgctccagagcggatgagggagtatgagatacgagctggaggggcgtctgcaaacgctcgcgtctctcgccttgccagggataaagaatatccagggcattctgcgtcactaccgtctacacttcaccgagaaagaagatgtctgttctgtgtttaaagtctagtgtcgtctgtcacctgcgtccacttgctgcctaacaggaagtgaacccccgaaagaccggtgtttgtcattgggggaagacgggggcagatataccagaatggcaattttgatgggaaagaagtccatcctctcactgtcgggcccacatcctggggcacgtggacagccagaaagcaacttcctgacggtcttgcagtggaaagtacgggaaccatcttaaaataaccgggatggtttctcttggcatttccagcagcgatcgcgttcggtccgggtctgccaagatccgcaactgctggtagaatcggctgaatatgtcgattgtgaccgcgcttaaacagcttagaagtgccacagacagtttctgcaacctatatatatgcatgcatatatatatatatatatatatatatacatacacatggaaagaaagaaagaaccagctcttcctcacatgtacgttcatcgggggtcgatgctcgtgaaggcagggggagttggatgcaaagtaaaccgaaagcggagagtatgcttttcatattgatgagattgaaaccctgtttttcgtttgagagcttcatttccgcgaacttggtgtcggaggatcactgaacacctgacttcacctcggcattgttgtgagaagtcaactcctcacaaccgaccttcaatggccgcttactgtcctcctatcacattgttctaaatgaatgcgcccttcaaagtaacaaaaaaggacaacagcaaaaagtttatgagcttttgttgtgtcacctcttcaggcacaccgagagtcatgagccttagccacacgctggtgccttgttcgtagcctggtactgtgattcaagttaacgtgagttgtgtgtaggcatttgcacggccagaaacgcgaaatatctgagattgcccctcgcgcgaaagcaggcagttcattgactcgtgacacaataagggcatgagcctccatttaactcttctcatgggcatccaggtgaaggaatacaaaccaggagagaagataagacccctcatgctgtatctggtaccagtattaatcgaatagcggcagcagcgtcaagcactacttataagcgtcgtatatcgaacacggcagccgcttgcagtgagtcaggtgacgcgcatgggtaacggcgtgcgcgaggtctatcccgcttgtttgaccttttgaaagaccaagaatccacttccgcccttttgcggattacctaacaagctggccgtttcccaggaccgtaccactaggaccttccgagagtggtagaacatccgggctaacaagcctcgctgctactgttacgaaggattcgaattgcaacatgctttccagagacttgcttctaatggcccattcagctcgaccagcgttaagtcaggagctccagaaacgtcttctatatgcccccaattctggatgctgttgatgcggtacagaaacaagcttgccgcgaacagacatacctaaaaaatcccttctcctaaccccagactctggctgatgctgggttacaaagaaattgaaaatataataacttgaaatagtcatgtatcaatgatgcattgacgagcaaggatacaggagtcgttgttcgcagctgccagcggacgacactgggtagcgcatcccctgagttggtttgccccacttaaaagagagcccacgtctgataaagaatgaatacccgtggttcatattatcgaaaatggaagtacgatttttgctaagccaagtagtgtaacccaggcaatgcatctactatttccgcgtcacttgactcgtcgaaatgtttcgacagctcgtaccaccgctgcgtgtatcgctgatttcacggattgtacagtaaccgcatcgtgtttttgtgttccctacttaagtgattatttcataccacaacataaactagcctgtacaactgctgaaacccgattttttcgtggcagagcgcgttatgtgacaccaactgcaactccttcgatatgcgcatgcagatgcgcagctctgggttctgtctccctcttcatcatccttcagttcgcctgaatctcgacgagatgttctgcagtttttggggcgctcagaaagcctcccgaatataccaaacccgcataatcagcatggtggcttgaggcaaaagcagatcaagaaaatcggtccgtggatcgcgcatctgtcctgtggaggccccggcttgagcatgcccagtgcctgcgtcgagcacatttcccagcgacccccaaaaccgtccagttcgttcccagtcaaacgaaggagatcgaactctcagcgggtcctgtgaaatagcttggcaggtttctagtctcttcgttcgcgagccattcgtctgcgtgtctgtcgcctgtgacttctgcggcacaacctacacgtggatttcttggaaaaaagtcacttgagttggtgagtgaagacattctgtatcgaaacgaccaccacccgaagcgtacgatgtaaaggcagcccgaaaatcgagtgtgaaaacattttcttcgtccccgcctgcaacgctgaggtgctcggatacctcgttgcggtttgcgcgtttaccgttcgccgtcaccagcaactagtctcacactacggccgaaatataacagacgccttaccgacaa

SEQ ID NO: 1675 - DNA, 1730 bp, Toxoplasma gondii
tctcttgtccaaaagcagcggaacgcgctccgttcgttatctgtagaaaaggtcttttcaacatgctgacggggttcggggatgaaccgtgtctgttcaccggaaaaagaaattcgcatgcggccttcgcctgctctgctggtcttcctgatgtagaaaaagcatgtcacagtatttgggcgtgtgttgtacttcttgcgcggccgtatccgccgcttttttcgttttccctgcagacttcccgttcctcccaagttccttcttgcctgtccgtcctcccagttcttcagatgttgcctgatccgtgtcaccttcagcgctgttttcctgcatctctcgctggacatttgagggaagcgtgtactgcggatttccccatttcgtgacggttgacggacggcgaaacttcgtcgacaaatacgtccgcttcgttaccataaaccgcggcagcgaaaaccggactccaccgctgtaccgcgagtgcctacagagaagtgcacagaacagacaagacgaagacggcagactactgaaccgtaaaccctccaccgtgtctcggctgttcgccgcagtgacaactcgcaaattcggatgccgacgcgaaaagcatcgaccactgtcacttcttcgaggccagactccgagaaatatgccgacgcacgtggagaatgaggtgtgaagtgacttgagcataacgctccgtcgttttcataaccccgccagggtgccggtacaaatggatcaacaagtcttcacagatatggatcctgcgtcagttttagattccttcagagctcacatagcctccactcttgtcacgaaacctaccgatatgtccagctcgttcgcactcgatctgcgatgagcagcggggtggaaaggcgaagcgccatgacaaccaggaaacttcgaccctccgagaaacccagcgttcctgctattggtcttcaacttccagccgcaagcacaaggatcgcatgcgttggcttctttgccagttctctctttcgactgttttgttcgaaatagcaaaaaaaaaaactggcgaaagaagcctacgacagccacaaccccttcgtcccaagcagatatgacacaacacacgaagacgggaggtgaaggggtcgagagaaagaatttagggaagacacagaaatacagaaaaagcgcccagcatggatcctgggaagatgtgacatgcacaggagtcaggagagaaaacaatcggcgcctcttttaacagaaattctccccgtcggggttgctttgccagccccgccgcgaacagacctacacgcgaacagaaggtttagcgcaccttagaggcgacagcagccccctggttcttcccacgactcaaaaaaacatataaaaatcgtcagacaaacagaaccggaacgttgtaaagccctcagaaaaggactgagatgtcacctaaagaacagaggcgacatgacaggagagcacattgtgagcatgcgatgctcagtaaaaaaaggcaatcacagaagggattgaatcaaggatctctgtacaaagtcagaggaatctgatacaacaatacaggtgatttgatggtgctcagggtgctacggtgcagccgttttcccgacaacagctccgattccagaaaatacacccagagcatgcaaacacgacgtacactgtcttttggagctcttcaaagttgcagccactccagatctgcgcattctgatccatgaactaaa

SEQ ID NO: 1676 - DNA, 4855 bp, Toxoplasma gondii
aggttgttgtctttggtcatcgcacgctcaccttcgtacacctgaatcagcactcctggctggttgtccgcgtacgtggtgaaggtctgagacttcttggtcgggatcgttgtgtttctttcaatcagcttggtcatgacaccaccagctgtctccagaccgagagagagaggcgcaacatccagaagaagcaaatcctgcacctgagagctggtaactcccttcaagatcgctgcctggacagcagcaccgtacgcaacggcctcatcggggttgatcgacctgcacggctcctttccgttgaagaagtcagtgatgagctgctgaatcttggggatacgggtagatccaccaaccaacacaacttcgctgaccgagcgcttgtcaataccagagtccttgaggaccttctcgacgggcaacagggagttgcggaagtagtccatgcaaagctcctcaaagcgcgcacgagagatagacacagagtagtcaatgccctcaaaaagagagtcaatttcgatggttgcctgagtgctgctagagagagttctcttggtgcgctcgcactgggtacgcaggcgacgaagggcacggctgttggtgctgatgtcctttccgcggttcttacgcttgaagtcctggacgcagaagtccaccaaacggttgtcgaaatcttcaccaccaagatgggtgtcaccagcggtggccttgacttcaaagataccgtcttcgattgtaagcagcgacacatcgaacgtaccgccacccatgtcgaagatgaggacgttcatctcaccgcagcccttcttgtccagaccataagcaatggcagccgctgtaggctcgttgataatgcggaggacgctgaggccggcaatggtaccagcatccttggtagcctgacgctgcgaatcgttgaagtacgcaggaacggtaatgacggcctccttcacttccttgccgaggtaagcctccgcgatttccttcattttgcccaaaaccatggcggaaacctcttcagggtggaacgtcttcttctctccctggtacgtgacttcaatgaggggcttgtctcccggaccagcaatgaccttgaatggccaatgcttcatgtccgactggaccgagggatcatcaaacttgcgaccgattaggcgcttggcatcgaaaatggtgttttccgggttgcgtgcgacttggttcttcgcagcatcaccgacaagtctctccgtgtcggtgaacgcgacgtaggacggggtcgtcctgtttccctggtcgttcgcgatgatttccacagcatcgttcttccacacacctacgcaagaataggtggtgccaaggtcaatacccacagcaggagagtccgccatgttgtcttctgcagggacaaacaactgcaacgcgacacaaaaaagaacgggggagtggaaaaggaaaaatggttggaaggaaaaaacactgaccttcgatccgtccttagtttgagctgcaccgcacggaacggcactctcctaaagatgaaatgcggggcgagtgccggacacaccctatgactcgtaccggacagcacacccgcgcagcagcaggggatgatgagggacgaagagggcggtgtgtggtatgtactcggacgtaggtgctgggagcaacttgtccgtgctgcggaggcagcacacggtgcaaatctcgctgttcaagccaaaaaagacgaaacacactggcgatttcttgcagagccccggtttcctttccgaaagcctttctttcttgcagatacttgaccgaacaatgcatcttctacactcctttgcgctccatactgacgcttgcgacacggacagcacaaaggttcctcgtgatgagtaccggcgtcgctcgtggggggaaggggggggaggtgacgagcaggatgacgcaagtcttcgggtggggggggcgggagcttactcaacgaggtcaaaaaagcaggcactccccgcaagaggctgacgctgcttgcacggtccactgcatgtcctgcgtctctccctgacagctgccaaataacggctgttgtgttgtccccgtcgggggagggggggggttgcgcacggcgccggacgtttccactggcaatagccagtcacaacgcgttacggacaatatctagaacgcgcccctcacgaaagtgggatagcttctcggggtgcttcgaaatattactaccgaaccgcaataaacaaagaaaaagaagcactaggagggccagtgaaagttcatgttaggcgggtgcttaactgttggattccgcgtttgtaaagagtcgcagaaggcggagaggaagtggtaagagactacggaaagttttcttcgagaagtcaagcagtcacagcggagatatgaggcacttcagcgactgagaagacggtggcattaacgtcagagtcacgcgctcacgaagtgacgcatgtaaagttgttggtagatgacgtttttagggagaagagccgtgcatggtaccgtacggtgagaaatggtatacacagtgggactctgtacgaaactggaaccaaactgcggacacagtgcacggtagcagcactccacaagttaacaagtagtagcagatgaaaacccaccgacgatggaagaatgttgtggggttaaggctacggtgtgtgtcaccccgttaaacctctgtgttcgtggtaatacaaaggttattcaagagcagactcggaatatactgcagcgtaggatgttcccggtaattcgttgcttgcgggtttcactaaccaagatgagtttgggaattacagcgtgacacagaacagggcgggtgttctcacaccggccggcgaggaaagcgtgtgcgagcgaaacggttgatccgtgcaatagattcaatgctcggagaaggccaaacaaacacgaattttgcatggtcacttcgtgtatagcagcatcgctgctgatgtgtcaggtgttttgtggccaggtacagttatccgaaagtcggcgcaaaggaacccatgaggcgtatccaatgaatcctttcgccgtgtgctcagaagtggcacaccagtacagttgtgatagacgtcgtgctgtttcttgttcataaactgatgggtgcacttctgcctgagtatctggagagatgtaatcatcgacgaaggcttgccggtctgcccgcatacacatcgcggtggtgtcatttcattgaactaaccggatgagacaatgcttaggaaagatgaagtttcttgttacatgagcttcgttgttaaggggaatgcatacgtggtcagtggctaactgccacctcagcactactacacctggaggcgccttgcatctcctgtctcacccttcgttttccgtcttttggtcaacgttaacagccaccattatccattggcaggaaacccctgtgagtcacatatttgaggaaggtctacctcataatttgacaacgcgcattttctgtaagtggctgtgtaccgaaacatgaagcgagtcagtcaaaaaagtcgagttcgctgctgtgtggcaagctgcgcagttaacgaagtgggacaggtatttcttttgtcgcgcatctgactgaacggcgagccacaatgggaacggcgcatctcgtgaatccctcagtcaacactgttgcggacacccctggaagtgctgcacagtatcttcgtagacatccgagggtcttccgtgctagtgagtagatacaagtacggatatttcatagaaatcaacattctcgactcccccttttacacagtattcaatcgtgggagctaatttatcgtcaaggtcatcaaactactaaactgaactacgtcactgtttgccacggtcacacacgataccttgtttccgcgatgaagttgactcgacgttttttgcgcggatccaaaatgttttgcgtttcccaagactaaacaagtttgtacaattgaatctgtctcaaaacgagtccgttgtctgtgggattttgcgtcaaagaacagtgacaagccagacgtgttgactcaaactaggattgcagaaaaacatgcagcgtcatgcgcgaaacgcgcgtttctactgttcatgaagccctgacccagtgctggcacaaagaaacctgcaggccgtcacgccgttgacagtgctacctatgtctgaacctatcattctcttttcagtaacggaagccgcattcagaggaagagattggagaaccaggtgtctgctgaaataagcgggccgtcttgttaacggttctcttgcccattggctgcatgctgacatctgtgtgaaccgtctgagtttaagaacagaggcaaccctctgcggaccacctccaagagctctacaagttagaaacagaattctatgcgcgagcgctcctgcgcgaacccttaggcgacgatagtcgacacagacaaaaccagtcatctactgccaagatggaagcgactgagctgaggccgttggttcgaaaacgcagaagggtgacgtccgtctctgggctctgagccctgtgcgtgcacacatatgcctcgacgctttgctgtgcccaacagtaggtgtatcttttgtcatgtttcagcgcagttcatcggttgcccaatgatgactggagttgagcctctggtgttgccagcttgctccttggtgacggagcacgccaatgggtaaacatgtttccttggtgcttggatcaggcaccggcattcggctcagttttatcccgctgggccccctgtcgtcttctgtcacacccactgtcgtgactaccccgaagacagggagataagcgtttgaaaagaaacaggccatgagcgcaggcagcaaacttttgttgttttctacggtcatacaa

SEQ ID NO: 1677 - DNA, 1881 bp, Toxoplasma gondii
ttcctcgatggagttcagttgttcgcgcgctgaaatcaagtaaagttcgcatcacaatgcgagggccgattctgcacacaagctcttgggatgtggaccgtcttttcgctgtgtggctgtgaacatcggagtggaattaccataaccgtctgcatcatccatggtactcgctaacagagcccttcgcgtcatgtcttttgaatgacatctgattcctttgccacacagcacgaacttcgtacttggcagggcacaacgcgccttttgcatcgcttacaaaaaacgccagcgagaagcatgtcgtacgactctgtacacattgtagaacacgtctccagtttgacacggagtggtgagtctatttagcgacgatatacgtttctttgctgttgggtgtcttccgcaggtacctgcgacaccatgctgaactgcaagaaatgctagcactgttcatgacgaaggttctggaggacaaaccaaacaacatcctcaagtttgctggagagttcttcactcaagatggtctcaaacagctcgtcgaagcacaggcggatgaagaagacacgtatagcggcattgatgaaaaactggaagaagtttgagttccaagcctgctttgtgtgtgtccttctacaacgcgcaacttctcagggaggaacttttcaagctccgtacaacagatttctgcctgattttagtctgcgagaaggttttcttcaaaaatggatggcactgtgattcacacgttgtggacatgcaggttgacgtgtggcgttcagccacttttccagcactcttgatgagacagtaccgatgacgggcgctccatcgaggaaacctgtggacactcactttccacatcaagctatttacttctaaacacaggtgttccaatcgtgcaacaacccaacgacggaaacgggagcaacatctgccacaaaacccattaggatgaccttttacctccgaccaccagcttgccttcgttacaaacaacacaacaagtatgtcccgacagcgctgcatttatcctactgcagctgctgaattggagcagataaactccggtaatcactgaactggtttccataagagaaccgatgcaaagtccgtcgtcttgatctgggacatgcggtttttcctcttttgtaatgagcattccagcaggcgctgaacagctgtcttccgacggaacacattttggcaaatgtctacagaaaagacattaagatatattaccttgttttctgtagaacttcggttgtaagttcccccattgccacgcgactgccaaaggaggacgcagtggcttccctacccgcgctgtgtattttgggaacctccagtgtgctggttctcagatcgtctcctaataaatcctgttaagtcagcagaaggacgatttgttgccatatgggcgtcgagaacacctgacagacgaaaataacagtagtttcctcaacttcggattcacaacgtcgcagtacctcatcctctgccccgactttacgcactctcctgaattgggaaccctacacatgcaccgacacaatttccgttgcgtccgtagcatcgatatgatcttttgagtcgagcaacataactatattttaacaaccccgtctcttgtcgattgttgccggaggtgttgcgttatttgtgtcttttcgcaagacgcctattcccgtgtttcatggtcaactctgcaggggctgccgccctccggcagctctgagctccgtccagccggccagaaaaaactgaccctctctctttaccaaacaaaactttgttgaatctccggcgcatgcactcgtccgtcgtttcccttaggaagcaccatcagggtatctcatgcgcctgacgatcgctacccaagga

SEQ ID NO: 1678 - DNA, 1608 bp, Toxoplasma gondii
ctaacacacaaacgcatccactcagttctacagtcgagaaggacaaagagacagatgccgctccaagtacataatatgtatacgagttactgaatatatatatatatatatatatacatataaatatatataaatatatatagatatatatatttgagggagagagatatggatatagagagagatatagagagatagttgcctccctctatgtgtaagtctgtaaagacacatgcatagtgatacatagaaatctatatatatatatatatatatatatacatatatacgtatataacggaatgtatatatgcgtagagatgaggtaatgtgtggtggcttttttattgcatgtgcgttacccatgacgatcccatcccacagtgcgacatagggctttttgaatttcgacgttttgaagacgagcgcgtattcgtggccaaagagtctcgcgacgtcagctcgaggcgcgccagcgacctgccgaatgtcgcctccggcgcagaaggcccggccgccttgtccagagagaagaaggagagaaactcgaggatcttcctcaacgcgaggcagcagcgcatgcaaagccgtgaccatgtcgacgttcagcgcgttgagttgcctcggacggttcagagagacggacaagcagccccccgtggtcgtttcagggaagcctaagagaagcgtctcatcccagaaggccccaggtcctggaagagaagaagagaagagccggcgcaacgccgagcggccgagcacaccgcctgtcgcgactccctctcgctctctcttaaagtcagatacagacatgaaggcggccgccgaagaagaagagagagaagacgagagagaagacgagagagaagacgagagagaagaagagagagaagaagaagagagagaagaagaagagagagaagaagaagagagagaagaagaagagagagaagaagaagagagagaagaggaagaagaaagagaagaagaaagagaagaaggaccggagagcatctgcgaagaagataggagagttgggagagaagagaagttttctcgagcgcgaacgacttcgctgaggtgagtgctcaggcgaagaaggcgccgggagcttccagttgccataccgttcgagatgcacggccagcaaacgacggatagagcagcagagagcgagaagagacagaaaaaagaaattcaagagaagaaagggaagacgagggaaggcaaaggttgaagaaagagcagaagaagaaacgggagaagactgtcggagttcagagatgagggccttgcacaagagagggaaaacgaatttctcctcagcgacttcgctgcttagacggctgattgcggtggcgcgccgagtaagagagaacagttgcgaaagccaggtgtaaaagtcaactttgtttccctcgagtaaagaaaaggagagagagcacgctcggagaacccagggcaacctctgttaggttgagacaggctctggaagccgctgtgtcggcagctgcagagacgcgcgttgtgagggcgttggaaagagctgggagatcgcttgcagaggagaaaacttccgcaaaagtatcttttgcaagcaaaagcgaa

SEQ ID NO: 1679 - DNA, 2309 bp, Toxoplasma gondii
tgcaagaatcgatgttgatctggcgtagtcacaatattgctgcatctgttagtccgtcttttctgtgcctggggggctgacgtgattctctgttaccagtgaccaaattggcaacttcatttgaatcatcgtgcccgccagtggttaccttgttgccagtgttgtgtggaagaatactgttaacactggtatgtattggtgtgtcagggatcaggtggatcgaagtctttttcgttttttccgtgtgagaaaagtttctgcctgttttttagaagaggcgaaaagagcattcgaaggaacaaatttccagaacgaaggtcatgaatatcataatctaacgagccgctctgcgcaacttggatgcccttttgtcactgagtctatctggcgctcgattccaactcacacaccgcgtttcgtattttgcagatcgtagctgacatgagcgacaaaaactcgctccgaaaccactgcgcgtagagcagtgccttcagaggtgctgccagcgggttaactaggaaaaccatagaaatgttttaagaaaagcagattcacaccccggcagtcgtcgatgtaactatgtcttgattcacactgaggtcagaggcgcagcttcgcgagcaggcgtgagattctcaagctggtgttttaccaagaatttgcatacgtacggaaatcccgtggagattgactcatcacatgccatttggaaaacagaatgacaccaccgcgcatcgctgttaggcgtccacatgtcacaccgtgcactgtgttcacacatttcatggttgttgggatgagtgctagggagcagcgtgtactgttagagggcgttcgcttggttctttttgccacagcagtcatcggcgtatacagtacgaccactgtcacagcatgtctacttactgggtcacggtcgtacgaagaacaagtatagttgaaaacaacaccatatgacaacggattcgtacgatctgagccttgctggggttcacgtctgcactcttggaaacccctgtagtgagcggtggctcgcagtcgcgttgcacacccgatgtctcgccgaattacgttacacctctacgagcaggagcagcagaaaggtattgcacttcaaaacatgcctggacactaggccacaagaccattagaggccagtgttaccgtccctgcgacgtcatcctcattctgtcttcacgagcatgagtagtccccgtcttcgttgacgtcgacgcctgcctcattaggtttgctgcacagcacgggtagacttcgctacttctgccaacagaaaacgatagcttggttatatttcgtagaattgtaccgagtcgaacatgctgtttaccacgaaaacgcaaatgccatcacaagggaacgttcagtcgaatggggaagtacatctcgcgtgtaccggtgcctgtatggaggagccagccagggtttctcgttacgagaatggaattaaggagcatccgtttcggcaacatactagcgctgattggtgacctgcagcctttgccaaaatacggtaacctcctttataactaaggggcttcctacgcggtaccagctaggtgacccgaatacctttaccacacagaaactgctccaacagacacgaggaaaattccgcgcttgcagttgctgctaccgctcttgtgtctagaatgtttatgtttctacattatattgatacagtgaacaattttaattgccgcaattgcacgtgtaacttcctgtccactttcttcatgggcgaagtgtggtaccaccgcagcgattttcttctgtggagaacgatgcgagcgttgcgtttcaccacccgctgcagaaaacacgtggtatcccagagcagtagcgtacatccactttgtcccggcacaacaaaacgcagatgcgtatactataaagcaactttgtgactagaaaagtagcagcacatcgtcggttgcaacgagggtaataaccaagggctttttcatgtgcacactgaagttggaggaaacgctgttgtgcgaaagtgtgtggaacgggtaaaaatcaccctggagggatcttgtctcgtagtgtgtggcttcttgaacggtcttttcttttcgccctctctgctcctctggggccccctttattttctactgcctgtctgttccgaaggattcttctcgcttgtctttccggtgcacaacacgttctttgatggttttcccgtcttccggtgtacgctgaagttacctgagtagctttcttcgccagtcggccaccatcagaccgtacatcgctcataatcccgcatactgtcctgacaa

SEQ ID NO: 1680 - DNA, 3515 bp, Toxoplasma gondii
ccgaagaagtacgcgccgccttcaccgagaacctccggagatcgtttctcctcttctgcatgcatttctgcaaatctctcactctccgacgtgcaaacgccttccacacaaacttgtccagagctcctgtgagtgtcggcatctgtgcctgaaagaaaggcgtggcgcgtgaagtccaaatccgagctaggtaaacttgtcatttcctgagtacctcttgaaaaaaggcgagcaccatagatggacaggtgctttccgtcaggcaagcggggctggtccgtcacccgaaacgcaaagttcgtttctagacttgacagcggaacaacactgccgcaaatccagagaaaacgggcgcaagtcgaaggaagccgagagcccgcatcagggcagagccgttcatcaggtgcagcacctggggaagaccggaattgacacacgctgcgaacctctaccggcacaaacgtggaattccgataaacctacatcgaacagataactcatgaattcgcgctgctcttgagaactgttcaaagggacgtcgcgcaggcaaaggaaacatggaacctgcacaacactcccagaacgttggatgggaatgatttgcaatctctacagcgtgggagagaatttaggatgtttcactttactcttgaacacctgcatccggcatgcagctgctgtaatttgaactgctttgttcgtcctagttgcgtcttcgaggcctttcgaaacaggcttacgcaacacgatgcaccagttcagcgcgaatcatctgcaagcgacggtagatccgcgaagcacgtcgctttcgctcacttctctgagtctcaacggatgctcaaactacccttgggatcaacgcggtgtgtagtccggaaccggcgtcgggaggcccaacagtgactggtgcgtagagagtgactagttgcccttcaaacaagaaaccaaggtttgctccacttagtcgaagaaaccggaactctcggcaaagcatctcagtacaaaaaaaaacaacggaaaccaatgtttgctaagctcgcttgacgaaaccgaagctcttggcaaagagcagaaccctacaagcagctgttcaccgtcaccgccggcgcctgtagttccgcaaaccgtaacggcgtaaataaaaagaccagataaactcgtgcactctgggtaagatgccgtttcacgtgaaaacgatgaaggcgagaacttggcgggttccgcttagagcaagggtttttgtcacgcgcttccctgcgacggttctagttctgctgacagcagccaccgctgcgtccgccaagaaggcacagatccgcacatgcaaagaatgggcaggtatcggactcatgtgtaacccagatgagaggatggaggggaatacagggagaaattcgtaaaaatcacacctctgcgaaaagctgccggcggatcgcggctcaggctgaatcacggtttttggcggaacacagcaatctgaagcagacttttgtggcgggtaatttatttatggacggagagaaaacccatcttcgaggctgactcaacagtgaatgacacgcgaaaatgcgactaagccttcgccgctcctacacgcacagtgccgggcacccgcccgctgcgtgggcagcttcaaaggattttaaaaacgggtgaggacccccggcacacgcgtctagacttgaaaaaccagagaagaactatctctcggagttggagatagacttagggagcgctgccttttctgaggtgtgaaaagcggtagcggtcggccacaacgagagcctccaacgcgactatttcgaccttgcagttgacacaccgtgtccagctgaggtgaccacacggatccagggcgttttggggccggagatccctgttttaccagatgagactccttcaggcctctgtgaggctggtacgggcggtttcaatcgccataaaccgatttccaaactgcccattcactttacctgcctcgctagtggcgcggcactccacaggcgagtgccttgaagtgacgcgtgcctcgtggcagattcagtttctctattcccgtcttgtttatcgtttgaatacgggcagacgcagggagatatgaatggtaagtttgttttggctggtgttcgaagccttccctttgctagaaagctgctgccccgtaggccattgacgcacccccgcactccacccacgatccggtcaagtgtgtgaagcccgccgagctcgtttcaggggtgtcttcgcgggatgtctctaacagaaattttggggggatagcggggttgcacgaataaaaaagggcgagacagaaaaggttcctccatcggcgcttcctagtctgtacagacacacagagaaccactaagggaatggggcaggatgttgagcaatgcacgcaactggcagaaaggcacgcgagccacttggagctctttgacggctttcaaactaatgattaaccaggtttctgtaccggtaacagtaatgtgaaatatcactttttcgtggaacttgcagtttgacgtatgcgtaggatacagtatcgatccgtgatcgtcgagctcacggtcgcagttgcgctcgcgacggctctcccataccgtgtcgacagcagggacgaaaaccagctcaagtcgctgtctcctctatgtctgctcaaagcttctaactggaaggctgaagaaggaaggcaccaacactcttcacctatgtcgccagaaaaactcagtgggtcctgatctcgcgtatatcgagaaccagtctctgcacctcgagaatcggtatgtcctgaaaaggattttgcgccagctgtggcttcccccatctgttctccatcgggcacgtgtttctccgacttctttgatgtattgttcgcacttcatttctacttgatcgggtgtccacgttgtacccactccgttgttccttgccgcagtgtgtctccgcaggatctcgggcgaaccctcaacagccgctgtttttcttgccgcgttccgtggttccttcccggaaagcaagaagtcatgggcacattcgtactaatccgtcttcttcagacagccacctctcgcagtgtacgtttcgcttccgaaaaagttagacccccggtgtagccgcgtgcaattcctacgcgcagacatatacgccaactgcttcctatgatttgagttaactcttggaggatggaaaagcaccttatccgaaggaaaagcaaggcgtgatctctggcactgccccaatctccctgccaccccgttgtccccaaagtttcgtccacttctacaaactggaatcctggcgctgttcgccgtcaagcctgctacacttccgttcgacgtggaacaccgttttttcttgccgcactaattttctctccctcgctcacctctgtgtgcgacactcactcacgcactcaccttgtgctggcgcgaattacagtgaggaacctaaaataaagacgccgagatagcgtcttgtgtcttcaccgtctttgacgaagtcgagcagaacca

SEQ ID NO: 1681 - DNA, 2322 bp, Toxoplasma gondii
gggagggatgtcataggagcgacgccaaatcttgacttgctcatctccgtgcttggctgcggtctcagccttgttgaggccctggagggcgccgtagtgacgctcgttcagtctgtaaattgcaccacaaaggaacatagttcaaaaacatggaatccttggaaatgaacgttatctgcacccgcgtgtgtgtgactctgtgcatccatttgtctggttatgcataaaaccttgtttgcaccggtgctaaatgccgcctgtctcgttgagaaagtgagtactctggcgagacagacagtcgtttagagaggtagacgcacagcttacctccatgagctcttcacagggatgtggcacatatcagtccctttcaggacggtccagcaggtgacgacggctctgcacacccacaccagcaagaaaaaaggcacgcatggctattttccgacaggaggcggatttccaaaaggcggctcagcgaaatgaggccgtgtattgtaaacaaaatggactaaaatttgaatgcctttgttttttcttacaagacgcttttgatatgacaaaacattcctctagggtcaccatgcatcgcaaactggtgtatatatacctgcacaacgtaagtgtgcgaacatattggatctggtcttggaaagacgatctgagagtccactgagaaacctgcccacgcgtgaaaaacgcaacggcacaaactctctcaagttccccttcgacagaatccttccacaaaaaactgggtccctcgtcggcgcgacaaagtagtaaaattttgggctaccagagggtagtacggaactgcaaccacaagcacccctcgcattcacttgagcaaaagccgacatcttccggcaaaggaaagaacacctataccggtgaatttccgtgatctgcttacatacaccggctgtgaaaacacggggcgtccgctacgacacatggcaatgccgcgtcagccgttcctctgccttacctctgaagcacggaagtgtaggcgacgtcaaactcgaaacccttttccttgagagcctttgcagcttccctgttacagaagaaaacccagatcaacagcaatcgtgaacgtgggaaattttgcggtgaagaggaacacggcaacaaaacacccgcgaacacaggtcacagagatatcaaacggcacccatagaaaacacagatccgtacttcagttaccagtgttattcttgtggaaaagaggagcggaaaaaaggcaactacacgcaactccagttgcgatatactagggggacagaagatataaaagaggaggattacatcctcttgcacgccgcctaggaacatacggggagaagtttgcgttcgccgattcacgaggtccggttggtttgcttctccttctacctaccccgctatcgtagctgcaccagctacctgtcaccagacaaactaatccaagagacttacacggcctcttgctcgccgacaggggacaacggcacatcggtccagccggtgaacctgttctccttgttccacgtcgattcgcctggaaagggagaacacacacaaatgcttgcattctcacgtacaacttcgctccagaatgagtaagctgccggtgaacaatagcagagtccctcgtgcttcctaccgcgctccccattaactgtctttcccgtggcagacactgcagtcccgtatcgtcgacagttccctgagccacggggttgccattttggtgctgccacagctcgaactcgagaggcacataacgggtgaagtcgacatcttccacggagaaataaactttttttgacactgtaatggtagcgtgtcactattggaagagaaaaacagcgttcttccagtggaaatcaaggggacgacgcagacggccgctcgtctacagagaagcaccgcaactaccactcttgtgcaaatagtgtggcgcgtaccgtggcggatgaggacaagagtgtactttgcttttgccatattgccgaaaaaacgacgaaaagttgaagcaggaaacatgtaatgtacgttgccgtgagaaaaagaaagatctgaagacaaaaaaggcgacgtcagaactggggagagatgacaggatgcgccacacaaatgccggtgccgggttctcccctgtttgggggtgtgcgggggtagtgtgtgcccggaacaaactccagcacattgcctgcttctttcacagcatgtccggcgtgtagggtcgcaagaagatggccaccccattttcctcgtaggaagaaggatgcctgagggtctcactggaggaaaggactgtccgtcagagttttaaca

SEQ ID NO: 1682 - DNA, 3123 bp, Toxoplasma gondii
ctccttgtagagagcgtccttacagccggcatcctgaaacatgaaaagcaaacgaaaatggcttcgcatgtcttcttaccactccgacggcgcagtttaggtgtcaaggtgtaacagtccgtttgaggtcatttgctgtctagacccatcaaacgggaggaggcacttgaaaaaagtcgaatctgggtcggccatacacagaggagtattctcgaagtatcgaacaggagagcgggacataaagcagccgattcgtatcgcgtgggcggtgcatttttcgaaatcatggggaacagagtcaggtgaatttacgggcctgcgccagagaaatgcggcagttggaataatcgatgaaaaggggaggggaaaaaacgtaaaatgggattaccagcacactgcgcagaaggagacaatgcaagtggggaggtaatggatagcaagcaagagaaacctggctgagggatggagggtcaaaacatggaaatacggccggcccccggcgttcggagtgcggtcgacagagaacgaatacatcaaatactctcagagatcggatcctgtgtctcaccatgtttcttggcactgagttcgcaagtgccctatgaaagcccttgagaatgtgttccggatttttgttgccgacaaatgtaaagaccagtgtcttttcgatttctggcgcgaacagaaggctcagcgcttcttgttcctcctccgcctttaaacccttctcagctgcatgtctccgttgtgtgtaccactctttccaaccctctaaactgtcacggttcacatacactgcaactgcgtacgccctcgccgcgggaatccaacaaatgtcgtgcatgcagcgaggcgcgacggcgacgcagtcgtgaggaaccggcgcctgttttccaaaggtcttttggggcagaaaggtctccgggaaatcaacggctaacacaggttcgtggaaacgtcttgggggctgtggcttttcttggctgtccgtaggcgaagcgcacgcaacaagaaggctccccgaggaaactctccttcgtggtcggaagggtaggctagcgactagttcgaaatcctctcttcgctgcgattgattcctcgatacatagcttggcgaatgggccttgcgcacgcgggaagaatgcaaagacggcggcgtaccgaataaagggtttacggatgaaggtgagggcagcgtataagcataggatggcaagaaatcgccgtcatacaaaggtgagaggtacgcggaggaaatcagacgacggtgaccaagatcgaaatatgaactccccaaaacagaagaagtcagtgatgagtctcccgcgctatttgatgtttggcggtgtctcagaccaccgggtaaagagttgcaagaagatggttgtctccgcaaggcagcaaaggctccaacgtttcgtctagatccccaggaaaaacgaagctcggagctagaggtgccacccctcagacgcggtgcagaggaaagggaatgcttggaacgtttggaacaagcttcaagtgacgcgaatcgagaagccgtgggacatgtctccactgttaggcttggtacaacgaacgggtaagtacgctgcgaaacaaaagggacacagcacaacaaccggaaacgctggtaatccacaattttgcagttttgcagtgtcgttattgtcgaaaggatcgcggacatggcgacaacgacaaggcctcagtcgtgttaccacacccatcgaaccacgcacgcgtgtctactccgtcgattcagcaaatctaaatgatcgagctctctttctctgactcacctgtttccacgcatagttgcgctcctgacgacagcattgtgccgtgaggaaaggcgacatcacgctaagacaaggagtgacggccaccatcatggcgctcgctggagggacgggcgaaactattttttcgctgacaaagtctcaagcgaagcacttgtcgtgtcaggcagattcagcacttgatgtgggagcggaacagacaaacgtgtctccgccatcacactaagacgactgctgtaatcgaaacggtgtaaaagagttcccgcattttgagacgccgcagtcccaacgtccaggacgggagaagtcggtacgcagtctgaagcgtctttgtcttgttactttgacgccgtctagtaactgtgaaaagaggaaggactccgaacggcacacgtcgacctccgggattggaagagctagatgcagatccgtttgacgccgcatgcgaaaagtaaaaagctttttcgatgtctcaagcaaccgtcgatcgaagtataaaccacagcagagagaagccaggctgttgactcgcagtgtcctgtattttttcacaacggttccttcctatttggaattgcagatcccgtaataccctggtgaaagaagcggcgactttccgatacgcgtatcgaccgcgtcaggtcgaaggtgtgtggcacggctggcgaacggtcgattctgtcgctaaatttttcctttgtcggtggctcatcattccagtaggcatttcaacacgaatgccttctatttcgtgtcaacaatttgtgtcggactgtttggtaagagcttggaacgaccctccctctataaggtttcgcgtccgcgttcctcgcctccaaccgcagcatttgcccctcttgatgcatacgaattttgaacaatactcaatttccgtggcggtgccggggccgtgttcaagcctgggaaaacatgagtaccacatgggtatcagctcggaagctgcgtgcatgaaactggggaaaagaagagagaccagctgaaggtgtgggttgcagtgacgtaaaggatacaacttccagcgcagtcgcctgtggcactgtagcaattaaacttctgttgtcagacgaggttgagggaggccgatgtgtacggctgaagttcagtcggcaatcccataccaacccttcctcgtgacgtggtatttccgacctacattgtcttgctcgaggtggtacttataaatgggaaggccttcagtcagtacaagggcacttgaattacaacaggccgcactatcgcacgggcaacgacacctcataaaaaaacattttgaagacggcgtgaccacggcaaaccgcaa

SEQ ID NO: 1683 - DNA, 1794 bp, Toxoplasma gondii
gagctatggtgtatgtggatattccgggtccgggagtttttcttcctcgacagcggcaaagagttccttttcttctcgggtgacaggacctacgggtgttgggagtttcgctctcagttttagtctctcaaaaacgcgcccctgtcgtcgaatgcgaagaagcgatacactcaggagtgcactgcgtcgcaacaccgtgcgctgagaatcctctgttttcctttgtcgcgtcctcgcttttcgcgcttctctcagactacgaggtgaggattctcagtgcctcgggacttcccaaagagctctccaacaacaccttcgtcaaatttaagttctttcgctgttcgagctacaccgagaccccgcgagtcagaggttctaccgccaaccctgtcttcaacttcagaaaaattttcgaagaatccgtcacaccggcgttcacggactacctcgaaaacgaggttttgatctttgaggtctacggagaggatctccgagctacaaagtagaaacaagaacgaagaagaagcacccgtctcgtgtgctgtttcagtggcgatcgagaaaaacctttccaggatggggcgccttcctttctctacagttgttatttctcttctttgcctgacagtcacctgcacgtttgattcttcctctttctacagttttcatcccttttcccgttaatagtcacctcccagctctgtctcttggttctgttgtgagaggtttccgcgtcgccgaaacgcgccatgtcgctcagtctgcctcagcactctcaccactcagagcgaagtagtgaaaacccggaattttggaagaaattcatccctttcacctaaggactggagacgattgccagaaagttcttgtggcgctgaagagccttcgatttccgacttctcctggctgtcttcagagagtcctcttccacctcaaacacacgtttgtctctcgcgaaatcacactgataaacaatcctgtccagagttttaccgacaccacggtggtgtgcttcttccttccgtgggagtcgctgctttccacccttaatccgatggctatcaccgcagtccctatgcagtagatgagaaccgttgcacagcgaagacctggctgtacgacagcgatcttagctggaataaataaaaacctagacttttggcaaaactcggaggctttcctggagccctgtgttcctttaaaatatcatctctcctagaccgttcagttcgtatacatgcctcggctgcatgcacgctggcgacctcgggcaaaagacgctaatttctcgctggactcctgaaacgaggatcagttccaagtgcgaaaaaatccaatttccaatgttgtgctcatgaatgtgtccagacatgcgggggatgtgcttcgcaatcgatggatgttctgctgcctgtgaaacgcggctttctcgaactgcatgcggatgtacgcgaaactcgcaggtcacctgtccgccgttccggactctttttaaaagaaaaatcagcaccccctcatccttgacagcttttttccccgctggctgtttgcgtttcttcgtcgcttcccaaagctcggccttttttcaaagaagaaaaaccaaagttccagcctctgctgggctccagcagccgctcgtggtccttcgagtcaaggcgagtctcttgcctgaccgttattttttcagtaagggaatctttttcttctcgataaaagtttcattcggcttcctgcttttgctctggaagcattaaaaggctctcggaaatattttccttggcacagtctctaaga

SEQ ID NO: 1684 - DNA, 2158 bp, Toxoplasma gondii
actgcaggcccaacatggcgactgcatataaccctagccatatcagcagaccgacgctattggaaaataccgaagtctgcgtcccgcatagatacttattggagtcctccacgtccttctgttccagctcgtcgataacgtagtcgacgtccggctggaggaccacccttgagtacggggaaagccccttgacgcggctcaacgacagtaagatctgctcccttttccgtcggtggcagatttcttcttcagtttcctctggtacactgcagcaccagtatccggactggggtccagagacagagtagcaatcagtcgccattgggctgtcgaaggcttgatgcgcagactaaggagtgcaacgtcgggcgtccactgccgtcaacagcatatgcacgtgctagtttcggtcgcggactacacgttcgatggaaaaacactttacaaaacagttactgcacaattcataaacgcgctgtgcttccgctcggtactacttctcttgcatagtgtggtcgatggagtgacctgacgaaacagccggtgaggaaaatgccagcgaaatgatatgaacggtttgcttccctctgttgacaagattcagattgaaaaggttgggaattccctgattgaagcttccgccggacattaggggacgatgggacacgctgatgcattccgaagacgataggcagcccccgttgcagtgtcgcggagcctgaactaactatggattacagataagtcggaaaggacaatatgggagcttagcgggcatcagtcgccgtgacgacctggttctctaacacaacgtcgagcatcatcaaacaaaaggatgtctgcgtgcgcacggcaccgcccctcggcgatataggcgcgccacacagatgatgcgcatgtttccataaaaaactgcattcacaccttattggacggcacagtgcaacggttcacggcggtgccttcttgataaatcccggattcagtcttttcgttggaatcaacaacgacggagtcgcgatccctcgccaacgcggttggctaacacccgaacagtcgacgtcaaccaaacatcgcccccgtccagtgactcggccacttcaacagaacaaaacccgtttctgcacagttgcttgcacaaaaatgcaaaggaaacggtaagtagttgccagcaaaggtttcctcgcaggtggagtcagtttctcgtgtgcggcacggctaggcttgcacgtggtcattgaaaagccagccagctgccgtaggttctgtgagaatcgataccacggcgtcgtccactgtcggtgggacaggcaacccatgcaggcaagaagcactgctgtctcactaaaaggcattcttcatgatctcttctctgcagttgtcttgcataaagaaacattttcttctgtgtccaccaagcactgccgcaagaaaaatccggaagtagcttccgtgtcctgcgagtggttaccgccaccgacagcctaatttttcatgccacgcataaagctcaactttgcgcgggcgacttgggaatacggctgtcgcttgcaggaacacttgcatcgcttctcctcatcagccgaaacgagggttagtgattcaggagaaaatgtcttgctggttcttggataaggtatctctgattgcaggcgccatagtaggcctgtttgagacattagcaagccacgcgctgatcgtgctggcgtgagttgcgacttcataatcaaaggcggctctttcgaagcagctggcgggaatgcctgctggtgtcggtttcaggcctcaaccgcgacaagcgccggtgaggtgacaataagtgggaaatcggatcgccggcagcctacagcacagtgacgtaccacagtcttccggagaaacaacaggagttccgagcttacgcccgtctacaacagcttattagctcgggccggctgtgtcgttgatgcaaacaaatagcgtaaacgtttccgccaaattgaccaccgttgcaagacgaaagcgagacccgccagtgcaaccctcccgtcgtacgaatgtggcttgacgtcctctccaccgtaccgtttgtgaggaccgtgttcatgctcagctggattcgtggggctctgtttacggcgcgcacacactaccgcctcttcacagtgggatgagagaa

SEQ ID NO: 1685 - DNA, 4003 bp, Toxoplasma gondii
gtgtttctcaaacggccggtcagtgtctgatccacgctccatgcatgaatggcgattggactgttgaaattgtgaggagatgcgtgactgcatatccgcaggtgcacagaccctcagcgatggcggcttgtccagtgttgcctcacttgtttccgcagcaagttctggaatgcgcatccgtggtggcggccagagcagactcgaccgtttgtccagaggcgttggtggcgtgtgcgaacgaggcgggatatcttttgcggaagtctgatggactctggcaagttggccgcgcctgccttcccactggctaactttcaggtgactccgctggacgtcttgcgagacaaggcatgcaaaccgcgcctccgtactcggctggaaacggggccttctccggtgtccatgcacctctttgacacacacgcacgcgtacgatctaggcactggcacggctgtaggcatgtcgacagggagtgtaccgaaaaaaatcttgatcttcactaagggactctccttcctaatgcttggctgtattggatacacggtggccggattcctgaaggctggcatatgtttacgatctggaaaaccgctgatgacgccgctgtacacctccaccgcgttggaccgctgacgacagcgaagagtggtgacattaatatcgtgacgtagagatggagaggtatctggagctcggtaaaagatgtggaggtttctgtgcatgcagtctggaactgtagagtctcgccgcagtttagtgagacaagcaagtcttcttcactggaacgggacagcaatcggctgggtcatgccgccgttcgtaatcggttctggtacaccgttgtttgcccgctggagagggctgcggctctctccgcaaatggttgggtttttcttcagggggatttcgagtagaatcgccgcctaagattgtcgatttttcccgttttcgaccgagtaagtgggcgcattggcgcattctgtgcgcgaatttctggcgtttcaccgccggtgtgtgtgtgtgggggggttacgctatggcgagcctcgaacgtccccttaacacatcgcgttttcgcgaggtttagacctgggttccaactttgcttggcaactttttcaagacggagtgtgccagtaaaaaacaaagacggtattttcacaggccaccgcctggacgcgactgcgtccctacgcggcatgatctcaaaaggccgaaaggagtggccaccggtggctttttagtggttatgccattccttgtttatctaaaactactctccgatatttgagccaccgaagtttccagcggcacgcatggcactcgacaggacgctgctgcctctgtctgcctggtcatccatcgcattcacatgttttttaggacaacaaagtcatagccgactcattcctctgagtgtcggtgcgacgaacgctcctcgagtcgtccacttccatgcatgcatgcttgttgacaccataacgagcatcagtcgatagcacaaaactcgctgaaacctgcgaccagatgctgcacgcgtattacttcgtaaacaagctaagtaacaataagtagtcagtgccggagagaaaaacgctcggagtacgtaggaaagtcgtcagaatctcgctcctcaaattctccgccactcctcgcaacgctgatacaggggatcgcgatctccgtgatgcgtcaaattcgactcaaacaccgtttctaatctagctgtcgcgagatgcggcggtcctgccgcaaacgcgacatatcctgggtgtgtagagtccggttcacactcagagcattaaacaaggctcccagcgcatctgagatggggtttgcaatgtctctgctcaataattggcgggtgcagctgcattttcaacatcgaaaatcttgaagacaatacggctagcaattccggtgtgtgtttgcacgttgacgcaatagaaaataggtgaaggaatatgcacattccagcagcgaaagaatagtgacatttgtactagaggactgtacaggaaattgccagcagcttcgccgcagcccacggctgtcaagcggaaaggagacttcaggatcgtgtgctgatgacagtggcattctcggtgtcatccgaagcagcgtggctaaaccacgccttacaattatcatctttttcggagatataggcggtgtgcaaatgatccccaatgtcccgcacagtggagttcgagacaaaaagccaccagtttacaactatcacgtatcggcggacggaagaaccccgtcgccgtttgtaggatatcgtacgaaacgtgcgcgttctgtttgttgggtgaggacgttttatgtggaccaagatcgacgttttgcatttgttcttttatggaaatggtgtaggagcagcatatcttggaatgtcttcagaacaagcgctatgatgttctgctgaggcctgtggagagggaacagtgccacacgtttttcgaggggctcgtccagccgacgcacggatgcgattgtcccagtttttacggtcgcacgcagacttgacgttccgacaccaggtgtctaaattcgctgcaagaaaacacccttcaccatccctatttccattgtacccagcgtgcaagcagacagccataaaacctaactttggagcaacatgttggcgtgtcacccgtccagtgcgccgatgcgtccactgaggcgcgtaggcgtcctgatatgccgagacggcgcctgattactgagggtagtgaaatacctgaatgtgtaactttattgcgaggcatcgcaaggcgcgaatctacagtcggcgtgcgtcgctagtctgggcgtctcgaatgacggcaccacgataccttttgcgggtcaatggtgggcaagggtctttccacggtttcgttcactggttcgaagcttgggtggcgcgtgtgccccttccaggttcagccattctgtcgctctctatcgtcgcagaactgtgggaatgtcgtggctcccctctctaccccgtccatgcgtaacccgcgagaagaggcggcggccccgaccagcgcgtttcaccgaagcgacgcgtttctgcaagtgctggcagacgatcgaggaaaggccgtttcggggttttcagaaagtgtcagcgaatgcaagtgatatgaacgtgacagagcagagcggctgttccgagatcgggactttccaccgagtagataccctatggtaactgtctacgagaggacgctcccgctgtgcgtggaccgttgaaaaccaaacttttaggtcggccacgggaggtagtgcgcgtgcagaccaggttcgtttctgcgcgtctgaacgtcggtgcgcggccttcactttcagacgcggttgctgagacaggcttcgttagatcatttctgattttccgagtttgcgctctgcgagtttgcccacgtttcccgatcgcgttaagtctgtttccggctgatttgtcgactgcgattctcttacgctacggcatttctagcagtttcgtgcgtttttcccattgtgttttctgctgtttcgagactggggctgcagtcacgccccgttctcgcgagtgtgtcgaaatatgcggtggttcccagtttctgcgagtttggcttgagtccggggtgtcttcgcgagagggacgtaggcgggtgtgtggccgcgctctgtgttctcgcgtccatcgcacacggtcttgttttttcaacgcgcttcgaagccgccgaacccgcgccggacacacgcctcgtattgacctgtgagaaaatccgacagccagccggttcgtgcgattgtcgctagcgcccgtccttgcgtgtataaccggggtcgtggcacccctgactttctggcgggttgcgctgcgcgtgcggcaccttttccggaattcagttgagtttctccgggttttgctgagtcactccagtccttttccgtctagtgtgcgcgttttttttttcgtgcgtggcgtcctcgtgtcccttcggcacgcttttcggctttccaaga

SEQ ID NO: 1686 - DNA, 2484 bp, Toxoplasma gondii
attgtggtccttcattcttccgccgttgttcaaagcgtttgactgggagtaagttggcgacagaagttggaatttcctgatgttcagtcgaatgcatgcgcgcgccgcccgacgcgacccgcggaattaaaggcaggagaaaaacgctcttcgaaaagcctgttcatccgtggggagagttattggagtggatagcacatgggtaactgtggtaaacgaaacatctgcggcgttacccgacaagaagctgttgacggaacttcagggcctttctcccttttccgccacaagccgagaaaaaacaagtggggggtgtgaaggtgccacgattctcagtttctgcgttttcatgctggggatttgactgggtcattgcaacactgttttgcagaacgagctttacgtacctgcgcgcgctgggagagtcgttctaccgtaacggaattctgccggtggttgcgttcatggtggacaaggaggacgcctggtcagctcggatgaacctgtcctaccgctcagaaagcgaacaaagctacacgtatgatgcggagcgggaagaagaagaaactggagaagacactgctctggctgaagctcacggactgaaagaacctcaggaggcgggtgcaccggccaaggctgcggcatctgacggaaaggcgaaagccaatccgccgccagcgacgggagaagctcggaaggaagacaagaacgaggagcaggacttggaggacgaagaagacgaagagcccctggctcgggatgaagagctctaaacttctcgctgtgatcctggtcacctcggcgcctttgcggcatctgctttgtttctccctgcctacacaggtgcctctttgaagagcagcgtctagtttttcagccacggcaaaccaattggaagggcagttttagaaattgtacggctagaggtcacgccagttgtgatttagctttgtttttagatggtcatgtcgcataccgccctacctgtctgcatgcgctgaaattgtttgtttctcagtactccactgaacaggagaagcacactttctggatcattttaaccggacgtctgtgctccagcacccccatgaattcacgtttcatagtggaagttgaagtttttgggttttttgcgcgtatgttcacagtggggagctttaatgagtagtcataaaaagtaaagaaaccggaggtcgggtgacaccttggatggcgggagagggaaggttacgctgtgccgcatgcctgcattttgcccttggacaaaggactgtttatctaaatgtgagctgtctcatctgccatcgaacggctgagttcctttcgccatgatagatgaacctgcgtacaatacacgtagattcgtagaacacacacatggccttctttacatcacgtaaccaccgagattccgcaaggaatcgacgttcctactttctaggctccacttggaacaccataaaacacgcaaatatttacaacaggatacaccgtcttcagcttcgaataaagctgcccttttacttccgtactttcaagtcagttttctactgagtgcgcattccccaacaagaactgctgctgtcttgatacaaggcagaaactatttgttttagcactacataagtttggttcttcatggaagcaaaatcctgtctaccacaacgaccagcttgcttggtcgaaaaaaaagatctgagaaaaggctttcttccgggctggaagtccaagaaacgttagtataagcgtgctgcgtgtttcactcttcctgctggggaagccacattttgtttgtgcggttttgaaccaggtgtgatattggttggagaaaacaaagttgcatttggtagccacaatggttatttgtccttgtagctgatcttgagtgcaaatactttaagccacgaccacgcagagacacgagaaaagccgagacgctggtggcttaaacatgcaagaggtcgcactttatacactctgtcgcactgtatcgtgtattaaaatgtgtcctccgcaaatctctctattccatgaggtgtctttttgagcacaaagcaaacccaagttcagaacgaaaattgtcggcaaccgcgcatcggaatctcggcagctcgatggtctcctgtacaggggcgctcctttcggccgctggcagagagaggaattcagaggagaaattatccacagttttcttttgaagaccttgcacagggactcgtcgttagagtcgtgtctgttttttgtggacttttttctttcgtgcgggagtttttcctcttcaaaagccttcgtgtttcgtggcgaataaccctagagttttggctttcgaggctctctactgaggcgggtctctcgtacgtggaacgcttttctgagcgcccgtcccaaagaacttgcttcttgactagtgcgcttcattgaacatttatcttttctgaaagccctgaggattccgtttcttctgagacaagtggtgattca

SEQ ID NO: 1687 - DNA, 2412 bp, Toxoplasma gondii
agccacgggagaggacgaagcaatggaaagctgaggctcactcagttctccagaggggagaggaggcaaagctctctgagaagtggaactggtaggcagaaggaggacgagcaggagaaagcagagattcaagagcgcgcgtgtggcgcttgggagggaagaccggagagctgagctcgaagacagttttcgtctcttcatgttggcgtgttgcgtccgctgggaggaaccagaaacgaaaacagttctcagcctctcgcggtgtacatacaccgaggcgcggcccgctgaggaaggcgacagacatcgacatgcgtcggagatgccgatcgacacgacaagtgaaaagagcgaagggtgcgctcatgccagcgaaggggagaggcgcagcgaggaagaagcgagatgtaggacagcgaaagggagactcgcatgcagacgcccgtgcacatgggggcgaggaagaagtcggatccgagttgacagacacagtctccacgatcgttctccaccctttcagaggcagccgcgagagagaagtgaggaactcccgcccccacccccgcccgcaggaccgaggaaggtgcaggctgcagacaccgtcgcaaaccaccagcccgcgttctccccgctgacgaagacagagcgaacggaacctcgtacgcaactccgttcgtggaaatcgagagagcgttccctggctgaagcctccgtgaaacgcagtgagttcacctggctcggttgtttgcaagcaacagtctcatttgaggtgaatgggttccaaggcagataatgcaaaaagtcgcggcctttttaataagggaagctctttacgcagaagggagactgaagaagtctcgagcctcttttcggagcagaacgcaggcagacctgtttttcgaacgccggggaaacgcaaggcgaggcgacacgaggcgagctccgcggactatgcgaggacgcagtgccccaggcgcacctgtgtggattccgtgcgaaggagccttcctgcttgttgcgtttccttttggactgaaagttcttgaagagaggagagcaactgacgctttttgcagctgtgtgcttggcgcgcgatgagtgtgaaacctcacaaggagtttgaggcgacggcgcggctaacgcggagtctgcagagacctgcacacactgcgaacgcggagcggaaatcgccgcaaccgacgagcctcccagtcagcaaacggcgactggacaccgcggcaacagatcctccagtggctcagtgcagggaactcgcaagcgatcgaaaaggtcggcaaatagatacaagtgcagtctcaacacgcgaacggagggccggtgcccggttgctggtccaggttcgttcgcgttttcctctctttttcttcggctggcgctcgcgtttgtacagggtttcctctgtcgagagacaaagctgctgacatagagagtttgtctggagaaaagggcactgaagcggagaaaaactgctgcgcgggcgcatgcagccagcgagaaatggcgcgcaaagcacgcgaccctccacacagtcgaacaagacactggtcctcggtcacacttatacttgcgctgctccgttggtgccgaggaacggaagcctggcgacgacgaaaactttgcccgtctgcttctctgatctgtcttctctggagcgacagaaacggattccccgcctccttgcctggcggcggagcttcgattctcacaaccgcccccgctccccgcccccccagatatgcaacagcgaacgcaggcggtgtgcaggtcctctccctgtcttcacgcggtttcctctgctgacctgccgtttcacccatcagaactttcggaaagcgagggcaacctcgcacctctcagggtggtctccgcagtcgcctgcgtgagtgggtggccgagcgcgggaagacacacgccagcacagttgaattgtcagaatcccagtcgaaagggtcttcccgtttccggcagatcctgcgagactgggaaagacagcattgctcgctcagaaacgctcgacggaaagcgccgatgccgacgaacaacgcaactccagactgtcgacacgcaaacaaaactgtctttccccagattaccacggtagtcttctgaggtgtatgtacaccagaagaattgccgaggtgtatgtacaccccactaagtcggccagcgtatgcggtttggagaatcgaggcagagttatgtaaacgacgggtttaggacttcagggatgaccgcgagagccgcgaagacctggaggcagcagcgacacaagcggtgccgcgcgtgtgggcgtctctctgtcgcttcagacgctgtcgttttcactcctgtgtcgcgcccgcgagccctgaagacatgacttttgcttgttcacccgcgcttcagtcccga

SEQ ID NO: 1688 - DNA, 2689 bp, Toxoplasma gondii
cctttttctgcttgtggtcttgattcgtgtttcacacggaaggccgctcacgaggttgtctctcctggatcttttgcggtcgcttcagaaaacgttttttcacctctgtagtgtgcgagggaaactggaccttgacgaaagcgcgcctgcacactttacttttttctgtttaacttgacgcgaatcagtcctcggaaatcctctctctttcgctacggcagcgcgcaccactcggcgtttccgaaagggtccgtatagtctcgtgtgcactcgaagcccgctgcgttgcggacgccatctcaggactcttctgagaacagcaccttgccacagtcttcgcaagtctctgcggagacagctgcggtggattctcctttcgtagtcgctgcgtgctcggagagtgtctgaatagcatgcgaacatgcctccgcgctgaaagccgtcgctcggaacactgtcggcagaagcagaagacatgttcactaaacagttttcaccgaacgtcctcgcggcggttgtgggagaactaggtgcagcggtacacacttttctaagagcgagatcacggacgacccctgaggtggactgtgcggcactgcaaccagaagttgctcaaatgccgccttgtctgacgttccgaaacgtttggaagtgcttgcctgcaaacctcgactcccttctcgttctctgaccacgagaaaaaacatgatttcttccccttcactttcgaggaagtatcacgtccctgcgtctttccagagtggcgatagccctcgcggaacgtttctcagttctctgcagagggaacctgcctggctgtttttcctttcttcttcaagcagacacagagacccccttctcccgcgttcttcactgtctcctccgagaaaaagaatctcgcggcattgcgtctagaccaggagaccagccgtctgaggtgaggggaccctgtgaacggacttcacctgttccagcgcagaagtcaggaaagagagcgctccacgactccgcaacagcagtttaaaggaaggctgagagtcacgttgaaatgcagaggcagaggacatccacgggagaatcaccgtgggttcgttaacaccagcatgtcgacacactgctccggcgagtttcctctcttgtctgtcgacgaccctgctgcacactttgccgtcgttctcttcctcgcgcttacccctcgcgttcggccactcactccgatcggcacaaaggccatggccaaggagaaaacaacggggaagcaatcccgatcatggggacgacagatccggaacgtgtctgtcgccgactgcagatgggcgcaagcgttcttttctgcgtttcttcgcgatgcctgcgcgatgtgaagtttctgcacgcgctcaattcgacggactcgagggtctcgtcagaagtttctccctcttcgacgcaaaacacgattcacagtcgttgcgaggacgcctaggccgtccgtgcagactcgcgtcctttctttcttttgtttctcgagaaaacagtctctcgaaagaaacgcctgggagagctaccttcgacgctgtgctgcgagccggctaacgggcagtgcgctttctgagcgtcacgcgtttccacatcgaccatttgtcactctgcttcgacgaaatgtcgatagaagattgcagagggttccgagaagaccttacataatgtcccgttgcatttactcaaagttatacagtttactggtaagtgtggaactcgagatgtactcgacggaaatctcttcttgcgcgaaacctcatctcgaagtaggcgagctcgacttccttcgaggcagacacggcttccctcgcgagaattaactcttttctgctctgcgagaactaactgtgtgattccgtttgcaggaagaacgaaagtcttctcagtcgcgtcggcttgtgaactgagggaccttccgttcggtgtgctgccgtcgcaggagggcagaactttttctcgacttctttccggatcgctggcgggggcgacgctgacggtcaagacagacgcgtggagtgttggcttcgcgaggcggtcaggttttcgcgaaaaacgcgtgcattttctccagaaaatcgacgtccgcacccgagatctcctcgaatcagtccggcggccgttctttttctcgcttttctcggcgcaaactcgcgagaaaggcgcacacactgcgacgggggtgtgtgctgtctcctgcttctgcaatctctcttcttctgccttccttctttctactccaaatcgagaatcgagcgttttcccctcgtcctccccggcaacctcttctgcgcctcccttccagcgcttttccttcctctcccagttgaattgtctctttcgtttctccaccctctgtggctttcgccgtctcgcttctgttccctcccgttgcgattccccttctccaccgcgtccttctcttctcgtcacaaaatcgtcgtctaagtctttgtcattcggctgcgtcttgtctctcctctttgcggtctcgtcgctcgcggttccctcgagtctttccgtcacgttgcctgttgtctctcgcgcgttgtctcctcgtcccgccgacgcgctgtgcgacgcacttgcccttctgtgcaagctttggaacttctctctttatcttcctcgtttctccacttctgcgctggcttcgttcctctggaaatga

SEQ ID NO: 1689 - DNA, 2062 bp, Toxoplasma gondii
gaacacagcggcgagtcgcggccgcaaggaccgaaagaaccattttggggcaacgcagagctacgcgaagctacgtcgccacttgctagccaactgcgtgttcaagaatgagatacgcgaaggcggccaagatgccaggaacaaggacgcctcccgactttcccgtcaaaacatgttttgaagaaaacgaaacaatcaactgcgggagtagatgaaagatgctacgagttgaaggaaagctccgaaaacggaactcgtggctggatctacagcgagaggggcagtcgaaacttcgtgcacggggtgtacgaacacctagggacagcatgtgtttgcgcggaacctcgagttttgaagaaacacgtcaaacgatttcctcttgtttctctagaaagaatatctcaagatgcgtcctgttctccaacagaaaatcggcagaggtgtgtctgttctgctgtgaaagatgagagcggtcctcgtttttgcggctgcgaagccgagcaagactctgcaagaggctcttcgagacaggcttccctcggttattctccactttcctctaaggtgaaaacgccaactcgattcctccgttttcgcatccagagtggcgcaaggtgttccatgcagagggcacagacgttcgcaaaacgcaaaggacgggcgttttgggctgtacgaacacgggcaacaccctgcccaacacagctggcgaagaggttttccacaaaggcagcgaaggcgtaggagagcacgcggagggagccttatgaagagagaggggagcatgtccgtttctgcagcttgtagacaaatgcaggtgcgtttttcgtgtttgtccggtcgagagaagtctcaaggcactggtggactccgagagactcacgcagagctgaggatatccactgtgcagatgtgcctcgaccctgtgcaaagccacctgaggaacaagaaaaggcggcacaaactagtacagattctaaagttggaaggagaaggccgccgtccaagacgcgaagagaaattcagttatctttaaaccctcgcgtgagacaccgagcccgacagatacctttgcggcacacacccctttcaggtttggagctggaaaaggagtctttcaagaagggcctttgagaagatcagctgagaggcaagagagctgagaaatggtgcgctcttgtttctcgagaacgcaagctctcgtattgctctcgccgatgtgggcagcaagcgcatgcggagagtcgcatgcaagagcagcagagccgattttgacatttccagaaaaagccttcggctttcgacactaggaaaacgaaaaagcgaacatccatggattcctgtcagcctttttggaactggagggatcctctgaaaaagccacaagcgtcgtgtgttccggcaaagcttgccatttcggcgagtccgcagcgaaaagcggagacgagacattctggttttcaagtggagaaaccgactcagtctcagtcaaaggagtttctgctcttgactccgagaagtcgctttcttcctggccttcagggagattcgaactcagaattcaacccctcgcaagtgcctgcaggagtatacgcggcgagatgaagccaatggagacgattttcctgtcctgcactctttatgtacacttgtaaacgcctacccgtcttcactgagtctccggtcgttcgtctgtctggaagggaagaacatgcaggaggtctctcggtcggaaagagtatctgtccctcctcctctgtgtctcggcgttgctcctccggtcctcctctccgtcgtcgtcttgagcagctgctttgtatcgtcgactcagacatcattcgccgtctccttctctcgccttctttctggcgtttgcacacctcagcacctgtgcagcgctttgccgtcgctgtcctttgacggtggcccctgtttcctccgcctcccgctttctgcgggacttcttcgttgctgaaccagggcgtgccgttgcaaacaggaagacaaaccagttgaaaatggttgcttcgcttggttttcctctcctctctgtttagaacca

SEQ ID NO: 1690 - DNA, 2327 bp, Toxoplasma gondii
tccgagagacgaactgcatgcgctcatgtgagagtgcggattgcacggcccggagaaggcgagggttggcgggagagtgttcaaggcgccagaaaacgcatcggaaaaagtactcgctgaaggcggcctcgggagtctgtacaccccacagggcagggaagaagcggcccagccacagggacggtcatgcgtcgtcctccatgcggcgcattcgtttgttcctgccccggcagacgatgtctgctggtcgtcaggtgcaggtcgacagagggaagatgtctccttcacatgagtcctcggattagagagaacttgagcatcttcatgcgttccggtctccgcaggcgcgtctcgtgacggttgcggaagcgtcttggacggcgcgagttccaaagtcttttcttctgatggggaggagggatgggtctttgggcagagctgcgtattgagccgactcccatctaacgcttctttggacgaagaatctgttttcgcactctctttctcagatttttgtgcgtcgtctggattcgggggagcatttgactccgctggagccgacgcttcgggccaggagtcgaccgtctgaacaggcacagtgcttccctgtggcgtgaggggagccaacggggcatcgttttctccccggctttccccgggaagagacgaatgctcatgtttctcctcttcgggcgcagagacggaagaactcgctgcgaccgtgtctgccgctctcgcagcggacagaggagctgtcgcggcgaaagacgcccctggcacactgagacaggcgcgcggcattccttctcgaaaggacgtttttctgtattcggcacagattgcacgactcacacgaggtatttaggtctatgatcacgcgcaaaagactagaatgaaacattcaggtcacagacgattcggccgacaccagactcccctcgcatctactgtgccacaacctccgacaaactgtgcagctgcgaccagcaggaacgctgaacgacgcagacgcgacctgcggcgatctgacgaatcttgaatgtcaaacctcgagcttgacactcgagcctttccatcggagccaggaaggactcttgaacttcgcaaagaaaccgcgatacagcgatgcattcgagaaaaaatgcatgcgcacacacaccgaatacatgcctgcatatgaatacttttttttgctacgtagcggcgggtttcagcggctgctaatgtgcagttacacgagtcgacacctctcaggaagtaacgcgggagaggaacagtcggcgatgaaggagagtgacaagagactgcgttcggttgggaggaactggcggacgccgggacatatcttggcgtatttgcaggttcctgccggatggaaggggcgaaaatccagcggcgctctctcgaaagcaatctttgtaaagaatcaaacacagtgttgcgcaaaacttttccgcttttcccagactccacatgtccaaccatcaggacaccgacctcagacacggggggtgggagaggtggtaccgctgccagccaggaggtctgtcacagacaaaagagtgcattacggaaaaaccagtcgagctacaggggagaaaaatcacgcaagcaaacagctcctggcgaagagttcttgctggaaaaaaggctttggtacagccacgtgaaggtacagaaaactgctgtttccagcatgtctagtcaacctgcagcagcagctgtcgctgcacacatgcgcatgcgaaaaaactcgacacggagtctcggaaggagaaccccgttttcccggagaggaagtgtctataggaagtttcagagagctgttcttatctcttcaatcgcgttttaaagtgaaggaagcaaacgcgggaccttcaagtgccgagagtggctttctctgcctctctacgcacatgctcacacatgcgcgacagaccttgcgacggaagacacgagaaaaccagctgcctgctggcccccctatcgaagtagaccgtccttccagtttttttagaaatcttgtaacagtaaagctcaccctccccatttctatcgacgaactccattccttttcaagagacgctctgacgtcggtcggcgactctcccggggtggtacggccgcgggtcgctctcttgcgcattgattccagcacagagttggctggtgtacactcacgctgtgtttttcttcccagtttctggaacttccctcactcggactgcttccggagcgcctttattgcacagtgtctgcgcgcccttcgcgtccaaggagtctcttgagatcgtcaccctttcctcgttttgttccggctccaacca

SEQ ID NO: 1691 - DNA, 1416 bp, Toxoplasma gondii
caaatgtattacagtgttcgattcgcaggttgtcagccacatctcacggctagtgcagtcgactaccaccaagcgttgtgaggcagaagtgatgatgggttgcgtcgacttgtgcaaaaagacgtttcgtgagtttttgtggggaacacgaaggaatacatgtttcaacgaggtgtacgacggttttcgctgtgctgcttgcgaaataaagagccctctgaggatgttaaaacccgggcgtctaaaaatacattgtttttttcgtcctgtcaccgcaactttccgactctgaaaattctcatgtttttgtaacggtagtgtcgtagaacgcgactgcattaagtacgcgagatacacccatctcttagatggaattgtttcactgctgagtcggttcacctgtcaaactctaacatatctcgtgtgcctgataaaagttaatcgattaactgtagccgaagaaacatcgcgcctatcggacctttactgatccaaaatttctcatagtgtcataaggaaattatgactcgaaaagggggaatgcaccccagaaacgtattgtctctattgcacacgctccgcacaggacggccacgtgggggacaaccgtcctactacttcaaaacgcaaggggaaacgaagatttttcgggacggaaagacaaagggaaagaagttgaaaaacaccgattgaatcaggtgtgctaccctagacagtcgacactccattcaccaggcagtgaagagcatgattctgttgaacatcgggacctcgtgactttcggcatacaccgatatgacttactgaatcttaagaagcatatcgctctagcccagcactttaccaacgttggctgtatatctcacagctgttcggtcggttcatgtcggttcatgcgtcagcatcctcgaaaccgttgcaaaatccgtccgagtcggatcgcttcggcaacactccttcagatgtgtgcagtctatagacaagctcttgcagactgagttttacttcggtagacgctgcaacgcgtacgactggaaggacagatttaaactcgttttggtttcaacggttcttcaatggcgtgcacgtttcataggaatgttccgcagaaggaacacttgctgggagatgtcgcgatcagtagatcgttatcggaatcgactgttggtggtcaggcagaaataacgtcacaacgggaaaaaaagttcctgcacccgcgaaagaaacgaaaggcagcgcagccgttcaatctggcctccagatttactggagttgcctctaaatcgttttctgggggatgtcgaacggctcgcgagcattctcgaggccacatccgttcatctcagagcgtcgcctccacactgatctacgcctatttcctgttccttgccccacaatctgtgttgtacccctcta

SEQ ID NO: 1692 - DNA, 1567 bp, Toxoplasma gondii
cccgaggctacatacgtagatgcctttacgcattcatgtaaattttattatttatgcatatgctagttatatatatatatatatatatatgtatatatatatatatatataacgatacatgactgtagaggacctctgttacgtgtgggattccaaaagggatataacacgtcctgggaaggtttcaaaactcgcgattagagacagtttttttttgacaaagtgaagggagcaaattgtagttgaagagagctttcggtagtggcgagtgcggaaagcccaaaccgtaagcaaacgcagactgtctgtggaagtgaaggaccttcgtcgattcgaagacagaaagatcaaagaagcgaacgcagagcaactctaccgcccgcccattctcctgctttgcttcacacagaacaaggaactcgcattcacagaaagaagatagctgtcagatttgtgtcgctggcgagtcgccgtcctcaaatctcttaaaggcttcacattacgaatcctgtgggcgcgtgctctcaatcgttcacttcacaaaaaattttcggcattctctctcttcctctccgtccggtctcatcacactacatatatcatatatatatatatatatatatatattcgatatttcgtgggtgcatttgtttttcggttcttccgctgtgtgtctatactagtatgagtctgtgtgtggttgtgtgtgtttgtacaagcatgtaggtagtttcacggttttcacggtgctatccccaagagcagggaaattgctttcttcgtcatctttcgtctgttggagctgtgcatgtgagagccagggcgaagaaaagagatagaaagtgaaagtgtaaaactgctacagactgcgtttgcaaacatacagaacaggggaggacaaccacgttgctttctgtctgtttctcctcttttctgcactgtctcatgcgccacaccgtccacaacacgcttcctctcggttggggttgcgtcgtgtacagagagccggaaaaatcgcctcttcctcgcttttcttccatttttcttgagcgttcctttcactgcgaagtgtctctcttatgtgggccgctttcctctccctttcctcttttctgcgactcttgcacgagcaaggcgcagagttcgatgctttcaagaagaccgacggggaccccggttgcctgcatgcactacgcaaccgaggtgtaaaaccgggattctctggtcaagacagagaaaagcgcgtggccgctcttcgtcctcgacttattatggacccaaggcagcagcgagagagccagaaaaagagcataaaaagcataaaaacgtttcgcttctccccagcgtgcgacatctttcttcttgtctctctgcctctctcctcagcttttcccgtcgcaccccacttccgcgactcttctcttcgcgttgcttccttctgcgtgtctctgctctgagatcttcttctttttctgggcgcctctgaaaccgctctctgcctctcgcctttgttttctggagtctctttcaacactgtaaaacctttcaactctctccttcgttaaga

SEQ ID NO: 1693 - DNA, 2273 bp, Toxoplasma gondii
tgaagaagatcaaagagccgttgtcttttgggtgccgtgctttgcgccggttcttagaggcacttttgccactcgcatccacgcctcttgtcgcaacctcggtggatatgcttcgatctttgctgtcccgaatgcaaacacagttccgctatttgaaggccgcagcggccggcaagcgggcaagaggccggaaacaacctaggattttctttggattttgtgttttccgagtactaacctatcaccccagtgccgtggtgcgatggcagggaccaccgttgttcgtcatggagaaatgtgacgtcaccacatttcaaatgtaaaagcacagagcgcagtgttccaccgtcagaaaaacacggaatacgtccgggttcgccccgccggtgggtgggtccatcatttctttctgcgttcgtgccttacgtcggcacgtgtgtgtgccagccacttttggtcaagtggcagccaagagctgtttcctgcagcggtagaagacaagaaaatgcagtcgtttattcgacgaatcagcctgtgacattgtatctgttttcgaacgactccccagagtgggtacggattacctacggtagtgtggccgcaagtcctatgtccgtattaagaggagtaacacaaccagaacaagaagtattaatatcccggtggatattgtgggtgcgacggctcacggacatccgccaatgtgtgtgctctgtgccacctgtatcaccacaaccgttgtcggccaggtggcaaacagatcccaatttaatgctggggtgcgaaaaacttagcaggtgctgtgttttccgctagcttaggctccccagcaaaattagagcattactagtaaaagcatctagtcagttcagaagacgcaacagagcattgcccagtgagagtcgacacggtttttagtggactctcgtatcagataacggcgcgagaaaactttttttccccctggtttgtgtgtccgcggcagagaagtgtactgggcgcctgtctacagaaagagaaaggttcgctgtcggaccctgagaagaatggagcagattgcttccgttcatcttcaagtcgactcaaatgagtgtagtccgagcctgctacggattttgaaggagctcattcagttaatagagatggcttctgtgtactgagaccacccgtgatgagcgcagtgtagcagcgagcactgttattggcaggaaaagacgaatctaacagaaatgacagaaataatttgaggtagttgacattcgcggcacatcggaacaccagtgttgccattttctggcgtgcttatgcgggctgaccttgtcgaggagacctttggtgttgctgcgttaactacactggcggaccgaggccagtgaactagcataatcaacacatgggcatgaaatactataaaacagagtcatacatacctagaagcatagacgcgtacggccgctacatcgaatgctgaagttgtgaacgtgtgagggagaaatataagggcgccagctagtgctgcagagtatttcggcaaaacgatgtttgttctgttctaatggtaagccgccggaccttcaggtaccatctttgaggagatacgcatgatatagggatgactgcagttctttcattccacaaggagcaagggagatctcccgctgtccgcgtccttcgaagatgaaaataaccaaaacggattctcgaggctgaaccaccgtgtcggtaaacagagtcgtgttgcgatggtttctggcgagctctacagcagcccaccgtctgctgcatagtaacgccaatcctatatattgcagcgtcaacgaggatgtcctccaggcgaatagctcctctaaagacgtttgtgccaaactatcaagcggggaaaacagtggattcgtgtagattcctttgtgccttgacccaagcacggaacacaggaaagtgagaatctgaaaaatctgtaccgctggaagctgtataggtgaacttgtgaaattacgagaagggaaaaaacgcacctgtggcgtgcgaagaggaaatgaccgacttctgagcgtttgtggtctagtggtagaatacctcgttgccatcgaggtgacccgggttcgattcccggcaaacgcacgttctcacatgcttcttatttcacccgtgatagttcgaacctttgttgaaagaacaacggcaccggcaccagaacatgcttcaagcaaaagttttcggctgggaaacaagaaacatgcggtccccaaaagcggaaattcgaacagtgcgag

SEQ ID NO: 1694 - DNA, 4493 bp, Toxoplasma gondii
agtgcgctagagctggtagctgagactcatagcgaatgatgtaaaaaatgattcgctgcaccgtcaaaacttagtttcaacttcaaagtacagcaacgcttgcaacgcgtcgtacggtatttctatcatggtgtaacacgtccttagtgtttccctaccttgttcctcggacgcgtacggattcaccacgaagcgcacacctctttccgaggcgaagaaagacctcgaagaagccggggctccacaatgggtggcaagtttttctgatgcgaacgaggagtccaccctctgagagccaagcgttcggctggagtcatggaaaggagctgctgaaacaccagaatacgcgaaacgcaatggttcctctgcaggagggaacagaggcactctgcctagaggagtcgtcgatgcactgagtttaaagacgctcggctgtcgacgtccaggcgttttgccatctggacagacagcagaagacgacgaacaagcgaagtccgagccccgatcgacagacgaatcaccaggaggacactcggaagcaagatgcgtttgctttccactgggatcagccatctctgtaaacaaaaagctacggccacagtgatcagaacgacggacgggagtgcaaggagagagacgaaaggaaaagagcttcctcagttttttgtccagtgatttgacaggcgaagaactcgtcgattcgttctagattgaaatgcacaaaacaagctctggcgcaatcagatagcaaaaaagccaacgaacaggcgtgacttcacgtgggtatcgctgagtcgaggacattgcacggattcgtgactgcagaaagaaagagccccgaaaaggtaacaaacgagtggtaatcccatcgagcaactgaaagcatcggtttaattcagctacacgcttgaagagggataaactcggcaaacgcgcgagaaaagcgcagggcagagccccaaagttctcagcgtgtcgtctccagctttatttccatattttgcctgaagactcgagcaactcaagcgaccccctatgtgatatactccccgaagaagatccactacgaacgacgacgaaaggttaccacaaagtgaagtcttgttcttatttctttcgtcggtgactatcgagtgtcgacatgactcggtgtctctggaacggctttggggacgctgtcgaggtactggcagcgtctgagaagaagcactccccaagtcagtacattttgcacgcgccacatcctatcgctacgcattccagtttgtctgagcttccgaagcaccgtttgcccgttttgttgccagtgtttgccgtttcaacgaccccgagctgccccgacttttctcgcgcaaacactcgactcgatggagtccagcgcatcccagtgttgtgaatgtgtgaatcctgactctgtctcaacggaagtgaggagacggctgtgaatcagacacgaacacaaatatatctcctttctgctcgtgctgtctctaccatttaatctcttccgtggaggaaaaatgccgccttttggtcgcgagaaaagtggtagagtagtagccacggggagaaggccgcgtagtctcatttggctgctaggtgtcagggagctgtctaaatacccgcggaattaaaaacagtgagagagggctgggtgaaaggccactcacggagtctccattgacggagctggaaaagcgtagctgtcctgagtcttctgaaagtgtcctactctacgaaattctccaagggcagttcaacatggactaagatattagggcggtgagagtggctctcgggcacccggtgaagatgacagcacacacgcgagattttcctctgactgagaaagtcacgttcacctgggcaaggagttggggaagggttttcgttctttccttcttcctccgcaacaggacgttctgtatgcaaatttgagtagttagttcgcaaaatgtggtttgttgagtgtcatatatgatggcctgcacagcgtgatagaagtatgctgaaatggtaaacatcggatactggcgatattcctgctcagaactcgagctgctagatttcctcagtttcgagaggaacacgccatggctacctttatgcttttcgtccgatattttctttgggtttttgctgagggtttccccgtcactccggtggcagcaactgatccatactaaagttaatagaatgtgcagttcacgagagacaaacaaacactggggtagcattcttaggaggaatgatctggtacaccacatgagggaagtcaggtttctctggagccagagtttgacaccggtggcatgctcgaaaacgcgatggcagccccgaactttcgctgtggggtgacgtagaggcacttatctacacactaagggtcttgtccccatcaagggcttcaattttttgttcgatacgaacgtgcagagacgcagcgaatcgtctttttccatgctttccggttgagaacaactggggagaggcaacgctgcgaaaccgtactgcctgttcgtttctttgacgactaaacccgtattcttatttgttacatacataatggtaatcggcaggctgcgccatgcccgtgggtttgaccgcttccacgaggttttcgcaggtttggacacatctcgctctcgttactatcaccagaaactagtgctgctctcaaggcgcaccaggcgacaacatcgtgttggcatgtatccttgagcaattcaggctctcatctcaatttgtgacatgaaaaacgaaagcgacaggcgactgggcggttgattgagtgtgtttggtgttttggaagtggtctacctcagaggcatattgacctggttgaccttgaccgtggtcatatgtttgtcgtaaagattaagccatgcatgcctaagtataagcgtctatgctgtcaatggtcattaccacagagaggtgtgcccctgcaatcgccattcacattcaacgttcgtttttcctgggccttttgagcgagatcccctttgatggcgggtgatgaaaatgttttaatgagtgacagagaaacacgacacacctctgccgacacaaacacatatgaatattcagtatagatgaagtataagaaacgaccaggaagcacatgtatttagtcgtcatgaacaaaggcagacacctgagttgagaaaatgacgaatagagacaggaacacacgggctgtgccacttaaaggcaacgcgacacggagacgacgtttgacacaagaaactggcgcatgataaagctgtagacgtacagacacccagataaggagtgataaatcgtgactccgagcaagatgtacccatgcacgctgcagcggcgaagaacaccctacagtgctcagagggggctacgagataaagggacttctccacacgctacggcggtcacaatgaagtcagaactgtaccaattctattctatttacgctatatgacgtttcccagcagatactgggtcgcgcaaaaccagcgtcgatgcttttctgcgcacggtatctcgcgttctgccactgccccagacactgcgcatttgcctatgttttctggagtatgatagcactagaaaacgtatccggtcctcaatgtgtatatttgtgtgtgatcgtgcctgcctgtaaatatataacgatacgtggacgtttattaaccggcttgtgcgcactgtctagtcgtgggtcaacatttcttgcgctttttgcacctcatcttggaccgctcgcagtggcactccttctctccttcaagcctgcagtcaatgagggaaatatgccactggattggcctggaccgaaaaatgcaaagaaccgactcaataaaagaaattcaaggacgagatgccacagaaacacagtacccgcctctggttgagaccagctagtgtcccccccccagcatgctgttgtttgcggagaagagacggcgcgttgacactaaatggaaccaagaaagcgccagaggccaaaaaacatatatttgaaaggtaagagagagagtaaccttcagaaagacgaacctattgaattctggggatcggctgtctccaatttttttttgcgataggcgagtctcgatctagctgcatgcagcgcgtttcaaggcacgtcgacctcgtcgccagtctccttactgcggcatattccggtgtttgaatctgctctctgttcttctacattctactttgtgtctttgtcctgcctcgcaacagtcgctttttcgtcttcacagccgcttccccttctcgtcgtctcgtcctgttggtctctttcctcgccgcctgtcgtttaggatgcttgtgagcgatatgggaaactagaatgacgtttgcagctctttgtggtttcttctccctgcagccctccttgaatcaaaattgaatcaaaattgtaagatgaatttagatttggagctcaccgaaaaaacacgaagtgtgcccggaagccaggtctctttcctcggcgtgtgagcaga

SEQ ID NO: 1695 - DNA, 3671 bp, Toxoplasma gondii
gatggttgatctcagcccgtctcttctgacaatgcggtcaagagattcacgctgaaactgtgtttgtgtgtgcgtggatgcgtgtgcgaaggtgcgtgaaaagaagcagcgcaaggaaagagatttctcggatagcagagacaggagaccctctccctcaccctctaggtggtgatgattccccgtctgggagcttcaggcgatcattgttgaacgttgcgcgttagcaacattcacgcctaccaaaagtctactaggcttttatgttgagtgagcaaaggtatagggaatcaggtatacatgtgatgaaagcgttggatgagcttcggacaaacctctactctgttggttatcctgtactgtagaagttccttcgctatttctcatctctaggaaagatggatcggtttttggctgtgaatttgtctcaaagcaaccctacctacaaaagtttcgattctgtttttcgtccgtaaaaaggtacaggcactccgctatgtaaaggcggcgacaacggagatgtacgacgcattcgagcgttctctactacaggcgatttgcgacgacacagtcgaaaaacgacacatacagcttttcgtacgcgagtttttcggagctccactcgtgggattttttgcgaatggcattgcacatgcactgacaacccattcacagacgagaattcgcacacccactggtggaagttctgcgtacgtagggtcctctttgccactctctacgttcctctcttcaaacggcactcctgaacacgattgcaacatactgctctggcgtgcacatggctcgaagctccactggattctgtagccctgctctgtcccgtcatcacgcaaaagtaatggatcttggagaaccggcgctggggcaacatcgaactcgagctttttgtaacaccacaaaagcatgcgttccttcgcagacacattcaaaatgtcgcagacttgacaagaacgtcaaacggtgctttaccacacaggtcctgctatttccttatgcgacaggcgaggccgatgaactgaagtcatcaaggccgggcttaacacctgtcagcccttcgctaagaaatcagaaacattctccaaaatggtgtggcaaattctttgccgagacgttttagaggatcaggaaaattacgcgattctcctcactctacgttagaccaggcgatcacatcattactgagagcaccacttcccgacagaaacgccgtatgcacaaatccgttccgcaagacacacctcctcagcctgacagaaagtaccatcaactcctgcattttcaccttgtaaccacttgtggcaacaagaaaaggtaaatctgccgctctgaattccgaacaaaagcataactcgttgctcgcattcttgctcggaaccgttggaggtggtgtttgccgctttcaaggatgtttcgttcagtacggctggaggaacgcgcctccattttctccagaatactccaccgcaacacagttacatcagcgccatgcaccgaggtgaaacaatcacatccttccccagtcactgttcccgcgctctagttgcgtcgatgagtgtgtgcgggtctagcggcggtccgacgaagatcttttacaaccctggcacttcccacatgctcctcgatgacgtcaaggacagaatcttcgtctagaacaggactgcttggcatgtcttgcgatgaagaaggagctgaggcagttatggagtcctgcgcgttcagcgaccactgacctcgactccaagaccttagggcgcgcactacgtcgtcttgatttgaagcagaagaaccaaagcttggcgctttcgttatgtcaacgtctccaatagaagacagactgtccacagtgctcgcatggaagtctttcgtctccatgctgtcgcctttctctaccttctcagagtgttcacaggtacccgacttcactgcaccaccgggtcgtcgacttttccgggattctgcaacaccggtagacgagttcccccctctgtttgccacttcttggttcccctgcttctcgttcccatcgtgaacagttgattcggcttccatcatcgatgccatccacatttcgcggctgtgccgccgaaggactgtgacgacaggatcgtcaggtaaccgtggtgaatggagtcccatgttcttgggtttgagaccagttgaaaacaaaattctacgctgaagttaaacacgcgaatgacaccccggaagcgagtttagcggtgcaagaacaagtgtctgaacaatgtggaaacgcggtcactgcatcaccaccgtgatcttggcgcgtggcacgcttagaaaagtcataaggacatcaccacaagcttgcaagacatgagtaacaatctcagaacgcgaagggacagatttcgtacactcgctctgctctgtctctttcaccggcgcgaaactcggtgaaaccaccgaaatccacaaaccaattcgatgggaaaggcgaagcagccgccgtggactaccagccgtaccggtagggctgaagacagtagaagtcaaccgtctcaatttccaactccatcaacacaagggacccgagtgacaggaggcaaaattcattttcttttcaactttctcagaaaagtacttctcaaaaatcatcagaatagtgtgtctgtcggtgttaaccaaaacccgttgcatgaccgcactcacccgatgagcgaaccatgtagcgaatcgcgctgggcgtcgccggcaaaagtgaagcgggtacaggcatgtctcgaggcaagaagctgtctgctcagtccccagcttgcacacgattatccaccaccaaatgatgaggttcatagtattctcctctctaccttttgcttgacgctttccttcccacaacatctaagcgaactgcagaagcgccaaaatccccagcaccgtcatctttcttgtctgttacatgcatatcgtggcggcactattttcaccaccgaaatggagattcttctttctaggatgcgagttgctgctccgacagagggatcgtattcgagggggaacatttcattctaaattcacatatcttcaagttttgggctttcctttgccgccaacgttgacccagtgctgttgtatttgcatgcaagccaacaggcaggccagttcagggtcgatcgcagcaaaacatgcgacgtcgctgcgttcctgaccattccgatatgcgccatttccccctaatctttcccgctcgtttcccatcaccttgggatggtccaaatcccatctcgtgggcacttgcttgccgttcgcggtgaaaatatcctatctcgtatcgcttttagagacaaatcgaagcattgccagcaatcttacacgagcacctgaatgttctgtgaagtacgcactgttttttcttctcgggagcccgacatacgaagagcgaaagttcttggctacacaggtacagacagtctcctagatgtgtgacagagaggctccccacgtgtttgagaccagctaggtttcaccaatctagtggagccaggcctgcccaagcagaaagacaatttgctatcccctccctcactttgtcgaagttggaactcaaagagagaccgtaacctcttcgtttggtttcgactgtgcaacccgtctgacgaaaactagccgccccctgtcttcccttgaaaaaa

SEQ ID NO: 1696 - DNA, 2691 bp, Toxoplasma gondii
aggtggaaacgatgtacaatcttggacatcactgactggaaagcggcacgcggctccctatcgtcatgtttcactcgccagtgatttgcttgtttgaaactatctacaagtctaccaactttcatcaagcgcaagaaaagtcctcaccgtaagatggcctcagcatcccaaagggtgacgtctccatctgccatgccacccgcaagaagccccagagcacgttcgccaacacccactccattcccgtgttctccagcgactcctgcaagtttattctggccactgcttccccacgcgatgcactgaaagggtgaagaggcggacacggaagccacgacaggcagcgccgtggaagaagaggcgaagtcgacggtggccagttcaaggtgtggatcgaggcccatcgtgcccagggctaagtacagctggtggctctgtagagaggacccagaactggtagatttttcttcctgcgacgccgcacattttgtgtgggcaggccctcgtgtgggcggcccccacgcaatacaagcactccggcacacctccttcagtgccatgtttctgtctggcgaaagtcagtgaagggccaccgaaaatactggtgacgatatatcaagctggaagggtgcttgcttgttggaagagttccacgaggagtccaaattactctacttacggacggggtgtaacagcggcaacaaaacgccaatatcgagaaacagacggaagcgacgcgtaaagaggaactatgcatatcaacaacatcccaaaaacgggggaaacaactgaatgggggaaaaacaaagagggagacctctggattctatgggtcagacgaaatggaagacccggttttaagacttcagcctcctcgattgtcactcagatacggcttgaacctgacggctactggtgaaaacaacagcacaccacgatactaaaaacagtacaggacgtcaactagcacatttcgaaaatgcctccttcgaaacgagcattcagatccagagattaacacttctgcctggcgtgatagagacgggggtccctgagcatcgtacacgctgaggtgaagacaagaggagatccgaggaagacgaccgcagataacacagtcagcagaaaagcagacgaccagtacacggaaagaaagtggtaagctgctgaaggcacatgaggaaactaggcggaaactgcacatggattcagagaatgtgaagaatccacgatgtcctgatatccgacggcacacacaaaaaagctctggctttttggggtgtatgtacaccaccgcaccagctgccgacaatatctgggtacactaacttcggatttcggtctaagatccgtgccttttcctgaactaccctcacgcacagcattacgacgcgtacagctctcgcagggcccgaggtcaacagtttccgtttctctgcaaaacagcaacaccgcctgtcgccagctgtgttcttctctggcctcttctagccgggcagtcgctgcgaacgtcgcgtgccacagcccgggactactacgctgctgcctcagtctcagccgtcctaccggtaatgtgcaaccgtcccgactgttcccagctccacagtagaggtgcgaacccccgctttagctgggggtcgcctggccaacgacacgtaatatggtgtttgccgtaggcatttgggtaaaccatcaaggttttgaatcaacctgcgagacagccctcacagttctgtcttaatgcttgtcttcgatgtttttcctgtctcacttttcgtcgccagggagagtttctcgttctcctcagcagagttcgactgcgcgtgacgggcatgcatgcttcttccctactgacgaatcaagcgaaaactgcatgccccatccgtcgacagcaaaagccgggcagcgaaaaattctctgtggggcgggactcaaaatttagcgacaattccacgactacggaaaggtacaagaagacaatctaatctccactgtctgcggtatttccacttgctgttggagaagcaaggccttttccgctcggcagcgttttgcgtcgtgggccgccaagccgtctctctctgttgaactcaactgccccgtgatgttcgtctgcatgtaaccatcatctgtgccagcgccacgaggcgatacgcgctctttccctgtcttcctttcgtgtgccgctttattggaacctctgtgccatccatcgcgtagaaacagttccgggacattgaccctcatctgctggtgtgcgttcctggccctgtccgatcacccttttgtacgtcacctggtcgtttcccccctttttttctcgttcattttgcaagctgttttgatgcaaagcagatatacctgcttttccaggtctgcccccttcccacgccgagtggactaccggagttcttttttaagcagggaaaggcgtccgctgcttttgtggatgccggcgggctcgcgggtctcactgagcttcctcggtcgtccttgaggcaactggaaggcagttctcttctgagttgcctctggtgacgtcatacaactcaaaggtgatccactttttcgttggagaactcgtgtctccgcagcatgcgcaaagggagtctcggaccctcaatttgcgaagtttctactcttccgaccgcgtaactcgtaggtcttaagcggacgaaagagttcgtgcaa

SEQ ID NO: 1697 - DNA, 4398 bp, Toxoplasma gondii
ctctcctgtgtctcgtcttcacttgctcgtcttctcgtccgtttcctcgcacctgctcagggactccgaggtcgcgcagactttcctcgacggggaggaggaccaagacggaccctcccggcgaagcgcggcttcctgcctgaggcttcgcttctctgctcgcgacactcgacgaggctgccgccgtcaggattcgctcgtggtggcgcaccacgcgctgcaggaaagcgtgcgaccccagagacatggagagaaaacacaggaccaggaaagaagcagagagagagaagaaaaggcaaaaagaagaaagcaggaaaagcagaagagggagaggagagaagacagagcgacgcggtgccttcaggacgcttcagaacgcgcactggggtgcccgagctgcccctctctcttctccgtcctcaaagatttctcttctacaggcaggggtcaccatctgcctctctcttcgtctctctcttgttctccctcctgctcgccgccttgcgccctccgctctcttatcctcttctccctcagcttcttttcaccctctcgttctctctcgctgactccaggcgcttttcctctccttcttctgccttctctgcaaaagagcgtgcggactgcatccgcagagcggagctggagaggagtcctgcatgcaacgcctgaagaagcaggctggccgttcagctggagtgtctctcgacggcctccttgtacgacgagagataacatcgggggggggaggccgggcagatgcgcctgctggggaaaagctgcactaggcgagtaacgcgctggtgcgccgacaagtaccgcggcattgaacgacaaaaggcgtcacatgctaatgaacacagacctcaatccaccctgaattacagacacacatatacatgtatgtatatgcatatatctatagagatagtagcaaaaagcgattgacggtgaaggcacctcggaagaaagacaagaggcagagtgtgtcgggagaaaaagaatggcgtgtgcagtgcggaggcgcccgctcgctgggagtttcttcaggacacggacggcttctgtgtccgtaaacagagacaccggaggcgagagagcggttggttttctctttttccttggtacgcagcgcgccagcgtgcagagcgcggtaaacttcagaggtctctttgatgctctctcaaatctgaaagtccagagacagaacggcgcgtggagagaccagccaagggcgggagttccttacggtggtctcacacctgctttgcgtcgtctcgcgctgctttttggcgcacacgaaacgcgggagagtcccgcccagtttagagggagagaggttcgaacaaagagaaagaaggcgtcatttccagcgagacttgccgggaaatattgaaggaaacgcagaaagctcgccctcaacccacccagcgacgtcgcccccgcccgctagctggggagaaagagccgcgcactctgcgactctccccccgatgtgtatgtacacttcagcgtggaggggagcggctcgatgaggtcggggaacacagaggcgactgagcatttcacgacatcggaggtcgcgcccattcttggagaaacgtcggcttagactgaatctttgagacgcagcgccgaacgctactcttagagcagagtcgactgcggtggcggaatcagcgaccctgaagaactcgggagcacagtcgacaggccttggtccctcgttgtccttttttctctgggtgcatgctcttctctgttcctttctagccagtgtcagaggaagcgaaactcacagaaaggaaaacaaagcaagaggaaagtctctgtcggtcgccgtcgtcatctgaggcaaagagcctccgagtgcttgacgcacacacggttgcatgcacaagtacgtaacttcggaagtagagtatctgtgttgtggcactcgtaacaatgtgtgttcatgaagaacgaaggacgcggaagcgaagatgtatttcgaacggagagaggaaaaggtggaaatggtggtgggtccgtgtatctgctgttctacgagctgcctccgggactgtctgtacaccccacgcgtctcacgtttgcgtacggcagaaggattcgtgcctgaacagaagaatcagttcttgactttcgactagggaagccgcgatgctgctcgagccaaggagagaaaaaaacgaagcacccaactcgggtggaggagggtgcgcgcctcgtcacaagaaatccaagtgcttgaaagaaaacgtttcttgctcttcataaatatatgcatctataaacctataaacatatatatatatatatgtatatattcaatcttcttcagtgccacacatctagatagatgcgtatataatgcatgggtcatcatccttttgagataaagggtgcaaacatcccccgcttgcctgtgtcgatgccgaggacctaccgtgtacgccttgtcccgcagagggaagtcatttttttgcgtcggaattctttagtggctggaaaggtgtcacgactgctcacacatacttctatgcatatacgtgtatgtaaagatggaaacgcttatgtgctcccgtacatacacgcatgcttctttctccatggtgtgtgaggccggtactctcggttacgctgctcgtgagcgccgtaaaacgctgcatctgcttccttcgaaagccctcgggacgagacagaaaaggagagaaaatcgaaggccaacatgaaaagcgggacccgctctcagttcgcaaaatagtccgacggacctctgcacaccccagactgtgcctcgcgaaaaaaaccttcctgcatccttctgaaagctgttcacggctgtctctgcaggacacacaatgccccataaaaccatgcatgtatttcacatatacatatatatatatatatatgtttgtgcgtgcatgtgtgtataggcctgtatatatgtgcatgtatacagacatacattcatatgcatatctgtattcatgtatgtatgtacgtatgtatgtaggtgtgtaaacgcggttcttcgcgagacacgctagctgcgtggatgatgctttctttcaagtcgagaactggggaggagacttgggtttcagaaaggcctttctcagagtcaggttttcgaaagttgattcgttgtcgaaaagtttgtccgggcgcctccaaaagtttttctttgcgggaagctccctcggggctgctcttggggctggcagagcaagcgggggcgcctcgcggggtgccgcgggagacgtcaaggtgtagatggacgcctgagagtctgtcgctcacggcagagtttctttcggggagagtttgattgcgtttcgttcgcgctttggaggcgaagtcttgttctccttcctcaaaaggagtggagctacatgctctttttccaagaaatcctgacgaacgtcgctggcagctgagtgggtgcgcgagctgcatgtcgcactgcgcgccggacgcgcgaggctttcagaacgcggcgtcgggcctttttcgcgtcgtttctgctcctcttccccgtttttcaatacgtaaatctccgcgtcttgccgccaattctccgtgcttcgcgcgccctcttcccgcccgcgcttctctcgcagcgagagatgcgacagttgaccggaacgcgaggatgcgaggacgggagagaaacagcagagaacgcgcgaggcttctttcgccgtccacggccttcggagttcttttccggtctccgcaccgtcactttttcaggtgtatgtacacgtgaacgggacatgcagtcgacgactcttcgcggcgttcgcgtcgtgtcgtcaaagctccccgtttcgccgtgaagtgactggcttctctgccgtttcctcccaggttcccggagttcggactttgcgtcttccacgcggtaagccttttcaactctccgcctcgtcgctgccaggcaggggcgccaagagctccgcgcgttgctcggctcctgacacagctcgccgaggccttgggggtggcgccggtcggctgaagcgccctcgagactttgcagtgttcactcctttcgcctttcttctctcagcctccctgtgtctgttccgtcggcgcggaacctggccgccgagctgaggcagcgagacttcttccgagtcgaccgctctctcttcttcaggagtctcttttgccaatccttccttcttccccgactcttcccgcgcttctctcccctctttctctcctatctttctctcctctctttctctcttctctttcttctcttttctgcttcttcgcgcccgttggaagctccctttctgccgactgttgttcgtgcgtcgcctctttgctgcccctcttcctgtctcttctccctcatcttcgcgtccttcctccgcgaga

SEQ ID NO: 1698 - DNA, 4397 bp, Toxoplasma gondii
agctgagctggagtcaagccagaaacaaaacgagtcggagccaaatacctccttgaacaacgtgaagtagtcaatattgcgtttcacctgtggttcttgtcctccacatgcactcagacagagatcgacagaggctatgttgatgcaccactgtcgatcaacgtttgacgcactgggcccgttgcccgttcgtttcgcggaatagggcacctggttctggacaatgttcttgggtatcagacacgccaactccgaaccgcgctctgcccaccacgaaatggtcatgtctcggaagttctcgagaatcttgtagccagcaattgtccctattgattcggggtgaaactggacgccatgcagtggcagttctcggtggcgaacgcccatcagcacgttatcctcgtctgtggtccagcaagttggctcgaggcatttcggcaggctgcatccgcacaggatcacacgggataactttcaaaaccagaactgcatgcaccagtaattgaccgtggtgaacaaaagctgactgtgcttacctgtctttgtccacctgaagagaatggtagcgtacaaccggagtttcactctccacgccctcgaatagcttgtagcccctgatgaaactaatagggcttcgccttccgtgtaccggtcgcggtgtcctctgaatctgacgcgacaggaacacatgctcaaaagcaggttagcagagcatatttgtatcttcggaacgactgtcatttgtctacggctcgacaacagttgcaccgttacagttttcgcagagtcgggtattcttacctttcccccataaacatgaccaagaccctggtgaccaaggcagattccgaggattgggacggcagcttccctcagcgcttcactgcacaccccgaaatcatgttcgttttcgacagttccagggcctggagagatgacgatgttatgcacagggccgacgcttgcctttgcctctctccagctggagaattcatcgttccggatgacagttggagccacaccattgatcgttgcaaggtactgaaacacgttatacgtgtaggaatcatggttgtcaatcaacaacgtgcgcacagcagcggacgacgggcttggcagccctcctctctccttggggggcagtggccgtgggaggtccccgcctgcgacgacactgtggttcatgctgatttaattacaacggtgacacgaaactctattattgccaagatatgagtcgggaaacggcgtgctggagcaggcgttacggtcataattccagcctgcacggcagcgttgcatgtcaaagcctcgctgtatgccacgttcgagcccgttgcactgccgcatgtcgtttacatgcgcacgctgctgtacagacacgcaagacacgtagacgaactcaacagcttcatccggatttttacccagttctccgaacatttagtcgcaagctgccaaacaatgaagtgcgtccctgggctggctgtcatcgctggcacttttgtggcgatgctaagggcgtccgccgagttgccacactactaccatactacgccccaactcaaagaagaggtggagaaattagggaaggactgcgacggatttagtgtccaccatgagccgatcggcaacgaccacactattgagtttgttactgtctcacgtgcaagcggaactcgagacagattcttcctgctggcgggtgaacactcaagggaattaatttcggcggaaagcgccctgcactttctccagggtaaggcagctccatctgcttattccgcagcttcatcgtactgcgcgtgctacagtcctatgtgaaagagaaacgaagctggcagagaaagcaggaaaagtgcttcagcacacaaacatccaagttgtcgtgaacggaaatccggtgtcccgggcgaaggtggaggcgggtgatttctgtgtaaggcaactacgcacaatccggtctctggcagcggcactccagcttcgcctttttgcagctgcgaggaaacgagaataacgtcgacttaaaccgcaactggggaggcaagttatcagcgattgataaggtgttaatctgtggtgacgcttgtctgactatagatcactggaactctgcagcggcaaacgcggagacaagtccgggcaataaagctttctctggtcagtagccaagttccaccgcttgtaaggaaattcaccgtcatgaaaatgcacactacagagcctgagacgcaagcatttgccaaagctgtcacgtcgttcaagccacacatcttcctttcggttcattcaggtgagcagtacgtggcttttgagagtgcgaaacggcatccggttttctggtagacaggcaccttagggatgtacatgccgtgggccttttctgcagaagaaccagcacggaatgagcaagcaatggagtgtgtactcatacaacaagtcgtgtttcaaacgtcagtgaaattgggtcatcaggtctgttttgaaggaggttgacgagaagttctgtcgctgtccctacggtaaggacggatgcacgcaggccgttgccgcagagagactagtcagggtgtttcaggagcagcagggaaagaagtcgggtaccagagttctggtacttgcctcgactttgtgtatgacaagctaaagacgcccttgtcgtttgcggtagaggtgtgcaacttgccgagggcctccgattttcacttcaagtcaaacatcgtcagatttacgcccaccccaacagacaagctgagctccataaagcatggaagaaggaaatcaagtttttggatccccactcagacttcagtggattaggacacccacggcgcacgcgcatcggcaaaggaccgcattttgccataatgccggagccagcagatgcttacaatgaatgctttgaggtacaccaccatgactcacctgatatcagatcagcttaatccctccgtgttcagcaatttaatccgaatagcgaagaagacttttcttccacgctaatgaactggagcgaggtaacggattgaccttgcaacgcaaggagatgagattgactgttgcttccgttaggcgtatctggaactcattgaaaagtctagcgaacagctgaggaatctgtaggttaacctgggtcgcagaagtgcgccaagcgaacggatttggtgctttagcaccgcaactgaacagctcggtcgccctcatgtaattgagactggcaccaccacttgtacttttggttgattgcagctgtgaaactgcccgaaccattcgaacacaatcaaggcttgagcagggttcctgttagaatgtggtgctgttgtgcagttgaattgctaagcattttgatcgttaagtacaacgtaaccctcgcgtcccgacgggctgattacccgagttactgggtgacttgagacctcgcagaaaattaaccatcctcgctacaatcgtgcgtgccccgtggtccgaaagatcctccaatgacttgcccttccccggtcagtcacttttcttgcgcgcttctgggaaaggatgacgaccagaacttgcggaggtacctcgtcggggggttggccgaggaaagtagaaaatatgacgttcattactgcgagcagtccatctttagtttttatacggagtcgacttcttgtccgcatgatgctgcggggttcatagtctcctttgcgaagatgcgttcagaagtcttagattctctgtggcaccccaaagtgtccgacgaatgcatgccccggcagacagtttgacagacacctcggcaccgaatagacaacttcggcgtcataacggttcaagcgccttcgtcagttctggttccgatgccttgcggatacttccaaatttggaaaaggactgctcgaatgaatgtacccattcttgcaggctttacgatttgtttagggcccgacggccgcccagtgttctcagccgatggtttgtgctcggaggagcagccacatggaaagcgagcggccttcgccgtccaagtgtgcagcaggcataacccacggtagaaatgccgctgtcgaaaaaaagtgacgccaggctcttacaattcgttttcactttccttttcgttcttttccagtaattgcttggaaatgtttgctggcctgctggagcgcttcgcatgactggagggtttgttcactgcggggttcgttagagtcgcctccggcggcggcttttttgtggggtcgccagcagtgggtgcgatatccgtctctagcaagagacacggcacagtaggacaacgatgttgcacgtcattgaaatattttgatcggagttcgtgtactgtttcttactgcgggaaattgattcgacaacggcgttgtcgccacttttgcgacaccagcgcctactcatttgtgaaa

SEQ ID NO: 1699 - DNA, 4910 bp, Toxoplasma gondii
gtgttgacgcggaaaggcttgggtggccatccttgtcgctttcatctccagtggggggtgcggatgccagcgtcatgccaccttcagttgccggcaccggcgacggcgccgactgaagagccgcgaggtcctccatgtccctctgggatgcttcttccttccgttcaccacggagctctctgtccacttcgtcgcagtcgccttcgttggacgtcgcatagtcgccttccctcacgacccgcgtttgtcgcgcctccggaccctcctgtgtcgggtgcatccgatcacttcctcgccgtcccctgggtatcgtgccatgggaagacgagcaggaagaaaagacgggggagggactggaggacggggaaggagacggaggggcagctgtcactgcaagcgcgagagcaaataagtcctctgtcgggtggaatgcgaggctggtcactcgaaacgagaggccctgatgtggagacgaagaaggcggacgacatacagacatccactgggcagggcgacgcttggagaagggcgcggcctcaggaggatcgagaatctcgagaggcaacgcatgcgtaaggagtggctcgtctcgcgtcgggactctgaagacattcgggtgtcgacagagatagtagaagtcctggccaaccattgtggcggaagtcggtgaggatggcgaggtggtcaggcgagaacagcagaaactccttttgaggaggcaaagaaaaggatgtcaggacaacgacaggatgggcagggagccaggcacccgggacgaaagcggaaagaggcatcgtctgcaaagaagaggcgtgctgagaaggaaagcacgagacaaaacagaaacggaggtcggcgaagaacgaagggccactcaagagaaggcaagggagaaggaggggagcggtggaagcaggtagagagaaatgaggggagagacagaagaaaaaaaaggtaatgtttgtcggttcggcgacagatgtcagcgaaacgagaggctttgacaagaaagtttcagaagatgcctcgtccgccgggtgctgatgtgacagcagcgctctcgcacatctcttgtgagcaaaaaggcctcgggagaccccctgctgttcttgcacaccgcggagaggaccggagggaagaaatgaggtgcagttccgtctttactttgggattttttgaagtttaagatgcggtcacgtagctctggcaggacatccaaagacaggaaaaagcggccgcgtcgtctgtttgaccgtgcgcggaaagtgaccagcccaagtgaccggctcgcctcgacatgccatcgcgggcacctgtacgcaaaaacgcggagagtcagccgagcgctgcttggcagcattctcactcagccgcgaggaatagtcccgcggtttctcggcggtttcagcattcgacttccaacatttttgcaccagcagacacgcagcctcaatcggcaagagtctccgataaacagagcggaagggaaaggcgagggccaagaacccgggtcccaggtggggcagggtgtcgggttgcgttctcacctgaatgaaaactccgcttttgtcggcattgtttagaacagacgggaaaggtcggaggtcgttaaatcgacgatgaagaagcgagacaaacagaagacgcggaagatggcaagaggaaggggcaactggcgagtctcatgtgagtcttgcgagacgccgaaactcgggcttcgtcaattcgtagggagccgcaggagaaatggttcccagaatgttacacgcgataaaccgaggttcaagcaggtgtagtggatgacgaaatatcgaacgtttctgcccctttccattcggcctctactccggaacccagcctgcccatatgataagctgcagtctgcagaacgtccgcgtggaaatgcgttccccgcggctaaggcgggggcaccggggaaaaccgttcgtgtctcggcaaaaatcaatgcagcgccgtgcgtaaatcttcgccattctacatctcgactttgacggtcactctgtcgagtacgcagggaggtgaatcagaagacaagaatctgcgtattttcctactagtgaggagcagcggagccggcaaggcgtggatctcggtttccctccggtgtcgttacgctcaaacaaacagccttgctaagcaggcgagcgaagttattcgccaactggtgtgaggctgggaatgcgttttcatttgttctgtgagaacgtcactccgcacgtaccagttcagatcaatctgcagccgctaatgtgaaaaaaagtatgcatattgttgcgattaccgctgtacatgaattcgtgtgtttgggtgcacatctacaatataccagtgatgcatatatgcgtgcgaaagttgcacgctagtagcatacacagtaagaggaaaagtacgtgagaagagctgagaatgtgacggtgaatccgcatgtgtgaattcgatagggcaccacggtcagcaccgccttttgaagcacgttgtgtcgagagactagtcatgcggagcagccaattggacggcgaggggatgagtccctttgcaacatcgcaggtcttccttaacgtacatcagactcgctgagggacgctgaaccgattactcccttacgctgacggtgcaccgatccgatcaggcagtggcaacgcttcaacatgactaaaaaggagtaagtttctctggaagaacgaagaagccctacaaagtattcgacgaagatcctgtgggtcttcatttacgcagactactatgtgtgtctcattagagaaacgcgtggagtgagtcacctgcgcatgtgtctgggtttatgtgtaattctaacaggaggcattgcgcatgggcatggctggcggccactttgtggaagactcccatgcagatccacttgtaaccgggtgtcctatgtgtttcttcgtgaatgtttagtctgcacaccgtccaacaggaactggcgtccggaagagggagaaaccaacagaagggccggaggcagaagccgtcagccagtgccgacgcgagtgagaggtgcctctaccgccccagactttcctttctgagatccttttcgttcatccggattcatcggttccgccgcaccgtaggttcctcgtgaaccagttctggagatttttgtgtaagcgaaaatgatttctgccgtgtagaccaaggaatgataggcaaggttccccgttttcaatgggtggttggcaacgcaaagtgtccacaaattcgctgacgcatcttgagatttcccatgttctcgttgccagcaaggtcacccagttcggtttgttttctgtttgttccttgttaaatatacatcggctgcacaatcaccctctccgtatgcaaagtcatggaagtcaagtgcgtcaacaagtcagagaaacgggtcttctgcgcgtctgtgtggctatgctttccacctttggccctaggatgttgaaattgaactctcgcatctatcttaggagttcagtgccgtgacggtgtgcagcagtcatacagcacgtggttatctgtatctcataactggactcatactcagtatccttggcactatattgtctgtttttttcgatctgagacgaacgattatggatcgggctcgatcagtcggaggctcctcctgcttctctatctttctcgataccacacagaaaaacggacagccgatgaacaaccgtagaaagtagcatctggtctacgtacttccccgcgtaactgccagatctgttaagtagccagagcgacaggaagagcaaaaacgtgctactgagagccggggcggggctctgcgtagagtgcctccggaatcccctatcagagccacaggttgtaggagttgcaacacacctccgaagattaaaaaagggaaattcgaaagaggaagggtctggcgttcgttctccgacggactgtggtgcgacttcgcgtcttgcaggtcttgtcgagacgaggaatccgcgtcgcatgatctttcgcgcccgagtttcctccgcgcacgcgccgcactccgacaagcggagggaggttgtgaggccgagaggcggcaaggcccacagcagcgcggtggagagcggagactctcgtgagatgtagtcagccgtactcgaagtctgtgcgccagcgttttgcggaggtgtgttttgtgagtctctgggttttccagactttcccgtgcacgtgctttgctttgggacgtaactcggggccggagccgctctctcctgcactatattcgcgctctgcgtcgcccgattttcctcccttttgtctcagaggtgctctcaggagtggcgcgcagttcggctgcttttcggccgctctccgttggggctttttgcccctcttttttgccaggctggatccgtctgtcttgtctcctctggcaggctcgtctcgttgccacgactccccgtgtgcgcgcggtccaacttcgccgaccgagtcgcgagatgtcggctctcgctttagctcccgactgacttttcccccgttttcccttccttcgtttccgctctacctttgtccgcgcctctttcttccctgtctcctcttttctctcccgcactcgactgtttgactggcgggcggggtcgaaagtccgcgaaagtttttttctgcccaattttgaggcccgcgaacgacgacgcacttctcgaaaacgccgcccgttcctctggcccaactcgcagccctcgaagtctttgctgcgctcctggcgtcgcacgcactgctaggaccagtagcttccttctccctctcgtccttctacgagcgggactgctgcggtagatctggaaagcctgtgaccactccgccccgcggtccgttccggagtcgacgcacctggatctcgccgcgttggccgtttcccctctcctcagagacca

SEQ ID NO: 1700 - DNA, 3529 bp, Toxoplasma gondii
gacaacagacgacttaaagtgacactctcatatatggaggtgtatgcacgtcccgcgggtctcccgcaagtcggcaagaaacgacaatgtccctaaacaaagcactatcactccagataggatacaggcacccaacgaagagtcatgtccatctaaaaaaaagattgcgctccatgaatgtgtcttgagagatgtagaaatccacgtggagaagccgaattagagcatggggcttgcagaagctcgtgtttctcagatgactgtgaacgtgaagaggcgagctgcgaatcgagtgcacgagttcctcctgagagtgaagcctgcgtggtaccatttgcgataccggctcagagtcttctctggatgcgcgtcgtctggagctgcgtttgaaattcagtttgtctccacagttcgcgcgtcctgggcgaagctctcgactccccggcgaatgctgcgaaggaacgccgagagacacgaggagggaggcgccgtcgaagtcactctcggacagcgaagcaagggagtcgacgccgacgacactgccctgtcgacttctgacgagtgacgagacgctgcagccatttccttgcccgaagaaggaaggtccccgatctcctggcggaaccgtcgatccttcgaatgacgtggtgagctggaccagcggatggcattcgttcgcgccctccgtcgctctgccttcttctcccctccgacttgaaggcgagtctctgaactctctctcgccttcgccatctgccctgcgctttgaagagactccagcgaggcgaatcgcctcatctcgactcttagcatcaggcggcgcggccgccgcgagggtcagaggagactctcttgaacggacgacgaactctggctgacgagacgaggaagaagaagaggaagaagaggaagaagaggacgaagaggaagaagaggaagaagcggaagaagaggaagatggctttgcgaagtagtctgaggacattcgttgtgtctgttgatttacatcaggaggtgcgtacatgctggcgagtcctccttccgtggaagccgatacgagagagacatcccgtcggtcgtggttgtcgcgcaggactggggggcctcctgtttcgtctgtccacgcgaatttggaggcttccttcgcccagagaggaggaagggcaagacaggctgcatctggggatcctggctcttccgccgcagagcgagaagaacgtggaaaccggacatctaagagagttgcggcaacgacgacccccccttgcttccgacgcaggtgaagagccgcgaggcccgcgcatgcagcgttaaacagccagacgacagcgagaggaaacagcagagcaaagggtgcacaggagcagaagagagcgacgcagagaggaagcagcgaagaaggaggcgaggagacagagacggcgtctgcggaggtgagttgccccgcgtcgtcagcctggtcgagaagaaagagaggaaagacagaaggctggagggaggcgccgagaaggaagatgtagcacccggtggacacacagcagagcgcagcttgacggaaggaggccgctgcaggtgtggacgagtgagaaggcgagccgcgcagagagggagagaagaaggccgaggggagagacagcgccggctgcgacgcaaaggaagagacgcgccgcagaacagaggcgaaggagttcgtagggagaccgaaaacgcggtcgcaggagtcgacaggaaacggaccggaggaagactcttcctggacgggagacaggccgttcaaggggagaacagagcggtcgacagcgggggtcgacggcagtgccatagtgacagagggaagcaagaaacaccgggcgggagggggaggacgcagccgtattgacgcaaaagacgcggaatgaggacaacggcgtagcaaatcagcaacggactacaggggagagaggagaaattgccgagaaacgactccgaagtgacgaggtccaggagaaaggagggagagcaggaggaacgagaagtccgacgattccgccagaacgaatgggagggacatcagatctggactgtcgcgttcgttgagcaggaactctctttctggctggtgaacgtacatctcggttccagcgtcacgcgctcgccagaccttcgggaagcgtcggtcgcgttttccatctttttcctccccgcttttgcgtgataaaatgtagcgaatgtgaagacggcttctaacaaattgcgaaaaaaagtttcgaacggcaccgcgttgccacagcatcgcattgcacctgcagaagcagtcgtgtgtctccccccttctttggggatctctcgcgctttctcgcgtgtatccgatcgaaactgtcctaccattcaatctctaaagtgaagaaacaggaagacaataccgcgacaaatgtctaaacaataccgtccactcttcagcaaacagtccgtcgaaaaagaacgacgccgcctagcgacgccacaatgttggaagtgtgtctccctgtggttccacggttttcttcctcagttgcagccagaggcagaagcaagtcctcgctgcagagtgctcaggtcgactggttttggtgtgacccgcgttttgatgtttgtcgaagctatctgcgttttactttcctgcgtgtgtatgacttttcagagagacattccccaggtcattttcaagtttcctcgtcgcattccgcgcgccgcctctctccgcagcagctgctgctttgttctttcgcagttctttttcgcgcagtggctccctctcgacttctccacgcctcgggattgcgcgacttcgacttgcagctgaaaatactgctccacgcggcgtctctctcgcctgtccaccccgatgcatttcagctgcgcctaaacttcgcctcggaggctcgcgaacaggactcgtttcgcgagagaagacaggaagtcaccgcccgccgccggctttttctgggaggggcgacgacgactcgcgggaactcgcacggggaagaattgtcgaaaaggttcagctgtaccctgagttgcaagagaaggcgacgtggaagcaaggcggaggaggttggtgtgtcgactgcctggcgaaagaaaaggttccacggtgggtgtgcagagacctgagacagagagagaggggcgtcagaatcgcttcaaggtcaagcgcttcatcgatgcatgcacggcgaactcgcgacgccagccgtcgtcccgttccacgagttctcgtcgctttgcagggcagggaggccgaggggagagagtggctagctgtgcggttacgtactcttgcatggttggcgcgcgcgtcgatgcttgaatcggggtgcagcgcgcaaaagaaggaacttcttcatttttcgcggagaagaggaagattcaggatctttgcggcagcgaggaaggcggaaggacggctcagattccgtggaccgcgagaacgacagtcgtcttccgttccgaagtggagagaggcacacgcaggggagagcagcctgccaagttcccctccacaagtcga

SEQ ID NO: 1701 - DNA, 3354 bp, Toxoplasma gondii
gagaaggaaaagcagaggaagtcggtgtcagtgtagacaaggcgaaggcgggggaacgagagagagacgaggaacgtgagagagtagacgaagaaaggcagaaagcatctttagacggacgggaggagaggagaactcgacgctcagggattctgtgtcgacggccgtggaaagagtaaagaaaggacgaagaagcaaagaccgacggagacagaaacgaaagcaaataggaaggtacttcagatgaagaagatgaaagggaagcagaagaaaacgaaagcgaagaagacgaccgcgacgacaaagacgacgacgacggcgaagaggatgaaagggccgataaggaagacgaaagagaagataaagaagacgagaaagaaagtgaaggtagtgagagagaagaggcagagaaggaaaatcccgaagactcaacctgcgaaagaggaggaaacatgtaagagcgatgaccccaaggaacgcaggaggaggcggtcactggggtctgcaacaggagacgagaaaagaggagaaagagaagagcaagaaaggagacaccctggaagacgaaacctcgtcggtgaattaggccagaaacgcacatcttcctcgcctacgaaagagaaatcaagatccatcttcacacatctttgaccttctgcctgaagacaagagggcatgcatcctttcttccctttgctgtctctccagctttgacagaagaggagagagtgcgtccaaagcttcgggggggatcctgaattcttctttttcctcacatacattcctcggcagacaagcagacgcgagaaacaagtctgcgctgacaagagaaacagcgcgacctgaggcgaactgcatgcgaaaacctagctgcagggtcactcctttttttctgggcgaaagagcgaacgaggaagggaatttcttgttcgggggaaagaattaaaaaaacctgagggagggacttcaaggaaaacaaaagaaacggaggaggagagtcgctctgaagtccggatcccttcacggaaaccgcgattcactcaccgcatgcactcaaccgttcgaccgctgtgatgtcttctgagaactcgagtagtaccacggttgcgcagagagtgtctccggtaatgcattcacagcgcgttttcttcattcgcttcgcaacgagaataacaacagcttggatgtttgtctctctgccgcggaaaagacagccttccatgtctggaaattgttcgtttcctgttgaggtttacgtcaggctcggaaactcgacttgcagagtggaaggagaaattccactttcctacgtgtgacacagcacatccaaagcggacattaagaacacactgattgattgtaacgggtcaatccgcgaacgaaagacaaccgacgaggaacaagctgacacccatccgtacctcccaggtggatggccttatatttacaccgcaaagcatgctggaaactgccattaacgttcggtgcaaagaggtcgccgcgatgtcgaggaccagctggagcccgacacacggttcctggtcgtagatgcgggataaactaaggcatgcgtaaacgcggtagaaacagggtgacatcccgactctggtaggatggagttgcttctatcagagtcccgtcgtttttcgaatctacgaaaaagctttaaaatgcgacgctgttggacggcttgaaacaggcaagagctcggggtctcaagacctccgcctctacggtgctgttgctcgtccaggtatttcacagctgcgccaggtcgtcagagacaattcgacgcatgtatctcgtaaagcctgacggcagggaagaacctgcggaagcgcagatcgcatgatttcagcttgccgcttccatttctgtcctgttcgagtgtcaggagtgaacggcgtcgacaaagcgccacgagaaagcgagcaagacaccccgagttgaaccaagtccgcaaaactgccttcaggaaggcgagttgcccgtgtgttctaaagggagtccagtgtggcgacccggtcactactctgccgaggccatttcgctttttgaatcctgagttgtgaagcgctgtccatttggctgcggacgccggcacattcttcggtggttcttgctttctgaaaagaaagagaaagcgaatgctcgctggcctagttaccgagtcacgcacagggcagtgtgtgtcgctattgagttttttttcctcaacgcatgatggcgtttggagcaggtacgcacgcactagctcgacatgcatgtgtcagaggtcttgagacgctctccagctgaatcagtgaaactcgtcttgaatgggtcttgtcggaaaagacggccaaaacacaggcggcgcaactgccgcctctgtgtgcaagcaagggaggcgccactgttggaggaacgaaaggcactctgttcctggcgaggaaggaaaggaattcgttggaaaaagaaaaagttcatcaccttgcctcacgctgaacgagtgctctcagtacgatgggactgaccgtagtcgtatctgaagagtcgtttgtttttctcgccgtttgcaacagtggcgacaggcaggagattccaaagcacaggtcgcgaccacgagctcagcattgaaaacaaggcagttcactgccgtgaaaatgttcgctgtcttgcacccttcacctgcacaaaacgccagcgtggaagcgcgaagttcgctgtcgcacacgctaaccttcactttggtttatgtgcccatgttcgtcagttgatggctactcaggaaaactgcttcttgtgtgtgaattggtgaaacctcttgtcgacgttaccctttgtttgcgtccactccaaaacactcggccaaagacaaagccccatgaggaactctcccgcttctgcgcgcgggacaggggaactttgagacggcgacgccaagcacgaggtaatgtgcacactgcccatagggcagctttccttcccattgaatacgtctagagttgccgaaaggtgaacagaagcagagaccctggaaagcatctcatcgtgttagcaaagcgcaattctctgcagggcttctacacaatgtttgcttctctacggtcaccgagacccccacccgcatatgtttgccgaatcgacaccatcgacacccgaaagcgtcttcgtttctcggttctcttcaacgagagtacgcggacttgagtcatggagaggctttctatcccgttgtttttgataaggagctggagaaacgcattgtgctgtcgacgctctcccaactccttccgtatctaggcgacatgtgaacacacaccgttcacgacgtccaccttttcgtgctctcgtctccgtttttcagctaga

SEQ ID NO: 1702 - DNA, 2317 bp, Toxoplasma gondii
ttgacaccatcgtcaagcttcattgaatcttcaaagcctttttcgctttcaagagtctgggtttgaactcaaatttgcctgcatgtgcatagaggtgtacatacacatgaaagactatctgttaggaacatgcttctcgcaacaaaagcatccacgtatacacagggagactcacctcttcaatgctgaacgccgcgtaccagacccggccgtcggcgtcaacctgcgtctccatttttgttcgtctttttccgcgtttttcccccaagagaaagtcagaagattccctctgcccttgtcctcgcttagacttctcgggtcttgaagacacacggatgccttgtgatcgcttctgtcacacttggatcccgttttctgtgcacgtccctctttcgttttcactttgtgagcggcgaagagagaaagaggaagacaccttcgccactcccgtagtccttctataagaagagaggtgtacaccgatcataaaaaacttggcaagttcgcctaattccagtcggacgcgcagttgacgaatcgaggagaatcccttcaatcattcaaagtctatcccgaaagccaacgtctagatgatacaccccagtctccatgaaacgccacctgctggccactgcattcttcggagattcctgccgcggctgcccagccagcggaggcgacgaacctcagaacaacaaacaatgggaactgaaaggaaaaagtgacaaaaataataagtggaagaacaggagacagggaggcaagcggatacgtggcgaatgtgtctgaagactgtcctgtttgctgtcactcaagaaatcgctcttcttcagtgagagcaagctcctcttcaccttttacgcttgtggtagcttgccgctaaggaaatagcacgagacaacggggcagtagacaagaaagacgagaaagcagacccgcaggcatccatctgctagtttttacatcagtgcgtgtctccgtgaagtccaaatgcaacgattccgcatgtacacattataattgtacatatatatgtgaatatgcatcagagcaagagaataatttgacggaggtgcacatatctgtggtgaaacggttcacagtcattctctcggcagaagggaaagccgaggaggaacattccctgttgggagacgccagcatctccacaattatcttgcacatctggacgacaaccgacgacctcccgtatatgcagctagagcatgcgtgtagaatgattaacaatggacacagcgacttgcctgttttcgatgagagagacagagagataaaaaaagatcatctctgagaaaaagcgataggtttttggaccacggcttcacgccgctttgcgtggcgggtaagcttggttttgcatgcacgcgaagcaacccatgacacagacgttttcagccggccgtgttcgcgggaagagacttgagcaaggactccgaaacctgtttgatgaatcacttcctgccacttcacaagctttcatgggtgtctcttgacgcgtcgagattgattgaggggactactccgagtgatacctcccgggaaagtgtcgattttccacgaatgctctcgcgctccatcgagtttctcgatcccgagtgccatgggcaccccggaggttctgcaccgcatgcatactgggaaggcttattttccgctttctcgatcttgcagttttcaggggaaacgagaacagagactccttggggtcagggtggttgtgtctgggtattttccgtctttcacggaccgtgcctccctggaagaggccttgtaagaagcctcctaaccgcgaacccgttgctgggcttctgccaccaacctttttcctgattccatttctggtttacagcgttgctttttgctcacgtttcaaccattttccgtgcacctttgaagcggttcattccccaactcccccatctggctgtgcccgttttcatggatcagaaaccgtttgaaccgtacaggtcctcgagtttttgccgtgacactccaggcataccctgaccttatcggtggcaaacccgttaacggttctcgcagaatcgcacatttgcgggttcctcgtgttcactcgaagggcctctagtgtatgtacaactccttccatgccacatccggcggcggctgcccgaccaccccggcggttacgccacattttcttttccgcgctaccgtccgacaatcctaggctcggtcaaattcattcctccacctttccgacttctttcccgtttctcgcttttcgcttactttcccttggaattcgtgtttgagctttcgttcgtggaaaaaa

SEQ ID NO: 1703 - DNA, 3951 bp, Toxoplasma gondii
ttttttgatgcgttcgttggtgcaggataacgaagtaactgcttgttgcttgctccctgtcaggaatgcatccaccagggaactttgattttttcggcgccccctggatcaggcgtgcatatctagtggagtcaatgatagaatatggcgtggaactcaaaatggatttcagtctaagcgtgaggcggcagcagatgtacgaacgcacaacaaacgagctgttgtctccaaaggcattcgtctgaatcggcataataaggtggtacatcactactaacttttctccgctgcacaaccctgacccattggcagatcgtttctgttggtagacaagaattttgcagacattttcataccctatcgactgtacctaaaccactgacgctctgtagacaagttatgcagtcactgaggatgcatgaatgcggcagcgcagctgtcatttaacctgaggaagcaccttttctttgtgaaatgcgagtttccgcagaacgctgtagatatctgctgcgacttcgaggccccttgcgcacattaccaattgtgaatttagcatttctgagagctagcccatcaattgtcaccgaccgctggtgtagcatgtgtgttgaaatagcacatgacgtcgaactgcttgagccccgagcaacgaagccgaaattggctttgctgcaacctgcgaattactgtccacaggccaccgtcagcctactgcagccagaaaagctgttgtgctgatctcatgttctagacagacttcgttgctgtacactgacaattgggtcgctcaactctccaaagaatgcactattccacataaggggcacttccacgaagtgacctggagggcaaagtgcattgcccgatgtgtgcagcggccacgaggcagagatgatagtttgtttgtacattgaggtgagtataccacgcctatgtcgtgcctggaatacaggaaacgccaagggatatcgaaagctgggacgaagtcatttgcttccgcgcctgtctccgcgatcccaaagttggcctgatgctctttccttatgctgctgtagacagggcgaatccattctttgagcgttgtcgcaaacttgccaaagtaccatcaatgcagatatacactagaatgcgagctccggctgtccaaataatgagatgaacgcgtcaggacacaaaaggcaatcgtgtttatacctgttttgtattggtagcaccagttatacatttgttgaagatgcttgtgaatcggagcagttcctgtctgttagttccaactttcggatcgtctttgagactctaacagaggacatctggtggctttcaaaaaggcagacatcccacagcacagacttaggtactgacagggaaacgtgggtgtgagagcacacaaacgagtgatgccgttgccgtttttttagcgctcttgtgttcccaacggagctttgcgctttagtacccgaatttaattcgactacaatgatggctcaaaacgtttgtaggtggcacaccgaacaaggccgaaccgtccgtttcgtcttttgcgaattccagtatggtgcctcactcttcttgtagccaaaaactcgtccctttttttcttgttggtgttcgttgcgcatccattccacgacaagttgctgccctcacttctgcagaggcctcccgaaccggctcgccctccaaaaaaactgaacccttggattcagagaagagtgaccaggtcgtgttttggaaatttgcacatatgtttaatggagacgaatatgagtactggaatttgcctttccggctaggacagccccctttacctcctcgctctctttaaaagtcacctgaagctgtagtgcccgcctcaggcgggcagtgacctgcgtgcccatgagcgagcccgagcaattcgcactaaaagctggtggcgatttgaggccagcgcagatatcagagcgcttaagacccgcgagtccgtcatgtggcggacaaaacttgtagactccctgaaaacaagcagcgacatccacatgcgaggaatgcttgctgccttgtttctatgtaaaagagtgagtacaagcctgacacccacttagctttcccctgccctgcagacggctgtctcaaagattttccaaacaaacggcgcttcagatttctgcacatctatgtggatggtgtagaggcatgcatacgcgaatgggagtgtgtgtttgcaaggccaattttcgctgcaaatcaccccatttccgtcggtaaacgcccgccgcccccaccgcctcgatatccgttgccggtcagcctttcttttgggttggtgcctcgtcaccgcacgaggtcgaagacaacttcagatattggttttcctgttctttttttaaaacgagccggcttcgtcccgtgctctatggtccgtaaagttttgggttttcacgacagctgaacgcactgctgtctgccagagagcacgtttgtagcccgtcccggctacaggagcatagtcctagtgcgtttgccccatatgtaagtcatccgtgaccctttatgaatttttttcctcccagtcgatcggcaccgatgaggatcacccgattctttccgcctcctgcactccagtgtcggttcctcatgagcgcattttctgcaaatacggggtaagacctcacctccttcttgaagtatcgatccagggataaagttcgagaactcaagagacaacagcgtttggaggttccagtcgcggtcttcatgggtgactttccgagcttcttaggatttcgtgtcctcttcccctcatgttttcgtgaatgggatcccttttcccgcgcgaccccggtgaaccgactgccactgcgctcccttttcagcatcggaagcggcgtgggtacacacgtcgggtctcgtgtacgtttcgctttgtaacgcttgtctgtccacactttttgtggcaaaagaaatggcgcatatctgtgcacttgtgcagcgattatggccggtcgcgaccgcagctgctacgttggttcagagaagttgaagtgaccgtcgtcgatggcgatgcggttgcctgttgacactcattccttgcttagcaggcttccccctgtagtccagtcgcaaaatatataaatgtatacttttatgttgaggtatgcagacagtatgagaacagcaaaggcgacaaggttcgctgtgctggctctgataggggacttactcaagcttgttatgagacagcactctagagtcagaagggcaagcacacgctgcactgtttcctgtcattcgtcaaacaggtaggactgctggtgccatggtccttttcatctgtgcatcgaaaacctcgtttgatgacgaaccacgggctctcaccattcagggtccggggtccatgtaataacgcctacagacagtgaattgaggatggtgcgaagggggcagccacatgcccactatctctctggatgacgcgacgaaaactttttaaaagctgaattgagtgtatttttttcaagcgactgcaagtcagcagggagcagcgtgaacgggacttcggcgtccagcgccgaattttttttcagccgtttggaccccgtcgcgtcgttgagcttcggtcgacagagctctcgtcacgcccttttcctctctatctttcaatggatcggatcctccacgggtctctcgctgcctagtcttcttgactctgtggcgagttcattccctctggccctctttgaaaaagacgttggcatgtgtgtagcggggcgttggcctgtggcaggctgcgaaaatatcctcggatctaggtcgccgcaacgcgcccgccggttcctgtctgcgaggcccgcagcgaaggacgggcacctcgaaatcggctggcgacgaagcctcgtcctcgtccccttgctgccccttcgctcccgaggcgcggtgttggacaaatcgttgtggctttctcgttgacaa

SEQ ID NO: 1704 - DNA, 4204 bp, Toxoplasma gondii
ttcagtcaatggcgtggcctgattttgaggcgtggatgtcgaagaaactggcgtcctacaaccctgaggaggagttgatcaaatctttcaaggcttttgaccggtcgaacgacggcaccgtgtctgcggacgagctttctcaagttatgctcgctctcggcgagttgctttccgacgaagaagtcaaggccatgatcaaggaagccgacccgaacggcactggcaagatccagtacgccaactttgtcaagatgctgctgaaataaaagtgggtttgagtaagggagaagcgaaaagccgagacaaaaacgcgacgggaggcgagagctgctggaagcaaagaggggagaatgaggaaggaaagattagcgcacgcacacgcgacgtacgccgcaaggggagctggtgcgcagctgacgagggaaaattttcttcgcctttggggcgtttctctttttcgttttctagccgagttctctcgcatgtcgagtccatagccagtgcactgacatttctcaaggggaacgcgccaggctgcggatgtatctaggaagaacgcacgaaagtccgagaggttgtgaggccccaggtttttccgttcgagctccaggtttttaaaaaaggcgacacgcgcggatcgtgtgtgtcaggctcctttgctcccttaaaaacagaactaaacacgcagaaccgacctcgcgttttgttcagaggcgctttccattgagtacaagattaaaacggggcccagcttcgatggcggccgccgcagctccgcaacatcaccgaaagcgagtaacaggcgtttcccgttgccagcgaaaaacacgactcaccttcacatacgcagaaacctgtaccgccgtgtgcgcagccccattttccacatcggttctgttttacgcgtaataacatacagatgttgccacaagagcccgttgagacaactgtaccaaggaacttgacggaactaaggatacgccatgtgtgtgttttgcttcggtagtaaacacatgttcgcagaaactctaattatgtcccagaaaggcaagaaagcaatcggggattcgttgtcgagtgccccccttcgagttgattgccgcggcgcctcgtgggtggcaagaaatgaaagggtgacagatggcttttttgtgtgtgggctgataaaatttaagcgaacaacggaggaaaacaagcacgacatgcaggatgaacgtgtttgcagcacgaatatcgttgagctccgcttgatcggcgatcggtggcctagaaaaacctcaaacactacgccaaaagagggtgtcgattgttagattttgaagtgtcaagagggaggaacgaggcatcaactgtttcgagaatctgacacacattggaacagatgcggtacgagttgtgttcctcctaaggtggttcacagattcgaaggggttgatccgatttagcctccaatcctgcacgcttttacatcacggcaaatatgaatacatgcgtagctgaagcgcacgtgtgaattataattccttgtcgacctggcaggagacaagggatcgataccgacaggcgaacttcgcgaaagggtggacacctgcgcgcatgagcaatatccagttttgtgtttctgtgtgtctaacgacgaaatcgtcggcgcgcatgaccttcccagttgcttcttttcttccattgctagcgggacaagctctacaaatatcagggtattcacgttggtagtttgcttcccaattttagtctgttcgaaaaacatggacccggttcttgttggtctggcatcttctttcgcttttctgcacgagggacaaagggcgagcactgacgaacagagagagagaccggatgtccaccagagtggtctgagctgggctgtcacgttcagatcatcgtcggtttcctcctgtgctcgggtgttcctgtgaatctggccgtcgagtgcgttcacgccttccgaaaaccaggcacaaggcaacaaacgccggcgaaaaaacggagtgtacccgtagacgcatagcgtcatcattgtggctgtgctctcctgctttttgtaccatcgctatcccaaatattctacgtctgctaactacagatataagctgctgccagttgtccggctcgttttatacgacgaacccattcctgtctttgatttcttgaaagtcttctcgagatcccaactttccttttccgcgcataattaaggcatgcacgacacttagatagcacctgacgctcgcttccacgttacgcattataaactgggattccaagatttctataaactaccttcaacagaattcgtgtgtctgggccgtcgcgaccaccccgacggaattcgttgctccaacatttcctccactgcagtgtcattcgaccctctcgctgtcaccctcaaaggtaactcttgtctttacttctctgagagctccatcgccccgcacatctctcattcccccttagttgtacacatctaattaaaactgcgctcctcacgctagcggacacgctcagatggccgctccgattatcaacaaacttaaaatcatctccgtttccccgccgttgttcatctttccgtccctggagcgcccgaacgatcggaacgacgctgagtcatgacttccacgaaagacaatagaagcacagacacgctttctcgaacagagactggctctgccgaacccagagagaagttagagtcgcagagaagcacatacatgaatgcacggcagattgatagaggcagatttaggtcgagacacaatgatacgtagacatagcgatacagacggaaacagagatagaaaaaagtagatacaaatagacagaaacagaaatacagatagaatagcggcaaatgcagagatacagttacacgtagagattcggatgtagacagagagagagatatagatacagatgttgacatagatagagaagtacagatatagacaaacaccaaaataggaatattgatgaaaaggtgtagatgaaggtgtatagagatatagatacatagaaatacaggtgtgtttctgtcccgatgcctcgtccgctgctgcttacctcgactcgggttgccctgctcttacgtcaatatccacgtcataacttgcagttgcagagccatggttctaccgttaccccaagtttttgaaggacccattctccgcgcgcattctgcaccggtgcaagttctgttaggtcggtgaagatccggcttgtttgttctgtgatttgccggcctttgcatgtcgcgcgttcgctgcggacttctgccatgaccgtgccgctgcgaactcgacgtcggtgaggcatttttctcgcgtttgccttttcatttctgctttatggagatgcccgctaagaaatggaggagacatgaaggaattttactgcttttcttgtggcgatgtgcggttttcgtagttgcacaccgctctccgagcctagtcatttcgcggccggcagcgtttcacagcctacggggtctttcctgagaggaacagataactgtgtaggcgcccttctccctcgaagatgtttttaaggcatcctgagaatctcctgcttgatttctccaagcggcaattgaatttcgggcctccgaacacccgtgttcctaccgtcgcagtccgtgagctggcagactcaccgacctctgggtttccctgagaaattttcaagacgacagggccttcttttctctttctctgcttttcctgtctcgcgaggcgccatggagtgacgactacactggtcctttcattttttctttgtgtctgtgccttcttcgcgggcctttcttacgactctcaggcaaccgaggaaaatcagactcctctgccgagcttgccggccgcacattctctcacgtagctcttcatgctttcgtccgtttcctctgtctcttcctctatgcgtgaagctctttgctctgccggcctcggtttcacctccagtgcgtctctgctctcgcgctgaccctctgtcgccgtccgtctcaccactgaacgtcttttcgttcgtctggttcttcgtcttttttttgtcgccttcgtcgcccgtcgcttcctttctttttctttccttctgttcccttctgtcgcctccgttcctcgccgtttccgcgttcctgcgcactcgctctccctcccgcgcgggtccctcctcgaaaacgcacctcgcaaga

SEQ ID NO: 1705 - DNA, 4431 bp, Toxoplasma gondii
aagcaaatctaggcttcgaaacagttcggctgaactcggcacttccggcgccactttttcgagagtttgcggagtgccggaatgtcgattcccgaagtgaaggaaggagaaatgcagcgttgttcaaaaggttccctcagtcaggtcgtctccggcatcgataggagagagcagaatgcagtgattagaaagcgagagttcatcggccccgaaacgtcgccggggcttggttggcttcttcctaggtgcgatcttgggcacgaacgtgacaaagcttgcgttccgcaacatacttgagctgtccaggaacaggtgaaacgttcagtgcgatgcgatgcgtttttggggggacagtcgacgccggtgagtcacttttttgcgcgctgaagcgagaagtgttttttcccgctactcgtgtccaggtaggaatgtgttttttcttccttgccgtgtgccctgttcgcggacattggatcttctgcgtttacaaacggacacagtgactggcgaagataagccaggatatacccagttaatgatcttcgtttcttcgttttcgagcagctgcctttttccccacagctgtcaaactaggttgcggttgctcattttttgtttccactctgcccctccagtctgccgagaagagtcgttcagcgacggagcgaacccagagtgaaacacgcgaagggtccgaaacagtcgcggtggacgcaggacaagctacgccatcgctgacgattcagaggtttctgtatcgaggatttcacgagaccaacgcaacacttgactcacctgtatctaccgtagctaacgaggtagtcataaacacctcagaagtcgcaaaaagtccctgtgaagggacaaaaactgccgagggttagtcggggctcgatcgcttgtaaacgacgcaggaaagcttctacatcgtgtggactcaacctaaattccccggcaagcctgcatgcgatatcatgctcctagaagttcttggtcggcacaactcggataactctataaggaaaaatcgaaagttccaaccgatgtggcactaagcgttctgctggcaggagctaatctaccggagatggggaaccgcgcgtgattcgctttttgtgacaagtgttcttgtacacgagccgtatacagctgttgggttccaaactaaagagaatcaatggtaagatgctccacctaggccacgtaaaactcgaatatatgcatagaagcctgtctgcacaacagccgctgatatggcagactaactccagagtgcgtagagtcatagattctgcacctgcatataaacctaggagggccataactatcctcctggttcagcactttatgcgacgctgaagcgactctgtgtatcacagtgtctttgccccaagtggacgatctccacaaaagtggagagggaagaggacaaaagggcccacgagaaaagaagccaatgggagcagttcagggccccatggttttcgtaggatagtctgcctgcttcgttgaatccgaggcacacacagaaaagaaggcaaattctgcggttcgagacgcgtggcaggaaaagtgctgtgtctctttgaaaattgcggtgtatctccgaattcttttcagttatgtttgtgtgaaggaacagtctgtctagatcactgggtttatttgctttcagaaccgacagacaaagtgggaggtgacacatttgactggcacactggatgacttgaaatccttcagctgatgtctcggcattgccatttctacgcagcatctatacaaggtaccttcacaaacaagcaaaacagatagccaagagaaccgaggaacgagagaaacagaagagattgtagtagggaagacagcagtgccaaactcctgacctcgagtgcttctttctagcaaatgcaggtatctgaaaaaagttgcagtggggcatgtacaacaaaagaggcacgacagagtgacgcgtgctcccgataattcttttctcattcaatctagcttcccggctcgtggatggctcctgatacgctcagttttcttgtttttctcctaccactcctcacttgtgcggcaaccaatgtggggtagcctgcaggatctacgtgggtcactgattatgcctttagttaacgagatgcagacaatcaagttccttaaggttactgtacacgaccactccactggactgcttagagtagccagatgtgttggatttcaatatcctacgagatcaaggtgattccacatcggttatgttatgggtgtaatatatgaattactgttacggttcatgaaggagggattcgtttcatctctgctcacccactttgctggaatcagaaccggcactcacaccctgggatttcctcgggtagcttgctaacgatatctgtaggtagcttcgccttatgcggtgttccttagagtggtggcggttgcagaggagtgtcgtcaccacgatgtaagtgagcttacttgtgcgaacgagacgaacactgtgggaaaaaagtggttccagtcgcggaggcaaattccttggtgtcgttagatataaatagaagaaatagatacatatttgtagatatggatcgaaatagatagagagattcgtgtagcgtcaccaatccagctcgcagtcccagaagaaccggaaatggtcagatcacccgaggatccgtcgggatccaaggttcttgccagaagccgatgctgacgcctgaggctagtgcgttcattccttgctacaggttgcccatccaaggatcacagcgtgtgtgagacagcgcatgatcatgagttaattaggtgagacgacccggagcgtgcaagcggcgaattccagagaaaatgcgggaattctgtcaggaggagttggacaggagaagaccgggaatccgcacggaccctggaggagtcgtgaggtcgaagaatcgtcggaatcacgcatcgtgagtcgttttcttctttttttgtctgctgcagtgtaacacccgccatcctacttacgtgttactggttagggcacgcttgcaggtctttttagatgaatatgtgatcaaagttgactgttgcctccgtgcgttaatctcagattctgaatatccagttgagactttccagatgcaggcgcggatcgcagaacatgaaaaggtgaatccctgagagggcgtaagtgactccatggacacgcacttgactgactatttaggaagtgcggtgcagtcgcgagcttgaaaactaacgggtgttcaccgcgcaagacatgccagcgctgcacgttttaaactgccctggacatgttcaggaaggcgatgttaccttctcatacgtaccgcgtgccctggtatgtgcaggtacacggtggcaagcactagcgagtgtcggttgcgtcggatcatttttctccacgagcagacgaagagttgcgctgaaacatcgtgaaaatacgacaccgaaagagacggaaactcgtgcgtctttccagggtgtagacccttcgtattggtttaaacgctgtaagctgaaaatcacgacatgaggacaggaacccaccgacaaataccacttgccgtctcattcaccgaccaacctccctcgccaggagggttttttctcgtgcagtgcgctcgcgttgtcttgtaactgcatccctcgataaacatttcgtcttctcttttcgccaaggaaatctgtcgcgtccacttttttcatttcctcccgtttgctttccctgtctcgcggcatttttcactcccatattgtcatgtctgcgttgtgtagcaagcgacttgccggtccggcctccaagtcgccccgtcacccttttaggcgaggtgagctgtgcgcctgtttgctaattgtttttcttctggtctctaaaatctgagggaaaattccgctatctgaggtctccgctgcaacgcagaaccgccgcatttcctagtgctgccgctcacatgcactagcgatcgctgctgcttgcgtcctttctcgcatttcaccctaagccgctgctaactcccaaagtgaatcagtctgcacaactaccacaaatggtggttcttcctatcgacacggagtcctagaagaacggtctttgttgaaaaccacgcacgaggaagcgcctccgtgtgttgggggctagatcgtgtgtcaaccctggttttccccgtggctttcgcgggcatccaatatctctttctctgtcgtagcttctgtctaccctaccgctgttctttccacaccacgttttggccactggtcttcgcaagtcctgctgacggggacaagaagcgtgccttcttcgttcgtctcgccgatcctctcagtttgtggatccggtatgtctgggcacttggcttcctcctgctctccactacctcgtcccagttccgctctccttggttttcggggaaacaaggaaaa

SEQ ID NO: 1706 - DNA, 4858 bp, Toxoplasma gondii
tcagagtccacactccgcgattcgtggcgaataaatctcttcgtctctcgctgatttagcacgtcttggcgccgagccgccagcgcctcttcctgccgatacacacgcagtacgcgacggacgcacacgaaaaagcgtcaaggaactgttcgcatgcgcaaatgcatgcagttccgcgtcgacgacgcctcgggaagaagtatttcgatgcatattcacatgaatctacctagagaaacacatggagctgcgtgccgactactgagttcaaaacttgctgaatgtgtaggctcagcagcacgcaagccatatcggaacaccgagtcttcctctctctctggacctcagaatctgggcagaccgctatgttccccgtcatgttctgccagaatgtggagtaaacacaagcactacgtctctcggcctctctcgcgtccagagtctcttcttgcgtgaattattcaccatcacccgcgtcccggtcagcgaaggctccttacatcatatccgcgttgttcttgcttcgccatcttctcgtcgaggcgcacctgccacatggcgcgcgtcgcgtggatcttcgcagcaaccgcggcctgctcggactctgttattgctggggatcccccgggaggtcggctgctagtttctgccccgcctcgctgcagagtgggctgggacaaattcgccagttcatcactttcgggagcagagtgtgggaagggcggatctgccgcatttgtttctgaagagtcgggaaatacgggtggcttcccggtaccacctgcagagttccttgacggagacatcgtgtgcgccgagcacgagacggaacacgtcgaaagaaaagacagaaaacctcgtgagcagatacaagcggtctagaaacgaaaggaagacgctacagcagcagacgagatcggcggaggaaaacgtagacaagcccaagaaaagcaactgccagccggtcagttgtcgacgacggcacgaggtgtacgaacactcgacacggtacatcacgcaccgacggcgattcgtgagcgtttgacttgtgaaaacaagaagcgaaatacaacaagaaataacaaggggaaacacggagaaagagaagagaaattcgagagagagtgccttgtctaaaactgccttcaatcgccacgcagtctccggcacagtcgatgtctacggagtgctcatcgccgaaacgcactctgcctacgcggaagtgaattactgacgaagaggacaaacagaaagcaaatggacagcccgacaggagaacctaatccacgaaggagaggtagagaaatggcaccggtacggtaacttgacagccacgcatgcaagcgtcgccgccacggtggcaaagaactggctttttcccgtaagtcacatcaacgccgaaacgacgagcagtgtccggcagatttagacgagtgatctgaagaacgagtacgagagacaaaggtgataaaaaatgcagagaaggatggaaaacaaagtcatagaagaagccggaccactagtcgagtcgacagttgtccggccgcggtatagcggtctggaggcgggcgggacgacgcacaaaccagcccgttcggaggcgaagttcatggccaggaaaaggaaaacatagcgatagactttctatggaaaaagcgacaacaaacgaaactgaagaaacgaagcagtcacagaggaagagtcgcattgccaactcaaaatgtcggcgtacgcacgctgtcagccgatgccgcgcgcgcacccgtggcgctcctaactcgtttatcgaagcagtgtgcctacgcaaatgcgaagaaacggtacgcgcgttgggaatgaggttcgtcagctccgtttgaaggcactccaccgttttacccgaacagacgaatttcgtcacgtgacacggccctaaagttccgcgtccatctccaattcggttacgtgcggcacagcgcatacatgcgtacgttctgtcctacctagaccgctgtggtacgggtagagggacgggaaaattgaggcagcaatgcaaaccatttagatcgttctgctgttccccccctcgtgagtttgttcaggtgtttaccgcggcagacgtcgcctctcatgcacctgcatgccctgtattgatctataatgcggcggcattctagcggacacccgtggtagacggtgaaaggtcggaaactatcaggcggctctaattacgccggccacaaaattgtctcgtgattctcgcgagaagcgtcgacggacaaacaagacgaaacaataggggaaaggggcttctacaccaaatagagggtacggggtgtgtgggcgcgagtttcgccggcttctggtgtgcaccagcgacgaagtcctataggctccgagtctggagcgttacttagtgatgaggtgtcagaacgtagtcgagtcttctgggcgttctgtttacttttctgtcggtcgtgcacctcactctttcgcctccgatgcacagcgtcagagttactgttcgaattccccacgctatctctcgcctcggttgggtcaggctgtggaaacaaaacagtggctcgagttcccgcgtcgattcggtttctgttcgctacagcggcaacattcctgttctctttttttcaaagcacagaagttggatcggaaagggtaaagatccacgggccactgagtcctaagaatagagaaaagaacactggcgtgccaccggccgcaggcacacccatgcttccggatgatgtcgacaccgagacacaaggatcagagcgcgccttgacgagtagtaagtcagcgctgtcagtaagtttcttcgccatgggtcttctgtgtgtgtccgcagaggttttgtgcggttaaattgagccgtggcgtggatcgtaggtaagggtttctggatttttgaagacggaaagtgactcggcagctttgtcgttttagacaagtcacccgactccatgttccagtctccagcgcagtgaaacacgcgtggaacagtataaggtgcgcccctgttcacctgttgagctaaattcagccttttctggcggtgctctttgccgatacaactgtcgcgaagatggttctggaggctggcactcacacgctggcttcgcagcacagcgtgaggcacgcgacagggggtacaagtgccaagaggcaggagaacacaacaatctagaagaatgagctgagtggcaataagaagagaagtagagtgagagaccggacttgaaatagaaacagagaaacaaacagaggagagttatggaaccgaggttccccggtgtgcaactaccacagaggcgagggcttgcagagtgggagaggcgggccatgcgacagctgcgggcaggacgttttcctcggttttccggatattccgccggttcgccaacgagaagggcacaaataaaaccattgaatcccggttcttgcagttgtgtctatcagagcacgtcctttctaggccttctctagaaatttccggtatcttgtgcctgacagcctgacacggcaaccgtactcgcttgcgttccccgcagaggccgctgcgcacgagttccaccaagaaggatttcgtgttgccaggagccgtccttgtctggtgcgtcgcgtctgaagagttccccgcctcttcagcctctccgttcccttcggcatctggttccaattggagcatgactcatctcgtcgttttgccgaggagcaagcggtgtgctctcgtgaaaggccttcggagaacaatagcacgggacctcgagtgcaagtgtcgtccagctcctcggatcgccatgccccccttctccacgaacaagattcttttcgcgttggacatccgagagtcagttgctcgcgattcttcgggattaatccactttgcttgacagagttttttcgtgtctctcgccccaacgcaaatttccgcagctgccgtccgctcattccgagttctcccgcatctccaacttcatccgcgcatgttgagcttccaaacccgccgcattcttcgatttcttcgtcctccccctttcgttttttcgttgggcgtgccagtttgctctcggccttccctcgcctcgcgttttgggtcaacgtagggttgcacgtgcgtagccagtccaggggccccgctgtgcgtcagagtggcgcgtttttttcttctcggtctttttcccgtgggtgacgcttagctccctctgcattttcctgccctcttgtttcctgcagtgagagcgaaacttccggttttgtggcggtgaacgcagcaccgagtcggcagacgtctttccgttagctctaagcggaggccagatagcattctactccgtaatgctcgtcaatcttgtcggttctccactttctgtcgcgctgcttactactctgcctgcgtaaagcagacatcctttttcaccgaattgagttgcagactctcttctccggcgattcggttttccctcggcttgtagttctgcctacgaagttgtccgtctccgttggttcactggctgccgcagaaacgttgggttcctttgagggacagcttccctgttttttcttccgataaatccgccgttatcctcttcttccgccttcctgtggtactgtccgtccaaacttgtctctcgtgcattcttgctttctgggggtctctttcactgtttgcccagggaagaacaaagagtcaggggagctcgaccgcagacttgcttacgatttcgtcagctgcgctccccggctcgcgtctccgttgccggtctcctcgcccccgttttcttttttccactccttcagcccgaaggagctttctctctttctccagcctcgccgaaattcgcaaaaaaacaaagcgcca

SEQ ID NO: 1707 - DNA, 1982 bp, Toxoplasma gondii
ttgtgtggagaaaacagaagactgtgagatccactccgtcctcggtcctgcgggccaaggccgtggacaaacttcggggaggcaaggcttcgcgaaccgcagtccgacactgaaggagaagggcaggctctgcaaagagtcggccgcgtaccaccacacggagcagtcgtcctggagggaatcccgaaacgggaagccgtcggatacagccacgacaggttcagtggccgccgttgtactccttcagagcgctctcgcaacgacgctgatttcaaaggaaagagcgacggcacgctcatacgctccacgatcgtgtgacgagattcagaacaagcgagcgaaccatgtttgcgaggcccacagaagccgaaggcaaattgcctgctgtgttgtgctgtgtccggctgcccaacgataacgctcgcgacacccaggcggctaacggggacagaaacgcagagaaggaagcaggcagaggccacgaaggcgagggagctgcggcccatagcgcgagaaaagatcgaggaacctctgacggacagcgaagctgccagcgagcatcgcgttacccggacacacgcacaagcgcataacgatcttagctacaccaggtactgcaactgtcacattgtaagtagttgatgtctcgaaacaaataatcaacgatccaggactctataaggcaagtcaaacagagacattgtagcacgcaggatactgaacatgactccagttgccagatagagacaacaaggttctttacgactgctgtgtggtatagtctgagaactggaaagactgacagaacttgaacgagaaacagaaggaaacgcagcttgactccaaatagttctcaggcttctgagggaaggtctaaacgtttgtccacctctcgtcagagaagcgtacagaattgggagactgtgccaaagtccattgtctctggaattgggagacaacgcctgatgtggatggttcccgctcgacagcgcggagtattggcgcaacgcacagcagcagtctgcgtcaaattcacatacgagagaaatgggcgagacagggtgcacgcgggaggaaagaaacacggactgtgaacttaattccgccgataagagagccacatcgtttctggacaaccctccgggacaaccgtctcagagctgttcacagggcagcgagaagccatgaagctagcttcttgtcagcacacttttgtgtttatcacaacttgtctcggactcttcctctgtggtcctcaattcatattcccatccgggctctcttatacaagacatatcgagtgccgatctcagagcgcagcgcatgtcgtcacagtcgcatgctgttgtcaccaggtatctttgcgcagtgttaaccacgaaaaatgggaaagagtagttgtaaaagcagcttcaatcgttctgagaagtgaattttcgtgtttggttcgtcttgagaacctgcgcaggagtgtagtagccttcaacaagctgcggccgggcattctcgcgcatgcaaccctatgtaaagaaccagcagtgctttccgcatacataccgcgatcactggccatctacgcaattgtttctttgagttattgcgtccgcctttcgccgtggcggtttgttaatgacttgcgatccccatctagcaattggtggtcatgcctggatagcaactgtcttgcaaattgttgaccactgctcgtcgtgtgccgtcgttacaacaaacgttgctgcacgtgggttggattatcacaccagcccagcctcaatggtccgtctgcataaccttcacagaaggaatatcagacatttcaacacttgtgcttcgccgctagcgaaggagcctgcaacgaaaactcggtggcatagtgaacgggtttccttacgtacgtacgtttcggtttggagtctagtcggcgctttccgtcaccgggacgagaaccgggatcagagcagagcacgactccacgaaaaaga

SEQ ID NO: 1708 - DNA, 3448 bp, Toxoplasma gondii
gctctcctcaccagcctgtgttcacagatattataactgcatgcccgagtacatttgtacgaatctccgagtgcttttttgatagccacatgcattctcttgtacatatatatatatatatatatatatatatatatggttatatatatggttatatatatatatatatatatggttatatatatatggttatatatatatatacatgtatatatatatatatatatatggttctacatatatatacatatatacgtaaatacatatataattatacatctatataattgtgtatccgcctgtacgagagagattgtgaacacgggagagagtaggcgcgaccgtggcacagcagcagatgcgaagggggattttttttttgcgtagggctgtgtatggatttgtcaaaatgcacataaatccgtttctctccacgacgttagcatcgccgtcatgctctggaagcttgtggatatttagaaatctgaaaggaagcgaagcgcgcactgtacctgctctgtggggcaagcctcgagtgctgcacggcaaccgacagtcggaactcagaggcatgtttagcgagatgtcaattcaagatgcgaggatgttcctacgaaatctgtttcgaggcagcggccaggcccaccacagcgatggccttatatttgtgcaacttctctgcagacaccggttttcacatacgcgttttctgccgtgcgagaggactggaaaagaaccatcctctctggagaaaagcgaaaatcgagccgatgagtcgtggctggttttgatgcctttgaaaagcagaaaaaagcgccactccaggtcacggcaaccaactccccccatatgcgcgtaatcacaaggcagtgtttgcgcgttcttttcctctatcgacaaaaatgtcgacgcatgcactacaaacaactcacacgcacaagtccatatgcaagtacatatatatatatatatatatatgtttctataggcgaatcagaatgtaaataaccgtcggtatccttgtctctgtgggttgatatctgtgaccgacgccatttttgctatcgtttttgtctcgagatctcgtactgttttaagtttcgtttgagtgtctggggacgaaggtgattctccgcgatactgagaagcaggaaattctaaaaaccaggaaactctcacctttcatggcctcgctgatgaaaaattccacctcgagaggatccatgtccgcctggcggacgactgcctttgcgagcgacatgttttttcgtttctccgtatctgtgtccttccaccttttctcttttcagtcgccacgagaacgcagagaacgtctctcgttttatatgcttgtctaccgacgggtgcctcagtctcctcccctcgcttgcggtttagtgaaagaggaaacggaggatcgttgcggctgaagcatctaaagcgcgtcactcaaacctgcgacgttgggtttccatggagtctgtttggaggatgcctttgtcgacaaagattttttacgagacagacaggcaattgcttctgctggaggcgagaaacgtccgataacacaagagaactccgctctcaacactacacacgcaaaagccagagcaagactctcaatgaacgcacgctgagcggttctcggcggtcgataggccttggccaacaacgggaaaatacggatcaaaggacctccagaaaagaaacagaggtgacaaatggagggagaaacgacaggcaaccgtctacagaacagtcgaaacgattccacaacaggagaggacgagagctgatgcgtttcggagtcagcagggaagaaacaacagagtgaagagggaacaaaactcgacaagagtcagtgtggcaagccgacagtctctgcgtttcttgcatccgagcaaggagctgacagaaagggaacctagcatatgcagtgagactcgtctttgaagccgaacttcccaggaagagtgcagacaagaaacaaaggcactagatgcatttgttggctttctgaaaaatcgcgactgttgcagactttcttctcaagaacaaagtaactcgcaggaacgctggatcgtctcgaacgatgaaatcgagactccctcaactttgtgtcccagttactcgcgttcaagcgcggagaagatcttctcggctaaagagacagacagtttcgtgcaacctttttttcctacagtaaagagtctgttcttttgaaccacgtctctcagagcacgagaggaatgaacacacgcgtgcggcgaacaagttgcggcgcacatttccttctggactgcagacgcggctttttcacgaatcgcgattttttcctttgttctcggtgcagcgtcttgcgtgtcgaacaagacggcgaaaaagatgctcaggtgtttcctcctattcagcgcgtctcggcgctgaggttctgtgtttttcaggggcgactgcacaatcttcagtacggcgaggagagctgcgggtgttcgttagaaagtctgtcgtcctctggcctttcatcttacgctcgttgtcagacagattgtgggtttcgttcgtttgtcatgctacagaagatggggcgacagaacgtgcagagaattcgctgctttttctcttcgcaccaaagctccacaacaaaagaaggcagaggacccagcagacacgcgttaccgagtttcgctcgaagtgggtgacgacgaacggacagcgcgcatcaagcaaagacagacacaccgcagaaaagacggaaaggtctgtttgtttggccccacgggtgttgccactcggatttggtaatctgacgctgcatgcatctggtttggaagagagtctcgcgacttcgaggacagcccgataccggatcgaccggttaacagcaagagaagacatcgaaacagtttcgcggtgcaaaacaagctttctttcggctgttcagtgcccagtggaactcgaaggctgcacgcatctgtcttgtggggggacctgggaaaactttggactgatgcacaaaccagaaagtcgagggctctctggaatgggccagaccatctaggtggcacaaacgtatgacaagccgacgccgcgtgagtaccgcgttgtcacgatgctctgtcggtgttacgctgtgagtctgttgctctcgggtgattcacgttcagcgaactcgcaaggaagtctcgagaaagaagcacgttccccgagaagagaagcgacagagaaacacttggcagcctcgaagactgctgcgcgacagcgggacctcttcgcaaaaacctctttttccatgagaacctaaagcgtttttcgctcgacatttaaaagatccgtttcagtgcagcttcctctggcgttgactactgccggttctaaaacacagtcaggttgatcttcctctggacttgagtcgcaagaagcgagagcggttgtagcgttttgaagaaga

SEQ ID NO: 1709 - DNA, 2386 bp, Toxoplasma gondii
ttttcgaatgttacgtgatttagcgattttggcatattgatagtttccaacagttttgtattatgtgacattcctttgtacgccaaaatcgtcttggaaacatttgagcgttgtcaaagcgggaagcaaaattctttgctgtgtttgtatgctgtcaatgtttgtcaaagtggcaggagcttgcgggatgtacctgtgcttcctagtgagcctcgggggcgatgcctgagttcgtggctttccacggttgacccaactcgaaatgtgtagcaaacgattccttcgctggttcctcgtagcaacgtttttcaaaatggttttgatgagtgtaccccgtggtggcacactctcacgccactagctgctggcaaactcgatagtcttgcgtgatccaagtagatatgtggggtattgagacagcttccgattaagtgtaaggagtttgcgaaaaaggctagctcgtttttaactaatctcccgcttctaactcattttttacgttttgtaacgagggatagcagctaagagtggtgtactgccagcggccgtgccgtgtacagacaatggtcaggttggaatattgagtggtatttcgtggtaatcgaagttacgagccacactgaaagtggaccacttgcacggttactgacctgcaatatcagcaatttcttgttctttacttcttttgtccatcccaacacatccttttttcacggacagtacttgctcggttctgtctcttctttccatattttgccaatacacgaaactggaaaaccgcagttgccaccaactcctacgtataaaagcgtccctggttgagtggctgcccggataacaacagtagttcgcgtgagcgaatgcgtatttgagtggccgatattctagcctccactcaacatgccgtagaacgcgacgtgcaggggtctgtatgaggatacgaagctggttgttacctcttctcgcgtcgctttggctaggggctcccgggaagggggttagagagggacgaccccttacaaacgggcaagttgtcctcatgttgctagttccagcgaggcacgacgtaaaggctgcgtgtggtggtgtccggagacctagtacgagatatcgatctaaaaacagtgggatgcaggattatcaagcactcggcagaagtccttctgagggacaattcctgcaaattatgttggcgggaaatgaacagcacagtttggcacgctctgtgtgcttgcgttcccgaccagccgcctcgaagcagactgctcatgtacctccgcgactcgcttgatcactgcaggaataattgtaggtccatcatcgaccacattcggttctacccagccctgaggggcatacggattaagctgttcactctaattgagagtgtactgcaggcgttatccacttcatggtcgaagcaaaattaacacggagacaaactgctagttggtcagggagcggccaactgtaacccccccccccctctggcggccactcgaaattgactcccctaaatggcagggctctgaccagataatgcgctttttcgtgaaagccatcgacttgacatactttcttttctaacgaataaacagaatttcgccaaatacatttccgtcgttttagcgtgaggaaggggctcccagaagacaagccagagtaacgccgatcgatcgtgtggatcgaagggcgcttgcaaaactgtcgtcaacctgtggaaacgaccggtctgagaagtgttttacactaagattttccgggtttcttacgcagatttgtacctctctgcttcgaaggagactgaaaagagtggaacaagaatgccgctacccgtccgcagtgcagagtggtcgagccaatgctgtgtctgggacgctatccacccaaggctgcgcgcaactacccccttgaaaggctcagcgtcttcttatcgtgagctcagcatccccagttagcataggtctcaccgttaagctaaacttccttactattttttgctgttttaggcttacaaactgcaagccgtaggtgattcgagttttggggagtcttccccgcaaatcatgtcaacgcctgtgggtctggtacccccccctttccctcctctgcaagacatggctttcttggcgcttctacagcgttgccacgctttgctgtgcttcattcatgcgactacgtggtgaggagtttttatcatttccggactgtccagtctacttcatccagactttcccgttgttgctgtccagggagtaccacggccaggtgtctccctggcacagccactgtgcccgccttggtgatttcttttctcgttgttgtaccttgtgataccccactaccaaaacgcatctacttccacgaagactgacaaattttgcca

SEQ ID NO: 1710 - DNA, 4949 bp, Toxoplasma gondii
ctccgtagtagctaaaaaggcgaatgcgttgctgcctgaggttgtcttcggcaccggaagtgttccgactgtgagccgagcctcatctagggtggtctttggtctttataggactttaaaagagaaggcagttgtgtttgcaggtacttcgccaggtgcgtgggcgttgagagtctgtcaacaacgagctcagtgcttgtggggtgataagtcggtcactgctttggcgtttggatccgttaaacatacacgttcaagatggaaatcgccggtcgatcccatcctttcttggggttttgacaacctacctttgagaggctctcttaacaaaaacaggagaaaaattgaaaaagtaacctctgcggtatagatcgacggattcggcacagacacaagttacaccaaacatgtacaggagtgcgttggtatgtctgacgcggcgactgcatgcaggtggccatcaaattccaggaagtttctgactaacacagtagattcgagaaaccggtattttgtgtctgcgttctggacagagtgtgtgcgacacacacggtgtgcatgtgagtgacgttgcatggtgtgttttaaagtgctttaaatgtgacgaatacgcacgcatggaaaatttaagacgcaggctgtgcaggtatgttgaccgctcagaaaaactgggagaaacgcgctctccgaaaaaacattggatctgcttcttaatatattgtctacagcgcgcaaaatgcacggtgcagtctgcagagaaaggaagaaagaacggtctctcgtacagatcactggcgcgtctgcctgaaccgtacagtgcacatttcactgccaaagaggcgacggaagctccaagaaggcgtgacgggagcttcttggaagcaacataaagacaccatctgcactgagacaccacggacagggctggttctgcccgagagagcggcgcaggtggttgtgcctgtgaagagacagaaaagcaaccgaaaggaggaatgtcgaaatcctgtcgcatttatacacgcgggcgatttcattcgaacgccgagtacggggctcttgaaaaggcagagaatggtaacgtcctgctgtcagttaaaatagccctcaaacagaactcgggaaacgaggtgaaagtgcagcgctgaagtgattcgcgagattacgacgcagctttcagatccgctttgcttgttgcctgtttgttcttggtctttggtgacgagaaagaacgcgtgtggtcggtagcgctcatggagagaagcgacatcagtggaagatccgtttcaaatcgtatgcgcgaagcgtgtttggtgtttgccgccagcaggaacctgtgcttctcgacaagtgcagtctattcgcatatagccagaagaggagcatccgcagctgcgtcgccgttccagaactaccacgactagtgcagcctctcgtgcgtcttacaaagcagacttgcaagattcaaaagtctgcatcgcgttcgcttctgtctgtggcgacagcatttcgttaaccgaggagtgctttgcgttgggtctgggaggctgcgtccgccgtggtcagaagacacacgtgagactacaaaacaaagtgacttcatcctgggtcgagactgttcacaacgaaacgagggcagaggtgcagcaattcacagtttttgtctctcaacgtggaaccccgaaaaactacaaacatgtggcattttaaaaatctgccttcgccatcgttcttcccgtcaggttctcagcgcaaactcgcgtgctctgacgtgtttctcttgtctgggatacgaaacaccacacaacctcgagagttctcgtgcatctctcttcctagagaccgattgcccacctgctgtgaaactctgagacaacgcattccctcctgggagccgcagggtggaaaaatgcatttttttctccacccacgcgtctcctttcctcgccgatcccttttttgcagcctccacgagtgcacacacgtcacgccgcgagcgcatatatccgaggtgactgccctattcagcagttgttgtacaggtccgagcgtcggtttagtatttctcttccttcagaccgtcgcgaatgtagatgaggcggggcgcctcctcgccgtccttgtagtaagcgaagacaacgccggcttcgcagtctgcgctttcaccgaggaaaaactggaagtcgtcgaactggcctagaatcttcttcacgagagcctgggcgccgctcatgaacttgtccacgcggtccggatggttcttctccagatgacccttcacacgctgcatgtaacctttgatgtaggtgccgaactccttcttggaaaacggagtttcctgcagacggaaagcgtcgaccacatccaccacggtctcggacgtgctgtccacgccgccaccgtcttcctcgctgaaggaaaaggcaacctcaacagcaaaaaaaaacaggtcaaaacagagaacgaaatgcggcgacaaattgcatgcgcctaggaccctcagacgaacgaaacgacggctgggatacaggagggttctcaagactacgaacagaatggggtccagccaacagcggacggtaggtcgggaccttctttattttaatggcgggagtgtcgatttttctccttcagatcaacaagccacacagactccacgtccatcctgcaaaaaagttaagtgaacggactttcggaaaaagtctaggtcctgcaacgacggtccccgtttgtcctgtcgacctgagaaaggagagcgtgtctgccgagtatttgccggcgctgaagaacagattccgtcaacgcacattcgaagtttcgtgctgaaatgcacacagaaacgatctggttttttttcggtgaaatatgctcaagagagcctcctcacctattgtcagcaatgccgtagtcctcagcacccttgacgatacgcttggttgcaacctcgaacgcaactgaaacaacgcagcggatagagaaaaaacactttgctcgactaacctcaacgagccttacacccttttctcgcgaccaagaagctcgtccgctgtaaactaaacacggcacagaatcgacacgctcagagcggcggagaccacaacctccagcaaaatatcgtgtcgatggcaaatctctatttattccttctttttgggatttctagagaaacgcccaccaccctctttccccaaaaatgtacaatcttgaaataatcgctatgcacaacaatacgagagtcccctgtctcgcacccagtgggacattgaggtacaacattcgtttgcggatctgaaccttttagatggcgacttcacgggcgaaaaaaactcagtccaccaaagtaccctcacggagacgcatagaaagaaaaaccgcaactgagagtgaggggagaagcacgattgagaactgctgatcacggaagcgcggttcgacgcggcagaggcatcgttctgagaggaagtgaggctcgatgcgccgttttcctctgcctcttggtagctgataagtactctttccaggaaaatacaagctgacagtccatgccgcctcttttggaagcttttcaaagacattcgtgggtggaagggaagacgagacgtcggtgcattgccagcgcagtccgcactaccccaccgatgtgacagttggaacgcgtagatccggcgcagttttgccgaagaatcgttttgcacagcactgaaagtcatggagattgccgaatacatttcagggggtcgagatcgcagtcgcaatcgtcgatttgcgtccttgttgccgtccagaactcaccttccgagaggctggggtcgtccatagggggcaactccgcgtaggagtccgagcagagctcgtcaccagtgaaaacgtccttgtagaccttcattttgacagtgatggagacaaaagacggcgaaagaaagggaagaaacagagggagaaaagagcaggaaaaaacgagtggcgaatcgtggcaaccgaccgacaaccccccttttcctcgcagtgaatccgaacggactggggcaccaagtctctgtcgccaagtttccagaacgtgcggggtgggggctctcgatgttgttttttccaaggggttaaccccccgacttctacccccactctttgggaaaaggggggctaacgcagtcttcgaatcttgaggctgttgcaccgctgttcccgctcctttttttgtctctttgccccgcgaactttcgtcgactccgaacccctctgatatcgagagctaaatcaactggaaaacgactctcggtgagcagatgcaggcaaagacgagacgtagaagggcaggaatcgaggcgtatgtcttcacgcaagtcgtagagcggtgcgcgcggcaaatacacgaaaactcatccgtgttggtgagaaagagttccagcgcctgcagacacgcgcggcaaacaatacccggaggctgacgcgaccggggcaggttttccgtccgagaagggatttagacagacaacatctgccgattcgaaagtcgattttctaaacactgcatttgacagcccgcgaaaggacagaaggcagaagcactgacagtttgagttccagaggccgctgggtgttttcacagtgtgagcgcgcgcgcgcccaccgacatttgaggtccccatcccccagaatcggagttgcatgtatctcctgtctcttctgccgatttttgcctttcgcatctcctgcctaccacgtccacacttttagtttggccagacgactccagtcgaccttgaaaagagttccgagctggcgtctagaggcacgcttcccctcgcgatcacttctcgatcactgcctaccctgtctctctctttgtatcgttttttccccagcggtggcgcgtctccttggctctgccctcgcttccaccggctgtcagagtcgccatctgcgttttctttcgactcggcaaaacaaga

SEQ ID NO: 1711 - DNA, 2454 bp, Toxoplasma gondii
gtattccctagtggttggtgacttctcgtaaaccattctctcagtgcaggtgacagctctgcggtggaaagaagggcagccgtgtggcatcgtccacgtgtatgtcgaaggcagagtgtcgtgcatatgaaattgcagaatatgtatcagctccccacgtccagccacacacgtaacttcttccgacttctgttacgtccacataaaggcgcttgacacgctgtgtggaatcttttgagctgaatgaatttcaaatccactcacggacggacggaggaagctgtaccgtcgcttacaggcgtttctggcacgtttcctcacccccacgagacttcatcctcttggcgcgagagcggtgcgacctcaaagaaattactgagaagattgcgtatccgctacagaaccacagcgggggatcaggtgactgagtgatgatatatgaaatcggtcgaagctcgagcagacctcgaagtagccttgcctgtgcttgctgtctcccacctttgctgtgaacaccaaacattgttgagggcgcgtagcgcgttctccgcctctgaaagtgtgtcttctacactgtccaccgcactgttcttggtcatgacagatccgtcgaccttggaaacgcgcgggtgccattaccgcagtacaagcgattgagggaaactgttttcccactgtcgtcgataataacatgtctatgtagctcctgaccctttgcgtgttacctcccaacagaattcccagatcgttatcactcgtgtcggagtcgacgtcccctccctttggtacacggcaaagaattcctgttgaaaggtcaagcgaatcaaccacccatgtccccgttgagaaactatactattagacctgcggtgtaatataactaggagctcaagccatatccacgtaataaagcctctgaggtggcccagtcaacgaatatgttcctacgagtggggagccgcatgtaacaccatcgcccgagcacttttactactgcagtttcgcaggactttatcctcccacgcaagcgtcgaccgtatggaagcgaagtaaattgggagaaacgcttgcccggttcctcgcacaaagtacgactacctgcaaagcggcatgccaacagcctttgaatgggcattttttttctgaaaactccctctcctacggtatgcgcggagccacgccgctcaaactggtgacctcaggaaagatcaaccgcgagatgcgttttctggttggcactgcgaatccgtgtcagaagaaagtcactgcatgcagcaatgcgccaggtgatcgattgttctgcgctttgcgcagtcgcccaggtggctaagcgtggggcagaacacagttgtctaggtcgccctccccaccagcgcaccaggtgtgggctttccagggacgcttagcgactgaagcgggaagatactaggaagatccgtgaacggttgaagaggcgacgtggcccgcatgggcggtcgaatgggaattcctggggaaatccaagacgaacatcagagaaaatgatggagcgaaagtgttaggcccgtgattcgtttcttcctcaacccgtctctggcctttgtaagtgaagaaaaaagacgtggtccctctcttttcttcggcctggtgtaaaaatgtaacagcgagagcgtgtcggtagttcagccatgacgaaggagggatgggaaaaaggatggtcgtggccagtacggtgcgggattcgtcgaattcgcgtttttcttgtcgatatatatcctgctggagttgattctctcccacgggaaagggctgcggagcgatattcccttgccgccgcatatttttcttttcacgcgcccgccctctgcagtcgataccccaagcgacaatttgggttcagccctatggactcggtttcctctggtgccactttacatcgtgatacattttcttgttattctataagaaaagacaggcaggcgtagacgccgcattactgaatataaaacccaatactgcggtctctccgcaaagggggggaatgccgtaactgtggcactatctctagtggcaactccattggccatctgcggttgttccatgccgtctcctattgcgacgtctgcggtaaaacaggcgatgttctaaagataattgtcagggctggtgccgaagtttttacgtaccggggactaaaggtttttgtcatcttttggttgtgtggcagtgtgaactggggccactaggcgcaaaacagttccagtcttcccagggtagctcgcttccaaatcagtgcttcagtttttgtaagggcctccccccccccccaatgctgcatcctggtgtctcttcgcttttatgtcagtaaatggcaggttgacgtttgcgtgtggtgttgtgtagcaggctgcaccctaatcgccgtcatcgtttttctctttggacctgccgacttccttaccagtttctccaaga

SEQ ID NO: 1712 - DNA, 3297 bp, Toxoplasma gondii
catcagttttcggagcatcgaaggctgacggaaacgcaagcaatccgtttcagttcggcaaagtgcccggtggtagtatccttggggccggcaccgggtccctcttcggaaacggtggaacgaccagctcgactggaacgagtctcttcggagcctcattgggcgcaccggggagcggaggttcggggagtctgtttggcgctgcagccggagggactgcaactggaggatcagagtctcagaggccgggcgctgccccagtagtttcgtcaccgtttggttcccaaagcgcctcaggtggagggtcttccggaggtgcaagcgtgttcgggagtgctgttgcttcacgccctctcacctttggggcgactggcatcgggggaggcaatcaaacctctacaggtctaggagcggggtccgctgcaggaagcacgggtacgttcggtgcagctaccggggctggaggactgggacagagtggagaagatggcaattcactttttgggccacaaacaggcggtcccgtcattcgacgcccgcgactgactatcaagcgaacaaaaaaatgaagtggttttaagtgaaagactaatcgttgtttatcggggcaaaaaacgtgctgcgcgacaactgttgcgtcttctagtaccccgtctgctgtatcttttttatttcggttagtaccgatctctctctgttttatacatcgtttctgtttctacgcatatatttcttgagtccacctgagtatagtcactttgaacgctgtctactgagtgtcacgtatgtgggtttttgactcgccactccactttttgtcgtttcgtccctatgtgggagggggcaaacctagttgtagcgtcgaggaaaataatgccgcaaaacggacaggaaccaggtggctgccgtagccaagaagtcaggcgatactgattcacccaaggtaaatatcacctgtaagacaatgagggaacaaactggacaaagaagcttgccacagccgcaaaaggggggggcaccgaagcactctgtccatttctctgccttgttacagttcagtagatatgatgaagcctcatggtgagctttatcgctctgcactacatgcttcaaggtatcacggactctgagaaggaaacaaatgagttgccattagggctcacatacgtctacccagtcaagcgcgacacttttccgagatgagattgcaaggtatactgtaacggcaactgtgtgttacaaagcgagtccactgattttcttcaaggggtctaacatattcctttgttcaaagaagccgcaactttatctgggtccacaaagactacacttagttggcagtaggaacggctgaagcggtcgggagacggaccttttctgccgtataccctggagccagttgaaattaatcgagtagtgcatagttcggaggacaaacaagtaccgctgatggtatcctacgcaacgctcactcatataaagtcgtattaccagattcgctaagttccgtcgacatatggaagatgctttacactgtatacaacaagaaacgcatggactgatgggttgttactcgcacggccgtttgacgatcttggtaatacgttcagaagggtatggacctcgtgtcgttcagcggcaccatccgagtatatttccttcacagacttcattcgttgtctcaggaaacgactgctacaaaaaagtatcagtgtgtatcagaaaatacccgtccgacggagagcggagcccccgcagcgcagcaagacaaatgacatctctggtgttgcgcaacaaggcggactgtgttttttgcatcaccgcgaaattggatgtattccagcgaaggtgagcagccagatagagtttccggtttcgcattggcgtcggatcttaaaatacggcagtaatttagtgtcgtttgacctcgataatgatttggatgtcctgttgaacacctgcacagcgggcatgctcagcaaatcggctgatgcgtatgcttgcctgaatgtctgtactaatcataatgcagtagttacagcgggctgctacaaacgaagtctttttgagtagttgttgacgccagagtactcatactctctgacaagaccgagattccgcccacttggtttggacttaaccagtacaaaagcgacatagggtcgccacactgtgtatgtggcatcaatgaacatcctacggaaatgccgcaatcacagttgttaatccacgtcctggatagacgcagtcgaggcgaaaaaggctgaaaaaaagatctgccctccccagagggccaccctgccttgcaagagcgtgagggcgcacacactcactcggccggctcctgatgggccacagaaagggcagctcgagggggaatgcactttggcggcagttccgcgggaactccaggtagcaagtgactgttcttctgttgttttggcggactgttccccctgtaaggttctttggcgatctggttcgatagttaggggtccgcgatccgtatgttgtacttttcgattgaacaatcagacactagacgctacaggctcaaagctgtagcgagccatgcgttgcggtaccctcgcgcggtatcgcctatacgtcacccgaagcagcgtatcctttattgctttctcgagaacgcatcccaacttttttctgtagctcatctcgaggtgagaagcaaatctcgtttcttaggttcgaatttagctacagcgctcccggttgcgtaaccctcgttggcgagccaggggcccggagccgaggggtctgtgctgcacggttttgttgccttagttgtattcatcatcagagcgatccattctttctttgagtcactgggaatcctccgaacgcaacttatcaaacagtcctaagctcggtaggcagttgcctacaacacagtgagggatattctctgcatcgataaaggaccatccccgttgagttcgctctgcttctccattctacggaggcgttgctacgccccaggaaattgctaaccccatgtctggtttcagtctattgtcactttgcctctagttgagccctccttggcttcagtgcccttcggcttgacgggcaaggtgattcttctcttcatcgaggaaaatctcaaccaacccgacgtgtcaatttgcaacagttctgataccccaatcagctgtcaacaagggcgggtctagtctgacaacggagattcacatcagtggccaaaaggcaacctagatactcggttattttcgtcttctttttgattttgctgctcgctttctcacggtgtacgaa

SEQ ID NO: 1713 - DNA, 3556 bp, Toxoplasma gondii
cagagcgcggttgagaaccgtcgctgtgaatgtccagatatatttgtttcgcgtgcatgtttgctctgcaggtgtggggaatgatgcagaaaacatggcgaactgcgcgcagggaggaaactgtttccgcttctgtcgagactcggtttccgaggactttcgtgtgtacagagaaagcgtttttgcgtgcggaagccgcttggctgacctggctaaatagtcttttcttgactctgacaattttttgaggaaacgcgagaaaagatcgaccgatagaagcccccggcgtcggttttttctgcttcgttagcatctcctttcgccgcggctatctgtgagctcgcatatccaggcagcttctgaaccgcatgaactgcaaccgaaaacacaaactaggagtcgagttcaagagaacacttttcgaagaatgatactataaatttatatagaatatcctttttatttgttacaacaagacctattttaatggtaatgtatctgtttgcatagttacttctgaaaacaactcaaggaaacaaacttgatctttgttttataatattctccaataaacgtgcaaggtctaagtgaaaaagtcaacatcgtgtacacgcctcccccgtgcaaccaagacaccccactttaagtcaacgcacaacaagaacattttatgcacaaaattgctaccacagaatgcaaatcagtcttgtcgatctatcaaacaagcgatgtacaaccactcgcattttttgtttgctgtaggcggcatcgcctgttcacgtggagcgctctgcttcacggagattccgaagcggcctctgcgtggtttcctgggagattcttttgtatcggaaaatgcattttcttcttaggctcctacgtcgagttttatttccagaaagacaggatcatcattaaccctagctttcgaacgtttcaaaccaatgtcttttattttgaaaacggtcgtacctacttcaggctgagcatgagcagaaacttgcttcctcaccacctcctttaccggcaacctttctgccggttcccatccttgctaaaacccttgtgagaaaggggcacgacaggatctggcatcgactgttatattcacttaagagttggtccaactctccacatgtggttgatctagaacttcacgaaatagaactgctttagaacatgagagtcaaggtcgcgcggccacatgcgtaagaacgaccaccacacacgcacaaacagcgcgctcgagttaacggaagaaaaacacctgaaatggaaacccagtggattccaccaagaacctcgaaactctcctcacacatccaactttcatcaatatcgctacaaggacccgaacagattttcgtatgccgccggcaaaacctgctaagcgggtgccaccagcatcgggattggctggtacagggttttctgctttcttgagcagtctagactcgtgagccgaagcatttttacatccgaccagccacattcatgcatcaactcttcctttgagagacgtccaccgctgtgtagaagtccctttgctacagtggacgactgagacgtttgctcaccagatctagtgccgtttggtttcgcagaacaagatgaaacgcttttccactatccagtgaaaaccgtgagctcgtcaggtgattcaaagccgcagagtcacttctcgagcttagtgtattgtaccctttttcaaacgccgacactctgttgtttcccgtcaaatttcatcgatgctcttccgagtctcctacatcggtgccggcgccagttttttgtcgttataggaaacgccattcagcgttggcgcggctgtgccgtggtgccttccacaggggaaatcgaatttttactccaaacgagagtagaaatttcaaccagctcgcactcgggtgagccgcgtggtcgctccgttgtaaggcgtcagtgtctgtgcagccggttgccgcctgagttcttgcacgaggcgagcgaactttcgtttctcgctgtctttctccgcgacttgtgatgtctacgaactaattcacgggacccgattccaaactgccactgcaataagagggaacaccgatttagagagtttctaaagtggagagcagagctgcagaggcgaccgagagcgggtcgcgattttagaggcacaaagtgaggggccatagacagtggtgtaggtgtagacgcaggtgacgaaagcactcttcgcgctctattcggagacagctgggtcaacagtgcgtgagaaacgagactcttttgtcaaccgtcacggcgaaggagtacgcgccaaagatgtgaaggagtgcgtttcagtttgagaacgaaagaaagagacctgacttctattgagtaggagagtgaggcccttcgtcgggggcgactccggcggtaacgcattccaagtagacagcaacagaacgctcctctgttgttcttcgaagcacatccgctttttcttcatcgctggctacctatgcctgtctccagttccaccatttcacttgacgcgcagtttcctgcttccgcgtttagccagttgctccctggcgaggaacgccgcgagctgcgcttcttggtccggtttcacaaagggcatttccgctttcttggtgacactttccgtcgttttctgcctgtcaaaaaagacacgctgttccgacccgcgtcctctaggcacccgtgcgagcaggcaacggcaacagaaggacgtgttagaattcgggcatttctggatccgcacgtactggtccctgaagccatttccatcggatgctcgcgtcctccgcgtcagatctccgtacttaactgccgttgacttcgaatttcacgccgtgacaatcggccgaagtgagccgaatcgacataacgcgctggcatttttcctttctgaccgtgattcttcttcacgggtagttcttcgcccctctgtggaagaggtgcgcaagtagccgagtcgaacatgccctcttcctagagttttactcgggtttgtgtcgtggaaaaacgcggcaacattcaagacgggccagccagacccggacagtttccgccgcatagaacctaggaacgcggtctctgtggtaaaataaaaatcggatactaacgcgaatcccacgtcttccctttttctcgttttgcaaggccccttttgtccacactttcgagaacggcgcttgcagaacacagtgcccgccccttcgttgaacttggccgttctgtgtgtcggcccattccggtgtcggtacacatgggaaaacgcaatccacacaaatttctgcgtcaaccgcttcgacacaagagtcgttgtactttttctgtatctttcgaccggaagagaaaattgtttcccgtttcgtctccgttttatatgcgttcgtgtaccccagccggcctgtctcttcatcgaccgactcatttttgtcgtccggcctctcagtgattgaaacccagccttgcgcccttcacactgcgttcgccagtggatcgaaggtgcacaccgcccgcatcgcttttctcgtggtcgtactttttccagacagaa

SEQ ID NO: 1714 - DNA, 1875 bp, Toxoplasma gondii
aatttctgtgacagcaacgctttcgacaattcttcggttgcgcacgaaatcaaacagccgcctcaccagctgctgtatgaggggtgggcaggcacgcgcacgatatggatttgctatagcgctttctattccacctcgaacacctcggtgtcaacatcagtgcagtagatgtgtagaaatgcaagtcaagttccatgttccggctttctaaagagcctcagtgacgctgtgttgtgacaaacgcatagaggtgctttcctaagcgtcctcaaccagtgtttcagtcgacacatgtcagtgtaacaacatacggaatggtacaaaacacgtctgggctaccacgggaggcagacggtgtgtcctctccacatgttttcctttcacagccgtcttgaacaatttgtgtattatcatcgaatccggacaggccacattagccagggggccgtgcgctcgttgaactggttggaacacttttctccatttacatggaacctcgctatgtacgctgcagccaaacaaggcgtagtattttttgtaaacagagacgaaacaaggaacaactggatccacgagactcgaccgtcggcgcacggtcatcttcttacgtttcacgtgtaaaataggacgcggcaatgtgtgccttcttaggaatactcgaatgcatctcgctgatcgaggtatatgaatgccgatgattcccgtttatcttaaatgtaaaaacatccttccatgtcaatcccttttcggcaccagtgtctcgctctcgcagcggctcgagtatggcgccgaagaaaatttcttcttttggcaccaggaagcagatatatcacttgtggtactctggtggcaatttcttcgtctcactcagtggaccttcgggtaaacgcacacgccccttgcacaccgtttgcacaggggtatcttctacactgtagagaaccctttcgccagatagagcgtccctcttccagaagcatctttgcacgaagcagatctattctgcagtgttgcgcggcaaacaacagagtagaactatgcctttccaaggtcacttgaacggtgagggacgtccactggagattccgctttgtttcttaaaatactgttctacgctcttcccattcggaggaactgtgctggtatggaacatggccggatatgtggaagacccatgctatctggtataagaaagattgagagcgaaattcgcggaaaatgcctttgctgtttcaatagttgtgctcccggccgactcgcgcatgcacaattttgcatgctgggtagttgttagcagcgcatgtctgctgcaaaaatatccatgagcgttctccggcagtagcaacccttggtctgcacgtttgttgctccctttccccgccatacagtggaattgtcttttcgaaggaaagctcgatctgtccccggcggaagctgtgccgtcaggtttgcgtttggaagcttcagtgattacggggataagttcttttttccagttcgtgaggtttcgccaaagatacaacattgccatgtttctctctccattcccgcagttgcgagtctgtttaacttcctaacgtctctctttcctgttggctcacgaaaaaatccctttgcatctctgaactgacccttgccctatattttttcccttcgtgcaccacactgtcagtaagcgcagtggtcctttccacgctcgacatagactgataacggtgccaagcttccacgttctgtaacaggaaacgtctgccgttgttctctgtattgtttcgaacccgcaccgcgatcatccgttgatgctgatgtaatcctctggaaaatatctttgttggcctcattaagatacccggctagtctctctgaaataaaaaa

SEQ ID NO: 1715 - DNA, 2030 bp, Toxoplasma gondii
gcagacggaagatccgatttttaggcagggaaaaagcgaaaagacgagaggaacaccagagacaagaggagaaaaagacgagaggaacagacggacgagattgtcacatagttcaggcgtagcagcagggtgaaaattgggctgctcgtttcagaagaggctcatgaatgacgcaggctaggacgagtgagagcagcgcgaggaacggcgccacagaggaaaggcaggagggagagacgcgaactgagagcgacgcggagtccaagaagcgaggaagaagacactgaaggaaagaacagaggtcgaccagaggtagatagacacaggaagagcagccaagtgtagcaagagaggaggaagagagaagaagagtcgaagagaagagggggaaatcagaatgtgaagtggatcggagacagatatcgctggccagaggagagagacgagtttcgaggaagtgtgtgaggctgcgacgccgccttatacgagaagaaagctgtgtgagcgacgtatccaagggtccttgcaagggaacgcaattctgttggattcgctgcatggagttccccaaaaaagcgaaatgttttgagagtttcaggagcctgaacttcttacgcgtgggcggctggttaaacgcttcttcagggatcgccgcgtctacggagcgagccagaggactaactccagctgtcgctgcggctggagctgcgctgaagaagccgcgagactggagagaagaagagaaggaagcgcgcaggcgcctctgagaaacgctcagggacgaggccccagaggcgacccgcggcaggaagcggaacatcatggagaagaaggggagagagatcagcaagtcgccggtggagacgagagaagacagaaagaaaccgagcaggagtgagagaagaaggaagagatcgggagaggaggcactctgggtagtttttattcgtttgtatggatgtccttgagtacccaagcagcgcgctagggtgaccgcatgcaccggctgcgagagcgacgggaggtgggagagggcagaaaaagaagagaggagaaggagagaaaagaagagaaatgtcggagacagacgaggagaaacgcacaagagcagagcctgttttccctagagagggaacgactctggattcgcacagcaggcgcgcagagccgcgtttgcggaggcggagtggaggtggaatcctcgagctcgcagcgcgttctcccggctgtcgttcgaaccaaaaaagaccaagtccgcgaaaagtaaaagttcgggccctctcctcgagccgaaactcgcccccccctgtcgccctctcccgggtgtacatacaccccagcgctcgcgcgccgcggatcccagcggctctgcgcgcttcgtacatacgccgcggacgcgcggctgagagacagagaaagttgcacgtcggctgcatgttcctccgcgtacgcggactgcgctcttttcctgctcgtcgcgtatcgctggaccggcttttcgtgaggatccggcgactgacgagtcggaaaaacgtcggcaaccagcagagagactgtccggatacgcatgtcttctccctggtgaggcgggagaagacttctctgggcgagagcgaagaaaagtcggccgccacgggagacgactcgccgccagtcgaaaaggctccggaaatcgcagctgcctcgtctgtctcgaggctgcgcaacttccgcgagtcgggaggcgctcgttttctttcgctggaccgcccgagcctgcaaagactcccccgttgcgaccgacagctctgcctgctcagcctggggacgcacggtttacgtccacctctcccttccgcagagacagagaggaagagaggaagaatcacgagacagaacgaagaagagctcgcgggacagaagtccgcaaggagagacgagagcgaacgagaaggaaaaaggacaacaagaaggagaaggaaatcaagaaggagaaggaaaacaagcaggacaaggacaacaagaagagaggagacatctggaggaagcca

SEQ ID NO: 1716 - DNA, 2360 bp, Toxoplasma gondii
ttttcagaaggaagcagacagcgttcgtctgcagttcgctcttcagccggaaagactttgtagggaggaaacggcgtcctcgccatcgaggctgcggcagcgtccttgtgcagcgaagagagactcggagacccgtgagccggcgcagaggagagacgcggagaagacagatgtcgagaagcagagaggccaccggaagaagagtgaacagacgacggatccgaggaacttctgtctccacgcctggagagagagacgtcgcaggcgaagggcgcaaacggactcgcgtcgtagaccgaaggagacagggaagagagggaagaagaggagacgagaggcgaggcaatcgaagggacgagagaagaggaaggagagaggcgagaaggggagaggtctgcgctctcggatgtctctacagcgcctctttttccgttcgagttgtttccttcctcagacacagaggaagacaccactcgcgagtcatctgcgtcggcctgcgcttcatccgcctcgtctccgtctgctttctctgtgttctcccctgagtctcggccgcgaagagaggacacaagaggagagcgcttctccgacctgttgctcgcgccctctctcgccagacctcgttctgtctcctctgctccagagtctctgttcctcgccgctcctttctcctccacctcgcccggggctcgacggcgtgccattcggcaagcgacagacgcaggcccgggaaccgagaggacagacagaagagagaagaagaaagaagaggagagacagaagagagaagaagagagagaagagagaagaagagagagaagaagagagagaagagaggagaggagagagaagagagaagagagaagaagagagagaagagagaagaagagagagaagagagaagaagagagagaagagaggagaggagagagaagagagaagagagaagaagagagagaagagaggagaggagagagaagagagaagagagaagagagaagaagagagagaagagagaagagagaagaagagagagaagagagaagagagaagaagagagaagagagcgaaaggagagacggacggccgaggagggatgacgttgcagactgaaggcgaggagaccgtgagaatgatgagacgcaaggatgtccagcgcataggataggaggaaagcgcgttcgaaacaaacgagaaacaaacgaggggcggtactcaaagaagaaaaagacagagaagaacttggtgacagcgccacggttctcaggagatcatggcatcacacggcgacctgtcgcagcgaaggtcgcgaagccagccgacagagactttttcacctttccgcgaggaaagaagaaacgccctgtccgtcgcctccggtcttcaactcactaatggaagccgcaaatctcttctctgcgttccaaagaagaatcgtcgcgaaagttccatctccgagtcgcagaggttgtctcggcatccaccaggcacaccactccctgatttgtctcgctcctgatcttgtctctctctcagcacagcgaaagagaactccggatctgcgcctcttttccccgagctctccgcaggacagaggtcatggagaagaaggaaactgcggatttcctgtttgcttttcggcatccgtcagcgaatctccctttcttccccgttctttttcgtacctttttcgcgtgtctggtggtctggcgcgcggaagaaccagcgcgtcgacccgacggcgttccgcatgcatctcttctcgcttgttctctcctctcttctcgtttcttctctgtcttccttctctctctcctctccttcttttctctcttttgccctgtcctgccgtctcttctcgtcgttctctctaagcttcttcggctcgcagggactcgctcaaatggccgcgctcccagagggtcgcggagagggtgcaaggccgtcgcggcgcgcggtgaccgcgacaccgcagctgtgtcgttctttcttttggaatttacgctcatctgcggcaagacgcgtcccatgagttcagcaacgcatcgccgaaaatcctctgcttcttcgcggcacgactgtcctcgtttttctgcctcctcatcctcctctcctgtgccgttccccttctagggcaagacagagcatccaggaaaagatctcctctcggccctgcagggaccaagaacttgtttcactgactccttctccctcctctcgactactcagcgtctctctgtacagacatccgtcatccttctcctcttctccgctctccagagctttacactttctctgagttttgtgcctctcttcccctcccgttctttctttctctgtatcaggcgaactgcagacga

SEQ ID NO: 1717 - DNA, 3342 bp, Toxoplasma gondii
gaacaagtgatcagttttctcgagagagaattcccagtgaagatgccggcctccggtggctgacaggggaagaaggacatgcaagaactgggggctgcacaggaatggcggattcttgtgggagaggcatgcacgagagaggaagttgtgaggaagctgggatggtgccgcgaggattttcgtgcctgtgggctctgtggaaacgcgggacaggtatgtggacgcggctagctgccgctgtcaggggacgaacggcggagaaggagtgtcagcaacttcaaagcgagattgctgcactcgaaaatttgtccagggaattgttcgtcggtttaaatgatttggtccagtctcgtgctcaggctatttttagcaagacattactcggacgacttaacaatttgatgggatggtgcatgacggtggtgtgtgtctaccggataatgacggctgccattaatgtgctgttcgaccgagtaagcacaacagatccggctaccagagtgttagagatcgcgctgtattacctaaacattcctcttaacgttgcggtcgtttctccgtacctgtctctgctcttactcggatggattatcgcgctgacaattcgagggttcattgagaaattgcttgctgtgtttcgctacgtctccacatcggtgtcgagcaatgtatttgccttggttatgtctgaaatcatgggtttctacttctcagcatgcgtcttactgactcgcgtgtacctgccccagtcgtatcgagatgcggtgactgagattattgctccatcccttgatttcagagtcttccaccttcactttgaccgcgtgtttctcctctcttcgttgacttctttgggaattgttatgctttctcataagcacactcttgaaaagttcaaaagtctttgatgcatgtgtgaaacacttgttttttaagcgatggttttggacgcggtgcgttccgccttgttctttactgtggggaggtgtctggcatcaactgcggcttgtggtgaccttttatcggatgtgtccatgccaaatggagaagatctatgttataaaagactgttgtcttcattcagcgaaaagacagtgacaggtaccaacggtgcaggcacaggttttgagaccgaaggtggcgactgcgatacctgtacacctattttgggcctcctcccctcaatcggtttattgatacatgtttaattgtatggattgctcagcacaatttctagttagagctgcgtgttgagaggttctggtagctctagcctagctttctttacggaggacattatccttccacttcttcagcagctgtgttgcacatccaaaaccagcggactatcgtttttcccctgcacgcatacagtccaacagcatgctggagactgcgcgtcactgaaaacctttaagctactcagtggtgggagtcctcaaactgcttttagctgctgagacggcgtggcgttccttgtgctggcgcagcccgcctacacacctcatcagaaaaggactttgtcctgcgtcacccacgacttgtggtgcacccctgcggtccaaccaactgcgctctgtgagaaaatggaaaatgtttctgaactgcgtagttcaggcagcactgcttcctcctaccaagatttgcattgcccgtacagagttgacataacagtgaacacctaaaagcttccaagcacgaacaattccgtcaagtaatttgatcactcatgcgcccgcttgtgcgaaatcgagtcaagtacttgtcgggaggcactacggatacacttggaataccgcacactggttgatccgatacagtaagcgcatatactcagctgttgagtgtgatagttgacgcagtgatatgaattatcgtcgagctgagggcacacgctaccctacctagctgtcagatgctgcacaacgactcagtatcacgtgtgtttaagcgctaaatgcctatcctggcttcctccaacatcccagaagggcctcacgaacgcctgaccctcacgattgttgcttgccacagtactgacacgaggtcggtgacagagaaggcaatttgcatatgcaacagacgttcggtacaccatataggaagcatggtgttgattccagtttatggagtcactaaaaagtaacgctggaagttcgcaccatctacattcttctcgcgcccggggtgtaactgtcacagacattagcgtgacaaatgtcgaatgatccgttggtggcagatagagacagctgctttccaagtggctgcaagtcgttttttgtgtgtcactcgcatacggacagcaatgttgacacaccactcctttctggtagttccagcttcttgtttcacactctttactctcgcagttcattgagagaagacctctcgccaagattgtgtgtcactctctatatgtaacatccattttgctcgaacatggcgtgtaagtagcttgttctccgaagcacttacggatttcccggacaccatcatcgtccacgcgcgtccaatttttgtctggttgtggattgcgtatacctggacgatggttaccaccgcggcagacaccttgcgtagtttcgctgaacaaaacacgctagatataaaaagttggctctacatgggcgaatcgcgatattctatactttttaatatacatgcacatatattgtggttctggatcagctactgctgccgttggttctggacttgaagtcgcaccggacctcgctgaagtcgacgtggacggcgtggccgggaaagatttttcttcgacactcggtctgtaactgtactagacgccgcattttccggagattttccctttttcacagggaatgggaacgtgcctcatctgcctgatgacatatttgtggcgcggaattgactttcttccgtatttcgtgtgcctacagtgccacgcggttgacacctccttacaacggcgcgcacgctgtgctttctgggtgcgaagccgtccggtttctgctgggacgttgcgccaggcagagcctgtattgtggtggagagtgacgcctccttactcggtccgcgttgaagccgctgcatgcgggtgagacgcctccctgcggtgaacttctgtcccctgcacgtacttcagtggttttctgcgcccttcgttaaagcgcaacgttggtcttcgctgggggggtcggattgcctggccggcgtcactttctctttctgtagcaggacgcttgcgaaaacgatggtggggatgtcctcgtctcttactactcaccagccagaatcgagggacgcaagcgaaaagcttggttgatggatctcaaggcaacgtgtttttctctgtgttta

SEQ ID NO: 1718 - DNA, 4992 bp, Toxoplasma gondii
ggactcaccttatcggctgcatgtccacgaggagttgctgctcgttgggaggaatgcgcgtctccgcttcgatgagcgccttcagcgcgtcgacggttgtccccgcgctgacttccagagaaaagacgacgcccgaatctgtcggagggagacacaatcgtcgaaatgtcaaagaacgactcatctccagtgcatacaaaaccacgcgcaggccgccacatacatacatacacatatatctatatctatctatctatctatatatatatatatatatagatttatgtatatttatgtatatatatatatataaatttatgtatatttatgtatatatatatatatatatataaatttatgtatatttatatatatgcatattcttagttggatgaagagatggccggagagtcaggagaagacagagatgcacgcactggcagacgcacaatttcgacaacctcaccaacgtgtagagctaaacagagaaagagagaagttgaagctgggggtgtcggcgttggagatatttctgtacaaagacgttgcggacgagagtatttgcatgtgtgtgggtgtcgtccgcggaagattagtttccttgagccgaagtcaacgcaaatgcgcaagagacagtgtgccgggcgaggagacatatcaacgtggatggggagaagccaggcgaagacacaggcagagtgtgtctcggaagaaaagagccgagacaagaggcgtaccgtcgtctgcaatggatatctgcatcttggagaacgccgcgacgaaatttctcaggccttcgcggaaaagaaaaggcgtcacggggacgaaggacgaacactgcgatggcagcagcctccgaagaacgggagagagacagacagaaaggttaggaccaggagaagagccgacgacgacgagacacgagagaaggtaagagcacaaacagagagatggaagagaaagagaagacaccagaaaggatgcagaaaagctgcgaggctgccggcgggcgggaggagggggggtcgagtgcccgtaataacaaaaagggatgtccttgtggagatgttgtgttatccggaagagacagaagccgtcgatgtgctttgagaaattgcagagaaatccaaaaaactagacggcccgtgtcttgctcagcagctgcctgtgcgtatacagatgtgcgaatatcttccttgagctgaggacttgtcaatctccaatctttggaaatctgtggagatgagaaggcgtctagaacacccatggacaacgaaggaaacgacagtggaagcctcgttcttttttccttccttgctctttctcgtggagttccaggaagagaaaccaagacacaaaggcgaaagaaggctcgcaagcgctttgctgagaacaacgcggaagttccagaagatcgcgagaaatggaaacgcagacgttgagaagagggtcctgcggaagaagccgagcgaaacaagtcttccaagaaacacgctgaaattcgaaaagagaaaaaccaagaccttggcacgagagaaacctttgtttcttgcgtctttgccatggcgtagcactgcaacgttgcgcgctttttcgcagccaaagcctcccgacggcattcttctcgtcttgtgttcgaagtactggcctctcaacaaacgcgctctctttcgttcctcgttttatcttttattctctttcctgtatcgtcagcgtcaccactctctactgcttcgttccgccctaaccctgcccagaccttctcctccggctgtcctgtaaacgtcttgtttcgactatttctccttctttctctttttctccttactctcttgtactttctgtctctctttgtgtctcatcgaactcctcttgctgtctgagacttccacgggcggctggtgcccctccacatcaggattgcacatcacctcaaataggacaggtgacacacacctgcacgcaactgtccgttatttttactcgcggcgacgggtggagtataatggagtgtgaaaatcggttctcctggaccgtgaggctgagggaaaggaaacatatcttttgtcctgccgtttcatgcgtttatcacagcgtttgcagatgcacgcagacatctgggcttcctgtcggtctgcgtttccacgccttttgtgttatcaaggaaggactggggatccagacgcggcgtctatgcggtggcgttgtttcagagaactgggagtctctgtatcggtgtgctggcgagcagttccctttgcgacataactctctccgaaccgacgccgcaactgcataggttctccagcgtcgttgataggcataggcagacagactcgttcgaacagacttgaatgaggaaggagactaccacagttaatataccaatgctttacagccttcttcacgcccacataaactccgagagcagcggcagcgtgagaggatgggagctgaccgatagactgcagcttacctgcagcggaagagagaccgaacctcctgaggcaaattaggatttggtttctcaacgaaaatgtccggtcaccgaccgcacctcgacggtgttggttgtttgcagccgtcacccccgctcggctttcgtatggaaagcagatgtcccggagaattggcaatgatttgcagcgaaaagaaatgcagagtgtgttcggaggtgaaagaagtggggaactggactgcggttcagtttttgcgaagctttatgactcggttcagtccatttgacttctgcagttctggatcgcatccatagattgcatctggaacatacgcgaaagaaccttagtttcgtcaagtatcgaaatccagaactttacagcagatcgagtgtcgaggaaccttctgtcggacgatattcatttccactactttttgctgccttcagcaatctacaaaaaaagttgtcgcccgtgctgaacgctcgcgctccgcctggcaactctgagttacatccgagaaacagtctgagagttggtgtgtgtctctgtgtgtaacgtaaagccatcctgctctacagtcctgttgtcttggttgtctacacacccctatgtacaactcttgtgttatctgccaaattctttcgcatcttgtgagctcaatgctccctcgccggaaagcgccgtgaaacgtctgactaagaggcccccactcccagcacgacggcgctgatcgaagctgtcgcatctcacggctctctctagccgacgcgaagggatgctgtgcctgcaaaagagaagagggggaaccgcggaaacagaaaagacacagaaacgggagaagttggcgtttactgagagtgctgaagttccccaaaattcctgaaaaaaacggtgtcgatcttacattcttctatgcccatcgtgtctatttctgatgcactctcctgcttcctagaaccacgccaacacccgttttgtaatgtccattcttttcttcttcagagaggtaattctctccatgcgcccgcgcctccgacgggaacttagcactggtgaggtctcgaatgtggaggcgcttttgaggaaggagactaccacagatgttattgtggcatctattcacagcttgcatcctcatgtgaaaaacgcagtctaactgggttccgacaaaaaaaaacagactttccagatctccaagacagctgcaacaaaccatgacagcctcccacaaaaaaaagacgacgagagaatacgcggcggagagagagggagcaaggaacagagacagctcgtgaaacatagagaaacgtggagagggaaggaaacgatgcagagagagacgagcaagagtgaagaaaacagaagctgcaagacttgtgaagatgtgcacagatgaggggtgagagacgaagaagtccaggccaccaacgatgtcgattgtggtcggcagaagtaccgaaaataaaagagaggaagggggactcgggtagtcgaaagtgagatactgtctaaaggtaggaaccgagttcacagctgtgcgtttgatctgtcagcagccaccatgcgctttctttaaaagttggggagggagttctgagacgaactcacggtgaatagcaagcaagtctacgaaaagaaagagagaaaacgcagagaaggaaacgaagcacacaccaaggctgccaccaagcgaaacgcctcggggtacagcggttcgctgcatgcgcacatatatatcggcttgactgcatgcgaagcctttttctgtctcgtcgtctgcgaggcttgtttttacttcttttccttcctcagttcaaatcttttgtattccagcctgctttcaagcgtctgcacgctgtcgcacaggtcgcgtggatgaaaagcctcgggaagcagagaaacgccatgtccgggggtgtctcctcgcgaaataccaagggtcgcctctttttctctgttcgtgaccttcctccttggtcttctttgcttgcctggttctccgttcctgttccctttcctctgcacctctcttttcgctttctttccccttgttccctcccctttctcccctgggtccatcttgtacgtcgttttctccgtctcgcccagacttcgctgttctatccgttcttaatcttcgcgtttgccgtaaacgcgtcgacagctcctgtgtagattcacggaacctgccgcatgcatccgtgctcactcgcgtctctctgccgatttacctgtattttttgcctctgcatgcatgcttgtccggcacacacggctaccgaggcgcgttgggtcgtccgagactctcagcagagttttcttttgagccgaaggtcgaggagagagaggagatgctgcatgttgtctgactgattcactgaggtcccttcaaaaacgggagtttctttaggagctagaaagtgcgagagagaaattttcaaaaaacgcgcccctggtggcacagtcagcaaacgccgtctggacactatgtgcatgcaccgtcgataggcggagcatttcaagtccgccggga

SEQ ID NO: 1719 - DNA, 4358 bp, Toxoplasma gondii
attccaatcgctgcagcagagctgcaaagtccctcagcatcatcgccgcatcttcttgagcgagagccgggagctcccggccgtcgaactccggcactgacaagcgccgggtctcgatcgggggcgaaaaagcgggcgcggggagacaaacaggcgagaaggtgggcgccgcagcgagcggggccgcagccctgcggcgagaagaagaggagacacgctctgattctaggcaggaaggtggcgaactcgtcagaggcttcacaagggaagagagaggcttcttctgagggggcccagaagcggacgtgtgggtggagggtggagggaaaaaagaatctaaagacgcgttgtcagaggcgagactcccagcctgtcttggaggtgcggttgttgatgccgcttgagaccgaaaaaggcaacccgacagtcgaggagattgctgtgaagaagctgacaggttctgtggggctggaggaactgtggctcgtgtctgcggagcagacttctgcagagacaaggcgacggactttgcgtcttgatcggtttcatgacttgatttgggaagggaacctggaacacttgactgtttcacattctcagtgcacccatagtctttctcttttcgccattgttcgccacgcgactgcgctctttcttccgtaacgcctgtcgtcgtcagcctcgctgaacagcactcctgggacgaggaagcgagaggagatgagacatccccacaccacgttttaacgcgttctcctccatcgtcgacggctctgccgatcagcgctgcagactcggagacaggaggcgcgacggcgcccgtggagcccgaaaggggcgaaggcctccgcccgactctgatagtaaccgctgagggtcgcgtggcatccgctatgctacttggaccttcgatttgtgtggaaaatctggaaaagatcagagcggatgacgtgggcgaagtggctgctcccgaaagcgacggagaatcagcgccagggagagaagaaagaacgtcggaggagacggcgctgggagaaagcgtgacaaacgtgtacgtggggcgagacatcgaaaggctcttctcgaggctctccacaggcgaagagtaggcacggagagggacacggaaagaaccttcttctggcctctcaaggtctctcagcaaaccgaagaaaaacggaacaaaaaacgagaaaaaacacaaagaggaacagactcgcaggcaggacctgggctacagtgaagaagcagtcgcagccttcgctgtggaaaaagaggcctcctccttgtttcaagtgtccgctgcagttctcctctctttccggagtgatgtggccaacacaaccgacagaaaagtgtagtggaaaaggcacacacgaacaccagatttatggcgccagttttcgaaagaatggagcaaaaacatgaatggcgggtgtcgacagcggctgtacacgcgagggctgccttcgtcgattgactaaatacaggaaaaggagttcgtttgatcgtgtgaaacgacagtctggagaaactaaaaataccggcatcaacagtgcaaccagatataacaaatacttttatgggggatctgtggacagaggtaacgagaaatggagagtttcaaagcttcttccagctctggcacttcctgaggggaggaaactcccaggcacactcccatcccttccagagaaaaaactcgcgctcctctccctctctcagtaacggagtttcatagtttcgaagaggggggtttgaatgccagaagagggaaggggtgaaggcgaatataaaattaaacttgcccagaaggggcaataactgcgcggccagtcacgcgcaatgccgaagaggcactgcggaggagaatgttcgtcagttgacctaaccctctacgaggaacgaccgagccgtcttcgaggcagacgagtgggcaaacaaagggcagattcgactgacaaaccgagaaggcctagtggaaaatcaagggcagaacgcgcgtcagcggcgtggatatccggacgtgacagacggcgacgcacgaacgtctcggacacagccccgccccagtatttagtcgttgtcgccagaaagaaaaggaaggaaatagacctaaacacgttttacgtcaaaaaccgccaaaaaacctcacaggatatccaggaactcaccatgaggggacagaagaactgcgtagtagaggcgtatgcttgtggatccaggacggattccgcgtctctcccggtgatcagcagctacctacactttctgctaaagcaaggcttttctccaaattatttgtgtttctcatccacttactccaggtgcgttactccgggcgagtctgctcgattccccgtatcttcagctttccagtatctgagccatggctctacttcgcgatttttcgcgtctctcgagccttgtgaacgggggagggtgagcgtgggttctctgtgcacgtcgccccgtccacagctcccgtgtgccacttacttggttttgtggcagcagaaaagcaagtgagcttcagtggtggcattcagaatcgccggacagcagtccttcagtggttgtggtgtacggacacccccttaaaacggtttcctgcacaacgcaaggtcagcactcaaacccgcggtggcacgcgatactgcgaggctgcagtggccatccacggggttgacagctgatagcctcgttcgttgccagatagccggcacacacatccaactgcccagcattttcgctttttcctccagggaacaatcattcgttccagtacgcgcgttgcaaacgtgtcactaggaaaagtgaatttgtgcaggtgacgccctgtcattgcttcgcgctggctgtccgtgaccgagagagtctttggtttccggatcttagcgtagcgcagggagctggcgcccgcagtgaggcacgaggctcaaagcagtcctcagattctcagcacagaagtcattatatcgaagaacgtcgtcagcaaggccaatgcagcgcctgtgttcaacggaaaaaggcgagcgtgcctcgtcttgcgcgcggacactgcgctcagtaaatccctggcgccccgtttcggggacgtcgtggcaacgagcggtccggggtcgattggaaaccccgggggtccttaagaagaaccctgtgtcggaacttctgtattaaatgcggtattttttcttccacagtgtttgctgttaccacacccaacagacaatgcgtacggagacccaaacccgtctcactcggtcttttgcccccagtgagaggtgacagctcgacggcgcacaccggtcttgagtttgggttggagctctctcgcgaaaccgccgcagttgccgtcggcaaaaccccgcgtcattctcacgttgccgttgctgtgtcaacatctttgccagactctcatactccgttttctgcactcttctcctcttgcttgcctggggtttcctgggtgcctgggaaacaggaacgagagatgcagagccgagcctccgttattgcacctgccttctcgccttcatcccctctccatttctcgagtacctacaggtgtgcaggttcggtgttgtcttccatgaattgaatcaggtgtcaaatgcttatgttcatgttcgaattaaagaccgcagtgccccttgattgccgctagggattctcatccccttcgctcttacatcttccagcgacgaagcgttctttcacgcagccttcagtgtagacactgcagtgcccgacgcggttacacaggtgtcgcttacttttttggtgagctgttgtgtgaatgtcggcgagaaaccggcggcgtgtggtatgtgcttttccgggacattcttagccgttgccactggtgcattgcatcttccacgtccgccgtctggtatccccattaatttttctcagtgagttactcatttcaaggattcgttcctctatagcgctctctccatcttgaaagcgcgccgcgcctttcgcttgacgcagtttattcgtgcgctcttggagcctcgtgctctccagggcggctatgcgtctcgcctcactgcaaaatatagaggattcgcggaacaggaagagctctgatatgtctgtgggtgataggcatctgttcccgccccaactctctccgtttcttggtctgaacacgatacgagattccattctctccgcaactaagaacttcaccgcatgcaattggggatcgacaccggctctgctagaagatcgttgcccctgtgggctttttctcttctgtgaatcgtgtttcttcagaagcagaggcgagttaatacttctgggggtttctgagtcttagaagttttctcctgtcgtgtatctgccca

SEQ ID NO: 1720 - DNA, 3388 bp, Toxoplasma gondii
ccggcgaagcggacgctgcattggacgtctctgaaggagaaagacacgcctcgacttcgtccccaccgctctgcatcggtctggcgatctctcttgagcaggttgccctttttgtggggactgcacgccttcgactcactcgacctgggcgtctcgcatgcaggcaagagccggccgagttcgcgctcttccctctgccctcccggccgcttcgagatctcttctctcgctggctgtctccacagccagccgcggaagcgcgagagaagcgcgtcccctcgcctcccgcaagtctctgcgccgctgaaggcgcggccgtctcttcgttctgcaagcgaggcagaggaaggatccccagcctccccgtcctccttcttgccggcttcggaagagccaccacccgagggggaagcgacagagtccgacgaccaacgagctccccgcctcatgtccggagcgtccatcctcgagggacccgaggagaagaaggaagagaagaaggaagagaagaaggagaagaagaagagggaggagaagaaggaagagaagaaggaagagaagaaggaagagaagaaggaagagaagaagaagagggaggagaagaaggaagagaagaagaagaaagagaaggagaagaatgaaagaacgaaggagacgaagagaaggaagaacagaggaagaaaacgagtagaacggggggaaaacagtgaagaaagacgccgacactgtgaggtcgcaatgtgcgcttagaaaacaggagagaagcacaccgacaactgcacttgattcgtggaatcgaagcctgctttgtcttggcctctttctgttccagcgccttttgaacgcaagaggaaactcgccgtgtccgttcacctgcaagttctctactttgttcacggggtcgtctttgttttcttcgccttccgagccttcttcgcagacactctattcctttgggggctgtcgctctccctaacggaatcttggaggtctttgttcaccgcatccacgttctcgcaaaggcggcgcttccgtcgatctctctcgctttccccggcgacttcatggtccctggagaacgactcatccagaagacttggctccgcacactgaaatgcccgaaaaatctgtagaaaacattacttgctttctagaagcagctgaaaacgaggtgcctagagtgccaacgaggaaagtcacggagcagcgagagacacaacgtcctcgatcggctgttgcgccggtttaaaaatacccgcaaagaacagaggggtcctcccccacagcttccttcgagaaatgcgaggcgactttgttctagaagaggaaaagaattccccagaaatgcttgcgattgccactgtcccgtctcaggaaaaatcctcgcggccggggaggacgttgcaggagatcggtgtgctcggcaggtcgcgcagagagtaactctgtgaccccctagatgctctcctaaccctgttgaagagtaaagaccataaacagcgaaaaaaggttttcctcgcttggcgggatctccgcggaacgcgaactgaacacctgtagctgatcggggaaaaaagacggcctttctcccgcagaacgaaggaaaagcatgcgagtgtgcgccagcccagcttcacgagcgctggcgacaagcgaactcgcaaacgaggtcgcaagagagcgtcgcgagttgcgaggttcttgaattctgccgcgacgctctgtttcgtctgtacttctaaagaacagttcagaggaaaagacactcgaaaaacccacgcatgcgatcagaactgaatctggaaggtccggaaaaccgtatccatgacgcgctgctgcggccgcgaggacgagactcgtcgaccctggaaacgcagtggcctcgaagcgcagagacacccgaagaacttcggtggactccgtgtcttcgcctcgcgttcttcgtgaggaaaaaagcctttcgaaacgacttgggggggggaagaggggcgaataacgcggactgtgcgcagaagtgtgtgcggtatacaaagctcaggcggcctgatctagcgtacgaggtactatacggacggaacttttgggtggagagcaagtgcctggggagactggacgaaagagcgacctaaggaactgcagaaagcatgggagcagaagagacggggaagacaaaggagtcaatcgagggcggattccacgcatttcttacgccttctctggatacggccggggtgtatggaggaacgtcgtgagtccagtactcgacagatcaggtagacacttccctgcttcgttctgcatacgagagcgagtctggttttttgtggagctgtcgcgtcgtttatgtcacactcgccagttctgtcacgtctttttatacgataaagagcacttttgagagcgcttcgctgtagtcaacatcaacacaacttttagggtccgcgaagagggaggccagaagactttggaaagaaggactcgcgcacttcattcttccgttgcctgtcacatttccctgttctctaatgtaaacggtcctacgactggagtagactctgcaggtcaagttaccgcctggaaaaaagcattcgcggccgcggggtcgacgcacgatgagtaagagtcttgggaacgtgggttctatttgaatgcgaaaaaaggctttctgctctccctgcggacggagtttcacgctatgtcacaagttttagatggagaacgtcaagtcgaacttgtggagtgaagaagctatatctgtttcggtgtggcggtgtctttgttaggtcctcacacttggcagagcggagaaccggagttctctggacggcttcgccgtgttctttcactccgcaaaagtttggggtgtcagtttctgagtcgaatctttggacctctgcagctgctttatgggtttctgtccgtgaaacgcatcagaagagacattttcctgtgtcactgcatctgtgacggcttccgcgctcctctgagagtcgctttcaagacgcggacgccttagattccaagtgcgtatgcgcatctcgttcgcacccgtcgactgcagaacagtggcttctgttctgtcttgaacattttgcgaggacaccccccccagatcacggccctcctgttccgtcagaagtctgcgcccctgctggtgcgcgcgttcgcgtctctgaagacagaacgtgatcttcagtccccctctctcctgctgcgcgttctagactgagccgcctcttttttccagctgggggctgaactgtctgtctgcctggagtattacttttttcttttgcgtcttcgtttctctcgcagtctgccagcttgtctctgcaagtacacgcaaccgccactgttcgcaggattccagcattccagccaagcacca

SEQ ID NO: 1721 - DNA, 2288 bp, Toxoplasma gondii
gaagcactcgtgaccctcgagcgcacagaaccaggagatccaggtctccccctcttcttcgtcttcctcgtcctcctcctcagaggcccgcgtgaagacgggtgtacctaccgctgccgcacgcacattggaagtcgcgtcttctcgcaggcgaccttctgtctcgcggcgtcccagctgcctcgcctcctcgcgctcttccaccgctggaagcagagaggaagcgatctccgaaccgaagtgggcgcctgagcggcccggagccccgccacgggaagccgaagaagtgagagtcatcttggacacagcggaaacgcgcgctgtggagaacagacacacgcgacgcagagagagtggaccgcggagagggtggagagcggggtaagaggggaggagatgaaaggcggaaggggagaaggcggccgtctaccacgaggtgagagcgctgtcagggggattatcgactaaaagagctgttgacggagggacgaggaaacggcttcgtttgctgaagaggagcgtgtgtgtagccttgacgctgacgagttgagaagaacgggtcctcggtctgttgtgggcagagagacgggcgttgacggaactgagcgacaagtcacagcttcgacgcaagagagaagacatgccccggaggctgatgaaacgattgaaactcgaggggaagaatcaagacagcggttgaaagacaactgagtcttgtggatgaggaaaggaaaaacggcaaacgaaagtgtgcggcctcgcgaggcaagaggcgggaagctcgaagggcttccaacagtgaacagacgaacaggcaataaaacgatgatagaaccaaccgaggaagaaccagatggaacaggcgagacgccgagtgacacaaatcgaaggcaggtcgaaagtgaaaaacgacgggggcattcacagcaaattccacgatgcttttctatcctgggcaggaactgcacacgggcttcttgacgtcggtttccagtctcctcaccgcggcctcagccgcacgcaacgacgataaaatcccggagaaaacgattagatgggaactcaaagaaggcagtgaaggaaacccgagcagataagcgaggattggctgcggacgcgcgaaaggccgcccccagagaagcgagacaaggaagcggaccggatttgaggaagttgcgaaactcgcctcgcggcgcccctgaagtgtccgtacagatggagaaacagaaacagggaaaacggcttttttaggggcgtcgcgaggattcaaacggaaagcggaaacatctgtggcagcgccggccagagcggatgcctctctgtgaaagtggaaaattcgaaaaagacagagcacggggacaaccgcacccgacagcggctttttccagtttctctgcacggggcctgaaaccgaaaaaacgacagtttcttcgccgaacacgcacattccaaaactctcaactggtattttcccctccccttttattcccgcctctcccgctttgaagactcgtccctctcagcgcacgcagagatcagccacctgcgcgacgtcacacaccttttctccatttctccgaccggcgtatacccgaaagcgtcctccctcggctatcgctctccctcgagacctctcaggcatttctcgattctgctgtacgatcgactgccgcagaagagccgggaaaataggaaaagagcctgctctttgctccaagttgccgccatgagcctagccgcctctcggcttcctggaaaaaaccaagcgttctcatcgtcatgcacacgtgagacagcgcgtttaagactagcccgtccaaaagctggtggggagagtcgaacggtgggacgaagccgagagccgctggcagctgagtccatctcatttcttcactttttaacagacgcattctccgttgcgggcctgttggcaacaaccgaaggtaccttgaaccataaaggcggtgattcgtttacggtatgtgcacgagtttcttgttcacccttacgcccttagagggacccacacgtggcgcgaaacgaggagggaatgaaaacggtgacattggaaagaatggtggcccttcctttcttctatgactaaaaagacggtgattgttcagttgatttgtccatccgcctcctctgtagctttcggctctagggtgtacgcacacctgagccgggacaagtcgccataaaacgggcggacacggagccttccgtggaatatccgtcgcgttcgtttagctcccatttcagaccgggattgcatttcccccggtaaa

SEQ ID NO: 1722 - DNA, 2616 bp, Toxoplasma gondii
gcgacgactggcatggatagagtccacggtgcgatgaaggtggaaagacgcacggcggtttacggggattctgcgaatgacgaaactgctcacttgatgcgcgatgagcgaaccagcgcatctgaccgcgggccagatgcgctggcacagaaatcatatttagcacgggtaacagagaatacttttgatgaacagggttcgcgcagcgaggaggtcagttttggcgacagtgacagcgtatgcaacacgcgaaaacccgctggctctaggcgttcggaaactgtggagtttagtcgagtttccgattcagaaagggaatcgaaaaatgagctggaattgcggccagcagatgcaactcaaccagtgcggagacgagacgcggtagttcatgcgcaccagtacagtccagatggcgaatacaccacacggccagtgactctggacaagcacgtcaaaaaaaagaatcgagcaactgggggagtgaagccaggggcagaacaagagtagtcgtaagtccctgacgagggaaagatacttctgctgcgcttgcggtcaactgtcagctacagtctcaggtgtctgcgatgggtaggggtgaaaatttcgagcaatagactggaaaggaatgcttcaggggcgccggcgtgactgctggataggcgaggggcatgcttagttctgtgcttgcgtttgcgagacaatatgaaggcgtccaaatctgcaggggacctccagaaactccttttcaaagtgaattgacgtccttaagtctaggttcgctggaaactgcagcgccttctctactgggccggcgtattgctacagtcggcacttggcaaaactcccaccgttccggatgtcggcgagaaacaacctttcccttttggcacttcacgtgtttgcggcgaacgtttatcatgcaattccagcggaagtggtagtagcgtttcagatgctcgttcgtccatatttatgtccttggagagggctattacccctatgctatgcatatacctcttcagccaacgaagaaaggctgaacggtagccgacatgccgattgttagtggcggcaaatgaaagaaacagaagttacaccagggcggttgccatcgagacaacatatcttgggctctgtgcgaaatacttggatcgggtttttggtggctacccggagtacggcgtgagctgacgagaagaagaaacctcatacctttcagcagaaaccatacggaacgcagcgtcaatagttttctctggaggcgttctaggcacaggcctggaggagtgggagggaactttttttccttccgcctgactcttgctttcaagtttgtgtattggcccacatgcctgcaccctttcgacgctgcctactgatcggctgagatagatctaccagcgccggcaagctttcgccggtactagcagataaaccaacattgagatgggcgcgtgaagccagtgtcacaccagcttctcctgaggagcggttctcgtgacacatggccattgagatcgtgttaacgcataccgcagctgggatcgtaccctcacagatgctgttgaacaacgttatattttctcgtttccccttcgcagatagcagagagtgggggattagttttcaggttctgaggggggctggaatggttcgaaagcgactgttcacgcggtctgacggcgaactgtgacacgccaaagggtttgtgggccgatagacaaggaagaagttgctcgagcgtttcgctagcagctcccgaaactgaaggatctggccaagatggtacactgaaacagtagccagccttgccggttgagaggagatgatcgatggcacgactggagacgagtgataacccctcctgcttttccgccagcctttcatcgaagctggaacacctcagatcgacaacagtacgtgagactgaaggttgttccgcttgtagacccgtgtttggcaataaacctcacgtgtactctggttcctctccatgatttcttctcctgggcaactgctaaatcggctaacaggcagacaatccccaaccaaaacgagacgtgacgcatttggaagaaaagtacaaattgctaccacgatgtacaaccgagctgcgagaaaattgatctttcttgcccaatggaggtgcgtagatccagaagcggcaagcatgagactggctcttgtctggcccctatcgctgctgagactttttttggcgcctatcgagcccaaaatctttgtcgggaactatcgccatagccttgctaggtgtctcacccagcggggctgaacgttttctctgggataggctccggagcgagcgctaccaccccgtccgctgtctctatctcgccgttcagacccactcggcgttgtcatgctgccagcgcgatgaaacacattttgttcttccgcatttttaaacacagaacctttcgaatttccagctggtggcttcccgaagccgaaaaccgtttgcatctggaaccccgcttctctggcgacattgtttttgcctcccagagagcccggagcgagcgacttgtgtgcccgttcttcccattttgtcgtcctggcggtataaatgtttatattttccgttgtgtgagtgaa

SEQ ID NO: 1723 - DNA, 2344 bp, Toxoplasma gondii
gcgcagacgatcgccttcgaagcgagaaccttgtaacatttctatccccttctacacgcagaacaccattcagttctaccgcccgccccctccccccacgtatgtcaatgacgtctttgtcaaccaactccaagaaacacaccctatgtgcctgtacgttcgcggatgtttggggatatacttttccattctctacgtgtacaagagcgaagggcgtagtcgaagtgaatctgtatcatcttatcgaacgtcgtccttcggccacattgctggaaacggttacactccaaagggacatttcccccagttctcctgagatgaaatctcaccttgggcgcttggtgaagtgatcaagaggaaggtagacatcccggacgcgaccgaacttctcgaaaatctgacgcactctgtccggcgaggtctcgaaacagaggtttcggatcaacagcgaacagcccgtcgccatttcggctcctttcctctcggaaaagctgtcctcttcgcacagagcagaaaccacttcagcacggccctcaaatctcgcgttgtcacgctgttccagctgtccagcacaaggtgcttttcaccagttccacttggtgccgtcgcggagcccgggacagcgaagctggggcggcttccaggaattccacgagctgccacagcaggacgtcgccttggtaggttcacgtttaaaatgccaaggtaggcaaacgacgacacatcacaccagcgaggggtttaactccgtcgtggacccaagccaggcaatgcacagggagaagtttgcacgagcggcgcctcgagtcatggagggagcgtattcgacgaaatcgaaacaatttagttcccaacacacattcacagcactgcagaatgtcgccacaggaaatgaccgccgaatttgcttcacagcgaccttcgtcggtgactgttctccggtgatggggaagaagtggtagtcgtggggaagagcctgtaacgctagctgcacaaatcggtacaaaccgttttctgcagctggactcgcttttccagatttgaagcagctcctgtggaacccgggggaatcgtccgccctcttgggcttgaaaaacttgacggcagtttctgtggcggcagcggcaaatcggccgaccgccgtcagaagtaatcgagtttggtcgaagaggagcttcaaacatgcaggcaaaaaacaatgggtgccccaaaattcaagcccaggaaaatgcaagaggcgtgtgcaaacctgggagaaaaaacgggatgagtgttcctttacgagatacacgggaaagcggacggtcgtctaccctcgtcgaccagcagtagcagcgagaagcgaactcgcgaacagacaggaaaaaatggaatctacagttttggacgcaagaaaagctccccagaccatcatccaccaagcgcaaaattaccgtaaagtcagacatcagtggaaagtctctgagtctatttcagacaggaccagctaatacggactgttgtctgtgcggttctcaccattccgccgttccgtccctagaaggcgttgccgcctcgttctttggtgataagccgaggctcctattcacgtacaacccggggtcatgttgccgccctccaaggtcttgtttagtacagttctcgtccacgaaagcacagagaggcagaaatggtgaaagttgagtcctctacaacatgcagggaagacctttgtggggtttcacgctccaaacggaaagcgcacccttcagacccgagacagaggcttgaaatttagtcttgcctctccatcgcgtgcaatttttctcagcgaccccggaatagctggcccgattcccagggtcaccgtgcgacccgcagaaagcatatgtctactcttgtcggcgataatctgttgaaggacgccaagatgcgtcatctgccaccttatctgttcagaggcatcttttcctacacgaatgccacacctggatggtcgagcggcgattctgtggcagctcgagttgacgatcatgtttgcaaattcagcatgacagtacgctggcgagctaactgctcctgggtacgacggggggggggaagggcgactgacgtgttgctgcattttcgtttgccggaaagctaattgcttttcggagtctgtgtgaatcgttttaacggacaacccttcaacaacggcagtgcctgcgattcactgggcaacgacccaactagtcgatgatacactcatacttacatcattgttcctcaaaggtatccgtacgctgtaaatgcggcgttttgcgccgcgctttaatgtttgtgcacagaacacgggagtcctgctttaacttggtgtagagga

SEQ ID NO: 1724 - DNA, 2315 bp, Toxoplasma gondii
cctgaaacgcacgaatgagagacatggcaagttcagctttccaagcagcgccgaccagagcacgcatacacgcttttcaaagtgtctcgacggggggagttcttggaggcagattcgctttgcgagttgttttgcctgtactaccgatgaagagactcacttggctacttgggctatcaggcttgaagcgtgaggccttgtccacggatatgcgatctggacttcgctgtacacgcgttccacgagacggcctcaagggtgcggctgatcggcgttccctgcgtttcttctgagagacagatctttcgagcgtcatggtctgcgactcctcgatgcaaagccctctggaggtcacgctgaccagtcaaaacctgagtccaggaaacgaggaacagaggactgtgcgccttcgtcggaagttcagtctttcacctgtcaaagcgacacaggctcgctcgagaaaaggaagcgaacgtgactttcattcccccggtaaggtgattgcggacctccctgtgaggttgaggaccgcaggagatgctgccgacgtcgaatggccctgcagaagccgcagaacaaagcggtacctctctctccgccgtgcagggatttcgagagtgttttgctttctcgcagcttctggaagtccgccctttttgtcggttgtcagaaggaatttccaagaaacaaagaagcaacggagaaaaagcaggcaaggaacgcgggagctgaccggttctcagtggactgaaaaaaactgtctggcttttagtgtcctatggcattgaggtgcctcaacgttggctctgtttgttggcgcacagccctcgcaatccaacaagaacagagaaactgtagccttcaggtcggcttcgaaagcatctctgcatgtgctcgcggcgatcgtctagttgaaaaacgaggagagtctctgcacggcggtgtctggaagaaagtccaagaacgacgtctctcggtgtctcggagcgcgcgtcgttgacacacacagccggaatggcacgttttgccgctttgtttcgactggtgttccggaaaaagactctggaaaagttccctttctctagcaactctgtgcttcgctactctcaacctgttctcgacttgcagaggtctgaagcgttcgcgtcgttttttgctgccgggatgaacgagaaagcttctgaaaacgcctcgctccttccactcgcaaatcgaatgaacctcgacaggatcctctcaaagatcctgcgcgtttttctacttctttcaaagaggaccacaggtgtaatctgtgtgctgtcgcctaaatacgatagctacatcctctgttgctgcccagttgtcttccggacagtctcgtatacctcactacgcgttgtccttcccctttcgtcgttccccggaggaaccaccccttcgttttattcgtcgttctctggactttcaagaaagatgtggaatttgtgaggaagcttccgcgactgtcgcagtggaaaactctggaaaatcgaagcgtgcatgcgttctggtccgcaggcgtccgagcctcccctcccgtcctcttcaggaagtcagattgaagctctgtttcccgtggaatctgccacttttgtctcctccttgaaagaacctttccttttttcttattggaccggcgaaaatctactttccgccgtccagaaacgtgtgtgtttctgacagaaatacgccgtggtcacctggcacccggtttttctcccgtggagggcgttccttgtctggttcctctgtaaccaacaagatgtttatcatgcagatcttcgtgtgactttgagatttatggctgacttccgcgctcaacttgtctccgctctaaacgaggaaggcgctcgccggcgactttcgaggaaaactctctcgacgggtgcttgaatttcttcgttttcctcgtggaatacaacgaacttcctctctccttttcaacctctttcaaagacagccgaaaccacaacgtccgaatcccctttgtcttccaagcgcctctctgcattctctttcacacccccgtcgttcctgacaggcaagactccgacgctcccaagatgtgtggttgtctcctgtaacttccgctacctctgtctgacgatttttttcggcctctcgagcgccagccaattgcttttcttcttttcggcagttgaggaacgaagaagcgaggtgcctacgccctgtgccgacttcagcggcgctctcctccttcctggaggtataagattcgagcctcctttctacgaaagagaggcctgcggctctgcaactctggacgtcctctcaca

SEQ ID NO: 1725 - DNA, 1516 bp, Toxoplasma gondii
aggaggtgacgggcagaacggatcctctgctttctccacttctctggacccccgaaactcgacgtcgttctcgtaccttcaacgagagtgtgcggaaaacggcgtttgactgattcgtctcgacgcaagacgagcttgggagtgaggagcggcccgctggaagcggagcctcctcctggctttgttggcgaggaagcagtcgagaagaaacatcggtggaatggacgtgtaaggttaatctgcctactgcggtcgcaagttcgaggccgcaagggcttgacaaacagctggctcctgcaagcttgggcaggttcgagagaatttgtgcggagttgtttcctcgcaatgccgccttcgctgatcaagcagctggagggtggaggacgagcggcggggacgggctttctagctgtcgaaacacgcgactgttgagttcttcgtggtacggttgctcgtgaaccgaatgccgacgaaacggaacttcctgagggctctgacttgctcggaaacggcgaaacgattctcgaagcggaggaaagcgaagcagaccacgcggacaacagccgcagtgaagggtttgcacggggctctgccacgctgctgcgatgaaaagattcggataaggacgaacggacggaccgtccagacgctctggtaaagctccacatcgtgggcaactaagtcgtctcatagaaggaaggaccgcaaaagaaggaagcaaacacgccagcacaaagcaaacgaggtcgcgaatatcgagaaaaagataggaatagttttcttctccaggattggagatgcgtgctcgccccgccagcgctccttcccaacaagacggaaaaaaagcccactccgtcacgatgccacagcgtcccggacgttccgcctgaaaggaaacccgaggggcgcctggccctgcgtgtgtggaaaagaaaacaaagtgtgttcagatgcacgacgccgcctctcgtgtctcctgttgctgcgcagtgtgcatctgcctgagcagtccgcgcgcttgacaattctctcaaagctacctgaatttggcttgctgtgcgtccactctagcctattctcggcgatactgcccggttttaagccgtctgtggcgtgactttttgcacagtaagttcgtcggctcgtgaccagccccggcaccctgttctgtgtcagcatgcatgcaactgagggcccaagtcctgttgccctttccggtggtctcttctgtcttgggtctgaaggactgctggaatggcgtgatagcattttgattctgatcgtgtttcctagacgttgaaggttctgtcgtgtgaattacttattcgaggatcttcgggcagtgactcatcctcactcacccacacccgacgtgattaaatctccgtgcatgcctttccctggaccttttgcgcgtttcgtgtcgaagcgggaaggaacatacgcgcaccgcccagttgaattgcgatcagctcagacacagaacggtcagttactgtggcacgctgatgctcca

SEQ ID NO: 1726 - DNA, 2941 bp, Toxoplasma gondii
ttgaaaggaagaaagacgcgacgcactctctcctgttcgaagttcgcgttctccgttgacgcactcaggagtcgaagggggcgcgagagcgtctcccttttctcgctcctggggggcaggactcctcgcttcgacggaaatcccccacgagagaagaaacgacgcaaaaatggaaagagaaagacttgccaacacccgacagacctctttgttcgcgtggagtcctctgacagagaacaggtgaaggcatgctcggcactgggtccgtttattcaccgctgctcctgatcttcttcgtggaaagacctatctgacgactgagactcgaatccggcaatctctcttccctttcgcctgtttcttcgtgcccttccaggtcttcacctcccttcttccttcagtgtcttttctcattcttctttccgaagcgttttttcttctttcagtgtcttcttcgtcacaactgtcttcagttttcctccctacctcctccagagaatccaccgcgtccgccgccgcgtccgccacctcgtccgccgaagcctccccgtcctcccctgcctcctccacggccgccaaaagagcctcttccgcgtccactcattttttacgagtcgcgcaatctgatggatacgaactgcagaagtgcaacgcgggcgagacgagccaatgacagcggcttgggaacctgctgcagaaaaccacgggatatgcgctcacgcgctgaaaaaagaaagagacgatctgcgttttccctgagtgaagcgttgctctacattcttccttctggacgcgagtttctcgaggagttccgatggagagacaaaaaagaaccggaacagattcgcctctttccttgacagggaatgcgcgtttgaatcggaccgtggttcagagaggctgcagatataagacctccaggacacgagtaggaaaacccccgccacaggatctctctggacgaagcgacggtttggcttttaggagaagaaattacaagcgcatggaaaaggaggagagaaacagtcggagagttagcgaaaagctccaatcagcaagcgagagcgtttagagaaacgcaagtgggctagacagcacaacaggcacggcgaccgcagtgagaaaaacggaggatgcggagctcaggtagcggctgaaaacgcttcacgaaaagatagtcgaaacgagagaacggcgaaggaaaacagaaaactcgtgaagaaggactgcagatacagcagcgttgaaaaacggggatggtatatcgacaagaggccccacacgtggcgtgcggcaagaagggaacttccctctctatttctgcgcagaatcagctccggaacgcgagggaccggagaaatggaactggcagtagagtagcggaacatgaaaaggaaagaaaagatgagagaagacgcaaacaacctagcgcaatcgagtttctgaagcgctcagagaaaacggaagatcgcatgcacacgggactgaagagctcgccgaatcgattggacgcttcttctggggttccactctgagcacggacacagccagacgacagagaaagcgagaaactctggcgtttcaggggcgaagcaaccttttgctgagtctgctccctctacaaggagcacaccgcgaaattatggagtcgagaacgcctgaggatctcctgtttgcctgcgaaaagaattccggatagcggcggcaaaaggccagcacgagcgtgtcgacatactttttctgggatgtcgttttccagttctgccgactgaagtgtttctggaaactgcgaaccgctaactgggatgaaatgatgtgcatatccacactcgcggcctagttccaggctttcgagtgcgtctgagaaccccgagagcgacgtttctgtcaaaaatcgcgggccacccgctgacggcggcgacagagcccagggagcatgtaccggaacagggaacgaaaccgggaaaaaactgaaacaaaagagagggcagaaggcaaatatcaacgacagggaactcgaggcctgggagttctaaggtggccgtgacctgctttgttccgaccctctgtctcaccgtacttctttcttttaccgataataagagttggagaaaggactagatgggtgcctatttcacgatagtatccgcggatggaggcgtcactcttccatgccgcgatacgtttttcatgcctcgctttttcgatacacagcggtgttcttgatagtcgttggcgatcgagttttcccgctaaaactgcgcagttcagccgataggccgctatcgttttccgagggtcacaccaccagacttagctgtacgtagaattcaacatgacatctttcgccgaaccctattactctcagagttcttcagtgccaacttctccgaggggattacggataagtttcacgacacgatgcttgggcgtttgttgctccttgccggttgaaatccgcagttcagatgctacagagtggtatccgccggtctgggtaccacttttagaatggaaaggacgtaagctgtttgggcactggaacatctgccttgacaaaactaagcgactggtaaattcggcgcacgatttcatgcggaactgctttcttccgatcgacgaaggacgagcgctgctggcgtttaagagagtttcctgcgtcgaagcgagaaaaattcgcactcgtcatgccgtcaggtccactcagcgacgctgcagttgtgactctgttcacccttacaaaaccaaacatgcacatacgaggtgtcatagcaaacctggggacccgctgtctaccgtccacgtatgaatcatgtcggaggaagaatctgtttccctctattgttcgatatctttaccgcgtcgccgtctcttcgcgcgccccaaggaattcttcagaccttcacatcagacagtaacacaaaaaccggctcccgattca

SEQ ID NO: 1727 - DNA, 2855 bp, Toxoplasma gondii
gtactcaattcttctcgcttttgtcgtctcctgtcaccatctctcctttctttcctgtctcgcgtcttctcaactttcgcgtttgctcgttccgtcggtcgcgtctgtcgagtcggattcgtctgagtcccgtttcgctccctccgacttcctccttcgttttctgctgcgcctcgtttcgtggaggcgtgcgtctgcactctcgctttctggctttctgcctcctgcccagccctctcgagctctgcgacttttcctcgtctgctgggaccggcgtctccgcgaggaagaatcttctgggacagagtcgcgtgtgaccttcagcacgatgccttcgagtttgattttagtttctgccaagaaagaaaactttcgtctgtgtcaagagacccgaaaaggcactttagagcagtcgccttgcctagcaagctgaacgcagagctcgcaacgcccctcttggatggctggatcagttcttctttccatttcctattcctcgtcagacaactgtcagatttgatccctcccattccgaaagctccgccctctccgtatgggcctcgcacgagagcctcatatggctttttttccggagaactctcaagaaagtgaacacaactccgttggggcgtcggccttctcagtcagagaagcccacgcgctgcttgtctgggtcgtgacggtcggagtaaaaaacgcctctttctaaaaacggtttgcccttctctgtgccggaaaatcctctctcgccttcgcactgcatacgcacgctccaagatggccgaaaaaccgtcttgcagagtccgagcttcaccggcgagagcggggggtccacagatttaggaaagcgcatcttttgctttttctgcgttttttcatgtctaggaagcaccgctgacagacacagcttgacagcattcacaaaagggtccttatcgcagtccgcttcgctctctcgaatcgccacatgctggagcttcctcgttggtggacttgggcggaactctacacagaaaacatgaaacacacgaccatcaacgtttgatgccaccgctctgtctgtctgtctgtgaacatccgcgtgaagacagaactacaaatgtataaatatccgcgcgttggtgaagagatatgtgtcttttgaggagccttctgttcgtgtacaaagtactccctggtttgaacaggcactgcgtctctgtgcatatacgcaggtccgctgtgtagaggacgcgtgtatcctcgtgcgatcagacggtttgcgccgccatcgttctgttttcttctgtgcttggtatcttcctttctccagaaggcctgagctcccctctctgaggaaactgcacctttcaggagttctgtctcggcagtcttttccctacacatgctggctcttcacacgttctcgacgcatgacactctcaactgatgcggaaccggcgcgttcggctcgacggcaccgtgcgaacctcgattttttcagtgtgccatttagcttcttcgacgggtctgctcaggaaggacggagaaacgttcacaaaaaaactcagacctgcagacagacagcagtacgaaactcctattcaactcgcaagcagtgctccgtctttgcgttttcatctgagccttgccaacgcgcaccagtaggttgaaaggatatccgcgttttcaaaggttccgaggtacttcgatttcaaagagtgtttgagaaacgccgtgtgaaaaggcggacctgacagtgtggcggcaccagctgcaaaaaatggcctccttcacaggaaatgaggagtcgaaaggcaagtacgcacgcacaagactcatttcattatctctgtttcgaaaaaagctgttgagcagcatcgacgcgctgcgccccatgcgggtcacctgggggtcgaggaaaatcgaatcttggggatggaaatttgcttccctttctgatgaaaaaacgtcttgattctgcgaagcaacaggaaatctcccctctctactcgccaaagctgattcttcgaaaaaacctttcttccctcatacaaaaaaggagaaaaagagacaacggagacagcgaagattccggcgatacacgcggccgcgcgccccagaccacacgtcgagctacggatttccacatttctttcttcgtgcttctcttctgtctccgtcctacgttgttgctgttgcttccttcttctggagttctcgagcaatccttgattcttcgccgcgaggtcggccaccgcgtatcctcccagcttctggcgagtccttggcttcctcgtatttctccgtcctttctcgcgcttctcgcgactcgtcttctcgcaggtttccttcttctcgcctctgcctctttctgctgccgcgtctgcgctcttccctgtccagcgcgattgaaaaacgcatgctccatcatgcagcgccgcgcttcacttcgcaccttgcgatctgtgcgaggagtgcgtgttgtcgaccttctgcgcgtctccctttctgcgactctctctttctggagctctttctcacctagtggacctcgctctcttcgtcggtctctccttgtcgatgtctttctggttctcgccgctgccattttgattctctgagtcttgttgtctccgtcggaatctctcggcgccgtccagaagcgccgcgcagaagaaaggcgcgtggatgcgtcggcgcgcacaggcgcgcgtaggtctctcgcagccgcagattatttttggagagcgcgtcgactggacagccggtctcggtcgtaaatctctgcactcctccatcacggctgggagacgcctgggggcctcaacttcggcatgcacccgcaagcccccgtctctctgcgcgcggaaaaa

SEQ ID NO: 1728 - DNA, 3170 bp, Toxoplasma gondii
tgtgcaagtctagaaggacactcaggattcaggcgttttacgaacttgaatttctctcgcaaagtccgtagccgtctcccgtggttttgctcagaaccagcgacgaggagaaccgagcccactccgtgttcgcgttttccttctcgcaaaaagcaatgtctttttcgtgagagtgcaaactatcgcagctgaggtgctcaaaactatcggggagatccgctccgagttccttctctgcttcgacaagggaaacggtctgctgtagcccgggaggtttgtggagtacaccattcatagcgaacatggtggtccggcctcataacagaagccctacccagatgtctcgggcctcgaatggctctgtctatacagtttgagttatgcagcttcggatctcgcatagatgggtgaaagcgcgtgtctctcaccttgtgcgtatcttgccttgaagaggtgtatggaacttttgtgagtgtgtgacccgattagagaggcagattgagagaggcaagacgctaggaatccatggttcgagaagtcacgttcatccggagacagtccgtctttgattttcactgagaagcgttaggggaattttaacggctgtaaaaggagtgaaccatccacgactctatcaaatggacacaacagtagagagcagcagttaaccttgcatccagcgatctgctacgaggacacagaaacacagaaaacctactccgtgggtggtcgagggtggaatgctcctgcgtcgcccgaatgcggattcgtcatctgtttataactcaactatttgtggaaaacactcttcttctagtgagtgtgacaccgaggtgacgaggcatcgtatcctccttgcttataaaaaatgctccggtaggtatcgcttggcattcttttcagatgcctctctttcgcacccacgggtatcgacatcttttgtcttctaggcaagagaaaacatgcaggacgacctaggaagaaagccgcaagatgaaaagtcgtcgtctgtgccacagagagtcgattctctgcattctctcagaaaagaggaccagcctgaagatgtctggcaaagacaatctttctttccaacgagagaggctggcgcgttgattcgtgaatcctcaacacagtcatgaagcgaccatgcgtctgtgaaaaggacagtttgtcgaaatgtgtactttacagtcctacataaacgaacggcttcttcgttacctatcatacccacctaccctgcattcctctgctctcctgccagctctctgtctcgtcttcggcatcgcgcactccctctctctacctcttccagtgttttgtgtttctctctctctgcttcttccgctacgctgcaacttctttcgccagagccaggctgcggatttttcatcgacgcagacaggtccagggcccgagtttcttttgtgctgttcgcaggatggagaaaccttcttggctgtagaaagcctctctgtgcgtgtggaggatttgcgcctctttcgcgaactctcacttccgggcccccaatgtgggctggaacgaaaaagttaccacaccctgtgaacaaaccctgcattttctgaccgtaagaatcgaagctccacgagtttgcgtaagctgttcgttttaaaaacggtaaagggcggttatggcgctcgctgtcgagaccctcacgttttccggcgtttgttctagttttttcgcaatgtgtcggctgcaaaggaaaaggaaatcgccgtctcctcattgcgcgatttatgaagtcagaacaacgggcccgtgtcgttccagtcgcgctgcggtacgcgtgttccacccgctgcttttcacacacactcttttagaaagcgtgtggaaaaggcgccgtctcggaggtttctcgcgagtgtttttcgcatttccacaaactggtgtgtgccccggcgaagcaacactggctgttcttccccattttcccccaaaaatccgtcgtcgaagaacgggggaaacgactgggttcgcacacagcgcgtgtcttgcctgaatgcggaccggcactcctccctttacacgcttgtcttccggagaactttctcgagttcgcgggtgtcctcctttcttcagaagattcaaggtccatggagaggaaagtgaaaaagtcgctcgcacactcagccgagagcgccgcggcggttccggcattctggagggtcccgagggctagcgcgtttcgttgaggaaatccgttgtttgaggaggcagctgtagtgtttgccaccggatttttataagggaatcggagagcggagtaaaacatgtagagggaaaacctcggtcggttgccaccggggcttccacggaaggctcgcgtcgccgtagcctctttcccgtcgtaccccatatttcagtttttttctcctttgctctgtctgctgcagcgaaggtagacgggaaataaccaacgggagggatcgaaccttctgtcggaagtccgaggaaagaaggaaagcctttgttcaccgttcgtaccaccgccgccggcgctacgagctcaccgtgtctgagcgcgtgaacggacgatcacggcaactatcaggttgaacgtgggcctttgtggagtgttttgtctctattgcattcttttttaatcgcctgtgaaaagcgcgtgttcttctctcttgacttgctgtgatttcctctcggacgtcttgaatatatagtcggcaggcacgaattgctcacggtccagtcagaagatttcggcggctgtgaaaacgactcggtcttcttatttttttttctttgaagccctcagccacactccctccagatcttgctctggactcgcgcctcgagaaggttttttttcgttctgagtggaaacaactcgttctctttttcttctgtgaaggaccgttttccgagaggaggctgtctcacgcaaaccctctctctgtcttcagacctcgcacctctcattccagctcgtctgtgtttggttttttctttcggtctcggctttccgcccgcaggcttgtctctcggcaaaacgccgtccatgcatctgttctcttccttcccgacagtgctcgcagaagcgcctgcctgctcctcgctgtccagtctgtcgtagcttgcccccttgggtgccaagacgcctttcgtttttcttttgccaacgaaga

SEQ ID NO: 1729 - DNA, 4653 bp, Toxoplasma gondii
gcatttcctcatcacgccagaagatatccgtacagtacagtgagtaacgatttctctgtacatacacgtacaactacagatacacggctaactacagacacttttgtggacggcgtgtcgcgcataccgtcaaggccgaacgatccctgcttggtgattattttgttgacggatttcgcagcgagtttgatcgaggtgaagatctgggaaatctcgtggacactgacgccacgttctctcagcagcggagcctgttgtaccacgtattctccgagttccagttgaatgctagtcttgaacaagggcggctgccgggggggatcgggaatgaagattgacccctttgaattcaaaggaattctgagtacgctgtctgatctctccatggtgccgaggatacaaagacggggagagccgcagaatatgaatcgtgagaggccggccgacgcttttaacacaacacctgacaactgacgaacgacgcttcctgcacaaaagtacaagtcacctcgtgagacagtcacatgcgccgcgtgaggcaggtgcggtgtagggctggagtggtgcgctacggttgacggcaactgtattaacaacacggcaccacacgcggctgcagctacatcggccaagcatctgttaccacgtctgcagtatcagcctaagaagtgcatgcacggcttcagaaataagacacccgatgaagtcttcccgccactcttcgatcgttgacctgcgtgcacgttcttatgaatctacgtggaaatgaatgcaacgttgccttcagagttcagagaggccccacaaaacagcaattggaagtccaggaccgcactcagtccagagagccgggattctgaggaaccacatcaacgatcagaagccaccggctgaaagaaatattcactggaggataacagtgagcggacgcaccgctgacgctcggaccacctgaccgaggaacattcaggttcctcgacgtacctgacggttaagcaccgcagcgtgcagccttttatcgatcaacgggatgctcacggttcacaacttggagaaatgtgcgttggcagatgtcccccaacaccaacagcgctcctagacggaaaaatttaaacctcaagggatggccgagcaaaaacttgtcctgtgtttcctttcggacgacttaggcagggcggaagcgaaagacgacgtgctgagaggaggcgcagcttcaaaaagacagcgatatctcttcccctcgacataaaagccaccccggagatttcgttgttggcaaacagcaaagtccacaatggcacgaaagtttcgaaagaagggtcaactgcgaacccaagcatccgtcggtctcctaatgaagaggagacagcccaacagtcgcaaagtcgtccatcaccccgcctgcagtgacaggctgtcccggccggtgcggcaactgacggggcggcacttaaccgttgtgtttttcggtatataaggagaaaaaaaacgtgcatgcaggacagacgaacatgctcgaataggtcaaaagactccagtggataaacggtacgtgtatgttctctgcaaatgtcacgaattcataagcgagcctattccgaagatctgcttcactatgtcgccgcaaagcacgaaagaggcacacccttctgctccggagtcacttgtttaggctggcagcggctgtgttgattattgcatgtacatccggcaaatactgttgtacgcatttttgaaaacattgattgggaaaccaactgaatgcgcgaggatggctcggccttctcggtggcatggcctttcctgttcttagtttctttttctcgtcctggtggtaacgaaacagcaccacgtcgcaaaaattgtacgtcagggacgctggtcaactgctctcattgtgaaagtcgcggtaaaggccactccggatgggtaacttttactgggatctctttgcaagttgggatcctatcggcgggttattgcgactgacaaccaggggtgcctgaccgcagacacggcaaaacgaagggaattctgcctcaaaacgaagagttaaatcgacggtactggtgctgaagggttattcataagttctttcggcggagtatggatggacgaaaaaagaggccgaggctggtaccccgacgtgccggaatgctactatgaaaacgctcaccgtgtaccaagagcatccagtatgttggaaacaaagatacagctgtacacggcaggccgaatgtttcttaatgaaaatggtgacttctttagtacgcgactatgtgggactaatcaagcgtacattatgtactattcaggaaagccaaaagcaaatcttccgttcgaggtgtgcggcatatatatatatatatatatacatttatatgcatcgacttcgagccactgctgaaagctattgcaatctcgtcagttttgctcgctttgttttgtggaactggaatgatagatgcgaaatacagatcttatacagaaccgcctaacggtgcaaataagaacgaacaaagggttctgacgcagacaacggagcaaaaaaggcctgactttatgcagggcaggctttcctctcactgccaatcccccagattcacgtcagctgtaagtcaacgctttgtttggtatcacatttcatcgcgaactgcggattcaacaccagttgcgtagataggtgtgacatttgaagtagcttgcttgtatacttctgtttgtagagcctctacagaaagcagggtcgaaagtaatactgcagcgcccagagagcgactttgcttggcaaattgttgaacctcggaacgttgtctcgggactaatttacgaaaaacgagcataccgcacaggaagaccgagtacatgtgcagcaccaaaaccagcgaacccaaaccgtagttgcctttatgagtccgtgcatagaactcttctggaagtatatggatatcttgaaaatgcacgttaaaacactaatcgagcgcccagaaaagctgcagttggccagaaactgaccctcttgcattgaattgcagacaaaggtagtatgcattctccgggaactaaaatgggcgcgtaaaaacacttcattcgcgatgataagtatgggattacttcttactggcaatcggacggctcggggcgagttcttaagccttaactcttaaaacagaatctcgaacgacatcaaaaaaaactactgagcgtccctcattgggcaaccgaagagcagtgcaatcacggggtgtccaagaagctaagagtttccaacaaattaccaacacttgatgaccacaaaacctcgctctggttgtcacgaaaggagagatacctgttgaaaaagagctgtacaaacatgacgaattatgctcgtcctcggcactgtggaggcgctccgcctccagtcggaggcttgtccttgaaacagttggctatttctttcgcggccgcctgcttccgcattttatgagtcttttgattccttagcctgttcaactgctcctgtcgcatccttctctccgcggtagcattcctagcttgtgacgtatcgtttcccactgtgccacgctcgaaggcggccgccattttggtgaccttgggcccctgcttgcgcttttttttcgagtgcgcacaccccatcttgaaccggcccaatccacgtaccgacacgccttcgttttctcgaggatagggtacgtgtgtctaccaagaaggaacggctatacagtggagacaggccagaaaccgttagctgcaacggcagtcggcgaagcttgttcccacatcgaagataacagagggcggttatgttgtacacctcatgaaagagaagtgacgccacgcacacgtttttctcttgcccggcagaatcaacaccaaagtgtcttctgcaaagccaatcaggagcagcttttcttgcagcggacctaaaacatggagagacagcagtcgacgtggtggtgtcgagttcagggcctcggcacggacgccctcaggcttaacagccgcatagaatacatatcatgcaattggcctctccggacgggcggacacgcattttggtgcctccattatcgttttctctttgtagctcggcgtgcaaaaagatgtgcatgcgaacggtgagtggtagcgtgtgttgcttatacgaccttttcgcaacgggcagcgagctggaggggtgagtgcgctggctgaccgctgcacgatacatctcccaaacgcaaaatggagacgtatttgtgcatcgttgcaacccgggttgctgccactcgcggcaggtgccctcggtacttagatgaacagggggaagtgagtttctttacgccattttccggacacggtgttcgtgattttgggcatatgacacttttctggctataggtggcgccgactcaaacttcgctcctcgccgttgctgtcggacaggagacggctagagttgagcaagatttctgttgatgcagtactgcatcgagcggcacgtttcatgcctctgaaagtgtttgcgctcgccttcacagctgtttattggaggagaggaagcccaacattttacaggtgacatttagattttgacggtgaacgaacaagaagcgcctggagacgaggaattgaggcagcccgacgatgtgtggcctgccaaacgacgaa

SEQ ID NO: 1730 - DNA, 2839 bp, Toxoplasma gondii
cgtacgaaacgtctctgcagttctctctgtcgcgttggtcttcctgggcgttgaacaccgagcgttcctcccagaactctgaaatccctgcggcgccaggcagacgaggagagagagattctcgccgatagctttccgcgaaagaccgacaggcagacgcggcgacaaaagatgacctgggcgcgaggtagtgacaagccgtcgttgcgaacggcgcgtctgctggccccggagactccagtgtacatacaccgtggcctgcgactgcatgcgagggctcgacccatcgattcagcgaagcgggagagggcgggagcgcgcgagagcagacgacagaggccctgtggcttgctcgcgaactcggggggcattgtgcatgcgggcgacaatgcggtgcggggagagaaaaacgagacgaagagcgagttggggaagcactgttttcagagagacagtggtagtttgtagagaagcagcaagcatctcgcgcatctctgttgacgcacgaaaaggcctctctccggcgggagagagaagaagagaccgacatttcgagaggacgcagacacacacagacagcacagccggtcgcgagagtttctctgagctggcatcctccgcgacaacctgtgtccggcaactctttgacaggtgatcgagccctagactggcacggtaaacgacgaagagaagcgagcgcttctgtcgcgaaagcactggacgaggtgcgagttgaacacttcgatttctgccgtcgcgttgctttctgtgtgtacatctgtcgcgaagcacactacgactgggaggtaaagacagaggcgcgcggagaacaacgaagcaaaaaatctctcgaaaaaagcaaaaaagagaggcttgagtggtattcttgcacacgcgcgataacgacgacgatactttggggtagagaaagacgctaaaagccgcgagagaaaaggaacagatgcactgagtgaacctctatcggatgtcaagacagccaaacaaaccaaggaaacaaacggtggaccacgtttgacaagcatcaggagtcttggactttttatccgcaagacacgggaagcctcctccctttcaaaagccagacgatccgtcccccgggcggtttccttcttgctttcgacgaccctctgttggcgacgaacacgatggacgaaagagtggcaagaaacgcgtctttcactctcttcatccctcgcgaaagtcggtggacagctactgaaaaaaagagacggagtgcggaggaggacgctcgcgaccggcaaaggaagtctgtctctctgggacggcggaaacccaactagaaataaaaagaagaaacccgtctggggatgccaggcttagatggccgtggaaggttcccccttgttctgcagccgagaccctgtgccaggccggagttaaccggctgtgaggtccagcgctttacacgttgcagagacttggtgaaaagagagggactttcacacacagttgaatggcggggaaaacgcggcatctgcaccgcaccgaaagactttcggcaaacgctctcctcaacgatgcgcgctgccttcgtcgatagcgtgcgacgaaaggccagtgtcgcgtggaacagaagtctgcagccggaaaaactcttcgaaggggttcgacacactcgtgatagaagcatctgtgaaaaagagaaaagtctatagagaaacgagagggaatcgtgttcagacgtgacggaaggaggctgcacatgctcgagaggaaagacagcacggaaaagagggggggcgcttgccgtgtcttctgcgactgctcaagggcgggcaggaaaaaccacgccgttgcgactcggtcttcagaaggacgaaaaaatgtaagcagaggaacgaaaagcaagagttcctcccgtctgctgaagaagtatggccggtttctgtcaagaaaacccgcgaaaaaagtcaaagaaaagccgaagggcgctgccagcgagcgcagtggtcggtccgcatgttcggtctggacgccggtgtgtgatttacgaaaggtaccgcgcggcgccgttgcgaaaaaacttacgcggaggacgtgtgcaggggatttccagtgaaaaatgtcgtcgagagagtctcggtgaaagacctggctccgaatacaaatgccgttcgacagaacccctccgactgcttaggctggtcgtccgcaaacaaacctgccgcgaccctggattatcgggcacacgacaaacctatggagcaagacctaaactggggaattctgcgaggaattgaggtcaacagaactcgagaaaggatactgccaggtggatggacgcggacctttccaacattgacggcggggggggacacagccataatcatcactctcctgaggggtacggatctcgtcaccctctactaaaggaaagaccaaggttcggaagtcgttcgcccaagaactaacatgaccttgtcatgtgctttgtgtctgtgtaactcacaacgaagttaggactgtcgcaactcacattgtggattggtacaagcaagttactgtgtgcatcgtagagagccggtggttgcaagggtcatttagacgaaaacagcatatttgcagaacttttgagatgcagcctagaaaaggcagtgcgtatgcaaatgctggcctttcaaatataaactctcaagatctcctccgtatgaatacgggttcttcaccgttatcggggcttgccagtttgagtgaaagcgtcgcttgtgaacagcttgtaccgaagaggcgaatcatggcatactccggtcaaaagagtagcattcactgcacggctacttcaggtgaaacgggagca

SEQ ID NO: 1731 - DNA, 1476 bp, Toxoplasma gondii
aaaaaggcgaaagatccaggcaaactctgcattctccgtccttcttgaatttacctggtgctggaacttaccccggcgaagcgtcgtgtcgtgcattttggcgacaggatggggagcgagcagacggaagggaacagaactgaagacgacggaaggtgtctatagaccccaacaaacagtttagcagtccgagactttgaccaggaacgtgaaggttcgcaaatcctcagcgggggctccagaaagagtaatgctgagagtggcttgtcgcagtgaagcgcgacacctgaacgcaccctggagttctcgcccggtgagactcggactggggtagtaacagatacgaagctctcgatggaaacggtttgggaacaaagcaaagtttgtcgacgcgcgccgactgcggcgacaatgtgtaaaaaagatagagaagtcaagactgccgaggggttctgcgaaaacggaaaagaaagtgaggctctcagaactccgtggacgtcctcgtcgcggcggactttgttgaaggagcgacgctaaaccaggaagttttctcagaggcgatcaacagttgagactcgaaaaacgcaaattcctcatgtgcaaacgaaatactgagcagatgtgaaaggcctgttctgtctgcggctagggaaagacgagggcacgggtgagcagttgtattgacacaaatccgtcttctgctcagcaaaccaacaagcaaaagaagacgacgcacacagagaaaagtgctattttgtacgcgggaaagatagtcagctgaaacaggcaagcggagcttgcaagcgcgggtggacagaaaggcttttttcactgcgaaaacagaaggttcgcgtgcggaaaaacacagagggcaacgaagaaagtgaccagccaaatgcaactccaaaccacagaacttccagttttagctcctaggcagaaagacgagagacaagcgaaagccttggggttcgaaaatcaattaataaaacacgctagtcctcgcgctgttcgaccctctcttcagaaagcaaggaacaggatctcgtccgccaagaagccgctttttctccacgtcgctacgaaacgctgtacacataaatgtgcggcatgcatgtggcatgtgcttttctttttggctttctaccgcgacaaccgccttccttcgctcacgactctgtgagcggccgtggacttttttaacctcagctcgcctaaagaaaacacaagttcggcatatattcggagtcttcgcgtcgcagcacacaacaaaagaccctcggcattgtgtctcggggctgtgtagccgtccggctaatatggtgaagctttagggccggctgcgagaagttaagatcgtcgtctggtttctggtgcccgtgtatttgtggggcagcgcctcgccgtgcatgttttgctgtgctttctttctttctcacttttttctccaaaaagtctgaaaaagaaagataaaaa

SEQ ID NO: 1732 - DNA, 2501 bp, Toxoplasma gondii
atgaaccgtcccggaacagctggtggtttcgccggtttcctgctttcttctcaggctctgcgaagactcgattacttcccccttccccccgtcaacctcccggcaaatgtcggcgcctcgttgcacccgcctccacccctgacaatgaagattgtcggttcgcatggcttttctcactgtcatgagaacattccagtgaaagagtcgaaccccctgacaggcgaaacgagtgctccacgccttgaagacgaatggtgcgactatacagattcagaaaacgtttgatcctggctggcgatgaaattcgtggagctgaaaagcggggacagaagcgggcgagggggaaggaagggcggcgccagtgtgaaggtcggatctttcgacacacacttccacaacttaacttgcagtaactctcaattttcataagactatcaaacacaagggaagcaaatttgaaatacccaacagcaaaaagggaattctgtgtttaaaaaccctcagcgaatcttggcgaccatgaactgtctcacgaagacttagcgaacagcagtagaactctcgacgttccaacagtcgcagcaggaatcacaaatcggaatcaagtaggagcctgctatgctccgaaattgaacttctccacttttgtcgggtggccgtgtattcactgccttaaccacggcagttgctccgcttttccttctctcgcgctggcgtgaaactaacggggctgttgctttgttcgaccatggaatcacgcagccgagtacaatggcttacttgtcaaacactctttatggcactgagaaccacactgcgccggatacggcccacactacgatagagaggcatacctgtagtccgcaagctagaccgttggagtttggaaagcggaccacatacacggagtcgaatgtggtggcagcaccacgcagatgctttcacttttttgtggtcaagcattgtgttgtgtggccacgtgtgtcgctctttgtagatgtggcgcgtccgtgcagaggcgactggtgcgggcggcgaacacgctagccgtgacattttttccttcgttttgtgtgtctactgatcgatgagctctaagtcttcactaccatgacgcgtgtgtccaaagcaaatgtgtactccttgtgtccgcggtgacgctacgtgttgtcaaagctgcttcccgtctctggatccatcctcggtgacattccgatgctcgtggttgcccactggagttacagagcgcagcgccatatcttaccacgcttctcaaatcatcggcatgatttctcccggactgtccaaatttgttacccagatggcacatgcgcttcgaaaggagtagatattttaagtgcatcatacaagggttatcaatttctgtatcatgcagaaacgactacacaacataaagggtgatccgtagatatcgaagggatctgctggacattatactctcaacacgtatcgatgatgtatcatgctaacctgtagctcctgttggagcgctcatacagcgacaggctaacgcgggatgctgccgcctccgtgtcaacatcctgcgactggacctggtctgccatgatgttgcttctacaacataaaatgtgttactggtgcttactcctcgtttttaattacacggtgaacggagctgtgttctactttataagagatgtgaatcaagttccccttacctcttcttgccctcctgcctctcactgtacgcgatgtcgagtttctgcacacggcgatccgtcacatccgaatgctggcggcactgcgggaaaaaaaagcgtaaacgcagcgtggaatgtagtgcggacttgtgtcactgtgatgcaacaactccataaatctcgcttttcaggaatcgaaaatggagactcgtgtctgcttctgttgatggtgtcgacgacgaacgctggccagctcaccgtttcttgttgtgtctggccaaccgagtgagcagcccagaatgcatgcaaaactgtcccgaaactcagagaacctcgaacatactattcacatttagagctggtttgacgaatgcttttcacatcgcaacttacctgctggactgtttcagttgtgtgtgtggtcttcagctggcactcggttagctacagttttcgactgccgaaggatcttcatcggagggtcctgtaaacgctcgcggagaacctttgttccatctggtcagcttggaagtaggactcttcctattgacttagtggtttgttttggccgtaaccgtgtaatctggaaccaaaaacgtgcaaggactgcggacgttaggagccctgctactcaaaaaattcatgacgcgttgaattcgtcaggcatctcggatgtcttgagagtgaccggcttgaaatcttcttgcccgcggaggatcgtctgcctctgacttactggcaggttctaacgcctccctggggcttagaaaggaaagtccctatcaaagcgcaaacggggcacaggcttgtccacgacca

SEQ ID NO: 1733 - DNA, 4573 bp, Toxoplasma gondii
cataaacgagcgcgctaacatgcgtttcctgaggtcgatttctgtcgacgcgttttctcgtgtagtctgtgtgtgcacagctcttcgttctgtgacgcattaaggagactagcctttgcatgccttttgtgaatgctgtggcggttatcatctgagagggtacgcatggacggcttttctttttttcgcttcgcaagagtctgacctcgacacggtctccgacttgtttcgaccacgtgacgactttgccctccttcatcgtgctggagagcgcaggcatcgagatttcctggacagctccgcggaggcttgagcccacagctgtctcctgtctcctgactgtcccctcagccgcgcagaggagcgacgacgtgagcctcgatccacatcttcgctcccgagtctgaagagaagaccccgccgacagaggtctctgtcctgcgttcgtcgaggaaacagaagacgctgaggatgcagaaggagacgcgaagaaacgggggcgcgtggagtggacgccagagccggaagagacagctggagcgacaaacgcgggcgccgaggagcctgagaaggaggtagaggaagccgaaggagcgggcgaggaagaggggacgagctggagcccaaaggcagaggagacggccgctaggaagagagagacatggacgagaataccgggtgaaggcagcgccatcttggagaggagagcggtgcgcaagtgagaagaagaagcgcgcgcgtctaagagacagatctcaaggtgagggaacagaggaggagatcctaggttgacttggccaaaaagaaaagactcagctgcctgctctgtgtaggatatagccttcctcgtcaatgcggtttattcgaatgcacaatctcgaggtgagaatgaaacagagagaggttgccttttgcagaagcgaaggtcgcgaggacttttctcgcttcctccgaagcggtttttctcctcgtttgtttcgtcctcgtccagttctccgctgtgcctccgtcctgctctcacaactagaaatgtctgaagcttcgtcgcagggtcttctcgctgtgtttgcgagcgcactgaagtgtcaccgcaaaacgccgcagaaaacgaatggtgtgcgctgagagaatggacctcaatttttcctcaatttttgggctgcttgtgtgcagcggcacagaggaacggacggaaacggcgttttttccccgcaagcacatcggccgagaagcgacccaagacgaacggtgagagaagggcagcgcgagaaaaggagacagcaggagacaaaaggagaccgacgaaggagacggcgtgaactcggggcagaaagagggccgaaaggtgaagaaagagtcgaggcacgagaggcgatcaagggcagaaaggcagacaacgcgagagacaaagacagacgcgcacagagagacggtgacagatgaagaggaaacgcaagcacgaagacagaaagaaaaaggagcgtggcggtgcgaacacacactcagcgagacttattcaacgagccaagacgaccggaccgaccggggccaatccagaacgggagacaggacgaaaagagccggggaaaggatgcagacgagaagaaagaacggggactcacgacgttgtttgactctgcaagaagacacacacgtaacaaccgtcgacgggagaaacaagcgaggcggaacatgagaacccgcttgtctcttctgcatgctctcacctctcagtcgccggtgtctccggtgttcgctccgtcagacgcgggtggctcggagacaggcccatggcgccagtctcccgaagtctctgaagacggaggaaacacgatattcctgcgaaagaaaaaaaacacagagggaaaacgaaggatcctggagggacaaagtgaagggcactacacagggaaagcacctggagagaacaagacaatacgtcaccgctgtcacacagccgcgccgttaacaggggagggggggggtacgcacccgtcacgaaaatgatcgagtttgtaaccatattattggatcttcacgctcttgaaagtgcagatggggagtcatctttgtaacttacaccagtagaagcatttcaggtgattttgtggagcagaacttacagcaaatcgaagcagacgttgaacactgcgtttgaattatgagcggacatccccgaagactgaaacgcggctggccccagttgcctctctctccttcctctctttgtgtgtgaggcacaggaatctcactcgctcttttcttcctctttcgggtcgttcctcgatagtctcgtttttatgtctcttctgtctctcttttcctctctgtctcccctgtccctctttttctcctcaccatttctgtctcttcttctttctgctgttttctctcttcttctcctcacttcttctgttctctcttcctgctgtctcaggcgctgtctcttttctcaggcgtggctaggcgagggagagcagagggcgacaagagaggccgagactggcagtgcgaatgaggaagaaacaaacgaaaggagcaacgctcttgactcgctctctctagctcagtaccgctggaggtttaccatgctcaccaagtggccaaagcgttttttggaagagcaggcagcccacagcagaggtcacacaaggatcctacgtagctcggaacccttcacaagtagctgcccataactaacagagcataaaaatatgtccgtaggtacaccgcgtggtaaggaggccgaatttcaacctcgaacactctcttcttcccgctatatcccttgttctgcgtttcactgtccgtcacattctcggcctctgtgcctctatcgtgaagtccgcttcccccctatcctctcgttgcttttggattttcactctctcgagttttcgctaaaacgcttttctgttccggcgtcttgctccgttcgcaaactacttctctctattgtcgtgtctccattgggaatctcgttgctcgtctgtatttctgtattagccgtttctttcttttgctgtgccacacgggctgcaagtgataaaagccagcgttccacatccatgcgggacagtgaaactctttttcatgccgccttctcggcgtctaagctccacgaaagaatgcaccacgattcgagatgaagaaacgaatcttagactctgaaaagcttgccacgtcgacgacctcacctgtggaatggcagacacactgcgagtgtaaaagcagcaatgaacttgtccctgccagtgacgcttaaggcgagttattgccgcttggcatagatacagatgcacatccagcatgcatttgtatgcatgtagttttgaaagtatatatatgtaattatatatatatatatatagagagagagagagagaccacacgtctggggaaactcctactttacacatttcaagattggcggcgtttctctcgctttcgcccacgagaaaacacgctggcgctgtccgcagagactacacaactacacttgtatctacgcatctgtatatctctgagcagatgctttttacagtggtatttgcctcagagattccccagtgttgaattgcacgcacggacgagaagcttgaataaccgagcacccgcgttagtcataaatccgctcgtctgtccagaatgttgaggtgctatgctcgtgtggacagagcaagagcaacgagttgacaggacacatttaatacatcagacaccgtgtatgcgtcgaaatcgcagacgctggcagagacgtcgccgtcaggaacatgaaaacaaggtagctagcgtattttatacgcgtctgtagtaccgggcatttgcatcttttaggacgatttccgtttccaagaaaataatggagtacctgaccaccatatccttcctgagtctcgtgtcttgtctcgtgttgcatgcagtaaagacattgagaaaaagctcgagactgagccggaggcaaacaaaggaaaatcgacttgagggatcgagaggctgcgctttgctccttctcgcgttttctctttcttcccttctctttcttcctctccttcagcttcacttcttcttacctcttcgtttgtggaccggcgcggaaaacgacgatcttggcccacacgccgctccttcttccacacctttgcgctcttggtgggagaggggggggggggcggccttctcgccagagcgagaacagagacagaacgagaacaatttttcttctcctttcgtcgatctacactgttttacctcgaagaggggtaaggacaattgcggaacttcggtttctttcgtgctgcgaattctacagacgcgattctccgttcaggtggtcagcgagtgaccgcgtccacgaaggagacagaaaactttcacgtggatttctccctttttctttttattgattcgctctgtctctgacactaccctgctgtatcgacgctttccgactctccgctcgtcttcgtttccgggccaccgtacaaattgcatgcgacccaggaatcgcatctttcagcctcaacagcttttctccctttatcgattatcgggagaagacagaagagcgaga

SEQ ID NO: 1734 - DNA, 4789 bp, Toxoplasma gondii
ccagggaatcgctccggctcataatcgacgtgcaactctctcagagccgcgagagcatgcagagaaattggactagagaaggtgtagctaccaaggatgtttgacactcggaaccgagtcatcgatactttgtactttgttaatggatggcgctgcagccgcctcgcgatcttcttcatcgttcgccggagctcctccactgaatttgcgcctgttcccatcatctttccgttactggagacacaacagaacagcaagagaacacagagcaaaccctatgaacggggtagctttcgcagaactatactgacgtagtcacgcagcaaacgctcctacagagcatgtacttacgcctgaatcaaggagctgtcagactcacgcagaacgcagcaagtgcggcactctctgcgtaaagtttacggaggaacaagactttcttcacacccgacagaatacgctgcagtatgtctgttctagtcgaccctcccctgtatgtgcgtggagcgtgattcaggcgtccatttgagaagcgtttctgaattttcgaacttcgatgtagccaggggcgcgagttcaccaacaggtgcaggggctcgaccacactcagtgcgacagagcaaacagccagttcagaaaagtctcgtgtgttggggacagtgcagttcagtatcagaagagtggtgcggtaccacctgaggcatacatccgtaggtgaagagtttctggtccctgtcctacctgaaaatgttgatggaagcaatgcagtttgttcggcatcggacatccacacggacactgtgaaattcctcaggattgtatacggaatttcctagagcgcggcatgcaacgtccagatcgatgttgcagttcagctggcagaaagccatgacgttgtggacgaaaaggacgcccacttcgccttcctcctcttcttgcacaggagggttggatgtcccttcatcaatgaggccttctctctcggcgattaattcgcggttctcctcgtcctccgtcgccgaccacccgcccagccccgtgggtgcgggtgcgtgcacaaacggtgcagctccgcggtgctgacgagtggtcgccatgaatagtaattctatgaagggacgacgcagagatgcgcctccgggaggaagtcctgaggagcgagtgaagtgtgaggtgccttgcacaaaccgtcggaaggatggaatggcatggtcactcctcaggcgacaagggattcacgaatcagcacgtcgcgcggtgtctcgtatccagagccaaaatgagaacctatgttttgcgatcatgaaccgacaaaacgacgacgaatagatggaaagctaaaaaaaacggccgcatgcataggagcagcagccgaaacgaagaagcggcatctgatgagccacaaggcgggattcggtgcacatacgctctgactagaccgctagaaccggcctccaactaggcgtcttgtggcgacaaacacgcgccagacaaaacacagctgaaacgcgacattcgtgagtccaattacggcacatcttgaagcgggcaacgaaggcgaaatatctacactcgattaagacgatgtagctgcacgtggcgacccgcccggttgcacacgttcccgacgcaaccacggtcccccctcacaacagatctgcttttgcgttgtaaccatttgcagcatatgaaaaggaattatgtggcacttcaaattccgccatgcaacttggtcctcacacgcccgctctttctcggaccccctggtagggttcagcttcttgaacacaagcgcatgcaggtaacagttcgaagcggtgatgacgcggaagctttttcgtcatgtgttttttaatatgacaccgctttcagttcaaacgtgtgtttctttcatttcagggggtggctaaccaaggaaatgcaacgtcacactgcacgtgttagcgtcgtgtgctactgcctcaccggacagccacacgtctcatgattactgttcgctgaaacacgcaacaatacgcggagagtaagggctgacaaacagacaagaaaacatcatgcttctcttctctccttcctcctcatcacctttgcattttttctcgtaaaagtcttcacagacctccatgtttcgtcttttagagactgtctgcagcaaagggggttcgaatcccgacgcactcgttcttcttcaaatggcgggcttttgagctgcggctgcttccacgaccttatcagtccgtcactaccgttccgcttgacacactgctcggcgaggctcaaagtcaaaacttcgaaacgggggttgttatctcacggtttgatggggatcctccacgagaagctgctgcgcgtaactccgtggcactggttgaaatgccagtgcagcattcatttaccgaaaagcgtaggtgctagtggcagagatttcactatcgaaccccgttgtgacaccacttggagtaagcgccgtgtggactttggcggcctttgcgactacgcttgccataaacatgcctgccacaggaagtgacacaggttcgatggccgaagaggtgctggcttctacagggtcgaagagtgtggcaggggtggttattcggcaacagatctagaaaagctgaaggcttttgtttgtgcatcttttgccctttcgttgccttcgctcactcggagagttggaaaattttcaccctagaaccacgactcggggttgtctagagactttgaggccggatacaaaggcatctaaacatcggagcggacggaagttgaatgcatcgctttgcagagctgtaacttttgttatataaagtccacgtctgccacaggttgtcagggctgctgcttgtgttcttgaatagttctgcaaaaggtcgcagagagctaattcgcaggacagttaacagcaatgtcatgcctcctttattcgtcgtaaacccgttccctctgaatctgtaaacagtatccatctatacaataaataggtaaaatccccgtttaccatccggcgttgcgaaaaagagcagctagtaaatcgtctctttccgtcgttccagaataaagaaaggactccttgtgttgccaccaaaatctccgcatagcaggacatttgctgatgagtagagtggagcggatttttgccgcgtttcccataagccttctctatgaacaacatggctgggacacttttgcaatcttaggcatgcggaagggttcttgcacgcatctgcatctaagaacttgtgcagagatgcacctgcttccgagtttttccaaatcagggtgccgcggaagcatgcgatccccacgctagcaaagaaatcacttcgtatgaagtttatcgattaccattgcctaaactgaacacgagcggtaccatgcgtttagattcaaaatcaaccctgaaagtatttatacatgaagtttgtttcccctgctaaggaaactctgagatcttgcaggaaactggggaataatttgtggacacaaactcggaacctgagaagtgcttcccgcagtcacttccgactgaattggctgtgagcctgtggaacacaaccgcgacttgctgtttctccgccttcgacgattctcggacacgatgcagttacacattcctttcgaaatcggtatgattcctttgtgagctgaaggcgcttctagctaggcaatgtgtgaggctttgcccttactgggcgaggatctcggaaccctgtaacagtccaaatgatgcttctcttgagaaacaggaaataattggagaactaagcccgttctttcaccccgtacatacctgtttcttcttttgcacaaagcgatatatcggggatcgtcgatcatttaaacgcaaaaacacccttaacggctttttcgtgcagggactcattcagtgcacaaaggagggtacaaggcaaagaactggctcggtagtcgaaggaactgatgaaccacgtgtgcagtaaaaaacggagacacccccatttatttttcactaagactgcatcgtcaccgatgaatttaccaattttcttaacatacacgcactcttccccagacgttgctatcgatgttgcctgactctcacaagatgacacaagcgtttcagtgcatgcacgcgttaatagaacacgtaggcgagtcgataccaagacaattcagctggttttgtctccttactcgaggaatctcctttctctttcgtatttgacttaaccgacgtcttgaaaaagttccatcttccacatgttccgtactggtgcgcttgtatctttggtgttggtcttgtggcgccagagccggccaacctccccgccagctgtgatatttcgtcgaggaaaagctcccggtgtatgcactgctaaagccacgttgattttcaattaataaatccggcagtctccttttcaaaaatgtcgcgtgaacgtttctgcagaagctttgccaaggcaggtccgatgttaccctggcaaagagggcgacgagaagctgggatctttcgctcgttgtgaaccgactatctaaatcgtttctgcttaacgcttctgatgtttactcatttccctccactgtttgacaaccccgttcttcgatgtgaaatgctcttatcagttgggtctcgcgacctctaagaacttgttgcttttcccctcctggtggtctgtaccacaaaacgcgcagttccaaccggagtgcgccttgcaaggctcttgctctcgcttcctgaaccaacagaaagaattaccgatctggtttagaactcagcgttgcctcagattctttgccggggtgaaca

SEQ ID NO: 1735 - DNA, 1407 bp, Toxoplasma gondii
ggtcgaaagcgaaaaggcaggcgtgggcaaggactcaaacagttcccccaaccggggcatcgggacttctcccgagtcctcttggcagttctcagagccggaggcaaaggccctgccgagcgcctggctagtcccgtcgctttctgtctcgtgcacgcgtgcctctccgttctttcctctctcttctctcccttcttggtttgttttctccttcggctcgagaagctcttcctcggatccgctcgctgcatgcaaaggccgccacagaggcgcccggcagcccagagaagaagacaggaggtgagcgccagacggtgggagcgaagatgaggccccaagaggagtggagaaactttctggggagctcccgacgacggggacaggcgcgaacctcccgttggaggaattcgacgccttcggcgcctccagtgaacatgcaggtaaccccatactcgctggcgggcaaaactccttcctccccttttcctttctgcttccttctcttgtcgttttctctcttttttcttcctttcgcgctctcactgcttgcctttcctttttgcttctcttgccttctctccccttgcttgtctcttcttgcttcaccgctccctctctcttcttgtatactctcccgtctctttctctctccctgatttctctcgccttctctttctctgtcctccttctctcctcctcgtctctctctcggtgtgtagatgctcgtggaggagcgcgggtgcacggtccagcggcacgagcgaaggactggaggagaacagtcgcggcacgggagaacgcggagtgagacgcagcgagttcttgtgtaccacaggccctgcgttgggatgtttgccttctctcctgaagaaaaggcgtgatgacctcttagttgagagcgaagggagaacgcaggagacttggcctgtgttttcatctcccctaaacccccgtcgtgatctcgcgagagaagtccaccagaagacgaggtctccacttcttctttctcgtctaacgcgttttctccctgcgactctaagccactgtttctacgcccggaactctgaagacaagaagcagagcagaagggggcaagatcgacggcgaatacttgacaggttcgagcggaatccttgtagcgcgcgccaccgcgagtcacgagctgtaggccattcctgttcgggcaacaagctcaagtcgcagagacgaaactcctcgactgaaccagcaagggaggagacagagacaaacatgcgttcagttcaaccagccagccccatgtttagactgtaggggggggggaacatgtccagcgtgtgaaacaggcgcagccttaacgcgtctcagtcgccgcgtcggcgcggtgtcacaatgtcgaaaacgaaggcaacagagagaaggtcttga

SEQ ID NO: 1736 - DNA, 1022 bp, Toxoplasma gondii
gtagagatgtgtgtagaggcgtggtgaagtgtgtgttttgtctttggagaaacttcgtcaatgggtttaaagagttgggggcaacctttgggatgatctcagccgacgctttcgcagttgtggctcgagggtggcgagaaaagggtctcgtagctgttcgagagaatatcgagaagtgagaattccccactttagaaagtccaagcggaaaaaggtgctcgttgtactccacagcagaagcctccggagaaaagacctttcgcctcacggaggtgttgccatgacattttattgctggggtttcgcttcgatggaagaagaggagggcaactttcgtcgtgattcttttcctgggagcagtgtcttctgtcaaaaaagaaggcatccctcggatcccagagggagagaaagagacgccttctgctgccttcccgtgtctccgctcctgactcatccgtttggaagacatgtgctcgccatacaaatcgttatgtctgtgtagtcgcgcctgcgacctctcttcatcttgctgtctcttttggcgctcgtaccatgcgcagcggtacggtttacaccaaaatttaacacgtacagtgatacgtacgttttatcgctactctactacaagagtccaagtacatcgatgtatttgttgtatatatctatctgcgcatcaaatacatatatatatatatatatacatatatatctatgttagtgcgtgcatgtgtgtctctctccacgcagatggtggcagctccgaagtttccgggaagcctcgaaatgagaggcagagagaacgttttgattccgtgcatattttttttcgacggggcacctctctctctcgacaaaaggacggggatgtgcgtcgctttgaatcgctttttcaagattgcgtttggaaagaaaagcataaatgcctctgtgctgtgtagggtatatatgtccgttgacacggtaattcgacagaggcatgggcgtccatgggagtcgctttgctggagcaagttgaaagaaca

SEQ ID NO: 1737 - DNA, 4526 bp, Toxoplasma gondii
atagaagcgtaaatctatcgatgagctgtcggctgtatgaacctcctccgaaacgccactgaagcgaaaaataagagtttgtgtcttttgcagggtgtgagtttgatattgcacatgaactgcagtcagatttttacggaacccaattccactgatcaggtggtgaccttgactccaccttttgtttgtcgacagctgcccttgaacagatagggggggtgcttcgttgcgtaatgtacggcgtgcgagggacttaccttcgctaatagggtacttgtgttaacggcgctctcaacgtatgctgcacaaaatgtagctcatgtgctcgtaatccaattgtttgtcttaactactcggagaagatagtgttgaaagtccatcggattcacgcaggcgtaactctccgtttgacactcctggtgtttttgtggagaatgaccctctgaaagtgatcgtcttggcgtatgtggtatcattcgtgcttttgggtgcagtgtcgattctcagcatgaaggaagtaccccggtgctcttggaaaccttcagtgatgcctcggtttccgtggctccttgagtgctggcccgttcaaaagacgcgtgacaacacgtttcaaagagaaacacgtgggtatacatctggagatttaagaggcagcagagatgtcgttctaatgtgtcgacatccacgataaactgccatgcctcttccaaatgaaactaaaagctgttcctagcctccatgtgtgtcgttagcttctgttgtaggaactgttgtggcacaccatggccgaaattcacacaacaccatattccgcagatgttatttccgttgccgcacgtctctgaaacgcaagacgggtcatccaacacgctcgtggaatcgtgctccggctttctgaggccatagcgaagactcctacagccagtacacgggcaacgtgcgtaggtgactgtgtctgccagacccgctgcttcacccggctcatcattataaaggctctgccagctagtgttttcgaaaaatacttccagtgactatgactgaacgcactgatcagaagagacttaaagcaggatcaagttctgagcacccactccattatttttccgttcatcaactacgcaaacagatcagttttccagtttatgttcccgcgcgtggcgctctagtcccccaacgaaactgaagttcatggtgccttcagtggggaaacgctgcttttccacttatgatacatcctcaaaatacatggcagtgcttatgtgggaaacaacttagctcacagatccatccacattctgtggcaaagacaggcacaggccgcgctcgagaaaaccactggttccgctggacaagccggtcggtccacagaatcgctggaccgtgcaacttgactcgtcgctgcgcagtacgtcgtggtgtgcatttcctacatcgaaaagattgttgagcccatgtggcctttgcgcttgctcgcaagtttttgcagtctgtccttgtggttagcgtatggcttgctactggcggctctcgcaagtgtctacgttacattccctcatgcattccagcgacactggctttcagaacgcggtcttagtacgtgtatctgccattaatgcaacaacttgaggtggtcacagtaattctcaccggatgattgctatcatgaaccaccgctgttttttgagaagtccgcgtgcgtgtggcgggttcaccctcctctagcacagcggcatccggtggcgattccgggtatggggaatctacccacgttgcccatcgaaggtacacggactcaagcatttccagtgtatagctattgctttttcttgtgacgcagttcatttttgaaccccttcagctacgtctagacatggtcgatgttgacggagaacttgtcaaggtggaggagacgaggaggaaggtggagaaagaattggaggagatcagggatttggagaaacgaattcgaaacaggcaattagagtattcagaacgacagaaaaagtcggaagatgacaaaaacttgaacgagacaaggacgaatcgtggtagacttctggcagacgctttaagtctgtacgaaggcggcgacttgagatttgatcagagccttctgattgatgcgttcagagattcggagatacaaatttcacaaagtgccatcagcaacctcttccggtggttggagaggacagatatcaacaacgatgaagacgcgaaggacgtgaacttgcaacttttgagagcaaccttagcggttatgagtggcctccgaaagcacaaatgggtggaactggtggagttgcacaaacaggtttgtgattcgttaccagcccgagatgacagtgggaaagaacccacggagaaacgaaatcgactcttgaaccatatcgatgattaccttgttatgctggagcgattgcgacgcttacattggaaggaggtcgaatatctggataatttcggcttgcagctgcagaggggagctttctctcttgacaaagcgctgcaggactacatgcacacgacactgctcaaccgcggaaagacatatagtggtcggtacggatttcacaaccggagtatttcgaccttggatcagctccgtcggtactacgtcgatcttcgagcgagtcagcacactaaaacgaatgtgagactctgggaggacctgcgaattgtgctttcagcgtacgacgggtacaaagctttcacctacgtgtcggagctggaaggtggcgtagccgctgggttgtggcctgtgcatgcgctgccactcttcttgtactaaagctgcgagaatgtagatgatgcttttcactgggcagctgtggagtgctgtcgcaccgctctgtggcctctccatgtgaaagggcgtatgccagttggtagaattcatccggtatatgttcgacatttgctgactaacttaacttgcgtgtcgacaaagggttcgcatttagaccaaggtacacgtgcagtatgtgccagagccgctgaaaatgtgaggcccctgtagatttcactacgctttgtactttacttcggatatccctaccgactctgcagcttacggaaggattcggaagattttaatgccttccacgatgttttcatgcaccactacgggacgacctgctgcattgatacgccagatgtgcgtatgcagaaccactaataatcaacaaacacgtgaaatcggtagggcccggaagacgaagcctcgctgaagacttccgaagactgttgtacaccgtgcaatagaccttcatcggcagagttataccttcgcagaagttatgggacaatcgcgtggggcgtaacatgcctgctcgctgaatcgatatatggggacggtcatagaggaggacgttgctgcatacatctaaagacgtgataactacacagtagaaggaaatttatcatttatgccaaacaagaaatcacattcatccgcaactgtaagctttcacgcgactccacaggcggcccttcagttaccgcacaccagaactatcagctcgtcgccccgaccacggctggaacggcgggttaatcttttcatactcaatctggaagcgtgagcgtcgtccaagttccgggagggacgagctgccaatttcgcggcgtccactgaacagcttcgacttatcgctcaatgtcggatattgcagtgatcttcctcccgaagtgtgttttgacaaccacacaggaaacgaagtgacgtcaagcaacacgcatcagccaaccgcctggcgacagcctttaggtatagccgtacttctagttcgctctgcagcccccgcacggttcccacatcttccagaaaaaacggtacagtggcctgttactgtcacaggaacatctactgggaggtccatacgacgtaacgaaccggttgcgccgtggcgaccgtcccaccacgcgaggagtggtggcgtagcgctttagagacactggtacgttaactggccgtttttatcggcttccggtgtgcgtctcggtacaataaggtcccgagcagttttcgtctatattcgcctgctgaactctagaaaagctatagcttgtgttggatgcagaatgttcttacgtagcttcgacgatttccaatatagtgggtgcagggagcttcaggtgaattggaaagtgctgtcacactcctcatgatacattaccgtggcgtgttccaagccagtgcattttatgagtccacagttgacgcgctagtatatatgagctaatgaagaggatcaacagtctgaagggattccaagttcccttggacttgatgtggtcgggagcttcgtttatcggtgatatacgtatgggcttcggctgtgggtgccaaagcgcgtaacagctagtgatcgtcactgaatgaaaacccccagctgcgttgtggagtgcatatgcgtctgactttgaaattgacagaattgtctcgcctcacgcgcggcaggattgtggagaaacggatgccagaaggtcctatcagctgggtgaagaattgtgaggcacga

SEQ ID NO: 1738 - DNA, 4963 bp, Toxoplasma gondii
atggccgtcgaatacagcgaagagagcgagctttacgtctccggtttcgacgtcctccggaatcgcgtcttcctcctccgcgatccccttctcctcctcgcctgcagacgaccggcgcctccggcggaagcttctgcgcgcggcgcctcctcgacagactccgttcttacgtttctcttcctcttctcctctgaagacagccttctcctcctcctcagcgttcacctccactgaggctccgacaggaatgccgcccacagttccgctggagcgtctctgggcgcgaccgagtcgcttcaccatcgtcgcctcgccccactggaagtagatcttctcgtcgggccccaccgccagggcgctggagcccagaaggcccgaagcggaggcggaggcgcccgtggggccttcggcggaggggctccggggctgggaggcgcgcgagctggcgcggacgggcgactccgcgggtgtctccgtttcgggcccgaggcgcttggggcccgaagaggcgcgcgggggcgactccgcgggtgtctccgcttcgagcccgaggcgcttggggcccgaagagtcgcggacgggcgcttcgcggtcggcgccgagggaggcttgggcgagacgagggcaagtcttcgcgtagagaaccaagtgcgagtcctccatgctgacgcgccagccctgcatgctgcatgtgctccatcggagattcatcgctgtacacacaccactcgtcgtctccttcgaggagtccgcagcggacaagtacgcccccatcttcagtgcaagaagagatctggaggagagaccgactcaacttctgcgggagaaacgcgacctcaggcgagaccagactccagcagaggcagacaccgcgcgagcaacagagcagaaaagagaaagaaagagagaaaagagaagaggaggagaagagaaaagagaagaggaagagaagagaaagagaagaggaagagaagaagaaagcgaggatcgacttcgtggcgtctgttgtctctgcgatccgcctcgagcgcatctccgttgcagacacacccgtgcgagatgagcgcgagaagatgcgtcagaactcgttcttccctgaagtcccgatccacttcagaaaaaagaacagcaggtgaaaggccagacgttcccgcagcctcgcgctgacgcttcggtgtacgtacacacgaggcggtgtgttcaacgcactcacggccacagacgacgcttctcggtgcgtctttgcgagagacacgagagacggacaggaaagaaaggagtacggaagaccgagagagaacgaagaaaaaggaaaggacggtcctcacggcttccctggggaacgcccccgaggtcggccctgtctcccgtcgtccatcgatgcgacaggaagcagccgaacctgaacaaagcagaggaaacggggacggagacgaccagagaagagaagcgcggaaggagaccaagaaaaacgcagaagcacagagggggaggaggtccggcaagacgtctggcagctcagaggaagaaagcagagacgaacaaaactttctttccttcgtactcgcgaaaggaaaaagacggatgctcctccctcgcatccaactggccaccaagaagcagcagcgcagagagcagacacgccgcaggacgcgaaaaaacgcgcagagaaacgaacgactgcacggaggaaactagatcaggagacgaagcgagggaaacaagagagaaagcagtcgaaacagagaggagagcaaggcgagagcccagaaatcaaagaaagagacgggagttcgcagagaagtccgcgccccaccgggaagagcaaacgcagctggctttttctgtctggcacctcacagttttgccacaaaacgaggaaggaggcctgagagtctcgggggaaaaagaactcaatgggcaagagcgattccgcccacgaaaacgagaaacgcgcttgctcgcagacggcgcaggtgcgcggggcgttgcgtcgtgtcgtctcgagtgacttggctgcaggtcgacttcctcgaaattcaagttccaacgacgcagcgagaaccgtgcgcttttgaaaaagaaaacgcgagaaaaaaaaggcacacaaagagcgcgagaaacggaggcgaacaaagactcaacagcgtctcccaggggaaaacacggttggagtgtacagacaccgcgtcaaggcaggccgcccgcctcagttgcgcctgtggctcgcgaaagcagctttttcgcgagagaagacgcgcgagactcgccagaattgtttcgcgaaggctccgctttctcttcgacgagaacctgcactttcttctccgcgacacaggccgtctgctccacgcgaatgcacaccgcagcagggtacgcgaaagcacacggtggcgcgcgctgtcttcgaaggccgcgacccgtcttcgcgtttctcctgttccccgttttttgacttccgtgttttctctccaaacgtggagacccacctctcgtccataccgagtgcctcgcctcagagcgtcaaagttctaaacattttccacggagaaacctggagcatcccggaaggccggcaacaggggaagctcagtgtttcgtttgacgtaaagaacagggtctttgctcttgtgcaagggcaggacagaagagaaggagaaacgcgggagacaatcctcagctccgagcagcctcgccagagctgcagtcgacagaagctcgcgcttcaccgaaacgctcgcagtgaagtcgaggaagcggggaaacacattcgcatcaagcatacatacgcgtacgcaggccctgcacaagtttagacgcatgcatggaacacagaacagaggaagctgctgccaatttgtgtatgcatgcgtagatgcatacctgtgccctgtagacagagaaagctactgttcattgtgtgttttcatacatgcatatgtataaaaatatcgatatatatatgtatagatggacgaatgtgtagatgcaccatggtagctgaaaaaaactgtatttcgtgtatatgtatgtatatgagcatgcgtagttatatgtatgatatatatgtagactcatgaaacagcgttgtgtagatatatatatatatatatatgtctgtttccttgaaggccgcagagctatatgaataacggtggcggcgcagtcgcaagtctgtacaggtgtgtcagtccactgtgcgactcgagaaacggtgcttttctaggtacagatttgcgtggtgtcgcgccctgtcacgatgcaaagaataaattcttctcgccgccgcgttgagggaagaaatgagaaacgcagaggtctctctgcaagcaggcagtggaaacacagatggggtggcaagataaaatccattaattcaaggattcgtttgtttctgtggagcgtgtgtggggaaatgtggagacaaagaaatcttgattcgaatcgcaacatgtgcgtatccgactgtgcagcgttgctcagatcttccctaaacaccataggacctcgctgtgtttccccagtccccttccttttttttggaaaacatcacgtacaaaaggaaatccacgtcaatgtacatgcgaggcatcagttctcgtcccccctcctgcttctctcttgagatgctctcgtctccgtactcccctacttccgccgatggtggtgccgtcacatataagtaactctgtattcatgaacctctacatatatatattatatatatatatatattatatacatatgcgcgcatgcaactaaacacatctttgactcaagacatccttttctgtgtatcaatgtgccatctgcattgatgcatcgctataggcatacaacacacctgcatgtctttctccttgagatacctccatatttcttatttaagcatatacatatgtatatatgtatatgtatgtatatatatgtatatgtatgtatatatatgcatatgtatgtatatgtatatatatatatgtcattatttacctgtatgtatgaataaaatatgtatacatgcctaaatgaggatttctgaccgcttgctgtctttctgaagaggagacagttgctgcgagtcgacactgcaaccccttgcccacgaattgtctgtgcctgcgacttttcctttcttcctttttctctgcagtttttctccgtgtgttgtctctccacgtcgtctctcgttctcctgtcttcttctccgtcccttctttcttcttcgtttcaattccagggggttgtctcgttattcttcctgtctttgcagctcttctttctccttttttctccttcttcgtcgtttccctcctgccttctgaaagaaagaacggactctcgagcgactctgcgcatcggcgtccgctgcttcgcgcaagtcgcgggatgagagagagacagacggagacagagggagacagagagagacagagagaaggtatttcggcgttctttcgtttttcgagagggagaaacgaagtgggggaccaagaacatgttgaagagagaagcagaaaggtatgtttctttcagaaagaggaggccgaggcgactagaaaactgaaagacgacgagagaagtcgcggctctccagtcggacagctcatctcttgtgggcgctctctgcctgcgggtccatgtacatccagctgactctcgagagaaaacggagaaaaagcgtccgcgttttccctcttctcgtttctccttctcttcctctctctaagacagtccgtcatttggcttcttcaccgagtttcttctctctccttcctcccttcttctctccctctgtgtgctgtgtcctcggctgtctcgccaccctgcttttcgccttttccttcgtcgcttcctccctccattcgtccgtctttctccctccctgttctttgtctgcgcgtctgtctccttctccgctttcgctgtccttttcgaccgtgcaacctctgccttttttcgaaga

SEQ ID NO: 1739 - DNA, 1237 bp, Toxoplasma gondii
gaaatctgaacaggctaggcctgaggaagagcgtcaaatgaaaagggtcgctctcctcgtccggagagagaagctgagagaggagaggaaacgaactggagagaagagagagagcagagaggaggaagagggagagattgaagatccagagaatttaggggatctgcggcgagaggaggtgagaagaaaagcctcgctgcggcgcgcaggagactgggcaaaggagttcggcggttgcattcgagaaggaaaggaaagagaaagaagtcagaggaaagctgagagaataagaaaaggaagacagcgaaaaggtcgcaagagaggtacgcaacgagggagagacagagggtcgtgaaacagtaggacactgaaagaaagaaaaggtcaaaaagaaaggagaagaatgaccgcccggacggccgaagcacggagacgagacacacgagaatctgcgacgaaacgcgtctcaattttgtgcgggtgaaatctgtaaatttggaaagaagaaaagtcggagacgccgccaaggtcgcgggggccaagcacagtccagtttttgtgaggacactcggcggaaggcgaaatgaaaatgagaaaactgagggattccggcttagcctcaggaagaggacagagcgaggaaacgaaggaagaagcagacgagagacagagaggcgaggagaaagaagcacgcgcgcaagagaaggatggggctctttccgcgagagacaggagacatcagtgaggtttccctgaaacgccgcgcaagcaatggaagatgcaaaaaaagacaaaaaaggagaaaaaaagagaaaaaaggaggacaaaaaggagacagagcagagaaagcagaagaaaagaagaaagactctgttgaaggcacacacagcgaacaaaagaggcggcggatgtctgtggcgctctggagaaacaactcgaggaagcaacgcaaagagaaaacgaagaaacgcaaaaaacgggtgaaagacacacggaagagttgcaagaggaaaagggagactttgctgtggaaggaaaagaatccggcgagcgcgcgctttcagcggttcgagcgatgctgaaaggaaaggagacttgcgacgaatgtccctgccagacacatcccattcaccttccttcctttgggagatatcggcgcggctttgcgaagagcaaaggagagaaaagaaagagaagcagagaaaaggagaaaaagaacttccgacaacctgcgcaa

SEQ ID NO: 1740 - DNA, 4317 bp, Toxoplasma gondii
aacttctttcttccggtgtctctacagctcgctccgttctgggtgcctccacctgcctcactgcgcctcgcctcatcgtccgcgccagcctccgagtcttcttccttgcatgcagaggccgcagacgacccttgacggacgttgtacgcgacctcttgtgttgccgcctctggtcgctgaccgcttgtggccggcgcgttagtttccgcacctgcccgcgggactaacgccgttgtttttatgcgcttcgttgcttcctccgccgcgtcgccttctccagtggaggttcccggagcctcgccatttctgtctcggtcggccgccccggatccgcctgcgctggcaagcgacaaggcgcacattttcacagcgtctgtttcctccctccgcgcgttctgcgtgaggcgctggaggatctcctgacgctcttcgtgagagtgcaggtcccgaaacatgaaggggaagagtcgattgcagggcgagtcccgcgaaagaggacgccgtttttgtcctcccgttctttgactgcgcgccttctgcgtagactccacactggtcctcggaggcggaagaagcttgaacataactgtgtctggagggccggaacgctctcccgacggaagcggcgcgacgcctcgacgcagacaccattccggagaaaacggggtgttgtacgtacacccgagggaaggctgcggaggcggcgcatgcgcaaccgccgattgggtttctgagggagcgcgactccgggagttcgcgcgtggaagaataccatcggccaccatgctcgtgaacgcgtgcgtcgagatccgagaaaagtgacaaatgcagacggaaaactctcaagaatccatcggtgcggaagggaagatgtgaggcagctggagcgctgtaaatcaactgcggccgcgcgcgcgcacacaaacgctgaggaaaaggacggcttcaaagaggaaatcgagcccacattcagaacagagagatcacagatagagatgaactgtgataaactccatacgtgatcctgcgtctgtgcagacgattcgagttccagaattgcacaactcaaaacgagccttcacgcctagatgcaggaagtcgtatcggcacacaacgcaacagagaggcgaacagttcgtaaaattcgttccgttgcagatacgcggagtcgaaacaagtgatgagcaaactgcacagacagggtcgacagtttttccacgccgattttcggatagaagcgttagacgaaaaagcgcgagagggtgcggacgccacgagctggtgtggtccgcagatcgcagaagaataagcctccagggacttttacttcacttcttgtcttctgaaattaggctcgaaaggcacgagaaacttcactttcgtggttcagtgcctgacagggaagcctcggttttgaggagacaccatcccagagtcgcatgcgcagaagatgtgcatgcccggagggtacctgccgacaccggatctccgtcgtgtcggaacttccttcttttctgagatcagaaacgagggaaaacgaaaaaggagaagacgcaagtatggacctctccatctcctgaatatccccggtcctttcctgagaaggcggtcagtcaactctgtgcactgctctggagttcggcatgcacgcgatgaaagggaagccggacgcacacagtttctcacggaaaagataaacgccgcggcgtctactttcgtggaagtttacgactggaaacaccgtcagatgaagattgtcttctccgctacgtcttttctttcttttcgtgtgcggcatgtacgacagactctcttcagtggcacccgtctagtaacgagcactgtttctaacccaggtcaccgcattgagtctgcgattttctcgggaatgtgttcaccgaagatggttttcgcagttcctttccacaaaagacgttcacgcagactgaaatggatgaataaaaaatccggagatgatgacaaaggtgagtatgcagggtcttctgtgctgtagaaattccctgcagagcgactgccttctgcagatactgtcgaattctccaacgccgaggatattccacatcggtgacggtatagacgtagtaagccggttgctgttatcccttgtatcacttgctactgggatatcgtacgacttttttctgagatggtcacagtaaaaagtagcacctcttcggaaagcctaaaacgaacaaacagctacgttgcgtgaagctcccacatgaatacgtctccacatccaactgaatcctcttaagtagatctgtgaaaatccagcgataggcgagtcactgttgatgcccatcgctcaaaggacgatccactatcagagcctgttcccgggagtgtttgcttcatgttggttcaaagtggatgtagaggtgctctctcggtaagctcgactatttccacggattatcgggtcttcgccttgtcgttgagactcgtctgcgttgcgccctcgctgaaaatgctctcgtatttgcagcggacaaaaagtctcggcacaaatgcagctatatcacacccctgacgacacgtgactgatacacgcgaagctccacttcttgttgaaaaatctggcaccgtcccccctctatcctccgtttgcagttccatctaccgaatgagttccacccacggaaaagatggacagacacaaatccgtttcgcgatttgactggatttgtgctggggttccgtcttaattcaaatgacctcactgcagctgtccccccgaactcatctttgtctgtcggggaaacgcggtcgcttgtctacttcttggaaagggcgcagctttccgagaatcgcgttcctccaccacatccactctgctgtagtgagcacctctttggctagtctctgcgaatccgagttaccacaatctggtgcagaacgagaaacaacatccgagtagggtcgtctgctctctattcagcctacttcaatgacggaagtccagagcacaaccttgtcctcaatcttcagtaccaacagtgaaatgtgcactcacggctgcctgaaaacatggatgttcacacccacatatttatatgtatatgtgtgtgtataagtccgcatgcatgtatctacgtttacagacgtaagtgaacactcattttcgtgcgaagtctgctttgccatggaagggacagtctgccgctaacatggcagcttacatcggcttagagtacgggatgtgtgtgaagtcagtgccgcctcatgtacgttgtgccagttgcacctctgaaggcattgtattgtcgagtaattcggagagttcccgtcgggcagaagagcacttgagctcttttctgtatcggcgccgcaccagattcaagtgacccaaaagacgaaaatccctcaactctgcaccgcaggcgtgaagcaacgattgaatcggttttcggagaagtgtggaagagacggctctttcttcctctctgcaccagagtctagctcgcgtgggtttcgttacagatgaacaccacgcggcgagttgcagcttttggagcagacgctggagtttcgagggtccgtccgcataccctcttcccctcaacatgtctgcagactcacgattgacgcagtcacagctcgtggaaaaacaacggaagtttccacttttccccgctccgaagactccagaccttcaggaaacgactccaggtgcaccagttctgcagatttccttctctcgtagatgccgaaatcccattcactgcggcatctggtacacgtctagacgtctagcgatttcttacaacggtgggccgcatgcacggtagcgtgtgtcgagtctggcgtgagtaatgtaactgctctagcggcgacgttctcccgaaaaaagacgcctttctccgtgaggaaagagtctcacagaagactcgaaccaccttccatcgccttcttaaacacaaggggtcgattcattgctcgtgacttaccattcttgtctctgcgcgtgtgggatactctttccgggttgcgctgcacgcgattgtattttctgtgcaccgtatttctcgtcgagtttgtattcgctgttagagacgggtttttttgtcgttccgaaaggtcttcttccggccgctgtatgctctgacatccgaaacgcgaagtttctccgcgttttccccagtcctccgttctgctgggtcgagttcgctggactgcgtttcttccccgttctcctgataactctgcggcgttttcctggagaattcctttctttcaaggacatcagtggattctgttgcgtctggctcgcgcattttcttttgtctgccaaca

SEQ ID NO: 1741 - DNA, 2775 bp, Toxoplasma gondii
ctcaggctgctcacgtcgatattttcaataggtgaccttgtgccagtgctgcgttcattggatatccagcatggtcatgcgatatgaaaactgcaggagcagttttggctgcttagtagtattcttgctgtgaaacaggtcgcctccttgttccgtaaaacacggtaccagagtacgaggcaggcgcctgcctgtttgaaagtgaaaacatcttgaatttgcggtccatgcagcgtttgtgcaacggccaattcgaattctttgtatttgtatagttcgtcctctttcgtttcaattgagaagaattttacaaaacacaggcacaagagccgttgtacaaaagcgatcaacctttaatcttgtgcttgcggctgcagaggtcatgtttcatgagacgatgtcgatacgtgagcttgcaagttatctttttttatgacaaccgaacccacgaattacatatttacccgagtttgagttgttgactgacgactatgggaacagtctcggtgtcgatcatgtgcctttacgcacctgctgaccacgcgcacgtgttttcgtatactcacccgtttgtagtaatattatcgttgcggaacgagtcgcctccttgtatacctatccacacttcggcttaaagcaatttgcctgcccccctttcactcttcacattcatgcacagatgcacaaaaataacgtttcgaccagatgtcaatcggttcatgcccccttttaatagacagtgactcgactgtgttcggcggcaattcagccgacagggcacagaatggtagacgagagatgcttcggcggatctgaagcgaagcaaacaccgttgttacttccctgactttttatttgtgctcactatcttctaactcagcaagcagaaaggaaaacattcatgactgagaggtttagccatactgacgacagctatgcaggtgtgtcatctgtctgtaccagtgtggtcgaggaggggggaccctgcaaaataactatactcgaaaattctggttccgatattaacaagaaactgaaagggcatttcgcactctgagagactgttgctcgtcagtttgagaccagactttctcccaatcatggccacccgttcttctgtagttgtgaggcttgtaatgatacacgcaaagcgcattctatgcagagaacaaacagctgacggagtgagcttggcacgttgctaaaaaccaccagtaacacaaacgcacgctggcaattactgaaatacgaggacttcaattttcagcggtgtcgtaccgtctttggcccttacatgaatcaggttttccggaagaaccgaagcaacagctagtctaccctacggggttacagcaagccgactgcgcatgtttcagatgctttcgtttccttagtaaactcccagtttcgttttgttggggtcttttggcgaggcgaaggaaggctataaaatgaggggcaagcgatggcgcatgcgagttcgtgggcgtcttactactcaactctccgcttttttcatcgtcctcaatcagcctgattcagcggcatggaacgggatcgtcagtgcgcaaatgcagctacacacgtgcgtacgttcgggttttcttgcacgtttcgaccttcctatacgccgctggggttgactgtacccctcttgcctttctagcagcctgctgccactgtaatatatgttaacgaaaacatacttgttgcctcagagcttgttggtgtttatcgtgtgatgaacgcctgttgccccccgctggcagactccaggttttcgcagcgaagaaagaatacagagcaaagtttttatacatctgaacgtaaagcttgtcagtgggttagctgctgtcacgcaataacttgcgcatccataaccagtcgtttcactgtcacttactacagcatttgaagataacaccacttcctgttgcagctaccatgcttctacacagcgctcaacacccttctacacctcaaggcagaccagcccacacctccctcccgctcaacaacgggcgtctgttggataatacaggtggtgtttgtcaggcaagcgaggagaggagcaaaaggaatttggattcgcttgcttgattaatccagttttaggaacgtgtaaatgggaatttcgcagtaagtgactcctgtatgtcgaatcgcctgggaacctaagatgaacagctggttgtgccgcggtctcctgaaaggaacctcctcgagagaaggcatctcttttgcgaggagctgacagccacaccgggcccgaattatgctgcacggctttttcgcgacgcatactattcagttgctcttccactcgacttccgcctcctgtctgcgacgtcaaaaataaattttctgcgttttttctctcttctttttggactgcgctgctgttggcgtgtcacttaccgtgccgcgtctgcctatgaggcgtccgtcccccaacccgggcgccgcagaattttccgcggcggcctcgtctgctctgtcatttcccttctgtctacgggggtagacgctccatcctttcacagacagttcactaggtcaatgttcgtttcctcttccgtggcggagacatctggtctcctttttagcgtattctgaacaggttgcgagccaactgcccgagcaacggcgtgcctgtgtcgctcatggccaccgcggagtgatttgctctctcgtgtcgcggctccctttgtcatgaagtgcttttccgcgcatttgtactccacttgtttgccgctgtatactgccacatcataa

SEQ ID NO: 1742 - DNA, 1809 bp, Toxoplasma gondii
tgagacgtcgtttctttgtgtctttgcaagtatactcatctacgatccgaggcacatcgtccgcgttgttgccggggaagaaaggcgattggtcgttctggcgaggggctcagcggcagcggagggggggtggccgatgaagcaacaattcggacttgtgcatggagtgtatttctcacaagtcctaagagaatgagaaatgagcagagctacagagctttacgcagaaccccactggaggaagcgatcacaagcggcttacagttcgacctgcgttcgcttgtcgagtctcacactggagcagctggttctttgtagagagcttcgagcgaaaacgacgaaaggagagtgtcgcctccctttgcctcactgtgctgaggaggatcggcgccgcctgaaactcgtgcggcgcatggccttcactggagtctcacggggacttcgctgacttcaagaggagcagcaaatcgctaaagacaacgaagttcctccgaggatggaggaagtaccgtagtgccgccggcactcacatggttttgggggccgggaaccaaaggaggacctgtttctcgccttctcggatagcctccctttctcgcctcgtgttctgacaaccctgccaacagccggttctccaggtaggcgaccgattctcaccgttttttttgaccccaggaggtccgcgtatgcggagagcagccaaaaaacgagacgcgagaagaagctgaggcttgaattgttttcttccgtcgcttggatcacgcgaaagccaagaaatgtgtggagtttcgagcagtcgcttctcgctgacacggccgaaagcccgacccgagacgctggagaagctcggcgggaaaaccgacagagagaggccaggaaagtggaggaccagtgggagaaaaactgaagcagcattgaaggatgaacgccggcaacacgcatgtgcactttaaatccgcggaaaaagcgtgtgcgaaaggatttgctcgaaaccgaatgcccgccacggtcaccggcttcgagctataaagccgtgaatggtacacctccctgtgagagcggtgagcgaacttgagagcgcctcggtccgcttgtccgccgctttcgccctcctttttcgcggctgttcgtggactgactttcactttcgatgtggagaggtccttctccgtccgcgtgtgtaacgacgatccagccgcaatctttgtttcgaaaaggctgcaccgggacgtcttccggcttcgcggcaacgcaaaaaactgcatgtgggcatgcgcatacccctgagacagaacacaagtggaattcgcggttggattcgcaacttcttccttgagatcgctcactgcgtgcccttggcgtttcctgactctcttcggtcgacgttcctgccggcgactcccgaggaatccggtgtccgcaaacacgatgggtgttgacccttctgcgcggcgcccgcctctgctggttcctttctccgcgcctccgtcgttttcgcctcgaatacctgcgcgtctgtccttctctcctctccagttgtttttcttccatctgttctaaagctgtgagtcgtcgaaagccgacagtctccgtcattcgcatgcactcgcgcaggctctttccccgtcttctccgggaaacgactgctgcctcgcgacacactcctcgcgcgcgctgctcacgccctttgtcttaaagcgccgttgtgattcggtcgcctcccgacttttccccggctctccatttgtttccacccacgtgtcatccgtcgcgaactccgaaacgcccaggagactcggcatttcaaga

SEQ ID NO: 1743 - DNA, 2240 bp, Toxoplasma gondii
agacagccaagtttacagggaacaaaacaacgagaaatggcgacgagtctagcgcacgaggggacaccgccgtctcgtgctcgaccccaacgaagggtcatcggcacggtgttttcccctttgaaaagcgagaaccagcgggagcggacaaaaggaaaatgacgccacccgggtgcgaaggtctctctggctcactggcgcttcgcatcctacacactcaccgatttgccgctgaggctcgtcgtcctcgtcgggagagctctcgcgccttcacttcgagagggaagagacgaaagggggcctgacgtctgcacagacgcgagactagaaaagtgcgaaggatggtctccgtgaacactggcggcggtgctgctggcagagccgtgaccggaagccgccgaggagagacccctcgagtgcccgagagccgtgaatcggccgccttccattccgttcttcatgttaggagtcttgacgaaagcgaggcggagactgagagacggctgcgagacggagcgaagatggcggagtctgtgacgaaacgcaagatgcttgaagaggccgggaaggcgccaggcgcgaacgcagcaggcgggaaaaaagtagcgttagacatgcgaagcatgctgagatggcttcagaaggttgagctcttcaaacggagaggcagacacaaggcaccagtgcggagaacatggaggaaaaagagcatcccaaacacaggaaaaaaagtgggtggtgaagcgagtactcgcagaagaaggcggaaaactggagattcagaaaacaggaacaaagtagaaccacccctgtagcagccagacacagagaaaagagttaaaagagaggaaagacggaggaatacagacggataaacgaatcggagagcgggggggcactcagcggctcaggaagcgacggtagggggacatggagacaaggcgaggaaggagtcgacctttggaggtgagagcgtccattctcacggtttacgctacaaagagatttgaaagagtaaccgccaacacatgagctacaggaattgattgctcgcagaaacagaaggcagtgcggtgtcgaggaacgtgggtgcacgtgaaagaagacagtgctctcgacgaaagagcctaggaaggctgccaggaaatggctttcataaacaaaaaggacctcgcggcggtgcggaccggatcagaagagggggttggactttacccagagtagagataccgttggacacgcctgaagtctgatcaaggaatagatacagtcgaagacagcagaggaaaggcaatgtatggcgatgtccatttgcctccactgacgggaaaggcaagtgctggcaagaactgtgaagtttcgtcctgtttgcatctctgccgccgatcttgtgtacgtctgctgttaattcatggcgtccagtgcacagttgtgactttctccgaatgtctggctgttttgggatttacgaagcaaaacatggttgtttccaccgacactgctgaaagagaacaccgtaacaaagccagcactgtgtgtcttgtgaacctgcgtggcagacaaaaactccactactccaccagagaaaagccgtcccgtccacatgtgagaagagggacaccgttaacgctgaggccggggaaacagaaaacagaggagctcgggtcctattcaaaaataagcgttcagacggacaagacaatataacacgcgtcaactgccccggaaaatgcgttcgtgctggcgttgctggaacactatcgaactgaacagtggccggcagtgtgcggaggttagcgtcgccaactacagcgtggtggcagctcgctctgccgctcgcgagtgtgctgctcaagcggctcggcagagaaagggacctgaaatagacaagccaagctgtgtagctccatttgcacaccgttctccgggtcacgccgaaagacctctttgaaaggggacgtcttccaccacgtgatggacgcaacagtctgtaattcgtcttccgtgcgggcggcggcggaaatcggagtttcgtgctctgttttgttttgtaaatgtgcccagaagctgtatttcgcagagtccggcagtctatcgccgacgctggtctcaaccaaattggtgagatcaggacacactggttggtgacggtccagtggctcactgtatcgtcattcggcctgctcaaagagtggcccgttgacaaagcatcttcggtgaggtctcaacgtgttgaaaga

SEQ ID NO: 1744 - DNA, 2646 bp, Toxoplasma gondii
gcaatggacatcagtagggatgtagacatgtagaggcagaaatcgtggagacaaagagcggcgtaggtccataggtgttcttgtgttagttgtttattctgttttttaagcgccgagatttttttccttctgggtgttgttccttctcttgtccactttacgcgataactggcatcgtgactctggaaagacaagaagtctctggtacaagagtgaccgcctctgcttgtgactgtctttgcctcggtccaagcaacatgacgattgtggtcaaacgggtaaactgcggcccccctctctgtctgctttctgcgtggtgcgaactctctctccctcttcggcactgccctccggctgaggacccgcagctggggatacgcatgcaccactgacgaggtgtgttgcttttgtaacagaatgaatgcggcaatcggagatctgcgtctctcctattcacagctggtgtctctcctttctgtctctgctacgttgtgctgccggagaacgtacactgaactgctggacagagaatgatttgttgcttaaagactaaaacgcgcagtgcctgtaacgaacactgtacctacacagatctcgtgtaggcatttccttccgcagttcacacgacgactggtcttgtgtttgatgccgctttctctctcactcttttgcgagattcttctttccccccaaagcaggtagcagcggacgtggacatggaacagacctgtgcttcatggaggcagacccaacaaggaagcgatggcaaatcactcggatgacggtgatccatcgctccttcttgatgtctgaagagttcacctcggctctcacgtctctcggcgagcgtctaaaccgacttgcgactcagatgctcacgtggaaagaactattccttgctcggctagttcttcactgaacagtgacattcacacctctcctgtgtttgaaacgcaatacatacatgcatacgtatgtatatagatatatactgtatgcatgtctttagaaacaaatctccaaataagtagatactcgtattactaaaaattgtatacacacatgtctacacatgtctttatgtgcaagtcgcggctgcggaaggaggcaaagtggacagggtcaagaagaagaagcggagcggaaatggcagagtttccgtatttcaaactcttgaaaatggtgaacaagaatggcagacaccggattcttccttcctgtgtgtttctccttgatcctaccaagcagaatacatagaactctcaactctcttgtctttctactttcacgagagaaaacatcgtccgtgtcagttgactggtggacatgcctaggaaaacttttttttaaattccgtccttctctgaggcccaccaagcgcggccttgtgcgcggggacccggagaaggtcggctgtcgggtgtcactttccgattttcttctgtctcggtttcttcgcagcctctgactctctgttttcgacagctgcttgtaaatctcttttctgagtttccgaggctgggccatttgccgctagcgaggactggcagcgcagccttttcttccgacagggagagagaggagtatagggctcgtttacggcgacgagctggctggaaggtgtgctctcgcgccctctcctttctgggaagtgaggacttctccgttgcatgcttcgcagtctttcgactttccaagttcttctcgttttgtctctccacgcactgtctgccgaagcaaaagcggagcgtgcatgtgttagctcaccgcaggtaacttgcaggtttcttcgcgtccccctttgcgtgtctgactggggctggagaagagggaaagctcgcgtgagcttttttcagcggtgacttcctgccagttctcccgcctttctgcgtttttcttgagcctttccaaatgcacaaattcgcctttctccgctcgagacagctgccgccgcgctcgtttctgaaggccaagaaaaagcgaagaaagttgcacagcgcctcccctttcccgcgacgcgtcgctcccgttcttgtctttttgcctctgagtttcgccttttccttttcgtcttccaaacgacgaaacgcaacactaaacctgctgtgtccagaaaccgcctagagatctacaccttcgtacacctttgtctatcagcgtcttcggaaatccccttgcgcatgtatccacgtagatgcatgtgtcttggcggcatacgtgagaaacgtctgggttttcccgcttgtcgaaaccgagttcccttcgcgcgttctttctcctgaacgcggacaactaggcaccgagacggtgcagagaggacgcgaaagaaagccaccaagccatcgccagcggccatacacagcgaccgcgaggggcggcccagaccgaggaggcggcagaaagaaaaagagaaaaggaccagcaagaaatcgcagacgaagagagcgaaaatgccatgtccctgcgccggttcttcgatgggccgacggttcatcgggtaaactgcagaggcctctcgtgcggggacgccccgtcgcgaggcttctgcgtttcttcgatttgaatccagtggtgtaaggcccagaggaggcgagcgagagaaagacacaaacaacgaaacgccggatctaaagacgtctgagacaa

SEQ ID NO: 1745 - DNA, 2142 bp, Toxoplasma gondii
cttcgctgtctccttgtcttctccactgtctcttgttcttcttgctcttctgggtccctccaccgagattttgcgttttcccccaacagcggtcttctctcaccttccaaagaagctctctctgcgtcaaaggagctgcagagtccgacgacccaggagcttcgaaagaggagcctggcgaactgcgaggagacacttggccggacgctggatgtctccccgctggggggctggttgtcctttcctcctccgtctctcgcgccccttcggcttccagacgactcagaaggtcgcgaaaagactcctgggttcgcacgcgagaagaaagagagcgagaagaagaagaagagtggggggaaggaagtcgaggcacctctgtggctgcaggaggctgaaaggaaacgccaggcgaggacctcacaggggaagaaggagggagagaagccggggaacgcggcgtgagcgcagagggtagagagtccggaaagaggggagccgaggagcgtcgagacactgaaaacgagtatacagaagaacgtcctgtcagcgaacgatgaggagacactggaagcgaagcgatgaaggaggcagaagaccggcgaaggacaggtgagaatgagcaagccgagaaggaagggaagagtgaggaagagaaggaagagaaggacgaagcggaaggtgctcgaggcccagaaaaagccttccttctgcatgcacccctcatggtctctcgtttcttatgaagataaaacgttctttcttccaacgacgagaataggacagggccaaggggcaaggcacgggtgacgaagggaagacagagggcgggacgcgaacggcgaggagagaccctgagccgaatggagacgctgcagagaacaaggagacaaggggagaacggaagacacacagaaaacgaaatcggaagaagggaaagagtcggctttgctgttgcccgcggtcgagctgcgaaaacctgtgcagggagaccggacggagagcattgaaccagggcggatttcagagtctctcgcgccactggttcgcctcctgtggggtccagaaggagacagtgagagccagaagcgaatcagcgggcaaaagaagaaaagcaaacaaagcgacgaagtggggacccagaaacgcgaactttttttttccgcggggcgatggatcgacagccgcactatcgacgctttcgaaaagtcgggagatcgagagaagacacacactgcagacaggggcacaggcgagaatcgagagcgtcaatcttctatctttagatctcttatgtttctccctgtccaccgttgtttctcttgggcgctctcgccttcttcttctctttctttcagtcctccttcctatgtgtgctggggtccccatttttacacccaggtctcctgcagctgtgtctataccagcagctggtctctctcctgggcctcctcgcgaggcgcaccggggcgagactcgtgagtcatctctgtctctctcgggttcgctgttcttctcccttcctctcctgcgtgtgcacagcttctcttctctctcttcttgctctacctctcgtttcctcgcttcttattcctgtcccatgctccatccgcggtattccctcaaagggagacctatctgttctctctccatcgtcttttccatgcgtgtacgcccctatccgtccacggtctccttacgtctgtttcgcatgcctcgcttcccgtgaaccctgaaggccttccgagtgtattcacttctcttcacctgcgtcatgaggcgaaaaggcaggtttcgtacttcgactacatttcgaggaaggccagcttcctggtctttctgaggcgcaggaacgcatcgaagagcaaggagcgctaaatgccctaaaatcccccttgaccctgagttgcatcggagagggcgaaccaggtaaagctctccggtcctgttttgctccttctcacggcggccctgtctttggtccttgaatcctcttttccccgcgctctcgactccctgtcgtgtttcctttcgccttcctcttcgcgtctcctttttctccagcggttcttctccttctgtctcccacgcgctcttctgcactgccttctcgtcccgcactctcgtcgggagcaacggcgaaga

SEQ ID NO: 1746 - DNA, 2333 bp, Toxoplasma gondii
cttacgcgacttgccgtacaccgggaagaaaccgtggatatatatatatatatatatagatatatatgcagaggggagagagagagagatgcagagacaaacacagacacgcgtctataagctgtgcttaacaagcaatatggagacgcatacagagagaaagaagacagaaaatgtatgtgtccacgtctccgcatacaaatatgaatacatatatatctatatctatatatctatatatatttgtatatacagacatacatatttatatatggatatatatatatatatatttatgtagagagagaccaaggcaggggcgatacgtgtttttcaatgcccgcatacatatatatatatatatatatgtttaagtgcatagagagaggtagatgaaaacgtgtgtatgtctgcgtttgcaggaaaaagtacgtgacaacatttgatgagagagccgaaaaagatggtatttttttgattggtgtgtccgaatgccaggcagagagagaactgaactagtctcgaggacatgcaacgcggttcgtcagttacggtcgcgagtgcggcgaagttccagctcgtccgcttcttcgtttaagaggaaacgcgagtgcgccttgttggagcagcgctccactccttcgtgtctcttcttgagcggcaacttggctgagaaagtagcttctcaaaggcacttgcatgcacgcaaacgatatctggagtttttacacacttcatttactcgagatctatgtactttagcagtgtgtctgctctgtattctttcctttctctcggaggccagacggctccggtgacgcgatggggaggtccgtcgacaatctctcgtttctcgtgttccagcgacttcctcagattatcacgctggtggacggcgcgaacagagcgcttttcgtttaagtctttctctcgcgcgttctgcttctctctcgacagagagcctcgttttctctcgcgcataaacgggtgtgcgcgacggagacgcaagccgtcgtgtttatgtgcagctctggggggtttcgcgaattcaccgacctctgaagcggcgttcgcactctagatttcttttcttggaagcatcggcgaaaaccttagtggaagacagagaagaaggcaaaaaaaaccaactacgctgcccccctggctgctggagggtcgacagcgcctcgaggccggcaggagcggcgacgcgtgaggtgcaactcggcttttcaggagatgaacaatgcggcgaagcagataaaggaactagaaaagaaaagggaaggtggagaagaaatcgttttcggatgtcaggaagaagcgtagtcacggcagaacgcgtatctcccacagcgtgcaactttgctccggttccaaaagacaacacacattgctctcagttttgctggcttgtcgcggcttctccaatgggagagttccggcgacgcagcacgaaatcaacgacagagattggtttttgtcttcgcgaaaataagagttcttctgtggacctcacggtctccgcggtggagagcggtcctccgaatgggttcagctcaggccgatcacccgcggtcagaaactctcaaatcgacggaggctggttctctggaacgaggaacaacgaagagtgcgcctgtttttctgtgcgagtgtctgcgtgggtgtcgcgaccccgaggctcgcgtcagccagagttctgttgaataagcctctggaagtgcagaactcaggcgatcccttccggctacgatacgctgaggtcgagaaggacgaacgagacgaggaaaacgacgttttcagacatctttgaggcctccttgactccgcaagctggccccgaaagtctcaaacagaaaggccgacgtgactgcgacaagacgaggctgtgcgtgctggtgaaacctgctcgacttctctcctctctctctgtggaaagagagagagctcatatttccagagcaaaagatctccgcgttccctgccttttctgctctcttcgacgctttactgaacacaccggaaagcgaccggacgaaagacgcgtctcaccgcggggtgtatgtacacctcctcctgcgcagctggcgaggcggccgcggttgcgtctcgactctccccaagactcgaggcgccgtgtgtgtgtttgtgtgtctgttcggtgcgtttgagttcgactttttgttgctttttcctctcttttcttctcgtcgccttcctggagcgccacaccgcctgcaaaagcgttcctcaacgttcttcgtctccccgatactctctgtctctctgcctctctgtctctctgccttgtcgccgtccaccctgaagca

SEQ ID NO: 1747 - DNA, 2016 bp, Toxoplasma gondii
gaatctttcctgcatgcaccagcttctgacgcgcggcaggcatgtgaggccaccgctgttccaccttttccttcacattcaggactgtctcctccgccccgacctcgagctccgcctcctcattgctcagcgtccggatgcgcagcttcattgtcgctcgctgcctctctgtagacatcaacgcaggcaagaccttctcctgagagctgcgattcgtctagccgcgagccaagtgctggacgctgtgtgaagacagttaacgacgcaaactctcgactccacacaccaacgttccaggctgcgcctcgcgctgtctagagtcgagtcatggccgccacaggctggggaacggccgacgacaacagagcgacagtgtccggagagctcaggctctcgagtccagacgcaaagtcgcgcggtggagagcgattcgcagaagctgaagcaagtcccggaaaacgaagaccctctctcgatcgccaaccccgggtagatgtttcttcacaggtgtacgcggcgttcaactaatcggtttctacagtggtcatctgaaaaaaaacacccgacagcggggactcggtggaacgaagaggttctctgtcccgacaaaacaccgccccagccgaggcggaggagtctcagttcgccgaaggctcacgcgaagtcgaagaaagcagattgaagaggaccgttttttctctggatgtgcagacacacacagagccgtggacgcgacgaggagaaacgcagggtgcacaggcacatgaaaaaacggatggagttccgtgctgtttccggacgtgcgtccaccgaaggaactgcaaccgtaacagtctggaaaacaaaagagaaacgcgaaagatgcccgcaggaacaagttttcgaacacagcaccacagccacctgaggagacagacgagtttccctggtcttctggggtggtgcggagcatagaaagccgggacgcgccacagcaggagtatctgaagaaacagctgccgccagggaaagactgtttcgttttcttacatggcgaagattcaatccacacaggccgcggatagaccgtaaggctgccgcgatctgcgaaagaagaaacggagggcttggaaaacgcagcggccgcggtagacacggagaagttaagagaagatgaggactttgttcgaaagaaaagggatgatacgaaaagacagcccagtcggctgtgaaatctttgcagcgcgtttttgactagaagccgcagagcgcatgtgaggcgaggctgtgagctttcctcagaaagtctcgaggtctttcggaagggtttatcacgaaaatctgccgccttctcggaaactttcctcgaaacgaaaagcacgagtctcagccgtcctgcttagaccccgtcgagcgaaacgaaccgcggaagtcgcccggttcactctctcgctctcctgggtgtattgccgctcgcgtgctagcgcgaaaaagtcgcatgtgcgtacgcaagccgtccgcagtagctgctgaacaagtgcatctacagagcatttttctccacttacaccacttgtccgccgcttgtaaacggtggtggcgtgagtctgaagacaaggagggcctagatcgccagcattcgcggtttttccggcgttgccacaagccatggatgcgcgccgccctgatctggtcactcgtcgcggagcataaaacggcacagtgcgacgtttcggcgcttgacggaatcgccgcgtgcgactttgcgcatttcgcgcggggatctgcactcagtcacgggaaaaaatcccgaaaaactccgggagacacgcccgtcacccaccgtggttccccagacgaacgcaccccccacacgcgcgcgaacactctcgcgcaagtgaattgccgagatcggcggacggctttttcctgcgtttcgaggcggccggcactggattcgctcttctgtttcgttgtcgttgtcgcagtcgctttccgtgtagggaaactctctgagctccacttcctcgcgcaaaa

SEQ ID NO: 1748 - DNA, 3713 bp, Toxoplasma gondii
gagagagagaagctgagggagagaggatccaacgcattgcaaggaggcgagaggctggactgctggggcaagatgcaaacgcggaagagatccacacgacggatgagaagacaaaggagggcagaggaaacaaggaaagaacgagacaaggagaggaaaacgacgaatgcgagagagaacagagacgagacagagagcagcgtcgtgccagcgagcgggtccgcggcccggctcagagaaactctcgaatcgaacgaacgagactgcacctccacgcgaggaggcgatcctcgcggactgcgagggggggagacgcctcgacaggaggcagaaaagagagacgatagtccggaataacgaaagtgatgcaagcagccgacagctgacaaggaggagaaagcaggccagagagcaaaaagacgacggccgcacacaggagaagagcggggcgatgcagttaaaggttccttcgaagaacggacaaaagaagaagaaacgttgctttccaggcaaccaatgtcgtgctgccgaagcggcgaatgcgaagaggcctgcacctcaatgaggtgtgcgtacacccgatatctcagcgagatgcgacaccaactgtcggcgttccctgccggctgtaaagttgcatctgaggaggaactcggaagctcgcggacaccgggagaagaatccaattcatggaaaataacttctgggctgcaaacgtccaccctggacggggaaaggggaacggcgagccgcggcgaattgccgctctttcggccagccgacgaacaatcaccccgaatggccagggagaagtgtaactcacgcaaaaatcctttatctgcgtgctcccgacaaacgcaaagaggcaatctgtttctcggggttactggtttcgtttttcattaaaacagtcccaaacgccgcggtggctgaggtgtcaatactccccagcctttttctttctcgtgcgaagccgggggtccggccgagagctcctcctgaggcagaagcggagaaaaggacgcaacgccttgtttgtgtcgtcggctgcctccaacgggttctgtttgttctgttgttttggttattgaaaaaaaagaaaaatctcctcgcggccctcttcgctagagagggtgtttcagtgacccaactgtccatgcgctgtccgggccgagaaagagagcaggtttcgcgtgaacttctcccgcgaacaggacgggcaagacatcggaaagtgcgagcccagtcgttcctttcttttggaaagtcggctctagttagacttcacacatttttcctgagaacggcagctgcactgtccaggcacatgctgcagggagcgcgagagcggtcctgtctcacgctctcgctttccgaggtttgcagtttccttctgcggctgtcgaaagaaggcgaagcgtgtggcaaagagacgatcgagccgcgggagagaccgacgcatgaattgaaaaaatttgctgcgtttctctgcgcgcgcgaaaagccgggaagcaagccacgacgcagaagagagggagcgcacagctcagtgggaggcgacaccgaggaggagagcctctgcggtcggccgatgtgcagctgagtctcgtccgtcacaccctcccctcgtcaggaaattctgagcatctgcctgtgtgccgcgaaggactcaaaaagactcaacgcgttcgtcgatttgctttgtgcagcgatttcgcttctccttcgttcctgagcctgttttctcgaccggtctgtacacaccgctgcccccggtctcgcgtttttccagacctcgaggcgccctgacgcttcttccttttgcctgcccgttctgcggcaaagaggagagagctgaaaacgcgaactgccgttttttgtgtaggcaggccttcctgcatctgagcgtctgtcgccgaggcgagagagactcaggcgtccgcagaagcctgcagactctcgccccccgaggccgcgcctcccttcttctgtcctcccgctcctgagtgcaccgctgctaccgctaaaaagttcgtctgtgtaaaatgcgagtgtgtctgtgtgaggctttgtgtcgcaacagaacgcgtggagtcgaggaaggcagcgacgagagaggaggacaagagagggaggaggacaagagagagagcgaggtctgagggagcatggtgtgagtgtgttgtcaaggcaagagagcgaagagctgtctacatacatttgtgcggtttcgttccgcgaactgaaagagaggggtgagacagagagagctcgcgttcgaggtaccgctttcctccagtttgccgttgtttcctcgcggagagaaagcaccccagcaaaacgctttcacccgactgtgcaagccgtttttggatttctctgccgacactgtgttcgactctcgtcgccgttcttcttttgaggacgagagcgccgcccagtcgccttcgtttttcgctgccctgcgcgcgggtgcgtgcgaggcgaagaaaagcgcgccgccgtacatttttcctacacaccccttgcgattgccgtctttatcgacagcgaggcaagggaacattgcgtttcctctcgattttcaaaatccgtaggttcttgaagagttccgacacagcagccggttcagagtttgctgcttctccgtcgcttttcctcccgaggacttgtcagtttctcaagtccgcgcctacgtccccggaggggagaagctaaggcaagaaaagacaagagcgaaagcctccgttttcttccgcgcgcgcgcggcgggccgtctttgcgcggcgcgaaggccgtttggaccgcgagaaaaaagtcggttcgcgttccaaacgccacagtggcattgaggagggacatggccttggaaagaggcactgttcactggcgacgtacgcgagaggaatgtgtgaaggaaggcgagcaaggagagagaacgcagaaggccggtttctcttcgcaggtcaagtgcttcgcttctctcgcgtcttttcttggagttgcacggaaagaaagacccgacaagaccgtcgcgaaactctttgccttttcgcaggacgccacgctgcacactctggacagctgctctcacgccaagtttacagacgccgcactgaagctttttttccaactttggggcggttgttccttgttctttcgcggacgtacacggacaagacgcgactggttcggaatttgtctctttcggccctcccttttcatgtctttcttctgtcagcgtctctcctcaagtgttcaccgcactcctttttttgcatgctccgtcttctgctctctgcctgtggtgcaccggaagcgactgctccgtcgtttcgtcctgtcttcctggccttcgaactctccgccgccgcgcggtgtctcttatcggcagacccactgactgcatccccgtctctctccgctcctgttcgcttacgtcctctctcctctctcctttctgcttcctctctctctctctcgttcttcccctcggtcgtcttctctctctccgctgctgctgcctccgcgctgcactgcgtctgccggctggagcgcgcctggagaccaagctgaaagacgcaggtcgcctgtcactccggagtcagctctcctcgctagtgaccgccagcttctcttcggtctcggcgaacggcgctcttcgctttctgccttccctctcgccttctgccttccctctcgccttctgaaaa

SEQ ID NO: 1749 - DNA, 2173 bp, Toxoplasma gondii
gaagcggcgaagcgaatcaataaatatactaaaagtgcacatctgttggaaacagctttcgcttcgtcgtcagcttctctgcgaggactgtgtgtgctttggacctctgtctcccgctcctctaaagctctgcagaaagtgatgttctgcatggaagtcttctttcgaagctcacatggtgtctgtacagtgccacgaaccgctaagtagttcgaccgcgtctgtcgcacgatagacacatttctcctcctggtttccttgagtgcgtttctcttttctccgtctgaagtgtgagagcgaggagcagaaaaaagcagagaacgagaagccgagacttcatctttctgcattgtgtactgctggcttcagacagtgcacaccgcttgctcctccgtaaatctgaagaaaggtaatcacgtgtcagaatcacctctgaaaaaaaactagttcatcggagtgtttcctccaagtctttcctgcccattcagcccagtgccgcgtcggcgcgtgctgaatctccgaaaaataaccacggcaacggcaaaatgttgtgaactgcatcatcagataattcgctcgtttctatgttcgtgacagaacacactttgcgcctgttctacagatctgcaaaaacaatagggtgcattgcttgtctcctgactctcctgtatcgacagcgtgaaggctcgaaggggcttcctcgaaagccaattcttaaagaagagtactgcgttgcctgtttagcgtaacaggtatatcagctttccattttcgtctctcagatttgggccaaccgactgtgcgggagacgcgaactagcgcaaagtctactcgggctcagcgccagtgtctctgcacacgcccaatgcttgtccgcagaaaaaactgaaaaaagtcgatttgtcgtgtggtgagccgtgagcgtgttaatctcggttgtgtcgcgacctcgctgagtggccgggagaatctgagatgctgcttggcggcgaagtgcagattctgaaggagacgatgtgcggaaacctgagcacatgatctgcatgcaagcagaagcctttcgctgattcacccctgaagatcgcgacacgatgcgccagcctctcgctcttcctcttcttcactcagtaggatgctataagggtccccttcggtgttctagggcaccgtcctgtgtgtcctaggctgaacgcaggaataacctccttctctgaaggcaacagtgagattcgcatgtgccacgagctggcgcgttcgaatggcaagctcggaatgacagtttttcttgttctgaagagctttcgagcctttcgtaaagacgaccgacacggcgttctgctacttagctcgccagacggacacacacacacgcacagccggctgttcccgcatgcaagcgggaaacgggttcgtcgtgttggcgcgctgcagaaagggaaaaagccgggatatgtccggttccgttttccaggatttccccgttctctataggtgtgtcttcccaattgtcgtgtatacagcgcctctttttgcaatggcgtgaaagccgagcgcaagttcggtgctgcgtccaagccaccggtttccgttctctgtatgtacacccgaacttttacacagcatttcacggagccggttccgttctgtgtcttctagcagcgttctgaattcgtatcggtttgcttttccgctggcttcgtgcggaagttttctctttccctctccacacgtgcggcttgtctgcgttcttgtctttccatttcttgtgccttggtggcggaaacgtcgaaccctgcgtcgtcgactgcgcggccgccccatggctcttggtcggtgtgtttcttgtctcattcattccctttcttgttgattgtcttttcccagagcaggaagaagatacgtaggggcttcttcgtgtctccgggtttctcctccgcgctccttgctcgtcgagcgtgtctcgtcccggctttgtgtgtcttggctacctgatctccggtttcttccggttctcagttacgtgaaggcggaccctcttttcttcgttccccgtcgtgttttgtatttcttagctccactaacccagatttccatcgtgttattgcagagctcgcggcttcgcgccacctccccgcccgtgctgggtcggccgtcagaaccagccccgcaaaaa

SEQ ID NO: 1750 - DNA, 1676 bp, Toxoplasma gondii
aaaaatgccgcagaacgtgcagctgtgggtgaagtcgtcgctgcgccctgcctgcgtctcgcgcttcttctctgcgcggcccggcctcgccgcctccgcagactcgcctggaccgaccgatgcgccaccgctgctgctgcacccgcatgattgtgtcgcaggggacagagacgagcagcacgaagcggctgggcgttccggcgctcccgagctcgcagaggatggagacgaggaggaaggcgcttcagcggcttcgcgcgacacgggaggctctccgtcctttcctagcagtgcctgctgggcaattctgtccatcgtccacccgtgatagagagaggcgtaggagacgacgtggagaggcaagttgtagacctcgctgtttcgcctcacagctgcgagcgcatggtctctgtaccccttgatgccttcgtcgactgcgagcaggtggagagagaggccaagatcctcccgcgcattcagcgtgtggaggacgtggagcagcaccgcagagtccttcccacccgatacgcagactgcaactttctggccccgttggaagagagaaaagcgccgaataaaggccgagacgtcgtcctcgaaggctcgcacgaaacatgctcggcaactgcgcagtcgagacgccacgcgcagcaaactgactcgcggagacccgcagaactggcaacgcgaaggcgagaaacggacagaagacgcggaagagaacgaagaagaggcggaagaagaagaagagaaaccagaggaagaagaagaggaggaagaggaggaagaggaagaagcgggaaagggagaagaggaagaagaagaggaagaagaagaggaagaagaagaggaagaagaagaggaggaagaagaggaagaagaaggggaagaagaagaaagagcagagctagcatgcaaggaatccatggtgagagaagataaggaagagacaagagggcgggagagaacagctggaggcttttgcgttcgttgtctttcttctcgtgtacctgaaaagacgggggagggagggtgtcgtagtggtttctcttgtcgactccctgtgctcacatgcgactggcctgtttatcgccttcccgggaacctgactctcaccagttccattctctgtcgccgttcgtttcgctcctcagaaaagggagcgaaaaatttcctgcttccagagatatgtggggggaaactttctgccacagtggtctgttttcttcccgagaaattcagtcgactgcagtgcatgcaggcgcagaaaatcctttttttctgaggcacatgcacaatctctcccggacgtctgagatgatttttccagtgaaggaaagccatctttttctgtttctcttgtaatccccgacttgtttttttccctctggatgcagaaagaactctcttcgcagacacgagacaaagaacgtcccctctttttcggcgacctgtgcatgctcatcattttgcctttctctcgttacgcattcggcctcctgcaacttttccccaaacattcactctctgcctggtttgctcccttaaacccggaagagattgtgttcttctgcttctcttctccttccttttccttttatctcatttgcctcgcgttgtcagctgctcggccctcttcactttctcatcgtgtcgcgtttcctccgttgcctcaa

SEQ ID NO: 1751 - DNA, 2988 bp, Toxoplasma gondii
acagtttcccggtactttcatgtcctctacacgtgatctaaatgcataatggaatacttgtctgatgtgacaaccagatggacatcatggaacggcggcttccgactaatgtctcgtacctcgttgttgtgctgctgtgcgaggcgcgcgtttgccgccgaaactgccggcgctggtaacagtgacattctgcatcatggaggtagcgatgagctctccggaaacaatcggtcccagatccttcaaaatcgcttgcagcttgcacacggccacctcatgcttgaagacgctgcaggcactccacactccaggtcgtctacctgtctcagacccttggctaggacccaacgagacggtattgtacagcgagattagatgcttcataatagacggattgaaggaaggaaggttggccgaaaaaacatgctttcgtgggcacttttggaagatttcgccgagaacaatggtctgcgaacacattgtaaaaaaggtggcattactatcaccataaaaccgatcgcctgtagtgcacgggaacacactggtgaagaaatggtggcaaagctatagtgttggatccaccaattcagtggcacctatttcttgtactatgcttggcaacacgttcgcgtggccatacaacgcgcatatgcttcaagaaaactcacatgcgagtcttcgggcagcactaggatgaatgcatcaacatcatcgcgttgcaacagagcatcgagccccgtctctcctgccccagctcgttgtacagcagaaccaggtcgcgtgccaatgccgcttaaatcgccggtcttttcccagtaagcattcaccgtgccttttccgttagcggtcaatgcctgtgcgatatcgagggattcgctcttgtcacgggaccacgcagcaaccacctcaaatgccgctgactgtagcagcattgccgcccaccaagtcgtcactgttgcagaagacaacagaaaaaactgtatcaagtactctctgctcttcaatgacttgcgagtttccgtgagacactacgtggcacgcttatgcatatccgccgcgatcgagaaatggtcaactagttggctggttggtcagcgtagcaccttggatcagttatgcctgcaacggaagaaaactgaatctgtattaatgagagtccagagaccgccccaggacaaaatcagtagcttacctgcgttgccttcaccacatagggcaagacgcagcgcaggcaacgtcttgccgtccaacttcgcaactgccatctcgagaacggtgctgaaacgtcaaatatgaacgagaggccgaaacggaggcccttcttcctgggaagttacttttcgtcaaataactcaatccccttttagcgcagttagaagtttaacgactcctgctagcccccacgagagaccgagcgcgccgtgtacagatcgaagtccgtgtcgcaggtcgagaggtgacgcagcgtattgctttgagactacggaatttgaaaggccacacgtttgctgaatacagataacccatgacgcatatttatgtctcatgggaagaaagaccgtagaagagaacgccacgacaaatggtttgcatgagttcacagcgggagcaccgagcaagacagttcctgttctctaacacacagcggtgctgcctgccttgcgagtcggctgcctagcggtgacctggctccccggaaggtcacggggaagagacacaacaaagacaccaaacaaacgagtgaaaatagtggcacgcgaacgtcttcttaaagaaagtcatccctactgcggtggcgactaaagcactcagttgaaccaccaccgctccgtgccaccccttgacacgccgactgcgcatgagacttggaggcctgccgtcaagcttccacacaacaaacgcgtcagccagcgcgccgatggaacttgttcatcacacacaaacctgtaacatgccatatgaatactcagctgaagaaaggattgacaaaatatcaccctggatgcaaaaatgccaaaggtggcagcgttgtttaaagtcaagggcgcgcacggaattgaaccatgaacctgccgatctgcagtcggccgctctaccattgagctacacaccctgcgactgtgctcctacgaaaagtccagcagttgaatgaccagtctactagcatgcaacgtaacagctggtaccgggcaaaaattgtactttgtacgtcaatgacacccacagcacatgcatctgacaaggtctgctctgtcattgtgttcaaagtggaaacgtgagatatcagggaaaattagaaaccgtgttagaggcactgctgaatcatgggtcggttcctcacgatatcaaccgaagaaggctgggtagaacacggagtttgttcgcctgctcgtgagagtgtagtcgaatacccgaataccaccactgggaccaggccgaaatgaatagtttattcgtgcgctgtatgcacggaacacacaattggcgtcgccccaattgtacccaatgtgagagtacttgattttatcagtagagattgttccgtggcgaggttctaacaagctagatggatgattctgtgagctacgctgtcgaaggtctccatcaaagcggatctttgggtacgttcacaggctggacagaggatgttttccgacttgccaaacagtgccatacgacgcatgaaacaaagtggcggaccacggaaaacaaaacaaatttcttctactgtctccctgggcataggcaccgaaagacaagacacatgccagcacgaagcataacttgcttgaacagccaacttagcttgcgtgtacatacacggcaaatactgccatgacacaccggtgctactcgccactcaacccaatcagcccaccttcccgctataccaatctagtctctgccttacaaatcagcaccactatgacgtagtccacacaattttcgcatagtggctcatggcggccctccatgcctcgtttctca

SEQ ID NO: 1752 - DNA, 1969 bp, Toxoplasma gondii
aacaagtgcatgcatcagtgcacgtccaggtggaaaggaaaaagtcgagagcaattcagatattcgcatatatgtatttacagatacgcatacaagtttctgtgcaattagctgtttacgtccgaaggaagttcctgtcctaacggtagagctgtcagggacggctttgggtgtttcatttatgcacaagggatggaacttagttgaagtggatttctttcagcaaaagtcacgttctttgttttgccaaagcggggacgtgtcatcccatgtttaacccaagagcacgtttcgctttagatttttctccactgtagatgtcttagcccatgacgctttgcagagccctaaatgacactcgcgcttctacgcgtgtataaatctacgtagatatatatttgtatataagaatattttgtgtgtgttaatttctctttaaacagacatgtgcctcggtaggcaaaggcaccgtgcgtttgtccgggcgacaggaatggtaaaagggtcatcaaggttagagaggaacgccgtgtactcaggcagtttttaagagcaataggatttttgaaatgctgtacctctctctacagtgcctttcaatcacagcagtcgctctccgcgtttccccctcctggttctgtttccttgtgcctttgaaggaaactgagaaagccgggacagggcactattttatgcaacatgaagttccgccactgcttcttacttgcagggaaacacacgaccgccttaaaagatgaacttgtttcggtgcgaaaacgttcacagttctgtttgagtgacaacggagctccgtgtgaaatcgaagaagacgagctgaaactttccgtgcaaacgtctatttggcggctgggaaggcggcagtgcggtgttgtggaaaagtctgtcaaaatgtatctaggaaattcctcaggatacgggttctactctgcggtggctccccgtggtttgacgttgataaggaagagtcccgagttagggaaggtcaccaactctgcttcacaaggcgtttcgtttccagaacttggataaaggttatttcggagtgacagcgggtcattttctttaattgttcaacaaaaattgatcccgaaaaagccgtgaacgcgtcccacagtctgtgcatgaagccccgacttcgagggttcaccagggctgcctgacgtcggtcacgtaacttgaaagtcgttttctttgctttgtaaagtgaaatgcagggatcggcacacgcgggatagcgaggattgaagcaagcattggctgtgtgcttcttttgtctcgaaaggaaatgcagcagagcatctcgtcttcttactttgcgacaggaagcattccgcatgttgtgtgtgcataataatgatcccctacaaacaggaaacttacttgtttgcagaaaaaccaccgggcgactcgaccatgcccaatcgtgtggggaaatgaagtgggtcttttgccttacagaaccgaaacgcggcattttcgcccttttagaccggtagagacctcgaagtgatccaaggtgaaagagcactcttccagcgtttgcggtgagctgtttcaccggaaagtaacggatgtccaggctcgatatttgacattcactatcgttgcacactgctgtccaggcgaagtggacggtatacgggtttttcgagtcgtagcaaatggcaattgcgagaagaacattccgatcaatgatactacaagcttaggagccgttattaccacccgaggataaaaggcaactttaagcagagcgcggtacctagtttctccagggttgctagatccatttaaatgcaagttttattacataaaactacttctatgcagcttgcagaagaaaaaaggatggactgacacctttcagtggacacgcggatctcgaagtagttgcccggcaactctgccgatccctactctttgcggaatttgccttctttgctcgaga

SEQ ID NO: 1753 - DNA, 4927 bp, Toxoplasma gondii
agtttctgtagagatgtggatatttatagacctaccagtatacgtaaaggacgctcctacgtgagtgtatatacactgaggcgtgcgtgcggagtttgggttgcggtagtggggcgtcgtcgtctttttcactttttctgtcttcagctctccgaagagttgaaagctgtcgtgacggatgcgctggcgaagcgaatcgtctactccgaaaagtatcaggactctgcttacgagtacaggtggggttgtgcgaacctacggaaagccgcggaatacgatggaaagtgaaaaacgacagtttgttgtgtctagcagggcagagcgcagttctacaggcgggatgacaacgaaatcaagacgcgggggcgacaggcaatcaccggaaagtaaattctttgctgggattaatgaaccgaagcgtgtacctggatattaggaatatatatatatatatatgtataatttgtatatgaaagcgtgtggccttgcggaaaggaggtaagaggagaggaagcgtcgagaatctgtcaattcaaactgatcagttttctgcatttgccctctttctgcctcagagcggtgactctgcccctacagcacccttttctctctcacagtctctctcccctcgccgacgccatccgaagagaacggagaagaatgtcggagaaagtctggagggcgttgggagtacgtgtttgattgctgacgaaaactctgcaagctgccagccgataaatggagtctaatacgcgcatgcataagtgtagggtgcatgggtgcataggcacgcaggtcctcgtttttcctcgaagggatcggacatgtgctggcagactccgcacgtgaaaacggtgtgtgtccgctgggagttcagtaggtctgcactgggataagtggaccagacatttggatgtgaatactacgaagatacatatatatatatatatatgcagatgtgttgttatagccccaaaggatttgttttcaatcttcctttccgcagaatacttttgtttctgtgtacgtgagtctgtgcatttatacgtatctctgtatgtgaacctgtgagtgcgcagccaccttcgtggtccacttttgcacgcgacagactgggcatttgcttccgtttctttacagattagaatgagttgcgggtggcggcactggggttggagtatgtacgagccgaacgtcctctttttcgcgcggtgagacgctcgaaagcacagtcgctctccactgggagtcgagatgactttgtcgttacgcactcgagggcgagagagcactccgagttagctgtccacagatcgcgttgtaacatgacacgatgagaaaaacggcagcgtcttcgacggtctggtttccctggacggcgcgtgctgctggagggaacagacaaaagagagagggggtaacgttcatccttttcggaacggttgataattgacacgcacaaagtcaagatgtctctttttgccgtctgtctctcctcttgtttccgtctgccttgtgttcatgaatcttcctcatttctccattgtctcttgtcattcctcgtcgtatctttctccgaccgatttgagacaggccaaagtggacagacggcgttaccgggatccctccgatatctgccaccttcgccgcaaaacggcacgaccgcatgcgcgagttgctagcccaggtgaaaaatacaccggccatgtcgtctaggtcaagaactgcgtgcagcaaggcagaagtggcccatatgtgtacgtggcgttctgacatgtattcagttgtgtatgtgcaaatatttccatgctgaaaaggcccccctatgcgtgtatgtacgcacatatatctgcaaagacgcatgtgtgatgggtatgtctgcgcctacgtgtgaatgtgttgtggacgttttttttaatttaagtgtgcggatatgatttgatcgtgattatttcgagctctgcttccaagccatggggaaggggcattggcctggtaggaatcgagagcaaagtgagaacgcgccgtgtgtctgttgcaggacgtggcgaaggggatgagtgtcgtctcccagaaacttcgctcggccctcgtggccacacaagactgctgccttatgaccgacacggaagacgataagagcgcatcttcgatctgtggtgtgtaccaagactgcatacgatagtcacaaaatattccagaaatgctgccaaggaggctcttcacgcgacagatcactcaatgaagcaaacatgtgatgttcgcgtgttatgagagtcccaccgactcaggtagacaaaaaatgtaaattgaagtggaaacatatcgaacatggtcttgggagaatgcccgacagacacacgtttccgcagaagggattagaaagcggatcgaacatcacggtattataactcgagacggctcaaaatgggcctgaaaaagactacgtctattttccatctgttttttcgtaatcacgcgttataccaccaacgtaggaatatgcggaatcgacagattgtctttggaagcgaactcgaaatgtctgtattcgaggtctgctgagaataagctggtcagctggtgcatattgcgcgcacagcagagcaccggtacagacacaatatctatctataatgtgataattgcaatacaaggtttacctatgggctttttgtccttaataccaactttgcacggaggatcagtgatttgtacctgatccgaaattgttttatcagtccaataatgtgttcaaatcacttatatgtcccggaaatgtctccctaaacgaagaaatgtggaaaaaatcccggcgcacatctgcgcccgtatgtgggggaatatatggtcatctatataaatggaaaacaaggaccttccaggaaattttgtcagcagaacacatatcgatcgtacttgagagtcgaagaaacctacgacgtatgcgtatttgtttctttccatgattaagctccgtctgctttctataaaagggaagcgaaaacctacgctgtgcactgactgtttgtcagcgttgaacatttacagaaatcaacctgtcaacaccttgcacgatgcagtgtattccctgaattaagaatggcattgtatttgcaatggagtgaagcgaaacatagccgaataagatagcctctcttcatgatagaccgtcatcccgcacagggacatttcgtacaatgaggaagtagcccgtcacgaagcaacatacgggagaggaaaccccacgaaagactcataattggtagctagcaggaggagcgtcaatcaggttagttattcgcatatcccgaattattccacgtcctccaagctggattagaagttaggtgtgtggccgatatttgcagccaagtctgttatccaaaacaaagcgacatctctgcggaactgcttcgtacggaagtagcaaattttgggccaccacataatggcatacaaaaggaatgcacgccttgtgcgctgctggatgcaaaggaagtaaatggtgctcataaatcgcacaagactggatccaagcgctggattcggtgtacgagttcttcgactctctagaatcgcttaaaaatctgtagtagcaattctttcgggaagttgttttctgtgaagagttatcctgtagtccgatgtacacctcatcacttttgaagacagcgcccgatctgctgtatgcgtgtgaccaggttgcatatgcagaaatagtctaggtgttagcgcagggatgagaatgcgtgtgcctgaaaacaggtttctgatgcctgtcttacaaatctgtgttcatcttactttgcacgtaggtcgcgttccgcataaggtttgcactttttcaaagcactgattttctttctgtatgcgtcatggatgttggaatttccccaaagtagtcatgttcgagtccgtgtcccgtgtgcatgcgtttctttgacagaccatgtcaaaacccagcacaacttcaggtcaccgtgacctttctcggccatgtttcgccagaaaatgtacattcagtcggacgagacactagcctgtccgttttgaggagtttgacctattttgcgtccaatgaaaaaactgccttactcaacttgtttctgcacgacacgcaacatttcatcgtatggtcgctctttgttgtatctagtgcacatactattagttacatttttcaatagcaagcatatcggactgtcgtgtgtaaattcattctgcttctggacggcacgccgaggccgatttttctgtagaacacgacgcaagtctacgtcggtggttcagcggcaatttaagtgtccgtctcctgacaacacttatgtcggttgacaaaaaaagcaccaaacccatctttggacgaattgaggttcgcatgttctgcgtgtttgttgcaagttacagctgtctcgtgtatgagtgtcctacagaggaccgaaagaagcgttgcaacgcggtgcatcagcatgagatgtgcgtaagagttgtttgtcgcctattttcgcggccgcgatttcgcataaagaacagctctttcacgaagtaacggggcacgcaaagtgtcccgaaacaccagttggatcagttagatggcccacggcgcttcttcttcggtcactcgcgtgtggaaggccacgcgagcgcggggccgcgctccactccccgtcctggcacgcggcagtgatctggcaccttttctgcactacgagtatgcccggcgtagccacaatcagatctttgacttttcactctcttctcttttatcttttgaggccaggtgggtgttggatgtgttgcttcctatgaacagtgctcttcccaaagaaaacgctctgtgtagcctgcacatcttttctcccgtatctagagaaacgcgaggccgcgaacctagaactgtcgtctgtgcgagtgcgaggcaaaa

SEQ ID NO: 1754 - DNA, 2654 bp, Toxoplasma gondii
caaggacgtagcgtttcgccttattcagcttcacgaatgggttgaatgtgggtttgacgcgaaccccgtcgatgacattctttgagtattctctccggggagttcctcggcattctgctgcatacaccggcctctcgcgctcgcgcaagatatcctgtcggctcttccaggggatctctcgaacggcgcgttgctgagaaaaaaagaaaacgggaaacgcagcggagcgagcactgagaacgcgcggtgtgaagaagtcgctccaagtctactcgagggcaaaccgtttccgtcaaatggcaccttctcctggtgtacgtgctgcgcgtcagtgcgacgcggcgattactatctgtgaagaaccaactgtcaagagcacctcgagtctccatccaagcagacgccgaagagccatgaagcgatcgtttacgatacgcaaaatgtggcgcgtgacacgtgtgaatccacttgtttggatctggatactttcgcagagacacgcacgaaagctccatacaatatacatgcacgaccacagtttatttgcatagtcgacgagaccttctgccagagcattcaaggatgaacagtcactgtgcggactcaccagagcccctgaagtgaaggaccgagacgagagcgaagggaagaaaagaagtggcgaaccaagtaaacaaaaacgacagaacggaggtgggtgacttccaggcagcggctgaggaaacgacgagaatgccgcggtggagacaccgcgacgaacgacgtgcggtgccatgttatgactctgttaactctgttaaaagagagcagcggaaaacgaaaaccacgaaggggaccgggaggcttgtcccctaagtgcgcatccaccacaggccatcttccttgtccgaccacactctgtttgttgcagaaaacacggctgttggggatcccgctcgagagcgacggaacctaaaagaaagggagcattgagggcggaagacacaagtagacagtctccagatggctgtgtgcgtgagggtggcagtgagtagaggcagggaaaaggggaagaagtcacgcagtaaacgtctgcatcggatgcaggaaagcgaccaacaaagatgcgacagaagaaatgccccagcgcggaactcgtcgctttcctctcctttctcctcctataagtgccttgtcgacaacaccgcatgcaacagcgttcaagggaaaatcgaccgagatcaaccgcaagataacacctacgaggaagagaggtctctggacagagaaatcctaggaaaagggaagatgtctgccaagggagcgaagtttctctgcagcggcacgcgcggctgcttatgcacggtttgcgcaaaatcgacctgggttttacccgtccaccacagcagcggaggcctctaccgcctcgtgacacacctttagtaataatcagcagagaagtcgaaggaacgggacagaacctgtgtcgtggatccagaagtccattaaaaccgaaaagtcaggggtgtgccctgaaactgcggcacaagccgtcgccacgtccgcaggcgttcttccgtgcttaagcatgccctcgataacgcccctcccaggacagtccgatcgagtacgtcaagaaaaccaaatttctgactccagtccggaatggcagtttgcttgtttcacaaacaagaaacgatggacctgtcgcttgcacactacgtgctgacctgagagatccgtagccgctcttgcgtggtccaggtcgcctcggaagtgttgttgagatggaaggctcttccagagcgcaggcggctgcatgcgtgaggcgagtcgattcgcgtgcgaccctttttggtggttgtgacagcgaaaaagggagacctggagggaagttttctgggcccataccaacaaggtgtcgtcttggagtcaaaaatttgcagctagctgttcccctcccccccccccttcgctgacatagagcagctactgcccctgcagagtcttcgagttcgtgcactcgattgagcggtgagtcaggctgcacgcggaattccactggttgaattaccacggtgtggaaatagagcggcagttttgcagactatgcggcaattcttgacgtgaaaaaagtggcgttcgagttaggttagggtggcgtgttgcaaggcggtctggagggtttgtggtgcagcgtgaaatggacccggagagcttttcctaaccggggtattagcggcgcggactttgttctattttctccgagccttcattagtgtgctgcgaagcgtggcatcgcagaggggcgacctgtgatagaaattatcgtgtggctcagacaacaaaaaagcagtttctgacggtgtacacagttctgtggcccagcgctctaattcactgcgctgccgggagtgaccggctgttcgtcttcgtcgtacctctttcgtgtaggtttcgctaatttccctccgacgcccagtaagaggaattatgatgggcttagatcagtagatgacttcgaaggcttgtgggtcgcagatggcgacagtgtttaataaaaccttaaacacttggtgaggcctgcctcaaagcaagtttttttttgcgggccgggtcatttcagagttagaaaaaagttttcatgtacatctctcgccgtatttgacttctca

SEQ ID NO: 1755 - DNA, 1563 bp, Toxoplasma gondii
ttcaaataccgacgtgagcactttgtaagagcaagtgttgacacagatgagaggaaaggagaaacgcacttagaaggaaaaagagccggggatacatttgtcccagttggcagtgatgctctgaagagaaggaacggtctgggaagcatagtttctgtgtttccgagaggagcccggcgtcgtctctgccacgcgaatcacatgttctttctgacagtttccagctgcctcttttcgctgttttctcagctcatcgaggaagtaacaaagacttccgggcaaaagtccgtggcggtggagagcagctgcagcgctaagagcgatggcgtcgatgtgctgcttcccacaatttgtgtactcaacaaatgaagtgttccctgtgaaggcactgacgcaagcggcttctgtgctatagttgctgctgcgagtttctcccccagcgtgtcgggagcgcgtaacggagaagttcgctacgcttgttttgtcggcgcgcatccaccagtgaaaaccccaggaggtttcgtgcctctcttgctttcaaagaaccagtgatcaacggacagacatatgccgctatttagcctttctcggactaaggggaccgagtcgccgtgtcaaatccagaagtccgaactcgcatctttcactcggttacaacaaacgccgcaaacgacgtcacatagcgagctcacatgtgctgccttccactgtcaccctctgctactttcgagcgcatgcggcggaggcgttgccctttcggcaccaacagagccgtttctcgttctgcctcgctgtgcacgatcaagtgcacttcactcgagatgtatgcttacacatgtgtatatcgtgagcagaactcgaggaagaaaagctgaacggagtcacagtgcgtgtcgcgtaggcaggcaccttgttgccctagccagcacatgtatcgagacagcacggaaaaggatttagcgctccccgaaatttgcccggcgtacctttggtatttcagcctgcaaacagtccatgcgacacgcagaagattgtggcggcaagacggggagggaaatcagaaaagaatacggcaaattccatgcagaccagtggagaaatcacggagagctgtagggaacattctggattaccctcggccgcgcggcgaaactaacgtcgacgtccagtccgcgcatgcacacgcacagcggatcttggggggggaagtacgctgtttagctggacagctgccgttctccaggtgtcatccgcagacccggtgagctgcgtttctgggttttcactggcaggctggggcgcgagcttcttttcgaaccgaccttgcgatctgggacgtcgtttggttaggaagcaccgacaaaaacatcaaaacgtcgctgctgctcgggtgtacgtacacgtcgacactttgtgtgcaccgggagttgttcggacgcagctggcccttggagtggacggcaacagcttctcttccgtatctttgctgttcagcttgtgtccgtgtcaatgtcgcggggacatcgcccctcgagttcccatctttcttttggttagcgtgta

SEQ ID NO: 1756 - DNA, 1681 bp, Toxoplasma gondii
tgttttgcagctgtcagtgcacacggataaggaaaaggcactctggccgccggcgaacccctgcagtccccaaggtatgcaacctgcacattcagatattgctcgtaccgcatctggagggtttcttacacagggaaaggggaaatgcaaggcccgtaccttcggcagttgtgcagaagtgctggttcattgctgcagggaagcgccgcgagctttcagaggttggacgagaaagtcgagaaacgaaagtgggcgcgcctgttgccgcatctgtaagttgttgagcgtagtagtgaacggaaatgtcaacttcagttgtggaatccaacaagaaggagacaaatagacggtcggggtaggaggggtcctgcacgcgaacacagcaacatctgcaatcgagaacggcttcagcggcaaaaactacgaccaaaacaacattccttgggcctcggttatgtatcgcccgtagacgttcgtctagatagctgtgcaaaagaaaattcagggaaaatcaaaaagctacgtcaacggagaattcatggatagctctggagtgccaacctctcaacaccgccggcttagtcttgcattccttctctggggacatgtattcgagtctcgaattcatgcaaaaacagggcgggcagaggcctgccattactgaaacagtacatgaaggaattgaggccggttccctgagacgtgcattggtctgtcggattcgtcgagacccgacagagtatactgccatgcaagaatgtctctgtatacacatgtacatatattttcgagaagtcactgggtggccaccggccacctgcgcaatatagaatagaaacctgcagcggttttgttccccctcgcgtacgtggaagcattttagggagtgcttgtgcaagttgactgggttcttgaccacgcaagtctgctgtacactgagccgcggaacagcttccggattcggtacaggaacttcactttgcgggtcgaatcgagggtctgttggctgctgaagaggaacgttggaagttccagctcggccccccacgttcggattctggctggcaggaatgaaaacaacctgctgagggccgtaactcagtcggctagagggctcttgccggtcccggctgactcctccacccatcgcgagggcgattctggggaatgacgcaggagggagaaaaaccaggttggagcacccgaagtggacgaaattgtcaaaatatcagtaaaaaaaaggaaacaaaaggacccgcttaccttccgcttacgaaaacaaaagaaattaccggagaccggcaagacaacgaaggcaacagctacaactactcgcttcgttccagagaccttgaaaattccgtgcaattctctgtttaggaacagtcgtgtctcgtgcaaaagcggaaagctgagactgtctattgtgtcttgccgccaacactttttggtgttcactattttagagagcgaagaatattctccgggggaagaggtgatgcaggaaaaaaatcgaatcacgcacaaggtaaatgcatgacgtcagtgcgagttgtcgcagcgcacatcggagggcgagacggtaaagaagccgccgcgagtttgctactttctttcactgttgaaaagaaaccgattagtcgtgttgttttctttaggttggttgtcttcgttctccgta

SEQ ID NO: 1757 - DNA, 3052 bp, Toxoplasma gondii
cgaatgtatacgtgagcgtggatcgctggaatgatgtcgcaaaactggcttttgaaaatgttatacaaaaaggctttcagagtctgagatacggcgcggggtcgtcgccgttcgtctgttgcgaaatcgtgtattttgcctttgtcggccaccaaggcaggtagaagacgtggagcaggctctgacaatgattttgtccttgtggtaatctgctagaaaggaactaatgtggaagtttcatcgctccaggttgtgggtgttgatgatatccatgtgactagcagttttgtacgaggtagtggtgggggatcggtcactcatgttcgcgcagattgagtgtcccaggcggtggtttctctgactgcactgcttcttcaggtttttctacgtttccagctgtatgcggcgaggacaaagacaacatattccccgcaactcaacgagagcgtcaggggtgcggtactcgggtgcagagatacctgagttttgtttccaagccatctggactgtttgcttcagcaatctgctgatatattagcgacggaagtcagcgtgtcatccgtggtcttgaattctaccttggcgtcgtctagcgctaatgttagcacttcttctgaggcttccgcctacgtgctggtcgtcaatgaactgccacaagacaggggcgaactacttctctatcagtgtagcccacatccaggcactcaaaatgaacgagagccacaagaagctgacttatccaagacaaaggtgtctaacgttcttattgaggcaaagcagtctggttaagccgccggggcagcagtgtgacagttttgggggatgttgtggcacccgtgtcaagtctggggctgagggttcaatcatccaatggcgacagtggagactgatggagggacagttaagggaaattgagaaagctggggttgacgcgatttcaggggattgatgcggttggtgaagagccagcctggtagtacaacaacgcgatggcaggggctccgtgctagtcacgtgcttgtgaaacgcatttttgttgtttccctgttgagttttttaacaggaactctgctagtagcaaccgaatgaccgctggcggcggcacgtgtctcccctttggattgtttctacatcttccttccccaccatgttactatcgatgcctctgcagtgccactatggatatcagaggcccatcgaaaaacagatacccaagtcacctggtactggttctcgctaaattttatgtagtgggcgggagccgattttggagatcacgtggctagtcgctggtgtggagaccagctgtagtagatgtaatcgactaccgtggttgacctgatggcatctggtggacacacttgcttgccttcgtttgccatgggattctacttgacttattcaagagaacatcgctcccaatgcatcagaagaacgcatttgcaacaccactttcccggagaaactggggtgttccgagacatgcttaccaatccaatacacttatgtagatgactagtgaagaaaggagcagtccaccgtctgtatggaacgcatagcttttagagccctatggcgaggactacaccgggcgcgtttgtgtcaccactgttttggagttttgtcaacctggctaatagagatgtgacatgaacgactgagggggaagtatggaataagaggcagcatgacgaaacggaaagcagaaacacacttgcgtgtggcgtcatgcttgttttttgtcatggttactgagatcgcaacgcgacattgttccttcaacagcacaagatgcaaaaaaccaagggttgtgtaccgtcattacaggcattaaaagataaaactgcgagaaaccgggcctctccaaaacacattcgggtgctgaaacgacggcggcaggattcgaacctgcgcaggcagagcctaatggatttctagtccatctccttaaccactcggacacaccgcctgattgtacatcttctttcctttcaccgccgccgtactccctttttcctgtttcagggtttcctgtcactgtaagattagcagagagcagactgaaagacagaaaaccagtgagtgattcgtgacacactaagatacccacaaggtaaggcgatttgcagagttgttcttcctttcgtatcttgcgcacaccacccgggcaccgggtgtggcatctcccctcaaggtcccatcgcagaggcattagtatcatggacaccttcctctggttatgctgttcttctatctccttatttttctccaggaggaagaatttacatgtggcaagcatgtgaaattctggtgagtccctggaaaacgttcgttttccccgtctcagttgtcttccctctatctcagttccgtgtcgcgagatctgtctacaccagcgcccggtgggtcggtccgtttcttgggcaccgaggatcgacgactctcaagtctcttttttttgtatgctggcgggctgtgtgttacctctacttcactcctatctcgttatccgtcactcttttttgtgaagtctacgcgtctttaggcgcgatcgaaaaggcttttcttctctgcgttctaccccgccccgctaaccgtctgctctcacgtaaaactgtctcgcctccacgaaaggggaggacacacggagaaacaaagagatatcgggcgacagaatacatcgagacgtcggagagcaagaaggatcaggcgagaacgtcgacttgttttattctctgtcgggcgcgcgttcttcacaccctcagtgtggatttatatgtgtcatgcgtcctgcggttctcaggcgctcatcatcacaaaggacacaggaccggggagtgtatggcctcccttcctccatataacacccacgtttctcggtctcttgtcatgcctctctcgtgatatgccattccgcaattccacagggatacctgcaacctgtttccaacttgaccttccccgttttgtccgcgaaaccttcggcttggcggaagaaagacatatcttttcagactctccctttccgttattgtccgtgtgggagaaaaaa

SEQ ID NO: 1758 - DNA, 2406 bp, Toxoplasma gondii
caagtgtctcggcgttggctttgccgtactgcagtgacgcaaatgcagagagcgtccctaaactaatctgaaatgaacgtgtggtggtgccgtttccgaaatagacccgaggttgcggtctggtgtctcgagtgctcctggaaccatgcgacctcccaggagtctgtgatacagggttgaactgtgtaaatatcattgttatgtttacgacggtacgcttttcggctgatgagtttctctcaataactggctgagagcttttacgaaaaattatatcagtgcattaccaattaagttgtgtagcatttcctgtgctccttaacatcacatgtatctgtttacatcgtacctgaatggtatttgctaccgggagcgaagataatctaatatgtaaatcaggtcatggaaatcaaaggagctttcacgctatacctggtgccagtcgagtcgctcaaggatgtttttatcctgtttatgatttaagggatgtaaagtctctgtacaaatgaaccacgacccaggactgaataagtcaaatcgaataaacagagacattatattacctaggatagtgaatatgactccagtcatgagatacagacaaccaagcagaggaactcagggtccaacagtcgggccatctggatcctcacattcaaagataattctctgtactcatcatacacaagtccctacttgaaaatgaaaaatcacagagatagttgcaccctggactgcggttttttgtttctattgtcttgacggtatgcacctgagattaatatgttatccaatacgaggtatcttgcatggtacttccggcacagggcttgataaaaatccagcagtgaaacatcaaagtgtgcgttgctgcgtctattctttaactcttcctctacacgccatgctagcacacaagtgtagagcatcgcttacattacggaaaaatcgagtgcttttctattgggtttcgagtagagcattcgctcgactactctacttggcttctctgctttacttggcacctgcgactatatcacatcgttccccaggtcttgctgtttgttgcgcgaacgagagtcagctaattcgcttctacctcgctatccgtaccatagagtgctttgctagtttatccagctactgccttgcttgtgaccgccgaccaagaagcagcggcgacgcttcgctacgctggctctcgccgaagggttgtttcccatgcatataaaaaagtagctccctactggaggacgctgctgcagagaatgatccaaccaaataaggacgttgtcaatttcagcgtaatgagcaggaaagcgaaggtttctcttggcaacaatatgcctctgtgcggcgggaaaatacactacaggaagtgcgcaaggggacctcggctttctgcgctgctgcccgcctaccgcgcagaggtggtgtgtcgtggattgttccttcgcacgtccgaactggggagacaaagctagaggagaattcaaacaacgttacactatacggattcccattttctttcgactttcaggcgttttttaactgcatcgaattagtgtgatttgcccgtacccgctatcctaggtcattcatttcccatcgctctgcatgcaagaatcgcattcaagacatcagcagctgttctacgttccttttgttttctgggtatttccgagtttctacgtcggcagatgtagaaccgtgccggctttggccaaagacacttccctttgcttcttggggtatcaagcattccgtcagaggagcagaggcggcaatttttgggcaggttgccccgggctgacgcgtgttagaagttatttgacgctgagccgtcttctcgttttcggcgacgtttctccctgttgcttaggtctcaatcggtgtccctcgcatatttccgtccgccgaccttgctgaagtctgcgccgtgggttgccagagcgcctcagcaccgggttagaagctttttgagaacgtcgccgattcttcggcaagtaaggcttgaattcatgtggcagcgactcgggtacggcgccggcactccagtggtgtagactggcgtccgagcgactgcaagctttctcagaagcctgcgacgatgaaaattttttgccgggggggcgtggcatcacttctctccgttcgcctgcctcggtctctgccttctctggctcatcacagcaaggtcctttcccacagcagttttttgccctttccaacaggaagttttgattgcccaacagctgtttccagtggaggtgttcgtgctcttgcgggtgcccggcgggatggacgcgcgcgcggcgaagttgccacattccgactagctcgtttcgacgatcaacaaccttggtggccgcattgcccagctcgtctcatttgcttctgtgcaaa

SEQ ID NO: 1759 - DNA, 2280 bp, Toxoplasma gondii
ctcgaggtggtctcgactttctccgatcttccttcacttgtctagacccgaatcggtattcgagcaacagtttggttttgtgtgattcagcttaccaagatgcatgtttgaaacattaggggagaattgggaacaatggtttaatttaagactttttcagagcccagttacacgaaatttaaaacccacatgtgtagaaaaatgtgcggtctcctggtccgtcgtctgttggttgagttgcaacgctgacaagcaaagtcctactgggtttcactaacctgcttttccagttttttattgccagggagcaattctacacaaatggcgggcaactattgattcctgcgaaaaccgcttccgctctccgtttggggaaaatccccgtgtaccaatgaagctttaccttcccacttgctaggctcttccatcgcggcaaaactaaagctggtgacgacacccttttcttgaggaaagcaatcttttccatatcatcgttattactattgtgttgcagcaccggttgtcactactggaaaaacatttaagttctgcgttgcacagaatagccagaaatccatttctttttataagacagaaactgtcgaaggcgttttgaaagcaggtgtacctaccgatacggaaacagcggtgtcactttatttttgatgccaacatttctccaacggctccaacagtcgacacaactgttatagtggtggttcagttcgataattacaaatttgactccctaacacgtcggttggagacactggtcatagacctccatcaaggctcccttagttcgcaaacatttcatcggtgacacagtgaaacaacactgctgggacagcattccgccgttctgactcgctggaatacgccaatggtgtaatgcagggttcaggacagcttcgagcatcatcgaagcaacgttgatgctccgaagtgctcaggtgacaaggaaaactttagattcataaagaaagctttccgagaatacagtccatctacgccacaccatatgtcgtccatcaaacttacgggaatcgaatgataatcacggcaatattttctgtagcgtactactctgcgttttacagtggtgacagaaacgtttctttaccatccactacccgtacaccatgactctgcactttcaaacagcgtttcatggtgggtttgtaggcgtgtacgccttcggaacaccccggattttttgtcagtgttttgcaagacactcaacaagctatgaccaaaagggcgcagctcagtttacgctaaacgcctttgaaactgtcatccttgtttggagctgcttcttcaaaaaggtcaagagagaactaccgaggaaaactcgccggagagagcgcctaaattcatgaaaaacgcatgtcgcgtaagcaccgcgtagtgttcatcagatcggcgttcttgtgaatcactttcgcagacagagacgcctctatatcacctttgcgagtagcactccgccgacctctttggcaacgctgacgccacccgctgcgggttctgttttccggtggccgctgctcattcaaggggcggagtctaccagaaagctgtgtcgacagccagaaagtatccaattgctggccccgccctcgcatgagacggacagacttccggttgtctgtctctgagaaaaagatattatcctcaagagaagaacaccgattgatggcgacgctgaaaggcttgtcgtcagatcttgattggatcctttcggttttacggttccacaacgtgtcccaaaccttgattcaaagcgacggcaggtgcatgcacatgcgaaacaacggcgtggtaatagttcagccagctgattctagatcctctgccaacagcttcatccctgaagagtgttaagattgctgttatgtcagacttttttttcttctcgtgccttccacttttgactgaaagactccggagaaacattggtgtttctttcgttcgtctcttgtgcacgctaacacagaaagtcggctgcccatggtaactgtttcaacctccagcttttttgtctcgattttctacagtgacagtagttgaacacgcatgcaaatgacaggcctcggtgccaagctggcaaattgtacggctcttgttttttgcgaaaggggggtgtacaaactgtctacgtttttcaaagttgcggtggtcggaggcatcacattacgaactgaagcatctgtgtacgtgcactctattcacattcacaggggataacagtgtgtctttaacagcagtgatgccaaa

SEQ ID NO: 1760 - DNA, 4434 bp, Toxoplasma gondii
aagtcttcgaaacgtcaggtgggaatatgacatttgcgtgaagtggatcttgaaagtcaacaggtggagcgcgcgagtccgaagacgtacacgaaggtgcagagacaggaggagacgaaggagagactggagaagaaggagagagaggggaagaaggagagcgcagagaagaaggtgagagaggggatgaatgagagagagaggacgaagcagagaaaggcgaggaagacgggagtcgaggcctcatgatgaagaggttcccttgagaagttcacagaagttgagttcagcaaaactgcgggaaggagagaccacgacaaaagtcaatgaggttgacaagatcaggcacaggtgcgccgaggggagacaatcgcgagtcccggtttgttaagacagatgccaggaatccttcgcctcctgcaaaggggcaaaaaatcgtaacggacaagaagcactggcgaacgcacaactcgggctgtagcaaagcctgccccaagtgggaagctctggagagaacgctactttggcatgttgacgaggagacaagagcggagtaaacgcatttctgactgcctgggaaggcacacaagccgctgtgggaagccgccgaggttgccgagaacacaaatcacgcaggagcggatgttgagtgagttcatccggaaggacggaattgggaagttgtggcgatgcgtccagaacagaaaaaacggatttgacagaaaaccctgaacccaaggcagacagccggcgaaacgaagcagaacaaattgaaaaagttcgcagaagaggcgcgctagaagagcagcaatcgcttacggtgcgtcgggtctcgatacagaggggaagtaacgccgacttcctgggagagaacccagtcagcttgtcgcgaaggactggggcagagggaggtaggtgagctgcttgagtccgttaggaagcactcgatgagtgacaagacagagcatcaacggggaaaaagtttggcaaaaaaaagaaaaacctctacgagtctcggcggccgcggacagacccgccaggcagccacgcggaacaagcgaacacgggtgtcagaagcgggagaaaatcgaagcgaaagaacgagaaacccttcttttttgaggcttggcgactcatgctccatccctttttttccctctccgcaaccagcttgagagaaacgcgggcatccaacgatcagcttggatttttgtcgcacgcgaaccgtccagacaaagcgcgcgcgccacccgactctcttccctttgcgaagaggaacagaaaaaggcagcggattcagactagctctttttacgtagaaagctcgcgttttttgctggaatcaagaagaaaagccagacgcctacacaagaacttccggaagttccttttcgcgcgcttcaaccgccttctttcgaagcccttttttcccagcgcgcggcgcgaattgctctctccagctggacgtttagcgtttaggcttgaggggtcacgcgttttggttgtctgtggtttttaacaaagacgacgcgggaaatgccgccagcgtggaagcctttgatgacggagaccgtgaggacaggctttctcccttccagcttcctcggaacacgggaaagtgaaacgaaagtctcgccttgacttggctgctagcaagcgatgaagagacacggagaatggatgcaaccgcagagagtcggtcgccatagaatcgcgaggcgccagttgaaatgttcgtcgctgaaactccttccacaagttcgggatctcaaacgttttcgcagaagaagcgcaaacgcttgagttggaaacaccgcgaacgcggacgaagagcgtgtaagacacgagaggaagacagtgcgcggggaggctggggcagccccaggcggtcttggcaggggggaaaaactgaagcaagaagtggagcagtacgcttcctagaaaaaacgagactcctttttctagtcgcgtctatttctccttttaagaaaatcgaattccaccgtgagggtgacaagagcttagagggacaggtcacttactacgggtctactgggaaaggcagatctgtatatatagcgccagcagccagctctccagagagggaaacctgcacatgcacgaacctcctttggcaactgaagaaagccatagcctccttcaaatgccaacgggtttacaatgtgttggacgtggctataagtgtttatatttgtcggttaaatatctcccttagtttctacacgggctgcacgactcgcagcaaggcggaccggaagagccgttcatggaatagcgacagtgcagtagtatacagaaagtgccctgaatcacgagatgtttaggaggaaaattttcactcagacttaaacgaggaacatctgcggttagtgatccataaagtgccgaagaaatatgtatcttcctgcaaaccacaacagcgcttgtgcacatcgcgcatatcgccttcgcgatgcacaggagtcacagaaggcctctaaaaaggcgcctattagtagtgaatgcgtatatatttctctttccgctcgaattcaagagagtggggcggcgtgccctcttctcatcctggaaccgaaacgaggaaaccttgtttcggcgaggacgaacctggagaagagtaacacatgacgcgttggatgttggctttgcttctggtcatgaaaaccgaaaatacacggagaaaggacagaaatacgttacagcatccactacggaaaggcaagcctcctgagagtgctatgtcgttcctcatgtatgtctccgtagttgacaccgtcgaagatgttcaacttggcgtgtcactgtgctcaaaagcttcttaaagccttgttcaagcgaagtgacaacacgagagttattgcaaacggtgttgcagcatttcatcctgccgttctgagaaaaaacgcgacgccgcaacgctgcccgcaggtagagactgtggtatgccgtgctagttgagctacaagggaaaagggggaaagacgagcgtctgtcattcagttccccgccaaggcagaggtgtctgatgcgaaaatcaagaaataacttgtgtgctctctgtatcaagagatgtcatggaacacagaacgtctccttagaacatgggagaggctcagtgaggtcaagaaaaaacatcaaaatggtaacagcactccagcagtggtgacggcgagaaccctgggggagacagtgctgaaaaaagacaagggagttctctcagttgcttctattcccgctgcatccttttagtctccaaccatggccggggataacagtgagacacgcacgctctcacttcgtgtgatgtctcagctttagaatatgtatcttctctctttactttgtgttttcaaaccttttctggatggtattttgttttctgtggcgaggagagaagaagctgcgttcttcgcgtctctcatgtgactgctactgtgcatctgttgtctcggttgcctttctccttttctcattctctccccatccgagaccaaaggaagagtcgagcccccgacagaaaaagtgcatgtaaattgaaacacaccgctcgtgtctactcaaaggcggaagtagacgacgttgtagagacacagccagttgaactccttgcactactttagcagaggtaatcagggtgaggactcacctgtggaggttcggcaaactcggaaaaatctgcactggtctggtgggggaaatgagtgagaggacaatccactttcattctggaaaaaaagaccgtcaagatctgtaaaaagatctcaactcccgagcagtcaaagagtagcgcacggaaacacaaagacggacggaggtcgagagagacgcagatggtaccgaggcagaaggctagaacagcgactgcaaagcgacagagaacgaagcacagagatgcagggagagtaaagagacaggaggatggagagaggaatggattgtgaatacggaagggagagaacaacgatggaatcagacgggcaaaacatattcgtttgtcttcctgtaggccccatgttctctggcgtctttcagcggagctcactttccttcagggtgttgcatttgttccctttcttgtatatgcaaggcaatggcgccaccagacctgtttgtttttcgtcctttcagcccaaatgtttgcctaacacaaaagctaatgctacatcattcgcgaacgagaaccccccggcgcctgagccaagtacatctatcgcgtatgcatctctcgcttgcttttcctaaaaagaagggccgatatcttcacgaaaaaaagaatatcgttcttctcctcacacttttccatggagtcgatcccgatcctgatgtctctcctcgcctcgtctacccagagattgagagaagggaaccttttctctgcgcggtgacttttctctgacggcacacacacttgca

SEQ ID NO: 1761 - DNA, 1732 bp, Toxoplasma gondii
gtctgccctcttcgaactcgcgaaactccgcaacattccgagactgggtctgcggaggcgcagcgcgagaagcagccgaagaggaagggagagcgaaggaagcgaaccgccacggacatggagagtgagcaagcgagggagacagaaaacgaggagaaagagggtgaaggaaaccaaacgcttcgcgtctctgcgctcgactcagagaggctttttccagcttgatcacagggagcaaagaagaagatccgcggaacgcgactggaggtaccgaggagccaagaaaggcaggcgggcaaggagttgtttccccgcaaagagatggcaagtggagtcgagggacaggcgacaagcgagcaagagaagagaagaggctggagagcaaggattcggagagcgtctcagataaggacgcggcccgctgaggcgaccggagaacgctcgcttcaagagggagactcgagaaagagaatcggcgagacggaactggcgcagcgtccgacagaaaaaacgactgagaagttccagaacgcgcttctcccgccgaatgcgttcgaccgccgatctgaggaaccaaagtcggaaacgcgaggagaaacgagaggagaaacgcgaggagaaggctcgtcttcatcttggggagaagctaagatgagaacttgctcgcgagtcagaagcagcctccgaagagggtatgaggagcagcagacgcgcaagacagaggcctccctacggaccttcgcctcgtcagtctgcctcgttcatgcccttcttctctgtctcctttctcgacgtctgaattcgcctcttcgcctctgtctcctctcccttgcgatgtcggcgttctccattttcaggtgaagctggagcgaggtcgagataccttctcgcgtttgtgtcttgtgtgtgcgtcaccttcctcgcgccgcgcctgcagggagagaagacgcgcgaagagaagagacaaggctgagcctctctctccactggtgaagagaaagcgagtgagagagagaaaaaaaggaaacgcgacttatggatggccttcgaaaagcggagacgagtgctcgcctacgggcatgcgttggctttttccggggctgcatgcatgctcgaaaaaagtcgccagaccgaggacctctctccgtcttttttgctgtgcttttcaactttccgcttccaagcaaacacagtctcacgtttcatttcttctgtgtcgtttagcggagtccccgctgcctacggctctcccccggtctcttcctgccgcggcctccggtggcgagagaaaacgtcgctctcgtcgtcgatctcgtcgtcgatctcgtcgtcgctctctcgcccagcaagtcgccttcgagtgtcatgttttctttccttcattcttcgtccccttctgcctgttcgctctcgtcagtctcctcctttctgcctcctttcgcccctcccctctcttgtctctcacttctcgtcggtctcttcttcctcttcgctttctcgccttgtcttcctcaccctcttcttcgtctcctgtttctctcttcacttgctccacgcttgcggatgcctttttctgggaacaagctcgcggatttatctgcatgcgacagtcgagagaagcatgcagaggattctggagcctgtctcgactgcagcagatagccatatgcagagactcacgtacctgtagatcgcctcaacttgggcgcgttcgaggcttcttccaggagga

SEQ ID NO: 1762 - DNA, 1776 bp, Toxoplasma gondii
ctgcccacattgcctgcaagttcgctgagatcaaaaccaagatggacaagcgttctggaaagaccctcgaagaggccccgaaatgcatcaagtctggtgatgctgccatggtgaacatggagccctccaagcccatggttgtcgaggcgttcactgactaccccccccttggtcgtttcgccgtccgtgacatgaagcagacagtcgccgtcggtgtcattaagtcggttgagaaaaaggagcctggtgctggcagcaaggtcaccaagtccgctgtcaaggccgccaagaaatgagctgttattggaacaaatctaccgcttcggtgatgaaaggtagcctatgttgcatcggcctgttgttttcgtgacatgcttttggtcgttcttcaactccttggcttcttttgtcaggccggcgttgtcgcgttcaatctgtcattgatcttgcttgtttgtttccaaactcaagctttcgctcccctaccgtagcaaaactcttcccctaacgctgcgctactgactcggccacttgtcgcccactgcgggaaggtgtatcgatttatgtaggggtggttgagtcacagttccacagatttgggagtatgttgacttccctcattttatttacgccttcgtggtatttcacagggcgctgaagtagcgcatcttagtctgttcacgaaatgtgcaaaaaacaaggcaacaatgcctcccaacttccggatcacgttcttgtatttggtatcctgtaaccgccttaaacaacctagccggtacatactgtcaatgttcccagatggctactcaagtaggcaggtatgagatatcggctgctttagggacttgcgccacttaccggaaaacaggcttacggttttaacggccacatcgagtgaaagcatagctatgtgacggctcggcttggaaatacgacggaactggaattagctcaagtcgcttaatgcttcagtaaataactctgatcttgcttccgtacttccacgtcactgaaaatgcgtcgtgcagtcgctgagtggttgccagcatagcttaagtctttggtacgcagctttcgatgaacgggacggttgaagctgctcgggaaccgaaatccttcgctgctggcgaggccctgtaataactgcagagtgcggcattgtgacatttctacgtctattttcggttaatattacaatttgttccttaaactaacgcaaaaaagcatcaacagttaaaacggtcactcatagtggcatcagtttcagctgttgttgcataccacaagcctggtaagcatgcgtgtcttcttagcatgcctcacttgccggatccagctcttccttgtctgccgacgcagcgtaattttactagctttgcttttcgtgacaatgagaaaaatgcactgaatgatacctgtctaagcgctcacaagaacctacaggatgataattggtgtctcaccggaatgcaaaaatcagcctgaacgtttcagaacctcaaacaccaccgccgaaccagcgagttcttccgctgcttctgtcttgtccgcgtcgcaggatgcgctgtttgggtacttaaacaacttgcgcggaggagcgaacctcgtgaattgcttgtcaccaattttcctgtatatgttgttgcctatgctgtaattattattcgtgagcctctgtctgatggacgtttcctcccccagcgcgggccgccggagacagctagcgctgcgccatctcgcgaactctctcgctcggatgactttagtcagtctgaa

SEQ ID NO: 1763 - DNA, 1708 bp, Toxoplasma gondii
gtaacttggttactgtgaaatccgacggaaaaacgcgttgccgatagtcacgcacagctctctgaacataaaatgtgaagggtgctagaagtcgacttcatcgacagctgcatagcatttgggctcactgtcgcagttaacgaggacataccttcactgcctggattctatagagatgctctcaccgaacgatcatcacacaggaactctggccaacaatatgatggcagaacagcttctagtttccctatgtaggatctgcttgtttgtaggtcgcaagtgggtgtctttttcagtcagggatatgtgaaaacgctccctgttgtggagttcggtttggatttcggcgttttttcgatgttctggcgtctgcgcactactgtgaatctgtgatgtgccataattgagtctatacaagttgctagagtcatttacatcagccttttatatcgcgactcgcctgcgcatactcgaatacttgcaacgagcatcgttcgccaaacaaatctgcgaacagttacgtgcaactgactcctgccgtcacttttcctctgatgttattaatagatgaacggtacacagacattggtgattggaagccagcaatgataacatagaaatcatagtgatggtttggatctgaagtgtattcggtatactcaacgacgtcaagaaacttgaagactatatgatcgccaaatcgctgttgcctccttaaggccggaagccgttttccattcgaaagccccgcccagagacaagttcccagggacagctgacaagtgtaagttccagtgttttcatgcaaaccccttgagaaatgtggtgctccacaagtttgtgacccggagaggcttcactggcacctccagcagctgtctccgattctgatcgttctttttggtcccgaagaccatcccagacaatgggttcacagcgtcttttttagatatcgcaagagcgagtaacgcatggagcacgaagctgtggaacttcacctttgccttcttctaatcctgttcatctttttttggatctcttattacgcttgctaccccgagagctagtccgtcccttacttttcgcgggcagcagcctgcatgcagtcttactggggtttggcactgacgcctagcgcgtctcagagacttgctagaaggcagagaacgcattgaacagtctcctctgcgtcgtatcacattcaagtggctttcctcaggtgtaagtacacctgagacttgcgccgcattaggggatccacaacgccgtccgtcccactttgcccctgcttcggctgcaacttgaggaaagcggaagttgcgtcctcgtggcagaaacgttatcattcttcgcgaagttgaccgaaatatctaaccattcatccgaaggattgcttttcggaagttggtgccccaactttggccgtcccgttccctcgccgtcgcagtctggatccatggtgagcgctgctttggcgcctggtagttcctatggcactcgatccgggcgaagtcggcgcctctttttgtccgccaaaaggtcttctgttcccctcaattccttttcagaaccgcgtgacaatcaaagtaacccccgttcttcgctggcgttcttcggcgtctggatcccggaacgtcggctgcatgcctaaggacaagtcaagaagacgattactcgagcagctccgttctctctcactttttaccga

SEQ ID NO: 1764 - DNA, 3868 bp, Toxoplasma gondii
tctgggagacaagaaatgttctgataccagacggaaacttaccgagtgccgagggcgggagccgcttgtctatataggcatgtatgtgcatatatatgcgttcatatatatgtcaatctatacatgtggctttgtgtcgagatagagcgtagagcgagctctcgcgcgcgccaacgcaattagcgttccttcttgcggacgaaaaaacgagaaggaaaagtaggcggggagcaggaggcgtgacatttcatttctgtcctatgttcgtagacgtgggttctgcccggtgaagaatgcgttcctctgtttctagcgtcgtactttcctcgctgaaaaccctctctgcagggagctcatctgtttgtttctaaaacttctcccatagcgcagaccgagtcgctgtctccaccgggttaactctgaagcttggaacactgatgaagcacgcagatgtgcacaacttctttgcccccgaacttgaggcacaaaggaacacagttcgttgcagacacagccataagtccacgcgcggccatagggaggttcttcctcctctggaggcgatagagtgatatcttcaaagctgcgtcaaaatgtgtaaatcggtcacagagatgctcacattgtgggtgtgttggcttgcatgctgtacttcttgcccacctttccaggtatttatttcaccacatgtgggaatatctatattggtataaagacgccctttggtgcctatgcaacggaatcatccgctgcattcttcaaaggtgcccacagaaatcctgcgcatgtattcgtatgtatcggataacgtaactatcacggagctcaggttgacaccggactgcagtattcatgcgtgtgttcttgcctgtgtaagtgcataaaaatccagtgaaacacccgcaggttgccggtggtaaactgtgaaaagtaccacactatgtgtttggggcattttctcaggtgatcaccaactttgagatatcgcagtcacgcatgtgttcttcagctacagaatcagcagcttgtgcgcctgctggtttacctgcagggagagggggcgctacggggggactgaaactggactgtcgcaaagactgttgtatacgaataactgatcgtaataaatagaaccgttacttgttctttccctacgaacgttaagaaaagtaaacgaccagtcttgtacgccgtcacttacctccaaaagaaacacccttggacggatcaaccggagggtctactgctgcagttggcgttcaaaggggcggtcgtgaaagcggaagaatttgttttcaggtgaaggaaagaagtgttgttggcatttgcttcctttttgaaacggacaccggggtgacggaagattcgtcgtcgtcaaacttcttcgaccgccgcagcatatctttggatgatattggataagactaacaaagtggcacaggcaatgacgctgagagggttaaaccatcaacataaacaggttcccgtttgactacagcaaatatttagtttttgttttggaacagcgacgacggtccgacgtagtattttcctttcttaccacagagtgtccatacaatctggctgagagtgtcaacgtgagctggcttcaactgctcgtgtcaagtctccggctcaactcgtgccgccaccaatgagtgttcctgggtgcaggttcaagcagaacatagcaccggacaaacaggaggtagggtcacctcggatattcaagaggatcctcttatatgaccaataaatcgccgacaaattgaccttattttgagtcttgaaatgctgacgagttagctatatagactttgccaccggattggttctatgttcgtactgaaccagcgttgtcctcgcttggatctccaaccatcaccaatgaagtcgttacatgcaagagttcccttcataaacagcatactcaaggaacggggtgcgctatactaatccagtctagttagttccacttctgacgaaggtacaacgtcggcgttacaccagatgtgagtggaactgcagaaacctagaggggtgtctctggatctctcacgcacgggaggtctcttctcgtttgtgcgcttatgttctgaaaaaacaggtggcttttctgcgcttctccaccggcttacccattttacgtaaagttcccagctttttccgattgtcacgcatgtcccgcattcaacgcatcgcagttggcagaatactatattaggggagtggaaccacgtggcgagtttctcttgacatgtcaacactgtgtggattctctcaactggcgcccctgcctctgtgcactttaatgactcaatcgcttttccagaaggcctacagaatgacaccttcggcaacccgcctgagagctggttgtgcactgttcgctggaactccggggacaaattcaggacttctgtagccccgatcatcccccctcaccccccacctcgtttttccttgctgaactggcacaagccaagcatttccatttgacaaccgattttaaaatggtggcatcattactagaaaggcaaagttcttcgaacgcgatccacccgtgtgccgcgtgtaatgcactcatgcagtacagacaagcgagttcgagccttcggtacccttcattcgcctacggccctgctgaaaagggtctggaaagtgtttaaaaacgaagaaggcattcccttcgtccgaaacttcacggaaaagatgtggcgggagttctcaaactctagtgcaactcgcttgtcttgacagctagccagacggcatttcctcagactcaacagggcatctcttctgtgcacggagagtctagcaggtgggactgatgcagatcttggcgtgaacaagtcgacttttctttgaagcgagagtcaaagacaccgccaccagttgagctagagtgctgggaagaaaaagaaagaaacccaaactctcccttcgctgtgcccgctcctagggtcaccctgcgaccggactctgcctccgcgtaagcggcccggcctgtcacctctcgagacattttgtgtctgcaagcgatgtcagcttcaccgtaccaaaaccgttctgctaatcgcgggaggagcccaccatgtgtccactttttcgctcctttctgtgatttttctgaccacgagctgaaacctagacgtctgtgccgcactctaccgcgcctcacggtctgagcgccgccgttttcaccggctgcttctcctctttgtcgtttcagaggaaactgcgtgttcgcttacctttgttcttgagatttcctttttttaccgacgggatttttcaggaagaacgccggaatactgagaaatctccaagggtgcctgtgctcttacagctgccgcacggcctcaaacaggtctcgttcagcagtgccttcctgctgtggtatttgcaacggagtgcaattgcgtgcaaagaaacgcatgcatatgacaaggcctttcctgcttcacgagatagtcgacgcaaaaaccttcaatgccctttttccctctgtccgacccacgttctgcctcgccccttggcgcgtcgttccagagagaacgctggggccgtcaaaaggctgctcgacgtccggagcccgttactacactttgaacgcgaaattggcatctgcaagcgcgcgcgtgtatcccatacgtgtctgcatctgtgcttccccgatttttctgacgaattgccgttttctcagcgcgaccgcaactcagtgttgagttgcgccctctgtgccgcaggcaggagtctgtactccacagaccgggctgctctttcgcttcgcgatcttctcatcatgtgaagaagtcgggacccagagacagtgtcgaattccctcttgatttccatctcacca

SEQ ID NO: 1765 - DNA, 2005 bp, Toxoplasma gondii
atggagactgttgcctgcgacgaaggcgaacgatctctcctctgtctcttctgtctcctcgcgcaggtccctttcgcatgttcctggagcgtctccacttcctgcgcagtgtggggaacgctcgcgcgcgtctcgcgcattcgcctctctcctctctctctcgctgtcgcctcggaactcctggagaaacggcgcctctccaccggggcgcttctccacatccagcggctggttcgttgtgcgcggagcgagagctcttctctcaggaagaagcgagacgcatgtggaggacgcctcctctgcccgcgcctcgaggaaccgcacaggcggaaacgccgcgctgccctcgtcctgccctgtctcctccggcacaggctccaagaagcagggggcctcgcgcgcgcggcgcaccgcagagacccgtcgagcgcccagagaagcgcctgaaggcgaaggcggcgcaactgcgcacggagacgaagagaacgaaaacgttagaggagaaggggaaggaggagaaggagaaggaggagaaggagaaggaggagaaggagagggaggagaggggggaggaggagagggcagcgcatcatcgagaggagttaccggagagcgaggcgtgagtggaggggtgctgttcccgcaatcgatgagcggatggcgactgatttccttctgaattgccgagaggagaagaagcgtcgagcctgaagccatgtcttcctcatctccactccccagagaagaagactgttcgccttcctcagcgctgcttcctgccgggaggcctgaggcggactcgcccaccgcgcctgtctcgagtccggagacgaacggcgccggtagccgcgctcgagccactgcggcccacggcggggccttcggaggcgatgctcccgaaggagacatcggagacagccggagacagaagaagaagacagaggcaactctcaggtagagagaaggaaagtggacgcagcagaccgaagagtcgggctatagcgagaaggagattctccgagacaagaaaaacaggcctaaaaaaccgactgtggctaccaggccatgagagagagggacaaaaaaggtcggtgtgacgaaagagggaagagaaaggatctgcggatcgggaccgccgctctctcccccgcgaggtccccctcaacggatccgtctgcgtacgcacaccgcgccgtatttccgaggaaacgaagaagaaagctactaaaaaacctgcaattgttccggtggagaacgtcctctgaaacagggaacggctccttcaaaaggaggggaaggccaagaagaagaagaacggtggaagaagaagaacggtggaagaagaagaaaaagaacggtggagggtgcaagacacaacggggcacactagactgcaactgcgaggaggggaaggcctccagcaaagaagaagagctgcgtcgacatgggtgattaaaaaagcgtaaaaaatgaatttcccgacagaaacggtgcacactacaacggggaagccgcgagagcggcgcgctgagaacctgtacctttttttgcggctggtttctcgcctcggcgtcgaaacagagagcggtgacgccggggaggcgagtgtaaaagaggactgagacaatgaaagtggaaggaaacagcgtggagcgacgacacagaatcctcagaaactgcatgcggtttcttctgggatgaggaggctgcaagacgtgagaagacctctcgatacgagctcaggccgccggcttcttcttccacgcgaaagccgagaaaaaggtcggaaaagcgagtaaaaaacggagaaatcgacaggcaaagacgagagggacaggcaaagagaaaaacgctggggaaaagggcagaagcgaaggaagaaggccaaagacaggacagcgaggttgttcgcgctgctctgtggtgtgcgcgccactgcggcaggagaagcgggcaggtgaaagtcacaaggaatcacaaggaatcacaaggaattgtaagggaa

SEQ ID NO: 1766 - DNA, 2145 bp, Toxoplasma gondii
ttctgttgcttctcctctttccgcatccggctcctcaacatttgtcgcttgctcggctcctcctctctgtctcttcttctctctctcgaggtcttcctccgcgacctccttcgctctctcgcctcgacgcgcttcctccccgactgccgtccacttgctgcatgccctgccagaactgctctgcctctcctctgtttcgtcgatgacacccgagcagacagacgtccggacgcacgaccggaaagaaggaggagacgcgcgttcggcggccagagattccagactcgatcggagcaccgtcgccaaagggagcacgacagcggtcacctcaacttcatcggcgctctctgtatcttcttctcgtccttgttctctcacttctgtgtcgtctgggcctttgttccttgctgcgttcctcatctcactcccttcactttcgcgctcatgtccgccgccctcctcgtcttcaagcgacggccgccaacacagtctcctcttcggccgcgtctccctctccatctccctttcttgtctctctgtcttcccctgtgtgctcctcgcagcccagcttctcgcgccaagtaactgggcgcagagcacccggcggacgaagagaacagaagcgagaagaagaagcgaagaagcaacgcggacgcggagcacctggcggacgaagagaacagaagcgagaagaagaagcgaagaagcaacgcggacgaggaggactggcaggaagagggcagcaagcgaggagggagaactcctccggggcgaaggacgttggggaggacacagtggagaaacatgcgcatcgagaatggaggtgagcgagaagatcaggagaaacgaaaggccgacgtcggagaaaggcaagaccggtttcgatccgttgaggagaaaaacagacagaaaggtgaccgaaggaggacagactcgacaaccagtggacgaagacacagagcaccggcggtaaccgagaacgtccagtatttttcggaagcggaagaggacgccgagagagcaaggagaaaggcaaagaccgccgagaatgagaaggtcgaataaaaggaaagaagcaagaggcaaggaatggaggacagatgaaaagcgaacgccatctccgactatttcagctcgagaaaagccgcctcccagagtgcttaatgccttcctcccagtggacagcgaggaaacgaaaaacacccacacacacttgaaagcaaaactgcttgtccgatctgcacttcctcctcttcaggtgtacatacacctggctctgagagcacgaattttctcgatgaaagatggatgtccaagagtatctgtgtcgtctcgtctgccccagtgcttttgtctcgctggagacatccccaaggaagacactttcgtcgctctttcttcttctacgccatgagccgcggtgaagggccttcattttctcccctgcaaatagcttctttattcgctagtctccgtcggagaggtgaacgtcgcctctagctacggtccgcagcgcgtttcgccgcttgtgactctattgattcactttccttactctattttctaccttcttcaccctttgaatactctagcagaaagcaacatctgtaaagtacgcgaatgcctgcatcgtccagaagtgacgcggcgcgtcggtagaaggcggcctcgtcagctgcacatccataaaagcgccttcgtcagtctgccgctcttcgaagagcgcttgtctcgcatgcgcttcttcgttgacgaaaacgtatcgaaggcacgttgacgcggttccttctgtcttgacttggggggagcgcgcgtttcgctcgaaggtctccgtctatacgccgatcggcgaggcgcctggaattcgagttttgtgtgggggcagcgcgggtgcatgctgggattttgcggagaaacggggaaccggatcatccgaggaatttgcgttcgtttccgcgtcggcggccccgcaaatcgcttttccttccccgttgctgagacacacaacctctctttcgtttctcttgtcgcgtgtacagtcctgctcgggcgcactgtctctccttgtgtacctacaccacccgagaggttcgcgttttttccagtctctgtcctccgttttttgcgaatttcgccgagcgaaaa

SEQ ID NO: 1767 - DNA, 3008 bp, Toxoplasma gondii
catgcacagatcgagagagttatgcgcgcttgtgtgagagttgaagacgccgtcgtggacctgccatgggtccggtgcagagacgcacttccagtctcgttctcgtccgcgcatgcaaacaaatttgaatttcaacaaaacgcactatgcacacacacgaacgtatacgaagagaacacacagacgttcacttttctccacatacacctacctaacaacaatatatacatatatgtatatatatatgtatacatatgtatatatatgtatgcaaatatgtatgtgtgtatgcatgtgagtatatgtcgactgcgcacgcagagggggaactgacctcgttgggagtggcttcgtcggcgagctgaggggagaaaaggtgagactgactgcttgcctgactttcgaaaaaagtctccacagcatcagcttcggggtgggcgctggtggtgcccttggcgcacttaaagaaggacaagaaagtcatcttgaactgcggacaaaagcgattctgcagacacacacagagagaccgagtgtacagacagaggtgagcgctccagcaagcggacggtcgacagcgagatttacagagacgccccacacagacagattcagcgatctgctaccagatgaaagagcagagtgatgcgaggagaagacaaggccttttgagtgcgagaagacgaagcctgcagtcgcagctgcacctctgcacctgttttcaacttgcctacgccggtctccccagcctgcatgcatccagctctacacatgcggtgcatttacatgactgcacatgcagagattctcccacggctgtacagacagcgagagagagagagaagcgcttcttccgacgacgacgcgaaggagaaggacgctcggctgcggtgtggtgacagtgtgtgggtcgggccagcatctgtcacgagacagcgtcgaccttcgcgagacgcggaaagaagttcacgaaacagagaaatcgtttgccgggatgtgcactctcttgcgaagagccgtcacagacactgttgggcgtcgaaccgcagacagagggaccaccattggcaatcaaacggtgacaggcgacaccggggaggagcgacgacaaaagaaaacaagagagaagacgactgactggattttccccagagagacaagagacgagacaaagataacggatggagacaagtggacgaggaccaagtggagagacaggagagacagagggcccctggggaagaaaggtcgagccggcacaggtgctcggaagggagactggcgctaaacgtctttctacgagtttcgcttttccgcagatccgagttgacgcctacggtggagtttgaggttcggagcgaagctgaagcttctgcgtgttggaatgcaggaaatccgtttgcgagaggacaaacaggcgaaggcgacgcaactggaagcaggccgggtcgcgggggaaaagactggaagtcaaggagcgtggagctcgataaaaacgtcaagcaattgctgcttaaacgcagggcgttgctggctttggtctcaaaagaatttgatttgaaaagcttcctggtcccccccgtccctcagtgccgcacaggtcacgggcgggtgctggcgcgtcaagcttcggtgtacatacaccaggggtgcaggcggtcgacggcgaccttctggggaagcgagacgcgcacccgcaaagcgcaaaaccgggagctgttcgcttgtctgtctcgtggcgtgcttcctctctggagcgccggcagtggcctcggtcaccaggccgctgtctctttcgcctcgacgctggacttgcgtttcctcctgcaaaaaatcctactcgacccgccgcacgaccgctgaacggaagcgtcctgcgagactcgccacccgcgccttcttgcacattccgacactgactcctctctgctcgcttctgcgtctccgtccgctctgcttccgttgccagcagcggcgtcgcggcgagcgcttcgccttgctgcaccaggtgtacgtacatctgaggggtcgattgactgtcggttcgcaggccgcttcgcctaccgccttttcaccaccttccttcccgctattcttgttcaattctcccttttctgcacatggactcgtctcccagtcatctccctccaaggacgggaacctcactcgtccagttttgtggggtctctccgactggccgcttctttacacgtccggatccgcgattcggcgtatattcgggtgcaacgccgaaaaatcgcgcaactctcgaacgcgcttgccgaggtagaggacacacacagcctccactttgttctgttggaacgcagtaagaagagactctgcacgctgcacatacgccagagacgcgactgccggccagtctgcctttcgtgatcagctggctctttccttcgtctcagattcagaatcgacaccgggaaacgcggctccccctccgttggcttcgcgctcttgtctgcttgcacgcctatgtgatacgtgtttcgtggcgttctgccttcgttttttctctaagtcgcatttaaagagtcctctttctgcaggccccagatcgctcggacggacgcgaggccagcgctggcggttctctcccctgcgaccgcgcgtgtagtcgttttctatcgtgggtctggggaaaaggatttttttaaaaagacaagacagaggatattcgcccccccagacgatgaccaacaatgtgagagcgcagagagaccgacgggactctgtcttgaactcccgttctcgctgcgtcgagcttccgtcgcttccgctcctctctgcttgcctccgctgtctctcgcctcgtaactgcctatagaaacccatcagtacacgtcaacgtacacacagctacacacatagatgtatgcatatgtattcgctgtttcgctgtttcccgagctgtagatcgctgtagtgttcttggctgtcgagagacagaaaaggcccccctctctctgaatcgcggagcttgcaaaaaa

SEQ ID NO: 1768 - DNA, 2207 bp, Toxoplasma gondii
gggcctttcaccacacaatccctactcgcgcacagaggcaaacttcccgcctcctcagctgcggtgcgacgtccagatgtgtcgaagctctctccgtggcttcttctctccttcgaaaggcttccgccaccttgtctgtctgcttctctgtgttcttgtcttccttcctgctctcgcgggctcctccctcggtctcgcagcgactgttctgcgtctgcgctgaggacagggaaggggaacaccgagggagaagaggcagcgagcatcagctgggcagtctgagcggcaaggaggcgagggtcgcgggccgcctccggactcgcgtcgtcgacactggcgccgtcttctggagagtcttcatcgagggaagagggaaggtctgaggagctcagcgacgtgtgcccccaaggcgaggagaagcggccggtcgcggcggccgactgttccggctcgagttctgcagcctttggagaggaggccattgtcgagacaaacggaagtgacagaggacgaaggacgggaggagaacgaagaaagggagaagaaagaagaaggcagagtttcgagtcagaaaacaaggtctgagagcagggcaaagaaagcaggaaaaggtgacgtcggaaagagttggagaaagccgtccagagagaaccaagggagatggagagccagaaccaagcacagaggcaaaagaaaaacagaagtgtgaaggaatctatcaaaagaaatgaacaggcagacgccctgcagggcccaggagtgccgagacgccgcagcagagagaacctgagttttgccaaggaaaacaggactaaaaaaatcggaacaaggacatccagataaaaacagatgtggactgttctgtccgttctgcccgccgcgtgggtttttggccgccacgaactcgctcaggtgtatcgacacccgacggtcgacttggggtgtacatacactggagcttctggcgggcacagagaggaatggcgcacaccgcgagttggaaagagtgaaggagctcaaaagaaccatggcacaaagggaactcggcacacttctgctcgagcgccggacggtcccctccgcgcccgaaaaaagcgtcgcgtttctcgcggttttttcccttcgcagagtgggcgactcctctcgctctcagtcgcgacgaacacatgcggaaaaaggcttcttggaaagccgtaaaacctgccgaaactctcgagagtcttcgcatgcgagacaaacagagcaaacagagacgtgcacctcagaaccggcagagcgccgcgtctgcgcggccgtccgtctgcccgacagcgttggaaactttgcgcccgactgcaggtcctttcagtggcttttctcacaaaactgtagacggtttccatttcttttcagcgtcgcagggagaacgcgacgagcaacatctagtaacccttcgcagcgtcgcggcgcagatcagaaagcaagagacactctcagacggcttctgttcctctctcctatatcggcttaccgtctctctcgttttttcgcgtttgctccgtttcgcgtttgcttctttctgcagccgtccaacgcacgcttcttgttttcagagaagaccctgcgccggagactctgtagccccgcgcggaaggacttggtggatcttggaagtcgcgcatcacttgcctttgcacatctgccagcttacatctaaccgattttcgaatatctgttcctccgtctttctggtcgcttggggatccccgagtctcctgtgttcttcctgcatcccctgtttatttccttctcgctcctcttctctctcttcctgttttccttctctctcttccttttctctctctcttcctcctcttcccactcttttctctccttctctctcttccttctctcctcgcgccttcctctcttcttcctcttctttccttcctttctcgctccgacattttcttcttgcctcttccgttgtctcgttgctttctcttccgattgctggcttcctctctgctcgaaccgctgcctctgttcgcttttttcctctcgctatgcggggtccaccagttagtcgccagctcttgcctctcgtctcgtcgttctcccttctctctctgcccgctctcctgtccgtttctctgctgcgcaatgtcgcggaactcgagagaaccgggaagctcccaacagaggcgacgcgcgttcagcgacgacga

SEQ ID NO: 1769 - DNA, 4021 bp, Toxoplasma gondii
ccctcacctgtagcagtacatgctctcgtcgctgagcatgagagtacccggccgggtcgcgtagtcgacgattccacaactgccaatgcgaacgacggccaagggttctccttccaaaacaaaagaggcttcacgaatgaaaaaatctgccatcggagcacccatgccaatgcagacgatcgacatgcgctgtccgcctttgatgtatttgcctgaaaacaagcagagaaaaacgaatactagagagttgtgaacgccaaaaaacaatccgaagaaagccaccgccgaccagcaggagttgccacgagctggaggtcctcgggtttgtcgaagcactatcatgctatgacaccccgaagcacacgacttaaaagatcgttcaaagctccctcaccctgttcgggtgctccccatacacaagatctacgtgggggtgctcacgcgtccagttcggtctatcatcagtctgtgggttttctaaactcccaaaaacggtaaaggcaaccgatacgcgttttttcagtcgattcactgcctctgtgcaggtgtggaaagggtcttccaactgacgtcgccaggtcatctgccaccgttcgctctcccatgttgtagaatgcaaatcgctacttacccgtgaaggtgtagaattgtcgcgaagaggaaacctccgtgacatccgtaaggaatttcgctgcgagaacccgcgcgcgctgttcgcagccgaccgtcacgatcagtgatgccaagtctcccttcttgacgcccagatggtacgtgcgaccatccggggtaaggaagatattctttcctttgagttccgactgtcagcgacaaacacacaaccacaggacacgtcgtcatgcccccgtgcataagctagaagtttagatagctaaataccaggtaagctcatgttgaaaacaggctagaggcagaaaaaaaagccggaaaaagatgtgatctgcaactggtaaagatgccactcttgaactggcaggcactacgctcgtgtcctgcaccactgtatacgtcgtcattgctgcaagagaatcaactacatactaggcaaatctacggcaaaacccctcgtcaagaactgtgagggaatggggcggaagcgcccgcccttttaaatgcgacaaagccagaaagagaagccccgctgcgtcagacaagagggggaacgcaggcggacgcagccccccgtgaatcaacgcagagcgtagatgcgtgccctatcttgctgaaactcaccattgtacgcaaaaacagaggcactatatacacgacctaaaggatggcgaaacgtttcttcacttttgtttggaagacaaaagggaatgttcaggcagcagcctctcttccccagagaagaacatgcaattctcagcttgggcgggtggaccagagtccggcggtgcgccttccgcgcgttggcgactgcgctgcgaccggcggttttctttgaaagcaaacgggggcgggaccatggggactggggtgacagcggtgctcgggttatgtacagaaaagatgcatcggtctacacaattcacacgtttgttcacggggtacagtatccgctctgcagacaccgtccgagcgggagcctcgtccgctgcagattagaaaactgaaactacacgtggaaaagggattcttttgttggcacaggggtgccggtttcttttcccgtggatgaggctgtgtgcaaagcgggatgatagggagttcgtgtgataccccttgctggagactaagcctgaacctcaggcactctgtggtcttttcagaagcacagtccagtgagttagctgcagtttcctgctacaagtgcacaagtgcacctcgctgtgtatgtctgcatgccgcgactcctctgagcatcacccggtcaacgatcaacggcgttacgtgcctgcaagtaaaactgctcgacttaaacaagttcacgggtaccactgtatcacgtattcacgtatcgcagagaagcggcgccacgccacgggatctttgttcgagctcggcattcaatagtctctagcgtggcgctggagtagtgaagtaccggatgctacgttcaaaatgacaatctcccaagttaggcgcagcaaaggaaacggaaggagccacgtctgacggagtggctatctgctttctggcaccactgcacgacacggcatctttgtaggcacaaccgaatccagagctgagaccgccgcagctagagaaattgcggggaaaccccacagttgctggtcttcgaatgatgctgtcgaagacgtcaagcgatccgcgtgaggcgacctgttgatcttcagattcttctagacattctaggtttcagcaaaacggggtcttcacatgacaagcaaacacgcgtttcgacgacccttaccatcgtggtggtacaggaaatcacatctttacacgattcgagtgagctcagcaatgcagcgattaagcagggcatacctcaaaaacataagcagcaggctggcaaagaaagccccaacacgaaaaatgcagtgacatgttagacctcgtcacagtcgacccctatgccgtcctgattgggtcagactcttcggctctccaagcccatagatctagttgtactcgattctagatttctccaggcggcaagcattctgggagtgaaatctcattaatctttcctgattcatggaaaacgctcccccggtttatgctcctcgacgacaccagcggcagagcagctgccagcgaagagtacagctcgggttcacagagctctgtgtgaccgtaagagcggtacctggccaagcgtcacacagcaaaaacaaagagggagtggccgcactcagttcaggtttcgcaatatttttccattctcgtgaagagagactccagtgtcactccaggatattttcaaaaggaaacacagtgaccttctgtatgtcatccacttttccgcgtcccgatatggccgttgcaattagctagaggcagctcaagcgacacatgcagggggcccagtgaatccgtggcgggtccatcggcgacgatgaagccgatgagtacgggactttgtggacggtattttttcctctttatctggagagtggttggccacggcgtccagctcctcaactgctagtacgggccttcaccctctcgtcccgtgtcgtctggctgtcttactgaacgccatctctgaatcgatccgcgaccggggttcctctctagcatccggtggatgctttttcgtgtctgcttcgctgcagttcgatgcgtcaagcgacagttttccagaaacggcattctcttcgggttttttttgcgcagagctgcgccacaggagcacgactttcccctgcatctccgtcgtcgaccacccacgctgcctcgcgggccgtttgccgaggctccctcgacccacgtcactttggaagatgtgtaggacttgctgatatgactcactgagattcaagtcttgggtggtcacaggcgtgtgtctgcttagtgcagctgcagtgcgccagcgcggctgcgctgtcgcgaggcgaatgaccacggtagagcgctcagaatgtatcaagaacgtgcatgtttctacaacagagtgaccagctttgcaggttcggtgcggctccgccttgttgccaggcagcatcttctttctgccgtcggttcgcctccgatgactcggtcagccaactgtgaataacgcaccctgcacagtggcggtaacgctctggacctcctcgcacgctctttgcattccgaggtttcatagtatcatcgccacgcttttcgccttcttctagtaaggggtcccagctggtaattcttggcatacaaagcatggaaattcgggacatcggccgtcggacgcagtggtctctttgtccagtagctgcgtgaacggctgcgcataagcgacagcgttttcgcgtctttccgtgtatagatctgcagggaagccagcgcgactttttgttttccactcagcttttccataatcgcgaagaggtggaaa

SEQ ID NO: 1770 - DNA, 1948 bp, Toxoplasma gondii
aggagacccgcagaacagatgaggcggcaaggagcacgatggtttccgccggactgagagaagaagagagggcgggggaagagctggagaagagccgagaaagcggcaggacgaacaagaagaaagacacgatggaagggagaaagaagaagggaacgaaaagggaggacttgaggaaaaaggaactgcggcagtccaccaaaagggtgaagagacagagggaggagcggctggacttcgaaagggtacacgccagcctctcgaacctgcggagaacaagggacagcgttgaaacggagaaggaagtcgagaagaggtctgcagagcaaagcacagagaaccccgttcacgcgagaggagaggagacactttcaacgaaccacaagggatgaaagcagccgtccaagacggagcggacgaggctaggttgtgaggagacggccccacagagccgcagagaaggaaggaagaagaagacaagaggaagacgacagaagagaggaaagcagacccagaagaaggcgacagaaacgcacaggctgtctctctccttgctctcctcgaataggacagagagcgatgcatcgaggaggctgcacagcgaaaggctctctcagaactcctcgccttcgcctttatctcttctccgctcatcagtcttcttctctctggttctcctttgctagtctctcttccttcttcttctctcttttcctctctgttttttttttcgtcctccttcttctcgaggcctcggtgagaagggagcaagcgaggaacgagacagctggagaaaacgtttctgggagatgttgaagacggagaagagacagtgaacatgcgtggagtgtgtgtttctgattggttccaaggtcaggatgatttctggaaatccgcgatttccttgtctcccggtcggtgtcaggcatcagcgtgaccggggcgcgcccgcgactcaggcccagctgttcttcctgtcaagttgtattttcgctcgactgccgtttcgtcttctcaaatgaacttcagaaatccaagcaaaaagtcgctgcagggaaaaccgagaaaagccgaaccgagtgtgcatgcatcgacagcgcaaagaacgccccaactggcgtcgacgaggcatcgcgtttcagcctccctctctctctgatggtcttcttctacttgctagtttttctccgtttttcttcgatcttgtagacggcgcggtggacacacacttcgaggcgaatgtgtgactcagatgtcctccctttcttgcagtccccgtgtggaccccccagaggcggtcttgtctgcgcagcgcgacttctggctggctgccggtccatcactgtacagctcgaatcctttctctttttgactcgaactccacttcctcgttctcactctcactttagaggggttggcctgcctggattctcctgttttgtctcttttcggagtgtgtcggtcctcgccacgaaatcgaatgcgcttgactaaatatcagctcgttacggtctgtgcgttgtttcctcatcttctgccttcttcgtcttcctctatactcgtcttcctccatactcgtcttctttttctcttctgtccttccttccgtatcttcttctctcccgagcctttcctctccacgctttccactttcttcgtctgctctccgcatctcttctcttcgtcgttctttgtctcctcttctcatcttcttgtttcctcgccttcgtctttccttatccactttccttacctctgtttaccttcttcgttcgccttcttcctctatctctgtcttttctggagttgctgctgctaccagtgaaatccttgcgtgagtgatctgaatcaaaggctttgtgcactgtgtcgcgtgctcttctttccctctcttctccgttgaaaaaaatcgtgtgtttaccacattcttcactgtctcctcccgcaa

SEQ ID NO: 1771 - DNA, 2424 bp, Toxoplasma gondii
aagagtctctcggctgcaaggagtcttcagagtgagaagacctgcgcggctgcgagtgatcctccatcgcgcgcgagcagacggtctcgaggcaggctctgagaagagcgaccgggactacacgcgtgtcgagagaacgtttcttcgagcgaagacgcgagaggctcctcaagcggcaagacggaaaaaggaaaatacggtattcgaagcgaactctgtgtcttctttaccggtatacatccacatatatacacgttctatatgtatatatcggtatgtatgcatatatatacatacatatatgtatagagatacctatagatatctatagatatatgtgtgtgagcgaagaagaaggagtcagtactctctctgacgctttagacgagcggaaagagggccttctggagacgtctggggtgcgttcgaggagcaagagaggtcgaaagtcgaactttcgccagagcggcgacgaaggcgttgtggatcttttgcagattcttcggagacgagttttcaggaatcaagaaaagcagtgccggcaacgaatacaacgctgtgtttcacaaaaaagaaggtcaaccggttctttccattctctgtttaagagacggggcgctgacggcgtaagtgcctggagagactttcagtgctctctgccgctgtcggctttgtggacctctcacacccaggaggcgaggcgacgaaaagcatgcagaagatcgaaaaaagagaaatcgaaaacgctggaaaacgtcagagaaatccagaagtcacgccgagaccggaacgcgacgacacgacaaagaaaccgcgtggacgtccgacctcggcaagaggtagagcaggccggcgaaggtgcagggggagcttcgctgcgcgtcgaaaagaaggtcgcaaagccggaagaacacagaaacaacagaagcggggagcgtacggctcttcctttgttcgttctttaggtgaaaacgaaatctcgtgggagtggaattaagagatttgccgtcctttagttgtccttggactcgagaggcatctcggctccgagcgtgatgaccagggcgcgtcttcaaggtagagaaaggcgagaaagaagtctattgctaatgagattcgtttttatttcgtttccccggctcggttcacgtttggccagaaaagtgagcccgtcaagcggccgcgaaagctctggaaaagtcgttttccacggcgtgcgcggtccaaaaacgaaaaggtgtgcagcaaagttcccgtccacagagtgagaggaacgcaacgaggagctgtcagaagtttgcaagcaaaagcaaggggttcgcaaggagacgccgccagttccctgcgagctgagagagtgcgaaaaaaaaacgtttgtgagactctcatgtgatagtcgggctagcaaatgccgcgaggaaccgcagcggcagaaaggcgttgcgtcgcaaggttgtttctgcgtggcgttcgattcgagatttcgaagatgccttaggcggcttcgggagtttcggtgaattggaagaacgcagacaagcggcgaggcagcgcgagcctctctttccctgtgcggcgacttggacttggcgttttccgcgtgcggctgctcacccgcgctgtctgctgcggcgaattcgcgcgaaaaaatgctttttggtcgcgaaaagcggcccggacatgtcttccccaccacgccgggactgtggactgacacgcggcagccagtttcggtttttgcgtgccttgtttggcagcgaattcactcactatcagaactgtgagagccgtcacgattcaccccagtagtagcacagaggcgcgtcttccgcgatttgtctctctaagaagtctcccactgcggagggaaaaaagctcaacgcgcgcgcgtaccttgtcagtttggcgttcttctactttattggcgacccagggctgatttttcagccagaatttccagccgactgtattccagtccattcgcgctgcttcgcccccgcgaccgatcgaggagcgaggacgagaatttttgtgggaagtttttcgaagtggcgccgttctctggtcaacgggcgccgcgggtgtgtgaagacgcgacgccgacacaaagaactcgactatcggactcgcgtttcctttcgtaacagcgtgtatagttccatttcccgttgtttttcgcggtggcgtggcgcgtttcacctagcccgcaactggttcgcgtgccgtccaccccagcgctgcggggaggcaaactcaccacgcagaaatccgttttttctgttttatcgtcttcgacctttccttttgaggaaccccatttcgggaaacggttttctgcgtggctcggcgcgaggacttctgctcgtccgctgctgtgtcccgtcgccgttgccccacgtcgcgccgtcacggtcgattatcgca

SEQ ID NO: 1772 - DNA, 2740 bp, Toxoplasma gondii
ggagtctgtttctctgctgtttctcgtttttctcgttgagagagagcgcacaatgcagctgaaaagcagcagcgtgttcagaggggatcgtaggaattgaggcattgtcgatttctgccgcgttccttcgagttttttcagaccactttgtttcaacgctatgtacaatactccccgtttgtttctgtggaggcgacgcatgcgctcgcaccttctttgtggcagtatagacgcgagacgtcgcagaaaaatattcctttgtagtaaaagaaccgccgtccctgcagaagacaagcgcatcgactcttaagggttgaactctcgaaagacacgtgaacactaaccttcgtaaacatagtgatatatatatatatatatatatcactatgttttccagggagcgggccgttcctgtcaacagcactatattgattcatatgtatacccatatgcgtggtatgtgcgttggattacaaccgcgttctgttgacgaaagactaaattcacacaggcctgcatatcggctacaccacagcatttttgtgagttcttgaacttgccaggacgattgctgaagctgcaaactgccggcaggaagaagccacctgagcacccggcgtttcgagtgtacattcaccctcaggagcgaaggcctggcaaaggcacccacggcattcgtggacttttcttgtttccaatatgttagagtactcgagggaacgtctggaaatatccttattcgtactgtgtaacagagagtcgcgcctgagttgttctccggtactggctgcctgtcgactcgcatgtggctcgtgagtctctcaacaactagcggagtgcttgtgcgctggtggcacaaaagtgtgccatccagtaaggtgcgtggaaactgtccagtcacgagagaaagcgcgacgaagcgaggaaatcaggagtacttgactcgagtgaaatcatggaagaagggggttctagcgagtcgaaagtgaacgaggaaacactcaaagagaagggcgactcacgggactgttcgacattcagtaaatgcctttttgaagtcgaaacacagttgttacgtcactcacagttgctgctccacagacacacaaatcgaatcttcgaaggtccaggggagaggagctatgtagatacaagtgtagacgcatatggacagtcttggagaggaagtagatttctgagcattcgtgagattgcgtttcgctatgaacgtttgagaaggggggaaattcttctggtgtgccctcccttgctttcggagaggccgaagtgtatgtacacccgaaggaccggtcgttaggtctctacaggcaggctggaaagagagacgcctctctcctttcccctgcgtgttcttgttcgtggaagagagtcagaaaagtagagagaggagggagaaatgacggaggggagaaggcgaaagggaagagcagaaaagaagagagaaaaagatccgttgtggaacgccacccgccgactgcccccgagagtcagcgtgtctcttcagccccttctgtgcaaagttcaccaatggatgccttggaggtggccacagacaccatggagacaagaaaaaaagatgaaaacgaacaaaaggttctgggattgcgttctccgtttcttcatcttccttcgaacaaagagactcgaggctctgcgtttctggctacacatcggtctgtctctgaggaaacaacacatcgtagagaagttagttcaccgctgtgcctcttgacatattccacgctctctctccgcggcgcaccttcctcggaattctgctttgaattcgttcttttcctctttatcttggatagcaacgacgctttcgaggaacccagtctcaggcgtgtctccttcgagcgacgaaagacgacgtctctgcgtcccccgttttccttgcttcttctgtttcccctcccatttcgcatggcaattctgtagaaatgaaccttccagacgtcgtttcaacatgttttttcgtctcctcctcgctcgcgtcagatcgagtgtatgtacacactgttatcaaaacatgtggtgtgtggacaactgtacgcgtacttttggggtgctccagtcatttctgacttcctcctttgtgcactgaagcgttccgagccattttgcggactccgcgtcctttcgaggagagaagacgtggtggttctgacctctcttgacgccgactcggtgtatgtacacttcggtctgtcctcccgcgtgtgtcggatgccatgcttgtcgcgtcctctcattctggactttctccggtcttctcttccaaaaatggcggaagtgtaggtctcttgtgaccttcttgtcttcttgccgcttcctgcctccccttttctccgaagtcttcgatattcctgcttctcagtctctcctggcgcctcttctctctcctctcgagctgcggccagcgtttctctctagcgtctgctgctcttgttttccgcctctcagtcctcttctgtcttctatccggtttttttctcggcaacccactttccctcaacgccttctttctccagtcgacagcactattctcgctcttccccttctcctttctcccttgcctcattttcttcgcgcttcttagtgctcccttcctgctgtatcacgttccttctctgcctgcctcgtttcctcttctccctttacaccgttctccgcttctttcttctccgtttctccgtcttatcggcttttttcaaaa

SEQ ID NO: 1773 - DNA, 2278 bp, Toxoplasma gondii
tcacggatgtcctcctcgacgtcgtggttcatctttttgaccagaccgaaggtaatcagtcccggccacacccatggccaggcgtacgcgctgcacttgcaccagcatctgcaggcacagacatcgaaaacgcggcatcatcaacaactgtcaaccaagcgaaacgaacatgaaaagagaaaaacaggacatctctagtgcacagccacaccgttccggtccccggaacaaaagacctcgcaaaatgacgagaacgcctccatggagctgccggcaccatccgaagactgccgcatcacatcgtcggcaccgagctccgagtttcacgcattgcctgcgaaaagtctggaactcgttcctctctcggactgcacaacgtccctagtcagtgctccccgtcacattaaccgaatgctctcttgcctctccctcgagtcggtgagcacatacttcaggagttcgcgacagaaaccgacattatctctcgcgccttcagcacaagcgtttctcgcatcgagcaactcctgctgcagtcgacgcggtgcgaccggcagagccaccatcgcgtgcatatgcgtacttccgcccaagtgtctacaccggcagattcgaggttttcgacccagactaaacagacatttgtccccgactttgctcgagtaagcgttcttcgagcccccgagctccatcctctcgactctgcctggaaaaaaagcgtcctttccctaggcgttcttgcctcaagctagctttcctcggacttcctttccctagactttcttgcctccgacttgtctccttcgcgcccctggaccccccgtgttgcggcgcgcgctcgcggtccactcaccgagcaaagaaagtgtgccaaaagggatagatgaatttcagctggtacggggaaatcgtctgttgaatgtagccgccgtgcgcagtcaggcggtctctccagaccatctcgaattcgggggagacagggtaagatccgagcattttgcgttcgaatttcggcgcaccgaggcggggtgccgacagagacagcaatcccgtctgcccgcggccggcgaggtactggcaaaggcgagaagctgccatttttagaaaggcgaggtcgcgaggaagctacgggttctccaaagtttccagtgcatgcgcgctcctgtctgaaaacaggtttctgaccacagaaacgatggtgtctgcctctcctctttcgcgggaagtttgctcggaaaaatacaagcgaaggagcaaagcgctccgtttcgctccaggaagaaacgcgagaaaaaatccaggaaaaaaacacacggaacccgtcgtcgagtcccgcctcgttcttggcgtcgactcccgcagagttcaagacttctcggcggccggcgcaagagacgggtggaaagcagcgatcgtttcgagcaaagtgcagaaaaagacgcgtggaaggaaaaacaaaggcagaacaaatccttaacccaccgctagtctctgcgagagcgcgagactcgtcctcagcgttcgtctgcagaacaggagaggcccctttcagtcaggtcatcgcgtgcggcctgtcacactcggaggcgcatcgcgaggtagacgccgtgtggaagagatcgatcgaagctttttccgtcgggatttcgagggaaatcgtgtttctccggaagcaagaaagcgaaatatgcgacctgagaatacaccttaagttgaatcttttttttgcgaagaacccgggacgtggccggctggtccgtcttcgtttgttgaccggatatttgcgcttgcgacaatacaccagtgagcatgcagtttcttcttgccgcgtttgccttgggtcgcttcaagatgtcatctcctgataggggccgccttttccttttcagaaaaccacggagagagacgagagacgctggaatcgagagcgcgtgagatctctgattgcccgaatacacgaacacagggaggtcttccaccagagagctctctgaagtacaccgacaacgtgcatccaccgtgttgtctcttaccagcagaagaagacgagccggtccttcttcacagcggatcgcgagggtctgagtaagtcgcccgacttcttcggttccgtccttttccccgcgacagaaagctccgtctcaaaaccgttcgagacccgccgaagctcgtctgtctactgcgcgcctttttctccttaagtctccgtctcgtctgaatctcttcatctctttctcttttcttttttcgcgttttctcttcgagaaagtctctgcagcca

SEQ ID NO: 1774 - DNA, 4787 bp, Toxoplasma gondii
ggtatcctagctccgccatacattgtagaatcagtgtgacgacctcgcgtctagagaaccctcgccatcttttctcattttggacatcatcgtatgtagcctctgatgaatcttcttgggcaccggcatgcccgttgcgaggatctccggctgatgcggcggtcccattacaagttgtagtgtgcatggttgccgttgcgtgatccgccgtccctttgtcttctggtgtcccgaaaaacggtaagctatgacttccttctgctgcaaacagacgtgaaggtgtgatgcccctactcagctctacagaattcgatttcgtttgttccggagtgccactcgaaacaaaggaacctggcgacagaccctcagtcgaaggcgtgtggtcgcgtggtaagtgtctctcttccccggagtccacggaagacacgcagcctccaccactgtcatccccagtcacttcactcattggccgttcccggcgtaaacccctcaacacggtaaagacagcccaacacacgcaacgaaccacagggaagagaatcgcaatctatacatagcatacgagagcatgcaagacagaaactcgggacgccgtatacaaacgtcaaccaaaaagtgtagccgagacgtgcgctctcaactgcttcgaaacgatgggaagaacgggagcgaatagccaatgatcgtggaaaaggtggtgcacaaatgtggctggagaaaaagggacggaaacgaaaggcttccagctgcctgcgcacccgcgttaaggtgtacaggaatgtgaaaatcgctcttgaagaggccctgcagctcccacctacaaaggtgtacaggaatgtgaaaatcgctcttgaagaggccctgcagctcccacctacacgcagaacgcttgtcctggacgagacaaggcgcctccgtaggccagttcgatgggacagaggtacgtaccgaagaaggcgtagagagaaaggggtgactggagtttctatcatgtacccattttcggttgtccggttacttggccgtcaccagctgaatagctcgattcaattgctaaagcgggtagtacctcgagccgctgtgacgctcttaaagagaaattagagtcagtttataattgaaagaaggtgggcgcgcatggaagagagagcgacaaccggagaaacgaacaagtcaacaaatgtgggaaacagctgagaggcgccagtaaaagtcagacacggacgggagtcaccgtctcttcccgaccggcaggtgcgggtgagccgcagttaaccgcaagtgttccttgcgatttttgtctgcgcaaaagctcgctcgatgaaaggaagtctcatgaagacaattattgctggatcaagcaagggtaaaaaatgtagaggcttacggaaaggcggatgactggaaatccgtgtgctgtgtcgacgcgcgtaagctcggagcgagctacgaaggagcgatagcacacaaccacatagcgtgcctcagattggcggaaaacacaagaaggacctctcagcgaaagaaaaaacccggattcggataccgaaagaaaactcggctcaggacaacagtggaggagctccgcggccccaggctttcactcattaaaagcgtgtggtcacaagcggcgtacggaccttcagtctcgtcccactcaaaaaaatgttgtgaaagaaacagacacacttaaagtttctttaatcaaagctgttcctttgtacgtcaattccttctgtaaaaatatcaatgccaaacggcagaatagcgcgcaaccgcgaccacctgtgtgccaactaaccgcctcaaccgcctggctgagcaacgccgtcgccgctgtaggcgtgcttctttgctccgttccctcccaagtgaagattcggctttccaactaggttccctgagccagttggaaaaaggaaagccacacgtaatgcgtcaacaaaaaagtggtaaatccacaagggcgtgacgtcaggcgtccataggagacacaagcaaaacccgtgtgctcccaacatcggcgttcagctgaaaaagcacacgaaaagcacagcgtaaactactgcctctcattgatgtctcacgacagtcaggggccgttagcagggtgttgcgttattgttgatggaagctccatggaagttgtggctatgacgcaagaacacgcaacaagacatgctggctgtggtcccctggttttttagtttaatattagtactcattataggttcatgctgccgaatcaaaacatccttggccatccggactttcggaaattcaattttctgtgcgtcaaacgtgtttgtatcggatttactcatgcggctgaagaacaagtatacgcacacattgcttcagaaggtggccatgggtaaattgcagacccactctgtaccgccttagaaaggcctcatctatggatgacggaacacaaattctctagcccgtacgtccggcgctacgctccaacttgtaatagaaatgaggcagttggagagacctagaatgtgttgtttggaaagtcgtcagcagtctcgaaatatttcgggatgcacggaaaaagtaacagacgaccttcgccttaacccacaatgcaaaatatctggtcactggtcgagaatagaagtcagaaacctcagagcagcgtttcagcagttagcgatctggagctatcatcagccatcaatgttatgtggggaacggactagcagtcggctggacggagaagcagttccacgttgtgacacattcattgcaaaccagagaaatccccgtttcaacttcagtcacgaacgtcgttgggtggtgaagacatcatacgcttcttgaatgccgaaacggatgtagtgtttttcttttgcgtatgtgttcagttttcagtcaagtgtttgagccaacacaaccacgcttcttcagggctgcggaaatgggcaagcagactactcttggcagtagttacggtcaccatcacgccgactttaacgcccgacagacaacgtatttctacgggagcgtccgcaacagcgcacacgtttgcaacgagaaatggtaaccaacactatggctatacaaggttggagtcaacaaggcatcacaactgtaggcctgcgcccagcagttgctatctcgccgccctaccgtccgccatctttaaaacgatacccgtacaagatacacgcactttggaattgtgcagtgacctcacgatacacatttttatacatttatggggttttctgaacgccagtaagcttttacatggttcccgttcacgcttcgttcgtgcaaatcgacagtagcatcaatagttgttcgatccctacatttccgaccgggagtaaaaaagggcaccggtagtgcggcgacctgccattaaccgtacttgtgtcgtacatattcctacccgtcagcggataaggtgcaccctttctctaatcttgtgcagatgagaagaaacaaaagagaacctgtgcacatggtctcggttatcctgctttttttcgcagattcgaaggaccggagggctcaagacaggtatcggtaaccgccttcgcattactctcctgcggcactactcagacgctaatatgatcagtaccaccgggatgggagtaataatctctgagagaggatctagagttcacaaaaacggtgcggcaactgatgtatcatgtaacgtccttgccacccgcaaaacaggtgattccttgtgactcaaattgactccgtgtactggcggcggtgggattccacgggcatttcgctcaccgggcgtcgatgccaggtcacccaaaggcgtcgcagcaattggatttaggaaagcatacggagaactgggcacgtcagaaggcactgctgttctccctgcactatgtattgaagcggaactgcagggaagaagacattcatccttgcatgcgttgttgtgctacagcagagctgtcttctggatgcatgcaatcgcatctaccacgcaagtgaaccgccacaccggttgacaagagcgtcgcagtgacagatattgctatgaagacttcccgaatgcgaggaacattgtttcgaacatgcccgttttttcgtgtgtctcttcgatcgcggagacagattgggtgctgcaggaaagggggtctatcgcttctgtgttctgcttccctgcacggctggtggcctccctctatgtgaaccagaagaaatacagttgactctcagagaagcgtcaatttttcgtgcctctcctggttaccgtaaacatatgaccgtcgaactacggagttcctcccccgtgacctggcaatctaacagaacaagccgctggttggcgtacccagttgtagtcagtcaagacaggtttcacgccaggaagctcgaactcggaactttcaaggagctcaggattgttagcctgtgagcgagcaaaagcggccacatttagtatcgggatcgctttcttgtgaacactgtggtcgtgttgtattgcctgcgttccgactgttttccattcacttcgttttttgttgttaccggcatttctttgtattgcttgctctgacttgcattcgccgattgtgccatcgatggcatactaagggagatgatctgcaacatacacgcagtcatgggccaatagttgaactgacggatcggtcaagataggcgtcaacaggtgaggtatgttaaggcatctgtcaaggactttttctccgggcttcctgggattctgtcgtcacgcaagcagagaccaggggatacacaccgcaattatgtgcgtttagagatcaagaaaa

SEQ ID NO: 1775 - DNA, 2183 bp, Toxoplasma gondii
gtttctttgaagcatttgcagtaacaagtaacactctgctaggtgctgctctcctgttactgcctgcgttcgcgacccctgaggagtcgcgaagacggagttggttgtggacttcatctgtccaagattgcttgaaaccatgcctcgcacgtaacgactccccgtttccctgcttgtgctctttcccatatgaacagaaacagtgaaaatatcaactttggagtgtgctgctggagctttaaggcgtactagataacgcagtgaaagtagagattctcgactgtggtgctggaactcggtatcgtataagctagctcaatggaactacgcactatgaattaccctagtgaaacgtgttgccgtatcaggttacagagtgaaagtagcgacgctgcaggcgccatctacgtctccgatacagcactagcggcacataaggttcaagacagcctcaacaaacggtcttttttcttccctccctcttcctacgagtggcaacattaatccatataatgcgcctagagcatcgttgatggaaaataaccacgatgtcgtacgattttgaaatctaacacttttagctgtcttaagcagatgcatgtggttgagcaaattaatttgactcattcgatccccgcggaaggcaagttcccggctgcgtggtgctgagagacattcatttgagggagtatctccgggtcgagagaacttctcgaaaatctctgtcactcatttgttgttcagttcgactcctaacacatgaccagtttaggatcgttgtggtgttccttacaatcggtttaatcattgagtggagccgacaagagcgaacggacgcgtccttcctgccctaccgcttgtctgcgttctcagtagcggaataacgcaaaaaagtgaaaggctggaaggtcatcctttccacttgtttgtcagctgcctttcgtggtactgtacaaatatcggaagcagttttgcatcactgaagagttctgtgccgtttctatagggtcgcagcaaactaccggtgccctctggatgccgcagtacactactcacgttgtcagttgaatttaaagccgacgaatgacagagacaggactacagccaaaaatgcctcatagtattggtcctcaacaactctgtggcactgaatgctgtcctgaatttaccagtgacaattctagatcacctagtgtgactaaggctatctagcatcgtgtatcggaagagaaataccaaaagctgatcgagccgagtgagctgagggttttttgcgtgttctcaaatcaaaagtgagtcggtcgcgaaaatccgcaaggaactggtggagcaagtgtgcatctgatcgcctgcatgacagaccagcggggcggcttcctgcgtttcttagtaaaaactctgtgttagaaaaagcacggttttagcacttctgatcttgaggcttggaaaagtctgcaacgtcgacgaacagactaacctcgtgtgtgtacgcgactttaatccgtccaagtgcacctgtcttcgaaaacaattttcttcaccgagcggtttacatacccgagtcttgaggtcatcggtcacaggatccaacaggaggaacaattatccccagagctcctctgctttgcacacgtaaagcggtaaggcaggggcgggggttggagctgggtctggcgctgaccacgacaccacaattccgtcaaaaatccacgtcggttatccgcttttctggaatgttttttcgactagaggcaaggaagcagacctcgttctcgagagtcttgaaaccaatgcatctcacgaacgcggcaccggccaacacgggggtggagaggacccccctccccgttttttgtgtgagaaacgcatgcatgcgtggacggaaacaagtcaccgagagaacaactgtgcaagagtgtgcaaaggagggaggctgttcggtctggaataggcaagaaaggtgctctctgcagaggccactgcttttcctcttaggaaacgttgcggtgtatgttttctctgagaaacagaactgtgtcaaaacggacgggacacaggcaattgtctgcggcgttttcctcctctttcttccacctcgactcccagtcctcgggtgtcctgcctctgtccgctttctctttcctgggttttctgcgacttcaagagtgaaaagccacacaaaa

SEQ ID NO: 1776 - DNA, 2265 bp, Toxoplasma gondii
ctaatcaaagcgcaggcgctctttcggctggtttcgaactcttgcagcaacatgtggagcgagacaccactttttacgggggtcgggaggccacaatggacgggggcaagtctttcgtgtgggacgtagaaaaagtcggagaaagtttctgtgacgtttccgccgctagttttcaaggcccatccacaggcgaacttcatcgcacatcttcgtcgacgcctcgagcagttcatttctaataggcattgggaaagtttatcgtctctgtggacagcgccgtgtggcggcgttttcccatttggcaataccacggagtgcacgttgtcttcgtacgagagtggcatcgtgcagatgaacacgagcatacgtgtaatgatgtgtaactgatggttctttgtcgatctcatcacccacacatccctcttggaacagcgaatgcttgttcttagctaaactccccgtggcacctgctgctagaaaaaacgctcagtggtaccggtcaggtctcgcgtctcgaaggaactcgcactggcagaatgctaacggatcgtggagaattgattaggtgaactgttgtgagagtaggaaacaatcaaatacgtgcatgggtcggtcacttctgagatcgagatctacctggacactgcctaacgggcaacgaaacagagccggaatggaggaaaaccaagcttcacacacgactggctacttcccgttggcgcaacatctggacagtcgcagcttgtggaaaatgtgacaaagtttttgccgtggatatgcctccgttttcgtaggaatcctcactgttccattgctgagtggaagtttttagctgcagcggaggtaccagtgttatgagtctgcttccctacgtaggtgcgcactgccttgcaaagcgagtctgcctgccaaactgttgtttggacaacactgcagggtgcctcgcggcgcctgggcagtcctctgtcacagtgatggcagagcgtttacgttgtatcttgcgggacgttgtcctacggcaaaaacagtgttgccagtgtcacatttcgtggggcaacttacctcagttttcgttcccaactggaaacgtactctgcaagctttcctctaatccgcggaaccatcactcacgtacggtgtatgcttcaccctaagacagagtgacagatgctaacactgacaagtttgttcgtggccgatatctgacgcacagggaactctagtgcgtgacagcttccacaaattcgtgcgaagtggagaagcctacagtccgtgtgtgtcgtaattagatggatcgttattctgtacagttgaatctgcaacaaacgaatattcggtccttgtggagacgcactgtcgcgcgtcaccaaatgcagctgttcaacttgtgaagaggtcctgcagctgtgtgtcgcaccaaggcagctccttgtgtaatcgctgctgacctacgttagcagtgtgaagtggtattgtgctacccatccttatgtttgcccaacaaaatccttgcaacgtcatttatgtctgagatccgcgaatctacctgttgtcacctccgcaggagggcacaacggcaactcggttctctatggcgtacggcactttttccacgctttctcggaaagcctgtctctgtgtgagttcatcccgtcacacttgaattatgcatgtaaagcatcggcccatacccattgctgaaactcgagaattccaaacggctccaaacaacggtgtacgcagccatcaaaatagcaggaccctggtgcatgcagtcatccaatgcggggcaattcgtgtactattcacacgcgcgaggccacgataagtgaatttcttccttacatcacttcctgacaacacaccagattttcttcttcctcacctggcagtggatcccagcgtcgcctactgagcacccacgccacggcaacaacttgcgcttgacacgagtgatggactcaaacataacaaaggaaaataattatgtcttgggtgctcgaatgcaactgaaagatgagtcatgatcccatccagctcctctaagtcccgattcccctatgtcgaaccgttgctcaaaggagaattacagcgatgtgcttaacgcctataaatcagtacaggcgtccttgattttccgtcgtctgtgcctccttctcaccgaagggtacagacccactgctttttctgataaactgggtctggctggtagttgactattatttgtgtgcggcacaatcttactgataaaagctacagcagaaa

SEQ ID NO: 1777 - DNA, 1574 bp, Toxoplasma gondii
cttttcttcacggtcgcgcagccggtcgcgctggtcttcgtcttgatccatgtactcccccagcgcgaggccggagccctcgtctcggtcataccaaatgcgcgagagcatcttgtcagtttcttcatcgatgtacgcctcctcattgtgtttttcgtctgcggcctcatcgtcccacccggaacgcatgcggcgagcgcgcggcggcgcgtaagacggagacgaagaccgagcttcgtcgtttgtcagcttcgacgaggagcaggctgataccaccgacggcgcgctgcttcccgccgctgtcgaccgggtcgaggacccgtcgtcgttcgcggccgtggttttcttgcctttgcggccgaggtcgaccagacaactgccggtccgcggggcagatgcggagaaagataaattaccagcagccgactccagcgaagactgtttactcgttaactgtcgcggacggctgaagaccggcgcgcgaaacgacacccctgagccaggtggacgtcctcccgagggatcgccacctcgcgactcctggctctcagccgtcgcagcagcggcctctacattgaacagcaggcggaatttctttccggattttgaggagaacgagggaaggggatctggacattggaaaggagtttctgggccgtagacaaccggggaagcggcggaggaagaaggttctgtggcagaagcagcggatcccgacggcgcagaggtcgctgcactgtggctattgtcgccacaagaacggaaaaacgacctttcctctagctcctcctcttcgtcatcgatgaaactgagggcaggtttcctcattttgctccgtactgcgcagacgaaaacgacttggagcagttcgctcgtggaaatcacgcgaaatgtcggggcagccacgacacagaaagtacggaatgcccggcacgatgggtagacgaggcgaaaaatgcgttggaaagcggcccgaactggaggaaacaaaaaggcgagacacggaaaatgcgggagtctcagagtgacgaagagtttcaggaaagaatgtacagtttatcttgcgtctgtctgcatgcactccttcggagagacgcgcagaccgtcagttgcgcactggagttcctgtctcgctgtcccacgatggttacggtggcgggtctcaagttcggttgcctgaatcgactcctccgttgggtggcctcccgcgcatcttgccactgaaaagccagccgagcggctgttcatgcttgagactacgtctcgtgtgtcagaaaacgcagtagctagctgcaaataactgcaccctggcaggtcatcgaagaatgatctacgctccgggtcgctgcccgaaggttcgatgagcgtccacgaacggacggctcgataggcatgacagcaggccactggccaagcggtttcactggctagttctcttcaccacattttcacgttacttcctttcttatttcccaggtgcctctttgtcaacagcgactctgcgtcaactgcctctctcgacagttcttttttccacagtgtgtgtactccttgaagctcagactcgcaaaaaa

SEQ ID NO: 1778 - DNA, 3063 bp, Toxoplasma gondii
ctggagtgtctcggcacctcgggagaaggcggaagctcatttttcagggtgccgcgccgtcggggctttgcggcagcgtaaattaggattctggggagtgtcagagtgtggaatttcccacagaagagaaaggggaagacttgcatgtgcctctttcttttaaaaaagacaccgctgcgggctgtcaacagcgaagcgcatgcatgtgcacatggccgggacccgcgttgagtcgcgtgagactccgttggatctgccggtctaaagtttccgtctcacttcagttccgcagaacgatataagcagtctgaagtcctgcgtcggagaacgatttgcttctcgtcaaacgccggctgtacaggctgcgcgtagactcgcgatgtctggtctcggaaattcgcttccgatctggaaaaaaaaactggaatgctcgatgcgttgtcagtgcgcttcgcagacggctcgtccccctctcctgcaaacgcagagaggtgtggagagacgcggttcttgtcaggtcgaattctatcggagagagtgaaaaaggaactcgcggattttcggtcctcgcgcggcaaagaaaaacaacgcagtcacatagaggtttctcttcttgaatatcctggaactgcactgctcagagggaagaggcgcccgtgatgggagcaataaaaacgcttttcggagacacccgatacaagcacacaagtgaatatttccgccaatccaccacttacccatttgcgcctaatgcatatatatatatatatatatatatatacatagatatatatatatatatagatagatagatatagatatatatagatatattattacgtgtatacgtctaagtatgtgtataatatctttcacttgggtgggagtagtattggttgactgcagcgcgttttccactgtgcatatgaagagaggcaaagacacgaagcgggggatttgttttttcgttgttattctgtctcgcatttgtgtcgtttttcagcgaggggcacccgacccgaggtgcatttcctttcagtcgagctgtcggccgtagtttcaggcggcgcagacacctcaggtgccttcgtccagcgttctgttcgctgtcgtttgcagtcacgcggtttcctgaaaagcgtggatagcgaagtgcggcggtttttgaaagtttcctcgacgccaggcgtccccaggaatccctctttcgccgcaggcgtacttcaaaaaacggtgtcgagcactcgcgcgttttacagttgaaaagtcgagacctgtgagcgagggactctgaagaggcagccgccgttggcgaggctcctcctttggtgaactcgtgaggcgtgcaggtttcctcacggagcgggcgcaatgcaggcgtggatatctccagttctgtatagtgcggcaattacgaagacatcacgctctcgcgtttcgacacacttcaaaagacgatctcagcaaggtcttttctcccgcttctggaataaacacagcaagttgtttctgaatagaactttagctattccgtgggggagacgacaacgcagctctcataggacgcagggcttctctcagtccataggagcagccagccatacacatatttacttatatttacttatatatatttatatatatatttatatgtgggtgtcaagcatctctacactgagaaacgtccgaattgtatttccgtcggcagagtacccatgtccgggagcgctgcgagacggcgctgccgacgtattgtcgcgtggagaccttgaaagacacgaagccagtgccgtagtgaggtcgttttttacttcgcgtttctgccgaattttttcctcgtgacccgctagtttctggagtaggaatcacactttttcttacgcaggttttggggaatggcgaaatccagcggttttgtccacggcgccgcctcgcctgtgtgtgtgtgtgctcgcacgcgccaagcagccgcgccgacgcccccactcatgccgtcgtcgcacacgatttacatctgtctgccaagtcacctcgtctccttgaatcgaagaggaaacgcgagaacggttctgcagggtcggtctgtggctgtcgaccgctgaagcatcgcgagatgttgccggtagaagttcgagaacacgagcgcagaagaagaggggggtgagcacagtcagtctgggagtgtgcagggcgacagctacactgtttcgcaagcagaaaagctgctgttggcgtttctgcttttctcacgcgactgagtgcttgaaggagagcaagtctggtcgaaaaaaccgcttgtcctaaccttctcgttcgtccacggggtcatgtatcccgcaccgtgcctcctccgacatgaatcttgagccaagcgtcgcggcaagaacaaaaaccggtcggtgtttctgcgtccactgcgggtttaaagtcctggcgtccccgtccctcacgcttttccccgactctctgcttctcggcgctgttgccttgctgcttttccttcttttccgctggcaaccgcgtggtgcagcgccggccctgttttcccaggcttccttccgagagcctgctgtgcttctgcaccctctccgtcgcgtctgcgaacttcgtctctgctgtctgccttctctttcctcgaaaggcagtctctgaatcctttcgctggacaccaacctttttcgcatcggttcgcgcgcgcgcggcggccgagtgtgtgcctccctcgatttttacgcgtgtcagttgctctccgaaagcgaaaagtcccagcagccggcgggtgcgggtgtgtacggttggtctggcggcgttccgcggcctcccggcgaggacgatgacgtaagagtcgtcttcaggttatagaatgtcggaaagcgggggtctgccccgtcctttttccccgcgtcctcctgcgtcaaccccagagaacagaaacaacgcaactgtggcgtttttccgcccgctgtgttcccctcgagtccagccagcgcgctggtgagaagaagccttcccgccgcgctcgcgctggaagagagaagcagaacggaccgcggcggaccctca

SEQ ID NO: 1779 - DNA, 2481 bp, Toxoplasma gondii
aggtatggttcaaaacgactcgttcgacattgaaggccgcgtcctcgttgagtccacgtgactcgggaggtcgtacctactgctgcattcagccgaagaccatatgtcacagtctgagcactgttttatccttacgcaagccgcgaccatctctcccggcttcctttgtctctagccgttcacagtaactcgccgacggtctctgctgttttcccggttccaagttccccggcgtcaacgtccttccaaggacattcaggacatctgtgagtctcttaacggtactactagtgttttacctgtgtgttctaagtctacatttatcctgtagttccggtcttcaccactgtcatgtcgcggatgtttctccaaggataaagaaagtacatggacgttcaagaattcctccaggaaaacgaagtcgagtttccatgtagagggtacggtgcgcccagcctagggtttccctcaaaaaatacataagcttcactttctattaaatgcacgcctaccagccacaccaattcctgcagggttaactttaaaggcgtgagcaaaagatgtgcaaggcgacaatagagcctataaaacgcacggcaaaatgaagttgacttccgcttggtttacgaaccagagcaatgaagtcagaggaagcggtactattcaggcattcagtgtcatctgtctacacataaatatatgtctaagtatacgttcatgtatgcatgtatatatatatatatatatatatatatatatatacagaaggcatagttattgcgttggacctccctgtagcgttcttgtgctcacaataatagtgaatttagtccagggacgccaaatctgcgtttccttgtagtgagacgagaatcaccgtaagagccatcttcttcgatgtaaatctccgacggtctttcctcccgtaccagcccccctcccgttttggtagaaatcatgcatttttcacgttcttgtcctcaagaaagattttccgaaacagagatttcgtgcctttcttgagtatacataccacaccggtcaaggtgaaagatttccttccgttcagagaggttcttcttgtgaaacaagcttctccatattttgactgttcagtcgtcgagagctcacctacgatgtttttggattgctgtcttctgagagtctccatcgctatgtttcgctccgtagaaatgtgttttccagcatccatgcatgcatgtgcacgtgcctcatccagttccattcgttccttttacggtacagcctgaggaagcgttgagaaaacaaacaggtgctcgttttatctcgacgtttcgctgccttcccccctcggaagctctgcacagattcccggtacccgatgttcaagattcagatgcagaagaccaagttgtctgcgactcgtgtacacactggctcactggactgctagagaaaggattaaaagttatcatttgaacagagtgtacatcagccaaattccacatcaacgacactcgaggcacgacgcgactttgcgatgacgcgtgtctcctcaccggagctacgagctgcagttgttcccctcctcgaatccagatgacccacagcatcactgttttcctttcttgtccattaattcctcggttttcaagaatctccacctcgtttttgccgcgggattttggttctccccggtgccggtgcggcagctgtctctggggctgtgtcccgtcgccgccgtgccacgaggtcttcctcggagtgttccgtttttttcgcaaaacctcttctgcctctgatcgtctgctcctataaacatgccccgtctccagacgtctccgtctgtgtctgtagcggttttacgaggctcgcggctccgggcgtctcacacttgggcgttgttgtgaggagcctcgaccctcgagatcggagtcgtccacagaaacagactttccttgttctttctctccctcgatcgcctttcctgtctacctgcaggaagcgttgatgtgatgggcagaagctgctctcagagccctcttgtcagtctgacgagaaggcggaggggagaggaggaagggagacatagagaaaggatcgttgcccgcttccacaagccagcctggctgtgtccgttctgactctgacaagaaacgctgtactaaagaaaatcttttccgcacccgagacataccgacgccctttttgtttgcaacttgtaccgttacattcaggagcataccgttatagtcgatgcctttttccctcatatatgttgatgacagatgcgaaaactcaactacgtcacctcgcagtccccaaactcttcgtgctactctgtcgttccaccttcaacagacccgtcgtctcttcaactttcccttccactcagtgtctgcagttttccgtgtctcccttcgttccggtttccagtgtaattccaacacagcgtgattcgttcgtaacggacgtcgctctcctcgctttttaccgaaa

SEQ ID NO: 1780 - DNA, 1727 bp, Toxoplasma gondii
attgtgcagcaatggcttcgaggacacgtagaattcgcgacagaatgagactgcggattccagccttgcgtttgggtatagagatgccgtgacagcgtgaaaaacacgctcgagcgcctgacgatacttccagttccacagaactctgttactaccacgactccgacgccgtgaaaccaatagtggcacatttacacaagcatatacaccatccaggaatctcacctgttttttctgtgaatccatcgtgtcccgggtaggctggaaacgcgcggcgatattgcagaatgaaaccaaagatcgatccttacgcacctgtatcaccaagagatttacgcgttatcgactgaaacatgaaaaacgcatgcaaaccagtatgccatatcgtacaaagtccgttaccagctgaagacaccgacgagacaagaacttttcccgtaggcgtctgtgactgtttccttatgtgtgggatgagaaagtatggctcgcagtgacatctcgacagcaccgacaagaaatgcaaggctgcaatcgatgccgatacgtaaaatttcttgagattgaaaagccatcgcgacgccagggcctgaaactcctcctagataaagatacatccttttcatcgtgacgcatttggatctattttcgctgcagtttcctgaaaagctttgactgctcgcttgtcttataacctcgaggcctccagatctttcaaacgcgaacgcagtcagggcgatggggtattaacgtctccacagaaagcaagcttcgctttgactgtgctatgaaaaagctatcgattaaagtcactccaaaacgtagaagtgaagcagctcattccggatgaaagggaacggcatctggaacttccctgtgtaaccgcttgtccgccagcaaacatccgacggattggtgtctcgctaccacttgcttgtctccacatacaggtagattgaagtacacagaacttatcgtggaggccgaatctgtctgaagtgtcttcaacaatgtaacagaaacggcattctgtcttactttgcggactgtttgtttcaccaccaacagcgaagcgacacgaggccttgcgcaggccgagatgcttttgggaaaacctgggaggaaggggccaacaaggcttagccagttacacagtattactaccttgttacaaaattccaggatttaatgatgtcaaaacattcttccacaggagaggccaagataccagaaagataaatagcgccgagagcacgcggcgggtcagaaatattaggttcctggtcaagtgaccccgcgtcaaaggctgaagacctctccgtcaaagaaaatctccttacggagtcccaaatattcgcaaaattgggaaaaaatagatgcatgacagatccacttgaaaaataggtgataaatatatatggtaattgtgacgtccccacggaatcaaaggccgaccttgcgataaaaagtggacgctgcagcgcaagccccccccaaaactgagacacacggtagcatactaaacccgagatgatgtcgtagtgggtattttatgattactttgtctcatagtcaagtaacgcagcatatccatagaagggaacccctgctgttcaacgccgaaacaaacagacgctgtcgaggcagtaaagcagttgcgtctagctcgacgtattcgcgtgtcggataagctgaatgcaacggctttacacgtgatgaattgactggga

SEQ ID NO: 1781 - DNA, 2712 bp, Toxoplasma gondii
ttcaagcacccgttttcctgaccgcagccggtgacagtgctaaaaaaaacgtgaccagacggcctgtatacacagcgtggctagacagtgttgcatgtagatcccgataggcagctttattaatctaaaattcagacagaggccttccgcatcccacccacaaagagataaacgtgaaattgaaggcccgctcatcgcccagtcaccgaaactcccttttacctggtatattggagtcggtatctccacaaacttctcgacaacttgaacttgtggtacgtcgacaacaacttctcgagttacatggcgtggaacttccacaatacgctcttgaatctcagttcgaggaacatgaataaccttctccacaaacaccgtttgtcgctcctctactaagtggtcgcggtactcgacttgtggtacctcaattatttgttcggcgactatcggcttcgtagtataagtcactttttcttcgatgagggtttgagatgccggcaaccctccaacggtggcgagtgggagtaccgggatcgctgggagacgttccctaggctcgcagcaggggctctcgcagagctccatcgtgtccactattggtaacggattaatgcgatttccttccggtccacacgaaacacaagaggaagactccagtcctcaattagcaacgaatgacgctttaaagcaggagaatacgtcgcgaactgcagacatcaggcaaacagtgctacaaatgagggctagactggaatttgagcactcgcagcgaagttccaacgcctccttttttcggttctggacacgaggtctgtgcacaggcataatgcttcctaaagcgtcagcgacttcatgacagcggacaggcaggcgctgtattgtattttggcagttacacgagttctctacgcggcagagcaactgataagggcctcgcagatattgacagagaaatgaggtttttagcttgcgtccagcacaatatcctacgacgagcattgcttcccaatgtacaaaccagcagtatatatgtactagcgtgcccgatagagttgtgaaaagcaaagttcggttttccttaaaaccggactcacacgcttcggcaatcgattctgaccgccagctagcccatcctctttctctcgagccgcggaaacccctcgtgacacgcagaatgacgggacaaaggagcaactgcaacaaatccgtcgggtgacgacggaaattcttgcggaaataaagggttgaccaggaaacagacgaacgagggcggctgttcacgttgcattcagcgtccctgagctgcaacaaatgccgtcgcattcaagatcccgacttgcacagcgtgggtcggtatcgggaaacccccgcgatgcagaatgagctggaggtcgagcgaatacgcaagggttttcagttcgctacacactcgtctacccaaatcttcgttgaatatagacaaacatcaagaaaccatcaatgctctttgtttcagcctcgctttttccactttagaacagcacgacgagatgcgcagaggatgcaagtcccacaattcgagatgctgtcccatacaatacgatacaggcacggatgtcccgttgcacaggctgtgtccgcttgcatggtgagcgcgggtctcgatgatcgcccttccttggtgtgagcggttttcagtgctggagctggtcaccagcgagactgtcttgtgctacggcagactgggggtctctgcgtgcaagaggcaagtgcatctgtcgtaagcttctgcctcgtccattgtcgtttgtattcatggtctctctgcgtacccaaattgtggatatgcttaaaaaacggcactttgccggccgcccaaaagcgtgcggtattgcttgagcccttccgtgctcttgcatgtctccagaatgcagtgttcctcttccgcacaggcgattttgctgtaacgaatcagacagactatgtagtgaagaggaaatgaagaaaggagaacacacgcgtccttaccgacacgccgcttacaccgccccccgcgcactcttttctcggacggccaaccgtcggggttggttcctcagcatgcgacagggaaagagcaaccattttgggtcttgttaaacaaaattgagctattccgtcatgagttatcattcttgtcgatccgaagccttcgtgcaacgacttctgtcgtttctttttgacgtcaacgcgattatttttcagtgccaagcaaagttgacctcgttctttgttcgggcaagcctcgaccgccatcggtaacctacgagcagtggaaatgatatagtggtactgttcgagtttgtgtttcctctctgcggtgtcacttaccagggcattcctggtgtatcatctttagtctccccggctgagatactggcctcgttttttccctttacagcgctctttatgaattgtgttgtcacccgcaaacaccggcacacttcgttgagcaacgtatatcctccacgacggtggattcaaatcattaaggacggaatcgcgtacctctcacttttcttctgtctcagaacatctctgaagtaagtgtcaacacacagagccagcggaaacgcaacctcccgggtatatcgcagcggcgagaaatccccggaacgggccttttttgtaaccatgcagtgctgatctgcgctccttgcaagccgttccaacttcgacacccctctgactcaa

SEQ ID NO: 1782 - DNA, 4305 bp, Toxoplasma gondii
cttcaacaaaactcaacatggcaggccgctgacaggaccgagtgcacgacagtcgagcacttctcttcttggccttggagacgagataacgaaaatcagaatccaaaagctctggaccggctgctgtggcacattacacctagggacagcaacgtggcgaggtcacccgcttcgcaagatccttacccttctcttccacaatgtccagggctgcatacgcggcaaactgcatcgagagatcatcgtcagaattgaagacctgaagagaaagcggttcattctgtaaatacccaaggcacgggacaataaatcaaaggaaaccgccgagtacaggacacggtggacgtcgtcgaaaaacaacagagcattcagtggtcgcaagtgatttccagtgactatggcgagttgaatttctgttgtacactcaaggaaagaatttgccacgtggccctaatcttcactcaaagcccagtcagcttcaacagcctatctatttgctgtcttgtcgccactaccaagctcgcaagggttgcaaagcggcgcacaaattcgcattcacatccagcaatgctagtccaaatcctctactcatcttcctcacttgttttccaatgaagcagacgcacgcgaccgccatcgtgacgcatttctaccgcacaaagaaacacccgacagggcctcaatcttggtaggatgctgacggggtctgcgttgcctccaccacgaggacttggctcccgattataactcccccactcaacgactgcattgaacggctggtcaccgttccgaaaaaagccagcagagaacagagtagtattttcatcggcgcgatgccaaaagcgagcttcgtcgtggctttctggaacgaagctcgcactccacaccgtgttgggtcagagttccgtcgagtatgcagtcacaagaaccagtgcctaacgaagcaggagcgccgtagtgtgtctgcttgcgtgaatgccgcgagctcgcacgcataggagaacaaacaataaactaaaaagtggataaaacatcaagagagtgtgtgtgcagtccaggtacaacggatcgcaagtctgaatcgtaacgctgcatgcggttgcagtgtctgttcaggcatgtaccgatgcgaacgggcgtgactgctggcaattgtttgtgtctgtagtgtccggaaatccttcatagcattatcagtgtgcagaacaacattgaagacactgttcatcatccgatgcttatgacatataatggatcctttcctccttagcacaaccagatgcatactttaaaggacgggggagggccactggcctgccctgcatagtacgggacggcgaagcggaaaagcagttgctgccatgattgcttacgaccgcgtgccgactgcagaataaacagaaattgcacgccccctctcccagtatcgtgtaaggctgccatggggtgcgatccaacttttttctggcacatagcaaggagcggcgcttgccgcttgcatctgaatcaccaggaacatcgcgcatctagcgttcccgctgccacagtatgcagacacgccattcttggcgtcatgtcttcttctcctgtccagccatccctttcgccaaggaggccaggactcgtaaaaacatcgccactgagtaaatacaattccctgcgggtgcgtgaagagcaatgctccgtaaactgcaaagtgcagcgcagatcaaacttccgtgcattgttaactgggcctgttcaaggttttttcctgtattggaacgaagagacatattcggaattgttcttgctgaaaactccatgcttcctgcagctctgttgaagagaactgtttgggcctgacgggtgcaagcacagtttagcaccatggatgaattgtgaatcctgccagctggagcatcaagacaagttcggtttctcgatcgttcactgcttatctgctgcgcggtgcctcgtctgtccaccctgcaaacgcgtctcttaaaagtacatctgatgtggagattgtggtatgatagtatggaaaagctactgccacacggcacatccctgtgatgagcagactgttcggaggcacacctgaacctcaagggtcacggtatttgcgcagattgaagcatcactgcttcaggaagtgtcacggaacacgttctgtagaaacaaacggaatatataagcgaaaaaccgtttctctcgctacttctgtctgtcatacgccaaaaggatatagagcccgtgctcctcgctgtgtacgccacccgtcgatgtgaggacgtcgaagacaagaactaagccagagtccttgcatggcttatcttagcaactaagccacagtagagcatgtccgaaatatctgagtttcagcagcgccgcgttacatgtctgtatcaacaacagcagggacgtcaaacgggaattgggttaagttgcaattttgtgctgagaatattcatatgatacaatcgtgcatctatagcttcaaatgccgagagtcgagctcgtttcttatgcatctaggactccgatgtaattggtaaacttcctggatggaagcgtctggaatctggattgctgcaatactcacacattaaaggcgccttaagtgtcatgaaactagtgcagcatgcctgcaatagcttcgttgcttcctcagcctctttctgcgagttccgatctatctgcatagatcccaagcagcgaaaactggtgctaggctactcaccaccaaggatcgtagttggttaaatgcgtgatgtacgcggtagtcactttgattcaaaggtataagaagaagagttattaacctgcttttcgtttgcttgaatgctgttgagtcgttgattcttatagagagcttgatgcggccgtgtctcttcatgtctgatatcactgcggcattgctaggaattgatagttatttgcactcgtatttgtcccacctcctcacttcttcacgcacagcggcgtgaaggtcctcagcacgtgcttcctgggtctcatctagtgatatgtaatggacaccatctgttaatcagggcgaagttactgcgtttgctgcttttctttggagttcctctggcggagagatgcacagttaccagtttcaacaacgtcgactgccaacgtcccttaccaatccgttgcagagtctctggagaatggtcgccggaggcttctggcgcatccgctggtagttaccatgtgtttgtaagacataactgaaggatggcttctagaaacaaccaaccgatatcctcctctatctgtttgtcttctgcttggatgttgtcaacataagcctttcttatggatgacacgaggtgctgcatggcatcgctgcattttcgctttcaactacttcactcgtccaacgtgcaggtcctttaatgtgtctcacgcgtgtttgctttgctcatcggcgcttgttatgacggagggttcctcagaatcgcccggagggacgtacacgtcttgcgaaacaggctccgcacaaacacctgaagtcgctcggtgtgccggtgcaagcgcgaaggtaaggaagacctgcaacatcttcattgcggtagagataaattcggggcacctcgaatcagaaaccgtgttgcattcggtcgtgaacctgtaatggattatatctgcacagggggcagcggaatgttgtcctgacgtgtcgatacaccgctagttggtacgctcgacactgtgcccaggttcctctaccgtaacgggacgcacactccttcctggccctttagggctttccatacatatcggagtcttcatctctcctattcggctaacaacaggttttttggaagactcagttgcttacctcggctacaaccacttacatactgcagcacgtgcgccagctcaagtaccgttcgtggaagtcggccacgctttcccttgaaatgttccactgccgagcatgcaacgagcaaattgccggcaccgtttttttgcgggtccgctgctgtccttttccaggcatcctcttctacccaacagcgcaccatttatctgttttttattaactttgccttcgtgcgacacacgcgaacccaactcaaatcttttgggtcagccacaagtactaggactcgttgcaggcctgtcgttgtctgccgcttagcaagtgtgccacggttcgagtgtgtcgttggcgcttgagtctgggaaagtggtggcagcgaaggtaaccaggattttgcgttgatctgcgagtggagacttctatcggcatctctgccagccgatttcatgtgtgctggcgtggtctcgcaccgaatcccacattga

SEQ ID NO: 1783 - DNA, 2153 bp, Toxoplasma gondii
aaagaaaaacgttcgtgcctttccctcaaaaagacgcggctcaagaaactcgctctcggtacgcaccgtgggaaaatgtagcgggagctgttgagtgcctgcactgacacgcgccggctcgtcgcaggctggaaacgcgagtgtttccagtggagcatgcgcggcttttcttggtgatctcgttcgctggtatgtatgcctttttgtcgaaagagaagacacccacgagcgcacatacacgcaccccaatgcgacgtgatagcgctctgggccacccgtgtgtccgactctctgttcccggcatgcatggcttcatcgtggaaggagccgtggaaaaaaagaataggtgtagcaccagggagaaatcttatcgtggtggtgggcagaatggacagggatccgaggcaggaaattgggttagagacgaacgcttgtcgccggagaagggtacgttcatcctctaaatctggtcattcccttcaaggaagcgataacttcggactcaccttccgatgtggcggaaacgaaaacactcgtagcttgcgagttgtcgtacagccgcgaacgctagctcacggttatctacaacggacaacaaaaggaaacggccagcctaacaaagaagcacatgcaaatccctgtttacccgtgtctgcttgaacggcgcacaaaggctaacaagcacaatcaatacggttcgtttttgagtgacactctggttagttattgacagacatttaacgaactcaaaagcatgaattcgtggcctcactggtttgcaacagaactgaacgcggatacgagaagtacagccgttgctgcggaacacgagggtcatgtgagagaacattatccacatctttcacacgaatgtagcatgtggaaagtactttcactgatactttcattaaaaactgtttcttcatcgtgcacccctactacactgctctgcaaggcgtcggcagcagacaacgaacatgaaccatggtgaagggaatcgttttgcggagctttcaaagcctcggtgaggttgttgcaccagcacggctcgagaaaaggaccattatgtgtcgctgggttccgttgtgttacagcaaagatctcgctcgttctaaaacaaagaggccggctctaccggttcatgtagaggttgtgaggggaataggctgatccttgcccaatctatggcagaccagctggacactgtttcttctttcagctgcgtacatgtcctacgctggcagtgctgcgaagcagcgccaacccgctttgtgtggaaccctgctttgtcctcatacataagactgtttacccattcatcttgaggcagcctacccacagctgagcagttccacaagaaaatcttctgttcagtgagagtgtttccttgtcgtcgttaaacaggctctcagaacttgttcctgcccaaacgcaacactcgatagcagttatggcatgtcagacatcaagcgccgctgtgccttttcattcgtccagtccatgtgtttcggcaagacgcctttgtggcctttcattggggtagtcacacacactattgaaggcgaaatactgagaagaataagcatttctcactctgggaacatgcataacattttctccagtggcagcatttttccgcactgtcgtcgccaggtctccttccacttctgtgtaccacgtagcacccttgtatacacacaagctactcggtgaagagaaaacgctggtggcttcctgggattgttaacacaacttccgggtccggctctcgcggttgctgcgcaggcgtcgacggagccggtgacgccgtgtccccggcaactggctggacacgccggatggagatggatgaccgttgaagccaacgccgctgagactaactagaaagaagtgtgcaacagttcatgagggacaaaaggaatgtgatgcggttcgcttgaagaaggaatgtttaagcacgtcaacaatacgccttggcgaatgttcatgactgttcatgtggttcatcggatacatttgaaaacatcgtgaggctggtacctggtcgcaaacgtcgtagtgtagtaccgacaataacgtcgtcgttcaaggggacgcagttctcggaagacgcgtcgcagcatactgcaactgctttcgtctgtcttcaacca

SEQ ID NO: 1784 - DNA, 2478 bp, Toxoplasma gondii
gactagatgtgcgaataaaagccatggacgactggacggttgttagaaatgcacccaggtgccactgtcaaacggttggtttcatatgttcttgtcttgtgcatgcttaggatgcgacccagtggggcgccgatgctgcagctgctgactggaagcaagctggcgctgactggaccggccccgctgctggcggagctggtggtgaatgggaccagtctgcagttgctgctgaaggcgagtggggtggtggccgccctggtgtcgctgttggcgagccctggtaaacactccgttgatcgaggcgggaagttctctgacgaaagaacgagaaggaagcgcccaagagagcagctgggagggacaggctttcgatgggagcactgacgggaccatcaccgaggttgtagagaggatatatgtggaggacctgaagcgtactgtgctcggatcgtctgctcggtgtggcgggtgtcttgtcgctggggccactgcgagcttgctggcgtggaagaaactgtcgactccccactgccttgtttcgcgcaaaaaacctatgctggcggcacttggccttggcgtcgtgagaagcgtggaaaaaactgcgtttcgtgcgcacagaatccgagggctttggtcgcctgcctgcgacaacatagctggacaggcagcggttactttgttatgcttgaaacggctcccactgatccacgcaaaattgagcgtaggcaagctggagaacagtgccagcatttgccaacacggtgatttgcggtgcgaacacatcgcacattagagtggctgtgccgcaccgtggcgattgtctgtgtgtgttgctcgcagctcacacaggcgtgtagaacgcgagtgcaagaagcaactgagatcacacaaacggaacgcactctacggaccctcgatacatgctgtccagtagtatatcaggtggtcgtttggacaaacacatacacagttttgtcttcctagatgagggcgggagcaccatcacgtacaacaaaatacccgccgctccacgcagttgattaggaccttcggactcctgacatatacagctccagagcactggttccgtcaccgtgcgtgtttctacagtgcccatgcaacaaggaagaattaagaacagctacttcaaagagtgcagacggagagtcttgttttctgtgggtggatgagggaaggtgcgtttcgctccggcggaaggccgctaacgtaaaaagttacgtgacacacaccatatcttattcgtttggtaatcacgtatcaaaaggatactctagaggtattaccgtagggtacgattgtgcctatataccgtatatgccgcgtgtacatgtacccctggcgtgttcgcgcagagtcacccccacacagatgtgtacagtatcaagttgttgctgtagccgtaggcagccgcgaggttgatacgagaagtggtgcccacgacggaggggttctctgctgaaatgagagtacctaacaatcaagttctcttgtaattctcccaaagggtcacgcaatgtaggcgatacagctgttgagaaaacgtagtgacaaaaattcaacatgaaaatgcacccctagtttgcaaagtaatgcataggaacatgtacgaaggaaccacgatgtatcgcccgatgcgaaaacagtggtacgtcactggggatgcgtttgttaccttcacagctgattcacttccggaaagccaggacgtcatgatcgagccctgtctcatccaagcagtcgaaccaggttgctcctctcaggcgataaagccctgacaccaatgtcatgagcagagttccccctaaacatagattttttgaatgttgtagccaaaaggggcttgagctagatcgctcttgcccttctatgggcaacggccacctctcgctccgggcagagcaatgggaatgaacggctgtcacacaatggaatatgtcatacaaggtccgtttgaagaatcgaattaaaaagtattcattttgacttctatactcaggttgctcatccagttcgcgtgacactttttcttgattaggttcacctaaagtatttgatgtgaaagactacagacacaaatacatcattgccactgggctgtctggcattttgtcttatctgccgaaagaattaaggcagcgtttttgacacattttggcatcatcatctttgtaacctcctctaccctgagcatctggcgttcctgtcaccagtgtacagtgctctgtaaatagctggaagtgtcgattcctgcgcgtcctactgtattttagtacgcttccttttggctgtgtttgggttttgtctaagcaccgtgcagaaaacgtgtcgcgtacattctcgaagaaagtgcccgcataaaacacggtcagaagatcatcttagccgtccgtcactgactctacagagaactgctcggggcattcgctattcaagttcttgtggaattgagataagcaa

SEQ ID NO: 1785 - DNA, 3055 bp, Toxoplasma gondii
taacaatgccttcgacgccttcctgggtgccctggtagtacaaaggtaggagcttggggttgcccatagcttccttgggaacggggtgctcgatggtgcgctgcacgtgcacagggacaggtacctccttgtatcggggctcgatcttggggcagaggtactcctggacaatctggagttcgacagggaccggaacgttacggtcgacgatcttctcaacgggaatcgggcggtagtgagtcatcggcacttcgacgggcttgggaatgtggcgatactgaggggtcatgacattgcggtaagtgtgctggatgtggggaacttcaacgaccttctccacatcgacgaccttctccacgaccactggcttggggacctccaccacctcttcctcctggagaatctcgaccgcctccagcggcttctcaacaacaacatcgcggtagtccacctggctgatctccacaatcttctccttcaccaccttgcgcgggacggggataacgcgctcttgcacgacaacgcggggcacttcaatgatcttttcttggtagacatactgaggaacttcgacgatcttgtcgacaacctgtcacgtcacgatccagacagagggggccacaatgcattcgctgcaaatattgtactctttagaaattcgacaacaaaaatgtggtttcaggtggcgtttcgtgtggctgtatgtatggtcgtttggggctagcatacagtagtgtgtgtgttgattcgaaggcggatggtaacttcgcgtatcctagctggtgggcgtcaagattgaagcgaacgtggtgcccgcagattggaaatacttaccttaacttgcggcacctcaataattttctgctggtagacgggcttatggacgtgcttcacgcgttcctgaatgatgggcttggcgacgtgagtcaccttctcgtgcacgacgtgctgcggcacctcaacaattctgtcgacatactgcacttggggaacttcaatcacgcgttcctggatttcctccttcaagacctcgacaacgcgttcctaaagaacagcaaatgatattcgaacactttcttttcagaccgccacgtgtacgtagccagggttcacggcgtccgcctccacgtcgagcacgacggtggctgatgcccccaaaacgggtctcttttcagacatgcttgtacgccttggatacacgaaaaacaaatataaagagtaatcgatgaatttctgcactgtatcggcgcaactgcaataacgagcgccttcgcaggaagttcttcggcctctacgcaaccagctacgttcttccgcccgcgcagtctgtgagcgttttgttggatagtcgagatatctcttcctttttcgggctgtctgccaagaaatctcacctggacaaggggctcgagaatacgggcttcaccttgagtggcaacaactccagaaacgaggcggcttccagggacttgagtcggttgcgcagcgccgggctcgccctcaccacagggagcgcacggctggcagcactcagaaaacatggtgagaaaggagggaacaactttgtctaaacaaacagcctctttgaggtcgagtgccaagcgcacttctgtcacctgtttctggagctgtggtgttcgccgcgagaaatcctttccacacgcggacgaggtgtttgcacaacccacggacaaagcgcggcagatctcaggggcaggacaggttgcgcgtccacttgcagaaggttcgcgcaaaagagaggccccgcgcgacagtggaagaaagacagtggtaaaaaatcgacgagttcggttccttggatccacaataaaactttagcaatacgagaagaactcagataaatttacacggagagacgacgcgtgctgcgagtgccaagctagactgtgtcaagaggccataatttctacacggcattcggcgggaagaccggcacaacccggaaggcaaacagctcttgagacctagcgcggcagggctcacgcgaaaagagaaacagcgccagcaggcagcctgcagacgccgcttgtccagccggtctcgctcaagggtcatagcgcttgtccacggacacggcgcggacccgcgcttctgcgcggacgcctttctaaatggctcgcctccataagctcgatggcgcacaacggctgtgacttatccgtcctaagaaggacacagtcgcgaatggcggtggcgacgctggcattcctggtttacgtctgcgcgagtagaaaaccggagaggtcagctcgggcacgggacgatatcgacggactgggtgtcctgtgacgacatgtgccgcgttggttgctggctggcgatgtgcctgtttcgaacgcgttgagcgattcgagaagacgactcgggtgccgaagcatggtgccgtcctctcgtgatgtgttacgtcgcggcgcgcgagaagaccattcgcgattttggtcgtcgcctcttgcacgcgctgtctgcggcacgtctcttactcaaggcatcggcctcgaagcttggctgttcatcgctggcagctaggcagacgtgttgtcctcagaaatctttttgtgttgcgatttctaaggcgcccttcaccgtcttcttttttagttggaatttctcgtgcggcgttcctctcagaccttcagtcaaaatatccgtctttctcaaatgcagtttaaacgcagcctcgcctgacgagagactctggcaaccgtcccctgtccattgtggagccgttcctaagcagcaactttttgagactcgacactggctgaacgaagcacattcctccttactgaccgaactcccgcgtgtacttttgcctttgcgtttcgggtggagttccctttctcccgccaggacttactgatcagaaagcggtttttttgttgttcttgcaaaagttctcgtggctcgaccgcgggccggactaggggccagcgcgattctgatttgcacccggtcgccctctgcgtgtgtgccgagaacctctcggatacttccacctaactccaaagactagtcttcctgtttgttgtcagaa

SEQ ID NO: 1786 - DNA, 3865 bp, Toxoplasma gondii
tctccgcaccacgttttctccgaccttgtgaactctctgaaagcccggggtgaaatttgtccttggtatccaccactttcgaacggcagatacctgtctgccagactcctgtcgacagctctgttcgcctcttgccgctgggcctctggttcaaaacaccctgaggcagagcaactcccgtggaagccctcgtcccgacgtacgaacccttctcgtccaaacgccgcggtccgtctaactgcggcagaggcggtgacagcggccgcactcgctgccgcggcagctgcagccgctgcagctgctgcttggacgttggagtggcttacgctaactgttccaaagacagtggccggtgtacagttggtataatggagatcctcggctgcgccgtttgtcggatagaaccctgtcggtgttccgagttttgaggtgcggaaatgggattgaggcaacagggcctcccgttccccatctgaagagccggcaggcgcctggacgtttgactggcacgccgcaggggcgttgagacggagcggcgaagcggcgccagcgtcttgggaggctgtagaagaggcagatctatcgggtgctagagtcattggaagacgtggacggtgtggaaaagtggcgattgcggaaggtacacacgttgggaaagtggagtgcgaactccggcccggatgagaagcgaaggaaggcacgaagtctagatgagaatgagcagacgaaaatgaggaaggcgcaagttgagatgtaggatcacagagttctgccgatagaggcctacaacggccattggcggcgggacgcaaagtctcgagctcgcgggagaccatctgcctactccactcgggcctgccgctggcatgctgctcaaactggggattcctgtcgtgtgaattcacaaacgacgcggatccagaggcgagacaagcggctccagagcgaatgtcttccccgcttccgctggcggatgccctgcaagcctccctggcgtcccctggcggccacatgcgagcatccacactcgcgcgcttgacgtcgcaccgcttcgcagttaacgttggagaaacgcttctaccgccggcttcgttgcatattatccgtaatctgtgtcttttgcatggagacacacggagggaaagaccgatcacagtagagctgacgacgggagaaatcactcattctgctcgtgaagaggccctcgcagaagatcgccggtgcgctagaaaaacgaactaacgcttcagtccgtgggacccgctgcgctgaaaaagacatcagttaagtcaagatagcgaaatggatgagaaataactttgacgaaaaggcaaggctataatttgaaacaatcggtggcggcagccccgtgaacccataacgtcgtgtcagttcggataaaacggcgtgcggatcaccgggtgtacttacaactgaatgccaagaagagtgcctctccaaaaaattaccggttatgcgcatctcaatcttgtcgagatgtcttgtctgaggagaggctgacaggagataatcaacggcagtcccccctcccctactatctgttagagtctatccactaaatcgggtggaacagatgaatccgcactgcagaatgggcaaagaagccgaaacaatgcccaagcaacgccacctaatgacgcttttacgtgagccacttgctgttcattgtgcgaaagttacgggttctcgttttttaaaaactcccaggcaccggtgctctccttaacgtggctggcgggaaacgtcggaaagacttacggggaagagactggggagacacgggtgacagctgcaaagccgtcggacgccagaaatccaagctccggcaaaacggactgaagacttgaatgaaagtttgcaacaaaacgaagactgtcctctaagaccgttcacacgagcattgagacgcggatgcctctcgatatcgcggtggtcacggccgagtgctccaggtgcagcgccctttacaaaaaacggggttctcacacagaggaattacagtgtgattgaagaatccttggacacagaacacgcaagtttctaggagacctgccagctttcagcgcgcagtatctcgctaactcgcgcaccgatggcaatcgacactcgaaacactggatccgtaagaagtccaccgtctcgggtggaggcatgctttgcatatcggtgttacaggacaccctggcgttttgcttaaaagagtctgcaggagacctgatactatacacaagtatcgaaagaaagtgtggtccaccagcttttttttctacgaacaaagcaggtggcgtgacagggtgccatgaacactcttggctagccgtacgtctgttggggggcggaagggggagggtgaaaggagggaggcgcagggttctgcactgtggtatcttcctgtggaagtttgacgaacatgccgaaaggtcaaaaatgtgattccctgtgaacagaggcagcaagaaccactttacatcacgggtggcatgctgctccgagccgcccgatatagctcccgcccaagtcacccacttcgaatggagcgaacggtataaaagccgaaagacacgcgtcttaacaacggtgtcaataatgggctgcaactctcgtcgttagtaggaagccacctctttgtggtgtgccggcgtgcgcgaaggctttttcggaggttttctggcgggcttctcgaagttcccttcaggagaagaagcacgtgacgagatccacgatgagtggtatggtaattggagaagcgaccggttctttagaaagctgctgatcctcgcgcctgtttagagcgaacagtcccctgtatagttgactctgtcgacaagaccgaccggagcgtttgtcctttctttcgtcatctcaggtggacgacgcgtttctagtcgcgttaacgtacagaaacggggaaagttctcgttttctgcgtcgcttcactcggtttcgtccggagtgcggtggcccaaaatctcgtaggggcatcgtggacacacgttttccttgaggcacacaaagttcagcgtcgccggtcttttcgcacgtgcccgtccgtgtctattctcctaacggggaaaggggtattttcgtgttcgtccttcgacttttttctgccgggactccctcggacttgctgcgccgcacttcacaggcgagctgctttccgagttgcgcggacaactcgacgggcttcgtgagagccagtgaagctgtgctttttctgttccgtggtctttatgcggcattcctcatccgaaactgtgaagttgtctttccggttaaatggattccgtagttgtctcgggaaatttcgacggacctgttcgaactcgaggagcatacgtggctccgctccaacgtagcgcctccgtttttgcgacagtcacgatatagcttctcgtgcagttcttcgattatgttttccttgttttttccgtctgaggtatgtttcttttcctcatgttaaaccaggcgttcacctcggtcaccccagttgtttttcttttgagtctcagtatctcttgggcctctccggcatcggtcctcgcgccgtcctgtgcagaagcctagctgcagcaagttgctcgtatcccattctagttcgtattcacaccgaaccacgcgagtacgaaatcgctttttgcaattatgcgcgtggatctccagtcctggagtctgtcgtgggcgtgtgcgcgcatcaaataagttcggcctttgtaccactttggcttcgctgtggtttcgattttcgactccgttcagctccgtagttgttgggtaccttttttcgtcaagactgcaatattcagtctgttttcaggaacagttgccttcattttctgtaaaa

SEQ ID NO: 1787 - DNA, 3070 bp, Toxoplasma gondii
cgcagagggctctctatggaaatcgacgacgtagagatgatacacaacttttactttccgcccattttgattgttcgtcgtccgcgattctaaaccatccccctgctggttttcgccgtagccagtcccgaaaatgtggtgttccattgcttcatctggatcgatttcgttcccgaccgaggctgtcggattgtttcttttcagtgctatgtcgtggagagtctttcccaaagggagcacctggcgccagtcgccgcggtgacctggcaccaccagcatggggtagtactcaacatccgcttcatcctcgtcctcttgggtcctttcatcatttttactggactccaccattttctgtggacgacttcttcgtgggaggttgaagggtcggctgaaatccggtgcggggtcgtcggccgtcagcttgacaaaaagcagagcgtagtgcgagtctgcacgcattgcacaaagccaagatatcgattcaagcgagtcgcgaccatccccgaattgtgtttctgtacatccaccgagttccccaaagaagaaatgaaggcgtcgtcaaaacagaaaaaaaccggcatttctatctcaaatatccatggcaactgacggtttgcccgggtcgccagtccaacactaagagctctggatcgaatcccaaagtcccggctgggtccattcggggcagctgtcgtctacccaacgcggatctcagctgccgcagagtccgacacagcaaaaagaaccgagacgctgttgaaccctcgcgtccctcgaaggaatttgcttggttgcgccgacgagagggacacccgacaccaccaacatcctgccaccaagcaacaggagccactgtgtcctagtttcagggtgcatcttgctagcgagagggaaagtgacggttcccacgttggcttcctgtttagacacgccacgttgggaacagatctatttgctctcaaatacgcttacttttttcgagaggaacgcgagggaatcggccggaagctcggaccagattgcgcgtgtggttcccgtggtagtagggtgacagcccagacagtaggatgaaactgaaggcgaatatcgcgaggtagaaagctgcgttcttcgcatgccttcgaagccagagaactgcgcgccgaacgggcgctgaaagcccctgtttctcgcattctagcgcggcagactcgcctttggcggcacccagagtcgtttctattgcctccagtcgcctgtgtttaggagggaaagctcgcgctggatgtaacattcgagtttcgcaagtttcttgtgtgttgcgagagtcgacctcggtgacggcccgcgtggctgcagccaaccaggagccttcgctcccgttgtctttgtcgtttcctttgttttctggagactcggacctcctcccaggtttcgtccccagagggagtcctccacgagagcggcgcctctgagagttagacccattcaagttcgagcggtcaccagaatgcggccgagaggaatatgtttcgagagcccccatcgtggcatctctccagatgcaggtacatacccctgcggacgagtcacacgcaccctcaaatgccgcacacacgtgtctgtcctctaaaccagcgtggccgctgcaaaatctactctcgggttagaggggaaagtccccaacgttgaccatcattcacaaaaccgtggagctcaaaatgaggaaactgccggctcgactgcgcccgaaggcctccgcgaggtaaatttactggggggggttccagcacatccatgagaaacgcactgcaattcccgcagatgcgagctggccggagacaaagactcctccaccaacaaagggggcgtttaccaaaacgacaaagcgcttcaccatgatattttaaatgtcaggtcactgagagagttccggaagacacttcgcctgggaattgcttagcctcggacgattcaccctttgcgacacgaccagccccccagagagattaagggcatgcacggagcaaacattctcgagctcgtcgcgctttgctgcgacctgttacactttttccagtcctggcccgacaagccgaaaaggctgcagtttttatggcttggcttaggacgacgactaattccaggctctgaatgcttttggatgttcttgcggagaatttcgctcgctgtcttccgttcctgaacaacggttttcacaggtgaagagaactgaggtggtttgggcggcagtgaccacaacgctcttattccaaatcaagactgtctgcatcttggacacatctggcggtatccttcccgcaatacgggtcaaaacctaaactttcaagacagacacaaatccgcttggttcaagcggactaacagataggattgaacgcatcgtgtgcccgaaaacgccggcaaggagtgtctttcccgtgccagcctgagagtccgaaagctgcagcacgcgcggatagcattatgcatctttgttggtactatttttcattgttccgttcttcttcctgtcttctccgctcgttcaaagcggccctgttagtctcctaagacggcaaaatcggctgatccatccaactgtccttttcaaagcgttggaataccagtgtgcgatgaccggccgtgcggtgcgacgttcggggcattcggaggattcgttttgccatcccggcaaattccaggagaggtattcgagttttacttgtccatcttcgtgacacacttcctgcgtctgacagtcgtctcttcgttgccttgctgttattcttcgttttccaccgcgcaaccctcacatcgttggtaggctgtgcgcctgtttgccccgatccgtttttctgcttgttccctttggtatttgtccactttcccacgtgtttgcatgcacaggacagagcgctaacgcgaaactggaagaaagcgagagttaagacagtgatattggatggccgccggtagaaagcggctggctggcgtgtgagctacgtaaagaccaccagtcgtttcagagagccatagaggtggaagcggtttctttctgactagttcaacccaacgcgcgtaccga

SEQ ID NO: 1788 - DNA, 4984 bp, Toxoplasma gondii
ctgcgtcacccgcctctctctcataactcactttccaaggacaataaggtaattgctcgtgccaataagaagcatgcgatcggctttaccctccacgatccggcgggtcaaacggtatcgaaaaccccccagtataccgctctccccgttctcccgagaagcagtcagcgtctcttccctggctctaagtgccgatgttgcgtcgtccgcaatcctgcttaggagtccggaaaaccgcgtttcgcccgcatgtgaaaaatcgtcagtttcccgacccccacatccgtctccgttatcttctgttgctctctctgtagcagaagtgcattcagatccgggcggaccagggtggaaggtgttttctgttgaatggctttcgttctgtcttgtcctttttggggagcttcgcgctcctaagcctgccaacgcagctgcccgcttccgcgcgaaaattgctgccgccgcccggcgcgcctccagtgaccgaggctgtcctcgaatctcggggcactctcccgagcaaaatggggaagctgcatgccgctggcaaaaaaaattgtcacgagagttggaggagtcgggagctcgcgacacggcagatgtctccagcaccggccgagaatgcggcgacgccggacacaggtcgccactcaacgtcgaagatcctcgagacggggaattccgaagagaggcatcttgcgatggaccggatgcggggttcgacacggacgatgtggatgacagactgtagtccggaagcagattctctcggggggcgctgtgcccgtctgcttgaaaccgggctgaagggagcgcagcggcaatagcggcgccagaggtagccatattagaggcataggaggaagaaacagcaggggtaagggtggtaaaggtaagctcttgtggagccgactggaaaagaacctccggaggcccgggacccgactgtcgcgacgagaaaccctgatcacaggcgtctgacgaaacagcgtacaaccgcactcgcggtgccactctgacacatcggatgctcgggaatacgcggctcaaacactgtacaagagtcgtcctcacagcctctcacatcaccagcagggagcgcgccaacagccaccgccgggcgtcctcataattccgtgtgatatcgagttgctttgacaagagaaagcgttcactcggtccaccgagggcggcacggcagctgacatgctcagatgtctagagcaaaacaacgttgggtgtctagacacctacatagcacatcgaacatcgtcctacaatgacggagatgcgcaagagaaatgtccacgagtggttggtcgcaaaaaaatggtgaacgacagcgccttctgctggcgtccgggacacaggttccggcgaaaaacatgcaaatcgtcaactcgataccgcgtcaagagctgcgacaagctgagacctttcgctaggtgtgcttgcccatcaagactcgcacgctgcctgcacacgttcgcgccgtttccgcaactccttgaaatatcgagcctttcctctgcagtggtggatcagtttatgcgaaaaaaagtagcagatggagagatttcactttcaccaccgcccaattgtctcttccgacgagcgatatcttccctggctgctcctctctataccgcttcaggatggtccgccccctacccgaatataaggtaacagcgtcgatgtgcatgtgggaaccaagggaatggctgccgtctcttgacgccgctttaactcatctgtcacctttagagtctcagtttcgttccactacgttacctgggactacgaactaataacactttgaggtgaacggtgcggcagccgtgcttttgtgtttactgtacatgaaccagcgtactgcacccatcttccctcgcttcccagccgcctcaaaagtctacacacggctaggggtttgagtctcgacgcttaaatttgcgaccggcaggggatttacggtttgcatgtgcctgtggatgcaagctttagcaaggggcacatcacagcaacgagaaaacgtcccgaaaagcctccgtgtttcggcgcgcacccgccacgcgacctcgtttgaagggggcagggtgctctccgtatgaacacggtttgataaacactcgaagtttacagtcgaatggcgtgtagaatgtggagaaaaacagaggagggaactgaatggggcgaagttcgatctaattaatcctgcgaagtcatcagaagagaggaagttagttgcgaactgcgcatcgaattcggaggtactttctaaagtaattgacgggcctccagcgtatgtaggggacggcaaagggttttcaactgaagctcgctgaggtcactgaaacagaagcgactatcgaccgctctactaacagttttatgaaaacagggttgtgcggcagaacacaatatacgcggcgtgtacagaaaacaagagaggccgcttgcgcggggaatccgcgaagttttactttcgttcgaattccttgagcagcggcctcgagcgacacgctccagtcggacttcatgtccaaaatgaactggaagggacgttagacgggaagacttgtgcacgaacagaggcagggaaggtagaaagaacaaactcgcgttcaggtgaatatgggagaaacggatgatagacgaaaatcgtttcgagtctgaggcagagaaacgcccagcgttttggcatggtcgctctgcgcagtggggccatgcatgtcgtagagtctactcagagagtgatgcctctccacggtttgagaataatccatttgaaaaggggcttctttcccgtcagccgcactacagaaactctgcgcttgtgtgccgcatgcactataaatgtgggaaacaacaagctctacgcttgcagagtcgtactccagttctgttttgtgaagcaagttgctgctcgtgaaaaagacgtgtaagtttctgagaaacagcacgctgctgccagcatgacttcaactcttgaaaaaccggaaacaccaacgagaatcgaagtagccttgattatcctatgaagttgtactggcaggagttgctcttcacctcagggaacggagttttgatgcgatacttcgggtcgggaagtgcggagatccttctgctggctgcctcactttccctgtcgtgatctcaaaactacacgaccacccattctcgctgttttcctctcgatttcctcattctctcttctgtgtctgcgcattccacgtcagccgcactatacgcaactgagccaaggcggcatatttattgggaggaagcagcatacacacacacatatggaaggactgcatcggagcacgctgatttcgacgccaggtgctgtatttttctggtcagttattcaaacggcgtatcatgcgacaggtgcgagccacagaaactagtctgagatactcaggcagatagagtttctttctactatttatacgccgctaccactttgttagagcagcgaacttcacaaatagccaccagtaccggtagaacatacccgtgaaattcttattactccgcagaaggctcgatgtcagtgtagacagcaaagctccaggcaatccaccactgagttggccgattagaagacaaaaactggagtgaagaaattaaacactgcctatgaatctaccaaatggcttgcaagaacgcagcccgcgtatctcaagttcagagggtttctcccgttttgttcgaacgaggcatggccgcttcccaacggagatcttttaaggttgaacaatgtgtcttcatcgaacccgggactgtcactgattgctcagcagaatttcgatacatatatacatatctatatacatacatatattatattatttgtatctccacacatgcacgggcacatccttgcatcgttcccctttacaatttgcatgacaggtccagaactctacatcttgagctaaaaaggttccaatgtagacataaacttggaatttttgtttgaacgtgaaattagagatgtgagttggcttcgcacatattgttccgagcgaggcgaacacgctgtagcttggaaaccggtctggtagctgtgcatgcaccaactattttcttcagccgtttttcgcgtaccacgaggaagctgtcaggtattcgctttccacggaaagtctagttaagtcttggtgaaaaacggggtgtgcagtaaccgatgcgactttggcttttccggcagtcggaggggacggggaagcttcgtccgtgcgaatcaccttgtctctacttcgcaaaaagccctgtttttttttgcgcggctcgaggttctcggaagcgccttgcaattgaacaacagatgagaaattcaaaatgaggctaacgaattccgtctgaaggctttgtctcgcaaaatcagaaatcccctaatcgactgcaggttgtcagaagtgaaacgtacggactctcccaatgtctctcgacaagttcggtgcgttttttcactcttggcctttgcatggacaaacacacccttcaagaagtttgtttttcccagaagtcctttttctttgtctttgacgcttttgaagaaagttcaaagtccaaaatgcgtgttcttgtccacgtgtagagcgcacacatccacgaaacagtatgcccgtgcatgtcgggttcttgtgcgcattcgcggctttagaagctgtgttgttagagaccctttgctgctgacttttgtttttttagcttttcccaaccggtttttcaaaacgtcctccgctctggcatttcttcccgtatcccgagaacgtttcccttcaatcttgaagaactcgactcctgtcaaacacgatcgtgagtccttttcccaaatcgctttcttctaagctattgcccacttgttttcacttctacatccttcgtcggtgtctccacagcgaccgttttattcccttcttttccttctccctttcacctccctttgtcgatctctttatcagttccagga

SEQ ID NO: 1789 - DNA, 2199 bp, Toxoplasma gondii
cagacttcgaaggtggagaagaggcaggttcgactggagttgaagaagtgcgaggtggagcgggggaagtcgcggaagagtcatgtggagcgcctggagctgggagaactgaagcgcccgaatcgattcgcgacgcgggtgggtggggacatggaggctcgtccacccggtcgtctccgaacgtctgtttgtgctttctcagaaattcgagaagtctctcgcgctccgcaaactgctcttcgagttgcagttgccgcagctgcaaaagctcgcactcttcctgggaaacattcaagacgaaaatcagcttcggaaaagccaaacctccgacgagcagccctccaggtgtacgtacacacgaagtcgcatcgggggcagacgctcgcggcggctccgggcgctggaggcgccgcagcagaagcagaagaatgccatgtgcgtctacgcctcttgccaaaacagctaacgcatcttccttgaccaacttctccaccacttcttctttgtactcaagagagggaaacaaatgcgcctgtctccccaaacggctcgaagcagaaggagcagaggaggacgcggaaacagaagagaaagacgaggaaaacgaggaagacgaggaaaacgaggaagatgaagaaaaagaggaagaggaagaagaggaagaagaggaagaaaaagaggaagatgaggaggaagaagaggaggaagaagaggaagaggaacggctggaatcgatatccgaggctggctgctccatggaggcagcacgggaactgccttcttggcgagcgtccatggttgaaggaaaaagtcgccgagagacagatggaggggaagaagagcgtcgcgcaagtcagccgccatctgcgcgcatggacgagggaggaggcgaagacgtatggggggagtacatgcacagcatgtttgcgagagcgtttatctctcttgcgtcgccttctgcggggaacaagattgaaagccgcggttcccctccaccaactcgccttctgcatgcgcgcatggacgcgtgaggagttttccgcgtcgagaaggtcggatggatgttctgtgaagtctcgctctgaagtcgtggtatttttcctcgttgatgcagttctgccattgagatcgctgcgggtggagggccaaaccagaatggcgcattgttagtggtgccgggaagctggagaacgcatcacattttgggggagatactcacccttggagagtgtagagcgcagaagaacgcagacgctggctgcaaaggaacagtctagcgaagagaaggaagccatctcccccttgttttctgcttcggcgacacagccgtaaaaggctaacagaagagaagaagatccaaaagttccttcttcctccacacaacgtcagtcgccgcatctcactctgtgcagccacaacgcaccctatgtatccggtgagtctctctgcgttggtcttgcttctctctttgcctccccagttcccttccagaaggtgaaagagagaagacagagaaggaaggcgaaagcaacggaagcaagaaggaagcgtctgcgccgacttccgtgctttgccaggtgacccagagacctcagccatgccagtaaaagacgaagagaagcgtttttcgagtgcgcatgcatgcatgcaacacaaaaaactcgaaagaaactgctcgagtctgtcgctcttctctcttctctctcctctctttcttttctctcgggctccttccactttcgaacaaatacgttttattccttcgctttcttggcgtctccgggggaggccttcaccgacaaagctctccgcgttcctcaaagttcacagagcctcttgggtttcctctccaagaaagatctccgtcctgtctgggaggacttcacctctctattagacgcaactgtgagacagaaaaccgcagatgaagaacgaaataggaacatgcaagccaccaatgtaggcttctcttcccttcgtcgctggactctctcaatctcctctctctccttcctcttctctctctccgtcttctcgcttcttcatctctctccttcctcgtctccctctccgtcttctcgcttcttcatctctctccttcctcgtctccctctccgtcttcttgcttcttcatctctctccttcctcgtctctctctccttctctctcttctctccttcttctcttgtctttcaacga

SEQ ID NO: 1790 - DNA, 1560 bp, Toxoplasma gondii
gacatcagttgttcatttgccgtcggtgggttgtggaaacgttttcattttataaagcataaagtggctagttttgtgcgcacgggcattttgcatgatgatttattgcagcagcccgttgtccgtttccaaaaattatttcgaattaatgctcagtgcgtcaacgtcctgaaacgcaccagagagatgttgagtaaaactttagaaaagacgagggtgatcttcgtccgtggcacaatagtaggaaaaagcaccgctacagttgtacacaacaccagacggttctacagggcatcaaataatcgatatagcaggcctcgccgcatacgatgagactggtaaacgtttccagcagaagtgagatgtaccgcggtgttgaagtgagcaaccgtggggtgagcgagtgatcaattggagcaagaacaacgcatggtatatttagcagtgtgatcaattccgtgacacacgagctttctgggaaacatgcgacgccgatagtgataccttcagtatttaacatctgtacattccagtaacaggtgactgcatgtatccatgcattgcttgtgaatgcacatgtgtaggtcagtgtaggcgcgtggcaactcagcggaaaaatacccctataggcaagaagggcagcgcacgttgcacgggaaaggatggctgcatccggggctctatctagcactgatcctgttttcacttgaacgtcctctttcacgtcacaggccgatgtgaagcgggtgaggtgaagcaacatttcttgtccagtcatgctgagggagtaccggaaaacaaccgtcgcgaggtgttatatgaacccgaagcggggattttcagaagcttgaacgcaaacgccactgcttcgaggcatcatatttggtagcctgctctctggtggatcccatcacggcgtaaaagcctgcttcccgtagtcaccgcgaatggtacgggtaatccgcagatgaagaactacatgggaaacttagtgacctgaggcagaatgaagcgaacaaaagtatcgtgcaaaggggagtgatgtggtattgaacatagaaccaatcacgaaacacaaacccctttgggtgcctcattcgttccatatcctaaagcatttcgtgtgtacaagcggaatgtctaccgtgaacaacacggccacggctcagaatctggcaaaactaaaaaactgtgattttcgggaataggggaacccagcaccgacctacgacagggtccctttgctgacattgttctacagaaggaaaccatacatgcagaagaacgcaaaagtagagaggttggtaaaacagttttgccgaagaagttggcgacggagctcgtgaggcggcacaggcagacgagcattgatacccataggcattaaccgatcccagcggaggtcagaacgtccgcagctcattatatttttttccattctacctaaattttcttcgaaacgattggcatcattatctctatcaatagatcgtgacgtattaatcacttttcatttgtggacgttctgtaccggtggaattcgttctttatttcacacaa

SEQ ID NO: 1791 - DNA, 1081 bp, Toxoplasma gondii
gggcctctcagggtcgtaaacaggaacgaactgcggcattttcagaaaagaggatctccaggatctctgcgccgtcgaaaaaactggagcgccccggacgaaacaggaaggaaagagatcggtcctgctggccgagatctctctgtgctctcactcgggcctctcaaggcagaggcgctcgtgacgcaacgtaggagaagaaaaacagagcgagaggagcaaggcggagatcgcgcgatgtcagagggagagtgctgtgcaggggaacgccaggtacctttctttggagcagaaaatgcaccagagagcgacagaggagaagtggattcaagaaagaagcgagaactgacaaaggcgacaagagagaacaggagagatggagcactcaaggacaggaggcgaggagagagatcccccctacaggttcagaagaaaccaagctgagccgcaggacctcctgacatactgaaaaacaatcctacgtctcggttgcacatgtttgtctacagacacacacatatatatagatatatagacataaatattgtgtaaacatgcatatagatctatctatacgtatctttggagaacaaccagatctttatcgcctgccatactgcggtttggtcctctgtgacccacaacgcacaaggccgagtaaaagacagaggaagagaaacacattccgtttgcttggaaaaagtcagacagcgaccgggagagttgacgaagtctcccttctccgtggttgctctttctgcgtcgactcatgtctttgatctcccgcagtagagaggacgggagacgatggaggacgagagaacagaggtcgcgagataaaaagcgaagaccgaggcggccgcccagaggcgagaggaaaaagaagatactgtgaaagggatcgaaaagaaggacgaaacaggagaatcgacaaagctgtcggcgaggagaacgtgcagcagagtcactcaaagtcgaggtctctccagaaagagtcgttctttcttcctgatttttccggcgaagaaaccaaatggctttttaagcgctgtggagaagaagaggctcagagagaaagcga

SEQ ID NO: 1792 - DNA, 1403 bp, Toxoplasma gondii
cagactgcgtagatcaacatttggttagctgtagcatttcattttacagcatagtatttgatctgtgagacattacacgtcaacattcgtttgttttttggggggcggcgacacatttgagttgtgaatgactgccacttctcaaggaagggcccagaagtggaacaaaagtcgcggagtagcaacgcgtatcggttcagcgtattaggtataccgtcctaggcagagagacgaagaatgcatcatctgtgaaaggccaagctgagcagctccacgtccacggaggacagatgagcctcatgcattggtacgtattttaccacttgaagaccggagattggtttgacttaccagtgacaagaactaacagccttctgttacaaggacttcctgtctcaagtacacaacggtatttgggtagtagttacccgttctcagtagctgttgccaggtcacggtgctgggctgctacctgataggaagggtcttgcaagacgaatagacagcgctgacgcccgtgcaactgaatcagaattgggaccgcatgggacagccctttactcgatagcgccgctcgctaaaatcgaactagtggcatttcgccctcatcttgtccagctgcatttatagttcctgttcgcttgtttgcgtccactttaacaaagaaaataacgaacacactccaccacgtcggccaacaatgagaggcctccggcacgaactctattcgctagaactgaaacatcactgtgatgaagctgtcgcaacgaaagtgcctttcccggaaggaggatttcctcttttatcgaccagtttgccagtttgatggacgctcctgcctagaccgaaagatacctagtttcagacttgtcccctcggagccgcacccttcgtcgagcagtggcatccctgcacgatcctttagatgaagttcacgaattctcagccagacagcctttcctggatgtcttgtggaactgtggcatttcggcgctaccaaacatttgctattacctcccccagcgaggccgtttatatgccgaaaaggagacgtcgtatgactgactgtccgacagtattttcgcgtctttcggactgaaaaacccccttttttgtcaacgtggcagctgaaacaacggattttcataatagaaaaggcacacagaagatgcgagcactcatacgcttaccgagcggagactttcactggagatacacccgagcggttcttccgaagtatcactcaccggcttcgccggcggagtggccagctggagatccccatggatggttaacgaagggaaatgtctacagcctgaacccatttgacggcgtttctcagttacagaaaaaacgtttcatagatcaaccgttatctgtcttctgctgcaagcttgtcgcaa

SEQ ID NO: 1793 - DNA, 2245 bp, Toxoplasma gondii
gttgtctcgaggagccaacggctcacgtgaaaactggcgaccgaaaattccccagagccagccagagcgtggactctcgactggctcctggtgagtgaagaggggggaaagaatgaaacgaacggtgaccgtgttggccaccagcgcgcacacccacacgaggaggcacaagaagattcccaagggactgaatatcagccgcatggtggggacatcacttctgcttcccgcctctagggttcaccaggcaagccgcagctccgacgcatgtggcaaggggcagatcgtttgtaagcgagacagtacgctggttcaagggtcattttccctgacctgagcggagccagaaactgcattcgaagaaacgcttagaattccattcgcgaggagataacggtggagggaacgcacagcacctgacatgcctgttggttatatgctgctcaaaacgaaaacttcgttttgtgcgcctagcagcgggaacaggtcccttgaaggggtcggcagacacccgggggtacgctcatactttgaacagaagaattcattgaaagctttgtagaagaggtgagcaaatccttaaggtaacaaccggcatgaagcacaaaacgttcgaaatgaaggtgcgcggaagaccttgggaactgcgcccaaccccccttgtagctggccagtcacacggcccgccaggccctcatacaaagcccagcttcctgatgatttgacgagggacagcctaaatgcgaacttaatcacagacaacctcatagatggaaaacacttgactctaggctacttgctacgattcacccttaaccatgcacaagtgccgcccggggaaccacggacggttgacgcggttcacgagagtgcccaggaaaatcacggcggaaccccaaaataactgtagaaatcgcccgccgctttcggtatgccccgcgcatctgcttctgctgtttccgtaagaggtaatcgaaactaagccagctggttcccagaatggcgcaaggaccgcctcctgcatcgcagcttgtgctcttggggaaattggcaagttgcgcacgatgtcagtgcctacagaaactcttcgtgagccaacagcacgattctaatcttggggaacaaacacagactcaaccatattcgtcgacactggcacatgccacagtgcgaggccaactatcgtaaacttgcacgttacatcaacagatcaagtgtgcggctttgccgcggccggtctgttgtttgtcaggcactccgatttgtttgacacatagacattttgcgaacactctggacgtctgactttattttgctgcaatgcgtgtagcaagatttgaacgtgcctccagaattagtgggtcagctggcacgtaaaagtgtgccgtggccttgaaacgctgtctccgcgctgtcgaaaagccgacaaaaactcttgggggatcggagcggtaggccggcggcacaagccgcaatgcggtcctttatggaaaacagtaaccgaattctccgtgcacatagtaagtcacctagttgcttggctattctgtggacattcgtacttcgtttggttgtctagacgtggctcaaccacggtggcacagacgaaggcgcacagaaacgctcagccggaaaagccttctcaggcagagagcgtagtgccggtggtcccgtgaaaactacaaaggtcatgactcctatgtttcctgcaaatgtgtggtgtcaacattaacgccagtcctttgtctgacctgagcgagcgcctcgaccaacctctctaagctcctctccgccgtgatagtcatcgttgtgaaagcttgtcttcaccgacctacgaagctttgtgtctctgttcaagacactatgtcccgctgcatgccgttgttttgggtgtagcaggggaccgtcttccccagtcgctgtgtttcgtgttgcactgaatactgtctgcattcctgcgttacgttttcgttcacaacttgtgtcttccttcactggctgcacagcagagcaacttctgggtaggcgacacgcagagaaaagcaatctttgtttattcaggtgtttgtggttctgcaacgaatttcgtccgcgatggcttcttggcggtaacctgtcggccgcaggacctctctgctacggaaagaagtgtcttttttctacgggcgttactgggaacgagcaaggagggggaggagatagagcatctgatgctttctaagggctgtgagggtgttgagaaaaa

SEQ ID NO: 1794 - DNA, 2101 bp, Toxoplasma gondii
tcgtcctcaccgtttccatctcgccttcttcattctccggttgctcgcggtctgcgctctctgctggactcctctttcttcgttcgccgcttccttcttcgtcttccatcctctcgactgaagcgccacctctgctgctgtctccttcggagacaccaccgctttcgggcgcggcgtttgacggccccgccgaggcggtcgagagggcgcgggccgccagggcgaggggcgagaagggcgcggcgaccgtggagcccagagaggcgcggaaagccgacggggagcagagagcggcgcagaggtgctcatgagaagcagaagagaggcagagagacggcgaggaagaaaacctctgggtctgtctcgcgagacgcgctgctctctccagagaagagaaagacgaaaagcattcgcctcttcggcggacagcagacaggcgagtttggacgccacgcgcgccccgcgaaagagaagaagaagcacacgagagagacatggtgcgtgaggcggagagacaacgcgcggagcccgacagaagggacagctgtgcgacccggttcgtctttcgatagggagaaaaagaagagaactaaagcgggaggagaagaccacgcgtttcgccaccgctgcgttgggggcgacgtcagaagtcggagaatcgacggaacgcgcaattcgcttgccccaagggagggaggaaacgacttgattcgcctttgtcaaggtcgtggactgaggacgccgagagacggagacacgctggcgtcacgaggccgcaaatccgagaaaccagcttcttctcacagtcaaaatcgaggagacttttttcatctgcaaaagaaaagaagaaagaagaagcgcgcttctcttctttcgcccgaccgaggcagctgtgcagtcttgcgagagccccacaagtgcagaaaaaagagacgacttctctacacgtggaaaagaggatcgtccactgtggaaaactcggcgctcgcagaaaggaaagtctttctccttggctgcagcttcctgatgattcgcgcgccatgccgtggcttcacagggccagtgggggggcttcgagccgcgaatctacatgcacgctgcagagaaaaaatgcgcagcagaagcgacaacttcgcgggcgctctgaacgcttcacggtgtctcgcgagacagctgcgaggtcgaggcgctctccgggaactttttccgaaagcgtcctcgttttcctcccagtcctccgtgaagcactttccttggaaatgtccttttcattttcgaagtttcctccaattctctcgcaatttccccgtctttttgacccgccagtctcgaccggcgaccgccacagacgaacgccggcaaccgttgagacagcgcactcggtgagtctggcaagactcaaatcgctagcggtgttttccgctgtcgcatttctgtctcttctctctttttggcaagaagtgcctgtctcccttcgacaaaagcgcgagttcaacgccgcatttcttgaggcgtcgttccgtgctgtgcctgctgcgcagagatagacctgcctgtagacccgaaaccgcactgcgagctcgcgagcgcgctcgaccggcttttaccagtttttcgtctttgcttttctctggagcgcagctgctcctctccttccgcccgcgagtctgtctgtccatgtggaaggcgttgccacctgaggccagaagcagagacttccgcgctctcgctagagcagatgcaccgacggggaaatggcgcgtgtggctcgtgtgcaggaagctgtacgtacaccccaagtcttgcgacctaccggaccggcgagaaagggagacttgcagatggagatcgacgcgcttcgtgactagactcaacaggatttgtcggaagggactttcatcaccgatctttgtttctttgtcggtgcccagccgagctgccgccgtctctctaaggaacgttccagaagaggttcacagacgcgtttgagaacagacgttctccaacctagagtgtccagaccgtggtttctgtgcatgcatcaatcgtcgccgatcccaacctgctctccagtttgttttgtgcccgctttccttcccca

SEQ ID NO: 1795 - DNA, 3446 bp, Toxoplasma gondii
ggctgcgacacgcttccgagtcgacttctctagcgttttgtggtacacaaagtgctcatcaagtcgctgcgtgcgtgtgccgctcgcggcgaccctcgtcgcgacgaaagacgcgaaaaccgacggacgctctgacgccaaacaccggcgagacagagagaaaaacgaacgcagcgagtccgccgctgaggccggcggcgcggaagctgcgagtggcgggatgggaaggccgagaacggagcgcgacgcccggcctgcagaccgagaagcagagctacacagaggagaatagagggagaaaaagaacaggttggaagaaagggcggtcgtacggcgacagacgcggagaggaggaaccgccattgtggaaacacctgcaacggtgaaatcgacacggcctgcaggaaacacagcgaatggccgcggtgtctgtacgcttcagccgtcgcagctcaaccaggtagagttgtactgccggtagaccgggtggcaaacgtccgcgaaagcgaccaatgaatgggtacgggaacagcagctgaacagaggagcgtgctcgccggtcgcggagacgacaaagacacccgctggccaggcacacccttcagacggtgacggcaccgctgcttgcgcccgaactcgactgggatgcaacggcctcttctctgcgtgtctgcagtttatgtctttgcctttcgacgtctctcaggacaccttcgtaccgtctttgagtctgcttctccttcgcgtgaagcacaactgcagcaggcacagcacgggcaagccgacacagagaaaccagcaaactctagcaggacacctgcagcagggaacacgagaacccccgacgtcaatctcgatgcaaacagctgtctgtctgtcacacgaatgctctgcaatgtgcctttcaccgaccctttccgttctccgacagtttcccttctcgaggaccgagccgttacgtggacgttcaccgacagccgcacacagcttgcgcaaaaaaagggagacatcgtcaatttttggctgccttctcaggaacaggagaaaaagcatgtgtgtatgcagcgaccctcgacagaaacgggactgcgtagggctgccttcccagtcgcatctcagttttcaccgcgcttacatgtgcacatgccgacgcagaagaccgaggaaagaaaaatgaagatgctgccgcggggcaggaaccccttccctttcatctttttccggcgctaactcgaagacttgtcctcacgcaactggtgtaactgcttttgtctttccttttgagtcacgggaacgagacggggtccttagtcaggggagggcggcgcggccggcgcagcgacagagaaagaactcgaaacagtggagacgcggggtcggcatctcgaacgctggccataaacgacgaaggaaatctatgctttgaaaccgctgaagcggggaagtagcggcgcagtttaacaacgaaaggcgaggcttcgctcggttaaactcgctctgtgtatcgccccctcgctggaatctgacaggcgacttctctcgcgcagaggcacctcgtgtcaaccgtatggtgtggcgggaagaaaaaagtccccgaagctccagcgatttgctcttagcagccaaagttcactttagttactggagttcttcttttatttcgtttttagggggattcctctcgtttaaataggtagcctttctccccgggggtatcgggtttcgatcaggcatccctctgtctccggacggatacccggcctgtgtgcccctcctttgttaaaacttgtcggagtcaaagtgcacgagtccacgacttggaaactgactttcacatttgctgccccaggtcgcctcccacggatagtggctttttcttctagatcaccagtacaacaggaattccctgtttcgtgcacagacaaggcagctacagctgtatgtatcacgccatagctatgatggatgtcccctggcacaagaaggcaagtagctacaaaccgtacaaagtctagctacgtacatttgtgcaactaatatggtaggcggttgtacatgttagatgccaatttaccggctaaacgtcccctgcataacttacgcctgttccttccgcggggtttaggaagggatcactccaaagtagcaacagtgctcattaggtaaggtatatgtcttcttacaaggctcagacatccgactgtgacacctctacggggtaacctttggcttttcgaacccgtgtgccggcacaggcatcagggattctgaggtttgggagtgtattacttccgaatcgggtaagttcattattgttgcgtaggtttttgtttagattccccgccgactttggactgtctttcctttccttctctgaggagcagttccacctgggtagctccgaatttatagtcacgtgacgatgttgacacctctaggagagtgtgttttttagcagttctcgcactgtcagtcgttgcttttgctttgccgccggagcgagatgcacgatcacccgcttattgtttatcgttccacgcttgcaaaaaagatggacagtccgcgtcccgcgtggtcccatcttgcgtcttaagggaaaaaaagacgaaacataaatgttgactaatcagcctgaagttaagccgcaattaaagcgtcctaacgaagcccgtccaaatatggtcttgtctgtttgaaaaaatatcaccttgcaggcattttggtatgttgctcgcttggctctgaaagcgtccacggggaactaaatggtgaaaaaattctgggtaagccgtctttgccgcctcactgttcctaactcacgctcagtccgcctttgaataccaggtattctcccggcggttgcacactcctcaagcctgcttgtttttagaaatgcgttcccgctctcatctgtttcaacgcagagaaacggaacattttttccactcggcacttcgccacgtccacatatcgagcagcgcgacaaaccatcgagcagagaggactagcgggacggcgcggctggacgagatcaaacaggatgtgctgacccctatttttttaaccgcgaaccgtagtcactgatgcagatactctgccacgtccgtaattcaccatatgctccaactgagcgctgcccgttattgtcggcggctcattctctgtgaagaacggccccacccgatcaggaccgcgtcatgtttttgcctatcttcgagaaatgattccgtcatcagcgagtaatgccgtcaaacatgaaccccactattttcagtggctaagctgtcgcggctagtcttgttccagagcaggatattatgttcttctgtcggaagcctgtgtctttatttggcgggcacatcggattctgtgcactgaaatagaacgcatcccatttttgactagtctgctattttgtgatgtccctaatgcacaattttccaaga

SEQ ID NO: 1796 - DNA, 2655 bp, Toxoplasma gondii
cttggcttccgcgtttctccttcgctaacgcatcatcacgcatgcagctggccggcgggcgtccacctgcgaaaggaaagggagagaagcgcagaagcaggcgaaggggaggcgaagcagcagacaagagacaacagccttcactaggaaaccgaccagagagaggtgtctcctccagaacgcgcaatgcatgcgccgcgtaggctcttcggcgacggggtaggacgctgccgcatgcaccgagagtgctgacatgcgccgccgcgagacgcatcctctgaaggcagagaaaacgcaggaggcgccagagagaaagggcttctccgctgcggaggcatgtcctgcagcgcgcccgctggagcggagagaggaaagtggagggtctgctcttcaagagggtggaggggaagctctgtagaggccgaggcgactcagggtgcccaggtaggctggggaatcgagtctcgcttcctggagacggaggcggtgctgcggagagtcgtcgaacagccggggaaggcgccactgcgatgcagcccagaaaggacgcagagagaaggacagacagcaggcgctgtggggagagaaagagaagacgaccttccaaaggtcgcgggaggagaacctgacagaacgcttccctcgcaccgttgacgctgtgcggagcaacatgtagatgcagacgaaaaggaagcagaaggcagcagagcagcagaacgagaggaggcagattgagaggaacaaggacgagagaaaagaaggaagcgacgcaggagcgtggcggtgagtgagagcgcgaaaggagagaggagagaagaaggaagagtcgacagacgagagcggactggacgcacttgagagcgcgcgtaagatggggagaacatgcgcgtcaacgagcaggttgaagatgacagagatgagtgactgcacgagagagagagagagagagagagagagagagaagaagaagatccgctcgaggggctttgtggggggaggccggccgagagagattgaagaaaacgaagagaaaaaggctcaacgtgaacactgaaccgccactcagaaaccgcgccgcctccagccatgcccgtcaacgcgcaaagaggctcgacgcagagaagaaagaaggccaggtccagaaggcaacgcagaggaacacaaaggagaacacagcgagagaagaacaagacgaagaaaatgagcagagagagagagagaggaggctcggcgggagaggaaaaggaagaggcagctaggacagagagagaaagacagagaggaagggagaaggatggcgagcaagaggaaaggcgaaggagatagaacggatagaaagcgaagagagcgtcaaagcgaggaggaaggtccagtgacaaagaagaagagggaagtggagacgatcctgtcggagagggcgaagctgaagaagtcgagcagagaggaggctatgaaacgagcgttgtgcaaggaagagaagaagtttctttccagagacaagggccgtggggtcaaagacctcaagctagcgatttcacttgcctcacgacagacttcggcaaaaagcaggaaccgactgcaacccagaagacctgcgcgttcgctctgaaaagaagttggtgcttctctcagaaactttggacttttctaacggacaacgcattcttctgacttaagctcccagcgcgagaggtgacagaaaaagagaggcgagagagagtcgaggttccttttctcgctgatgcctcttgcggttgaagtcatttctgctcgcggaagaccggccgcaaaggaggagattttctcgttttttatacgaacgaaagttgttccttctcccttctagactagcgcgaaacagtgccgagtgaccctcaaccttttgccgacaagcggatgcgcgtatacagacgaactgcggcgcggtgtgcagcagccccagggagatggaaaagcatgcgccgtttgagtttcttttcgttgtttacgtttgatttataaaagaggatcttctgttgcttttgatcagccgtttggcgttcgattcgtttcttctctttccgtcgatttccgacctcgaaccagcgggaactggatctctctggggggtgtcctcgcttgtctccattccagactccatcgcgaaggatcgcaagaccagggaccgaggctttccttatattcctcactgctgaggacttcgttgtccttttctctggcgaaccgttcttttctctccccgatttcacctgcaaacgaaaaacatctagagcacacactgttgtaactcttctctctcgattcctctctccatcatcttcttctctccttctccttcaccttcaactttcttctcttcttctcttcttctcttcttctttcttcttctcgtccatcctctaatttttctcctccatcgtctcctttcgtcttctccccgtcttctcttctcccatcttgtctcctccttttctccgtcataccgtttttctctttttttctccgttctttcttaacgaagaagaaggtctctcccttggaggcacggttgtcgaaacggacctcgagacgctttcttcgtttctctccttgcggctccattctttcctctctctgctttttccttctcctccgaggtcacaaagaattcaaaga

SEQ ID NO: 1797 - DNA, 1680 bp, Toxoplasma gondii
gctttacttctgaagacacaccaacatcgagacagacatatacgcagacagacagataaatggacaggcaagcatgtatgcacacaccgacacaagcatgtccatctacacagctacatacatacatacatataaatatatatatatatatggagacgtataagtcgagctacctacgtggatgcgcgaagcgtttgcacgcacatggatgcaaacgtgtccatatatatatatatataaagatagatagatagctgtctacgtcaaggtttctgcatgcgaagatcgctcgtttttttttctgtgagtctctggaacttacgggaggaggaggtcaatgtcatgagggtctaagagatctgtggcgccgcagttcatgaggagggaaaatcttccgaggcgcagaatcgcggcgtggaagccgccagagcctctgccgcccacgtagaggggctccactgcaactctgaccatcgcggagcgccgagaaaagacgagaaagaaagaagggagaaggtgtgtacatgggagagaagatagcacaggaagtagagaaggtgggggagcagaagaggaagaaacagacgcggcaagagaaagcggccgttgaagatgaaaagcagacaaggaaaagcagaccgtctctctaggcacgctgtgcctccttcccaggaagagagagacacaattgcctacgagaggatcccggaggaagtcgacttctccgcggttctcgcgtctgtcctctccccgtcttcttcgtagagaaaggcgcgaaagagcgccacctgctgtcggagtgtatctgctattgtttcattttagagaagagagcgaagcaagcgcgagccacaaaaaaaacgttgcttccgcgccgtgcggctctcccttccccacgaagaaaggaaggtgagaaggctgtctctcccctgaaacgaagcgctgctctcgtttcttgttttctgtcgctttcaaacgcagaagcgacaggaaagtctgccacaggcagtttccagtttgttgcctgggaacctccgggcgcatgcagaaaactgagaaaagattctcggggcaatgtcgcgcgccctccacagtcacgcgtcgagaattgaaaaatgggacaagacaactggaacgaaatccgagaactccgcttcctcgttggtggccagtcttcttgaacacgaacctttcctcctgcaaaaagaaggccgatccagcgccgattttcgtacatacagacgctccggacaaagccccgcgagtcgactcagcagaagggggtatgcacacggtcttgtacttgtctcttttctcttcctgctctcctctcggttcccttttttcttctttgctcgaggggaaagcatgcgacggagcgggcgacgaaacgcagtatcagcttcgcgctgtggcttgagttccttgcctctcccgacggcttgtcggaccggctcgctcgtgacggcgtgtatgcatccctctcactgaagcggcgcttgaaccggagactttgcttgcaccgaaactgagtggagagaaagaggcgaaccggtgccctctcctcagtctccgttgcactctgtctccgcttggttctcttcttctcacgcttctcttcgacctgaaggagagaagaggcagaagagagacgttcagctcctctgcttttacgccgca

SEQ ID NO: 1798 - DNA, 1753 bp, Toxoplasma gondii
tctttgtaagtacaggaagaccctcgtctgtttgtgtgttgactcttgctggcaccttcatgtacttccctccatcgaaacgaaagcgttggttatgcacaagtctgtctcttcacctgaacacaacttctcgatttcgtgttccatttgaacataagttccctagttcaccgtttatcagcagacactttgtttcctgtccagagtctttagtgccacgtatccacgagtcactggtcgattcaaacgactctttctttttgtgcaagaactgggtgcgtgttcgtagaacagcaatatcgatgtattgcccataaaggtgggcggttcatttactaaaaatgtctgtaggcttgaacagaatctgttttcgaattctcctatgctcctaatatcggtgagatctctgtggaaaataccgactacgcgttgagacgtgtgaaaacatctcccaccccaagcatcttgcttcagcgttgcgtcttggaactgagagggtttgatcttgacacgacagctagcttttccgtttgtgtctcgcccggcgactctcgaaaaaacgtactttcacggctccgaaagaaacctagtctttcctacagttcgtacacctcatcaaaggcgcctttctttctcaatcactcaccccataatcttctaaaggaaatgtctttgctcgttctcgaaccacacgtatggtgtcaccaccgtggtggatatgccgcggaggtgatcgtcagaaaaggcagcgtttttcttcgaacaagcagaatatggaactctacaacccttcaacgagtccaccaggttgtctgttttcctagaccggacgcaagctctgtttcctttttacggctcggatgcggagtgacgctcatgcatagtccatcggcgaacttcgcagccacaaaacacagcaacaagactttttcacggacttccgggcttcctcgctcagtagcttcgtctccttttgttggcagcgagaaacgccgaaaataaacgaaatctcttccttgaagaggtgagaggagtctgggctcctacgaagagctggaaaactcgcgaaaatggcatgcatgcgcgcatgcatgccattttcgcgagtggcaccgaggaccctcggctgtagattttctgtcgcaaacttgagtctgctgctccggaagaaggcgactttgtatcgaaacgaaacaaagtctcatctggtgttcatgtagttgtttttttccaggaggcatgatgtcggaaatgccacttttcccagtgcgcctctcgcagcgtccacacgcttttcgcacatgcgcttttcctgaatgaatcgaagatttctccagtcgataaagaaaacaactcctgatttaccacagattgtttccctgtcaaccccgagcaacgcaaaaaggagaagaaaacggagcggttcttgcttcctttcccctctaaattcctctccaaatgaccatatgcacaacagcttcaaaatccaaaacgactcgaaatccgtacacctaaaatatatacatgtatatagatagatatagataagtataaagacagaaacatatggatatagctgtatatatatgaacttgaacgaatttatttaccaatgtccacgtctataaacgtctgcatctgtccctatatagctgtgtgtgagcgtgtgagtcggtttttgccgcaaagatgaatatacagctgcatgtgaatgaggctaggaacgcaacggtgattctgtcttttttctaga

SEQ ID NO: 1799 - DNA, 3005 bp, Toxoplasma gondii
caggttgccggtacacagtggtgtatgaggtgtaccattgtttctggcagccccaaccagcacgcgggtgtatgatgaggcccgcacattttttcgcttggaattgtcctttcgcgcagcccttcgcgtttttcctcttcgtgtggaggggattctcgtcatagcccgaagaacagaaatgcaggactgctagggatacttgattctggtcttttcttcccttcaaaaggactctcgaaaaaaatccatatcctgcgcagtcggcaacgccgtctcaccccagcactcagtctagtagacacactcgcatccatgctgccagcttgaagcggaagttgcaactgcggcgcagtgcccttgaacgccagattcacctttttttacgagaagagttttgtgagcgcaaggctgagccacaaagggcggtgcacaaaagaatgataaagggattcttttagatgaatgcacctccatatattctaccgcacaccgtgaatctgctggtgattagtgtaggcaaaattaacatcccggatcgcgattgttttgccgtatgtacgcagcattccagaaacgctgaatgtgcaaaggaaatggtcatgcaggccaatcatctctagaggccctgccgcactcttcagtggtaaggcagtggtactcacctgtcgcctccacatgaacataatgtctagtatcgaggggtcaaaagccccacccttcccgcaccagactggaggaagtctagtcgccgtaggctggcggcgaaggaccctgctacgcgccgtggtgtccacagttttgcaatcggaggccgtaagcaggcatgagtccacaccatgacaaaaggtcagatcgttgaatgttttttccattcacgctgacgtgctttcgaagtcatcagagcctcacactccacagctttctgtcttgagaacgttttgcagagccccgctttcataaaaacaaggccatgcattcggtcaggggtttagcgtgccagagggttttggcaacgcggaacagttttaatcgcaggcggattcacagttgaaaaggggtttctagatagtaaacaggttcacaggacagcatcttgacacggtgatttatctgcagtcaatcgaggacacctgctgatggcgtcttgcgatacgttttgaaacaggcttcagactcaactgctgtccgtgtgatagcgagtacccgcatatttttccctcctcctgtacgcgtaacggactgcacatcgatttagccgaaattggtgcaccaagaagaacgttagttcatttcttaggttgtccgcgtttatcatcaacactcagtaccaccgccgtgtctacggaacggcggacgcaggtgaatctggtgtcccggtgataagactaatccatatataacgccttgagcatattacacgacatattagaaaacagtccttaaacggacgtagctgttgtcgattgaccgacacttttgtaaacgtgtagaataatgggtaagcgcgtttttctgttatgcgaacgggtcaacttttagactgtatcctcaagacttgaccctgcgttttgtccccctctttgtttcttcagaccagaaacacagagcctttagtctgcatctccccactccgtacctcagtctgatttctttttcaggtgcctaggtagagttggatgctgttagtcaaaaatcagacacctatctcgacgattcgatgcctttctgcgatagaaggttgtgtctcgtcaattcctcgtcctatgcatctaatagaaagagcaacagcagttccattccctttgtgtttttgcgctcggtctggccccgaatgttcccagtcccgggtgaccaactggactcggaaaacatgcagcatgctactcgactgtgcaaacgcttattctttcttcaagctgggctaccggagtccacaagagtcgtggtattcctgaatgtttctgtttttcgtatgccagcaaggaatttgcagtgctctgtgtgcccgtggcgaccgggacgagttggttgggcaacggagtgtgtgcagaggaatgcgacactcacggggaaattttagaccagttcggaacagccaccgtgcccttttccccgctttccccttctcacggaaatacccgaaacctgccgaacgccggtgctcgaatatcacttctcgtgtcgctaagccacacttcgacgtttcgcagtccactaccctcttgacggaaatggtttgcacagcgtagaaaaaaaaaggaaacgtcacgcaagaagcgcttgcactggccgcaaagagtttttaaagggcaaactcggggaatcgctcgaggcgactgcaccgggcgcccacgcgccacgtcccgagaggccgccagttctggctggcagaaattcaagttggctgtgtacattcacgatcgattcaggccagcgatattgccctgccacgcaggtccacccctcagctggctgtcgacagaggctgcgaacgcgccggagagtggtgagatttcctttcagcgaattttgtgatctcaagagcgagaggcacaactgtatttgagaacttttgctttttcagcgttgcacgagttttaaatctcggtgtgactgttcgaaaccctgtcatttccctccgagaagatcggtcgacggcgcgcggacaaccgcgtgcgtaaaaggtgtttgctatttcgccggggagaaaagcggccgtaaagtcggaagacttgccagacgagacgagaaactgggtgcggcacggcatttcatcattctgtatgtgttgttttccattcgaagaaagttttgtttctcgcggcagagggaaaggcgcgcaccgaacctgcccgcagtttccggtacatccacgcacacacttcggtggctgaaacgccgcgattgttccgttcttgtgttcgcgacttcgactctctgaatcgctcccccacacatcttttgttgtcgccccctcaactttttcgcactttttcgattcgaaa

SEQ ID NO: 1800 - DNA, 2375 bp, Toxoplasma gondii
gacagccgagacagggaaagaatgcagaatggttccacaaggacaggggacggtcggcaaagaccaccgccgcgttagtcgcagttccaggacccgttttttggacacgcatcagctatcagccgcagtctgaatgtccggagtgctttcagaaggcaaaaaaacaaacgagcatgtgttctggtttccgagttggtctacatgtcgagaagccatagtaacaccacggcacgagaactgattatgacacacagagcccttaacccttgaaatcgttcggtcgcccgaagcgtttcagccttttccatctcactcgcgaaagactagaggtcttcgcacattcaaaacttccactgaagtacacattaccagcttccttattcgtctacttcgttcttactgcagcttatccctcataactacgtcgcacagaggcagacgaaacgcgaatatcagcctctgctcatgctttttttccacggacgatagctagaatacagtgttagctacaccgaaaaacacccccccaggaaatgtctgacccttcaggcttatcagatttcaaacgctcttggattcagaggcagccctctcgcgtctaccttcttctgtccaccccctctcgaggtcgctgactggggttcgaggaagccgtggccggagcgccctgcccgttctgaggcgcggctccgccagagtcgcctcccatgagacttgccatgacgagaacacacaaaatcagccaccagttccgtctccagaacgacggctgttcatcctccttctcgccttggcctccttggatcggagcgcccgcggcgccggcccggtgctggctctcgccgggaaagtagacggggacgatgagcgcctctttgccagcttttgccggcggcaaaaccacttgcagcgcaggcgctctaccggtagacagctccctgttctgccccgctgcagtcggagtcacctccggacacgtgagcacgatgcggtcggaaaccgccttctcgtcggagcctcgatctacactccgggcaggttcacttgtcgcagatacctggtcgctcgtgctttctgggaggcgtcgaatcgaagcagagaagggaacgagggaaggcgagacgtggagagaaagcaggaacggggtctcagtgcgacagactgctgacggcgacccgggcctgtcagcgttcactaggaaggaaacaggggcggatacttcgagagctggaatgagcctattttgttggtttttttcttcctgcgtcacgacgggttccagccgtagagacagcaaaggaaacatgttccagggcagcgtttctgtcccgccactctgctgctcgcgggtagccgcctccaaagccgacgaaagcacgctgccggaaaaggaaatccagttcgctcgaaccgcgcgtgtcggaccttcagcaaatgctggtgcagaagcgctgccagagaaatggctcttcgcgttcagtgctggggactccgctggacggctgtattcccggatcgcgaggcgtcccagcggcttcccctcgagttgtgtgccggcccctagccccgagagaacggagagctttacatcatatacgagggcagatgatgccgaacagcacaggaaaacgtaaacgccaagggtggcccagaggaagaagaacctcacacagtcatgggctgcatgcccgcgtagagagaatggagcggacaccatcctggcgctgctgcctgcgagaggaaggtcacaccttcctcgacaggggaattgcgctctctcgctggaagggaacagaaaaaaggaggaagacaccttgagataccctgaatgaggagcctcagccaaaacctgatgcggcgtggagtgcaggcgccgctggcaaggacgctggggtaacacacgctacaagctcgttcgctgcacaccagctttcagggagccccacaagtgccatggacgaaacacaaaaccgatagttgagatttttccctcgtgtggtaactttaaagtgtccatgaggcgccagcattcttaatcgcgtgatttgcgaccgcatgcacagaggtagcgactcagacagggggtagcggttggcactgagcggccacagaagtgtacacaccgtttagttagagtccgctgaccccttcacaattgaagatgttctgctgtggatagaagaggacaagaataacaaggctgatgttgaagaggatcttcttcactcgtgaattgataactgtgtggatgctttgcagcctactagctgcaagcttgccgcgctggccttattggtgacgcagacgaaaagcgggcccatgtctgcacaggcgtcctgtcgagatctcaggaggaagtagtcgcgctctgttaa

SEQ ID NO: 1801 - DNA, 2985 bp, Toxoplasma gondii
ctctccttgcccggaaaaccaaagcgatgaaggtcttttcaagcgtcaaggtgtgcctttgtcgttcttcatctccgccttcgtggcgtccccagcctcgctcctgccgttgcctcgagcctggcgagagctgaagtgtgcagccgagcttttccagggctcggcggagatagctggcctcggaaacggttgctgtgggctcccgagatatgggagcaatggccgaggctcctggcacaacgcggaaggccacaacgttggaggcagtcgcgagaagagacaggacggggcgctggacacgctggattccgggggaagcaaaccgaacggcgaggcagaggcgggaagcgaaagaagcgagaattcgagcagccattctggaaagaagagcagtgaaagaggcgaagagagccttccaaagatcgggagcgatcagcctagggcaggcgagaaacggccgcggctggcgagtaggccgacgcttgggttttccgatgcctttctcagttgtccgtgctgtggagacacatccaactatcctcttcatgtcgcggctcgcatgtccggttcgaaaaacgacgcagagcggacgaggcggcttctcgcccaggcgcggggggggaacgtcgtggacgcgcctctacctctttcctgttcttcgagttctgcctcagagtccttagagatgctcgcgagactcgcagccctgcgagcacagcgaggcgaagagaagagagtgaaaggcggccgcctcgagcttctctcttcctggcttcaagacgacgaaaggagactcacccttgctaggtcaagcgcggcggttgagaatgcacgcgaagggagagaaacagccaattctgggagggacggcgacggcagcgacgaacaggcaagtagtcgtgttcaggccgggccgctgcatctcctgctccaggctgtcgactccatgacccgtgagatgttgctcgcttgaaggaagcctcagggcactttagaattcgatattgggaatcaatgctctgcaaaacaacatgtcaggtttccttttgtgcgactaccaggacacgttttgtttgtgtgattcgtacaggaggcgagggggctgtggtttagcacgcgagaatgagactctttgcgttcatcgcgcctgcacgttgcttgtgtttccctgtgtctttcctcgttctcgattctctgcgcttgtaactgtcttgttcttctctggggttttttccctgtgatctcaatcgcggctttcgcgacgcagcggaggaattcaaaagaggggtttgaacgtggtgtggttctgtcaagtttttctgcgcgttcactcctctttctttgtcggtggttcttctgtaactttctcgtcctttgcgtatcatcggcgaccgtgtatcactttgctgactctgtgtcgctggaattcgcggctgtattgtatgtgcactgacagcgttatgtttgtgttgtgtgcgaagtagcaaaccgaagtgtgtcgctgtttcttcagtattattatggtagaatctgacccttttatgaagtcggtgccattttctcctgagacaacacagagctccgtactgccacatttctcccagttacattttttccgaaagcctgtctcggcacacgtgaacgaatctagtcaccagcctcaggacagtcaaggcatcacaaccttacatgcttaactcctcgacgtaacctaagtgcgttctgatcggtaatcaggatttctattgtagagcgtatgtcacagctattgacacccggtgggtctcatttgtgcatttcgtttgcaaaatcatgtaggatttgtctccgcttaattcagaaagatatttcggccattatgacacacatccttccaggactcccgcagctttacccatccttcccccgcaaaaaggtgttaccggtggaaacccggcttacggcgggattagccaaaacgccacgatcgagaagtgttttttctatggcacgcgacgaacccagttcggttgaaccacagacgctcctctggcgcctctgcggctcttccagtttccacttttcttttagcatcatgcagttaccacacagaaattgcgtcaacgactgtctcacttcgttttgtgtatcgacgaaatcggtgctttaaatatgatacatggtacagtgtgctacagctggggggaccactgatagagcaatgctattctaatgaatcgcggagtgcccgaactataacccgttgttcaacgtggtagagacttcggttaagtggctgcgagcgtgggtgttagtccctccgatccactggagtcccctaacgaagacaaggcctcttccgcgttcgttaaaatcggttcctggccattcccggtggtgattcactaacagtgcaaatcttacattcgacttcctaaatcgcagtgacactctggtgagaaacaaggatcacgacaaaccagcaagcgttcttgtagaatggtccttcttagttcacgacagcggaacctgctacaggggaaggggagaagttgctgccgcctgggcaacgataatgggagtctagctagttacgcttccccgtcgcacactggcgctgatccccacaatgcattggctgtttgaacaaccagagacgctgacgcgcagcgagagattctaaagtctcgatgctgtccgcagggagctgtgtattggcaaatgagcaacgtatgtctgcgaggccacaattatggccacggttattcataccatgcagttcgtagcgatggtgttcgacgcgccatggttacgaacgcactaaagactccattccattcagtaaatccgaggcaaattttggcgtttcttgtcgctgagacccccaagcgatattttgtgtagttcgtgaatgttgatggcccctgaatgtttaccatgcctcgcagataaagtaagtttagggagatgcaggtctttctgcgcaacaccgggtcgtaggtacga

SEQ ID NO: 1802 - DNA, 2971 bp, Toxoplasma gondii
tcgtgtccaagagtgacaaggatttcctcgagagcgatttcttccttcagaccttcttcgttgcctacccctgcctccacgtctcggtcttgacccgcttgatcaccccctccgcaggcgccaaacacgagggccgcagagagggcgactgctagctggcgcacgacggcttttggcgctcgtctgcacgagaagagaagctgcaaaaggccctctctgagttccttgaagacagtcgaagcggctgaactgtgtcgctccctcgcgccgcccaaggagtctcccccccgcttcttctccagcaccagagacagctgctgagggaagcctgcgcgagcttgcgccgcgagagtctgcgcggcaaaatagaggacgcactcgtcgcctgtgtctacagatgaagactgcgacgagcgagcgaagtggttcaagaaggaaatacagatcggccaggccgacgcatgctgctggaagtcgacaaggaactcgtttgcctgtgcaggggtgactccacacccagacggcgagtagaaagccgcaatcatctcacggacattctgctctgtgtacgaaggtgggagagaagaaggatacgaagggccaggagtcgggggagcccccggctcgacactggaagaatgcatcttgaagatgagaagaggaactggaaaagaaaaacggggagagatagcacccagggaagaaatggaggtgacggaaacggggaggcgggcggtgaaagaaggaagacgagagtggagcgaggaacacaagggacaaagacgtagagttgaggcacgagcacaagcaaggtgaaaaggattcgagaggcatgagagactccacgaagagggaggaactgcgccgacctcaaggacggaaaaggtctcttaccctctgtccatcttcacgttaacctgaactatctatatttgtcggaagcagatactttacccctgcgttcgccattcccagaatcatttctctggtgctgctgctcgtgagaactcccgtcttcggcttccagcatcgatgttttcgcggttggtccgcccccagtcaacactcccgcgaacggtgcaggaagaaggggcaacgcaagagggaggaatagaaaacaacaagtgaaacgaaaaaatgacgcgaaggcaatggcgacaaaactatggtagggaaaaccgtcgaagactgtgtctgtgaacaattgcttctcaccggaggtacgcgatatcgggagcatatctacctcccaatcaattacaaaacaactcggcaggcgaaggcacatgaacgtgtgttggggcagatgagcaaattcatgcagcgatacagtgtgtagaaacacagggaaaacataatgctcgtccgcttccgcgctatgtggcctgtcggttgcacgaaagcggaaaatttctggcatgtgcgcgagtgatcacatggggtgtgaatgggaaacctttgaaaagacctgataaacgacgcgccggtcaagccagcaaacacgggccatccgctaaaacgcaaaaggagctgtgaaaagcaggtggaaacaagaaagaggaaaccgtgaggcatgtgcgagaacagcgggctcacgcgtcgaggagggaggtaaacagcacctctccctggtcttcacactgccgatcgtagcagctgcttttaggcatccgtgccccgcgtacaaagtggactttcttcatctgttcgtccatgcttccggaaaaacgaatgggcttcagtgctcagataactggcttgaatctgcaagatctctcagtttctcagattatgtcgggcacagtgttgtcgcctgtctggccgacggctgtggctggtgcctattcggcgcgactctcacgcgtgttctcacagacgccacggcgcatgctgccccatgacaacgcagcacacattccgataacggaaaagaaaacctagctggaaaaagaatctgctttttgacgccagctctcctcggttttcacgacctgaagcagtaacgcaggaacggtctctaaaaggaatccatattcgttttcgccctatactgcaccgccgtacacgtcgtctctggccttgactgcgctggcttccttacttccggtgcagacacacaaccatagcattggcggagcccacggaactgtttggtacagccgccgaattgaatgtccagcataaaagtatgataatggcttctatgttagttcgctttgcttcgatggatcagatggagttgcaaggctcctgggagttccgcatttggtagtgtcacagcgacttttcgagagcacgtctgatcagctctcttgacggccccttccaaggctgaagcaactccaccgccggacgatgagcgactgtggactccttttattcgtatgaaattttgccctagtaattttttctccatttcgggctcatccattggcgcgccacaacgccctcagtcttgcaccggcggtaccttgcctgtacatacacctggcactgcccagaatcactgctaacggaccttcagaactgctgcaatcgaactttaccttcaatcaggaattttcaattttcgcacttgttcccgcagccgtgcataagtgactgaattctcttcggaagtccccgccctccgtcattccgtaggaaccacttctccatcttgtgaggcagtattcgtggcaaaagactccgccgactgcctctgccagcacaaacatgcttaggtaaattacggatccgtagcatcatagaaatgtaggttggcgtcaccatcattggctcagttccttgagcttcagtgcgttttctggatggtctgaacaaaaacccatttgtcgctaccgaaacggatccaccaagagaaaacggcatgtctacatgagaaccaaccgagtccgacttctgacttctgaattttaacatcaacctcgtactagggaagaaagtgtcttttccgcgaccctcgcagcca

SEQ ID NO: 1803 - DNA, 4211 bp, Toxoplasma gondii
gaatatagccagcattgctagggcaggttgttggtaggtgaaactcaaacagttccttctgtgtcggaagcagttgcaaacaagcggcccatttgtgtgcctgaaaaatcgtgactggcagtctgttgttgttcgccgcaacgaaacaggcgaagcatgtttgcgatcccagaggaatttactaagtcacagcatgactataatgttaccgtcttccaacagaaatggaaaatgacaggtggcagagtctcccactttattgtctggtttttgtgacacgcttcctgtctactgatgaaatcaagcaacgctctccgcccccatccgcctcctcgtcaccaggcaatgtgtctcaacgcatccgaaaaagagaatgaattttcatcacagtatctagtgttgaagcacaacagacgctctccccgttccgccacctaattacagtctagtgttcttccgacgaagaacatcatgatgagggaaaagttccgttttaaaccactcctttccctccaggagtcaacaagactagcgcaggagattgtacgtaacaacgaagcggtattgcattgagcttctgcagctaaatcattcctcaacaagggcagctctggaagcaatgaagcaagaaatgggaccttcacaaaagctgcagaaagcaggcgaaagccttgtttaaacccgaggaccgctgatagccagaaattggttatgcctccaggcccttacgattctggtgagccaatacgtagacttcattttctccagcattcctggctccaaagcgcgccgagtttctctgcaggaccacgtagggtctgccatctgaagaaaatggacgacgcttcgacgccaccaggacttttccccgttggatagaccatcagaaaagttctgaaaaaaccaacggtcacgaattgaggccccaaaccccacctttccctccattccacccctgcttgtctctcgcggtggtttcatgattcacagataacgtttttctttaggtcgatatagggtagcaatggcaaagggcaagtggccgtgccgaacacaccgtaaggagtcacggtggaaaaaaacatagctccccgggagcagacagtggccttgcaagcatctagtgctccaaaagcgagcgataaatagaactgtgcgacttcaagttcccgactgccaacactgctagctcacacgtcttgaacccgggtggctccgacaagacacacggcaggcagcgaaaacgggaagttcaaagacgggtatttccggagaattgtaggccacacaactcattcactagacacacggtggaaaagagtttatgcaggacaaggcccccaaagggcgggtgtggcatcgttgatcgaggctgaaacatcgttggttgcctcaaagagctggtaaggtgcaaaaattcgagaattcgtgacgcagtggatgatccaactctaaacggcattttgaagtgcacacttcaatgattgtccttttttgggctatctggccgaaaaacgcgagaagcacgctgaaggaacacgacgcttgaaatgctagccactactggccatgtcttctgcagcctctgtctagcggcccgcaaaaacgttgtatgtctcccccgcagccgaaaacgtagaggctgagttattcggactgtcgatggttgcaaaagaggcggaaagacgtatccagtaatcgcctcgtaaacataaaataatggttgcaaagtacttctttcatccacgatttctctcgtttttcgtctacggaaacggcggaccgctagtccgccagttgactaaactcagacggaaggctcctggtcaaacccatatccctccctccacacgaacggtgtgctgtttccctcagatacttacaccgttttttgtgaaggctcgaaaggattggaatatgtaatgaattgcccatatggatgtgttgcgtgtcaggggagcagatgtacccgtcgcgtgttccaccttgacgcaacgaatcagcctcgaatctttggctctttggactaactgagcaaactgcgtgaccagatcatctcacacactgtggagaattgtgatagggtactcatgtacggaagaagagacaaatcataccattgggcaagatcgcttacgataaactatgttgtaccgttatccagcagatgccgacaagctgtttttgtagataagcacccgccgaaagacgcgggatgcaacacttcatcataatgtgcagggctcgaaaagagatttttttacgatattccccagatgtacatgagtaaccagtttgaactattcactccattgctgtggaggtcatgcgagagtttgggactgaaaactcagggaacatacaacctacgtgatacacgaatgcagcatgggctacgcctgtaggcaaaaggtactcggtgtcaaaaaagccataggggcagtcttcaggaactgaaactcagcttcaataggaaggttcatgcagtgcagttccccgaaaaaaacaccgttgttatccttcgtgcaggggaccgccgatggtacagtaactggagcaatccacgtgtcgctagtgccactcatctgcgtcgggtgctgctacacgctccttatgggaagagcagctctcgttttgccctgcttgatttcatgtaccacctgttgacaagaaccgagggcacgcgtcaattgaggaagattctgttgcggaagcccgcttcccctgattgaggtggtggttagaacatgaccaggttgtcgaggaatcagtgatgatagaaaccgaatgtggcctgctgacaaaggacgaggcgaggtaaacagaaatccgtgacggaggtctgtgatgcctgtagcgccacagagtcatttgtttccatggtagtatatattcggagaacgcagtggctatacgaagcagatataaaatcaaacctgtcatccaagaggttacaggcgtcccgtcgccgcattgttgcccattgaccagggagttaccgaaaatctctgaaataccgtgtgctagtcaacacgaaagtcctcattcaagtcatcatttaggaaacctctgagcctctgctaccttctctagggctatccgccttatgctgtatctttcgcttcgtctactactgttgatcttgtacttcagcggctcgtgtattgcggcggaatcacaatttcgtgttacccgaagaggacaaattctccagaaggtcggttggtttcaaattaatgcccgatggcctcggcggcctggagggctcccgatgtttcgtcaccaatgggaaattgaattcaatacggaaaaaaacggaaaagcacaaaggttcgtttttttggcacgctttgcccttcggcagctcgctgcatagagccccgctgagagctgccacgggtaacaagacagattgtcctagcccagccgccagcttgtctttggttgctttcgacactccgttccacggcttagcgggaaattcagattttgtccgattctgtggaaagggttttgtgcttttcttttccctcaacggagtactcaaggactcaaaaagaggcactcgacctgtgtctcgcggtcctgcggcacgcaccggtcctggcggcacgaacagctcgatggcccgacaatcccgcaacttttttatctgtgaacggtggttttctttggctctattctcatatccgatggcggaatttcaacgcatgtgaagaccataaccgcactttgcgttaccagggaatttgagtgatctccgtgatgccatcccgggccttgtctggtcgaggagctcgagagccaatgacgtttgcgttagatgaaccgttgtcattgattgtgttccaattcgacctcaaggagggatcaagatttggtcgtcgcgcagtttcatgtagacattctccgtcgctgtgacacagggttctcggaaacgcctgtacgtttgtctggctagatgagagtgagggtgcaacggcgacgctcgggccccataccgttcatttcgtcgttttcttttcttcttgtttcactcgttctactacgtagactttatgctgtcgtgcccacagtttccatttttcgcacactgacggcggtggtcttcgcggcggcaaaacaccttcccggttcggatcgtgctagcgagcccacagatatcacagaggcaccggtaacgttctctccgtttccctgaattgtcagca

SEQ ID NO: 1804 - DNA, 3006 bp, Toxoplasma gondii
gtcttcaactggtggcatctctgtcttaaagcgtctactcttcaccgcctccgctgggctgctacatatcccttctctctcgtctagtgtgagaattgtgggctgcgcgtcctcctcagcgcgccactgcctcccccgtttgtggcagacgaacacagagacgaacacacagtctcccgacggtctctccggtctcgaggactctgcgtggtccaggtacgaaaaggatttttattttttctcgcttcgcttcgcccccgaaacgcttttctgtacgcactctctgtcgagccagaagaacgaacgacagaagccgacgcggaggtcgctgacgaaggtggacgcgtggtggatgtagaacgcagagaatccagtgaagagccctacgagggcggcgaggacccagacctcgagaacctcgaacagctggcgcttccccggtgtacagacagtccgcttggccgtgaggagcagccgccgcaggagagccgcaacatgcactgcgaggagaaccgccacgcggagcagaactgcgaaaaccagcagcgcaggcaccagacaccaggtgtacgtacaccccgcgacgcggcggccgagacgcagcagcgacgccggagcagccgcatgcaggcggcgcgggcgcggcagagctccacgtctcggggcgggagagaagagcggcaaaaaagaggcagcagaggcttcggagtcccctagaaaacgcgaactcgcctccgagaaatgatgagtttctgaatccttgaggaggatgcgctcgaaggagggctgtcggccgtctgtggagagggactctcgctcttcttctctctgggaggatagaggcttgagcggaatctcctgtggccgccgctcctggcgagaagagccggagacgagcccaactagcggcagcgcgaccgcgaaccctgaggctctgacttctgagaagctgtgcacagaggcagtctcgcgcccgtgtggagactccgcagaacacaccagactctcaaacagcggagaagattcctccaaagacgcagacgaagaaaacgggaacgaagaggggggagaagaagagaagcaacaggaagaagagttctctggattactcagcggattgggagcaagggggagagtcaaacgttttgatgttgtgccttcgttgacgtctctgtttagcgaaggaaaggagggcagcggcgcggtcgcagaaggcgcatgcgtggaaacggagtcgccagcctctcgctggctgttcttccccgcccccgtctgctgtatgtacacctctcgcgggctctgtgactcccttcttctcctgccaggacgaggctcttcccctccgccgctcggtgaagctggcatgatgcagagacgaaggggagggagaagaagagaaagaggagaagtggaggaagaggacgcaggggcagctagccgagtcgtccggagttactcgccactgccgccggtcatgtcgtcgcgcttttgtcgaaggggagacatgggaggagagtctggtggctttgacagagcatgagaaggatggacaatgaacagaaaggtccgctgtcgctgcacacagatacgagggcggtgaacggcgcgggcaggcggttcagcagcggtcctttgcagaagttgacgtagagaagagaacgcgagtctctgggcttcgagcaaaggatagaagctgcgtggttggtaccatctccaaatatcagagataaaagagcgtattttgtctccgggagaacgtgcaggccgcgacgctttcgatataggcacacgaaattggctgggcggagtcaaaagaggggggaagagtgcagaaactcgggcgtggaagtggagagagaagccgcttttcgtctctccctgtctgcgtctcgtctctctcgtttttctcagctctctctctcggtcttctttgtcttctctcggggcctctgtgtggctttgtcgtctgcgcctcgccgagcgcgggcgaggttggagcagccagggaatgagtcggttttcgcagaaagatgtgaaagcgtccgcgtgcagacgagaaagcacaggaagcaagcgttccacctttttgggtgtctttacacccgaaaagcggcgagtgttttcgagcgctgcctcgtcttcctcctcgaccttgtcctgggccccacgcaggtttgcaggcgactttgcgggtctctccatgcgccgcatgcgtctttttttctttttcctgtcgactctcggacaccgagacgcagaggttcatctgtgcgagtctgttcttcgcagaaaaaggcgagtccgtgtgtcgaagcaagccatcgctgcatgtggctacaacttctcgttcggtgtcggctctgcgctcctctcgccctcgactggcttggtccttgttgcctctctcgctcgttgtgtcttcttttccggtctctctgcttcctgtagaggcacacgtctttcttcggatgtctcccgctttccccttgaacaggaagacaggagacgctctcttctcccagagataagccgcgggcgaacaaagacctcttcatgcacagagaaggagctggcgagaaggtttctgcagctcagtcgatctcttctgaaatccaccaacgcagacagacgaaaatggagaaggaaaggaaagcaacaagttaggaggcaggagggagcaaagctcggacgcccagcccctgctgtctccgatctgcggcaacgacctgagacaccagcagacacgttctgcgcccagaaactcctgttgccgtcctgaggaactctttcgtccttgtctctctcctccacttcttcttggtctgctctcccctacgcgaccttcgcctcgggcagcctctcctctcttctttccttctcatcaacctgcgctcgacttctctctcgtgtctgagaacagtcgacctcgtctgccttcctcgtcacccgcaaagattatatatatatatatatatatatatatatatatatatttatgtattcgta

SEQ ID NO: 1805 - DNA, 2324 bp, Toxoplasma gondii
acaagcgaggagctccagaattttgattttcctctgaatgcgctcctcctcccgcgcaaaggcctcgactgcgcggggacctgcgcctccgtcgttctcacgcgtcgcctcagcgagcggctctcgaaccgcagcctgtcggactgcatgcacctgccagtctcgaagaagctcctgccgcctctctttcagtcgagagagaagaagcgagaggggcaggagaggaaagtcgccgaccttcttcacagaggcaaaggcgcctggaacgatctcgccggtgtccagcagccaggccgaagaagaaggcgacgatggcgaagaagagacagaagagagcaaagactccgcgacttcgtcggcttcgtctgcgacgatacactcgcctttcttcctcggcgagggagacgaggaggaagcgaatctgcggagaaaggctgcggcgagtgtaggaaaacctcctccttgcgacgcgaacgcgcagggtggagagcggtctcgcgccgtctcggagtatgcacgcgccgattctgcatgcgagaacgaggaagacgaagaagcggaagaggaagagagagaagacgatgagagaggaacagaactggaaggagagagaaaagaaagcgcgaggagtgacgaggagactggcgacaaagggcgtggtgagaaagaagaggagaaaagacgagaagcgaagatcatctccggactggagaaacgagaggaaagagagaggaaagaggccgaggaagaaagaaaagaggactgtctcgtcccttgtcgaagcatctggctgcgcgagaacattgtgagagtttcgttaaaaagaaaacaccgtaatgagagagaaacttaaaagcgtatattttaccgcaaggggccttcgcctcccgcatgttcctcgatgctctccgtttttttgtctttttctctctcaacacagtcacaccggaaaggaatggaacaagaacgccggggaaaagagttcaggtctcccctctctccttttgcggttcgttcttttgtcatttcacgagtctgcatgcatcaccggatgtcctccaccgtggaagtcgacgcatgcgtatgtcttcccctcccatgtctctttctggcttgctcttcctccctttctcggaagacaaaagtcgacagagagacctgcgactgcggcagagcttcgctcggggatgccctgggagaagaggcagggcggaacggctccggagaggagtgagggaggaacgagaaaggaaactgggggaaccagtgacctgttcagctgaatcaagaaacgcagacgaacatctggagcacacaaatctctctgcatgtacggagaactcagtacacacaggcaggaggctatggcctccaggggatgggcaccgaggtggagcagctgggagaggagcagagaaacagaaacgctgagcaaagaaggggaaagcagagtgaacactggcgaaggaatctggaaaacgcaagactgctctctcgccgcctcttgaggcttccgtggtacgatttgacattgcatgcgctgccttttctttgcatgcgatctcgttgtgtcaccttctctgtgaactttttccattacgattcttgaaggaagaccctcgttcgacctgaaacacacaccagcttgcacaggagactttgttccggtttcgctttcttttttttctttcctctgtctgtggctctggtcttttccaaagatcccgcagagcgcggcgcctgctgtgtcgatcgcttctctcgagagtcctccaagagatttcttgacttctcgcttggccttccttttctcgctctctgcgcgcattctcctctctgtggatccctctcgaagggaagctcctcccacagttcttcctcgccttcacgaataaggcagttcaggaaacgaagagagatcgccgagactcgcctctccagctcctcttctctcggaagtctatgcgctaatgcttcttctcactttctttccttgatccctgtttggcgttcacccccttccactgtgcaccttcccttcctttcaacctttcgttcctcgttcttccagtcttcttctctcttcctcttcttctctttctcttcttttctttcttttctcctctctttctcttcttttctctctcttctcctctctttctctttttctcttcctcctcttctctctttctcttcttctttcttcctcttcatccccctttctcttcttctctcttcctcttcttctcccttttgtcttttctcctggcgctctctgaaaaggggccgaagtcttggagagagcacagcgcgctgaaggccga

SEQ ID NO: 1806 - DNA, 1990 bp, Toxoplasma gondii
ctcaattcgtgacgcctgcctccatatttttacatcggaaattatgtcgcttgagacggtctcagtcgcgtacaatgacttgccacactgttaaattgtaccataaaatctacaagttctgtgtgacaaggcgccattcggttttcctttcactatgtgcgcagtttttacctgaatcgtcaactgggttgtaattttgtgggttaggggttgtttgcagtcatcatttgaccgcgcggctgggtgttcttggcaaataagaaactgcaggtgtatgcagaactatctgatatcgccaaggttaaacagcggtcctttttctcttgcgataaatatatgaggcttcccagcacctcatgctgtgctgccattatcaggggacgattacaacatcttctgcttgtgacaacctagttctgcatcatgtgaacaccaaagacagcagctctgttatttgtggaactgtatccgtagaatgcagttgcccatcaaatggatcaagtgcactgtggtagacgcagggcgtaaaaagtcccactgtttcagtgtggtattcgctcgcagcgtttagtgacagtcggtgatcatacactaccagcgtagccagtactgacataaagcaaccatcatggctgaacctgcctttctcgtgtctcgtggttcacactgcaagctgccgtatgcggagcgcaactgctgagcggtagcactgtggaacacctagccgctacgccggttctggttctcttcaaccggttataaatttgtacttcactgcggtcgacattgaggcgctcccgatgtccccgtgtcagcgtgagacttgcggtttatggtggtattgtgccttacggttctcttcgctgaactgggtgaatcgatggtagagtgttcggtggcaccttcggcatgtgcaaaggcatgttcacttgttcatcgtgacaaggggccactaccacagctggagacagctgtattcccttgtatgcgaagtgtgtgggggcacacgtgacattccttcacagcagagaaaaaaactgccctgctcttgacgcttccttggtgacacggagcggtgtcgccgctcgatcaatccccgcatcagcgggtgccatagtcgctttgggccacggggacgtgatctgctgcattcggtcacacaaaaacacgctggcaaccctttacgaaaattcatgtaggcaaaacggcactcttttcccagccacactagtccctcaccagaacctacgctacacacagttcacgatcaccggtcgtcaaaggctacagtttcgattccatcgtgacctcgctggtaccggaaactccaatcttggggggcttagcacgttggacatgaaattgtgcttggaagcgttcaggaagatccctcttctctttactgcccttttccaacgcagtcttctgggctataatgcgtgcgtgacaatggatacatgacctgggcggcacgagggacacgagcgagaaatacctgcggagtcagcgtgtcctatcgcgagtgcaatcgagaggacaacaaagtgaggcatttatgcagtctgcccgtaccaccaaaactgccaatgcaactccacaagggcatctccacgtagctctagtggtgaactctctacagcacgagtggatgttgctcatatcggcgcgaagagcgcatgcacttgtccttttagaaagcaagagcttgtcagcaggtcgaagaattttgagttttcggcatccgcgtttctgcagaagcataactaacacttcttgccacggcgattatgcccgtagcaaaactgttcccaaagctgaatttttgttccatccttttcgcctgcaccgccgttgccgcccgagcggtcactagcggcctggcataaaattcggggactgatttctccaagtcacgtgtaaacaggggagttggcgtgacttcccacatttcatccctttcgttttgtgaattccaacatccacctaaaga

SEQ ID NO: 1807 - DNA, 4546 bp, Toxoplasma gondii
gcatttcctcctttgcaaggcaatcaggagtatcggagtgctcatgtgtgtcgcggtgattggatcaagtcagcaatggcttttccccagttgcctttctcgaagtgcctctgtgttgcacgcgccctgcgcttcccttccttgtatgcgtcttctctcctttcacgccgacttccgctcttccggcttttcaaaaaatgcagtgcacgtcttttacgaatcgacggttttcaggggctctctggagagacaccacgcgtgttcatagcaaagctttccacttgtctacatgcgtttctgtttgtctccatttcgctgtcgcgagggtacggcggtgcgtgatatgctgttttgtagtcgcgcgtttatgtggacgacgtcacgtcgcttgctgcttcttcgtctctcggcttcctctccgtatctctcctatttgtctcgtaatggacgcctgatgtaaactgtctcctatttctcaagactttttttcgcctctttgttacgtcttctaggtatcttttgtcgcgtcgacggccgtctactgtaccccaattgtgtccgttggagccgatgcgtttaacctgaatatagggactttctcctgtggtaacgagtgttagcgtcttaaatgtttgcgccagtgcgaattttcgcgttccagcacgcattcgcctgcggcgaccctggcgtggaatctccagtgaggcactgtactgcagcggtcaccacctcctgtctccgaatctgtgtccacctggagcacaaaaaaccaatacttccatctcttcgactttttcgttttagtctgcgatatcggagtcttgcaacgagacgcactcgcgcactcaacggcgcctctttgtgatacaaatgtaccgacgatcccttggcaacagccggggaaatggcaaatttccctgctgatggtctcccagtgacacacgcttagaggcatgtcgtttgctctaaaggcgcgtccgtgaagcagacggttgcttgctggaaaactcagacgcaaagaagttaccgctaccgcaaaagcaggcaaggtgccccgactttgcgtctagtctccggccctcaaactgcagccgactgactggcgagctagatctgttcacgtctgtgctgagcggtaacgccgatacgaattggcgtatagaggttctgcaccaaaggggctgaattcggtagtggtcttggttggacaatgctccccccattaagtactatcttgatggagctggagacgacgccgttcacttctttgaatagccgtttttctttgagggtattccagggcctcatcacctgtcacgaagctcatgtctgaatttcttttttctgtgtggagcgctggcggcactcttgtgcctgagcgaaaacggactgccgcgaattcatccgcgacttccaggaacacaccgcggtgcacgcacacctcaggtccagtggcgcagcacgcatcactgtaagttctgtacttttgcgatttgtggattgccggtaagcgttcgaaattcggacgtgcccgctgtggtacgggtcaacgattgccgtccaacgactcttcaataccgaacgcggaatgtggcaggaaaatcctacgttctttgcggggaacttgcagatgcgcatccagtacgagagtggtcagtagtgacagttccgacagtcaacaaatgcatgaaagctgcgagattacgaaatttgggaattttcccgctggatgccgttcctcaacggccagtgcctcctccctctgcagtaaaacggacgatgcacggacttccagttatgctacgctgagcagcttgacccgttcagacgtgctcttcatgtgagtgggcgttccaccgttcgtcgtcgcgtaacggaaatgtacgcgatgtttgctcaggcgagctttactggcctcccctgtcgagaagaacatttacagcttacaggttcgaaatcaggtgtcgcgtgttttccgccgtgcattccattagagaagccggctagtttttcaaataagcgcgggaggccattgtacttcacgcacttaccatggtggtcatgaacaacacagtagaacttggatattgctcttttcaagtcacttctcgtttgtccttaattctctctcttttatccccgcggcacctttatgacgtgcacgcaggtgttcgtgtgtcgtcgtaatcgaaaaacaacgctcagatcgctcctacgctacgactccaaatttatatacggtgtctaactcgcgtgtctttcactcggttgatcgaaaaccaacgaacccgccggtggaatttgagcgttgtttcgagtgaacgaacagcttctgccgcactctcaaggcggtcgacagtgcgggtgtgtgggggttctactagctctcgatgcattccagtgatgagcagccactcgtgggtgtggcgaatacgtcgctttgtttccttcgtatcaagctgcctggcagtgtataacgacggcagaaaggggatgttgtttgcttaacgccctgctcacttaagtacgattgcgcgagctgtgaaacaaaatcggaactcggctaacttatctcgtacacatctcacgattctctcgagctgaaactcgtggccagacagaccgagagcgaggctgctcctctgtgtttgcaattcagtagcgaacgctggggttgtgcgtccgtccctacataacggagatcatgcctgaagtgtcactgggtcagtgccagggaccagtgccgggcactgttccggcacttgacagtgtgtccggcgctctgcctttggtacacgtctgtcgggggacacctgagctagccacccatccccctaagtgagttttttggagttttctctgtgaattctctaaagaaaaaactatgaggagacacgcgagaagaagttcgggcgcggagtgaacaatgccgccatcatagccacaaaaatgtggcggggacccagagggacatcccccgcgtcagaggcgggtttttccccgtgccctcttccggcgcccggcgcgccagatgcgcacaagctcgtccgtttttggaggattgtttggtcacactggccgacgaaaagcgacatatggcgggaagaccgtgtgtggagagactggcatggaccacagccaaaagggcagaggaaaatggaaggaaaataccggcaaaacgagccttcagcggaggaaaacctcctcattaggcgttgctcctaccttcggcgaccgtgggggaggggccaggccgcaggcgctgcacgacagagcgacggtgccacttgccgtctccaggtcgtggtcaaattctgctagagcacgatccctccaaccggttttccgacgccgcggccctttcctcgtattttccttttatcgccgtgttcccgccactgtttgtttttgctcaggtttctccacttcccgcctcgggagaaggggtcacttcggcccacagaactttggcaacgtttggtcgcgttgtctgtgagtgcggggtgctcccctgccaggcgaggggaagccttgggttcagtagccttcgtcgcgtccaacttcgcgtcatcagatggctttcagtggctcaatggcagtctctccgtggtctgtgcggctgagataaacaccggccatgtaggaacgccgtcggtagtcatcgggtcaatgcagaaaacccgaccaacttcgctcgaccagacaccagccgccgagtgtatgtacaccgttagtcattaaatctcagtgccgagaagcgcccgccaaacttgcaaaacgcgtcgtcctctagtttgtcaccgtgaacctggacgggaaattcgtggtttcctctcgtttctctggaacttcaaagagcctaaaggtggcgagattttgtgggaacgaatgtacagggtcacaacatcgtggtcctatgtggcacagctctcgccgtctccggtttcactcgttgttccaggaacgcaggacaaactcggggggagttccctcagtgctcttttccaaacgtgcgctttggaaaacgaaacattcgcgtgagttcctgtccttcccctcctgtctccccaggcatgcactgttgtcacctcttatctgttgcctcgtgccctggtatggcactttatcaaacacccgaccgtgtcttgcatgggtacgtgggttcggtttaagaggtattctgatgcatgtgtcgcacttttcttcgagggagtgacgtttcatgtcaactgcgcagaggtccgccgtctcttttgagaactcatggttattcttcttctgtgccgtgtcaaggacggactgcgaccgcactttctgcggttagattcacgcaggagtgggcagcaagttagcgtgatatttcctcggccccgtgaccgcggacgctgtatcgacagcccttagcttcgacgtttttcagcgtcccttctgacttcaatgtgaagcaggcgccgtctttcacttttgccggcccctacgtggagcccgcgaggtcgctgcctcgctctcctccctttgaattattcctccccccttttctcgagaa

SEQ ID NO: 1808 - DNA, 4565 bp, Toxoplasma gondii
gagtctctctgagaacccaaggtaagccatacgcggtcctcttcggcggaggcagaggcgcctgcgcctgtccccaggggagagtgacccccagcgagttcgaggtttcctgctccacttcttcccccgtctacgcttccttctgacgcgtttctttcctctacgtcctgcactccttccaagactctctcagagacgcaagcgcgaggagatgcgcggtctccagtggcgtcgaggcgcgggctgaagaaagagcagacagtggcgcccaacgcgcccgaaggagacagggccggcgcccccgctccgggaaggcgcgcagacagatgctgcatcccggcggacttgaaatgctccgcctatcgacggtgcatgcacatagtgtccagacggcgtttgctgactgtgccaccaggggcgcgttttttgaaaatttctctctcgcactttctagctcctaaagaaactcccgtttttgaagggacctcagtgaatcagtcagacaacatgcagcatctcctctctctcctcgaccttcggctcaaaagaaaactctgctgagagtctcggacgacccaacgcgcctcggtagccgtgtgtgccggacaagcatgcatgcagaggcaaaaaatacaggtaaatcggcagagagacgcgagtgagcacggatgcatgcggcaggttccgtgaatctacacaggagctgtcgacgcgtttacggcaaacgcgaagattaagaacggatagaacagcgaagtctgggcgagacggagaaaacgacgtacaagatggacccaggggagaaaggggagggaacaaggggaaagaaagcgaaaagagaggtgcagaggaaagggaacaggaacggagaaccaggcaagcaaagaagaccaaggaggaaggtcacgaacagagaaaaagaggcgacccttggtatttcgcgaggagacacccccggacatggcgtttctctgcttcccgaggcttttcatccacgcgacctgtgcgacagcgtgcagacgcttgaaagcaggctggaatacaaaagatttgaactgaggaaggaaaagaagtaaaaacaagcctcgcagacgacgagacagaaaaaggcttcgcatgcagtcaagccgatatatatgtgcgcatgcagcgaaccgctgtaccccgaggcgtttcgcttggtggcagccttggtgtgtgcttcgtttccttctctgcgttttctctctttcttttcgtagacttgcttgctattcaccgtgagttcgtctcagaactccctccccaacttttaaagaaagcgcatggtggctgctgacagatcaaacgcacagctgtgaactcggttcctacctttagacagtatctcactttcgactacccgagtcccccttcctctcttttattttcggtacttctgccgaccacaatcgacatcgttggtggcctggacttcttcgtctctcacccctcatctgtgcacatcttcacaagtcttgcagcttctgttttcttcactcttgctcgtctctctctgcatcgtttccttccctctccacgtttctctatgtttcacgagctgtctctgttccttgctccctctctctccgccgcgtattctctcgtcgtcttttttttgtgggaggctgtcatggtttgttgcagctgtcttggagatctggaaagtctgtttttttttgtcggaacccagttagactgcgtttttcacatgaggatgcaagctgtgaatagatgccacaataacatctgtggtagtctccttcctcaaaagcgcctccacattcgagacctcaccagtgctaagttcccgtcggaggcgcgggcgcatggagagaattacctctctgaagaagaaaagaatggacattacaaaacgggtgttggcgtggttctaggaagcaggagagtgcatcagaaatagacacgatgggcatagaagaatgtaagatcgacaccgtttttttcaggaattttggggaacttcagcactctcagtaaacgccaacttctcccgtttctgtgtcttttctgtttccgcggttccccctcttctcttttgcaggcacagcatcccttcgcgtcggctagagagagccgtgagatgcgacagcttcgatcagcgccgtcgtgctgggagtgggggcctcttagtcagacgtttcacggcgctttccggcgagggagcattgagctcacaagatgcgaaagaatttggcagataacacaagagttgtacataggggtgtgtagacaaccaagacaacaggactgtagagcaggatggctttacgttacacacagagacacacaccaactctcagactgtttctcggatgtaactcagagttgccaggcggagcgcgagcgttcagcacgggcgacaactttttttgtagattgctgaaggcagcaaaaagtagtggaaatgaatatcgtccgacagaaggttcctcgacactcgatctgctgtaaagttctggatttcgatacttgacgaaactaaggttctttcgcgtatgttccagatgcaatctatggatgcgatccagaactgcagaagtcaaatggactgaaccgagtcataaagcttcgcaaaaactgaaccgcagtccagttccccacttctttcacctccgaacacactctgcatttcttttcgctgcaaatcattgccaattctccgggacatctgctttccatacgaaagccgagcgggggtgacggctgcaaacaaccaacaccgtcgaggtgcggtcggtgaccggacattttcgttgagaaaccaaatcctaatttgcctcaggaggttcggtctctcttccgctgcaggtaagctgcagtctatcggtcagctcccatcctctcacgctgccgctgctctcggagtttatgtgggcgtgaagaaggctgtaaagcattggtatattaactgtggtagtctccttcctcattcaagtctgttcgaacgagtctgtctgcctatgcctatcaacgacgctggagaacctatgcagttgcggcgtcggttcggagagagttatgtcgcaaagggaactgctcgccagcacaccgatacagagactcccagttctctgaaacaacgccaccgcatagacgccgcgtctggatccccagtccttccttgataacacaaaaggcgtggaaacgcagaccgacaggaagcccagatgtctgcgtgcatctgcaaacgctgtgataaacgcatgaaacggcaggacaaaagatatgtttcctttccctcagcctcacggtccaggagaaccgattttcacactccattatactccacccgtcgccgcgagtaaaaataacggacagttgcgtgcaggtgtgtgtcacctgtcctatttgaggtgatgtgcaatcctgatgtggaggggcaccagccgcccgtggaagtctcagacagcaagaggagttcgatgagacacaaagagagacagaaagtacaagagagtaaggagaaaaagagaaagaaggagaaatagtcgaaacaagacgtttacaggacagccggaggagaaggtctgggcagggttagggcggaacgaagcagtagagagtggtgacgctgacgatacaggaaagagaataaaagataaaacgaggaacgaaagagagcgcgtttgttgagaggccagtacttcgaacacaagacgagaagaatgccgtcgggaggctttggctgcgaaaaagcgcgcaacgttgcagtgctacgccatggcaaagacgcaagaaacaaaggtttctctcgtgccaaggtcttggtttttctcttttcgaatttcagcgtgtttcttggaagacttgtttcgctcggcttcttccgcaggaccctcttctcaacgtctgcgtttccatttctcgcgatcttctggaacttccgcgttgttctcagcaaagcgcttgcgagccttctttcgcctttgtgtcttggtttctcttcctggaactccacgagaaagagcaaggaaggaaaaaagaacgaggcttccactgtcgtttccttcgttgtccatgggtgttctagacgccttctcatctccacagatttccaaagattggagattgacaagtcctcagctcaaggaagatattcgcacatctgtatacgcacaggcagctgctgagcaagacacgggccgtctagttttttggatttctctgcaatttctcaaagcacatcgacggcttctgtctcttccggataacacaacatctccacaaggacatccctttttgttattacgggcactcgaccccccctcctcccgcccgccggcagcctcgcagcttttctgcatcctttctggtgtcttctctttctcttccatctctctgtttgtgctcttaccttctctcgtgtctcgtcgtcgtcggctcttctcctggtcctaacctttctgtctgtctctctcccgttcttcggaggctgctgccatcgcagtgttcgtccttcgtccccgtgacgccttttcttttccgcgaaggcctgagaaatttcgtcgcggcgttctccaaga

SEQ ID NO: 1809 - DNA, 2195 bp, Toxoplasma gondii
ttcaccacgcatgcactgcagctttcttctcacgccttaggttttgacggagcaccagcgcagagtatgccgcagctcttcgcttctgaggcgtcgcctctcgctgtcgaaacgctgaagcgaatgccagcagaaatccgcatgctcctagtataacagagccgctggggggacccctgatagagaatttcgagtccagtgtctccagcaagtgtgtgtgtgtagcctcagcggctctcaggagaaaggaacaaagatactgtgcagttcaagaagaaaagactcagacacgtcgtcagcctgagagggaggcgcctgccatgagcgagatgaaaggtcaccgagtaagcagaggaaagaatgtggtgaatcaggaaccgaccattttcactcatcagcaggagaatcaacccgaatatggagacgaagatagagatatccacatatgatatacatctctatgtttttatatgtatttatacatatatctctatatgtagttgtatatacctttatacataaatatatatatatatatatatatatatttatatatgtatatgtgtataacgcatgcattcatgagtgcagacaagagaagaatccagaggcgttcggaattgtttttttgctttcatgcgtttcgtgtgtggctcgcgcgcgcgaggttttggcaggcactctgagtctcgctcttcagtcccttgattgacactgtggctttgtgagccggattccaattctctcgagaagcacactagtaaaaaatgggaggaatgagaacgagaaaacggcgctgagggaaatgctgtcttcgaagagaagagaaaaacagtaaaggtaagcagagagaaggaaagacagagaaagcgagagaacgacacggatgtctggccgaggaagtgccagacagagaagtcgacagaatggagttccaaaaagtgaaggaagaagtggaagacagctgagcctcgcctgccctctgtggagagtctcagcacatattcacccgttttgatctcacaattcgcatgtccatcctctgttgccctcggggtcagctcgccttctgcgtttctaggtctcttcttgttccggctcttctcttggctcactctgcctcgattcctgtcccctcgctactcaacttcctccacacatgcttcttttctgaggtgtacgtacacttgactcgagtcgttccgagttcccagtgtcgatcctctccttgcaccgcacaagtccctccgtcggtttgccgcgataaaactctcgcttcgctaggccttctcttggattcttctctgacgacacactgacgcattccaccgacttggcatgcctccttagcctttctcactcgactcaggtgtatctacactcaagcgcagtcacccgcactgcagtgtcgcgcgcgcgatccgctgcacacccgttcccgcgctgtctgctcacttcgcgtcgattcttttcgttcctgtgcctctctcgagtgggctctttctcggattctctgtctcttcaattcgcctctcctccgttttttcgccaccttcccttgactcgctgttcatcgcgggaggacgtcggcgcgcttcctccaagcgagcttctcccgccagagagagtgcatgcaaacttctccccgggctcgcgggtgcgacagcactggactgagaagcgaacttcacttttcttcctccgttttcctgccttttcacagccttgcctctctcggctgtattcacggagactgcatgcagccaaggaagtctcttttcttcttcttcttctcacccgccgcggccgcggaccccgctttgtgtcatgcctttgcgccgcctgccgctgtgtctcctggacccacgatgagagaggaagcaattccttgcgatacacgtgcgttttttttgtgagttttccctgtgtttttccgttttttctttttcctcctctctcttctctcctctccttcgccctgttcttcgtccttctcctcgttccttccaccccttgcccccaggtccctgtgcttctgacacgcgtaaagagggaaggcgagccctccgttcctccccttccttcccgtttccacgcatttcttcgattcacccagttctccatttcctttactttctttctgcctcctgctccaggatcttccccccactctccgctcttcgccttcaacccca

SEQ ID NO: 1810 - DNA, 2735 bp, Toxoplasma gondii
agctcgactcctggctgagacgcggaaaacctttacttttgacccctctccttcactggtttttgttgacctacgttagagaacaatcgaaaccacggtttgaatctcgcggcggaacgaacttctcaaagtaaaacgagagtcttcaacagacctccctctgcacctcacaaacgcgtttcctccagattcgcctgtgctccacgcttcctctaaaaccatatatataaccgctaaatttagactttggggattcacagaaaaggcagcagttcgtcgcagtgctacatcctgtgtccaggatcccctctccacacccgaaaaggaacgacagaagaaacctgaaagcgtttacgatgctcacaccacgtcagaaacgcactttgtttctctctcttacttgttccgaggacctgcgttttccttctctacagaaaaagcaacttcattttctcggtcgaaattcttgtctgaacaggcggcagggacgttcgttccagaggagacgctgaggcctctgtgccacgcagtcgacaccccaattgccgagaagtctctgcggcaaaaaactcttttttcgttcctgtctcccttgaccgcgcgcctgccgccagcccaaagtctgcccctctcccgcctcgcgagccgaccccacactggagacacttgatcccgccgattgacttctgaaggtccggagacagccacccgcttcactgtctccttccgaccgcgctcgcgccccggcagagcagccgaggaggagacacacggagagcaggagaaagaagaagagctggagagcgaaggagagcacgggagagaaggccgcaaggaagagcgataggagggcagagcagactgaggttgttcggcggagagggcaggagggtgtctccggcagcaataagaggcacgcggagcaagatgcggagcagccgagttggttttcctccaagactcagaggaaagagggagtgagagaggaagggagacgctgtgagaggagcgcgtttctgaagcagcagaaaacattctacaaggagggcggcgaggcagagttctccactgcattctgcgtcagagaaatcgtcacaactggaaacgaattcgaccaagaccccctgacagtgcacgaacgagcaaggcgaagatacctgattggagagaaactgtctcgacagaactgcgcacagaaggagcgacgcgaacgacgacaggggacgaagagaacgggagcaatccggagacctcgcgccgtttccacgcgaagaagacgttcatgcatgcgtaaaaaaagagttgcagctagtcttcagatgacgaattcatccaaattgatggaagcaatctccacatacacacgcaagcagtcgagccggtgacacgcggcgtcatccggacttgcagagaagcatttacgcattatgggcagggagggtccacttccacttttgaaggctctgggaggttacatatgtctagagacgcgtgcgatgaagtctctacaaagcaggttcacgacagttgcgagtgaatggcgatagaccgcgcccgaatgttcagttttctgtttcagtgggtcttgtttttcgcaggcaagcgttccggctgcgagtctgctgcgtcgcggcgcctcggctattcacaggtgtctcgggagagaaaaaacgtttccgcgctttaattggaagaaaaaggctttagggcgtcgtcgagaagacgtcgacgagagggagagaaaaccgcacaaaacagtaaagaacaacgaagacccgctctggctgcgcgagtgcgcgtgcggcgtcaaacccggagagaaaacggcaaaaacttgggggaaaaactcggaaaaagcgggacttttcagaacccaaaggaaagatgggaacagggcctcacgccattccggggacgggaacgcgccgggcggcttgcagtgccgcatctccttcgacggagcgagggaaaccgaccgaggataccggatacacgacgcggaaaaaacgcatggagtaacgcgaacgcagccatcaagaggagaaaaggcggatgcgagggagagagaaaactctgcgccggaagaaaaacgtttttcggtcagcgggtgacacttctcaggaggggctgagaccgccttatattcggaaaacaatgtccgaacaacagtccgtcggctctgcgggagacgaaacgcggagactcattggattcgacgcaaacagcccagagagaagcgcaggtgtgtcttctccgatggagaccgggaaattttcttctctgtattctatttcttttttttgttttctgggatccctcggaggtgaacatacgcgccgagaatgcccgctgagtcgactgtgcgcacagagacaggggggcgaccaacacagcatctccgctgcttgttctccctcgttttctcctttgttttctttcctgttctcgcttgtggcgtctgagcgtggagagccgcgtcctctttcacttttttcctggagggtgtatgagtactccgtggaacgcgctgggtccgtcgctgcttcgcgacggccgtctccgccccccatttcttttgacttttccctgtgccttcttcttttttcgtgctctctttggccttcagtctgaagaagagatgtgcatgtagccacacagaaacaaggcgcaaaccgcaacttttttcacttctctagtgcggatcagacgatttccagagctgataacgcagtcca

SEQ ID NO: 1811 - DNA, 2282 bp, Toxoplasma gondii
taatattactgaaggtgatgaggacccgcctgagacccaaagacgcaaagaccgtaaaggaagcagagctgaacaccccaaaacaacaacctgcagaagttttttcacctgctgaaacacctgccacgacaacgaagacccgccactctcgccgaaagtatatttgaaaaaacgctttctcatgttgggagcaatcttcaggctatctccaactagtatgtgcatgcgggagggggagccgaaagaaacaggacgctgtcgaggaaaatccaactgctccttgtatcagactccctacggtacatgtatcctgttgtcgactaccaagacatgctatcttgtgtgtacagacgaggagtgtttgagttacttgcatgtaactggcctactctatcgggggggtttgttagtttttgtccaataccgtcgtccctagctctgttctttatcagctacgtttcactggcagatgtgacgcagctaagccgatggctctggccagagcgaagccttccttcatatatgagtataactcgacaaaacaaaattaatagtcgtcgagaaacacacactctgagtgtttcgttttaatcaatggaaggtctggtgaagtggtggtgatcagatggtaatgcctcagacacatgcatacatctttgctgctgtgtacctcgtccgaagagtggaaggcaggtgaactgcattttgccttttgtttcttcgttactgggagccaactaatatttccaaaaaaacttttcacaattgctagaagctactccctacctgcgctacccgtagttttgtcaacactgacgctaaaccggctacccgacatttcttcgtgtgtaaaaagactaacagtctcagccgcgataagaactgttgcttttggccgcgctgttagttatgcctaactgaatatcctccgtgaattgcctttccgcttacaatattaagacacctggcacattcgaatgttttccgcagcctcttttggacaggccgccacagcacggactcatgatcggcaccagcatgttcacttacgtgctcgtcaataactctttctcgtttgagtgtcttgtgaccctcacctcttggttacccgagatacctaagaagcctcgtttgacgcagtgacccttgtatttcactagcgacccacgacaatctccgacgcagagtgattcacatgtagaaatactagtacacaggaaggagtccggtggaggatgaacgttcctgcccacagattttgttcagcagtgtagctcactgaccatagtggaagactttttgagtgaggtctgttccgcagcaggcaggtacattgttccgtgccgaaagccgtcgtggtctctaagcacagagttgttcggtggatgtaaaaaaagcgcaagaaattgaccacaggaaagtcccttaagtccagattggatctccggaaacaaacgggacgaacagcgttgggcagcgagacagatctctgcctgaggtccggccatggcggcagccgtgccggttcgagcccgtaaaacagtggtcttccagccttaaaaaaagatcgattctcgcctgctaggaaagttcgataaagcagagtggataccaacagaacggagagcagacagttactacagagaccgtatgttaggcgaagacacagcgtggcacaactggacgaagaggcgggtgagacgcgtttcatgtctatgccgagcaaggatttgtcacgcatgcacgcgccactgaaactcggccaccgccaaagtgtgcagtgcgttcttgttgggaaaacgtttaatcgtttgagtcaagacagaaaatattcgcaaagcgtttgcttttgtgacgaatgcatgcttccgatgctttctttgaaatgatggagacgtagtgtcatgcctttctcgcattcctttttggggagcagactttgtcccgcgaagggccattcggggctgctgggactctgcgcttttgccgcgtatacccacacaaattcaatgcgtgaaaacggaagcgtcctcaaaagagtggctcctatgttctttgggacggcgaggactgaagccgtgtccttgttcaaggaccagaaggctcatgtaggttcgtgctcccctccttttctggacaagaaacttgcgggagggccgtttctcagtttttttaacgtgaggaactttaaaggacgtgcttgaaggcggaagtttcggcacggagacgcttcggtcaatgttcacatctctcttccctgtataccctcgtacccgacacga

SEQ ID NO: 1812 - DNA, 2684 bp, Toxoplasma gondii
ctcgcccaggagcgtcccataaaaatgagctgaagtaggcttacatatacaaatgaagatacagacgtagtctcagagatttacaaatgacggtaaacacagttttattcattcaaatcagggcacatacatagtttcgtatgtgcagaaatgaacgggcatgcatatgagcgatgcttcttccggcttctggatctttctggaagactttgtttcggtcgtcgatgagctcccccagtgttccactagcggttcagctccaacaagctatctacttgaagccagtgtctatcttggacgtgttttgattctgcaaagacccaaactcattcagatactgttctccgctgcgacgtggggcttcgcaactccgctgtcaactttatgtggagaatcattcgagaacactttgtttgctggctcgtctgctggctttccgtttgagacggacgtttctgttctcagctggacaagccgctgtggttacaggagtgcacatgagcacatgcaaaaccaccttccaagggtcaactgccgcagctgacgatctcaaacacagtggaaatagacagccacttgacgggtgcgtgttccgtctaggaccctgtagatgcttaaatgtgtgctcagaaacgagtgagctcacgtatgagacactgtgttgatgttgccgccgtgtctcgtcggcatctcgtggtctggcgtgccacttccagtcttccgaatattcagtagtccgtcgcttttatgcattcagaggggacggcgcatttcccgacacacatgttctgacaggtggcttccgttggtaagaagaggaaatctgcaaggcgctcgacagagacgtctcctgatgaaccccactttcttcggagaagtgcgttgacttcagtcttttccttgcgaccctggttagcaacgcaaaactgtagggatggaaacatgtaatcctggccatcccttcggagaggcacgaaatttatgtcgaccggctccgatccgtcccgaacgcctgaggataaaaggcagcttcagttgcgttatcaacaaccccccgcaccacgtaagagacgtaaagctgctcagggtgtaaccgttggggcacttctatttcaccgatcaagatatttcaacccaaaaacatattagacgaaccacatatactggtcgagtttccacgtgactcgcagacaccaggagactgcccagttcgacttcgtgcactcgacccgaacgattcgttgtgcctctgtgcttgcagattttcgtttgagttgaaaaaggcgaaagaggaataatgagtattttctacgtctctgccggttaaagcaacttgatgttcaggcatggggaggcatcacacacgtttctcggtttctgtttccatctcctctcacttggcgcgcgtgcgccgccattgtttctggaggcaatttggcaccctctcacttttattcgttttcttcgtctggcttggctttgtatctatatccgtctgcgatcccgctctctaccatagccgtctgtttcttgacggtacgcgctctttccccatgttttctcttcttccagtctcccccgaaaacaccctctggctcgggtatcttcaatgtgctaccatgaaaagcacgcgagaacctgggtcccgtaaagacgctcaaaccgtaaacctatagtcaaactcccagtaaatcatttccaaaaaaggataatgaataaacctacgaatccctacgtgcactggtgcggtcacttcgctggctgtcaccatcgcgagcatgcttaggaacgcataccgtgaaaactcacgcaggcacacaccgccgctggaaggcaaaagtcgcgcagctccgaattccaccttctttttgttcgaggcacgttgctcgccgtttcctctctgcgaaaggcaacacaaagtgcgccttttctctcgaaaatttccgtgttctgcgcactttgaaatccggtgtgtgcccgcgtaccccccttcccccgatctgcaacttccgctttcgtccgtcctcccaccagcgtccacttgtctcgtagccgcaggaaaaagtgaatatctgtcaacttctcgtctatgtcgctgcttgtttggttttcccatgtcctctgtttccggttttttgtctcggccgccctctcgcacatggcgcacatgacgtgtgtgcgcctcgcggagatcatctgaaaaggcgcctccccttcacccggcaaagggaacttttcctgtctctagttttctgtctcctcgtcttggccgtactcttctccaccagaagtccccaagtcttatgcgctctgtccttcacacttccctgcgcatgtgccggatcctccggagtaactgcggacatcgatctagccacgcaacccaatgcggacgcatgagtctggcaggaactgtgcctagtttctgcatgcgcctacatctacgctctgcaacttgttttcaaccgtactttttcgtgtgtctgcgcttcctttttctcaccttccgacagcgagaccccgtctcgttttctgcgcgcctgccgcgtgtctttcttcggtgccgccacccttctaaggctcgggaactcctcgaaggaactgccggtttttttttctctcacctctttctcttgggaggcaacggacaagtccgccgacagacagccaccgtttccccgcga

SEQ ID NO: 1813 - DNA, 4059 bp, Toxoplasma gondii
gtatcttctcgtgtggtttcggattgctgcagaatgatctgacgtttttgcggataaggtccaaaaagcatgagattctggttgcaccagacaaagattacgttctgattgttatccaagacccgaactcagagcaaggaacggcaaattgacttcttgcggagatcggtccactgttggatcgatccgctaataaaaacttttttcctgtctgctttcgcaacgcgtccaagcaactgtcaccgaaccctcttgttaattttttctctggaagcaacgatggttactgtctcacctcatctgcggtcgtcaactgggttccgcagaagctcatgacttcccccaatactcggaagtgaaggatcgaggcgcaagtaaaatttgggatcaattccagactcagatatgtttgcgatgacctcatggttgcttgagttcaaaggcccttctctaatgactaggatccgtagagttagagtgcttctatccagtccatcgcggcagtcgaccacagagcgctacatgtctgatggcgccaactatgtcgcgagctgcacgagagtggcgggcgcggaatgcagaaggccgaacgagacgaccgtctttgcgtagacgtcactgcatgtgacactacagaagaattacaggatcaagttgcaggtgcctgcggcaactgtgttacgggctcaaccaagcgcacaattaagtgcacgcctggataggacactttttgcgcacgatcgcacattgtctttgcccttggaaacagatgacctgcggttgcttgacgacccttactaaaccttcgtgggtagcgagtttttacatggccgaaagcctgcgggtcaaagaaggcagaggcagaaatggaagaaaatggcaaatctggttgtgcaggacgtaacaagtgatggtcctctgcagacggacgactacgtcagcttcgagtcagtggttacgtggtctgtcctgtgaatggtagaggcaccctcagcgcgaagcggatgggaacaccttcggttgacgacccccctgccacagcatgctctaattccgtttctactgcagctgaataggccttcgcttgcccacgaactgtgttgcacgcaccgttgataccttcgttagtctttaaggttcactgcggaagctgtatcaggaatacgtgcaacgtctcttgcatacgattttcgaacggaggctcgaccctctcaaacgaagtcgcttcattgctgtgacgctcaggtgtacagacacaatgacaccgctatgcaacattagggacggcgcgttccaccacagtctgatgctcagtgtttgaaaagagctttacgtgtcagtaggcaatcgatcttctgtatctgggttgtccatttgcaacgctttgtagatttcttgttgcctgataggatatttgcaacaaagtagtacctacctttcaggtagacacatttgccgagaggagttaaaatgggtcgcacgatgaactgtgtcatagttgccgtagcctgcgtggttgccaccactggagtacgaggtaaggagacttagaatatgatcaacgaaggctcaaatgaaacattttgaacatatcaggggccgacgtgcctgtagaggcaatgaataccccaacagaattcgagatgagcgccccagataggcaaacaggaaagctttccgatttaccgccatttgctgagctgccacagctggcagaaataccaaagctctccgaacttccgaaaattgcggacatgccgaagttttcggatatgcccaagatggccgagatgcccaagttatcagacatacccaagatggctgagatgcccaagttatcagatatacccaagatggctgagatgcccaagttatcagatatacccaagatggctgagatgccaaagttatcagatatgcccagaatggctgacattccacagtttccagagatgcctaggatggttgacatgcctcagtttccagaaatccccaggatggctgatacgccgcaatttccggagatgcccaagatagctgacatgccaaagtttccagacatgccaaacgtcactgagatgccaaagcttgcagatttgccaaggcttgctgacatgcccagtattgccgacatgccccggctctcagacatgcccagtattgcagacatgccccggctctcagacatgcccagtattgccgacatgccccggctctcagacatgcccagtattgccgacatgccccggctctcagacatgcccagtattgccgacatgccgaaattctctagtaacgagttcatggcaaagttaccatattctggcgatatggacaccgtcctttccggactcaaggagttttttaccccgctctctgacctaatcaagccagaagctgcttccctgacaagcctggtcaagccatctggagttttctgagaaccctgttggcttgatgagaaaatgtatattgacaaatggctgtatctccatagttatagtgagaatgtattgacttattcgaggactctatactgaaccgcgcatacgagggaactgacagttggtgatgtgcgtttctgacttccccgatacgcataaatatgaccgtcttctttctgcggtacgagctgttaacgttgaggtggaccgtgtactgccggccgaaggatgctgcagtcacgtagttgtccttcaacttgacttctgattacgcagtaattttgttgccttcgacggcaaacataagcaaacatctgaacaaaaagtgtttgcaagtgggttagtagcacaatcagtgatggtcacttgcggagttcaccgacgtttgccttgtgcgtggcttcgctggaggatgtggctgcggagccagcgggcccgccacacgagacggactaagaaacagataacacaatagcagatttacttcctccaaattacattcatcagctgcgttagtgaaattgtaatcttacatgtggcaagatacacagtgttacgtcgagaaaacaagacaatgacaacggagtagtgttttgcaagcagggtgcccatggagacaagctggacacgcttccctgttacgaccccgtaagcgcgaatgacagaccagttacacacctttcagggaatttgatactccagtggtgaatgtttggaggtgcatgtgggcagaaaagaaagcgtctgatagaatattttcttgcacagcaaggagtttccttgggacctcccaaggctggccgctcgaaaagccgctggtcaaaaaactcgcatgcggaaataaacccttgcaagcccttttcgcgcacacccaagttgtattttggatctctatccgagttttggtggttggcagaagctagccttgcacacgtgctcacgggcactgatctatgatgagcaaatgctgtctgtggacggagcctgattatttgctttcatgtcttctgggtcgaggaggcagttgtgttgggcagttcgaagtcttcttgtctaacgggactttgatgctgctttaactgtttggaactcgagcacagatgacgtacaaacgccaatgaaggcagctgctccgtatgttttgcaccgtataaacggccgtggcttgcctgtcgtgtgttgttctctacgccaaatgtgaagagacgcgatctaaagtgcgcagccctcagaagatttctcgctcttgtctcttcgttgctgttgtaattttaggctgagagctatgttgcttattcgagcagcattcccctgcccagacgggcactggctacgaaccgtagttccagcggtacttcatcggcaccgtgcctcgtgatccgttctgagttagaggtaccgcctgtcattgtgagtagtctttcagcttgcacgacagtgcgctaacgtcccatgttttctgtcgagtattcgctcggcgtttccttgtgcccgctgtgctgtggccctcgacggtgttctactatttttggggggcgcgagtgtctttgaacaattgaatcgcgggtcctttgcccgctcttctttttgaccgttccagaacctccgagcgcaa

SEQ ID NO: 1814 - DNA, 2656 bp, Toxoplasma gondii
agagtcacttctttgctgtcgttgtggtagaacaggcgcagacgccgcgcttcgatgccaaggcggtctgccagtaatagcttcacgtatccaacctcggtactgctctttacctgtgaaaaaatcgctcatacataaacattgttcgacatggaggataaaaagtgcaaaaacactatacgacactgaaaaagctcgacattgtagcggcgcttgcggatatcaagcagatgcgcttccctgctttcacttttccctcccaaattcgcccacataacgtctgaatcgtagcaagtgtgtcaaaatgtggtgcgttttaaacgaaactgtcacgttgcacttcctgtacagtgagcagatgctgcatggtctaccttgtcagcaactttgtttgcgacctgcacctaattgtcatttaagaagtgtgttttgcctgcgttcagttggtcagcttggctcatcacaaataggctacctcaatttcaactggatttctgtcggcgagcgccacgatgagtcggagatcatctccttggagtgcagcatcctctttctcccgcagttcggcattctttggcggtaaggagaggccgctactgctgtctgtcgccattgtaaactctttatgtttactgatacgaaaattgccgtacggtcacaagaatggacagatcgtctacaatgaagcaagttatccagccgcaccgcagtggtgttacccgtacctcaccgacgcttagggacaaaaaaagcgtccgctgtaaggccctggtgtgactacgtgtgacactagaaatcttggcacagggcgctcatatgaaatctggtgtgagatcctcttcagcagaataaaccgggaatacgtccaaaacacttccccgtcaccggggccgaagctgagatttttgaaaaagaaaacctccttgcgaggtaggttcgagaactccactgtccaagacacgagtgaggtagtttctcggaagataaccagcaactgacacgagaaatcgcaagaaaaaaaggcaagacaggatttcgttgcgagggagagaccaaacccccaactgtgtcagcaacacgacacaagcgtggcggaaggctaaattaggaattgttcctaaacttcagtaaaccacaatttcacatccaggtacatgtttcgatccttttccaacggcaaattctaggaattttaactcgtcttttgagcatttcaaaacgaaggggatactgtggttccctgaatctcatgcactttcttcgcggcagcgtctgcgaaacggaataagccgtcccggaggtccccggaccgaattttcaagaggaaattggacctcgatttcgacagaaacacatcagtaaaagacttggtcctggagcggtgcgaagaggaaccacggatgatcccaggtttttaatctcacctccgcgacgaccgtacgcagaccctctggaactgtggacacggaactcgccgctgccccgtcggcgcaggcagcgggtaatcacaggagtgccgtagtgtgaaaaagaaaggcacccacggttcaggacacggaaggctccaactgagacgtcggctcgttctttaatgtgtttgaaagcataaagaagcctactatcgattatgaaagattatgttgtcaccggattgaaagtgtgtgtgggtttgtggctcatttctctgcgctcacgctgtacggcctgataccacgcatactgccacatctcgacgtggtgtgcggctagattgactatctgaggtagaaaagcgctcgtgacaaaggaaatgtagtaggcttgcttgcagaaatcaggttgaagactggggtgatggttggtgatactgcaaagaaacgatgaagcgagtcagattgtcttgacaagctgctgtgttgcattgtttttttcctctcgggcagcatgcttgtacaagttcaacggagatgctaggtcgtcaggaggagtgacctgctcccactggccacgcgaggacaccgggcgacggcgtggtgccggccatcctgttgcatgcgccgtccacgaagggggagctctcaagaatctcactcgttttcgtatcgaacttgtttccgtagaatcaccttccgatgtggtttattttttcagggtatacgattatctcttagtaactacggtgcagacagtaggtgtcactctgttagaagctggatgtcttcgttgtctccggccacgcgacatgtggtggaaacatcggcaacgtaactgaagcatacaccggcatgccaactcttgtgctcattgacctgtggtttacttttatcgaagaatgaagcagcggatgtgtttttccttctggttgaattgtctgtgataagaaccctccaagcggtggtccggtttttagcacgcgttggtttgtaccacgactgccgtggtttccctagtccaggtggtgggccactgacaatctcgtggcaaggcaggttgcccccgcgaagtcgacgactgtaagcattttcttcctcacactttcttcgcctctctccgccagcactggggaggtggtcgcgtgttcgccacaggtcacataggattggtgtcgacgatgcccatttgttcgcggccgagtagcgcccccgtaaacagtcgtcgaaactgtagcctcgcacaa

SEQ ID NO: 1815 - DNA, 4126 bp, Toxoplasma gondii
catgcgattaatggcgcactccagagatgctcgctcgacagtcttcaccgcgtcccgaatcttctcgtccccgtctgtggcgggtgtacgtacacccgagtcagaggttgcgcgtgcgtccgcagagagagaggaacgcgaggcggaagacgaaacctgagacgaggggagaccgcgactgaagttttctgaacagggctgcgaggcagctgtcgacttctggatgttctctctgcaggcgtcgctctgttctcccgaagtctcctcttcggtcgcgctcgaaagattcggcttcgatgaatctttatcttctcgcgactcggcgcctcgacgtccttcacaagctgcctcatcgcaggcaactgtctgttccgtctcacctctctcacttctttcttcctcttctctctctcttgttgccttttcttcttcgttgtcctcactccgttcttgcgtcttctgctgcttctcatcttctctacagtttacacagacttcaccttgtatgcttctctcagcgttctccgttgaggtctcttctccttcgacctcgtctgcgtcgtccctgccttccccaccccaagagccccccatgagagaaacggttccgcttttctcttcttctctgttcgcctctttttctttgttgttttcttcatcgtggcttccttcggcttgtctctgcctctcagtgctcttctcttcgagcttcacttcttccacccattcgtccctcccaccgtctccctcagcggtcggccgcaagcctcggcgcactcccttcttggattttcctgccatcgttgctctcgcggaaaactccccgactgtccctcgccctccacatgcagagggagtttttagaaaagtgaggacggccggaagaggcgagaagcgaggaagcagcgcctcgtggctcgtgctcgaactgtctgtacacctagaagtccgcagctctctattcgagagacacaggtgaacaagggagagagcgagagcgagagagcgagaacaaggagggcagaatggagaaaattacggaagagaccgagaaagtgaggggaaagacaggggaggaacgcctgcgcggcagagccgcgctccggtttgacgaggaagaggaaggtgagaagcgtctgtctgtgtctctgtagaaagagagactcggaggcagtacagaacgaggaaaacggtctttttctccgcagaagagcagcccgaagaacacgcagcaagaagcgaaggaaagcgggagaaaagcggacttccaaggtcggcaggaggggagagagaagcagcagggagagactggagaggccctgctcgagttcgagagaaggaagacacaaagagacaggacgaaaatgagaaaaaaagtgagaaacgcttggaaagattcaacgaccagctaagcctgagagccgcgaagaagtgagctacaagagcagagaaggtgagtctgaggctgccgcgtaaagacacccgaagtgccaagggcctttcaccgttaggaagaagagaaaagatgcagggaaaggagtgaaaaaaatggtcgtttttctagcaaaatggagaaaactccaccaggaaactccgctattttccagcaagaaacgagagggcctcgcttcgcgtctgtgaggtgtacggacgcccgagcgcgtgaaggagaagagcgaggcgggcagaggggggcgtggaagcagagcgttgaccgagctcgttttcttcaaatgaagagagacatcccggaagaaacggaggcgcagctttcccctgagtcaattttttcttgtctcttccgagatttgtcatgaaacgagaaaacaccctcagcgaagaggagagaaaaggaattctgctgcaagcggacggagggcgaacacgggaaatgagggaactggaaacttcgttggttgtcttctcgcttctcgtttgggagaggcttttttcagaacagccttcacattttcgagtgagagaagaagagagagagcagtggaagcgagcgggagagggagaaatcgaggaacggcggaccagggattccaaccactcgagatgcgcagcaggaggcctgaaattgatggagactactggaccggcacacattatacatgcatacagatcgacagagatgaagaatgaacaagtagttgacaggaacagagtatcatagtggcaggacgcgcgtctgtagagagaggtgatttgggcactgaagatcagtttctctgcgtgaaaaggcggcgtcaacgtccccccttggcctttttctttttgcggttctcctccaacagcagcccaactgttttctctgccttgcaggtcttgctcgcacgcgacgcctctctcttgcactcgcgttcgcctctccacagccatctctgcacagttgttcactccttttcttgagcgcagaaacacgcactggactgctagttcctcgacttttcctgttctccaaatcccagttccctcgcgctttgcgcggcctctgttcctgaacaggtggcgaactaccgagagttcgatctcagtatcgtccagccaaacagccaggcgagcccaacagggaagtcgagtgactgaagagagagagaccggcgtagacgcttcctctttttttcagtgcttcgcttcccggtttcgcagcgacaacacaacagctggcttctcaactgggcactgcagtttctctctctttttccaccgccgtcgcgcttctcgcactgagatgtcgcagctgcggatacgacatctctggaagacagaggtcgacggcgacgcctcaatcagagggcgccttcagatttatgctttcatgttcttgccgaagacggctgtcttttctgtgcgggtgagacaatgccccagcgaaaaaagaagtcgaggcactctgcttcttactccgacaagacgtgaagacagtgtctgttgcgcgccccggccccgcgacattcgactgggagaaaacatgcttcctctcctccacatggcaatcaagtgtcaacactgagagaaatacgtttcgtcgacgacgcctcgaagacgacgcgctgcgtgacgctctcccaggtcctcactggacggtttgaacagagagttagtgcagtctctgggagcgagttcctctcgcgagtcccttcgttcagggaagaacctgaacttgcttctctcgctgccttcatgctcaaaaggtagggcgcgcatggttccttctttcctggtgtggagcgagctaaccatgtgcagacactcgtttcggcataaagtgaagagttttggacaacggagaaagccagtcgaaagtggtttgtgagaagcgcgtgaagggacgatgcagatgtacaatggactatcttaaagagagtcttcctacggaaacagctgctgctgctacgtctactgcctgtataatacagctcggtccgggtgtacttcgactgcttcagcacagaagcgcgattttactcgctgctccgcggatacttccatctcggcaaagcggatctcagaccgatgaagatgtttccatgtcgatcattcgtgtagaggtgtatctgtttccttttttcctcggtgtcgaaaacagagtgtgcgacaccgctccatatatgctgcctgtgcatgcgtttcttcccagagacagtggcaacttcactgtttttctctggcttctccagcttttttcgccgggtttcccagacgatttcccctcgacgtttcagcgaaaacgcgtcgagaaaaatccgagaagtctctctttcccgtttcagaaaagttcctcaccgggcgccgtcccaagcttcttggctgtctcgtaggccagcgcgtttcggagtttgtgacgaccagttttctggactttttctcctcgaaaaggacagagacgccccgctcttctgcgtcgcctcctcccgtgggctcgtgtttctccctttctcgctgcaccgggtgtcttcgcgcctctcttttttgcggagacatgccgcagactgcgacagctgctctgcagcaaacatggtcgtcccggcttttgcttgtatgtctcctctctggcttttctccctcaaaagaaaatgaagtgagagcgatttgacgatgtgcctctcttgcggaatca

SEQ ID NO: 1816 - DNA, 1433 bp, Toxoplasma gondii
agtttctttcttgttgctgccgctcacagttgcagtcattaccaacagtgggacagcgcgaacttgaaatcagtacggcactattaaggtatacgacagtggctcatctcccggggatcataggaagcgtacgccctcgtttttgacttctttctcgcaggtgatccttcactttcttctgacgctcgcagcatccctccatcacactcgcagaaaaacagcgtgctggagtcgtgaaaactgtttcgacttttttcgtcagaagatacttcatccggaatctctgcaaaactcatcttctctgtcacgacacagttgggtgtgcgcgagcctcaattttgcgttttgtgagggaactcctcgagaattcaatattcccagacacgacatgcgaggcagagaacctcagaaaaaaggtaagagattcggctagaaatttcgtctcgtgagacgagaaacagataacgtcagttctgctttgacaagacacagagagaagcccacttggtcgtcagaaaaacgcaaacctctttttctaccttcctacatcccttcctctctatctctctctccttccttctttgtacttcgctctatctttcttcttgtctcttccgacgcctttccacctcgattcctcttcatctgtttctcggtcagttcagctctgtaaatttctctcctctgtccaggaaacacaagaagagacttgcaagagagtccgagtgcttccctcgcgtctccatgagccagagaaggcgcgtttctccaccctcttcgagatggccttgcgccttgttgtatggatgaaaatttcccctccttttccttcaaaagggaactaccgtttattgcaagacacacgccaagggtgttttacctcataccttttttttcgttctttgattttaagctaccgagggggagacagggaatcgaaggcggaagggtgagagaactgctgcagaggaacaagtggaagaataagaaaagaggaaagggaagaaaacggaaaggaaaaagtgaaaatgcgaaagaaaaggaatgttgaaggcgtgagggggtggtgtgtctttcgcgatataaagtattgcatgcatgcggaagcgatgaacaagcgtgcattgtttctctcatgctcgtctggagcatctgaacctgagtcctttgcttcgccttccctcgtcctttcttcttgcttctcgcctcatttccttttctttctgtgcctgcactttcttcaccctcctgaccgcgcggcggagaccttccggagcgtctctctcccttctcccctgattcgtttttcacaacgctaaactaaggatctttcttacgcttcttctggatttgcctcgcttctcagatgcttcgcttttctctgacaagcacacgccgcttcgacggctctccctctctatttctctgaagaa

SEQ ID NO: 1817 - DNA, 2690 bp, Toxoplasma gondii
ttattttccgttgtttggtgggtgacagaggaattactctcttggctgtttaagcgctgcacgggagcaacgtgtgggtgtgttgattcgcatgcatgcagttgggccttctggccccccagtggcaatgcaacctcgaacgggctgtcgggaatttgccacgagaggtggaatgtcagggactggtaggaagtcagtgaaagggtgaagggtttgtgtgtgcggttcacgaagcaagactgggacgcgtacggggtattgtggacacttcagtcctatttgagcagcttcccagttttttggtatgaaccaaaaagtatacagttttaaaaaaagacaaaggaatctatctgccatcactgatagcgcaggttcattgtatgtgttgtgtcaggagtggagctgcgttatgtgaaatgctgtctcgtagaacccgaagacgcatgtagcccagttgcgcgttgttctcatctagctcaagactttcttgtcgaatgcacactttggagatgcggcggagctggttcatcgcagatggtgcacgtacttccactgaaaatgaaggcctttgttccctaaaggcaatcgctcgtcgagcaattcagttacgccccagaacgtattgtcatttgcggtctaatcgcacgagtatcgtagtaacacgccggggggtgaactacgggaggtagccgcacgccacccagcagcttttcgtggcagaataagagtcagagtttgagatgataacgctaaaggtcatcatagttgagatggaattcgagaaaagaaattcagttctctcggaaggccacctcattccgaagagcgacgcaacaacagcgagtatagtgcgtcatttgattctgtgatctgcctcgtctactgttacgatgttgcttccagcgttttgggtgaggccacagaccccttgtataaaaaagaaaaccgaccacactgggtgactctcgcaccgtgaaacggcccacattgggaccacaactctggggcttttaactgcaaacagatgacaagaatatggcactcaggggtgtaacgtctcgacaaattgcagatgctatgcgtgtgcaaagaggatcggtagacgctgtggaccgagcgtgaaaactgatggagaaacttcgaaagctcgagggtgatcaaaactgaaagcaacaggacgacggacccgttccttcggaaggactgcgatgtagcgtgtggtacgccttctttggtaattcggtttgccagacacacattttcttattatcgatggaaataggctcgagcctccggggtctgctggtgtgcagtcacatttatcacatctgcagtgtggtccaggtgacacaatgtgcttcaaaatcggacagttgtccaccaggtgactacagaggcgaagaaagtttgttgttccccttgactagatcgacacacatctgtttcttgcagaaataatgtgggaaaacacttggcaagaattcaaagcgtacgactgtctcgagagtgtgcactgtcgttcgctgtagcagttctctttgttgtcacgcctttagcctgctgaacaacctgagctaggtcgattgtgtactcatttcttttttctgtatattcgaatgtccttcggtttggtacggttgtgcggtctacctgatggaccaaccatcccacaggcgtacacccgtatttcacattgcacactgaaagagctgatattcgacatggtattccagcttaaagccttgaaacaattgagcttccgttaacagcgggttatttcgccctacatgtgatatgatggcgcctcatcgggatttcgtttactgctgaggggggagactgagagtgtggctattgagggtacagcatggagccgagacggcgttacacaatctagtgtgcatggaatgacgctgcacaaaaatatctgtttgaaatgcacatggtataggattcgaccatgcaaatcatcctcacccgtttgtgtggagagaaactgaaaacggttttattgtccagatgtgcgaggagtccgttgacctcaacagcctttgcttgtgcacgcgctggcttgatgtaagtggtcgggcagcccctatgcaaaagaagagctaccccacggtgcttaccaggagtttcacggtcgaggacttttcttactattgcttagccactccatccacgaaaactttttctccacggctatgacaggcaaaaaattcattgtcaacgtttttcacaagccgttcctttgaaactccatatttttgcatcgttgtggtccagtctcgtttgccgctgcatcgggctgcaacggtgcttcctgatgaaacgttgctcactcacagtgcaaaacccatgtcctaccatcgaagatattttctttttgaaaacccgcctacatttgcttcaaggctttctccagactcagttaatggtatttcactcacctgcaatacgtcaaaagattccctctctggagagtgctttcgcagcgccgcataaaacgtgttgcgtgagactgggctagcgaaggcatgcgccaagccgcagcgaggcagtgtaggatattcccgcacatacggttctcgtactttttaagttacgttcaggttttcctttcgcttggcagccatttcggtcgctgctgttgaaaagctcaacaccattcacccaaaagttgttcaaga

SEQ ID NO: 1818 - DNA, 1793 bp, Toxoplasma gondii
tcctcaacagcgctgagtatttccttcgccattgagtcgaaggaacaccctgctggacagcgcagggctctcctgcgttctcctgggagtctcttttttctttttttcgcgcgtttctgcacgatcttcctcgccctgggacgacctcccacaactcgagcggcaaacagaaagggagggaggcgtcgaacatataaacatggcggcgagaagatgagaagagagggagactgaaggaaagtgtagattaatggaacaactgtcgcattctgcagtgaggtgttgcgtacagtcttacaaggccgaggagcggcgacggttgaaggcattagctgaaagaagagtccttttctgcgccgaagagggtaaagaagaaagttgccaggggagaaagagggaaaaagagagagaagaagagagagaagaagagagagaagaagagagagaagaagagagagaagaagaggagcgacaggcgagaaaggagaggaacgcttcgaggacacaagggaaagcagttgaggaggaggaaaacgagggaggaatgcactcttccggaaaaagtcgaaaagtcagttgagaaagagagtcaagactcgcagggaaagccgggacggttgcgagcaacagaaaaaacgaagtcgcacaaccgaaacagtacataaacctgtcgaactcgttgccgatgaataataccttgaacgcgttttcaagtatgttctcgcttccttgccatgtaaaccactacacagagagagctacaattagtcgtaaatgaggaagtatttgcatgagtgcaagtctgggcatgtatctgaaccagcacacatgcaaaggcgttacaggaaggcgaatttccgatctgttctctgacagatggactgacgcggcccctccacctcgaaatgcgtcgcgtttgccctttatccgggagcgacgattaggcgattaggcaaccagaaagcggcaggtttccttcgctttcctcaacgacgcagagagagctgccctcctcctagtgtcttgccgcgccgaccaatgtgaccttcactgcatgcatgggtttgcgaacggctctgccgcgggaaaatgtcgaaacctggaactcggaaactgctgcaggtttacctgcgcgaaaggccattgaaaagcggaggagagagaaggccagagatcgggacattggacccgctgcgaggtcttcagtaagactttctctcgcaggaaaagctagcgtctttgcgctagcccacggccgcgtgtcgatgaaaatcgctcgagagccagctctcagggtgccggagaaagcggctgatttgagtcgtgtggcacggtttttcgcgggcataagcaacccttcgccgattgagtcttttaaaacgcattgattttcaaatcggacggatctgccgagtattttgaagactgtttcgtgatcgaattccttcgtttcgccgcatgcaggcgatccaacgtcgaggtgaggacacttataccgcaaccctaagaagagggtgaattgcagctcaaggcgaaccagcgcgaagaagaaaaagagaaaactcgaggctttgttatcttgactttcacgaagcccctccggagcgcattgttgaaagcactcggcgccgaaatcctgcagtttcggtggtcggccgctcttgcacgggtgaccagtgggaagccagatcttccggttcctctctgttaacgcgatcgttcaacttgcgactctccggcgagattcatgattcgatttgtgccacggcaactcttctcgctgcagcgcacca

SEQ ID NO: 1819 - DNA, 2682 bp, Toxoplasma gondii
tatttaacacaggagtggaaggtgttattgtgcggtgaatcgtggtccatgtgcaagacctgcatcatgcgtttttgggtgacgaaccctccgatatagctccttcggctgatgtgaactagaaggataagatgggtgagaaacgatgagaaaactgttttgttgatattgctgcgtcagtcgtgttacgagaattcaggcaagactgagaagcacatgattggcttgtccatcgcataccattatagatttatggtgtcagcggctttcgtgtagacttattgagtgtttttgacgcgagcatattcgcgggactatcgaatacgcttagagggcgcgagccggggcggctaacgtgatcagcatccttttttcggagtacggaaatcgaaaccagatggtaacactgtgaagggccatgaaaatttccgaaagcctaggttcatcagagttcatagatatgctcgcacttacttcccagtcaaagaatgttcagaaaggcaccgcttcaatcttctttgcattctcaggattagacagtcgcactgcagtactgtcaccgctccagaaatacgcgtcttctcaaatcagaaagtcgaagtgctacacgtgtctcacgcagggtgaaggagcatgccattaccgatgtagtatcatctgatcgtatgctggggtgccgccagtaaacgtcgggagcgggcagccatccttcacaggatccccagaaaagatgtggacgtttgtgttgcgcgaacctgtgaagtccagctgattaggatttgagaactgagtgaacgattgaagtgcggtgaaacggccacgccacgctggtgaaccggatgtgttatatgcctgttgccgtggtgtcagtcaaattcttaaaaagagaactatcattgcctcccgatgcctcagatatttctgcttacacgatttttagtcgaagttttctagcttgctgtagcccggctctcgaaggactgaattgttttaagagagaagccgaaaatggttgcctcatttttgcaccagtttttatgtttttacgtgtttgccaattagtctaatctgttttgtttcctgcattcaggtgtgcggatatcatatgtgtgtgtgtttcgaggcttgtgtgtcacggtcgctaatttttctgaagcaattcaggaagccctagcccttccttcagatccaaggacactctaggaccccttcatacagtgggaacccttgactatgcaggttctgagcactcgctgtgacactcactcacattcatgaggggaataagaataatctcgtcaatgtataggcttgcaaatgaaaagccagtatttctagacgcagaagtcatcgtttaaatgacactacaatctggtaaatattttaccctcgctcgtggccatggacagcccactcagcaaaacggatcaaggaaactgtagcatgggggacgtctccagagtccactcatggagcaagaagtcatacctgggtctgggttctttgacaacacacccgatgcagtgtgtgcgaacaaggagtgagtgacatttcctttgtggctgctcttcagcacgcgacggcgcactccgacctcaaccggcgacacgatgggattgtgtccacaatgtgcgtctgtctccccttcgcatgcgtggaaaagtgatgctggcgcgcgaaggatcaactataaaggggaaacgtgtgcttctgcgaagtgattctccccacttggcagaatcgcttgcgtcgaatcaacttcgcccgcgctcccctgtgcggcggacgatggtggatgcctgtctgaagacgtggtagtgtcttggcgtggtgccatttcagcgctatgccaatccactaggagacgagaatgcaacctcgaacctgaaatttgaagatacttttacaaatctgccgttaccaatacctatgtgcagatattccgacggttgttcgccacttcggtcgtcgatattgcattgtttgttgttctctcttgtgccacagtctatggactactcagctgcagcgctcccccagctagctgaaacaccgagtgactactttgacttcggacgaggaaactccgttcaagtggccacctttgtgaaagagtccttgtcgtgcaggatgaaaggaagccgtatgcagcgggcggacttgtttgctatttctactccatagtgtcgcagaaatcagccttccgttgtgggcacggtctctgggtttacgtatttcgttgcgccttccttggccccaaccacgccgtccactcgggcgttgcccgtttccttcgtccgtcccagcggtgtctgtagggccaacgttttttccatggcacaaatcaacaaggtgccagtacaagtggtctgaaaagaaagtggcctcccttttctgttggcgtaggggagaatagtttctgcaattaagctctccggcggcagaccacatgcgagggtcgacacggtgcctctcctcgtgttcctgccacgtgagttcaattttcacaggtggcctcgaacctgtgcattttgtgtttgttcagtcacgattccacttcaatttgcgagaaaggccttaaaccccctcagccagtattggctttcttccgttaacggcacacgtgagcaatgggcgcgtattcatgttttccattctccagtccgtgactttgaagaccca

SEQ ID NO: 1820 - DNA, 3242 bp, Toxoplasma gondii
tctctccgtgacaacggatttgcaacgcgtttttcgtgcactggaaggtgacagcggtcaaaatgaggaaagtggggttttggggtttcccagtagtgatgcagtgctcgtcccgcccttgcgtcatttgcttcttcgtatttgtctgtgagaccgacggaaatcttattttcaagtgagtgggtgagacttcattcggacatttctatgttagcgcatcaaccccagcagttgatgtgattaacagtgaagtttttcacgtgttcgtgtgtttccgattatccgagttggctttgtccacgcgtttgcgcataagagctgtcaagatgacataaattggacgcgtatcaaggtaacagagatactcagccgcatgtttctgtagggcctgtcccgaggaaagatcctcatttcctgtctggttaccggagatgcgggtgccacggtgaacaccccacgcacactcatcttttcaactttactgtcgtcttggtgcaaagccctttcggattccttgtgttcgttgcgacgcatttggggggcgtgagcaggcctcccccaccgcataatatgatagcaactaccaatcaggtacgatataaatagatagctatgatgttaaggagcataggaaatgctgcacacctcagttcattgtctggagacagagagcagcagcgactgttgaacggaggtatgatgcacattactactcatcaagacctctgtggatgtcagcagcggcatcttctcagagcggcgaattcaccgttgttgcttcttgtcttgcgaacactctctgcttcgaatgatgaaacccagagaacgtgcggccacggccggcgctaaggagtatgtatcagcggctttgggaaatgtatactacgagttgaattcgtacttcagattgcggatgcctttgtttaccgggtccagatctcctgcgtaagcagaccggcactgacacgaccggaggaacagccccagcatttaaagcaaaccacccgtcgagagatggtctttctgtttgtgtcggctctccgtgaaacgggcgttcaaagaggggctgttcagttcgttgaaaaatgcgtcatttgaagagaatttctccagctaagccgaacgtctgttaccccttcctgtcggcaaagcattccacatttgtatctgagactagagtagccttgcacatgcagtggccattttagtgaacgtcgataggcttcgaagggggtgtcaagatgtcctgccttcaaccttccttcccttgaaccagtgaagccatgcatcaaattactttcgtgttcatctgagaaatacgcggcggctttgttggtggagagttccgtctataacagaggctttgtctggagtgctcggcatggacacatggacagctgcgcatcatcatccgactacgactggtgccattgttatacaacacaaaagagacgcactacgtccccttattaatgtcatctcttgcacgtgacgggcatcagcgaaaatctggatcttgtctgctggtggatatcacaccagcagacaaacgtgaaaacaagcccccgttcgcaaaattgtatctgtgttttcaagacctgtctggctgtccttgatgacctttgatctcgccgtatcgtcaatgtatgctgttcgtcgaggtggaggttcatgggagtttcacacgctttcaacttagtcccgcggcatgagctcttcacgtgcacgaggacttgtccaagtctgccactgcatcccggaaagacttccgacaaagcggttcctgtgcatcgttgtcgtgggagaagtgcggaaatgtctctcagcattcgcactgaaacgggtgttgactttgtccgtttaagttgaggaaatccctggaagggacaagcaaacgtagtcacccgttgcgggacgtaactccgcggaaaagagaaacgcgtttgatttttcggaagtgtcacctttccccaatggggatttggagaggtgctttgcccgagtctcagtgcatcaggtggaggagcaaacaccagcgataactggggggttctctctgcaacttttgaagctgcgaaccgcaattcctgcgcatgtgtcacgctgtcacacgtataacactttccaccacccacgtctgtgaagacatgcccggactgcgttttcttgatttccagcttcctttcccttctcaacccagttgtgactcgccatttcgctgtcctttctccccctctcgtggtacctttcttgcgtttctactcgccagcaccatcgcgacaccgtgcctgcgcggagccagccgtgtgttccacatcgtgagaagacacgtggcggggacccccccttttcgttttggtggggtgtacctccctagttttggactcgtttcggacattgcccttgcgtttttcccacctttgccttgaaatactacaccgtggacttcactgccgcgttcctttccttatccagtgtttaggttccccttcagttcactggagggtggaagaagtgtcgcgggcgaggtcgtcgaccacgcggcgacctcggagaagggaatccgagacactttctctttcaggtgtttgcggaacgcacgcaactgccgtctcttttttctcgcggctaagtgcatttgttcgttccctgactcgttgggggatcgtcaggctgcggctagcgccctcggtttgtctgcctcgtgagaacgaatcgggaaagcagcgggactgatgatcccaagaccgtcgtcctgtggaatcagggtgttttagggcggtcgcggtgccttggacgtttcgtattgcgaggaagccagactgacctgcagttcgcttttgcctcttcagccgcctcgcacacactgaggtggacagaccttcgagcacacagttggcatctaccttcaggttttctgtcggattccgcatctcttcatccgcaaaagaaacgcgtcggctctctctcttttccatttgtcctccactgcacatctcggattctccctccctgtccgaccacctctctccagtgtgtccggttgtggtgaccccgactgcgtttttcccttgcgcgttccccttgttcctctctgtctcccatctttctgctcagaccgtcgactcgccgcctctcgaagccgtcgacgttccccactgtttgtctgcgcagccgcgtaccccagcgcgaagcctttctctcgaggtctcgctctcgatcctctccgcgatttggcctca

SEQ ID NO: 1821 - DNA, 1574 bp, Toxoplasma gondii
gcattccaagaattgatggacatccatgcatggcagtatctatgcctatatgtccaaatatgacatatatatacatatatatatatatatatatttatatgtatgcaggcaattgggctttagtgtgcgagccgtatgtgtgtggagggccgttggttgcatgcaagtatgtcaagctttctgtgtctcgatgtcgagaggtaatgcggagcttttgtttgggatggagacaaagcattcagttcgctttacaggattcgtgtttcgcgcttgcagagaaatcagacacaggccgtaaaagcagaaacagtctccggtctgctgttttttcgtcgaatctcaggggtcctggggagtccagacgttcgaagagtcattgagaaaggacttttcagagacagaaactcgggagcttcccgcgatggccagggtgggaagaaaggagactgcagtctgcagaagcgagcaagcgcgtccgctcatacgcgtgtgtgtctttcgtgaaggagaaaacatcttgccagacaggagcgaaacgaacgagctgtgcgaccagcgaccaagggggagaagaggctcttcacgaagacctctaaaaaaggtttctcgctgattgtcgaggaaactacggcatctccagttacatctatttgagtgtaaatgtccgacactatctcgtagatctttgtgggctgcgagagagatgagccggtgaaaaaaagaaaagttacggagtgccttttcttcctctgctccttcgacacagccttgaaagaagcgccaaggtggcagagacgtcgagaagtaacgagagcgaatttcgttagaaactccgaagcagaaagacagcagaaatcgaggtttagggtggaggtgcctccccccccccccccggcggcagcccaccgctctctcgcagaaacgtttcttcctttgttttctcccttttccttcctacctgcctcgtcgtttctctcctttttgcctcgattgtgctttgggattctgcttcctgtctcttttgttgtcttctttccgctcgagtgactcgtgaagactcaaacatgtcgatggtgccgacgagcgaccttgtctgcatgtgctcctgtgcatgcatgcgcgctctgcagtgtgaggaaacgtttgcggcttttcccttttgacaggacgaagttgtttctccccttttttgtccaccgttttctcttctcttcagctcgcgtctcccttattccctcttcttcgaaaccaccatttcgtcttttctcttcctccgtgcgcctctctctccccgctctctcgctctgtccgtcttctctccagatccttttcggccgcttgcttctcctctcccgccctcgtttctctcttcttttttcctctctccgtgttttgcctctccttctctgccaggtttttcgtctcactcgcagcggctccctgccttcttttcgagattccccttggctcacgcgctcatctttgtgtccgcgcatctcgtcttcgttccttcttctctcgtcgtttgcctctctctctctcccttttaaagtatataaatatatacatatata

SEQ ID NO: 1822 - DNA, 1837 bp, Toxoplasma gondii
gaacctgtacgtccgccgtttcctttcaacggaaggaaagtgaatgcgcacaagttcccctcctcctccttagtctttcgctatgttggatcttttaaaacgtttcttttttctctttcccccctaaacgttccgttccccacctcgcaggaagagcggcactgctccaggttctcgagggtgacgccagcgtcacccggggcagtcgcttctccgagacatgcgaagaaggcagttgctcgctcctcgcatcctggacagaagatgttgccgaaagaggcggagaaagacagaagaagacgcaggtctctcagtgcctcttggagcaggagactaggagagccgtccagcaccgcgcgagagagaaggcgcgcggcaggagagtaagaagaagacagacgaagaaaaacaaaggaacgcacggaggaggcgagaggcggaagccggtgtgcaaaacatgagagaggaagaccaaagttggcgaagacacaggaaggaagaacaaaagaacagcgagagagccagttccagagagggaggcgggagaaaaagagacacaagaaaaagagaaggatggacagtagaaggacaacgcagaatcggagagcaaagaagaaagaagtggagagaaacaagtggagagaaacaagtggagagaaacaagtggagaaacaaatgacgaacggaacgtacctttccggaccaaggggaagaaaggagggaagacgaagctcgaagaactcgatgctgaggtgacagaagtcgtcattgcttcctttcttttctctggatcctattctgttccttctccttcgtcttcctctcctcctagctgcttactctgtcttcttcctctctttcttcctctctttcttcctctctttcttcctctctgcagctcgcttctcgcttttcgctttctccactctgttgtctgttctttggagggcaggtcaggaggcgcatggccctcgtctggcctggaggaaaacgagagagaagaagacaaattgcgaaggagaggcggaaagacggagaaaaagcaaggcatgaaggagaaacgattagcagacgcgccccttgaggaaagacatgcgaacacctgcaggtgaggcacagagtggaatcgaaggaaacttgaaaatcggtattcgtgtgctcgtgatggaggcctgaaatccgtttgcgtttggaggaaaaatctggagaaggaatagggatttccttctcgtttaaaaggagagaaaagcggcgccttcgcttctctgcacacggttcgcgcgcttgcatgcgtccggggtctgctggctataaaaacatgcacaagctgacttgttggagcttcgaacgaaacgagggaatttgctctcatgtttctggaaatcgaggaaagttttgtggtcttcgtcactgagaaaacatcccgatttctcgcgctttgacttccctctgtgtgccgagttctccgtccttctgtccattgcccctggtccatgcattctctgccgtgacgcgcgcctttccttctgccgttctcgatcttccttctgcacacaaaggagtgaagaacgcaaagactcagaaaaagagaaagactcaaggacggagacaacagaggcgttcgcgaacagtaagaagtcacgagcttcccggtctgcttcgtcctcgtttctcaggtgccttcagtcttcccctgtctgctttcttctctctgtctctgttgcttcctccacatttctttttctccttcactcgcctgtccctttcttgtccctttcttgtcccctccctgtccctttcttgtccctttcttgtcccctccctgtccggaccaaga

SEQ ID NO: 1823 - DNA, 2386 bp, Toxoplasma gondii
gttccttcctcagctgctccttctgaagcagccagagctgctgatcgcgctcggagacgccctccgccgttgacacacccgacggcgcgtatacttcgacgtcgtgctcgagggcagtgaggcgcgcaggcggaaggtcgccttcgctctccagtacttcgcgcttcgggagaacaggcaagtcgacgtcgagaaagttcgtttttcgcaagcagtcgtccacgaactcgtccatgcaaacgatcgtgaacttcccgtcggccaggcgcagccgcagtttccggtagtccgcgagcagcggctcgaggtgcgtgtacacctcgcaggcgcggccgacgaggcgcaggtagaaggcgccgacggcgcgcagatacttgaactgctcctgcttgatgaactcgagaatgatctccggctctggctgaatctgcagcagcttcaacaccaagcagagaaacggcgcaggctgccgcttcccgccgtacgttcccccaacgtacgtcaacccaacacagggctcgagaacggtctctgctgtcaacgcgaagcactgttccttccagaaggcactttcgtagatctttcggcgaatgatccgcgacaccagcgtctgcggattgcagccgtggacctgctgcgcgagtggatctgtgcgattcgccatgctcggacactggcgaagaaaaacggggcagaagaagaagcaacgcgaaggagcggagtcttggtacgagcgcgaggaagtggagagcagagacaccaagagggagagacggggaggagagggagaggagcagaagaagaagaagccaagaagcacagtttactttgacggaggagcgaggaagcgacggaaatcgagagcggtggaggaggagaggaagacagggggaacggaagacgagcgtccaggaaacaaaaaaaggaagaaagggaacacagagctctcttaaacagttccaggcagcgaaggaaaagacgacgacaaagagaaaaagaaaaagctaagagtttacattcacgaggcccggtcaaggacgacaacgaagacagggacggcgcgagaaggcgacgcaccgggagggagaggggaggaaacgcgaaacgagaaggaagatgccaacgtggagagtggagagatgcagaacagaagaggtcgtcaggaagagaaaacggcgagaagagaggagcctcaagagggtggggagaacggggagaagaagcatgcgtagtcgttcgtttcttctccccggaaaaagggagaaaaggagggaacgttatccattcacaacggaggaattcgcaccgctgaaatgtttcctccttctccccacctcgcagaaggaccccaagtcggcttgaaacgcgacatgagttttctaccgcaaaaaaggaattttcacagcgcaccccagggaagaaaacgaactcggaaaacaagtacttcaccgacgctctttcctcgcgaaatcgggcagcgagacaaggaagaacgcatgcagtttttacgcctcgactcgagccgctctcgctagacgcggcgcagccagcgagaagagcgacaagacagccggcggacttggcttcgagaagggaggaaagagaggaaaacgaccttcctttccccgaaaaaagacgcacagggcatctctgctcaaacgcctagagacgccgcgcctgctctctctctttccttgcccgccttgaaaaagaatccgaggcagaagctgccgacactacactgcaggaccggcctcctctcttgtaccgcgagaaggacttgggatttccccggtggttgtacacccgactttcgcacactgagacacagggcgcgtctcccgcgttgcctttttcgctcttcactcgtcaacaaggccaggctgcgccgctccggtctcttcttgcccgcgctctcccgccgaagccgcgagactgctgctctctcagagagaagagcggagagcaggaagaagctctactcagcgaggcagaggcgagatggcgacgccggcagcgaggagaagagcgaggacagcagaagcctcgcaggaatggtgaagagaatcaacagataaagcgcgaagacgagaatcgagagaagagtaggagggcggaggacaaacggcaagagaaaggaacagagcgtatgaaaatacgcaaaacaatacgcgtcgaagcgccggaaatctcgaagaaggactccagagttgaaagactctgcttttcctccggaggaccttttgctgtttttcactccaaaacgtcaccctgttcttctccgctcgaaataatgtctcctctccatctcagtcgtttcttcgcaagaaaaaacgaccttcccagttccaccacgaaagagatttcttcttctccttcgccgcca

SEQ ID NO: 1824 - DNA, 3271 bp, Toxoplasma gondii
tcatgcagcactctcgagtgttctggtcttctacagccgaccgcgtctatttcctcttgagtccgtaaaccacgcaaatctcaattcccttccctgctcggtttgtcctcagagagcagagcctcgccacttgattgcatgctgcttcgcagcggctgcgtcattcgccggaactccacactggcacgcggcgttgcttttccacgcgttccacgttcccgtcgcaggacgcgctctcgccgcgggtgtatgtacaccggagagaggacatggagcggccgcaggcgaaaaaatggagcagctccgagatgcgtccgcagtttgtgcgtccgccgacggcgaaacttcaaccatcacgtggccagcaaaattcatgcaaccttccctgttcagccttctcacttgtcactcagaaacgcaggctcgtaactccaccggagcgggcgtttcgttccattcctttacgactcctgcgagcgagacgcagttgcctcgccgtttgaaggcgcctgacaacgtgcagtgggcgactgccgtcttccgcggccagactcaatccacagaggcgggcgatgccgcatgctgccttagttctgcctccagcaacgtggcggcggacgaaaagagacagaaacaaggagagagtccgatatcggagggtcgagaactgcagcgtgggagccgtggacaccctgtgttagctgcggacagatcagcgtgttttcaaacagggtttagcaccacagaaacgataaatgtgacgacgacagttcaggcactgagtgcatgtggtgtgacagtacagacggtctctcagcttcaggctgtgcttctgcacttggcttttgagttgggtgatatcggaggactctcagctctccacctccgtgtcctgcgcgcgtcaatctccattttggattactttcttcacacttcgctcccttacgaccagatgagggacgaacctctggatgacgggaggaaaccgtccaagtcccttctcgagtgtcccgacacaaaatccgatttgccgacgttcgtgggagaacacttgagttcgttatcaccttcgtacgatagggaagtctgtggaaagcatgtttcttcctttgattcatgtgaaacggacgggggtagtcagcctcacccggcaatgcagcaggcatgtccccgttctcccattaaatctcaagggaacgtgtgtaaagcaaagttgagaggccgcggcaatgacggcaatgccataggggaggtcagtccccactaccctgatttacagagtttgtccaagagggtgaagtcgtctcgtttacactgtgaggttctagacacagtgcgtagcgtggtacgagtggaacgaaaatgtgagagtcacggaaacacgctgaaacaccctatgcagaaagtcggtccgtgtctgatggtgtccgaggcactgattccgccgtatgtagtcgacatagcggtcctccctgtgaaccgttatcgagggagctgtaattgggtgtgacaaatggagaactgcgggggctgaggaagtcggcgtactttcatggttttctcgaaaaaagagtgttttgcttttgcgtatctgttccggtatttgcgcctctcgtttctcgttttttctacaccacaggcgtagctgctcactttttagcccgtttcgggtccgaaagaaacgatgtgtcagcgtggtcgactcttggcaagaaagtcacgcgtttgtcgtctttttccgcctcacgccggtcgaaggatttcagtcgaatttatgtgccctttctagatcacagaactgaacgattcgatagttctctcgggaaacatgtctcagtcaagcctatatgggtacgagatacactttgcgcgaaagtgccgggtctctgcttccgattcctgtagtggaacgtggccgttctctatcatcctacacgcggtggtttaggaacaacacaaaactgcgtctttgtggcagaaacgcgctactgggcagcagctgcccgcacatacgccgcagagaccgcagtcatctccgacccacaagaggctggaccgtaagagtcagacacttgcccttcctaattctgttcaggagatagtttttttttccgataacaagacccttcgacactctcttgctgttctagatggcaggaaacgtgggcgttacttccggctgtactcgttgtggcagtagattacggcatgtacgattcaagggtgtgagtgttgtgattttacgacgtggagaaagtcctctgttcgcaaggagctcacgcgttcttcaccgaagtacggaattttcaaaagacgcgttctaacctgctgcagacacgtcaggcaacctccggtgagacggtgagggtctctcgctgtcggtcatcgctatgctgttcacagcactgcgagcctctgcatgcgcttgcagtcaccagagagaacatcctcgaggcgaaaaagctctgagaataaacacaccttcgcaagtctccgcggaaacatgcgtccccttactcgtgaccgttcagcagtcagcacaccttgtcttgtgctctgctcgccagcgagataggacactcacagtggaggcggcgtcggcgcagaaaatgggtctgtacactgctggatgtttctcagtttctagccgatctggctgccacattgttttcctgtccggcaggttcctccaattgattgttttggaggaaacgcacaaactatgcgcccgaggaacaagagcagcggcgtggccagagtggacctccagtgaggggcgatgccttgccttgagcgagacagcgcgttgacgcgacaagcgtgcaagcgcttttcttcgttgttttgaccaggcactcgtttctctgtcgcatctttgacattctctctctcacgtagcattccttccatgaaaactgagactagtgggcgtacccgcgagctgcgttctctaacatgtcgcccctccacagcaccgcaggtgacgtcgtttcctgatctcgaactcaggcattcggaattctttaggaaaagccgcgtctcaggacctgcagacgccatttgtatcgcctttttggggctatctgccccggttttggccgtgttatctcgccgtgtctgcgagactcgcgtggtgtggggacgcgcagcaaacggcgcgtttcctgcgccgcggaacctgcagtgcgttttgacctagcccttaaactagaaggcatctgagcgtctccgcacggtctccttcgacgaaaaacaaagacacaagcggaaa

SEQ ID NO: 1825 - DNA, 4789 bp, Toxoplasma gondii
gcgcggcacgttcgctgcgaagacgtccttcgtctgtttgtcttcttccccgctctcgtgctcgcctgtctctccacgacgaggagacgctctcggcactacctccggtttcctctcggtcttccggagaaaggagagactgcgcagaagcgagttggtttggcttccgtcgatctccacgccttcgcactctccaaagcttctctttttaagacactgcgactgcccgtgcatgcgtcggccgctcgtgctcgtcgggctctctccttccgaggaggaaagaactgtgaggtcgaggaagaccgtctcatccttcttttcggattcgctctggagactcggcgccgctcccggttgtccacaggagcgcctctcgctcgtcgcctctgcaggcgtttctcgcggacgccggtcgcgtctgtgtggcgttttagctgtcgaaagatcgctgccgacgcaaccgctcagcgcccccatccacagaccttcttctgcctgccgggcggggacccaggacgaccgcgaaggcagaggagacgacatgtctgctctgagggctccatgctctttaactggatccagagtcccgatagagagcattcccacccgactgcagctcctggccgggccgcaagccgtgcgagcgcggccagccaccagactccagctcagttgccggatttcttctcggctgcatgcagcggaccaagagcgagttgacgggaagcagagcacgtctgtttttttaggcctgcgactccgagagcgtttcttgtccgtcgtccgtcattcctttgtaccgcaacagtttctcacttgtcttcttgcaaggagacgcacgggagaagagggatcacaaacacaggcaaaggccaagaatgcggttaaaaacaagtgtgaggcggtgaagagcgtgagacaagctggagggagaaaggacacaaagagagcgagcaagtctccgcgttgggagaacgagaacggggtgggtcttcactgattgtggagtagtcactcgttttccttgacgctgaggacggggacttttgcggcggcagtgcctgtagtaattaggcatgaaagctccgaaggagagaaaagttcagccggaaagcttttcacagggaccttttggatggatggaactcttgggaggcagacgccccagtggatgttcgcttgcagcagcgagagcgtctctcccgtggcgaatgagcagggtgcctgtatagaactcaacgaggcgcccgagagggcggaacctcgccggctgaagatgtgatgctagatcgcatgcgggagagatacgagacacacgatgaagcgagaaagccgaacttgtggtgaagaagaatatcttggttgcctgtgaagtaggggtaaaggggaatgaaatacttccggacggggaattatctcatctaggtttggtgggtcacccttgtcagtcagaaaaagtcccgccttgtgacacgaggaaattccttgtgtcaagtggaaaaaacggatataagacgcaagtatgaaagatagcgaaggtcgcagtgtgcgtggagtgtcgttacaactgggttgcagctcacagccgctgtggcttgcacgacgctgggtcggcaaccgacgatgttaacagcaagaggaggaagacttcactcagcacgactgtggagagagaagatcgataatgactttcaagcgtcagctgccgaagcggtagcggtatctgagactcggatgcaagtcgacaatcgtagaacagtgttcaaagcgatttgctggtcacttcctgccaccatgcacacagcttgccaccgccgggaaccgcgactacgagggggcagccaaggaatgcagggccccgaaagggaaatactcgcatgagacaagaagtagtagtattttgtgtataaaaacttttcctgacggggactcgaaacgtgtgcttcaaggtacaaacctctcagagctggaggcgcaaagaagaactctcccgtgaactgcatgcacgtggttaccctccagagccgaagagcgccaggaaatcgagttagagggccgaagattcgccattttcctactgttgtgacagccaccgaagtccaaacggaacgatgagaaggatacagccgtcataaataacgacgtagcatcgcgtctcctcaaaccgaagctcacagtggcggtaagaagtacagctgctcgggtgtgctgtgccagtgtgaaattttctctttccgttctcaaaagctggatggaggcacagccgcagtacttacgcgcaagcgactatgagagttttgcagctggcgcagatgctcgttggacgcacatccagtcgtttcgtctcgcaggctgcgctcgtcggaaacgtcgaggtgtcacgagaaagccacggaatgagactctcatattgaagagaactgctgaatggtacaaatagacaagtgacagtctactccaagtggatgcttatgaggtcactgaacattcactttttcgtagcccttcaaactgctaaaggtgcgcaaaagaattccgtgtactgacgggaggtcctcttaaccaaggcatatggctgaaaggtgtacgcaccttgcaaatggctcgcgcaatgtctggactgcccatcacgtttcgttgaccatgtggatttactgcgattatcgcgtgcagaaacgggattatttgcttgagagcctgcgggggaacgggagagtagtcctctgtcgcgattctcgtttctcggggcagagcgaccatcagcagtattcgctggacaaaagcgatactccgggtagtttgagcagaaatccattgttcccttttcataccgtcaaaagctgtacagaacttggtacaaagaagtaccagcgaatgcggtatttctgaaccaacccggacgcaaaacaagttgtcacaccacaactgttgtttagcatcagattcgaactgtacattgaccgttcaacacaggcctcgcttccccgccacgccatggcatctgtgcctcagtttgtccgatgcattttggtcatattgcgacttcgcgtaattaaagagcttctggatggaagatactgtcaacgcgttaactgtggcccagcgttcgaaattttgcaaggaaatgtccatcgtggggatgcttccgacgttcaacccttcctcgaacgctgcgtatgttgttccgctaaagactattgatatgacgtatgtgatattgaggtgatcgggtaggctcccgcggtgtattgtgacggtcgcacatgccgggacgatcgacagaatctaacggcggcgaagttcactctgtgttgagactgcgctaacagtatctcagccaatttgtcttgcatgcgagcatgtgcaggttaagccaccgaacaatgacgcaaagatgatcacaaaataagtgctggctaaacgagagggaggccctcgaactgagcaagctgcaggtgctgttgaagaggggcaccgtgcctgtagcatgcttaccagaaagttacaattaggtctggtttggtagccagctgcaaatgccgtcaatacccgcagttgtgtgcgagccaaaacactgcctgtcgcctacagtggcatatgcgaacaaggagggtacatcgcagctacacctggtgtcagttacaagagtgatatcagaagctgcaagtagcgcaaccgacatcgagtaagtgttcaacaagtaaacagtaatatgggagaaatgagatgtgtacgcattacagtcatgctttcaagtgttttccgcaaccatacacgagaattgcaaagcccctgcgtctcgagtaaaccaataccgggtgggtgtaggactgctggaattaaggagataacagcatccacccgcctacatgaagacagcctacaaacgtagacgaattcggaggctgtcggcagtaggcgaaagcaacagcgattgttttccagcacctgagacgagaacgcttgtgacgaagcctcatatgccatgcttgttgtccgtttcacctgctggtcacgaaccatcttttctctgcgttctctattatgcacactttgtggcttgcagttctctggcgtagacgtttagccagaagtagagtgtggctgcggctgtgccgagaaaaaggccacacccccgtggcaggctgtttttcaccgatccgtgaattctaagctgtccagtacccttctagaagctacattgctggacgaagactggctagctcaagaaggggaaagcagaagtcactaagtgaactggaatggatgtggatgtaggtctccctacaccagagccgcttgccgcgagcacacagcgggaagacctggcaagacgggttgctttttggttctttgcatgaacactatggctgcgtaactctttccaatgtggtttccacccagctgcattttgtgttggaaatgttgttttatgttttgtatcatatggtgaccatgcaccttcaattgttcctgttatccctgttttttccatcttagcggcactagcagcacgccgttggtcagcgatgcgtcggctgagcttatcccctggtgtgatcacgctatgcgcgaaacattttccgcacgaattcttccggctttccacacgctgtttcaatctgtccctccgtcaagccactgccctgtaggtcgaccacacgttcacctcgcaaaacgtcaggcggacgtcgaacacgccagaacgcgtctgtgtgtggctcaaccatattcctgtcacatttggctggcttccactctcataactcatgcacggctaccgaatcga

SEQ ID NO: 1826 - DNA, 4984 bp, Toxoplasma gondii
tcaggaattgttaggagtgtgtgtccttgtgtttgaatcaatgagttccaaaatacaggcgtaacgactttttttccaggatgccagtaaccgtgagagtatctgaaagaacgttatgtccattcctatttgcatacatcttgacttgtgcacgcctttccgcaataatatgctttgcggtggaaagttctttgtgggcaaagtgctgcagtacaccgcaatggaagcgactaattgtatgtaggggcactgagacactcgatttgccgactgtcgtgcatggtgcacattggtgcaaatgcatttttttggcttagctcgactgagtggaatgttctacgcttgcaaacaacaaacccctttttttatttgaaacaagcgtgtggaaaatcctggtcctcatggttttgactctcgaaacagtctcctgcccaccccggcgtcaagcgcaaactctctggaagtagcactacactaaacagaaactgttcgtgcttcacagattccgtagatcgtggtagcctaaaagcgctttgggttcacatgaagccacgcgatgattcacaaagacaagattccctgatctccacgggaagtgagaactgtgactaggcaacatcgggtcttcttgcgaagatctcaaagtactgcgtcggcgtagcagctgctttttgtgaaatgggttctcaaatgctagcggcggatgtgtttcacatccatatcctgcaaaggaactccccaaacctgcattgtagaaatttttgtcacgtctttcccaccttgattctcctcaataaagagccacagtgaactagtcacaccgaagaggagcgcagggagggggaccgctgtcggtggcaaattgcgtgccgatgctataggtccgagggttgaagaattgaatggggaagagcctcgcttcgaaccagagtttccaggtttaggggactgggcagtcgagtcgtgagatcggcagagatcttcaggcaaaagatgcagcgtgtggaggggctttacggaaacggcgtcactgaaatcaaaggttggaaggtccttgtacaagtggatgacagatggcccgtgctgcacctgaatttcgcaagagcacacgtaggcgggaaaggacgttagaatcaggacaagtgagctgacaaccgaagaaagtgtgcttatgcgcccatgatattcttgtctgtggtaaactcatccttgtagactcagggatatgccgactgagtgcagcgttgaagttgccacgagcaatcacagattgtatggcagacgaccagtgaccctttttgccgaaaactccggtggtgattctgtgttgtgcaatgaaggattatctttggctttttttttcaggttgaggaccgtcggtccctagatgagttgggggtaaagagatcacgcaagaactcgcggtctgtgtgcttctgcttcgctggtacaaaagtgcagtttcgtaaaacatacctggtctgggtggattccgagggagatacccatcagtttcaccttgcggttgaatggaatgtgaataatcagctgagcatcatctgcactggacacgaaacgttgtccttttctaggtctgccagctctccaatcacgagacgggaacggttcctggcaactgtcattcaggcagtgcacattcgtccagtccacgaaatgctcgaacaaatttacacacagcctttcattgacctggaacttagcattgtgctgaagaccggagaacagatactcttcccgatgatgttcgtctacctccagttcccctgcatcagacgcttttccagttgcagacgcccggggaatacctgcaaaatcgcgtttatccattgatgcccaacaccaaccgaactactatatgttgtctctattcagtgtacagttccatgaagagcgttaatcgctactcttttgggccaacactttacacagtaggctcttctatggaagagtaaccaggataacgttatgttgaaaccggcatatcggttcacgtgtcactggtaggcgatgtaattccacccagcccccaaagtacggcttcttccatgctatggttgaaataataagcatcaaggcgggtgattcgcgttcatacaaaggacaactgcttttcaactgccatgcatccggtggccagacgcaggaaagtgtcgtaatggaggcggcagctgatgcgtcaccgaccacaaagacgaaaacgtctcagaggcactttagcaatgatttagaacagccaaaaagctcaacaaattttgagccgtggagtatgcaaaaaggtgcactggtgagtttgctacacgaaatgaatattcgatccgtgaatgcatcactgagaaaacccggcttgtttttggttagcgtgtttcgcctgtgctgttatgacgctacaaaagctgtttcgtcaccataagcccccccacgtacaacgtgcagctgcaatacgttcaaccttttacgagagtttcatcgccatgccgcggtcactgttgctgttggatgcaacccagcattatgaataaaaaacaacatttctgccgtattttggattcgggagcagggacgcgccccggtatcgtatcatgtctcgtctggatctattccatccctatctgaggccacacgggcggtgtttccttcaattcgaaataacgtcagcactctatgaaccaaaaatgcctctagaaaattgtgtgtgtgtgtgtgtagctgacgttgccatctctcatccccccttgtctgtccgccttctgcacgccagcgatcgggtacggtcacaagaagagaggtaaagctaatgacagtgttgggtgttgcacggttctctcccatacgatcgcagcgtagtgcaccaccgtttctgcgaaaattgttatttgtagccggagccgaatttcgcctgctcttcctttccatcgaactgaacttacatcctcctccagcataattcccccccacccgaaacttcatgcagctgaacatcaggtttctgaccctgtttagatactgaaggggtctaaactgaaagctgtagcttgcggttagtgtgttgacgggggcgtgcgatgaaagtgctgatgtgcattggaactggaccacacgtctcgccggtaaagatggccgacattgtggaattccccgaataccgactccctccgccttaacactgcaacatcatagcaccaaaagaagactctcgcgcgttacaacaaaattcgcttgcaagtggatttctgactgcttaaaaggaatgtaccttacttcaagcaatccagtgtccactaggccgatgaactcgtgaccaaagagaaacttacagtgtgattcggacacagtgactgtcgtgagagaaactacattcgccccgagtgcaagtttaactatgccaggtgaccccctgtttcttgacatgtaagcgcgtgtgtggatcaggcaacgtcggaatgtcttttatacaagtgaagaagtaaagaaggtagccctcccgctctcccggcacgtcacacgagaactaccacaagcctgtgtcgtgctgcagcaagtgagcgctccgtgccaacggacctcacacagtccgactagtacccactgcatactgcccttacaaaaccaaccactacaagcgtgtacatggtggaacctcgtaacgtctctcctggttcccttccttcaacttccgtcacgtgttagatctgacaagcgagagggcataaggctcagtgccagccgtgcggctgccgctgcaaacacggcagccacttcgtaatttgcaaaccacactgcatcgcaagctaagcagagtggatcttgtgtactggcatctgaagataccagatggaaaactaatcggaaactcagcagccgatacggactgttacgtagtctcgtgggaagatggagcttcgctagcaccctcaaggcactcctaaaagactttcgcaatagagacgcaaggtaaactccgcgacgattcagtcacgatcatagcggcactaccgtgtccaccccagctgcgggcgacaccggtgcctgtcctacggggacacctgccacagtgggaagcgtttatcacagtcgcgtttttcaagactctgttccaccacaccatccaatgctatagtgtataggaatggcgtggttgccgtttggtgtttggttttcgtgaacggaaagtgtgcaaaggctgtgacaagttccattcgcattgtggctttaacgtttttcctcttcccatcaaccatgggaagaagcttggcgccctcagcgtcttccacgtggcgcttcgacttgtttgtggattggcgctggtggtagattacaacagataatttcaccatattgtatgcttggaatacttttttgtgataagccgcagtcgatcgttctgctgtgcaagcccacactctgtcccttgtgcatgtccagaatgacgtagcctgggtttgcgacgagggaagttcagcgatgcgaccagtttcctttctaccttcttgcgttccttgcgagacgtcccgtagtgcatgatttttcccttcggtctcgtgaattttaagcaagagaggaggctcgcagaaatttttgtgtggtgggtgaaaaccgatgctgataggggtggccaagaacagacgcttgcattagagaacgacttcccgtggtagatatctgcccttacgagagggcttggtcacgttaagacaagcagcgtattccagtcactcttctacgctcatgcaacagttctgttgaatgaggggagatccaaatctttttcggagccagaagcacgtggtatgtgtgagggaagaccaatccgagttgtggaaaccggaggtgacgcagttatagagcagttttccttaggcagaccgcctatctgcttcgaaggtgttcagaattgaatttcactacgtgcattcattcctggtggaaggttcgaagtttgcacgggttagacatcgcatcaaaa

SEQ ID NO: 1827 - DNA, 1623 bp, Toxoplasma gondii
gctcaaaatccagaaccacaccgaagagggctagggcagagtagttttttttcgcctgtctgtggctggaatgttgcggtgttctccgcggtcaactaccacgccggcgggtcgttcaccgcgtgtctatcgacagtgtacgccattcctgtatattgtgaccgcgccaactctccgtccgctgtagagtagtgtacatgttctttgccatcacaactcggttagtgtgttcgcgccacccactgcgctgccttggcttctatgtgttcagtccgttacagccggggtctgttggcctgaacagtatcgtctgacgagattcgacggtgatatagtcccgtatggtgttggtgtcgtggatgcgtggagctgatcgtcgaaagatctagtcttccgggctagcgagctactctagagaagaggttagcacatgtctctttatgaatgtatgaccttacctttttccatccccctcaacaccttaacgggactgcacacaacttcattcacacattgcttcatcaagaaactgtacaccaccaccccactggactgcttaggacagctgaaagtgttgcctttcaatatactacacattagagttattccacatcagttaaaaacgcaggtgtcgccagaggacggacagcgacgggttcgcaaagccgacggtggacgcgagcggctcaatcgaaaagtcgagttcatggagtgacgactacatggattgtgtaccaagcattgaagtggcctgagataaaggaatgaagagaagcagcatgtatctcgaaaacagtggacggtttgcaagacactcgttcagcagatacatacttcatgcaagtctgtacgcaagcgtttgcctggttacgacgtctatgtggatcagaccctcgaaaaactacaggtagaatctgttcgaaaagatattcacaatcgttaatgtgggaagagaaacgccgtgtgttggagcacgaacacatgcgttgtcatatagttccgaaataggggaaaagggccctctaggtggccgtcacaaccgaagagacaggctgaagcaccgggtgaacctgccacaacattacatccattctcgtcctagaggcctctgattcctttccgtacgcaagctatctatgattcgactcttgaattacctccatcttctatgaaccaacgcatgacgtttttgaatgtaggaacaagcgcgagcgactgtgctcggaaaaagcgttcgttctacacgcatgcgtctgcgacgcgccagtgctgacagtgactctcttctggggtcaaggcagtacgaaaaactaatgaagtcaacattttgactctctgcctcacttttcctggaatggtatgaaatccgctcgtgtagtggcggcatagcaggaatctgagtgtggcgttctgtgctcatctgaatgacttatgtttggcgggggcatgcagatcgtccgattgcattttcacctagcccaccgatagatgtcctgcgggaacttgagttccgccttgaggacgacggtgagtttgcatagcagtttatcaatgttcgtgtctagtgcgaggcttcttcagcaacagcgtgtacggtgctgactcttgtgctcccctttggca

SEQ ID NO: 1828 - DNA, 3127 bp, Toxoplasma gondii
gaagaactctgtcgaaagtgtttttccatctgcgtgggtgaaacgcattttcatgtctagatgccgactctttctgctgttcgtctattgtccaaaacatgtaaacagcatcaaacgccctctgtcgggactggacggcgtcgtcgcgaggcgaagctcctgctcgcgagtctgtctacgaaaatcgacgtgtctgcatttcttgccagcactcggtctctggaaaagcatgtgtctgtgtgcagtgtgtctgtggtgcttgggagagttccttcactccggctgtttcgttcgaagcaactgcgtcgtccaggcacatacgtgctaacggcgacttccagtccggttccgaaaacccgtccacggcgaaaatttatttctgccaaatgcgtcagaaaaaagtcctggcgaaaacctgacccacttcttgcggaggtcaacagccgcccgggtgtggtgcagttgccggtcgttctcgcacgcttcacctggaaagccacgactaaaaagagtcgacagccgaatgcgaaaggcaattcgcagagaaaccacacgaattcaggacagtcttctcgcacaagcgtatacttgcggaatcatgatcgtcgcttcggtaggcttctctcacacctccgaagcatagagacacacacagcaattcccgaggaaacagggagcttctagggtactgacgcgttcgttcctcatctagtcgggaagtactggtttcgatcttaaaggtttttgtttaccggatccagcttctgtggtgtttccatggtttcaaggtcgtggtagatgggacgaccttccacgcagaaaagccgacaagacggaaagaggagtttgcaccgcgatctgtgtcgaaaaacagaacgtcgaaccctaatcgcaaagacgcgttcccaaaaaacatagggacggcatttttgttgcagactctggagcttgcgcgccggacgaaaaattcgctcacagaacttggtgccctttcctggtggaaaccccaacactaggagtgacacacgcggctaaacaccttcagtatcgggaatctacaattcccgaatgtagcgagatctaaacagcgagactcgcgagcacgatttcaaatgcgagcagtgaactcttacatcctaggaggtgttttgtgtgtgcggggacaaagaagtaggcagtctattggttttacttcttcgctcagacactcgcgacaagcggaaacagggaaaggtgagttcctgctcacccttttgtctgcttggtttctcccggctgcttttccctcctggttgtgttacaccagcgcttcccgttttttgacggggctcttcagcagcgaggcagtccgggatctcataggatttgcctttcaggctgcaaggacctttgtaccctgtaaattacagacatcacatttctgtttctattttgaaggtatctcccatttccataccccatccgctctcgacaaggagcatggagcggcagggcagtgcctcccttgaaaacagcacgaggcgtctcaggttccgaatttatcgcctttacaatgattatccggtggggagaaaagacctctttactctcggccccagccatccggagaccacaaccagaaccggttcgccacttttcttccctcctgcgaattccgcgcgtaggattcgccggcaaacctcactacagcgtataattggagaattctgcagatgtgtatgtacacgggtgaagaaccatgtacggcgacaaccggaaagaggtgtaaatagcacgtattattgcctctggctggaagacgtagaggacgagtggcggcgacgctgctcagcgtgagacgtagaagggcgcgtcttcgtttacgtgtctcaataaaaagacaaagacgaaaagaggaaggaagcccagccctcatttacaggagaacgtgggcgagggcggaaggacagttttttctgttcggtgcgagctacctgaaaaaaatgcgttctacatctagatgtcaactatgggtttccgttgacggcgaagagaaaaacaggacgcaagagcccaaatttcctgccgcccctcctcagtttctataatcacctggaaaaggaagagagaggaaaacgctctgcctcttcccatgaggacaagccccaactgctgccgctgtggaatgatgaaagtgtcaagctcatgaggtttgaggcggtgtctgcgcctttttgatctttcgtctgtgtttccaaacgcgagccaaaactctcacacgatgtcgcagagttttcggagagctaacgcagacgttcttgccgtttttatttccaaaatcgcgaaagtgctgcggatctacgtggagatgtctggatgcgtgtctgcccgcgcccgccgcaacccccagaacaaaatcgcctcgcgcgctacgcaaaatcgggagcttctgctgtcgctttttgctgaacatttgtttcctatagttaagtatcctaggcatttggctgcgcgccacagttttgacgaacaacggactctttgttcgcttcgttagactgctttcttgtcgcctcgacttgacaagggctcgcgaaatccgaaacgctgcaaggtgattactctcgaggtcactcgccaaggggggaggatggtgaagctgacgcttttgtttttctttgtctcttctccttttcgtctcctttcttttttctagtccagaaggttttagatacccggacgttccttgcgaccttcgcgcgaacagatataggtggtttcaagactcgtttgtttttccacgaacaaaaaggcatgcgacttcgagagagcgtcgccggcaatcgcccccgagtcttcttcgctgtccgcgtcgctcttttcttttccctgcttctctttcttcgcctgtgtcttctccccccctcgccttggtctaggccttagtctttgtcaccagtgctttccaggactctcgctcctgttcagtttccgctcaaatttccttcaagagtgctttcgaggcgctccgccgttcttgcgtgagcgcgagaggtccgggaggtctctttgtccagccgacttgtctcgaacgcatgtttttccttttcttggcctctctccctctctcctcgacggctaccgaaga

SEQ ID NO: 1829 - DNA, 1642 bp, Toxoplasma gondii
aaaggagagggaagaatgagacacgaacgcatacagagagagaaagacaaaaaggagaaagagacgaaaaaagaggagaaacagcaaggcagaacaagcagagaggcgtgaggccgcccaggagtatcagggcaaagtcggaagagacaaatatggagagagacgaaatcgttttttcaatgaaactcacccttggagaggtcgcgaaacgctcctccggcgctggcgtcccttgtagctacacccggcgtcatcgctttccccggctgcttctctgtttgaaagtttccaatcgtacggcggaaaaaggaggaaagagagacggagacggtgagatgaaagaagatgtgacaaagaaaaggtggagaggaaagagcgagatgcagactggggcggcgtcttgtcgcaggagcgtcgactctggtgaagaaaatccttttgaaaaaggagggatcaccaaagaatccgacgagatagaagaagcagttagtcctcgtcgttcttcaaataagaaggtcgaagacaagaaacaaaactcactttccttccttcctgcctcaacaccggaagaaagacctccaggatgtcgaccccacaaaccggaacggcgcggtctttgaaaaactggaaatccctgaaaaattccttcttctcgctctctcctcttatctctcttctctctcttctctcactgctctcactcttctccgacgacgcagaaataactgttttttaggaacagcttctggtcttctcgcaagtgttcggaagactttttcctcttgcgttcttttttccgagcttgaaaaagccgacgccgagagtcaaacgtctcccaagcgcccttcaccgagacatgccgacgcgctgctcgctcgtctggatagctgtcgagaggccgagaacttggaaagtgagaggtcacaggagagagacgaaagaacctctaaaaagtagctgagcgcgagaaaggagagaaatctgctcgcagaacggacgagaggaagaggcagaaggtcttcgcgacgatctagctgtgtcagtgagagagagacacgagacgcgcgccaggactcaaaaaaaggagcctgcaggcgaaaaaggacttctgcaggcaaggaggggataagcctcgaaagacgggaggtgaagacacacaccctctttttcgttcaagaagaagaaacaggaaaagcgaagaacaactcagcgaggcaaggtcgaaaaaagcgaaagtggagcctggcgcggagaggagacacgcgtgagagatttttcatgcggttcgccatccacgggggggagctgcgcatcttccggccgttgggcgtccagccgaagcagacctgctcccgttcttgcaggctgcggaaacgcgtggaaacctcatgagaaggaaacgaacgtcgactgcgtcggtttctgaaacatcgacgcgtttcgattgcgctggaggcgtatatatagggggagattcgacagacagctgaggaaacatcgaaaaaacatgaacagaagatctttttcttgtttcgaaaaaacctggttcggaacgatcgaagaaaacaaaagctcactgcagagaagacacccttctactcacttgttgctcgccaaccggctagcagaaaaaacagcgcca

SEQ ID NO: 1830 - DNA, 5008 bp, Toxoplasma gondii
ttgatggaagtcgtgtgaaagggtgacagcgtggaatgcagccgaggacggaggcgaagacgcgcagagatccagtggcccgaaggcaggggcgtaccacacagcggcggcgtcgaggcggttcgttcgcaggaggaaaaggaggaggagacaaagaagagaaggaacgacgtctgcatttccccgtgtgctgacagccgcggccacggggaagatggtccagcagagcgcaggaagaagaaaggcgctgacggcgggcgttgccgacgcttgtgcggagcagggagaagaaggtcgcggggacggcggagaagacgacggcggagaggagagtgaagaagacgagggtggcgaagagagtgaagaagacgacggtggcgaagagagcgaagaagacgagggcgactgcagcgaggagagcagcagactggccgcgttcgcggaggaggcgagaggagaggctctgagggcaacgggtttctcgccaggctcctcgcgagggatctgctctgaggcgaggagcagcaggagcttctccgtcaacagcgagagaagcaggtctgcagccgcgaacaggatcttcccgcatgcagagtggagcacgacgttgcctacgcagagaaacgcaatgagtggtgtgtatcgataggtatggcgtctgtagggcgactcgaactccacaacatgtcgcgcggcgtcgctgtacaccttgtagtcgatgtcggtgaacttcacacgcaggttccggtcctgccactcgccgtagacaatcaacgccgcccggagaagcgccgcgtacgcgtacacgtacagccggagccgcgacgccggcgcctccctgaggtgtacgcacacccggtggaacggggcggcgaggcgctgagcgacgccgggggcggccgacgaactcgcagagccaggcttctctttttttgcgtctggacgcggcgccatctcctctgctgtcgacacgagagaagtttcgagaaacgcagccacgcggctgccggcggactcccaaacagcgcgggtcgtccgacacaaacacagaaaaaggcgcgtgcagtcgaggaggtccgtggagagggactgcgcggtattttttcaccaggtcagcggcgcatgcgcgcttgagacttgagagaagacaacgcagcgatgcggatatgtatatgtgtgtgtgtatgttgtcgcatgcagggcgactcgaagagccacagcgagcgagaagggaagaaggggagaagcacggagttgcggcgaggtggagaaaaaatgggtgcagacgcagcagaaattggagctcagtgatgactggaaagggcggagctcgagggggcaacctggcaggcggaggggagccaggctccgcacagcgactttcggtatctttcagagaggtcgaaaagcgcgaggtgaagtcggcaccgcaggtgtgactgcatagacaaggatcgagaaaaagagaggatcggaaacggaacgcggaggaatgggcgactgggcgagggcggcgcgcgccttcatctcgcaagcctccgcgggagacgcgcagaagaacgcctcagtctctcgggagacgaaaaagaagagcactcggcgtcaggtgtacagacagcagagacgtcgacagcgctcgggactggcggcttgcgagacatgtgcgcgtgttccgctttgtccggaagagctttcgcgatgtcgcaggtctgaagcggctcctgctctgcaatccccgcggcttgtgcaatttttttctttcggaacgccctccgcgacaaacaggcgcgagttcctcgcacccgcttctcgacctcgcgccagagactgtcgcgctgtcttggccgcgcatgcagccatcgatttgcaacacgctgccgcgccgtcaacgaggtccccgcgaagaggaagggaaacgaaactcttttccctgcacctccagaggggtgttccggtgtatgtacagctgaagacggagagacacttgcaagcagctgccgtgtggggagagctgggcggaagtcgaggggctgtcggagcctcgacgcgtctctgcatgttgttgggtgtgtgtctgtgtcgagagtcgccgttctggaaatgcactcgagtcctgtttaggattttgggtcctgggctcgaggtctgcactttccggagcgtaagtggcgacacgagtcccacccagctgttggctttgaaaagaacctctgttgacgctgcgcgatggcctagaaattgcaggtcacgtatgaaaaaatggagagctgggatgctgagaagctttgcctctttgaaattcggcagagaggcagcgaatgtgaaagtcaaagtgtccgcaagtgaagagaagtccccaaagtagcgcgtcgtcgctgaggaaggcagtggctgagagacagacacaagcctgaccctgcatccacgggtgtagttacgcagctgcaactccagctgtgcagtccccaagtcttgtgaatgaaaggtcacaagacgagagaagctgtcggagcgcgcaacatccaaagtgtacatccgcctgctcaggcacactgcatcgcaaactggtttctcagcgcgcagttctttgtgagtgtgttctcgacagcagctagcaagttttggaagccgcactctgcgaactggtgttcacgccagaactagttccatgctctggtcgctggagaaaagctcctaggcaacaaacgcgcagttcaggacaggcacgcacactcgcgaattcgatcaagacggcgcgagaactgtggaaagcagacgcatttcgccgtgcaacaaaacgtaagaacttcccttcccctgtattccgtcccggacggagtcttctcccggagaatcggaggggctacgcagtggaaaaaactgccaagttacagggctgcatctctgtttcttgatcctcgagtctctcgcctttctcggaaaaccggcgaagctcgttcgcgctggagtgtctcgacaccgcagaaacgttcggtgactccggatcgcgcgtttgtcgtccgttccgctgttctcgtccactcgtgtttacaaaagacgtggcgacacctggggagatttcgagggatctctctctggagtttataaatgaagtagagcagagcgaacccctgcccttgcagaggagatattgcaagaagtcttcacggaaaagatacttagcggaacgcctccactcgctgcgatgtcgatcgttttccccaggtcctccagctccttctgctcacacacagtacaactttcatccaacaacaaaggcgcaatgccgcgacgaacagttactctcattctccacatgcttggagtccagtcaacttcgctcttgcggccagctcgcacgtacatacagatacaccgcccttccaatgtgttgacatgagtctccttacacaaataagtgttttttgtttgaatacgcgtacatatatatatatatatatgcatacatatatactggaagacctgtcaatagatatatatatatatatatatgtgtttgaatgcgtgcacacaagcctgcattcatcccagtacctctgcttgaatgcctgtgcacatatatgtaaaacagatatgggaatcgaggcctgtttgttctgtgcttgacgtcaaactgaaaaagttttctgtggcatgtgcatttcccttcgcggtagaggtgcgatatggcacagaggcgcttcctgcgcacgagtttcctctgccagcttctgtcgcgtttgtcttttgttctgcgcgactgtgctctaagaaaacccagtgaaaaagtgacggaagactccccacttccctcgaagtccctgtgcttttcttccctcttcttgtctgtaaaaagaagttcccctcactctcttcctgccagcgcatccggcctgaccggcgacctgtctttcggtgcggtgaagaagacagaagaagttccaactgttcagtacactcacgaacaagatacagaagctgctggacacggagattacagggaactcgcagatgccgttttcacttgtggagtctattcacgaggtatttccgtccccgaatcgttatcaaatcgtttagcacagcattgacaatgtgcagctgctgcagatattgttcctgactcgagagagcaagtagttggaagcgtaaacttgccggaagtgcgttgcccaggtcgtctcacggagagatgcttcgcgtggacaaacagcggcgggagacttttctctccacccccctttgtctcgcgcgcgcgagcggcgccgtttcctctgtttgcgggaggtgcccgcgaacgctggagaaacttgcgctgttcgcgaaagttcaagatctctgaaagcattgcgcaacaaatgcgttccagtgaacttcctgacagccgagggcggcgtcgcttcttaggggttgctgtctttcatttcaacaacgcgaacagcgcaccgcgtgtggagcctctctgctggcgtttgtctttcgtagtcgcttccagcatttcgcgtctctcgtgtctctgcagtttcgtgtctttttctctcttcttcttgtgctctgaggcttcccctcgccgggacgcaacttgtttctcgggagtacgcacaccgcgcggtcacctccagcgccagcttcggttccgcttttctcccgtctgtccgcgcgtttctcctccggcccgacggccctctgcagagtgtatttgaaagtcggcgaacaccgccgttgtgagctacttctgaccacgactgcgacaagacacgcagcagctttctctctgttcgcgaagacactttgcagccggcttctgccccgcgtcgctggcctcacggcagttttacatcccgtccagctcctcccttctgagtcgcgtttctgcatgcacggtcttcgttgtcctctcttctccatctctgccctgtctctcacctcgctgtttcacgaggacaaacgctcgccgatcgaaaagccgcaaaccgatatccgaacggatcgtctctcccgcagacca

SEQ ID NO: 1831 - DNA, 4250 bp, Toxoplasma gondii
ccttgacgacaagaacacgacgcggctttcccaccgatggcaagagccgagcaatcgcatttctgctggcctcccgcagcggtcaacaacgaagcccacgcttccaagttgttcgctgttccccgactcgtcgcgcaagtttgccgcgaggctgcaaccggaggattctcttgcggagcgaacccgggacacccgttcgcagagttgcattcttcaaggcgaggacactgctccgtgatggaagaaaacgcgccgtcgcaggctgcgttgtgggagcggggaacagaaacttgagtcccgcgaacggaaccccaggtggaggcggcactgttgtccgcgacacagcgacacgcagggagccggacggcgtcggaccccccgaaacaagacaattttcgcattattgtaaaagaacaacctcggagcgacgcaaagaaccccctgtgcccgcgagcaggacgtgccagggtcgagcgcacggaacggcgggcgtcagcgaacgtcggaacgacaaaatcggaacaatgtgtagcctgaaaagattatgggccgagtaaaatggaaaagcttcgaatcgacgaacggcgagcgccttagccgtcgaccaagaggacaaccaacaagacacacgctcaccacacctcagggtggtttgcacaagatttaccatagcgacgaacgcacgctgcgagaaatgctaggaagaggcaaaatgaacgcccctattagatgcagagcaacttaacccggaacgacgacccacgaaagaggttttccgcgcgctcgaagttaaagtgacagcagagttacggtcaaagcaggtcaggaagggaacaagacgtggtatcgtcgacctgcagggtgtgttgtgagtcatcgcgaccgtttatggtttaggactaaactttatttctgcacgtctgctaacggacctagaaacgcgacaagcactcacgatgcttggctgaaaatgggtttctcaagtttttctcgccgctcgacgacggcgcgtagcgtgaaacacggtgttaacacacacggcaaacaaataagtcacaactctacttgggtggatttcacaaagtctgccgcagaagtcgtcctgatcatgctctggttcacctgctatcacgcaagcaaaggcacactgaaatcaaatcctagtggggcgcaacccctagcaaattcctagttgtgagaggacaggaaatctcgggattctcagcaaacaacggaaacgacctgtaaggaagatttccaggtcatacaagctcaaaaatgtaacattttagacagggaaacagggggaactgttctgccgtgtccgacgctggcggtgaagacgcaggcgctggggatgagtgccgtcgtttttcacctagccaagaaggcgaaaaacaaagatatccgacagtaatataccgctgcgtggacggcaatgtgcctcccaaagaggtgaaactactgcattcaaataacacccccgactatgtgaaaatgagcggtcgacttttcccatgggacagctcgaaagctcgaagcgtcgaatgcgagcacgcgaaaaggttccgtccgggttgccctcagaacgacgaaacgcgggattctaccagttgccggaaaagagtactgccatcattcctttcacttgctcttcggaatggaactcggctcgtgtttttcctatgcaagcgagagaaagtgttgcccttgcacaaaactttgcagctcacaagaccagcgcgttacagccacatccatgccaggaaggtcggtttctctttcacggcagacatcaaaagtccttatttttcgatttgacaaataggtctgcggaaggcacaagcgtgcaactgtgaggatgttaggttctatgcacaaggaacagaggagattgccgtgaccgacaaaaggggtcggcctgtatcgagcttgaactacgccgtccaatcatgagaagcttgaaaaagtctcccgatgacgcacgttgtgtttgcttcttgtcactattcagcatgtatcttgaactcaacgggcacgtcctacacttctccgtatctgtcttgcggtacaggcggtaaacaaaggatttgttgagaatatgctttagcagctgacagcagatttgtgttctaccggggttgatgtcagaagcagcttgcgaccgtgtagccaaccaacaggaaagtacacggctcttacaggtgacggtggcgaaagaaagcagatgtccgcaaaatgtgaatatccaaacgagagaacatctgcattaacaggtctcgtgtcctgccaaacgacttggtgagaaccccagggaggccagcaaggtcatcagcgcattcggatgagaagagaatgcatgggcaagagggaaggaagtgtcacgaatactccagtctaagtagcaaagcgacgcaaaactctggttgtccgagtatgagggacacgtcgcaatgaaaaaaccgctaactctcatgatgctccaaaccgggtcgataacagggaacaccgcaagaatctgacaatacactcagggtcgcatgacatgagactgcacttttgcaagatggcattgctgcgacctaagtttttgtggggcagtatttgcattggacgacaccccctgtttctagcttagaaaacctgagcttctgaacactgaagagagaagtgtcctcagcactcaactctgacgtggtttgaaccacagtgtatacaaacagtggaaaaaaaagcagatcctcccagggaagacatttcagcaataacggcaagcacaatgcattgcaatttgtgtcacataaacctgtcacatgatgcgaagggcatatcgcagaagcatgcttctctcaataaacttaggcacagatgaggggaaacacgtaacgcgctcagcacgcgaattggggtggaaaggtgtcttgaaccgcgacacggcacggaataaagagtaagactcctgtcaattgggaagctaaacgaaagagaaatggctctgctcctccaattcatcacacttcatccccatgcttcacggtttgttcctgttctttacagttcattcgggtcagcatgacgtatatagctaacacgtgtgtgccgcaattgcctggtaaacggataccgacagtctgagtttcctagacgatagcgcgctgaaaccccacccggtgtgttgttcccactgatgaaaatagttcttgttttccaaacactcgcattcgtgtttcctgaccggattcgttgcggtatgcagtgacccaagcgtcacgcgtcggttttcaaacaaacatgcacagtgcgtttcatgaacccaaagctctccttgcttcccactatacagaagtgatactaaaatgcagaatctgaggggcaagaaattgttgaatcttcatttgccagatgggtgctcgcgacagcggaagtaatgcttcgcggtcgacttgcgcccgcgcaggaaactcttactccggctgcttggtgtgcagctcctctgtcagcgggactccatcagttcctgcccgacagcaaaaagacgacacagccatgggaaagacacatgttatgacttttaagccagccacagggtctgtcgattgactcggaatgtaaaggctcatttttggcaactgcgcttttcgccgctgcgcagccgggcacagtcgaagcgacttcttgtcgctgccacgttcactgcggtgtcttgtctcgccggcaaggaaatgagatgcccacttggcgatgtcagaaagggcagtctccagttttaaaaactagagcgatccacattctccagcgcgtgacgacatctcgattctctccctcagagtgtgcaaggaacgattcctgtttacccgccagtgaaagtcgctccgccggccgcgggtatccgtgtttgtcttcggtattttcgtcggcctacgaaactccgcgttacctccgttccgtttcccagaatctgctgctcagaggtgcctggttctgggaacgacgcatcgtgtccctcttgtaacaacggctccgccattttatggtgtggccgtcgagaaataccgccaacttgtggagttcacagccgtttcgcggtcaagggaagaagcgttcagggtccgcgggaccagaaggattgggggtgtatagacaggcgacgcttcatgcagacgcatccgacacggctttccgccgttgccgtggaagctgagaagagcgttcgaccactggatgcatctgcccactcctcgtctacttca

SEQ ID NO: 1832 - DNA, 4094 bp, Toxoplasma gondii
ccgatcagttcgagatttatccgatacaggagcggcagaatccgcgctgcatcgcgattcggagacgccgcccgacacagggttcgcagtgtcgcctctttcagactctgaggagctcggcaaggggcctgcctctccgctgagggaagcatcccgaggaacggggcttcctggagtggctccgtcctggcttgaaaaatccgacgccgccacagtcgaagggttagaggactggtccggcagcaatttaccagaagctgaaggcggcaggggagtagtcctgttgtattcagaggaaagcctcgaggcgggatgagcacctgaagagccgctaggtctggaggcggcgccgctctcggaagcggctgcatgcggtcccagtcccatggcggatggaggcggacctcctggaggcatgccaagcgaggcactgtgaagtgcgtcagatcaggcggacgccggagactgagaggaagactcgggagacaagctagttgtttctcgatagtccttctgtcttttcttgttaaacccgtaaaccgaaaacttggaggcgcctcaccctccttgacggcggctgattcatcccggcttttctccctctccaccagaaggcaaaattcccaattttctactccgtgcatgaaaggcgctgaggcctgcgccgcagctctcggggaaccggggggttctgcgaaagattgtgcagggcggctctcagacggagttatgggcagggtacgccaaaaattacaagcttgcagaagcccctcgggcaaatgggaactggaaaaattccttcagaatagcgtgagaatggtggcagtgcctggacactgaatcttcgtgcgacgacccacagcagacggcgttgtgaacgctgcgtagagtggtaccccgtttctttggagagagtcaggtgacgtagaaaaacaaaagacgatcgcgcgcgggcaggacacgaatttcaggtggcaatttgttcacaggagatttgtcagctcctccagaacaaggggcatgcacgaaaaagccgaccatatgcacaggagccgtcttgtgtccgacacaggaatcagcgtcttacatccaaaagacggagtcacatcaggggccgtggagcgtccagcacaattagaggcaagtcctggagacgagttcgacggatacgaagacaagaaggaaagggggaaaacaaacagagttggagacagcgaagagcggcggccagggaaaagagagggggggtagtgagaggagatctggcgcccgtaaacgaggagcgcatactaacacaattgcattcggcccaaacaaagtatccgcttcttgacaataataatccatggatctgtcgtgcaaagatgcgattttcaacggcaaccgcctttctttgtttggggctttcctccggcttctagaatgggacagcacacaaagacaggtcaccgcaatgcgccggattcgaagccagcatggaaaagacgagcaaaatcctcatcggcgaacatcgattccggtcactcttaccgtgtttctcttagtatttttccccaatcagtcacgcagcatttcacggtgctcttggctagatcggcggtagaaaagacgagggttcatgcgtgcatgctcaaagtacaaaaaacagcgtgtcaaatcactgggcgcttctagtctccgcagagtcacctcccctgaagcttacctgcggagggttctctggtgcctacgaactactgactgactctgcgtttaatcttgctgtgtttcaccggggggagagagtcgttcttgactttggggaaggcgaagatgctaaggcatgcatgtccgtgcctcttgtttttcagaagtgatcacaaaaagtgtgagatactactccactcgcctttgttcctcttggaagttcccgcggagtttcgtcagtgctttgactcttccaacgtatcagatacatacagaacggttttcttctggtgcaccttgttttttccacagcggctcagctacacccttatggtgcgccaccgggaaactagcagcgactcgctattctacctctcaaacatacagtttatcgaacactgtacgtatcgtaacaaacctccaggcaattaacttggcattatgttaccgttcctcgtgataagcacaatcgccgaatggcagaggacgactcctcaactgtcacacgagagatattcacctcttgtcagacttttgaggcagtcctatcacgctcaacctttgcttcctggtaaatatcagagtgttgggtagcatttcccttcaaaggaaacgaggcaactcgctcctaggcttcgctgtttttctttcgtgttgctccagagcaaacaaacatggagggcagtaaactttattcttctccaaggatgcaagggacagtcgcagttcagatgcatgacaactgatccgtggcaactttcattcactgggttgctgcagctttgagacagcggaacatgctgcggcaacctccatcgactcagaatgtaacttatcacgaccaagtaacggagacagcgatattagcaaccatgtatcatgtaaggcgtcaggcttctgtttcgatatatactcgacacagaatttagtagcgagcgtagtgacagtcagggtggcaaagagcgcacggtcgttactcctttgagatttgatcgtctatctatttggaagaacgaactcgactgtcctaccggaagtagattctctacagtcccagcagtagcggttaaatgaagacgctgctcacattcatgccacatacgtaactttcgaggaaccggccccagtgaagtgccaggttgtgtcctgcaggagccttgggcttcttgacgaacgtctctacaagaagtagagcattagtagagcagaatactcgtaaaggctccacccccatactgcaaaaaggaagcctctcttcgcttgtgccccggtcgagaaacggctttgttttacaaccggttggcaatgacttgtagaggccgccgccggtgcctcagaatgaaacttggtagagtctttttcttcagcagaaagacgtcagggcaaatgtgtctaggcaccggctgcggacctaaaagttaggaaaaagctctttacaaaaacgacaatgtacctctccaatgtcgctagcctttttgtactgtggcatgttttttggaactggacagggggaaggctcgtaccgatgcgctccgcctacgattctgaaggcatacgccgtcgaactgcaaaactctgagctctatcttggctttggggtttactcctctctgttcaatatactggcgatgaatggcgtccgtgcccaacagctctgttattgccgactgagaagatctctatttacgaggacgccaaccatcctaagaagtcacgaaagccagagtatttcgttgtcggttcatgttcagcaattctccctcaggtgtacggacaccagattgatcattcttggtcgttcacggcgtcacctggtcactcttcagaaactgtgcaggttcttcttactggctatcgctcaaattcccaagtctcgaggcgcctttctctcctggtcgccctgcctgaattggtgtaacgtcttcgttgaacaaagaaacaagagtcgcgcatcttcctttaatagcatcttcctcgcgaacaccctgtgcaaaggcgcagcgaacgactgctagtcacttggcgattgacagccccggagatgaccggtgccactgttggctgtccctcttttctcaagaatctcttgacaccgtgagaaactcgattgatgactagctctttggtactttcagctatgagaacaatatcgatcacttcgatggctccagtgctcgatcttggatgtgcgcccaacccggcttgcaacagcagtcagcaacacgtgtgtctgttcgctctccgctgtccatcgttttgataggccagcaatagttaccacctgcgttttacgatggattttgaaggctacaggagcggcacttttttctcgcatgtccacaaaaagatggccacttcaaaccggtaagattcaagttgtggcaatttcctttttctggcacttcgca

SEQ ID NO: 1833 - DNA, 2388 bp, Toxoplasma gondii
acagacggacgaagcagagtgtgcgcgaataaggcacaggagagaggcgaagtcgagagcgccacacctggcgcttaataacggtccgtcttccagctttgtaatgaaccacaccttatcgtggctgatagatagcttcttaccattcttgccgcagtagataaactggccggtgtacatgccttcaacggcaaccatgcgctgcttgttcagcttgtagcggtaagcatcacggaaagagacttcagcgagaggcgcgccacggccggggtcgtggaggatgtccttcaccagacccttgatgtagccacggcgttctgcgaagtccaaaggacggagcttcgcctctcccttacgcttgtgcgtatgggcacggaaaacgcttccgcgacccttacgctgagctgtaaaccgagacgcagatcgacatgcacacagcaacgaatttcttcacggccggtctcgctttcttttgtggcactccactcgggcatcagatctacaccgacaaacacaaaaagtgctacacgaccacctactgaaagacagcaatcgtcggtacggcagcgaggtgcgcgccgccactgcctcagtacgagactcgcacaaaacaaccagttccgtactgggctggaaacaaatccggcatttcgtaggagctgttcaccgttcctcacgggcgaatgaaaacactggagaatctcgaccttcatggtcgtgtttcagactctccactatgggcaggcaatggggaacacaggtgtacgtacgccccagtctgccgagcctggggcggtgtgttccccccctttccaatccatgagtggtaagtggaaggaaagaaactccctacgtttctgcatatcagttatcagtagcagtccacgcatttgaacgttcttgtttggcatgcagtgcggcgaaggcgttggcggcaaccgtcccccccacaggcggccgtccacgggaagtaattggagataggtattcacaggaagttccgaaaaacgggaagaggcgaaccgtcactttggaggaccacagagaccgccctacgcgtgaaaatggacgccgtgtggtcgccttccggaaaaaacacgcgaaatcagcaacttacctctgatgacgcgccccattttgatttgctttttccggtgcgggagactcgagaaatacagaaaagaaaaacaccgaaaaaagcaaaagacagcttttcacccgaggtgggtgggcttcggcatctgttcagaaatggcggattttcctccgttcccgggaaaacccccacgaatttctgtgcttcttctccccacctaggcgagtggggcagaccctgttcagcacgcgctgtactgcacggggcagatgaaggcgctgccaaagccgggtctgtgccacagtgcatgcatgcagaaaatcgatcctataaggcgcaaggacacttttcttttacgcagacacacgggaggtcaagcaagaaaaacaggcggtgagcgcgagaagggcaaaccacaaatcgacgcgcgtatcgccctctgtcgcgacacgcgtttctcatcgtctgtccgaaggacttacgaggtactctaagcacctttgcctgctgttatggaacacttatggtctcgttcaaagtttctttcgtttctctcgtcgacgtgtgcgtgtagtgacggcattactacgtccgacgcatcgtaaagttccacggacgcgtctcgctcccgtggtacagcctgacgtacgcacacctaccgctagccacgagccagaggagaacgtgtgtatggatgaggaaagaagacacgctttagatcgtcgagtttctaaaatgacgtttttgccatccacttccgtaaggtatgccagcgacgctgtaagcgaccttcagctgacggcagattctcaacaaacgcgcagtgtgcttttcgcttggaaagttcgactgttggaaggacgacgctttgaccgccgaacaagcacacgtggacacggaatatggcatctttgagcgcctctattattgccatcgcggacctccgcccaacctcctatttttttccatagcgtttctccttcagaagacacacgcattcgtcagtagcggtatacgcctctgggtgcgtgaacgcgcgtatctgtaaatcgtacgtgcctgtatacatagtgccttcatgacctctcggtgtaggtatgctacacgggttttcacttgcatatatatgtttgtgtccatgtctgtatgcatgtccctttagggggactgtggtgcgtgtagcgcctgcctcctgaaacaaagcgagttcagctagcgcaaggtattcatttgcttgcgggcatgttgaggtttcgcttgactccatgagaggaacactgtcttcagcagga

SEQ ID NO: 1834 - DNA, 1688 bp, Toxoplasma gondii
agaggaaagaaacgattgagcagaggagacaagagagtaaagaagaaagaagagactgaaaaggaaaaaagaaagggaggagatgcagagcacacaagaatctgagagcaaaagagaccagagaagacaggaaaagcgtggagacgagtgcggccggagagaaggagaacggcagacgattcaagtggtttccttcttgatttcgatttcttcaagaacgctgacgatgctccagcgactttgtcacgaaacagcgattcaacagaaatcgtgcgggcacccggcagagaaagtcggagctctttcttcgtttcattcttctcaatcgaagggcctcgtttcttccatggaaactcttgttttcttgtctcgcgaaatccctgtagaaaatgccactcttcgtttctaggccctctcgcgttagcatattcacccggaaacgtaacagtttctgttttcccccagtctccttcgtcctgttttgtctccaccttgctgctctgcctcgctgcttccttcctctttttctccttcctttctgttcgtttctcttctccggtgtgtcttctgttctcgtctctttttcgtccttcctctcgcgggtcgggggccagctgacttgtttctcacgactgcgttccgtgcagttcgaatgataaggcggtgcgatgacaggacaggcgacaagtgccacagtgacaagctgaaaattcacatgaaggaaaagaaatctctcggatattcgacagccaaaagacaagctctcctgcacctttctagctaggaattccacacggtatcccctcgcttgttccctcccttttgacctcttttgtgttctctcttgatctctcgcctgctctctctcttgttttctctcctgccggtacgtaacgtgaggatggtcgacgagcaggcgaaggcgccagtcgagcggcgaggagaaaaacgaaaaaaatgcgtgacttttcgtagcacacacatgcgcggtcgcgactcgcggaaccgttcctctcttcgagcggttgttctcactgcctctcggaaaagaagcttggagaggagggggcggcggcagcgaaaaacggaacgggaggagagatgagaggacggggaaggacggctctggtcagacgaaagaaaagatgcgcaagacacgcgcgccgcagaaaacagcgtggaacgcgcgatttatgttgtaacttttcaaatagcggaaaaaggaaaaagtctgagacaaatgcggtgaggagaaattctggttttggcgacctcccttttttcgtctccgtctcctctccccttcctcccttctcccgccttcgttgctttctcccgccttcgttgctttctcccgcccttgtccccgccgcgtctcctttccttctatatatatccgatgttttcattccgcttcctccattttttcgctcttttgcttctcacttattctgatattcccctcgtgtctctgccccggaagagtctcttctgtacccttcgaatccatgtgtctcctccagtggttcgaacgcaagtgaaaacggagacgcggacaggacagacaagccgagaaaaaaagaaaaaaacaaagacaacagaaagaggtaacaaggtctgaaggattacttccaacatgcgcgagcgcctcgcctcccgggccgctcgggcgcctggtccgatcttca

SEQ ID NO: 1835 - DNA, 5032 bp, Toxoplasma gondii
gacttgagcaacgatggtttcggattcagcgtttcttcagagatcattcagcgactgtgaagcatatctcttgtgtccctccagagcctgattcaaaatctctaccatttcgtgatccccaatacaagccaactcaccccgcctgtgtcgacgatcaccctgaattgctctctgcagtcgcctatctctttttctcccgcctccccgcttccgcgccgctgatcgggcgagaagcacggcggagactgtcctgatgcatacgcctgcatgtcgtctggaaactgtatctcccttgtgtcctttgtcaagtgcctctcgtgtcacctttgcaaagtttgtctgttttttctcctttgccaaagtgtttctcctgtgtttgcttgcccagccctctctctctcgcggatacatgcaagaagtgaccgagaaaaaagcgagagagctctttggcgcagaacctctcaagaagcctctctccacagggagacggaacaccgaactgcctcgagaattccgccgctctcgagacaactgcatcgacacgcaggtcctcagaaagacgttcttcgcacaaaggagcgaaagaagagccgaagacactcgaacgatgtcgccccgcaacagccggtcctcttcgccaagatgtcaagatgtgagtcctgtcggtacacccggctcgagcctagtgcggaagatccaatgcacaaaaccgagacgtcaactcccacaagaagaaacgagatctctctctcactctgcttcgataacacacatcgggccccgcgcgaaaacgcacgacgcagcagggctgaggttgcggcgccgttgcagccgcagaactggaaaacgcgcaaagaaagtgcgtttgatggtgcatgcaatctggacacgcggaggattcacacacacgtgaaccgaagggaggagcaaagcaaaccgaaggaagccgagtcccgtgaagacatatattcacatgcgcatgtaatcacgtagctgcattgcctgtttgagactgtatgtggttttctgtctcctccacgagccctgtggcacggaccttgacagagttctggaaaaaagggaactgcgggctttgggaagaaatgggtagacaccttcaaactttcgacagtctccaagtttgctcttccccttctctatcgcatgcaaacgccgcctctcgaagcgacaggaagctcctgtttgctttccgcgtgctccataagataaaaatgggagaccaaatagagggttcgtttctcgtggttttatgcgcggtcgaaaggacaaaccggacacttgccctacaagctcctcaaatctcacacgtctgctggcagacactgaagaagcatcgattccgcgaggcttccctcctcagcgcacggggagaatctttctttggttctctgcaaggtggcgagcagaagaatcgcgttcatgtgccctgtgcgcgaggcagcgactgcacacggatgaatctggaactgtggacccgctgcttcgtcccacaccctcaggtcctggcactcgttttcgctgtacacagaccagcatctagagggaattttcgggactgaagaagagaaatggaacgaaaaccgctactgcacacgcgctgcgcagcaggggcacaaactgccacgctgagcgcggctgtgaagcgcgtggggcactcactcgtgccggaagtcagcgacgaagaaggggagacccgaggaaaccctctcaacacaaacgccgttctcgcaaaaacaatttacagaagccacaaagccccgaacaacagagcgactgcgcgtgtgcctagcgtcgagagaggtgggcgggccggtccgccggtacgtcggaaaaatgcggagtcggaaacggtgcggcagcggcgaggaagtcacgtgcactaacttcgcagtccgtgtcagaaaaaacgagaatgaaccgcagaaagctgtctgttcctgcgcgtgcaaacaacccgagactcgcgcgcgacgggtagaggctcagcctggcggaaccgtccacgaacctttgaactgcgcgcgcactcgagaggaacgcacgcagcaagggccaaaaaacaggtagcggtgtcagcctttcctgataagtgtgttgcagcgatttcaagctgaaaaaaacctcggtgaaaccccgagatctggcgcagcttgctgcaagcggtcgcggcgtgagtgtacatacacccgagaggggggggggcgcagtggcatgttgggtccgtatcgatgcgctgagcgacgaagatgcaagcagacgtgaactaaatgacgcgacttgcgcgcgaaatcgctcatcctctcacaggcacagtcgactgtcgactgttcacacacagaccgtcgaagagggcggtttctcatcgaaacagatgcaaaaggcaatggacgcaaccaaacggcttttgaggtgagggcggaacatcgggtgcccgccgcatcgcgagcgttctacaatcacagccggtaaacgttggaacgaagtttgtgttcttcctggacttgacgaacttacccaggggcagaacagcgggtttagtggaagtgccaaagtcacaacttgtcaaacggggaccacagcctactcgttggggtactggggaggaaacacgcctatttgtagacagtacgcagcagctcaggcggtacaaaaggacagaacaacacggaggagaaagcacgttcactttcagtctgtgttgttctgaaccgtaccttccacatttccacaggggcgacccgcgtactaccttgcctctcccggaggttcgttacagcctgtgtataaaccctggtgtgtgtcaacgcttttctgtatttcgtggatttcgttgttgcgtcgaagctcgtcgacgagagactgccgattggtgtgtcaacggcaagcgcacgtaagctgctccccgctcacggtttcttctccccttcacaagtgagaatcgattgcctgttcgatcgacgccatgtcgctttttcgtgtgtaacttgtgcgtcgcgttgccagctcaaatccatgatgcgagtatgtttggttagtcttagaaacgatgtaatttccatgtagactacgagaccgggtgcgctcgctttacagcagccaccatcgttctctttgggacagagcgcagtgtcagagtttccccgagcgcgggtggaggcagggtggaaggcaaacgattttagatcgattggtatacagcatcatagaccgtctccacggcacagtgcagatgccatgcagcttgatcgtatgtgttgtagtgtgccaatctccgaccgttttgagtctcctagcactggcgcagaaaggggcacggggcacgcatcacttccctgcagtgcggaagaccgagaccaagtcaacctgatgcaagatgtcgccggtgttgacgggtgctgcgttccgtcgccaactggtgggtgcaagggttacagatccgaagaagttgcctccgtagaatcgaaggagttcttggctgtgagacagctcctccagaaaagcagcagcagaaacgacgaggtcgaagagtgcccttatttccgttcctcggtacacaccactccgtgcagcaacggagacagagatatgcagcacggaattcgctcccttttcacgtgttcatagacgagaggatgttcccgttctccgctggtcattcgatcatgatacaggtagttcgctgtggaacaatggacactgcagtctgcttgcacgtggttcctcactaaaacaatctgtcccacgaaagttaaaataagtataaacaaccagaatacgttgacgaaacaaaggcttttcctttccccaaatttatcaaactgtttttgtgccccgtgctctacggcgttgtgcacacttcacgcgccatatctgtccctagaaggttgggagaatcatgtgaatgtggattgaagacatgtagaacgattatagtacaaccgaactactggagaaaaccgcagattgcggcgctacggctgcagagagagtcatactctattatttcatattccgtggaaactatcgcgaaaatgcataccgtcccttagcacatacgctccctccgacagttgaacccctttacacttcgacgactacggcaacagcgaaatctgcctcatttgtcttttcccgttcgtactcgcggcacgcatcaccaacaggtaacaaacgctctaattcaacattttaccggcattcatattgcgtggaagcggcagttctcaccagtgctggttcagtatccaagtagacccagtccgtttttctttgcatccttgatctgcatctgggtgctaatggaaagtcattcaagaggggcttttactgtcgcgcgggttcggcttcaaagtattttaagctctgtgtcagtggctttcgttagacggcagtcggttgttctaacgatgaacgacaaattcaacgatggaagccgctcagtggagacatgacacgcgcacagacaccacagatagaaccgttgttctcccaaaacacaaagagcgactgcttctgtccttttgctgttctcgagaagccacagggagcgagcctttctctactgtaaagcactcaacaaaaaggtgtggctatagcgctctgtttgagtgaacctgctgaacacgaacggtagacagtggagacgatttcctacgttaactacagctctagaatcacacggagaactcagcaagagatggacagcgccccgaagatgcaaatacaggcccaaacacatgcacaagtacggacgtcgaaaaatgcagggatacaaacttaatcacaaatatgcaggcgaggaaacgtgtgaattcaaacaagaacagcaaccattcataccatgtgacgatctgaaagcgtcactgaagaaagggaaggtgctggtggttctgtctcctactacataggaggggaattttcaggagattgctgcatctgtgcctattcgatccaatggaaaacacattaaccctacaacttgatccatgaaagcacagatttgtcgagtgta

SEQ ID NO: 1836 - DNA, 3903 bp, Toxoplasma gondii
aacatctctcgtgtgcccactgtcttctccatcctcgaatacatcagctgttgtgggggatagagacggaggacgccatacggcaccatcctcaggaccacgggatgcagaggagccggttgataatttatgagaagaatatctcaatctctgtcgagactgccgttcttcttggacgtgctgtctctttctctccagttcgaggtccctttctgcgactgcggcagaaagttgcttggccacctcttccttcattttttgtacctcggctgcaataccagaagcaagataaaacgaatggacctggactgtacaccgaggtcagttgaaagagccaaactttccatttcaatcaacaacatggaaactgtgaaagtcactttacttcgtatgttcttcctgtagacggtacaggctgcgattgtgccgcaatcaagacagtgtactccaagctcaggtcgaatgaacaacgaacaggcagcttctcatcgctaccataatacgctattaactggggtgctttcggcagttttctcaaagtgaaactcgtgccacgtgcattgacaccaaacacacaaatatgatccacagtgagtccacagcacaaatttatactatatcatgctactgcacggcctacactgtcaaggatttaagtgtcaaagcgacacccagctgccaacaggtttcagtgcagcgtatgctctgccttcttacacttgggaatgttgagctttgtcgcgaggcttcggtagaaagaggtcagcgtgtgcctcactccgggtcttatttctggaccaccatgtttccttccgaaaataagggtggcatacatgagttctcttttattgatcgggtcagctttgtcactgatgaacgaaatcagatcacccgctgcacgaatgcagcaagaacggaacaggcggcggcaaatgtgagctcgtcttcggtgggaaggaactgtcatgttaacatcgaatagctaaaagcatatggcgtgacacgccgtctttaacgtatggcctacctggttccttctcgataaatctttccatttgagcaacataacggtcaactgcaggccagaccaaaaacaccacatcacgcacaaaacagactgtgtacagctccttcgatccgacgatttgagatgttttatagcgacagtctcgcactttgatttgagaagtcttacttttcgaggggtatgcacgccatcccccgtcaaattgttcggaccctaatacatgccctgaaagcacacggagaacgcaagaaccgccattttcataacccacgcatgagacgtcggtgtctgtccgagatacaaacgctgtccaatcacggcaccaatagtgctccattggagaacgctgggtgctccgtttcagtaagctctgcgcggaatcaacgccgatataagttgatgcaccagttatttctcttgtttccctgaagtgcagtatacaagcttacgaggcccgcattgctgcgtaactccggaaagtagaagcagcagcaagttgcatagcgggaacacccgccaccaagatggcattttgttgtggctgattaacggcttggcaaggggaggttcacaaaggacaattcactgttgctgaacaaaagaagtaaaacagagccgtcggctacaccgatggaggtagtaactaaggggaaataagcaaaagtcgagtgcttcggcaggggcctcgacctgggcatcgccatcttccgccgcgtcgctgttgggaaccgactgcgcgcttgtatcgctgaatcacgtactgtttttttctgtataagaccatcaaaagcagcgcgtctcttgccgaccgttgagaaagatacagacactgcaaggagaaaaggcagctgcatcttcggtaactgtcgcgttcacatgtctcgaaactacctcggacgttgcaaaaaaatcaaactcacttgtggctacaacagcgcgggtccctcgtagcgactctatagttcagccatacagctgtagtagcagtcgcatcacagccaacccggaactctcggtgaaaaagtcgcttgggagccgcggggaacgattgagtgtcacgacgatcatttagccacgccacatgcaaacgggtattgggatatttgccccacttgacagccggagagtccgcctcggcaacggtggaacacctctgtatcccgtacggtgatggcttgaaagaaagcatttttacccgatccaagttctagtttgatactcccagaacgatggtgctgatcatatcagcaaaggaaaccgctatccggggatcatgcgctcgcaaaggccacaccgcagtaattgatacattccaagcactgaaaaacagctgcgtaagcctttcgaaggtgcatgccatcatcatcaagggggtataaataacgggagttctgtcagtaagatatttgtctactatccagttgactcacgagactggccattttgacttgtcagcgcagcagtggggacatcgaaactgcaactacaggctagctaaacagcctgggccgatggaagcagggtccggaattggctctcataccgaaacaaatacggagcgcgaatcagtgagagaaaattgtgaactatcagaaggaggaacacacgaacacaaagaaaactgctgggtactccgctaccatcggataacggccttccgtggaaaagaatcgggaaagaggggcaaggcacgggtcagaaaaaacgctaccgcaacatccaaacgacggtattagagctggcaagaattgccggctggtctcggacttctaatggcaaagaccgagaatcacgtgcagggggccaaacgcttggatgttctgctagtagctggctgcacacggtgaaacgaggagacatagaaaagctggtttactgcttcctccggttgtggacctgaagacatgaaagcgcagccattgcgaaccggacgtccgtcgaactaaatctggcggacgagataaaacagtacgacttcagcgaaacaattagggcttgttcaccacgggaggatctgtatgcgttgcggagcctatccggtcttcagcggttttctctagacaggaaaatggtgtatatgggtaacaagagctacgtatactggctgcaagccacagtgtctaacgggtagttcgcccctgcaactttagaatttctccctgtagtatgttcctgctgtttggtcgaaactgccactgacgacagctggtattacgatgcgcgttggtttctttattcgctcgctacgcgagtaaccccccgaaaagtgaacaacgcgagacctccactcaatcgtaccagcgatattatttcttgaaaccagtgggtactgaaattgaatcaacaagccacagctgatgctcggagtaaccgcctacaagagcgacagtcttcccggatggagagacagccacggtgcgggttgaggatggcacatgaccttgcggtgtcttcgtcagacgcagtggcattgcagaaatcactctttcccgttttgtttcaggtcaacattatcgaattaattgctggggcaagtcactgtgtattttacctcgagcttttcaatgctttttaaaggtggccgctgaaaatatcgtatccgcagttatcccctgtcttgtggtggggccgcgatggctttccgacggctgagcaagcgcccattccagtcgtttaaaagcatggcgggtgtcgtgcgtcgaatctagggcatgtgcttcgccagagaaaccctcctcacgaaattgtaccgtgtctttcttttctgtaccgaaagagaagtgcgttcggcgaagacgtctctcctcgtttggagcttcttaccggcttccctggtcatggggattggctctcagatcctactactcccatctgca

SEQ ID NO: 1837 - DNA, 4622 bp, Toxoplasma gondii
gtggagactgtgtgtaaccgcagagtaccatggctctcttctgcagccgtcgaatgtgccgaaactgctcttctgtgagaaggggaagcaacgcacagtaccccaagtacgggttgctaggctcgccaggatcgccacgcaaacccagcgacggtggccccaggctcacggggatgccaaacacacctgtctcgagagccttcctctcgtcaccgagagatcctggcagagacgccccccgagcattgaaactgatcgacacaccatcagacgggcctcttccttcggacgatacatcacgtttctcgacaactgaaacaccattaccagatgaaagcgaaaagcccgattcccccacactgcccggtggaggcggcggaggcggaggcacgcgcgacccttcttggccaatcccgccgacggggacgcctttcttcggcagacctggagttgcagcagctgcagaagacgtctgagacgctggatgttgccacggttccgctggtcgactcccaaactgagcatagtcttttatgcatgcgaggacttcctcgtacttggccgcctccacagcggcctcaatcatgcctgcgcccgcgcccccgaacacttcgcgcttcagaagcccaggaactgcaggtacaccagacgcgttgctgtgaaactgccgtctgtgggcacccagcagactgcacagaggctgctttcgcgagggtagcatgggcatcggattgaacttgttgtcccacgatatcctgtacacgccgaacgcgagtccggccccgtgtcccggcaagttcgaagcccgacccgaggagctctgccactgctgcacgacagtcgccgcggcactgtcggcctcggggtctacctgcctcgcgctgttgatgcgagcaaagcccgctattgaaaacgacgttcctccccccgcggaacagaggggcaccacaaaaacctcgtgatccgtgtttttactccccgtggtacgcacttgttcctgctgctcagtctctcccgtcgcggttgtgggtccggagttccctgtgccatcacgcaaggcgccttccgcaggttcccctagctctgcagcggcatcagggttcccgcttccgcctctctgcgtggcttttctcaccagcgcgacggccagattcgaggagctctcgacgaccatcatgtcgtattgtcgcatgagtttcaggttttcctgaggcaccaaatacacaaagtggacccagtctgcctcgctgcggaagctgtcactggctcctgcgctgtcgcctctgctcccgtccgctcccacgtcgtcatcagtctctctatcttcgcagacgtttcctccagaaacccggtctgctacacccgcccccgttgcactgtggctctctccggaacctagtctgctcgcgtcagacggtccctctcggcaagcgcttcgaatcaggtccgttgatctgctgccttctcctggcgccactgcactgctcgcagggtcgcctgcctgatacgcctggacctggagctgcggcaccgcgcatgcggcgccgggtgccgactcgaattccgacaagttcgcgagagcaattatttcttgcaggcgtttgttgcgaatcgcctggcgaaagggactgttgcagaaggggcagatgcgattcggaccgaggtgcgcctcgagacacgcgtggcaggcagactgcgcacagttcgtcgcgcatctgaccagcacggggttcgtcatcacgcggtgacaaaggccacagagccactcgggaggcagccgcttcagccggctgctcagcttccgctcctctgcagttttccactcctcctgagagagctccgagcgcgctttgtgcaacacactttgcccgctcccgccgtatgtgatggccacccgctgcaacacgaccttggagtacgcgtggatcatctggttctcgtccacgatctcagtgagctcctcagcctccgcagcaccgcctggcacctgactccccgccaagaaaatccgaaagtcgatcttccgaccatactcgttcgccaatccgcaacgcgccgcgaggagctgcttcacttctgccagagacagcgcgctacacgacagcgggcactgccggtacgaccccgcgtgctcgctgctcagccggtagtacagcagcatcattttttgtagggaagcgatgaaaaaaacaaggcgagtcacacagaccacgcggcaaggggcacccactcgcactcagccgcaaaaaggctacgcggtgcccgcgtcacgggtatggacacgaaacgaagtctgcagactacagccagtgaccccgcaaaaagttcacgttcccgggataacggataaccagtgaccgttctgtatataaatgcatatgcatgtatttgtatgtatgtagatgtatatgcatgcgtgaccacagatttgacaaagtccttcggcagtcactggggttcgccacagacgcgctgcatcaaggccgcctaaggcggggagactgcgttacggacaggccatcatggagcagtccgtctcacagttttcatttgactgcgtcctctcctgtgaagaggcactatcgacctctttgcggctttttgctcgcagagtgtcatgtgcagactcccaggagaaagtcaagggcgccgctggacggaactagagaaaaatcctccaggtgagcgtgtgtttcctagaaacccctacactaccgcgagtgtgccatttatctgcgacaatcaacggactgcaaactgccacaccctgggctcctcagcagacgcgatctacagcttctcatgagacaatgctaattgagtgatcgatcgcctacagatctggacgccagagagacgctgacacactcgagagtactcctttgtcaggctactcgtataattacgaatgtgaatatatacatatttatatatgcacatacatgtatgtagcctgatgtaagccccagcgtctcagcaatcctggctggtacggcggaaaccaagttccactggactttcgtaggtctccagcaagagcctcgccgctcctcgtgtgaggccaccctatctgtcgagaagcagacgaaaaacagccatttcctcctcagcctctctacggtatagaaggaatttgatcgtgagacatgaatctttccctaccagccgtggtctcggtgttccgatgtactgccactgtgaacgaactgtaaaacctgccagtgaacaaggcaaagagaggcagaaatgtggtggcaaaaaaccgtttttgtctgctggacggtacggtggaaacgaaaaacacgcgcatgcacgagggtcactgtagagtggcggcgcaacacagcaacaatgcatgggtagatgttagaagagacgctgcttccccgcgttgcaagcaatacggaagttcccctgtactcggagttggcgaaaaagaggaggcggtcaaacgaaaaatcccgatggattcacactggaaaccctcgaagccttttaccgagagttgaatctacagagccagacacgacaatgctgctctgcacttcccacttcctcccaccggctggattttcagtctcctcagtgaagcgacaaccgaaaacagaattacttttacgaatgttgacaggatggcatcaaaaacgagaggccggggcactgaccatacgccgtctgtgtaaagacgtttttccttcgtacaaaaacctttctttcgaactgagcggacaaccataagtgcaacaagactccacagaaaatatccaccttctcacttgtgtccattaaaatagcatttccagacacagccgctcattccctgcagagttccgcagaacgccatcaccacacgacggtggaaagcacgtgcccaaaaagccacggctggtggtgagaaggaactatcaaaacatcgaaatgcaacacggatgtagacagcacctgcaagacaggaaaaaagaatcatggtattttcgcgttgagtacgtcagagttgacaacgccttctttgcaaccgcgaaatcttcaaaagatcagctcagctcagagtctccgagtataagccgaccctcgcgctgctcgagttcgttcgtcaccgtgtccttttttgccaggtttctcgaagcaacgaagtcgtttctaaaagcgaactggagtacttctgcgtcggctctagcgtttccactattagtgtggcacgagtcaaattgcacacggtgtcagctgcggatctttgtcgaaaattgtgcgttggatctttccgttgcatgcgcatgtgtgcgagttgcaggcgttctggtgcgctgattgctgcggcattgtcctcgcctgtcttcgtgtgttctttgctttcgtaaaccacgcgcgctcgctgagactgcgtcttctgcacttcttccggactttctccctgatttttcgtagaacccgagccttgccgcccccatcttgaggcgtcggcgttccagctgtcgagcctgctgcactgtgttgctaccgcgctcgcgaaccgcctcacctgaccgtgaaggaacgaacttttcgcgtcgagcatcaccggctttattctgccccagctcccgtcgattcaggccgcctgatcaactcaagcccagacaaaa

SEQ ID NO: 1838 - DNA, 3120 bp, Toxoplasma gondii
tcgatggcttgggccagatgaggcatccatgcgcatgacatcattcctgcggtacaccccaaagagctcaaggaatctctgaaatcgacgtcgaggctgcaccgttctttcgacagttcttgagaggggacggatttctgttgattcattcgatttgtataaatgagcacagaattctgacccagtccacgcagtgtggcaatacacaagaaaggtacacacgacaaggaaatgcgaagtcgttctctcgcatggaaatgaccctgcttggccactgtcagattccgcaaaagtggtgtcaggtccacaagaatgcatctgggcaaataacaacttagcgtatcacgaaataagttgaggttgcgacggacgtcacggcacctctggggcacatcaatttgtatgttcccgactgcttatgaaggcatctcagactagtagcctgtcttgcctcgaggaactcccagatcagatgtggtatccttagacataaatatttcatgaggcagcaatcgctacacggtgcgcatgaagcaaaatccaactcacatatgatgaccagtgcctcgagaggtcagggacacgaaaacacacggtggtttagcaaacttgcttatgccactttttgtgagacacattctgcaattcttcgcattgggcttccacgagagatgtgctgaaggtgggttcaaaagtttcgagcggcccatgcatttgcgttcagccagcgtcgacctccgtggtgtacgtaccgtcggtgagcccagcaatgaagaccaacgcgcactcgttcccatcagcataagaagcaaagaggaggacattcgggtgtccgcggcaaggctgtgccagcacacctcgcatgcacggacctcgtccagaggcttcgccgttgaccttttcgttagaagtgtcgacgcaggacattgacttagtcagcgaggaagagaaccctgaagaagccatcgttgaaaggtggttttgtgtggttgatgtcctccaaacaactcgaacctgctaagagctagtcgattggtaaaagagcgtgggggggtttctagaggtgtcacagattcgcgttgccaaggtgggcgaaaatgtccttaataactggagacctacacagccgtcacacttccgggacgattatctccattcaagggaaatcctcgagttcgaaaaagcgacgctaggtctaaagcgcgacggcgaatgacctaaactggagcacctcagacgcacgcgcagatcctcggcacaaagagcctcctggcgcagaacatgccaccagtgggccaggccactttcatcaaagtaccttatctcgaggacgtgtactgttatctattcggttgtggactagggagcgggcccctttactcagcagcagaacgtccgcaacacggtttccggtgctgcttcgagactctgccgggtgcgaagcacgccttctttcctcaacactgggacgagcacgacgcgtttctcggtgggcaaaccaaaaatagaatcaccgaatcttctctggtctggctccagggaatgcttgtgaactttcaacgagttctacggaatcccaaacccagtctgatgggaaggaaaaaaaccgtacgccgccaacagtgaagcaggtgaaaatgacgcccgatacgggaaccgaagtggatttagtctttcttctgtggagaggaaatgggtaacgcggatacgttggtttcgtaaccgaaaaaagggacgaaatacggaaccagcccagggtcaagacggcgttgcagccgcctccgcgtactcggtgtttaaggcgaaaagagcagcactggaccctacgtgttcctcagcgagttcgtcagctccggatagattcgaacgtgtctagcaagagacaaacggcttcctcaaatcggtgtctttttcgtctgcactaaaactttattctcttcctcctagttacggaaatcgcggttttggcgtgtggaatgctgatcgctggtgctacgtactgcaatgaagcgctgtgtcggaccgtacttccgcccccgtttcggacagcggcctttagagtgaacagagactctagaaaagagctcccttctcgcgtgctctctggcatgcacaaaaggccctcagttttgcagttcacaataaaataattgccattcagtggcctttcctttgggatccggggcttcatcctgtcgttgtacgccagctaagagctcctgcccgcagagagaggctggggcgccgcgagctggacccgaactctgggtgtgcagcgtaatgggtgggcaagctaacagaagagctgccgtctcagaggaacgcatcaaaacataaagcagcacactgtttcaatggaacggggtagaagtgcgttctgagacaaaaaagctttcaatgtgatcgcacacccgcgcacggaatccgtttcgtcgcgggcgacactgaccccacaagaaccctccgtatgcagttattcttggaaacgtcagataagctcttgtttgtgagaacactcctgttcttcgcagtagaagtatggatgtttatctatttgctttccccatctagaaaagtgcgaagaggcctccatgtaactattgctgcaacgatgtttccgggcaacacgcttgtatcagtttgccgtctagaaagctgttactctcgggacgggagcagctgagacggcatcgggttacatgcgccccaaattgctgggacgtgaaagcgttatccgcctggtgagaaggtggaaaattccttgtgtgccgtaaatgttgaaatgatggtagtcaagaggtcagagtacatacatgcacatgcagagggctaaaccggaaacgggaagagtcagatgcaagattgcagagactccacgcatctaggatgcgatcgcggtgctttgggtaagggtggggggggaaggggggtcggcttaacccgagctgaataatctgacattaaacgcgtacagaggacatgcgactctgcttcgtcctggcgttacgtgtgggcctgtgcgggtaaggccacaccctttgtttaccattttctctggtttttttgggcttcgccgccatcttcagtccatttttgaacctgcgctctcttaacgggaca

SEQ ID NO: 1839 - DNA, 1034 bp, Toxoplasma gondii
gaagagcttgcaagacgcttcgcctcctctgcagctcttcgttttctctgccttctcgcctgtcgtctcgacagaacaggggaaggcgcgagggcctttgtccccatcgattttgtggagtggactgaaggcgtacgtttaggtgaaggcggcgtctcaagagacgccgagaagaagcggaagtcaccagaggcacttggcagaacaggggacctttccggttctagctcaaggggagcgacaggcggttggcccacagaaggaaaggaaacgaagagaggcgatttcctgttttctgcttgtgcgtgcagggggaaatccgctcgtttcccagtgtgagaagtcgagtacgggcgaggagctgccggagaaacagaaccgcgcagaagctgcagagaccgccacagtcgctcacccaagagtgctggggagggagacggagagaaggcgacccacgggaaagacctcagatgtctgccgtcgatctgagcacagcctctttgctgcgacgacaaagcaagacttggagtgaaatactcgtacctaggagacgggcacacacacgaccgtgaagacgaagaagacctttgactcaccagctcggttgcaatgtcttgcgcttttccgggtgtcttgtcttccagaagatcggcagagagtgaccgatcgccgcgctctgcagcataggccgggaagtccctcctcctgcgtggtccgcctcttggtgccttttctcgctctttgtccgcctctcgcgttcgctcggtcggcgtttccctgtcgccttctctcgctgcggcgggggtggacgcacggctttccacgagcgcagaagagaagaagagcggcagtcctgagaggtgggccaggacctcaagaaacgcgttgtcaacttgagatacagagagagaaagaggcacttctttcggagctccgctgtcgtcttggcaaaacgggcaggcagccatcgtgggacttctcttcagcgggaagttgcggaacgaggggctagcgggactggaacagccgacgaa

SEQ ID NO: 1840 - DNA, 1926 bp, Toxoplasma gondii
agcagccgccttccaagacgctcacgtcctcatcgtacacccaagaggcagaggaagcttgagagtcgagagagggaaacggacaggaagaggaagaagatgctgaagaaagatgacaactcgacacggatgaagaagacgaagatgaagaggacgcaagtgacgatggacgagagggcaactcttgacctcgtacactctttttttgcggcggagcttctctgtctcgaaggaaatgcggaggacgagctgatctctgcaacttaatacttccaggctttcttcgacagaaaacgtggacgggagtgacagaacgcgtgagcaggggaagagatcccatcttccgcttcacttccagcgggtgtacgtacaccacgagacccttcacgacttcagaaaagtccgcagaaaaactcagcggggggttcggcaagcatgcgcagtagcagacggacgcaggccgcaagcagccgccacagatttctcgtcctgctttctccatcgcgtccttcgccagcttccttctttctcgcgtcttctgtgccccgcactccttcttgtatctcctcctcctcccatcaatatatatatatacatatatatatatatatatatatatgtatatatatgtctatgcttatgctgtcgaacgaagtctctctctctctctctagggttgcgtataacgtggtttttgtgagcactgcaataagatgccagagacggactttcagttcaacttgctcaaaccagcgctcttcagagaatagaagagaggcgccttcctcagttctgcactgccgtagaggagcgcgtcgacgcctcacggagggaggtggagagagagaggagagatgagagaatggaagacggaagacatgagggagacggagctttcctgttctctagacggggattggagaaagaggaatttcaggaaaagagagaagaggacgggatgttttctcgaagttggcagagaagaggaggagctcatgggagacgtggagaaacgcagtgctctgcttcgaccaccccttttaaacaacagctggagagagcgcgatattcggatgcgtttctttttttatcactttttttcaatttttttcaatttttttgagattaacgagctgatttttttgacattttttcgcacatgcgaggacgaagcatcgcagaagaagctgtgcgactttgctcaccggcgccgtgctgctgcgactcagctgtcttcggcgcggacgaattttccttcttcctttccacttcctcccttttcgtctttctgtctatcattctgcttttctcctctccttctttctcggtttcttctcctccacctgatacacctgacggctcttttttttccagcggccgccctcccgaagacgagggaggctgtttcacaggacacagcagagagaggaggccgacacaggaggatcacgcgaagaaaacggagagaaacggtaaacgcaacgacgaaaggaacaagaaaacttaaaaatgtggaagacaacagggaaggaaggttcggctgtgtaggtgctgcagtttgtctcgtttttccctactctttttttattttgccctcgcgagacaacatctaggacgccaccaagacacatttgaattctcggctctgcttctacagcttttttccttcctcgtcttcaccctcgtctccttccttctcttccctcgtctgctggttctcctcacgtttcttccgcatcttcttcttccgcgtcttgttctttttctctcccgtttttcgcgcgctttccgctccattctctccgcgtgcatcccccctttctggtcccgagtctgttgtttgtcgcgcgttcttcctggcgttcttctgcctcccagtttctctctccttcgaccttcggagcgccctctgcttttttctcacca

SEQ ID NO: 1841 - DNA, 849 bp, Toxoplasma gondii
tctttccttcatgttggagaaaagcggtttcctctgtccctttcgttcggataaaaaaacgtaaccgagaaacaggacacaaaagaccaagacttggacgcagagtcgcgtcgatgctttcgcgaacacaatctgacacgggtatagacgaggcgatgtataagcacaggggggaagattcgcgtttccttgttctgcacagaggctgatgaggaagcagaagtgcacatgtagggaagacagagaggcacggatgagatttaaggaagagacggggaaaaggtgcaaaaaagcaggaaatgcccacttcgaacacgtagattcaaacgagtaggtctacaagcagaaacgcaaaaaaaaaaatagaaagaaagcgcgtttcaacgaatggtacgaaagtgaatcgactctgggggctctgcttccaggtgaacaagtcaaaggggaaggtgcttgagaggaggcattctcagcagccggaggcaagaaacacaccttccgggtattcgtggtggcgagaaacgaataaagcgaaaccggaggggaacgaaaaatcaacgtcagagacggagagagtctgagaacaggcagagcccctcttgcaaagtgcacatagtccgaaggccgccgaactgtttctgtaggactctcggcgaaattagtttacagatcatttataaaagaagcgtggcacatctggcagcttcaaaacgagaaagatttgggaggcggtccaacgtttatccaggtttgctctgcgacaagtgtttcagcactggcgaagcgccgcaacgcagacggggctctttccgactcgaaattttcctttttaggcagcatcaacataca

SEQ ID NO: 1842 - DNA, 1495 bp, Toxoplasma gondii
gaaagtgcaagccaaacaaaaggcgacgccaacggcaggagtttcaacatgctgctcaggtggaacgcagctgaatggagcgaagagcgacgcgacgttcgcaggcgcaggctggctgggggtggcgactccgtctcccccggcgcaggcccccgggagttcggcagaagagcttttgctgatttaattcgagcgaaggaaggatgcgtggagaggtggagagggtgctggagaagacaggagagacgggttcgaagaaaacgtgagcgacaggcgggatttttcaccgatgcgtggaatggcgtttgtggctgcggcttgttttcccgcggtcgtttcccttgtattcatagattgtccgcctgtctgaggagaggcacaatgggtataatctttctgttcttctcgcatcagtttccctttttcagtggtgtgcgttcgcgtttccgccatttctttcgtctctcggcttgccgcgcaagcttcccttctcagtcgagccacggtgctgacaccaaagaagaaagctcaactgagagtgtgtggccgcactgttcactggacgtcctttttgagggcagggtcagtagctgaggcagttggaagagagtgaagaaaacgggacgtctttcgttgtagatctgcgcgtctgtcccgaaggaacgcactgtttcgtaacttccggactggatctggtgactcccaccgttgcactgcgcagtctctagtgcctcaaacgagtatctctcgtgtcaagacgtggagaagaatctgttggcgagtcgaacctcaacgtcaaccgaaagctcgcacctcatgtgtaaagaactttattgtccgttgctcgtcactggaggtgtgttcagttcccacgtaaaaaaaacacggcagttccacgcgaggagacgcgaactcgtgaaagcggcatatgcagcggtgccaaagaaaatgccaaggacactgaactttggaagcgacgcagtccggattcgcctaccggtgtgtgagttgacatgtgcgcatcttcacctgagagtcggttatagaactcacggccttgtgtgtcgttgcgcgcatgacacacacagcggtcggcagttgctgcaggagggcagctctctcatgctcagacggcaaacggaagcaagagggggaaactgtgcgtgggaacgggtctggtgacaacatcctcaactatatgtatctcaagacttattcaaggctgttcgtagtcaagcggatcttggcagacagagtgtcacctaggcagtagcagacataagccacgttgcgttttttcgacaatttccacagccaactgcagtcgcaagttaaaatatcgtttggcaaaagcatggaaatcgtgtgtctaggaaatggctagtggtcttaactgccacgatggaaaagggcgtttcggtgtcacgtcgcccccgtagcgcgttattcgggtttgagaggatcccggcgctatgtgtgtagtcgtaacagtaaa

SEQ ID NO: 1843 - DNA, 2253 bp, Toxoplasma gondii
gcgaagcggtgagggtatcattgacaagtgtgaggacaaaacgaaaaggagaggcaacgtgaaaagaaccacggcacttgccagagggcgggcaacagtcggtcaagtcttggtttctcgagggtagacacagcaggtactttgagtgagccgggcacacggttcttccactcatccaaaagctgagtgagttctgggaacgttggaaaggagtcctggcgaaagaccacgaaggagaagaaaatccagaaaaaacaagcacagactgcaggaacgccgttcactgccgcgagggtaaaaccaggggtgttattcgagactatgcgaaggcgagtgagacgaaccggcacagcagactctgctaaaagagaagctacacacgcgaaagacaacggcagatttcatcagctgtggagcaccgaaacgaaacacacgggacaaggcagtgagaatgatactgccaaggatcgacacgcagcagaacggagtttgacggatatgcaaaaggataatcgaagggaagaggtacgaacgggagatcctacttcacaggccttctcaaacagggggttccttaggcgtcacagagctcgcaacattgccgttgaactccgagaaaatcatcgcgggacggaacgagagatgactttaagaccgatggctaacgcgagaaggatccctgcacacgacagataaaacgaactgttagcggcgggaagacagagggaatatcgctaagggaagtcgttccgaagagtgaaacgtgatgtcgaaaaggttcgcgccgctttttcggacggggaaaggcactgcaggcgggaaatgaagcttcccctgagcatccgctgggtaaatgctgcggaaagagaaagacctcagaagtaactgagacttgcaagatttgccagcggaatcggaagtattacaagcggaagtctgcgacccgtacatacggctcagcagaagcgtctcaccgtacatgcaactctttgacacgtccagcgttttcagattttcacagtttcttcgcgcagcagctttctcagacctgcagacgcgaacctctccacaggtggcgctatttcgctgtaatttacaagacgagaacgggtcgctttctccgggcacaacgcgacggtatttcgtgcttttcggcctgcggcgttacggcaccttttttttgcgctggagcacccccctctcacacgcttttctgttgaaacttgcgcaggcgacagcggagtaggtcgtgagtaggtcgtaccctctcgcagagcgaggcttccgcgcttgccaggacgaggagcgagagacgaagcgggagctgttgcgtcagtttgcatttccctgcaggaaagcgacataacgttccgattttgccgagtctttttctcaagaaacgagtcggcgccgagacggcaccccgtttttgggtggcgctgctggggcgtgactcttggaacaccaccgcgtgaatctcctcacgttttcagccgtttgtctggacctgcacacttcctttgccttcacaaaacgaggcccttttttcgctcctcctcgcatacgagcacacaagtatgcatatgtagcaacctgtggtctgtggtttatgtggcggtacatccgctgcactccgtggctactccccaccgtggacgcactgcagagagaaaaccgttttcggtgtttttcgtcccctcttttgattctggcgaagtctttctgctttctcaaacacatcgcgttccgctcgcttgcgccttgcgtctgctctgcgacccttcccggtttgcccggcgactcgaagttaagctggtgcatgctgttcgggatctaaacaactgcagaaatttgctgtcgcgtgtctctgtttctctgctcgaaaaacgtcctgctttcttgtgatcgtggtccagtaccgagtttggtacttacatcgcatcttctgaaaactttcctccagacgccagtaccgccagtactacatccgctcgtcggccccacgaggcgtgactggctctctactcggttttcgtggataaatccatctgaaacagacgcaaaaaacatccgtctgcgaggccctctccagaacaggcaaacgaggctttcgtcttgcacttgcgtcttcgcttttcgacccttggaaacgtcaactcgtgaaacggggctgatcgccagcattcacgacttgtatctgcctgtaacgagaactggcctgcctctcacagacacccactgagagcgacaaaa

SEQ ID NO: 1844 - DNA, 1779 bp, Toxoplasma gondii
ggaaaactcgcagatacggaaggccgccaaacctgcatcacatccccggtagaagacgagcgagaaggagaaagacaaggaggagaggaagaagcagaacgagggggggacaaagcatgggccggagaactgcgaaacgaacgagactgaagagctgcgctcatgtccgggggatcgtgtagacagttttcccccattttctcgcggcatctgaacgagatctgcttgtgtgcgaagccggagaaaaaagcataggctgctgtctcctgaagcgcttgcatcgaactggataatgccaaggacatcaaagacctctccgacactgactacgttttctcctgttgctctgttctctctgtacttcccagggaggaacgcgcgacggactcgaagctgaaacggagaccctcgcgtcgaaaggagagcctggacggcgaggcgacgcaaagagggaaaaccatgagcaagaagaagggaagaggacaaagagggggaagagcgaggaagaagaaggggagaagacgaagaggaagaagcacagaggaagaagaggagggagaagacgaagaggaagaagcacagaggaagaagaggagggagaatggacactatctttggaggcgtggaggagagactgagaggcgggcgaaagagagaaagcgaatttttgatgcagcacgagaatggagaggaaaaatgagttttttgaggtgtcgagacaccgcgagagtttcaagatgcatcaacgagatgagcgagcaaatccgagaccctccgcggattctcaggaaggaggaaccctgttagctgtacaattgatcataaagcctatccaggaagaaataaatatcgtttctgtgaaagaggcttttctctctcaatccttcaatctctctgtctcgtccgccacccgcgcgctgcatctttcagtcgctgcgacagccgcagatgctcctccgcgtcctcagcgcagacgcagtttcgtcggcgttcacttgagtttgaagaaaggccatccaaaacgcgaaagaagaacgcgcctctcccggcttctctcgctgcgaatgtgtatacaagtttatataatacatgtacatatacgcagacgagagggggttgcgcgcgcgcgtctctcgcgttctcccgacgccgcgagcgctttttcgcatggcgtttttcctcgtttccccgttcggtcgctctccccgctctcctctgtgaggctttccttctcttcctcggcattcgttcacacgtcctcttcgctcttctcgagacgcgagaaattcgttcttcggcgcgagtctccgcaaactccagctctggcccgtccgtgcgacgccgcgctgtcttgcgttttgtcttccggagggtggcgagcttcgcctctccacgcaggaaaggctgcgaaagaatctggcgaaagatcttggagagaacgaagcgccggccaagaaggtgtggatgggaaaaaacgcgggagcctcgtcatacggtcatgtcaatctgacaacgtcggacgagagaaaaggcgtcgcttttgggagggcaaagaggccgctcaagaacgacgcggagagttttgccggacggccaagcgttcctcttttttcgacttcttcttctacctccgaagagctcctcctcgagtgactttccgtccctgagttcctcgcctgtcccccttttttttctctctctctctcctcggctgctcccagcctctcaggccttcacactgaggaaggagacactgggagactcctcctccttctccca

SEQ ID NO: 1845 - DNA, 3759 bp, Toxoplasma gondii
cggtcacgtggtgtgtctcgacaatttgctttacatgacgcgtgttcgacggccctgcggtgtacgtgacactccgaagaaaagtgggagccagaagaaaactctcgtcttcttggggctccttccccgcttgttcagggcttcccacttttggggtgtgtgcaagcagtccatctcgatactcaggtttacctatgtcgcgggcaaatccccaccggtatacaatatatctctttatttatctgcatgcgtttgtttgggcatgtggaaggtgttttgagggaacgaagaagagcgcagaaaggtcgcgggaggcgtttgtctgagacggtcgcgtgtccagaaccgggagagcagaatggattgtcgattttgctgctctaacatgggtggtgcggtctcttggtgtcactggaaaccagttcttgtccaagataccgaatgagcgctgtcgagaaagtgtgcttatatgagtgcctgcagagtccgaactgcaaacacacgaactggaattcacctcccggtgtgcaagggaaagcggtgtgtgatgtctgtcacgtttcccgttgaaactctccgtggagagatcggacatgttttcttcgctctttcctttctacgccgaggcagaaacccagtcgtttttccccatcacgcacttttagcacgctgttctcagattttttcgtactgcgtcgcaaacaggcgaaagtggtagtagctcagaagcgaacactccggtttcctggaattcgtatctggtggagtagtattcatttcacttgttagtccaacgtctctgtttttttcgcttcggatttctcgatctggagcgcgtaccattcgtccaaacgttcaatgtctccttacaacgtgggagcttgagaacatcgtgtggatacgatcttcgtgtacttgcagccggttttgtacgttgcagagggaggcatacggtatccagaaggaaaatcgctttcaagaaacaccaaagaagcagcgcaagaacaatgcgaacgaggaaacgttcattcgtgtagacgccagaaaacgcgcgaaaaccagaccccagagagggcgtagaagaaggcttttcctgaccatcatattaactgcactgagcaggtgtccagcgaatacacgacaaaccccacctctcgcgaccaacagcagtgtccgacttgcctcttttcgcagtttttctttttggcgtcttctcggaacactgctgtcactcgtattcacagcgaaaggaaactgctactcagaattgacgcaagcatgaaaaaagaaaacctgaggcacacagtgccgccagctagggcgagagagaagtctgacgctaagggaattcgttgcagagaaacacgataccagctctgggtgtgacatctgtagtttcggtacatctttcgactttccttttagcacctgtattttctgtacgtgtctcatgcctgtgtttgtggtacacatttcgagtttcctctcgaatacacagtagtcttgtctgtgtctaagctgttgatgactccgcagacggaacacacgtcatgcggagaatcgccaccattagaattgaagaaccgaaaaaagccaagaaaccaagacagaaggttgatgcgatccaggaaatcaagggtgcttgaaattaaacactgatactcttgggagtctcagaagccgacctcgtttcttttcaatgtagaagcgacgtacacactgcagtttttcgaggctatctttcacttttcgattctctcacgcaccactgcgtccttgaaacatccacaaaggctatgctctgttgagcactacgacagtaccgttctccacgtaataaaattgtggtagaagaggaaaaactcctacgtttacttggggggtgtttccactaaaactaacacacttgcttcccacgatctattctaggagaccgcgtgtacaacgtttccttcggtgggcactctgaaacaggagtcttttggaacggagcaaatgcaaaggtgcattgtgtaagactttctcgaaaccttttccaatctttcctctacatttcgtgaaaacaggcaaattgcgttaaaaattgcagtcagttgtggccacgccttctgcgataagcgagtgccgtagggtcagtccggtcctgtacggagaaaggatgagcgaatattctgtttaagcttttctggggagtctacaccacaagacggcccccggtttagattttgaaatgtttgttcacaggatccaacttccattcagttagtttcgtttcgaggagaaatcacacaacagaatgtgtaatggatattgcgggagccacacctaatgaccgtcttaggaggctacatggaatccagcgactgtgttacctttgttgtgtcagcttagagtctgatggatcatgaccgtctgtgcatctaagttgatactggggtatttatgttagactcgaacctcccggacaaactgttctttgttctgcgcggacgaatgtgaccacacaagatcgtcgagtacaacggtatgctcctgaatggaacggtgaaaactgtaaacacagaactcgtttcggaagttgaatgcacttttaagtggaagcagtaaaagtagcctgaagtgaacctcttaaactggagtcaaggaggcgcggccttccgacaacatatatgcctgagggctgcgtggcgccttttgtcagaaacggttgaggcgtcaggttgcctgtgttgagtcaggtttccatgacaaacctaccacgtgaggagttgtcgggtatctctctaagtctggcacaagttaccattacaacgtatccagtgtttgaggtttaaagcatctggaaagcgaactcaggacaacatcgatttccgcgtgtttagagcgtggcggagtttcctcagcacaaacgattcagactgcaagttggctttcctgcgcagttttcttctgcagcatagagtctctgccttaactctgactccactatgtagctggagtctcgctaacacacttttccgctaacttctccgttcaaacttcgatacccgagcaatcaaacagaccgtgaagcccaccacaaactgctgggatttcgcgtcaccttcgtcgtttgtagccagaggcttccaaattagcagaagcgactttgttttagatgcattcccctcccatccagagaactactgctgcaaagcgcatccgcccttttttttcaggcttctcgtcccccccgcggtacctcatgacacagccggctctttgccagcttctgtcgccacacttccgctttttacttgcagaagccttggatattttctgcgtttattccacctactaagaaggcgaaaaggaaactccttttagcagagatttttgcaacagaaagtctgcgattgggaaggacccggatgcaacttagttcccccaaatctctgtagaggttcttagccatcgtgaccctcctttttgcgaacgcgtgtcgctttctatgactctgagcgtcccgttttgtgcggtgccggtggcccccgcgggaaatggcgaacccggcctctaacagtttcgctttttcagtgaaggactttgtgcctttctgagttcaactgaaatgagcaaattcgatcctccgcagttgccgctgctgttccctttccagcttccactcggggcgtcttccggtgctcagctgactgtcgctgggcgcagagtgtgtcgagtgggttttttctcgccttctttctggggcgtttccaacga

SEQ ID NO: 1846 - DNA, 1412 bp, Toxoplasma gondii
catatgcctcactcgtgctggtcgttttggtagttccgttgctgtcctcagagcctaaggacggtttagtttatcattctcacaaggcaggccatatatgctgcccatagggcatgttctgctgcaccgcagctcctggtgtttgtttgacgtctttttgctcaaagaacacagtagcgccagaaacacatatccgcaatgctcgagcgaattcgaaaaatatgcatttggtgggtttgcctcatgctttagtgtctagtcatggggagaagataccactctgcaggtggtcatcagaagacaactctctccaggggccgggtttatctgccttacctggccagttggggacagtaacattacgggcgcgtgcatagcagcatatccggatatcggtgatatctggaagcgcggattggtttggaccgaggtggagaattcgcagggcagttagttacctgtctgaaaacaggagacgttgatgttagggcacctcgtggcgagaaggtgtacgatgtcggactttgtgccgagggggcagtcacgcggctctcctctgcagggaaatgcccggcagctcttgtatatacggccgaaacgccacgtatgtgcctcatcactcaccaattaatctgcacgcgcacattctgtcgttcacgggagcctggacgggtgccttcagttcgaaaacggcacgagattcgcaaactctgcaatcttaccattacagtcgaaccgaattcgagaaagcgcacagaaggattagcaggcatatctttggcagtggctgtgttccttgtcagagtgccatccgctgcccgagtcaggagcggatgccatgtttggtcggaagcagtctggtgtgtttgtccaacagtagctgcgaaagggaaaaggatacctaaaatcataaatgacttcattttgactcgggagccgttctactgcaccgatcgtttcgtcacatcagttttgactgaagtaagacgagaaccacggctttctgatatacaatgtcgtgctgtacagacagcgcagcaacgttgaagcatgcaaccagccctccgatgttctcgggcatgcggttgctagaaggagttgcggacgaacaggcagcagtcaaagtattaatcgttgtgtatctgtttgactttttgatcagatcaagtgtgttgtagagactttcaatttcagtgaaaataaatggcgggactcaaacggaaaaccgacaaagcagtggaggcatgcagatacccttttttttgaacaatcgctggcttttcattttcagcgttttctttatagcatggctgcattagccattgcattctctttaaatagacgttgttcaccttttatgtgtagttaatttcccgtcgtctccttcgaacgcaggtgtttggggcgtaaca

SEQ ID NO: 1847 - DNA, 2972 bp, Toxoplasma gondii
aacttcttgcgcccttcgagaatcttgtagtaccgctgcgaatacggcgccccggtgtacggattgatgccttcggggacttctccgttcgggtacagaggcgccgcggcgacggacgccgcgccgaccgttccaggcaaggccgcctgcgcaggaggcaggccacccggaaacgcgaagccgggggctcggtccgagaagcctgacgcctgaggcagcggtcccgaggagaagttcgatggcttggcctctgtgccatctgagaaacctgtccggcgccgtgcagagtcgccacgaggatcttcgtcgaaacccgtcgcgcccaaggcccgcttggagcccaagtccaacttgggcgcgggaccgtccatctcgagaggggggaaagagagaggagagagggagatataaaaaaaaactgaaggaagaagagaaggagagaagcgacgacacagagagacggcgaagaagacaccaacaggtagaggaagagacgagaagatacttgaggggaaaaaaaggacaggctaatggaacggaagaagagaagaacaggcggaagcaaaagtggatgtgagacaagagtggcggaagagagaggagctgcgtggacgaaagatctaaaagtgagggggtccgcggtaaagaaaaaagagaaactgagaacaagaatgcggagaaccggacggaggctcggagggaaggagccagagaaggaaagcgttgaaaagaaatcgcacgaaaactgggagtggcgaagaggaacacgaaacctgatgtttgtcttcgaaactccgagccaagtgcaagggaaacgcaaaggaacacctgggagagaggaggccgaaaaaacttttttagaaaggtggaaaaccgaaggaagaaaatgacgaagccagatcacgatttcaaccgccggatgccccacgtaatgaaggaagcagtttgtaggggaatgatgggactggtcaaatccccaagagacgcaagacacgtgtatcaggaaacgatagtacgtttgagttgtgcgggagattcgacaaggaaaccgcgttttcaggcggccgacaaaacggagaggaagatcgacgcagagaactggactcggagacgaagtgcgctggcatcaattacagagaagaaacgcgatgctgttgtgatttattcgtttccacgcattgctggagtgtatttcgacactcgagagtgcgtccccgagaaacgacgggagacactgacacgagcgctgcgcatgcgccaatctccatccccgaccctcgcgggtctaacagaagggcgatctagccagcttcagagtttccttcttgttcgagcatatttcctcgttttcccccccaattgttgcagtgtcgaaaggaaaagtcaactgaaaagaggaagtggggcagccctacggcatttctccgcgagaggaagcgccaacgtgcaggagacacgccggagggatcagacgcgtcgccgtcggttcctaccgccttttaaagctcctttctggccagaaagaaactctcaaactcttttcactacccgggcaaagacggcactttgcgcgcggagagcggccagcgggagagggggcgttttcctcgtttgatgcatgcaacgccctgcagcggcgcccggagcctggggcgcgagagcgcctcgccgtgacccgtgaccactgagaaaaaaaggagagacaccattcgacttctttcacatacaattaaacgtttctttgaagcagcacagctgcatgaagccgtcgagaacgctcgaacgacgccgaaaaaaggagggaaggaagggagaagcagtttccgacgtgtgaggaaagggtaggaacggggttcaggcaaagaaagacacaaaaggagggctggagaggcttggctttctacggaggggcgaattcgtgctgtggcatacgacacgttccaggtcgcatcccgacctgccgacttgaaatctgagagtcgaaagccggtaaacgagcttcctgagttacagtttcttaaaggggcgacgaaaaagcgagagtttgagatggatagtggccacctgtccctaaaggcggcaacagagccttgcctcagcagaaaaattgcaactatcgagttgtctctcatgtgctgcggtctgcttcattttgtatctacactcaaccgaggtggacatacaccttaatggtcgaagcgcccggcgctgtgtagcggactcaacgatcgctgctgggaaaagtcaaggttgccggattctgccctcagcggagcctgtagccgacagattatcaggcgccagtgtgacgtttcgatcaggcatttgaggaggaatcgcaaatcgacacttttggtggagatgtggaccctttacgcggcgcctgccgaagacacgcgactgtcttggtggaatcgcaagcgcacacactcccgggaccctgtgagaggcaaggcttctgcgcgcaagtccactttcggaaagtcgttgacacacacgcgtttcctctcgtttgcattttccgcggaaacgagaagaactggatttcgattgccagtgtgttgagagtagaaagaaccggaaatcgacacgtttaacaacctccattcttccaatatatttgcctgtcaatttctgggaggtcaactagcccctgtgctcgcacactgctgtctctcgccctcccgtctcctcgcccgcggcacttgaggtgtacgtacaccccacttttttcggcgtttgcggtcgtgactgtttaactcctattttccgaccgtcgttcctccagcattcccgatttttctcctaagtctcctttttttctactcgtaaaggcgcgccggcgacaaacgagcaacttccgcacactctcgcgctttcgacgcactgtctcgtccggcgacgcctcgtccaaagctgcaagtgacgcgcgacttcctccgtctcagtctgttccatccctctacccacaa

SEQ ID NO: 1848 - DNA, 1990 bp, Toxoplasma gondii
aaatgatgaggcggaaggtgaacaggtctcagaaaattgacgtgttctgtgctgccttgagctgccatagtgtcggtgagccagtgcttgaatctcacaagatgtgttagggatattacgtgaacagatcgccggtcgtgaaagttccatgttggcacagccaggccggccacccagttccgttatacagttgcttcgtcagttgtggtgcgacacatcctggtggaggtccaattccctgcgaatgttgtgccgaagaagctttatcccttctggatttcaattttagaatctgttcacccttgattctcctgaagctccatgaacttgaacactgtggccgtttttcactgataaatgagttgtgcacatcccttcccgaaggaactgtgtggagtatcgaggcaaagctcgcaatccttgtttttagagaaagcaatgaatttgaggggctctgctgagtaccaacggacatctaatcggtcttttttcacgacacggtgtcactctgttgtgtggactacagcggcctggataatacagcactgctctgatacagaccccgaaaaacacatcgttggccataagctagctcctcctgtgcctgaaaactgatacgcttgtacggcgggttcgtcacaaggatagtgagcaccttgagagtcatcactttcttcgaaccttctacttgcgcacaaaagcatgatgttgctcatcgctgccaccgctgctgagccaccaggtcatggattggcttcaccttctgtagcaggcgttccgtagtctcaatgcctgacctagtagtcctgctaaagtagccggcacgctaaaacgagctaggtggtcctgtagggttcgagggtgtctagttagaacgtttaaacatccatgtgcgatctcaagaacggaatttagggagtccttcttggcttttgttcggcacactcaccaggcataatattatggcgtctccactttcctaaaaagcacatggcacacggtgcgagtcgacccagtaaccttcgttgctgcgcacgcatctcttcatgtaaagaagtggaagtgcctaaaccaatacgtcatgcatacagggctgagacactaaaatgagcaacgctttgttagactgtgcgtcactttagacgcatcaccggacgccttccctgttcactgtccctgtacttgcagaggatggcccgcaaaagccgatcaggaatatctgcctttcacaacagttcattcaggacaatgtggacctgtgaatgactctgcttttccggatttttctccgccgtgcatgcactaccgttctttttttgcatgcgcgtccaccgttcaagtgtcttgcgtcgtccgcggtatcctcctttaagcagacttccgacaccgcttctccacaagtttgaacgaatgtgttagcacaaatgccccctgagtgtgtcacatgtttccttgcggtcgggtcaacctctaagtggcgacatgagacctggaactcccagcgacacacactcgagtaccaatgcagttgaaccgcccagcttggcggcatctgttcgtctgctccaatcataaagtgttttctttcagagtggaatcatgcaaactcaagcgtaaggagtttcgtagtctccagcgagtggacgcttgcggactttcgactctgacgtgcgtgtcttgttgcgactctctgtgaagtgaccgcgtaacctccgggagggcctcagcacagctttttcgcctaccctagagaaagctgttgttgatgtgcgtcaagttctgctgcagatcctttgagactaagcgcgcgctgcgtgttttgacgtggttttttgcccggtcaattgtgttggttgtttcccttactttgtcgtttcttcccgaactcccgcggttctcgtatttttcggatgtcatctgccacgcgcctgacgctgcgccagcgccactcgtgtccccacgttggacctcctcatttctggcgaaaaaa

SEQ ID NO: 1849 - DNA, 3022 bp, Toxoplasma gondii
gactctgaacttgggttcgtctgtctcgttcctccttccgttatctcccgagcagctggtcgctgcggaggaagcggccaaggcggctggggaggcggaaggctcgggtgccaggcccagaaggaagtcctcgtcatcgtcgaaggagagaggcgcgagtcgggaggaggcgcgttcaggctcagaagcgtctgactgcgatccttcttctcccgaggaaggcgccttggcggcgatcccggtggtcttgtcggggacgcaccccgcgcgcgaggagacagaaacagacgagtgaggagactcagacggagaggaacgaagcggctgcggaccaaaggaggcgtcatcatctgaatcctcttcggctgtacaagaggtgggtcgacggaggcaccatttctccgctctgacaggcgaagaagtcgcagccgacgcgagcggctggggtccgaagtcctcatctgaatcctcgtcgctcggcgtctcggcggcgattcttcctcctttagttagagaggaaggaaatccagagtgacgggctcttcgaagagccgacggaccgaaggaagcgtcggcgtcgctctcgcggtcctctccagcttctccttcgtcgcccgctgagtcttcctcttccacaatgcgctgaacatgcgctgctcttgctcgcgctgcatcctcctcccgccgctccgcccgagttttgaactgacggcccacacggatggcgcgcatttcctcttcgtcactcgacatgttttcgaaaacgcggtggaaacagacgggaagacgggggtgcaggctagacggtgccctgcacgagggaaacgcagcacgtagacagcccacagaaactaggaacagaaagctggagcactttcttcgagaaacagacagaaaaccagcatagaccacgtgtaaagaaaacagaccgcaaccctggcggttcgaaaccgatgagacactaaaccgcgtcagccaaaacaatagctgcagactcgaccgcagacgggtttcaacgaagactttttcgcctccaggggcggacgaaaaacactccctatccgactgagttgtcacgttgcgggtccctcgaccctcgggagaaagagagatcacaccgcaaacggaaaacgcaggaacataaaaggggatgaagcaacgcgagaacgggtcctgactgtactgtctgcgaagaggaaagcgcacgtgacaacgaggaaattccttacagacacaagtgaaggctttaactttttgggctgtccagaacaggtcccgaaaatcgactgaacagcgctgtggcgggttgtttgcatgcacgcgtgagaagaggtctttggcacagcgcgtccagactatccgcgctcatcgattcttgggtctctcgcgacgcgaacaggtcctcttccagcagtcgcagccgctcacaggatgctgcaaacaccagcaggtcgtttcactagttcggtttacgcattagcgctacgtttctgcgcaggcgacctgacagtcgcccagaaaacgaaggagattgcacgggcgtccgttgttgatccttcgaacctttgcagacaacacgaaacgccgggagaaactgagacaacgcagcagatgaagacatcactcgcacagagacgatgctggagctgtcgccgttttaaccgatgcagaggcagcatgcatcatcaaacttaacgcagctgcggaactattccagtccttcggtgaacaagagaaatgttcatttgtggcaactcttgctctcttgagaaccggaggggggactcttgctattcctgttctgccaatgaatcacgcttgagagactgctagaggagaccttgcttcttgtccttctggcccacaatgtgctacacaaagtctcgagctgagacgaggtgccaatgtacaagtgccgtccaagtctttgaactggccgtaccggtgcaccgctgcaaacgttcgaggatggacagtcccttaccgtgtacctatataaaaggaaatggttttctcggacctagatgggcatgcgagtgaacttcaggcacgaaaattgtcatgatggtgacggccgctatccgttgactacatctgaaacagtggcgtcggcatgggttcattcatgtagttagcaaagaggggaaaaccagttctcgtgttgtcaataccaagtttcaacggattctgcggggcctcgtgacatcgccaactgtcgcaggtgatgcgaaccgtacccggggaaacacttacaacgttgtcgagcatagatgcttatatttggattttcctggaaaatgtcgtgggtgtgtattggtcagcacatatagagaagctggcgatctcgagcaagcttttttcttggtgttacagactcccgttcgtcattaccacgcccacgtttaaaatggaagctgcggaaacaaggcccccttcagaatattagaaagtcgatctctgtgtcctccgactcacgcagggttcagtggcttgcctgagcgcgaatggacaacgacacgcaaaaactgtacagctgaaatgctctgctcgttggtttttgtgaaaagcctgtagggtcttagctgttgttgcatgtggtaaccaaggctcgcgctgaagtgaacgtgctttccccacgtttgtctctttcaaactgagactttccaaaaaattcaaaaaccagcaccatgttcaagtgtgcaaacatccatgaacactacgttgacagcaggtcatcagcaccgaacttgccgtacaggcgtgctggtcgggttcatatttcctgcaaacgaccctttcttgggtgagaagaatcatgcgttcgtattatcgtaaactgcatcttttagagacacattcacagaagtctttagttgcttttcaggaacgttgagtgacctcccgttctctgtcgcagacaggggctcttgaatgcaacggtacaagctctaaggctgtaatcagaggacttcttggcgtaaactgaaaggagcccagaaagtacaaaacgtacaaggattaa

SEQ ID NO: 1850 - DNA, 3664 bp, Toxoplasma gondii
gtctgctgtgcctgtctttgccaagactgcctggcgagaaaggaagccccagcgacccgtgtcctgttccgtcgcgctcgcgcccctgagtcccccgaatgaaccggtggaaactaaatctcttggggaatccgcaggcgaagcagagcgaggaagccccgaacgcgtcgacctgtgacgacgcagaaacgaagctgccgccgcatcgcgtgccttcgctgtcacgctcggcgacggatggatggcctgcaggcaaggagtccacaagagtgggggagcgcgagaggtggagagagtgcgacacagcgcgctggggtaggccaacgcacttccgcttttctcgcgtgttttgccggcaccaggttcgcttgcacgcaagggacgttttttccacgcctccgcctctgctgcattcgtccacacttctccggcatgcttcgcagacgacgaccctgcggacgcaagcacgaagccgactccgagagccgcgcaccaaactggggagcaaaatcgcagacggggcgcgaaaaaagaagacccacacgacagggagacagacaagaaagccatgcaacttctgcgtaccagaaggtccaacggggtgagctgctcgaggggatctttcctcggctgggcagtgggaggaagcgagaactctgcaacgtcaatgtcggaggcggaagcgactttcatgcggcggttgtcctggacgaacctgggaaggcaaaaaaatgcacgcgttgcatggacacagtgtctcgccagcttcaccgaaagagtcggcactccatcgacaacaaagcacaaacatgcagagaccatacttcgacgaccttccccaaacaagacagcgtgtgcggactctgcatgcagtgtacagacagaaacaccgaggaccccaagactgacaaccagtcccagctgaactccagcacagacacacacacatatctgaactcaaatgcccatatctatatatatatatatatatatatggatcccagatttcgcaaggaactgagtgtttgtcagtggagtcgatatctgcgggacacacctggatgtgaagcctgtagggaggtcgcgaagttgcaaatgtctggtcagagaaggcgtgagcaattttgggtctttcttcgcctggcgtcgagctgcaggcgagagaggctggatcctgtctctctttttcagttcctgtgtccagcactgacgaagcaactgccgacaccgtccagcggagggcggcattgaagagacgggagaaagaactagcaaacacgcatcttttcggggaagagggtgccccaggaaaacacccgacaaaagaaactgcacgccctgttcccttcgcgcttcttaggttccctagacatggctgggtatgattcagccattcagaggagctgaagttccacaaaagaaccacgggcgcaacgaatcgctttcccgaacggaaacgaacgacgcaaatgagaaccgcgcatgccttgcgcttagctccgcggcagcactcctcgtagaggcagaacgcggtggaatacgcgacaaaggcttcggagttgtgcgctatctctcgcgaaagacagagagaaaaaaatggtgaacatgaggaactctcatgtcgacctcgattcgtctcccgtgttcagcgggcctgttgtccgccctcgaaagccacagggacactgcggagttcaaaccatggcaagctgttcgctgaaatgcagtttaaaacgaaacgaccctctttccgaaaacgtgcatttccacgtgtttttttattttgctgcggtgtttctgcataatcgcggggatcggaaaaagccacttgttcaataagccatcctgcgcaaagtcgggagagtccgtccggcgccaatttcgtcgaggtgcagtcaactatttcaaaaagagcatgagacccaaagacacagaccttacaaagtgattcaagaactctgtatacacataaatgctacgtaggagcgtgtctgtctgtattccatgcgcgagtctcgatgcaccagttgactacgagtagctacactcgctgccttcctggtcaactcgcgacgtctcacgggagggtcttttccgttgaatccttaaaaaaggcatgtgaatacgtaaatctctccgcatggataagtgtgtatttgtctgaagggaaggggaagagacagccaactcaatctcttgcttatgacaaacttcggaaatgctgcagttcgaggcttagtgcggggccccacggcacggactacagtctcgagtatgccttgcatccgttaggctcgtactgccgtgtagagaagtgaaagggaactccaaggttgctttctttgggtcttctgcatgaagcgtcgtctcctttttgcgcacgtcacctcgggaggtccccgatgaactctagagaaatccgcgaaacaagagtcaaaactgtgagcgctctcaagaccccccccccggaacaaaagacggcccaaatggcttccgtagaagcaaatacacaaataagtgtgagcagaatcgcgtttgtaatcgtgcactttacatctattccttgataattcgtatcgcgtgctggagtaagaggaaacttcggcagtttcacgtgcgcacgcactccgcgcatggggtggctgtccgtccggttctcctttgtttggtgaagaactctgcagagattttgcatcgagctgtgaatagttggaagacggcgacgccctatgcgaagaacatagactagtcttgtcccgtggaggaagagttgcctctttatagcttcctggaaagaatgccagcgacgtagcttaatgaaaacgaagtgtctctgcacagatccagcgctctccctgcagacacttaccaaagtcgaacttgacgacgactctctaactgcaaccctctgagccacgaagaagagcctaactttatcaaaaagacgaacgcagtgctgccctcttatcgcacacagagagcgtggcgtcttgccagttgccaactggcaaatgaggtgttcttcttaccccacctgctcaagaagaggcggaggtagacagcgtatacgaggcaaactcgctgttacacatcgcggagaaggctgggcgtcacgctcagagttgcttcagctggtaaaagttcatcttgtctctacatgtgaaatcggtgcgcgtgttgagctctcgccgtcgcacgcgacaacgaacgtgcttcggaaatttccaatacctggcttcttcctttctctttcgtctccccgcaggcaagtcactctgtgacggcgggggcttatcgtgagcgaccaagaagggtcccgtgggtctgccggagtcgcaagcaggggaagaaaacctgccaacggctgacagagcagatcaaaggaacgggaaagagaggagggagaaaaacaccgtgacggaagggaagacgttagtggaaacaaactcgggaaaaccagagggcctctgtaggcttctctataggttcctcggcatcagcgacgctggttcgtggaattctctggggaaccttctctgagaaggtttagaagaaagcaaaacagttgttctatgctcttgcgggttaggagtgttggcgtgcgtctctctctcgttgcttccctctctctctctcctgagggaagaacttcggtttccaagaa

SEQ ID NO: 1851 - DNA, 2393 bp, Toxoplasma gondii
ttccatagctgggcgcagtgccaagttcgtttcttggttgtctttaactgctttcctctaacgcgcggacgcctttctttcctttttcactttaacactgtgtatcatgaaccagagtactgtacttttgtacgcacagaatacatctagctgcgcgtgttcgttggggagaggtcgaaaaattgcttgtcaagccatgccaattactaccttgaagaattcacacgtcattcgcttacggcaagaagcccggggtcgatcccatttgaaatgaaaactacaaggttacgcgtgtccttcgcttgacagactcactccccgatctaggctccacgtcttctgtgtgtactggctcttttcttgctgagttgtgaacagcgccctgctccggcgattccccgcattaattctttgagtcctcgtaaataactagcgtaaacagtgtcccctgactaaaggaagtctgctatcgaccacgtagaagaaagcgggaactttttccggggaacggacacgtccagcgaagcgcctcgtagcaacttgcttctcgctgcacttaccaacggtttctgatcctgtctgtgtatcggcaagaccaagggaatgcccggtttactgacagggaatttggacaccactgttaatggctttgctgggatcacactctggattatgataatgagaaaaatcagtgttgcgcgcaagcgtgtgcgtccgtcaccccgcacaattgccgccctgttaccagggacgccagaagcttactagattgcaacgtcgcttaaacttgttgcttccccatttgcttctagaaaagactcctttcaagactaggtgttgtggaaagggagctggattccatttgaaggaaggcttggcccatgacatttttatggttccttttacacgctcatgctaccaatcatgccacctagttgccggcgacatggaacgttctctggaattacctttcagtgccgggagcgaattcgagtctactgcaggcaaatccatcggagggactgctgatgccacaactgaacaaatacgttacgggtccctatgcgacacaccggtcctgtcttgcggccagactgtgccctgttggcctcatgaaattttcttatcgcggcttactgttttgtctgggtggccacattttctctgtcgcttttcagaagcacccaccacacctggacaggcattcgcgacactgtcacataagctcagtgccactctgggacgcaggcaatgaagcttcgcaaagtttttgcctgttcacttttcgtacacagcggcaagcgtaaacatagataattcgaatgaaatgaagccaaaggtcaccataagacgacagacgctgcacaagttcacattccccgactcacccagtggttaggtcaccacgacttcgtcaccgcgctcacctgcctgctactcttattgaagagtactcacgagaaagcttttgttggtgtaattgtgtgcatttaccgccaacctcattagctatctacatgctggtgaacaggacacataatatgtcaccaggtgtagaatgccaatcataccgagtgaatactgaaccttgagtgcccgttactcgatgcaagatggggatgtctaagacacccttgcgcttactaacaattccttcttccagattcgaatgaagttcgtctttaaatgtgtccaatatcccatcgcgtagcaggtttcgactgtcgaccgccttccctagacaagtgtgccaatatgcctctctccaacgacacaacaactaacggcggcatgcgtccgttccgcctgcttgatttaaccaggctatatttctgcttctgcgggtgtgtgtcagggtcagatcatctcaatcaacaagaatcatcttaaacggtatctcgtgggtctcgtcaactcttcatcgttgcatgcacaaggaaaatcagaacagaaccttcattcgcctggagtaacaaacggcggcctattttcgaggcttgctgggggatgttgccgtcagaaaaggaacctggaacgcgcttctctccattctttgacgagacattccttcggttgtggaggacttgaattcaaactcgaagagagcagttcggctgccggggccgaagaagctgaacttgaaagagaaaagttgccccgctgccgtgctaggactctctgcatgtaagactcggtgggtccgcgtgtacgttttgaaggaacgaatcgaccttttcgcaaggagataaacttccttctttacttagtatcttcgtttcgttttcgtggatttggaatcgtagacgacgggctcgttcggattcggttgtgtgcagaatgttcttgtcttgccagacacgcctggctgcagttcgcttcttctgtcgacagaa

SEQ ID NO: 1852 - DNA, 2389 bp, Toxoplasma gondii
agatcgtcttcgtgttttctgtcaagaattcgggaaggcctttcgctttttcacagagcgcatgaaggctgttaaatgagcggatttgcctcgctcgtgtgcggcgagtctttgcttttgaacgtggaaagacccggaaaagaggaatttcactcacacatgctgcggcagtttctgccacggcttgttctgccaacgaaccgactcaaagtgtacacttttcaaacaacgagcttgcagttgttcactcgtgtatacgcttgaaccgaatgcatgtgtatgtatatgcatgcacatatacaatatgtgtgtgtcacgacccttcaatgtattcaggcgtgctttgaaaacgggttcccactgtcgttctccagtgattctcagtctttgtcggcaaactcttccttcagatctgacgctggtcttcggcgatttccacctgttttccctggaatccctgtggttcgctcgaaacctcagttccgcttatattcagagagccccctggacacacaggtcgtgggcggaccacctcacttcaaggtgcgcccgttgggagttgctatgtggaggggttctctagaatctctccaattttagaaaaatatccttttcaaaacaaagcagagctacggattcggggaacgcttttctcttcctgtgtcggctgtcgaccagaagcactggttttctggagttgatcgccttcccgccggagacgaacagaacaagtctgaaatttaaaacgagaaacgcgcatttttacgttcaacgattaggccgtggatttcgaacatcagcacgcttgagacacttctccaacttcagagaggactacaaactggagggagattctcactttcttcgacactttcgaggcacggtgaccatttcaacctttagagaccgcaggtagttttacacgaatcgtaacgggacacagtcttgaatgtatgttcgtgctggattccaggggctgacacagcgccgtcaagcaagctgaagcgcggacagtcgagtgcagtttggagcattgattttcgcagtgtttcgtttccgtggatcgattgataaagtgtggcttacagatgctgtagtgcctttaaaagcagtgcacagcatagctgtggctccgtgtacctgcaaagggatctgcattgttccaagggtcgacactgcacatgatgtcgacgcgactatctccgctctaattgagatttctcgccctctgtagacttttctcctcgcgctaatttgttgacgctgtcgcatcaatgctaaaggggtgtacgtgtgcgcagaggagcagaaatccttgttcggttcgaagtcctacaacatgtcgaaacggatctctcgtagtccccggtagggcaggtccacacccgcacccgtctgtcggtcgcgaggattgccacgttttccccacatatccacagttacaaagtcctgcgcatgttcgacgtgttctctggttttgtacacccggacttttcccccccttttgttttgttggaggaacccgtggaaatcatggactcgtcagtaaaaactggggtttcttcgtacgaagaacgaccagcgctttttccccattgaatacatccttctcatcacatgtgcctcctcgtccaggactttgttttgcggcgagagttgataggcaggccctcaaattgctcgacaaggtggcagccgtcatgctaactgttcagtctgtttggcggaacctccggatagcctcgcgcactacaagaaggccgcgcgaaatcagaatagcttcttccttttcttttggctggcatcctcgtcaaatagattcggactgcttcaagaaatgccagaaaacaacagcgtcctttctgttcttcgctgttctagctgttccactccaagtcattggggcgcgtgcgtgtcttcgggtctcggttgtgacctcgtcgctgtcttgcggcttgggaaccctttccagagtcacctcatgcggttacactccaatgcttttcttttcgaaagcgcgaggattctcggagggtacagacgcgagaggattgcgaaagcgtgtttccatctgttcatttaacgccgtctggtttcgtttcacacgagcggtgctagcgtcgcgccgccgtccacttccttgctcaacttttcccttccactctcgtcttgctatgacgcgtgagattccctgtcgccctcgcagatatttccttctcaaccacagtagtttccggtttcaacgcttcttcttcggaagcggaaactgtcgcatcgagtgcgctagctagtttgcggtgcgccttgccgcaagagttcgggacttctccctgtgtctctcgcgaaaaaaccctgggttccaaacagagcaatttcgggaaatttttta

SEQ ID NO: 1853 - DNA, 2862 bp, Toxoplasma gondii
cctgagaacggtttttcgcgattcgaggctttctgtgaacagagagcctgtctcccatcttcgtctccatctgcgagagccgcggcggagaaggtgggggaacaggagacggccagcggttctggctgcggcaggccaatctcagttcgctctctcgcgggtcccccgatgttgtcgcctagcgtctccgcatcagaccgaccgacctccgcgctgggctgtcgggagtccttcatgcgcgaagttcggaaacaagaaggcgctccttcagctccttgctgggagacagacactacatgagcagaagaacgggggagcgaagaagacgcgagcgaacaaggagatggaggcgacagacgggggagagaggagctcggaggagaaagcggagacggaggtgaaggaggaggagaaggatggagagagcaagcagcacccctaagaggtgaaggagaggggagaggttggttttcgagctgcggagagctgaggcgagagagaggcgaattcatggaagaaaattctccggaagccggcgccgtcggagcgagtcgctctccgagcggcgaactgtttcgggccattgcttggcagagaagaaaaccaaagacacctgaagaacacaggggtctcgtcttatttttatcgagctgtaaaacgaggcacaactgctctgaagatgtccccgagagaaacaaccagccacgatcggcgcatgtccacagttgcttccgtcccccgacctctgcctgcaattcttcttcctctctgttcagacgagtctcccaggactcctttgcgggtaagttgtgagcgagacgctgcgtgcatgccgcgcagcctctgtagcaggagactgtgaggaggtcctgcaagcgggagagcgtctgttggacagaagcagtggaggctgagtggggaagaaaccgagaaggagaccgacaagggaagcaggttttccgctctactcctggtatcggaggacaccccactcttggcggctcgcagagtgggcaagagaggctgaagaggaaccgcgtggaggcttcttcgtcctctcttccggcggcctcagaggcagcgaaagcagatccactgcggaaggcggcgactcgaaggggagacacatgagagagagaatgtccgagtaggcgcgagaaagctctggttttgtgtggctggaagccgatgagaccgaagaaaactttcagacagcaagctgacgaggcgcggaagtgcaggggaaaacgggattggaggcgaaaacgagcggtggtggggaaaattatcagggaaaatcggaaagacgtcgagaccgctgcgcgcgatacgaaatgttttccaaaagttgtgtgcgaaaaactgttgtcacctacgcgcgcgcgtcctaggtccgaaaaaaggttcgatggttagatgaacggctacacagacggtagacatgaaaaggagacggcgactcagaagcaaatgacgactctggtcgagtgacgacagccatccatttttcgtcttttttaaaaatacccttactcgggaagaaagtttggacatccggtgtgaaggcggcgggtcacctcacgattcaaggaataccttcaggaaatccaacaggtaaacagcagcactaaacaggtccacatctgtggaacaccctttccatttctcttgcatgagttcgatcgttaaatgcggtttggtggccgtaacggagagaccatcgcttttttcgccaggctagttgaacgacgatgtggacggcaaacgcgcgaaaaggggcccaagtgttatcaaaggaaaaaaacaaaaacaggtagtttcttcaaggcttcgcgcctcttgttgtgccttcgggaaattaatgagctcaggacaaagtggctgtttctgccttgctatgctgtcgtgtgtctcgtcgtgttttcctcttccttcttgctttgttgcgcgcggggacccagctgcaatgaggccagactcacgaatgcttcaggtcttgctctgacgccttttttctgttggaaatcttcagtgggctcacggcctggatgacaaaggcctcttcaagagaaacgtggttgttcagacggcgtgagtttgcttttcgccagttttaaggtgcaggtgtgcagcaagaaggaacgcgcggctttgccctcccgccgtttttttccgccgataaggcggactgtgcatccttgcaaatgaggcgggcatgtgcagtccagctgtcgcgcacatccaacgcgaaaggcgtgtcggcgcatgtgctggggtgaagcgaaagagcgggagacacagcaaggttcgaaagaatagaacaaaaatctttgcaggcaggttcctagagcgttgagagaggggcgcctgagattcttttccagacgctgtctgcgccgatcgggaattctcggggataagggatagacgagacaaaagagccggttgtttctgaactgtgttgtgaggataattgtcggatctctgcctcaaaaagagaccgtttcgtagttcagtttctgagtttgcgcgttcgccactgtcgcccgtccgttctgcgcgaacgtttcagcgcgttcgccgcagccgttcccccgctccccatcgttcagtccacccgccatctgtttcctcgccccgcgtttcttttccgtaaacattccctttgctgtccatttccgcctttctttccgcgccccggaacgaatccacgaactccctctctctcacggttctccgcgtggcagctcccgccacacactcgggcgtccatacacctggtggctcgtgtcagtttcccagtcacgcgagctgtcacttctattgttctgtgattttcacgagtctgcctcagagacaaaa

SEQ ID NO: 1854 - DNA, 4652 bp, Toxoplasma gondii
gagaacagggagacagctgtggagcacaggacgaagagacagggattaccggatgtttccttgtcaccgcgtgtctgctcaccggatgtaacgggtgaaagtgccactgcagctcgctgtgtttacagtgcacgatctgcgttgagtgatgaggaaaaggtgacaggggaagttgaaagccacagaaagggagaatcctcggtatctgataaatcggcgtcggaaggactcgcagcgagtgaaacgagagaccccagagaggcaagacaacgcgatttgaaatgcgaacgagacacgctttgggggaaagaggagaagggtagagtcgccagtttgacagagagggtcggtgaaaacgatctcgctcaacacacaatgagaggtggcctcgcggaccgggggaaaatagaactcgataactgcgctgccgaagacgaccaaaaagcgttgatgaaaaggctgctgttgatacgaaactcggtttcgtttgatgccttcgctcctcctctcagacatcgacggcgggagctgccttcgaatgtcactgcggcggacctgcacggttctgggggggcgacgggggaaacggagcttttcagcgagcatgaaaagcctggaaatgaagcggaatgcggcgacggaggcggcatccccgagagagaattgcggaaaaaagagctaacccaggaagacgtcgcgaaggaacgcttgagaggagcagaacctgcactcctgggcgggaaaaagtatccaaacatctggagaattgcgattttttcgcctgagtgaggtgcagggacactcgagcctgccatcgaacgaggcagagcaggaacatttgaactttttattgtacgagtttttgcgcggctcaagaagtgtacccgcacagatcttcacattcgacagcaaaaccagtggacacacatcttgtacggaacctggaaatcggcaggcaattgcggctgcgagtcgcgtggcaagaaactgcgacgtttcacaggcgacgaatcgtgacaacagaacagggtggtggaatctccaggaagcggcttggagtcatactcactatttcacgtactacagtgtgtctatttagtcttcatttcagtcatacgagcgtgaacacacaatatcaccgaatataagggtagaagagctaatcagtgtttgctagtaaaaaaattccatgaggttcgccttcatacagttggagggcgatgagctttctactgcatatagaggctgtagtagactgactgcggattgaccattgaagcagcaacctgattaaggtcagcttgcagaagacggacaaatgtcgcattcactcctgagtggaaatagattcagatgacagggaaggcatttcaacgacacaaacgcaaggtattcttgcttctagaaagctccggaggaacattcgatcgcttgtcgtcggattcaatgccacggcatccttctgagagcagcggatgattggcacccgagtgctgggcaagaactgctcaaaatgacttttttccgtgtgggcatttcagtcagcgttgcggacgcgttgtccgctgccaaacagctttccagacactctttgcagcacgttcgattcagttgtccggagaccttctttaaagtactttcactgagtaaaagtctttgctcgcagcaaacggaaactgatctttggcttcgatggttgccatggcggtgaagcctgaaaggatgatgctgtcaattgagatgtccccttgtcgatgcaaaaagtgagacagacctaggtcgacaggcccgagtctggatggtgccgtagcgtgttccccgtctggcatatgttagcatatgctagcattaaacagtttcctgtgtaaagcttgaatgtaaaatcttcaacacgccttttacctacgacaatacaaacgtggcaaaccaccaggccaacccgtaaaaacacatccaccggcatgtagtgcacggtaattctttttgaggattggattcatggtgacacctccacgtacagttgccacactactaccgggtttttcactgtacttcatagtccggacgtcgatccgcaccggacctacgaatcataatgagggcaaaagctgaactcacgctgctaccgtccagtgacaactgtcccgaaacctactggacgcaagaagtgaattcaaaactccgtacggtggactcctcgggagacgcacgtgttcatggccagacttccgtattcgtgagactgggaacacaagaatccaacaactaactagaaacaaaacagtggataccggagtgtcaccattgtgtctgacaccacggcccgttggggtatggtcaacgctaacagaagagttcagaaactccacagacctcaagagccactacacttcaatgtgctttataaaccagtggagctgaaaaactgtaaaaagcctttttgaaaacgatcccaataataattccgccgccgggacttgaacccgggtcgcgcgggtgagagccgcgtatcctaaccacctagactacagcggatgttttctgattggtggattaccaccagagaggcacgaacacgcacctaacaaacacagctgcgcctggtacacaagtcactcaataatctgcaagagccttttgaagaaaaagtatccgtgtttcatataatgtagaaattgaacccgggtcacgcgggtgagagccgcgtatcctaactacctatactacagcggatggattgacccatccacttttcctcaaacgatttacgttctcatccagtttatccatattttccacagtgaccaattctgaaatcgcttgcgttttctctcaagttccatttcctccacagcagctccattatcggacaaaagtggtccaggagccaccgaagcatcgatagccctgcagcaacagaaaggacggaaaacaatgatgtgatcccatctctggatgctgtacacggttccgcgcacagaaatcgccatattcgcaatgcctatggccaaacattcggttcgggaatacatgaggcacacgaatccactggcggcttgcgtaccgaatatgggacacacagggggcacctgcagccatgacagactgaggatcaccaaccggtgaggcccatacaagtattcctgagatgcgaagagagaatggagctgatccgcattggacttgacataatgcaaaaatgatagtgaggggaacgcaacaacggaaacaaacgtatattccgccgccgggacttgaacccgggtcgcgcgggtgagagccgcgtatcctaaccacctagactacagcggatatcgactctcaggcattgccctgccgagctatattttgaccctgcggacagtgcttccctgtacctcctaaggtcgatgtgttttcgtccaagaatgcggcaagtcgatagtgtacctcagccgcttttacagctctgctgctaaactctgttcgattagaccctcagttctccgcctattcgccggtggactatgtcgcaagaacaccggaatcctgttcgcagaaagagaaagcggcgtctgtctgtttaatcttccctgcatcatggaagtgaaaagtatcggcgcggagatgttttcctcctgtatgaagtggactaagactcccgaactgatcatatagaagacgacagtgctggagagacgctcctgctcgaataggaactcctgtttcttaaaacggcaaagagtaaccttcagcgagacagtgtttatcgaaagaagttagcgtttcggctgcatccgagaaatccacgttgcagttgtgcttgacatgacctcatccttccgtgtgcatgcagccctctgacaggcagctccgtatcagtctcggagttgaacattaccgccgatagcgacgctctgtggagactttcgcctgtcactgtcttgccttccatttttgcttcaccttctcaggcaaagttgtgagcaaaagcagctgaagcacgggtgggttttcaccgtttcgtttgccgtgccgtcggcgcatgcgcttgggcacccagcgtggtcgcagatgagaaagatacgacatcggtcacctgtttctctgcacccttcttcgagactcggagcgtttaaaaaaaaggtcgagatatgcatctgcttccagttgacaagtctcccttgaagccgcgcggagcccgccgtcaaaagacaggttccgtgagcatcctcctgttggttttcccgatggtggagaactctgaagcatcctaaaatgcgagatccacatgaatcggtgattttctcacttttataccttgaagttatcggggtaggcaattgggatacgtagctgtttcagattctggttgccggctcgctgtgcgggtctgtgacgtggtcaccacactgtggcagcggcgccgaactttctgtcgtttttctctctttcgattgattcttttccactgttgccacctcccggaacttttttcccagtctgtctcgcagaattcgggagaaaacacggaagcgctcccgggtacgcgcagcccaagcagctgcatggcaggcagaaaggacggacgaaacggaggcggggtccgttaagtctgttcgtgtgtttgcctgtccgtctgtcgcgtctttttcaagagatttccggaacca

SEQ ID NO: 1855 - DNA, 1985 bp, Toxoplasma gondii
accatgcacagctgactgaggctccttttgtagtagcttgagactgggcggaggaaaggcacatcggacggttgcctgtagcgccgctgagcatgagttgcctcggacgcagtgagtgacaagttatttgcttgaacgtaccgctgccttgattccttccatacgtttctcttgtctctactgcagttgtttttgcgggcgagtcaccatgggcgtttgctttcggggaaaaggggcgccagagcggcgagggaaaaggaactctgcctcccgaagttagcctactgataacatgatgtcttgtttgtcacttccaatatgtaagtggaagaggacagcaacacaacccacaggcgcagagttcaggaagtttctagtgagcaggttacactaggatgaagtgctgaaacgacgcgtaggaacacaggcgcatacgggctcacttgtacgcgatggagcagtccctgaagccagcccctggtacgcagtaaaggcatcgcggttgtccttccttcaggcaacgaccacactgcttctgtgcttccgggcgtattcgcgttactgtgacttgaaagtatctctatcagcacgctagtggagtactgaacaggagagcgagtgttgcgagtgttctggatgagccgctacgccaatagctcgaatagcccaaggacacggcggctactgccgtcagtggccgcttgcacagagagactgaaagtgaccgttccgtcagacaagtggctctcgtttgtaaccacacggggaacgcctgaccggagtaattttggcgttccctctgtgacgcgccagtgcgtcaagccgagccttactatgtttctattgaactgcaacagatagctcttcaaagatttgggtcctcacttccggttttttgacgtgcatattcgtatcgctgtcacacgaaacccgtcccaaaagtcgacccttcttcctaagtgaacgtgaatgtggcggacgacggtgctatcgctggagacgtggctgtgaaaacgcagtcgagcagcgccgacctgcaagtcgattttcaggggtgatcgatattttttttctagcgtttaggcatcccccacgatgttcaacggcgaaatggaacggcagctatctagtcaggaagctgtgtagtatcatgccaacagtgtcgagtagggtctgggtcaatgagtatagagacctcgagcgagatacaagtgtgatagcctctacaatatgatatatgggtaatcgtagaggccgaactgttcttggtgccgttataatgctatactgacatggctcctgccgatcacgtaatacttttgcattgattcccagcaagcctaacggaataactgtgatgcctcacaccccaccaccggcatctcagttcgcgacgcactaatcgaaccagcggttcttctcccaccgtctgagcgaggggacgaagagggagctaaggactcagcactctttgagcgaagaacaaccgctattgtccacagcaggcgaagccggaaaagcgtttctgattccatgtgtagctgccctacaggggatttcctgcacgcaggcaagatgctctcagcaatgctgcttgtcgcaatcgcgcacatgtatgctgtcgaggggtagagacgcagctgctcgacccgcagaactactattggcattgctgtcgatcctgcgttctttcagttcgtgcagagaacgaaatgttattggtcttggtctttactcaatacaccgtcgctggggggtcacactggcatacagacgcatcaatgcgtcttccacggatgcaaaatcttctgaagcattcagggtcttcattgcttgtttacgcccccacctcaactgttcatggttacgcttcggcaaacacagcctccgtttgcctttgccgcagcctgtgtctgttgatagcggctcttgaacgatccccagtaccgcacgtgctgctttgtcgagcaagaccactcccacaa

SEQ ID NO: 1856 - DNA, 3907 bp, Toxoplasma gondii
catgtgcaggaacatgccagaccggaaggagatgaagatagagaaagaataggtgtgggagaggagcgaatcgtgctctcacctctagccgaacagccgggagctgtttggacgcatagagcaaaagagaaggaacccgaagacagcaaggcggaagtggctgaagccattcgccaggcacaaattgatgccatgaaacgaaatggggtcacacgcaaacttcccacaagctggctccgaagagcttgaaaacatgcatgtagggaactgtcggtagagcgcgctggttttcctcagtcgtgtcagaagaataccggatccgctggcacccctttgtctggcggtgagtctatggaacaaacccacgaataaaactcttgttcaccatctgattcgatagagacagacagaaaaagaacgtgccttgacaggcagaaccaaccgtgctgggctcggacgaaaaatccgcatccacacattcacggaatgaagaaaacaaagaggcgactcctctgatagcagagagaggaactcaccaaggcggtcgtgtctctctcactggaaggaaggaaaagctgaaaactacccgcaacagtgtcttattactggagcttgaccttgtgtcccgtattgttagagcatgtcacatatgcttgcaactccattcgttttatttcaactgttttacgtgccgtctagacgtcaaggtgaagttttgtcttgagttatcaactcgccactgtgagtctactcttccactcgttttccattagccctgtgctccgcagctactgtgtgcacgagtgatgaaaataattccttgcaaagcggttttttacatggcctgaacagtgggatctcgcgcagaacattctcactcttattgatgcctcagaaaaaatgaaggtaggaaagacgagggagaagttgcgcagccagatgcaaggaaaagagaatgaagatcggagcatcgggctgcggagacactcatgtatgattcgacacttgcagcaaactgagaacaacgagacactgtaggattcgcaggacagtgaattcacgttttcgaccaagaggaaggtgcgatgataaaaaatgatggcacaaacagctgtcgcaagagaaacggggattttttttcgttccctggtcgcaccggcagtatctattcaaattcgtcggctcaggtagaccagctgatataagcgacagagaagcacacaggcaggcacaaacgaagtgaacagtttgctttgaatacatgcttaaataactggattgctgttgtactccacagtgttgtagaaggaaacctgttcctgacacttcgctcgtttgtcaactccatttcgacttctctattgtatctgtgcggctgtcgtctatgcggagtttcaagaggaaaaagatgtagaagtcaggtttagggcttaatgtgccgcattgtcagcgctatttcgatccttttgtctgtgggtaaacgtaaattttccagtttgtacttgttggagcttttcggttgcttttcgctgttactcttagcctctacaacttttgtgtgttactttttcccagtgtaatcgaagggaactgcgccgacgagcagacctccctcaacactattcccgcgttttcgcacatgtggcataggatgacatctggaagttgtgtggtaccagtcgcgaaaaaagatcagtacctgctcagacaggagtattttcttgatcagagatgaacaactgagagtgatttgtgacatgtaaaggctttgtgacatcggtgtctgcgcgtaggtagaccgtgtctctaggcgagatatagtcctacaatagttggcagatttgtttcaggttttgagtacgcggatcctcagcagaggaagaaaggtggaggttgtgttcagcctcgtcctacaagaagcgggtccttttagaacacgggcaccggaaagcagcagaggtaaggaaactttaccatgttccttaggccggattgtcggtggagaggcattgcttgcttgtggagtactctggagattctccttgtagcacacggaagaaaagttacgcggtaaagaatacaaaactgctccagtcaacagcagccttactttctttctgtgaccatcgttgtggagagggccccgcccccaggtggccgtgcggcaacttttactttggtttttttcccctgaactctaactatttgatgcattgaactattcggtgaagcactcccgagaaacgcagtcgagtttcagcccactgcaagaatttcccactttctctgttcctcaatttgcgtcttctgcttccgggactcgcattaccccggcaaacgacccttgctctccctttccgttgcacacgccttttccggtttttcttgcctctaccattgtgctgcccctgtggccatattcttgccaaaaaaggcatcagcgcatcggcaatggaccgaggaagcactgtttcgcctccacttcagccgttaaaaaatacaggcataaaaacaatgtgcacaagtgactccggagcaggaagcaacagcttctaggttgcgagagctccgttcagcgtcattcgtccccgtcaggctcgtccggaccgcgcgtcccgttgcacacgaggaattctgcttctgagtctcactgtcgaccctcgaaaaacgtgactgcgaccggccgcttccccgatttcagacaagtaacttcatcgtatgcacttttgctgtggttcgcctgtagaattacatcgcttttcgcagagacttcctccgtagcggacgcacagtgaacggcctgcccgcagctttcccctgctgtcttccgagacgaagcaatctgtcttcggatatataggcactgtttcgactgtcttcaagtctctgaagctcgcttccacaacgacttgcgttcttccgaggcgtctgaaggagacgaccaacgcacgccgtcaaacggttgtcagtgcaactttgagataccacaggcacaacgtgagtatttcagtgccgcttcctgcgtttccccgcggttttcgtagccttccatgtgacacaatcttccaatttttgaggcgatttccatctgcggcccgttctcaggttccccacgtagcaacgcagagcccacaagggtatccggagcatgttgttcgatgtgacaacaccgcttccaggccggggcggaccctatcaattgcaacaagtttacccccaactctgttcagattttctcctgtctgcggcgttcacatttgcccggataggcagttatgctcgtcatggtgggacgcaggctgtgaaggcaatcctgcgctttttccagagtcgccgtgcactaccgtccaggtttcatgttaagagctgtgtagacaaggcactcatgcctggggttgactcgggatgcgtagcgcagagatgcctctcgttcaaagtgttgttcggtgccactccttgtctttgggtaaaggtagacaacaaggatgcgtttgcctccgccgggtgacggactcacgaggggccatcgaaacccgctggtcactctgcagtctaaacaaatccgaggtgtgtataactgccttttgtgtagcgtgcaaaatttgccccctgcctccactgtggagataatgcgcgtgcgtggaatggtttgtgcctcgcgggtgagctgcgtcgacagagacgcagcgtggggtgcttttgaattgctgaaacgctggtggccaaacctcgagacaggagagatcgaggagcgggtagacagggttctcgagtttttgcggcggcacgcagaacgtgtaggttgcttgtgttttacatcacatcgggagcatgtttttgtgtgaacggttgcatgttttgttttccaggaccattccattccgacttctcgcacgttgctccacca

SEQ ID NO: 1857 - DNA, 1856 bp, Toxoplasma gondii
ctgagtgttaatttctactttgccgtttttctggactttgtctgccgctgcttgtttcttccttggtatctcttttctggcggcatccttttttcagtgacagaggaacagggaatataggatcctagattctcgcgtgttttcgcacgaagagatcatctgccggatgcacctttcggggcattgagaggggaggcaagcgggtgcgtctcgtgccacaagaacgccctttctctccagaaacgtagattcacatttgctcaaaaggatgttgatcagcttccgtcaattccactgagtctacagaaccgtcaggacaatttattctctacggtggtctcagtttgactagcaagtctttttggcgtaggccactcaaatatctctgatttagggataaagccagcacggccggcagagatccttgccacaactactttagttcagttgagtcacgcgcattcggattaatacagagtgacacatacaagactggacaagagaggtcaacgcgagtgattgtcggaagcgaggtctcagataaacgggatcgtaggactgtgtgtcaagttgatacttccgaggaaaactcttcgtctcttcagagaaacatttcatcaattgtaaaacagccacgagcgatacacagtccactcgaagattttgcttttattgagagtttgccaagcaatggcaattgtgcttggacggcaacactagaacaacatgcgctgcggatcgacagcttttggtcgcttccacaaattcatgaagcccaactaaagctacaaatgagtccggtggacagaatgacttggcagtgtagtcctgatttctcacaggcatgcgtgtccgccaagttgtcaaatttgctgttgtcagtttcccgttaccgcaatgcgcaagactaccacgaatgcctcggtttacccgctcaacgattcacagcgctgccgacaatttttgaatagatttccagcgagttcggtcctgcaagtatgtttgtttcttggcaatgccacaacgacggcgcctccccctttacttattgcagggcatctgaacaggtgcagagtttcaatcagagagaggggacggctggacttggagttacctctactggcaacaaatagaaataaatctcatacaggacataccgcagccatgtgagtcatcaagccttgctagtccttggtctgccgtgagctggtgtctttccaaatagtggtacctctaagaacatacgattatctgtatcactacgtcacatttccctctctgggttcccgaatctctgatttacagaactctaaaagcaacagggcttgtttgactcatggacaccggctccatcaaaaacactcgtagtcgctgagcatgccgcgttttagttttgacccatcgtgtggcctcgagtgaatttcggcggttttgagcagcatcgagcgtttttgagctcgaccaaaaatcgaaaacgtttgacttttcttgtggtttggcgtacacgtgacagcctggacactgagtgccaacgccgcgtattttttgctggcctttcttcacgtttttgacattttttcttgacaagaccaacatggaatacgaacaagggttgagcagcgcggtagtccagggacgtccgtttccctcctcagtgccggcaacgggtccgtcgccgcctcccaaactgtcgagagaggcgcaacacgcttggcaatccggacaagatattggggaaaaaacctcgcaagagattcgctaccagatagaacggaatgaatctgcagagtccctgtcgggggaagagggtttgagggagaaggaaacgcgtgaggcagctcgcagcgttttcaaaa

SEQ ID NO: 1858 - DNA, 2626 bp, Toxoplasma gondii
aatgacgcccatgcctctgttgagtcagcgcgcgaatgacacaaagtcgcacagccgcgtaaacctctgaaaccgtgagacaacgcgccgtcacacggcgagggaacgccgaggaaacggagagagccgagctgctctttgcgaagctgctgtccagacaccgcgagctctcggagcgcagcctctcacactcaacacaggcagaggcacctgtgtctacgcggtggagatgcgctcctcgctttctgcactttgaggcgagatgaagacacccacccaccatcaacgaaatgccgaataaacagacaacatatacacatatatatctatatatatatatatatatacaaaggtgcatagaagtatatgtacggatgtacgtatgcgacgagaggagggtgagaagcgagcaggaggaaggtgtgagttgtccgcctggacagagcttctgagtttctgtttgagaggcgaatcgactttatgctcctcaccccattaaggcgcagccgatagccatgcggtgctcggtgactgtgtccatcggagaagaaacaatgggcgttcggacatgcaagttccgtgtgatgcgcgtcgacaggtccacatcgttgactccaaaatcaatgtgacctaaaaacaaagacaatcgacactgtccaatacacacaaaatgtgcatctctctctctccagaccaccgtctccatctatatgcatatatctacatatatacatatatacacatatatctatatctatatctatatctatctatctatatatgtgtgtatgtatgtgagaataggactctctctaaatgcgtttatatggcacacgggcaactctgcgagatctggggtgaagcgacggcggtaggaaaacggatcaccgtctcgacgttccgctcgtcatcgtgattctgttggcagactgcggcgcgtctactacgggcgccgtctccgagcggcgtctgtcggtgctgaggcgtcttggttgtggtgagagcggcaacgaaaagtcgcggacgggcaagccaggaagcaaggatttttgcgaggcagagaaagtccactcttgagggcgagcagacgcgcgccgcgtggagatgtcgttacgtaccgggcatgagaatcaggtcatcgtacgtgaacccgaagaccgtggtgttgaagattttctccgcatcccatccgtcagccattttgtttcgctggggaagtgcaacggaagaagaaatataaaaaggggaactggaaagacacccacaagccaaacagccacgaggcaaaaacgacgcaggcgcgctgctcgagtgtgaagtcgcgcggtctcggtcgagaggaggaggcagagtttcgcgggcgcccagctgtaagaaagcgattgaagagtcccgacctcacggaggtggatcttctctgaagggaacggcggaaagtgaggacgggggagaaatgagcgaagacgcagctcacggttcgtcgacgctcgatgagaaaagcagccgagagacgcagacctgcgggaggagagagtttcagcgtcaaaacgcccgcgcgcgggtgcacagcaggaggaagtctcgtgcctctctcggctcaagaaacgcgaggcatcacgcgctcggcgaagcgaacatacacacatacacacctcggcggggagttgttctgtcgcaagaaacgcgcagaatcgaaaaaaaaacgaaaaaaaacgaaaaaaaacgaaaaaagctgcgggggaacttgaccgcatcgtcgagtccgcggcgcggggccctctcgatgccatctgagcttgtctgctgaaaacgtaccccacggaaacaggccaagcaagagagaggaggagttcactttattagcagcttccgttgcatgcactttgagcgcctgtctcgcgcagttcgccgcgacgcttgtcgcagggtgacgcggtgaacacagttgtgtgggaagcgaccttcttctcgtcctcttttctctctgtgaaacgcctcgttttctctcttcttccctgcctctccgcgactgtatctcagcccccgctccgacggcctctttgcgtctcccgccaggcttgcggcggccttgaccgagcaaagcactacgcgaaaaggcgcttcgcctctccctgtcttctctttcttcttttctctgcaaaagctccccgttttcccccgaaaagtctcctccttggcgctgtcctctttcctgaggaggcagaagccagtctgccaacccgacgccttcttccacgccagtcttccgcgtcttgctctcgagggccagcatccctctttctctctggacgcaagctctcttttcgaacgtttcccgccctggacgcctttacgcttccggagacagacttcttctctctctgcgactgcgttcgccgatccttctttcctcccctccaaactctctttctccttcgacggccggagaagcagagactccagcctccaccgctgttggtacgtctctcctcctccgcctccgcctcctccgcgtcctcaggctcggctgcttctcggcctctcccctccgtctggtcccgtccacgacgtagctgtcgcttctccggccgagtcgccgctgcgcagaacgcgcgagaaaccgcaa

SEQ ID NO: 1859 - DNA, 2354 bp, Toxoplasma gondii
gagtcccacgcaggcttcgtgtaggtaaatggagttatttttgtagacaaatgtgtcagtctggtgtgggtagagcgcagagcgaaggctgaaactgtacattctttatgctagccgctggcgtccgcgctggcattccggtgctcctctttgcgcgacgagagccgacaaacagaggttcaagctgactgttttctccgaataaaccgacaattaaagagacattctcagtattcttttctgtcacccatttcctccgaaattgcgagctcggattccttatgttgtacgctcacctttcatttgcagacacaaagccttcagagttctcgtctctcgtctgtgtttcttggcgtcgtgtcccccgctttttctcccgttcttgtcttttgaaagacttcctttgtgtctgcgtctcaccccaccactacgttatgtctgcctcacccggagcacgaagccacgcgtcgtcctttccaatagggaacagcagggaccacacttacaccacagatggccacacattcgcacgcgacacattatgttctacacgaaaaagcaaaaccagcgcgtcttctccgtcaaaggaacttgcagtcacgtccatgcctaactgtgcgcatcgaccgacatcaacacatctggaacaacacctgcacacctttatttatacatgtttgtgttttcctcactgcagtcgacacctgtatgcaggcacatattagagaaagacaacttccaagagaggcggaatcggtcgccatttcgcgtttgcggatagtcagggaccctaagacctgcaacgcaagcgtcgacgaacacctgccaggtgtacagacaccctcacaaactgcttgccttaccagagtttaaaggcagacgttgggagtctgtttccacgcggggccgttcaactgcacagacgccgaccattgctgccgagctacttgtccgatgacagtctcacactagacgagctcgagtcctgcctgagttgcgccaatgaaactgtggagaagcttcccggaaatggtacggacccgaaaccgagactgcgcgtagttccagctgcggaacgccacttttgggtgcaagacaaccgccgctgaaaaacgaagaagcgcgcgagacaccctgcagtcaccgtgccgaggcctgggccctctcgtccgactgaggaacctggattagcgatgtgcatgcattttgccaagtccctagtgcagccccgaaggcggaatgaggaaatgatgcaacgtggcagatttgacgcatggtgttgtacgaaaagcagacggattcagtttgcatgtttcaagaaagacatctgcggagaaccgcgccagaaagtttcgcggctattcgctaacaacgggctttccagtcggcgcgcatgcagacgacccaaatcgcggaaagcacaacggctgagcttttgtttctctggtccgtccatgtttttgccacggtgccacagtaagggcgtagaacagcctctttctttagggcaacaaaatccgcgagggtagtcctcacgcgaaagttaagccgagttgcagcggagtttcctctggaccggcacggcgagtcacgccgtacaacggacggtgacgagaaactcggcttcaggacacaacctcatggacactttgtgcacatctgctaacgcaaataggtacgtcctttccactacaaccataaataggaaggtatgtgggtcctctatccacacggaccgatgtgggcttcctccttgtcttgtgcgttgccctaaagttaccgcgtcgccgctgttctgtggtgctgagagggaagcagaaagcgatggattctcttcctcgatggacggcttcgtcggcattcacatctcccaggccggttcgggactacaggagaggcagcaggcaccacaactgaggcgaaagacagcagacttttctcttacatctgcgtctggcctgccttcatcgttctcccttccccttttctttctctctttctctgtttttctgattgtctgctgcatctatggtctcctcagatgtcgccttctactacctctaagttttcgtctgcaccgttttcttctcacatcacacggttaacggaaaatcgcaggccacttgaagaggatttctcgtttcctggccagcccgcgccggccgccgctcaaatgaaaagtctcagagcctcagagagcgcgcggcgggttcctcgcagccagaacgttcctgctttctgtgcttcttcgcacgaaaatccctctcagataacgggcaggctctgcctgtgacgcaacttcgccacgcgtcccttctgcccgcggtcttgttcgcctctccctctcgccatca

SEQ ID NO: 1860 - DNA, 4628 bp, Toxoplasma gondii
gaaaatcttccgcctctcgaaagtccactagagccgccactctcatctctgctcagtcccccgctcgctgccacgtctccagtgacgtttttttcctgaccgtggggcagagtcgagcttgaagaatctacggcatccaggcgtgtctgtcctgattcccccggaccctttcggtcctcgagggggggtccggtctcctctttgttgccagcgaatgcaggaccactgcctgtcgcttctcgagatgacggaccgacctccacatccgatccggcgagtggtgaaccgttgtttgtctcggaagtttcctctccctgctgccaaaaaattccttcctggtcccgccccagatcgctggacgaaatcacagagccatgggtctgtgcaggagtcccgctcgtgtcaaccgcagagacaccagccgcagcactgccgttcttcgtgctcagcagtgcatcctttggaagattcgtgccatccaaggaaactccatcggctccctctgaaggaccaggcgtaccaatggatgacggaatatctctggaactttcgttctgtacacgctctcgcgccccctccccggaaacgtctgaagcttctggtgctagttgctggtgtccttcggagccggaagaaggcggagcgccgggaacaacatccacttttttggatcctggaaaacgcttctcatctgaatgtagattacccttgacatcacgcctctctagtccccgccgatgcgatgccgatgaggacggtggcaagtcggatgccgagacaacacagactaagaagaagcaccaaataataagccgagtggcaaggcaaatcgataacactgaagaaaatctcgcttcttgccgctgacccgactcgctgtcttcgcatctgcattgcgcacgccttgtcctggggtacagacagcgctgcgctagtgtcagtctcgagtcatgcgacccacacttaggtgtcgactttggttccacgaagtactcaaaggctttaaaaataaggagcttgggggactcgttgatcacagggttagtacgcaactttctcgtgaccgggattggccccgaaacaacgcgtgcggaccgaaacaatccaccgacgggggcgggtagcggttctaccgccccccttcccagaacatgatgcgaatgacgagtccccgctttccggctcgcagccggaagatctgggcactgtttgtctcgcataatcaaacaagaaaacatattgcgagcgtctaaagtcccgaaatcaagccctggaggcaattcctacacggggtcgacggcgccgggaaccggtcccagaccgagcgagaaacaaaagtgctgctctccgaccgacatagtggaacgtttgtgcagcaacagaataagtaagccaaaaccctccttttgtccgtgtactttagagaacgatattgccaagcgtctgactaacagagaccctcgaaacgggacacgcctccgccttcgcgaactggctgctgtgggtcaagcaggtggattgcggatgttgaattgaatcttaaattccttcgttccctgcccgtcctcgtgaagctgcttttgccgtccattggcagcggccgtcttttaggacatacagtgctgacaacagttgccaccgcgggacggggggtaaagcatgcacatgcaccgtcttttcccctgcagctcggagcgatgcacgaaattgactgtcatgtcggcgcatgtgggaggagacaaataactcacatgcgaggggcttcgattcctcgagacagatgtcctcctcagaattaggcaagcaactatagccagcgatctatgctggtcatttcccccaaacctcttttttcgaaacagaaagaatgcagtgatggaaagcctgccagctggaaagggttgctggagtttctggatcgtaccactaccgtcgctaacactaaaaagaccgatcgccggctgcaggaaggggaactcacgtgaaacgagaagctggtcacgtgatttcggtgcgaaggttgctgctaaacacttcgcaccaggcacctgccttataatagttcagaggtgaggcaaaagtgcagcagaagccaccccgtgtgcaccgagagccggtcagaaagcactgtcttggcaccgtgagaaatctaagctctcttacagacaacaaacaatagcaagaacgctcttgtgacttatgtggatgttgatgtggcgggcagcggcatttggtgtgacgaaaccgattgcctaggtgcacgtgggacaggaaatctagaacgtcacttctcgtctacgcgggtttttgtagaatcgattctgtcgattgaagtgtagaagtgcacactcgcaaggatgtgtgcggtttttgacaatagatttcccgattcttcacaggaatcacattacctgacgacgcgcgaagtcccatacagtggctttcggcaacggatgcggatatggaaccgctcacggcagttcgtgcgtgtgtggcaaggcaagcaccagatcgcgtcgggtatatgcaggaatagtgttgaagcatctgcaatagcagaatgcttaagtgtatcagtgctaaaaggcttttaaactcggcattacagaagaagatacccgagtgttcgtgataagcagcgaaattgcacacgaaggcgaatacccctcgaagtagtggccttttatttcactttcaaacactgacaacctcattatccattgtctgtggagcgccggtaagcggtgcgttgacaaaaaaccgaacaggtcaccggttgtgggtgaagctgcattaggcgctctgacacctaaggtgactggaggtgtcactgtcggcaagccagaaagaagacaactcacccgtgtcacagccgttgtcatgaaggagcaatataggcgcagagaagctccgtaatatgctttttaccgtcacagatgtttttgggtcgtgatctcctgacatgaagagacagtcaagagcatcgctgtttttgatagtaaaaccctctagtacaaaattaatatgcagcagaacactccaactgattcgtctggtggtgtcaccaggtcgtttgaggatactccagacggtgcatgaatgttctacgtgattcttgaactttcatattcgccgtggaagactcaggagataaccgaaaaaccaaggccgtaaacggggtttgttcgcataccgattctcccgcgatccggcctgtcattgtgaacatctctgttggtcttattggtttgtgttgtcacaaaacggactggtgtttctggcgaagaccgtgccacagcattgtattcccttcatgcgcttgagtgtgggggttacgtcatgaaacttggcaactgtccgccagaagcggttccaaactacacggctatcgtttcgctgggctgacgcataccttttggcacagaactccattaaacacgcaggcaacaatctagtgcatcttgcgctaaggagcggacaactgttggcatctcttgctgcagcttctggggactgatacgccatctttgtctccgcaggatgttcccaagctttcgagcttcacgcttgcactgtggcgcaactaacatggcctgatttccctttccactcctgtctgtggcgtctgccagttaatgtctccagcagctctgcgggactgaaaccaaaacataagcttaagccataaggaattaggcgcgacactcaatttgaaagcattgctgacgccaagcgatgcctcaaacgagcagcctgactgctagacaagcctacgaacattcctcagaggcactatgcgcgtgcccgagattaaacaagtgaccacggtactctcgtttcgtgttagaaacgcgagccaatatcacgcatgcgcttgctttccctaaaggaggtacctaaaatcgcagagggaaacacaggaccgggaacttctaggtttgcgccgttagctcccaccaggtgcgcgtgctacagacgctcgaagcgaacgcttgcaagaaaacgcgcagcgcggagcgctgaggcgaaaacggacgcagttcgacgttcggcgtggcaggttcgggacttgttgttgtcatttgtctacgagagcctcttttatcccaccttcacaaagcgtttttacgtctactgcattttgcaccatttctagagctgtttcgagtagtccctgtcccccaatctttctcagccttgtctttgatgcttcgagtgacgccagcgcttgtacgcgcgcaagtccctcgagcgtcgttcttggcagcatcggttctcgtgaagcaccgcgattgcggcaacaaacaaagctgcgcaaacttgtacatgagttttacggctctgcgcatatgacttaccacggttttttgttgccgcgcgggaccttagctcggtgtttcagcgtctctgttttcaaattcacttgtggcaacttctcgaaaccagcgcgccagcacgaggtaatgcgctgtcttggctgtgttcaacggcgaaccggggtcgccggctcgacgtgagtctctcgctagggtcatttttatatcattttgttcgatgttgttttccgtctaggatttctcctgtgtttcagtttggtggtacagtttccacgttggacagcggaagaa

SEQ ID NO: 1861 - DNA, 2938 bp, Toxoplasma gondii
attgacttggaagaagtctcctgctctataccagcagtgaaggccatcgatcccagtggatgcgcatagtgtcccggggtcgcttgtgacggaattcaaacctgcagaaaaaaaacggtaatcgtacagcataatcagttttcaccggacgtctttggtggatacagtttatgctgacagaaacgctcgagccacaagactaaagcgtcaagaagcacgggtaaggggatagatgggatcagatctaaacagtcacgctgttacgtttctgccacttttaggacaacactccgtgcgcgagaaaaccaaggggtatttaagccatgatctgcgcacttcgaactctcacctgtatcacgtaacaaaaccgttgcacctttttgccgcgcttctgctgcgtcaggggacacagcttgagcttgaacggcgatctgcttgcggatctcagcaagcttctcgttgaccgacctcaaggccagtttacaagactcaatttcgagaacctggtcgcagaaagtaataatatatgcgcactactaacgcacgacggtccgggttttcctctcacaacattccaaagaaagaaactaccgcaactgcaaacaccacttgacgtcggaatggaggtccacacttatgttcccagtgtgggcatccccaaaagcaaaatgatagtttgcagcaaggaatcagacagatcatcctagtggcagatgatacgcctgtaaagcaccatctatggggggatttgcagttgaggcaggctgcagtgaacgttgcgtatttccctgccacggttggacgtactcgtctcggatatcgcacgtcgttgtaccccaccgccggaaggctacccgcttggtaaaacgtgtagtgaggggtgatttttgacctgtagtggtatcctccacgctcgttgttcgacagaaccggatttacggttgcactctcgggcaaaccagccagtcggcagagaacgccttggacatgacctcgttttacctcatgctgaagacgcagccacagaggacagatgaatccatacctctggaagcggatttatcatgtgcctaaagggtctcataaatttatcaaagccagagctggaagcctgtcgacaacggctatatcgtacctgcattgacagtggcatatgctgatattggcatccactgcacgctccaaagtagggacatggagatgtcacccgccgaggagaaggcgcgttgacgtaagcgacaatgaatccaatgctgtgctgcgcaagtgctttgtggattcgcacccagacgtattcaccgggtattgagaaaggaacaaaaacaggcttcccgtgcttcccttgacactgaggaggagcgtttcggtcatcaggagggtcagccacagacgaagatgaaggtgaggctggattttcatgacgagcaaaagctgtcgctatttctgtttgcttcagtccactctcgagagatcttgatggttgagggtcgcagcaccccgctttatggtcagggtgcccgcagtctgagacgcatctgtcgcctccaaaacagattgacccgaacccttcacctgtgtcaataatgaactgaatatggactaggactatatcgccatcggacggccggtattggtctcttttcacattatcgatgctggtgccgtcgtgagcaggcggagtagccgcggagttgtggccatcgagtgatgcataaagaaccacctgcgatggggtacgggaagttttctggtgtgatttaataagcctcagagggagcttgaaagaccaacggcgctcctttcgcgccgtgtcatcgcgaatgactgagcagggcggagttccgttgcacacgcctaggcgctctagtgatcgcgctgacaggtgcccggaagtcggaaagtggtagcgacttcccacacgaaatgccgaacatgatgaaagtacattcagcaccagagaataaattatgatgattacaagacgccaagtcccatcggaatgacagctgcgtccatgcttcggactcgacctgggactcatttgctatccgtgatgtcttgcgcacggttagcactacatctctagaggcatccagtacaccagtgggtatcctcggacaacacatgaaacaaacaggcaaacatgtatgtcaattccgcgtatcctagaacattcgaacacccgagttcggaaaggaatttggtagccccgtctgctgcatgcactccacatggaaccatggcgcatgtacgatccacgccagccgcggacgcagcacacaagtgcctcatgcttgacacatctgtctaagcaatgccgtcgaagagatcattgttttctcaaggtgtcaacaagatgaagattaccagccagaatccccgggtgcggatggcatggcacactgtagcatcggcaccgctttttgatactcccgatctacattgtcttgaaatgttagcactagcaacacactgtgctccaactccagttaataagaatcataaaataagttgccggttctgtggttgtgccaaactagcactgtcaatgtcccagaaaaagcttttaaatagtcctgtcccaagctgagccgggttgtgttcctctagtcactcaataacgtcggttttccatgttaggcgctaacttcacgcatgttgccataacttcgcctcatagaagcatgcctctcttcggcagattctcatgaatgttcgttaatgcaattctacccagtttcacagttcttttcgtgcatcgcggatcggcccagtctcgcagactccgctgtggtggatgaggcgtgaggcaaagcagcaacggcaagccgtgctcggtacatacagctcaacgttgagtgacacatttcacactcacttcagttaagttgtgtccctggcgcatagcataaccgaaagtggtacaaccttcaagcaa

SEQ ID NO: 1862 - DNA, 1447 bp, Toxoplasma gondii
tcttcgtcgtcatagtcttcctcgctgtcggtttctgcgtcttcctccctggcgtcttctggacgcgcaaacgcggagaacgttggactggcgcgcggtgtagcagctgctccgtgaccggtcggtcgcttcacgtcggctgcgtgatctacagaaccggcgaactggccagcgactcggcgacaggcggccgagtctgtgtcttgtgttcgcgctttgatgccggagagagcagactgcgacagccgagacgcgctctgtcggtggtacagcggagattcccgttcgagcagcaccggtcgcgtgagcctccggtgttcgtacgcccgagagaaggccaccgcatgagccgcttcgcgcccaatcccaggctccgcttctcgctcgaaggagtccatcgcaggatgtttctggctgctctgagcacggcgaaggagaagcagcggccgcgcgcaaatacagaagcccgctgctgctgcgcgtcgtcgagtcggccgcctggagcgctgcggcgagacagaaaatagggaatcgagagacagctggggagaaaggaagaaaagaaaagcttctccctgtgaagcgcttttccgcggctctcggaaagtcggaaaaggcgtctccagaccccaggcttggccaggaagggcaggcgtcttctcgcgccgggagtctagacactcgaagaaaccacaaagtacgaaccgtgagggcaggccacgaagcggaggagaaaaacgcgtttctaggaactccgccgagagcgaatgttcaagacagccgttgtcatgctttgtctctctgccggtttgctcggaatcagatgccctctctctgacaacgtgcacttttgatctacacaactcgttcgccttcccagctgcacagaacttgcgatttccaccgagaatcgctcaaaaactcttcaagagacacgctcttctctgcaggaacgtgtgtgtgcggatggaagtcaaaagcgtggacctcgctcttctctggggggtggacagtgccggagcgaagaaaactcacgagcgacgtctcgacaccgggtacccgcgaaaagatctctggactcatttctcgctttcccgccatttgcgcagagaaaaactcgctcttttcacgaaataaacgctaaccctcgcccccctctccctccagtgcgttcggctgccggcgaataaaagcatgcacgcgcacccggccgctgtttctgccagacattggcgccggactctagaaaaagtggacaaatcgaccagagcccaggaccacagccagcagaaaatgttttcctcattctgaagcagagggcttgcagtctttggcggagcttggagacgaggatggatttctgagggacgagaacgagtggagaagacaaaacctcagtttgctagcgaacccccgcagaaaaaccaacaggaccacgcctcggcga

SEQ ID NO: 1863 - DNA, 2182 bp, Toxoplasma gondii
aacaaaagcatctcgaacctcagacaacggcacagaacaagacgaagaggcagaagaaggaaaagacgaagcagagtcctcgggaggcgaggccggttggacgttgccttgccagggtacccggccgcgtctgtagatgtctgttcgactgacgcgcttccgaggttcgtccgtttttgtttgagagattttcaagaactcctcgagaggcagcacctgttgtccagaaaacgccttcttgtcaactaccttttgcaggcgcttttcacattctccggcactcgcctcagcaccacatgccggggtctttccctgtctctgtgtcgttttggtgcacacagagaagcgcagagcctcaagagcgacgtccacatcggagtcatcttcgagggcctctgtacgtttcacgaggtgctcttcctctccgtctgaagctcctaaaagatccccgtgctccgtgttgtcttgcgccggagttcgaggaacagcagcgagcttcgcacaggagaaagtagccttcgtctcgccctcggcctcgcgaagaggagaaggagaaggcgtcttgcagcttccagaaaacgtcgtcatcgcggaaccacagtgacgacgagttttgagggaaaaacatacggcactcgcgctaacaactccccgcgagtatggacatctctccggcaccgggtaggagcgtgaaactttgcttgtggagaaatcggagggattcctccggggatataagccaccagaagccactggctgtctgcgaggtcctttgtgcgagttcgagaaaattttcgcagctatttgaggcagcttcgtggagactctctgcgtgctttctacgtgcatgcagtcaaggtataagaacgtccggactctcagcgacaccagttagtcaggcgcgttcttttgacaaccgttcggagtttgacgcggtaaatggaatttctctctccgcgtgctgcgacagtaaaaaacatgtagatttccgaacctggggggtacgccacatcatcccgcgttggcacgcgaatcgaccgtgaagttcttccccccaggaggtcccttcatcggcgcttctagcagaccagaaagttatacgcagaaacctctacaggtgctttttctatggtgaaaaggtctcggatcgttctctgcatgattgaggtgggggtttcattccaaggcactacacagcctcgctggcattctgttctgtcgcggtgtgtctgtctctcgatggctcagtgagtctttttcgcggtcccgttccaccgcgctgtttcgctgccaagctcttttctttctcgcgtgcatggaaaaacaaaatgaaaaccgaattcgacggggtgaaccagataagtgaaactgttctgtaactgggtgcaattgaggaggaccggtgttactaaaggttgtcggcacaattgtgcaggacgagacagaacggcaagagccgcatcgaagcatctcaagtgggcgcggcgctaggtttaatgcgcaagcaaacgacatgtagagagccttgcattcgcggccatcgattctatttctttccggaacacccgttcgtttttaagccgacacagtcggtacaacttgacttttgacgtctttcgggcagtggcaaatggtgggaggagagcccgggaggccagttctctgtcgggagacggagacgacaccgatccttcgccggaggactggagggaacactaccattcatttaaggaaaccctggtagagtttgtgcgaaatgcagagacggggctccactatgccccaaaaggcttgctaaacagcggtgtcgctggcggacggggagcaccaggggatctgaaagaccctattgtgcatgtcggctaggcgacgagtcgctcccgcggtgagctccacgctcgtgagggtagctttttacggttcgcatagaccgacgagacgccccattttatttatgttttgagctgcgtttgaggagctcgccagttttgctcgacttgttttcctttagtaaactattttgttcagctccatcgtttccaggtaggcgaaaaacgttccctgtttttcggtttagcgacgcgcgacgcagcgcggtcttttccctggcatttttctccagcgttcccagcgccacgcatcgcttgttcgcccgtgaatttgctctatattgcaccaacaa

SEQ ID NO: 1864 - DNA, 2396 bp, Toxoplasma gondii
tttgtttttcatctcaggcgaggattcttggagtgacaacgacacagccgctgggttccgtgactgcggcaggtacgcgacttgccggacagtgtcacagtttagtcgcctttttttcttttcacctttgtcgcgttcttctgctcacctggcagcaggcctttgtagggcgtatctgtgtctgcagagacgagggtgagacgcatgcctttctcaggttgttttgcccagtccttcatcacaaagaggtgagacgaccctccgccaaccagcacaaggtctcgagaaatcgacctcgcgccctgcccgctgcatcctcctcttccactttgtttcatcttgacaaggacgcagaaagatccgagaactgggggaagtggaggaaaagcggcgaagagcgagaacgagcaggagagacaacgctgcggcggcgggcacagccaccaggcgcgcggcgaacaaaaaggtggaggaagaaggaagacgcgaggaagagggagacgccgaagaaggaaggaaagggagaagagaatacggtcggattgggtgcatgcgtggagcgcactggacggtcgaggagacgcgagacgagaagaaagggaggaagagcgacgaggaaacccacagacgcaagagagacatgcagagtgaagagacaaaccccgagagaacgaacagaaaagacagaaaagacagacaggacgaggagaaggcggcagagagagaaagacgagacagataagaaggtgataggagaagaccgcctgtctgcacggaggaatctgagatgaaaaactttaaacctttggagaaggagttgagaaggcgatacgacaacccagcagaacgaggctcgctgaagcggcaagtccccaaggaaagacagaagagtgaggaaaggaatggcaggcagagtcaaaaaaaacgacttctgttctgcgacagctggaatctcttctgcctgtggagtcaccgaaccggagaatgactgtcgtttcgtctgagagagggaaaagcgacaggagtgagaacgagacgcggggacgtcgagggaagacttggagcgaatcggtgcgcctgctctttctcggcgttcgccccgccctcggaaaatggagaaaaaaagaaaaaggaaagagaaagaacaaagaacgccacaacgtcccctcgaggagacaccagatccgagaaaggatctcgaacaaagcggcacacgactctggtctccttctttccaatcttctccctcaactttgggtcttttgcgacgccaagtgaaatggagatgcaagggtgaatcgcctcagctttgtgcgttctgtatccgtcgaaacaccgcctttttctctcattcattccgcgcgacgactgtgtctgcaggaccgctcccctttcgtctgcgcgcgcgcctcttctgaatcctttgaagtggagaacaacgccacaaaagagcgcgagaaaatcgagcaaggcgcggacgcgagcgtttcaaaggcgacaagtgaggaagaagacaaaagacaaatgcgcgaggaggaagaagatggaagcgtcgtgtctccgcagctcgagagccgtctcgcttcctgctctgtcgcctcgggtgagaagacgcacgcaaagagcggaaggcgggaggcagatgcatgcagatcatctctctggatttgcttcgagcagaaaaaagagcgaacgcgccacgataaggaatgatcgtgagactcaggacgaaagagaacgggtgcgacgcggtcgcagagtgaatcttttagatcgacgttgtcttcgcagagttcgcaggaaacgcctgcctgcgcctgggaaggtcaccgagcgcttgcacagtgctttcgatagagaagcagagaacgagagagaaaactcgccatctttcgtcccattcagcgtcgtcgcttacaaacgataagggagaagactcgaaagtcgatttcctccttgttcttcttccgtttcttgcacaaaaatccactgccaccgtttcgttcgcctttccttgccgcaaatccatcctcttttcctctcttcgtatatccctgcacctgcttcatctgtgcctgttctctactttctattcttaccgccgcgattcttcttccatcttccttgttcctcgcttctgcagcctttctccgtaggccgcgctcctttgtctcggcctctctccctcttgttcgcccactcctcgttcttgttctttttccctgttctccttctccttcgtctccttctgcttcttcttcttctgcttctgcttcttcttgctcggcttctcgttctccttctgcgtcatttgctgttctctgtcttggccttcgccctcctttcttcttccttgtcctcttcatcttttctccagtctctctttcgcgggagga

SEQ ID NO: 1865 - DNA, 3053 bp, Toxoplasma gondii
gtcctggaagaacattattcttgatataacactgcaatcttctctatgtgcggtagtgattgcaacacagatactgtagagcgagctgtgttcaccacgtgtgagggacattgtatcaccaattgaaggccgagagctttttgcgtcttcactaggtgtcagaatatgccaaccgtttctcattctgcgtctgatgcactaagttttagccatcgggaattcgctccattgtcattcgccataggcagaatgagttgctgtcaagcagtttccgtgtcacattcgcattgttgctaacaaaagcagagtttgctgtgtgtcgcatgcacgcagatctggggaggtagtccatcaccggcatcgcatcatcctcaactttaacagcacataagctcatgagcgggaaagtactctaccaccgagtagcaaggtcgactgcgtcacagatgttctatggaccctttcatccttcttcgttccctctcttttctcttattcgttcactttacctcgagattttgccaagatttcagaactgacaaaacagtgaaaccgtgtatttctgttcgccccttctgcatctccgcgtggctcctgcctgttttgcctatctgtgcacgttgaaaacataacccggctggccacaccgtattttagatccctgtcgaaagcgcaactagactttttgactattctgttcacgttacttgcgatggaagagggaccgaaagtcgtttcttgctacagtcgaaccgaaaccatggcaagatacccgcgagacacaatcaagttcttttcgagcccaagaggctcgcacacgccctgcattgcctagaaaacctctacgacgaaagaacttcctcgatcgaacaaaaagcatagcgatcctcctgctcctaagtgcgtttttgctcacaaccaaaataacggacaaacgagtaaaggagaaacaagaggaaagataaacaaaatactctttttctcccagttcatacccactaccctctcatccccctctccagcagtagcacattctttagattacctttccttcgcttgggtgcgagacgtctgttgggttcaaaagcaacgagacttcgtgttagaaagcatgagacccatctgtgtgattgctagaacatcgtgatgcgcacagcttatacggccaccgcactggacctagggcgcgaatctacacagaggagaagcaataatagtgaggaacagcagaacagtggactacaacgagaaagaagcacgaggccagaaaaggagggagtcgaagcagacagagggagaaaaggttgaagagtcagggcatctctgtctttcttgcggtttgccgttctaccgtttgcgaccaacagacgactccagaacgccaatgacggaagccttgcttcgccgttgcacataccatctgatatcttgctcttccccatagttaccatcccacaaacagatattacttcagccactaagatgatgcggagatgctcgcctttgctatcgtgtcttttcacggcagaagacgcggaggagtgtggaaggtcgcaagggggggggggcagttttgggggggggactgacggctgtctgtcccagaagttcaattgcatctttttcccatcttctggttattccgtttctgaacatttttccagaggcgaaaccgagtttttcttctctcttcaccgaatttttgcttcacactgcatggaagtgaagcagccgggtctccttgcttctagtctcgtctggttgctagcttgctgctctccaaaacatgcgcttcgccacgaagccagaattttttcacttacattttcgtgcaccaaccagtttctgtgtgcgccttcaagctgcaaagtggttggcctacacacgatcccgcttttaatttcaccttccgttcttcctgtttcccctggttttccgcgtcatctgaccattcatcattcgcgtgagaggacagcccaattagcgttctctcagaggccagctgtgtgacttccacgtctgtgtggacggacggcaaaaagataatgtacctctttgacaaagcaactgtataaacacagtgtgtcacaccatatctaaatctgactgttcagaagacacacacttacgtcgacaactatatgtgggtataaagaggtttgcacattttcctcatgacgcccaccatccctcttcggtgatacgagatacatcgtaccaatccagagagctgtccgtgaatcgtctccagacccaacgctcgggggcgcactcttgtccacgcgtgtgtgctcgagtcttgtgcgtttcgttcgcccttatatccgttcttatcttcggttgaaaactggttttggttgtgtgcctgttcctgaatgtaatgccagaaaacggacggtggacgtgacgacagtcatttctcctaacagatttcgagtacgaatgtctcctgggcaactatggatgtcaacagttgggcctcggttgcatgttaaaatagttctaccagccccgtctacctgcgctggcgcaaggttttgtctgtgtgcgtgcattgggatgtcggacacatgagttggcgacatcgagaaagattataccatttcttggaacctaaaaagacgtggggcggttcagacgctgggtgaacttctttggtccgtggttgtgatgaaagacctctgccacaagcaacaacgttcgacgtaaagccactcgaaatttgcttccgggaaacatcgcggctctctctgcgtgtaattacttggacatccggtgctcacaatcttaaagaacagacaaggaagcgctaatccgtccgccctcccatggtctactttcgcgtcttgctgccctgaagtgccccatggagactttgctgttcagccgcctgtgaaggttacagcgtgacgaagaatcagccgtcgagaaagccatcttcctgtttctacgctgagcatacacgctgtgaacgacccgagtcttccattcaaagtgcgtttcccggagagacggatgacgttcagcgcatcccgtgtccgcgatttcaaaga

SEQ ID NO: 1866 - DNA, 3599 bp, Toxoplasma gondii
ctacctcttccctcctctgtgtctggagacagtggaaagagagtaggcgagaggcgggctggaaaggagacagtctgcctgcacgcagagtcgcgattaagtgccggccgcgtggaggatgaagaacctataaaagaagaggtggtggaggaaagcgaggctgccagctcagtgcccgaggcagcggggacagagatgaagtgaggccgaacgccgagagacgcagacgaaggagaagacggggcagaggaggccgaggaagaaggagataacgaaggacgagaagagacacaagacagaggagacagcggaggcgagaagcgcgaggccggagaagagagaaacgcagaagtggatttgagcgtcaaggcagagctggggactatgtccggggacgtgacgaaattgaaaaggaaaggcaacagaactgggagcactgaaagagaaacgaaaggggaaacaagtaaacagcgaaggcgacgaagccagacgtggtgcttccaccggtcaagctcaacaaggaacactggtagcgacgccatggtcgcgaaagggaatgccacgccttctcatcaagcggaactcaggttcgcggaagacagaaaagggactacaaacagttaaagatgtcccaagaaaaccgtgcatcacgactccagtaacagtttttagaggctttgaggacgagcagggaacacactaacggtaggaactcggtttcccagtcgctctttcctgctccgccgggataaagccgagagagaagaaacagatccgtcgagtgcaaatggaaccggcgtgcgtcgcgcacatgttacactcaacccgggacaactggcactcagccacgatactaaaccatacagcgtgacgaagaaatcgaaaggtacggaaaaccacgtgcaaaatgcccgtataggcacaaagcgctgacgaaggagaacaaagacgggagagaaagcagaaaaagcgaaggacgacgcaggacaacaaagcgaacaactcaaggggtggggggcgacgatcagggggcttgccacattcagcactgccaaaatcccagctaaggtgggcgaacatcgaggttttctctcagggaataaatgatctgaacagagggagaccgccagtgctacagacaaaaagagcatccttggagaaacgcgaacagaaaatgacaaagtttggtgagcgttgtcatagtgaacgctgtgtgcgatgtgtccgacggtcagcagcaacgtttcacattctccgccgacccttcggaagatgtcggagcgcattctcttgactcaaacgaacgctgtcctcccttgcccctcgccgaagtagatgggaacgaatgcaagggcttcagtgtgtttttttgcaagggttcccccgtgagttcgccgcagcaagagcaagccacgcatgcaaccagaagcgacttgacgaaccacttcgtatctctcttctgcagctcgaggtttcgctgtgtctccggtcagtgaagcatagatcattggacagtgaagagcatttgatgactttttttctcttcgcaacgacaggcaatatctacacaagtgtcaggtagtttttaggatctcgacaacgacggattcgccctgtgccgcacaccgctggtggggtctcgcggtatactggataataaattgctctttggaactctgaagcgatacatacaatccacggaggggctgtctgtgcaacacatctaacatcaagtagtagtggatcacaactcgatgcttcaggtttcagacgtcacggaggcggtgtcgttgccaaggatttggtgatcctgatccactgttttctctctctagcggagcacgcgtcttcactgtgcgtgcgtgaagaggcaatgaggactacggtacatgggtccgttctctcacgattgagaaagttccttgcatcgtgagaggcagttctcgctgcttcgccatagacacgagaacgaaaacccagctgtctggtcacacagggccgtctccaccagtgactcacatcatgtctcttcagccgatagttcgtcaggggcggaattagtgctagagggcgacacagctcagccgacagggctggtgaccggaagtggaggcagcaagctggtcatacagcagaagtggatcgacttcagcgtcttctggacttgcaaaagctgcatctcctgtataactgcaagcagccgtttgtagtaccccatggctgcagtcgttgaatccgtgagcctgagcctctactacgatagttgtcgagacttttgttgagagtacagcctacgggtacgtactaccaccgaagactatggtatggagttatcagagtacgtatgttccatcacccagaagccatatgatctacatataataaaacattagattggcctgcaatagatgtgaaaagttacgtgatgctcatgaggacagtttgactatcaggtagtcggcctgtaacgaagttccagtaaccacgcatcagcggaaagtggtgtttctctgtcctccacgcatgaacaacaacgccgtaagacactcttcaatttggcctatgaaacaaggcaagggagagaatctaaacgcggcgtgtcgtttgcgtcacttacaaggtgaatcgcaaacatggcttcttacatgtgtagggacgaatctacgcggattcacgtgttttcagtcgtcgttgtgcatgtttttgtgatacgggctggccactacgcgtctcattctaaccatgttttttacaggtttctcgcaaacgcttgtaacacagccagactgtacaaccgcagcgtctcggaaccccctgtcaagtggcgaactgtttgttacgctcttcgcattgacaacagacgagcgaggtatcccaaacacagagtgttactttcagtctacgacatcctgaattacgggcttttgcagttcgtgtgtttcgaaacccagatagggcggcgttagaggtgtcatgtgtattgagtcgacagctagccgagtccctgtaaacgaggccgtttcacgtgagttctcagaaaaacatcacgtttccgtgcgaagtcatcgtgggcgagttttcttttcgcagacagagattttcggacgatttgaacacgacaggattttggctagccgtgaaggctcgtctgcagagacgcgtttacgatcggctgcgcgcgaccgtcgcgtgtgcgtatcacgtggcagttaccgagacggcgataatcctgctgttcctttgcccgatttccttgataaccggacacatcattctcacgaagtgagcaaaccgcgtatacgtgccccaggtacacgcttccggtgaattccctccgtgtgcgatccatcatcgccctttcctctgtcaaccctaatcctcactaagtccatgcaactttgagtcagcgacagttctttctatctacctgcactgtgacctgattgaatcgtagctccgatgcacgctgacagctgagaaagttagagggaactcgtgttttctttgaggttccccggtttccacacgtcgccgacttaagtcgctaagtcgtgtaactcctccctccgttccatcggaaaaattaaaaccattcacaa

SEQ ID NO: 1867 - DNA, 2719 bp, Toxoplasma gondii
tgtttcgaaagtcagagaagcgaagtcagtggcggaacccaaaccagactccaagagaagcagaccgtctgcgtcgtcattctcgcgcgcctgaaccgcagcggagttgtcgaggtcctcctcgctttccggccgtctcccctcccccggcagaacagaagaagcaaaagaacaagctcctgtggcagaggcaggcctggaagaaggggagagtggaggtggggagggacctgtcgcgttgctttcgacgtcagcgaagtcagcgaagctcgaggcttcttctgggaaggcttcgacctgacactttcgccgcttgcaggaagtctcttcttggactgagagtggcacgacggggcgacgcgactgcctcgcctctgctgtctcgtcgtcctcagttgtcatcctgacggtaatcagcctcagacgcgccgtcccaaaaagaagagcaagggtgctctgtagcggagagagaagaaaccgggcctcgtgcttcacgggcgggagctctggtgcaccaagaaaagagacgcacggagagaagaaggtcgcagagacaaaggggaactcgcctccgcgacttggacctcttcttcacgactgaacaggcatgctctgtgccgcccagtcacattcgacacgaagagacgagaactgcaggtggaagaagcgtctgactcagatgatttctacagcgaaaaacgttcaaagagacagagcgaacccggtcctgggagaagactcaaagagcgtcaggagttctgctcccaaagaaaagaacaccacggccagagactagagacgagcagcgactcaaactttcctgatgccatgtccaactggtcttctcctctctctctccacgaccagctcagttatcaaagagcttgcggatcgactgaagcagcaccgaaaaggcagggcttcttcgccggaaacctctcgagtttttttgcggccccgaagagagggcagcggaaagcgacaggaaactgtgtgcctcctcaaaagacgaagaggagtcaggggagaagacaggaaatttgtgagttttaaggaacggagaaagggaagagacgtcgcggaaccgagcggaagaaaggtcagcgtctccaagcggtgaggagcgacggaaagcgagaatgccgtcgtctcgccgtctgttcggggacagaaaaagcgaaagaaacaatggcggaagcagatccacacggagaagagaggccagcgagaaggagaggaagaacagaagagaaaaagaaggaagaggaagaaagaaggaaacggcggaaagccacgcgaggagacccgcaaaggcgcgggcaccacagtaactcgaccttgtcggttcgtgggagtcgaaccctctggtgtacatacacccgagaaaacaagcaaaagagacgccttttttcgtgtttgtgaaaaattaggggacaaagctgacatgcagacctcaacaacgcctgctcgtctacgtcggccgacagcgacagagacacctggatgtgccggcgacattgcggggcagttccagggcctcgcgacagaaagctctttacggcgcctgtttggcaacgttttcttcgttttcttcgttttcttccgggtttctttctgttttattttctctctggccgcggaaactcgcatcgctgctgtcttgtgcagtgactgcgacgggttcgcttgggccgtcgctgctttcgttgtcggtaggaaccgcgagaagtcgcgacacactgagaactcgcagattccaggcgcaagaaattcccggaacgaacttccgcggtgccacgccgtcgccttgggttttttgtcgccctctcgaggacgcagagtagccgctttccacccctcgttgtcggttccttctctccgcaccaccagggggaaatgcggctggaattccggtgtatgtacacccgagaaagggaagattcgccggcgttccgacagggacggaaaggcccgtcgcccttggctcgcttcccctccagcgattgggagaaacccggaagccgcagttcacgatcgatttagattttatgcatgtacagagcgttgaggtggcggagaccccactgatccgcttttttgtagagaaagacctcttttcgctcggctgacgtctcagttgatcgtctcaaagacctcacctgggtgtacagacaccgtagagaaagaggtctgcggatcgcgcgatcctgtgaagggccggccccgccgcctgccacgtttccaggagagaggatttgtcctgtgacgattctctggtgaatgaatttacgttttgcgtctctctcgaggcgaggaatccacgcgtgccgggaggcccagcttggcagatcgaaatcctcacgggtttgtgcttcgattgcaaatcctcgtcttcctcgtctgtgtgcgcggcgccgctgctctttcttcgtagccctgagcactgtgaagaaattcccctttgtcccccccccccgcccggagccccagttttcttgtcagtctctccagttctcgtcgctctaatcttctcgtcgtctgtcctctttggtctcccgtctccctgctgtggcgtctcgctctcctctgttcctgtcgctccgcgacccttccgttcgcgctcctctctgtctttccctccctcttgcgcgtctcttcctgcctttgcgcctcctctctctctgcgtttcctgctcccttcattctctgaaagtcgaga

SEQ ID NO: 1868 - DNA, 1816 bp, Toxoplasma gondii
actgcaaagagttttgtttagcgtttcgagaacaagtgttatgtccgtgatgcacttatgattgccgagcttttcgtttctgtgtacttcttcagagcactggtcgcccacaacaatgacaaggacttagctttgaaacagcttgtcgccaacctcagcacaaacgagcagggaaatatatagacgcctagagttaaatatgtactaagtccgatattatctgccctgcaaatatctgtcacggttgctcttcttttgtcgtttgtgaatcactgtggaatctggggtttaatttcattcatccgaatctggtttgtgttctgctcctctattcacaaaccaagtgccattcaaaagaaaaggctctgcttgagaatgcatttaagttgtgtctaccgacacaaccttgaatgcagtgacaacacaagtctatgcgttggagccctcaaattgtggaactcttcggcacgtagccatccagtggtccttatagaactgtgtccgttttgtggcgtttcatgccccagcaaaaaaagtattccaggctgtatcatccgtgcctttggaagaatgtatcaatcacatatcgttaatgtatggttctgcttcctgtttcgcgccgggcaggtccagctagattggaggcggttatatccgctgaaaagaatttagactatgagagttcttgtttccgtacgtgcgtgcaactagtgattcaaaccttcctaccataacaacggtaatacttgctagaatctggctgatacgcagtaccgggtatcgcatagtttgaaggcagagcaactgtcctacgcttgtttatagatggacgggaaagataccgcggattccacccataggagaacctgcgttacagaacccgggaaattcgcagacaactgcctgtactctctgatgacgacgttcacagcgcacagcacaagaagtgacgtcgttcctcagtggagtacacgaattgccggacactggaatagtctagttgacagtcctgcaagcagcctcctcattgctgcagccgtcctgatttctatgtcttcttcaccggtgttctctttctttgccacgtggtaggtaacgcatataaaacatacttttcgccaaaaagctgcgcatgcaaggtgccgacagcgcgttcggcgaacacgacctacagaagctcatagagcgtttctttgtcttttctgtccggaaatgaagcaacagaaaccgctccgtatctgaaaacggcatcaaatttccagtagggagaaactgaatggtgattgtgtcgatcctgttgtgcagtgggtaccaagcgtttcccaggtgacccactacagcagcacacaagcgtgtcgaatcgcggccagtcttcgcctgcagtctggagacggaagtcgtttcgattataacgaatttcagtcagagcgttagccatttctgtgtcaaactctcgttctcagagaggaagagtgcgcaccacgtcccgtaaaaacagtttttcattcgccctccgctgtagctggctcccagtccgagtgtcagaaacccccctcctcggcagcgagccgtggtaacaatcgtcacagggctctttgtgtcggcggcattttccgagtttctatactttcccttcctgtcgttctgccatcgtttttggtccagctttcttatacaggcattcagctgtaaacacgggcgttcgtaacgttggataccacaggccgtcgttcaagatatcccagatttttgcggcggaatcgcatcgtttccgtttttgtgcttcgctcaggcgaccctgcctgtttgtcaacaa

SEQ ID NO: 1869 - DNA, 2267 bp, Toxoplasma gondii
tcgtatatcacaagcctgagctgtgacaaatggtgtcgctccttatgtcgcgcactcgtccaaccccaaatccgggtggatatgtgggatgccgacccttgaaaatggcagtcacgaagtccggtaacgacttgatatcaagagcgcactgtgttcgaccactgggacagctagcaataagtttgtctttggttggctcatgtagcgacctagttcacatgcattcctccatgcgtttggcacaacaagaggggctcgtacagcgcacaggtgtacacatttaatgtaacatgtccatgcatgccaaagcacgcaggtaattcgcttagcgaaaaaattggaaaagtaattctgtatttacgcatattaacgtatccagtgcaattatacaaaatgccaccgcagacgtttttcgcaaggtggccggtgaatgccataattctgcaacattgggcagatcaccttacactaccacaccgttttatcaactccgcctcacttgtagactggtctagttttgttctacacacgtgaacgattgaaacaggcccggcacatgtgggcgagaatctttgtgggtttctcctgcaccagcggcatgtcattctggctttagagtaactgtcaattcggatttcttatgttcgaaaatggaagcaacgtggagcaccttaacgcgtgccatatgccgataacagtcagtgactaaccatcagcagactttggcgcacgattggccatccaaaatacctacccaacgatagatagtttgagaagagcaatatgcttccaccatcgaaggagctgtgccccgtgtgatgcgattcacgaggagagctgggtacatgaacgccacgctgaaatatcgcccggaggcatattcaaatattcacacttgcaataatcacgtcacattcatgatcaggcaaattgttcttgtagcgagaaccaatatggctgacagcatgccgacactgggggttcaagggcatttatttctccacaacaatgtggatacactctgaccaccacatctgttgtgcgtgctcaaccatctacgataaacgtgtaatgcggccaaattcaaaatgggaagcctgttaaacaaaaatacttttctgccggatgtgtctgcaagtcgctgaaatcaatggcaccttcatatgggctggggtcctgcaaagcgagtcaaagctctctgagagacaagctgcattgctgctgcagcttacacagcattcatgtctaacttgtcttctgtctttccacaatttgcatctatacttcccgtgtgcctacggggcttcgaatgcgctagcgacgataaatgtgcaacagaaagacttccagaagcgattaaccgagtcactgaggtgacatggtttcagatttctcgcgactgcgcataacttctcggtaatttgtgctgcgctgaatcgctctgtctgatgagtgaaggggtttgagagaaaactatactcaacccccgatcacctcgtaaggcgtcttttgtcggacgtcaccttgaaatctgataaacgactaaatttcgaggtgtttccaggcctgacctgcacgcaggctagctgcgagttcatcgaaaactcccaagcactcgcattttcgcggcatctgcgagaagctgcctggctgcgcgtcgttgcggttggagctgccacactcttgtgcaagtggtgttttgtcaagacatctgtcgggtttcctagctcttgtttgcagcttttggaccctttttctttcagacggatgcgtacatcctgaatagacagtggtgcagttctgccttggtgtactcacgaaaaagattttcttccgctcagaaattcgcagtcgacgtgcagttgcgtctcatcgcaaaagccccctacaagctgttcgttgttcaagacacgctggcgccagagagtgagggtacccacgctaccgtagtttacgttcattttccccgttgtcgtattcatatctggatttccatttgtgcctgaggggaattctctgtcttccttttattctcgtcgtggaaaaagccccgtcaaaccacgagtgatcgaactccatcagccgactccgctagcccaagcagagctgctgccgtttggtgggtcaggaatctcctacaaggtctggagaacatcctggtctgagagagctgccgcgcgcagaagagaattaattcaagtttttaactccgtgctgataattccttttcagcttatgccactttaaacagaaggacctgtcgaaaa

SEQ ID NO: 1870 - DNA, 4463 bp, Toxoplasma gondii
gacgcttttatcactgcacaggaacagagacgtggtatgcgttcgaattcgactatcgagggaagcatgggaaaatccaatgccactctcgccggtgacaacaggagaaaggtgaaggcagatttaggaacggtggaagtaactgtttcacgcgcacaacggtggatgactgagccttgtgagacacaaagaataatggaacgtgtgacccgggcagaagtgttggagcgatatgcatgctatgtcgatgaagtagagaaaactgatagactaaggtgtacatcagatgaacaagaaacggggaggagcgggaatagaaaagccaccagcggcgggcaaatgatactgaacagtcgggcgtcgttgctgaagccgctgttgaatatgttcgctggcgaaccaggaagccgtgcgtttaagcaaaggcttcaggctgcctgtggcaatccagagagtttccacgttggacagagtgaatcatcagatgaagacggcttacataaaggaaggggagaagtttcgagtggtgaatattcgaggcaagttgttgcctctaacgcctcggggcttcggtttccaagacaggagtcgacaggcgaaatcattcgccagaccttagaagtcattccaacgggcattcttcactcacaaccagaatgggatttctggcacgcaggagtagtctctttcctaccagagactgtgaagcccacataagcttgtgtagaggatacggtggggtgttcttggacgggataactgactcccctcttgaagtagctctcggcgttgcttgtgcggactgaggagacagtgcgtctgagatgtgttcgttccaacgttatgaggagccactgactagagattttgtttatctcaagctcgtacgaagagttcgcgagttcatatgaaggcttgcactatgttcaaagggaaagaacatctgactgagtgtacacatcacatgcatggtgagtgtccttcgtctgtctcttttccgtcttggtggagccgaactgaattacatattgctgcatgaggctgagtgctacagatagagagacggtctcgtactcgccagggcgtcagccgaagggcggatgcgagcggacgaagtctggagtgaaaacacatgacaacgattcccaggacgtaacccagctgcatactcatgacacactgggtggcagagccaatgcatttttggaagtcgtcaggagctttcaatatagatcgagcaccgtggcagtatcgaaaactagcccaaatatcccaggatgctcgcgtgtcattgctcgactgtcgatgccagtttcttggaagagccaaagagaatgggtcgctgggccgtgataaaagtttgtcaatgctagagatctgactacagcatttcggcgttcaagggattatcagtccggactgactgcctggggtagatcgcatgtttacaggtgaccgcaactagttcttcattagagacgtttatggttatgccacttccttggtgggcttaatgaacggacaagttcgtgtagagccgtgtacgccggtattggctccggagatggaggtcggcgttctctagtgatggtcgacagtcgggttcacgtttttctgtagatgctgcaccgcctgctggttccttggtttgaagttagctacgatgttcaggattcatccaagcaggagtgctagagagtgacaagatacactcgtctgaaccccatctgtcgcacttcgggatttactttaacctcctcgtcacctctcgctggtaaatggaattgatttgtacgagtcacactggtacggctgcccccttttcgctcaggtgtgtctttcccctcagagacttgtcggagactattcacttccagcgatagactatcgccacatggctttttcagctacaaataaattctttcacaagaactaaacataaaacgacctcagaaaaccagaatacgggaactaatcctacgtgcgcggtgccagaagaaggtaccagtgcttgcgtgtgtgacgacgtcacactgaaggatagtgcaaccgaatttaactctagcgcatccctaacagaatacaaacattctgtcaacatcacgtgtcccggagataaccagtgtatgttcgctgactgaaaagatagcgagcctggaaaccttcgaatcctcaaatgagtagattaaaaagcgttcgaatccagttccaacaagcgtctcggagtggagtgaaatgagtggcagcggagaaaaacacgttattcagcacttctgtgaactaatttcccattgactgacaagaaaatttttgtagcttgcttatccaaggcgccacgaaagctggtgtagtctcaaacaaacagtcatgtgtggtgaatgccacgtaaaagtagtggctaataagcccgtactgaagcagaacgtcatcaccagcgtcaatgacgcagaaagcagcaccaacaccgaaacacccgtgacggcgctgatgtccaacaacgacactctgactctcgaaagtggccctgaaggccaactgcagccttccactgtgactcagaggagtgcaaagtcatagtgaaccgatatatctctaagcttcgacgaaaatgctaacagttgtcgcgaagaaagccacgaacaagctcatgattcctgagggctatttccctgaggagcaaaagacgattatgctcggatgcagcctcacggctgagacccccgggactggtcggaaaaaagcgacatcaactgcaacgcaccaactggcgaagtgaaggtggctatcttcgcctcagccacttcgccgacctcccatccgtgcgcctcgatgcagaacgatactctatcacccttcctgagcacaaatggtaatctttccggcgtttgctaccagaatgtgctcccgcgttagactcagtgcacacctcaacgatttacaacagccaacaacagtgggtcgccgaaccgtcacaagaacttgtttatgttgcacaaccggagtcaagtgcttcctcggtccaaggaattagcggggcgtgtttctgcagagtagggccgatagacctcacttctgcacttgcccctgacagttgcctctcagagacgttggcaattcgccttttctggcgtcaaaagacatggcagggtcaggctgaaaccattttcggtatggttcctttgattggggctcgtgtttgggaattttagcagacaatggtgtttacgttttcccgtgagtgatgtgccttccactggttacttgatgcggcatgaactggcatattcagacttcattcagaaaaatgttactagagagcgacaagccgcaacctagtgacttgtggtgttccccccttgcaaaagaaaataattctcaagagccacgggtacagctgcctacgtgtcgcccaggtgactctccccccgttcagggcgtagttggggaccgttgtcgctttgtctctcgatgccatttttaggcacaacgaaaattgccgtgaactcttaggcttaaacggactaggaggagtaagtgcaacctcgaaaagcttctgtattgtttgtagctgcgaagttgactgagttgtgattttcgttcctgtacaggcccccggcggatagcaagacataatagcgtgaccgactttaggacccgccacaaacggatggtcatcagctacagaaaccggcggatctgtcgccgtgcaacaagcagggtgccccctagggcatgagctgttccacatggttccagacaggttgtcagaactgctaggtatatcacaatcaacagtggcagcttttctctgagtcacgccaaccctttctctctgaggcactttttttacgtacatatagactctgttcttgcagccatggagcggaaggcttctttgcaggcccggcgcagctggccttgggtgtatttttccttctttccgtaacacatctgttcctattggcgattgccatggaaagacaacagaatcctacggcaattgaagagacatgcaatgattctgacaatgatacgacctgcacttgtccagacgatgcagctcatggagtaaacacgggagtcaccactaatgcgttcataactgagtctaaacctacagttagcgtcaactgtcccgccaattatgagtttgtagctggtgagaaagcgatggtatgctcagcgggtaaagatgcgaacgatttgaaagagtgcaaaaccaatcccgggggagaaattaaaaaattattgtgtccagtcccagagaggttgctatagtggagcacaagtggtgacggactcacgacgaattgtctaacacttccacgagcctacttgccattatctgacaagaagttctttgtaggatgcctaccaaaggcggaagaagtgtctgggggctcgaacaggtgtggtgactctacaagtggcggctgaaaggtccatactgaaggaaaatgtca

SEQ ID NO: 1871 - DNA, 1445 bp, Toxoplasma gondii
tgagtttattaagtgtttgcaaggcttattgtgatcacacaaaccatgagtggttggcgaaccacaaagtcgagccgaaatagagatcgcgcttagctaatgcatcggcaattgtttattaccacggcgtgctcatggattgcccggcaaaagaagaatagcagctgtggtgccggcgtgcagtttcggattctaaagagcttcccatttccgcgtcgcagcacatcaggtttatacacacaggaagaaaatccctcctagtgtagcgcactcaaaatttgatcagaagacccggtcagatgcaattcaagacggatgaaatagaacagaaaacaattacgaattagagacccgtgttgtctccaaaaagtgctgagaagtgtcattgagaaactagagggcaaacgcgaaagactaatgttgtaaaggcaaggtgacgaaagacacgacttcacctctttgggtcgactcagtgagtgtatatggctttggttctttagcagttccccacctgcttccaccacactgcacggtacttgcagcctgtacctcaaatcatcgctacaccgctgctgcgtatcaacataacatgttgaagtgcaaagcgagaccacggcgggaagcctaaaaagcagaaatgctctatttgtgaaaccgaaaacaagtaatgtatgctttgagcccggtttatggttgattcggacacccaggcgtgaacgaggagggtcgacaaacgcttttgtcgctctctagagctggacccttgctttggcatgacgtggtgtactggcagagatgcggtgcggagttgttcggggcgccgcagttgagtctcagcaaaggttttgctctgcagagcttgtggtttgtctcttgcatatgcgatacttttaataaatgaaccttcgagacgggatctgttcgaccgcccccggatgtctccgtggctataggtaatctccgaggatacacggaaccacggatttttactacacgaaaacgccaaagcccagtcgcccgtaagtgtttcttcataagcatgccctcccggaatacagatgttctcagcttcgtttagagcttgttttttggcaggcttgcgaggaacgacgcagttcatatagtgacgtttaatagtggggacacagcggtactcacttagacgtcgatggaggtacgtctttgcacgttcgaagacggtcgctgctaaccgctaaatttactctggttgcatgcagtcagtctaaccgatggctgctccgcccattattgcggacaggacctgtggggtgggcgcgtgatcacagctttccacttttccttcttacttctgtcgattaccggtctgttaggttttttttgcgcggaatcgcctttttcttctcggctgggaagaagttctgggatcccgttcgcaggttgacaagagaaagtcgaacgcaaga

SEQ ID NO: 1872 - DNA, 2710 bp, Toxoplasma gondii
atgagttgcttgttcctgagcatatgtaggatttttgtgatctgggtccctgccgggggggaggggggcagttcatcgcccaggtgaaaaaatctctggtggtaaaaggttgaacttgagtggctgcagttgcggtcgttcagctcggtatttctgttggtgcctctatgaactcagtccatgttcctcacctcaaagaaattaaattcttataagacaggacgtgtcactacgtcgcgaatgctggtcaccgatttgcctccaatgcggcacaagcacagcagagtagccacgtaggtatatgtacagcagcaacagatttccacggggagttgcagggtatcagcagaggaatggtccttcacaacacaaagcgctctactgcccatccacagctatctttccttggaggacgtccgccccaaagtactggtgggacgggagagtttcacgttacaaagcgacaaacgccttcttagtcaggagatgtgtggatgcgggtccccgtgttccatgaaacgaggccgagcgagcgccttaagagcaccaaaaatgcaggtggtgtacttggttgaactctggtgcatcaactgaggaagttcatctcttggaggatccagatcatttagaatgcagcctccaaaatcgagttttttcttctacacaaatggcaagaggggaagcttaatcagtcgtatacaggaccagaaagcaggactagaatgcagcagcgaaggtgagaagtgttgccgtaacgacaccttaaagtgtgcgccagtctccgtgccgcattctggaagtttctcgacaagacggaaggctcgagacactagaattcgcatgtgcacgcgattagacatcatccctcctgattcgagggccgtcagccgcatgcgtcactgcagtggggcgggaatatacctttctcctctcgtcatttagctcgtatgcgctatcttttccctggtagtatgccagtgcagaatggttattcccggtagattcgtttagagttatgtagcgccttcagggaaattctaggtatccctgaatacctctcctcatttacctgtctggggtatccggtagtctctcagtgagacttgttccctttagcctcatctgaagcaaaccgctcgagggatcttctgagtgtttggtgtacaacgcgtgtggtagttttccacctcatctacgaagtgaatctgtcactttgtgtctatcgccacctgctacttccttgggtattgcacacacattcgttaagattggtgagcgaagcctgtcaccacgcttatccgaaactcgcagatgagtacgctgaggtgacaggcctttggtctatcaataacagtcggtgtagctttttaaaaactgagtcgcgaaacgcttctctagagcagggttcaagaagaccaggcgaagtctgcttcctacgaagagaaaaagggaactgggtatgcggttccttaacgtttgacttggcgattcacgttcttcttcgtcaaattccctgaattcagtttccaggatctttcatgtgcaatattgatagcaacacggcaatcgagtttcaacgttttcgttcgtaatcgcgttgccgggtttcgtgttgaatgcatctgggggccgcggcggttaagagcagccttgccgccagtctgctcgttccagtgaaccaccagctggatttccttgttcgtcagtgaaacgtttccttcgtccctgtctactgttagctgtgcaaaagtgctctcttcttcatttggaaacggttctcagtccctattgattttacttcccccaatcgaaataacggtggcgcaacgcttagctcgttacccccgacggcttcgcggtggttgtggtatttctggaataggaaggggtttgcccactggggttctagggtatcgctcagggtttctctattcgggttatttcagggagccaccgttttcctgtatttgtgagagatgttgtggcggagtcaacgctgtggtgtatttctaacgcgtgacagtgagctctgcgcgtggacaggtgatccgtgggggttggtccgaggagagagattttgcatgtagagacggtgcttctgttatcttcttaggaaaaaccgtattcttgagcggtctgatataagcttctcctttgcgtttaaaaggaacatcaaggccgcatgcatctgctggccactttccaaagaagcgtgactggggtaaactctgtggctctttgttcgcttcgaaagtccagtataccaaaacacatacatttgtcggacagtttcaacatgtgacgcagagggattgcctgtcctttccgcacgcaatagaaccagtacgtcttaggccacctgtgtggttgagttccgtagaccatcgtggcaccctcgccgcgcgcttcccaacatccgtaggctggcctctctgtttactatgtctttccacagcgctgaggtttggccatggctcgaccggcagcctggtctcaagcgcagtatccgagtgagaagctcttggcggagatccagggaccgggcaggggtactgccacggggactgactgcgttttacgattctgctgaaaggcttttctctgtcgtaccaccacaccgcaacttttaaacaccgtaccttctcatcagcttctccggggacggcgctgtagtacctcctgttcttggattcgacaggtagcgtccaca

SEQ ID NO: 1873 - DNA, 4260 bp, Toxoplasma gondii
ttctctgtttgcagtaatgcatctgtgcctgcgcattcgaaggcaatccgtttccctctgatcctcccctgatggctgcggatggaacgcaaggcactttccagcaaactgcgtagctttgaataaatgcaccttgaagttccgagccagtggtccaacgtatgtatgactcgctctcttcgctttcaagaaggcgccactcttctctccacgcgtccagtggagaggcgggaggaacgcaaccggcagaaatccaaggtggacgagaaaaaacgagactttcacttgcgccgcgctcctctgttggttattgcttcaaaagtcgagcgtgaaggaacgccttacagagtaaatgggatattccacgtaggagatagtcgccatgccggaaaagacgccgaaagggtttgttctcaaagaagccgcgggctgccgagcatcgaaacgaatgggagagaaatactagttgctctgtatcttcagagaggcttcttcgcccaaataagagtctctccgtgagccggcgaggaggatgaagggaggaaacgaaaggcagagacgattcgcaaggagcgacagaagctgtgccgtggttctgccgatgcgcggactacagaacgaccgcgaaactgtgaatgatggagtgcagggaagtggaggaaatggagaggagcaaaggaaaacacgatggagtcagagacaccgcaagatggaggagatgggcggtttacggcagagagccctcggcctctgggaggtgaggaacacgagacaggaacgacgagagcacccaatagtgtgagggagagcccctcaggctcttgttgatcaaaaggcccgcggaacttaactggcagcaatgaaacacggagaggcatgcagaaaagccagcttttttgtgaaatgcgtacgctgttcctccgacacaaacacacacatcgccgcttggggtgttgggaccctgttgcctccagcgcttctatgctacacacggacacccaaactcggcgagaaggacaaaccaaagcggttagtttctgcagattccagatgaaacacacgaaatacattcgcgagaataactggcgacaaccggaccgcgaaaaagacttactccgttagctggttgcaaggctttcactcagcacaccagacaacatagcagcatctgcatgcagcgcgcagggagcatgcgctggctggctaaaaaagcaaacttcgagaactggataccctgcgcagccagccggcttggattatctctagaaatccacaggcagagtagtcagtcgattggcagggcaccacttcactatctgtctatgatcacagccagatgaggtgaccgaacccggatgcacatgttcaagaaaagatgtgcagacacttcctaggtatccccttctcaagtgtcgaggaataagcttgctctacggcacctttggtaccgtcatagaggcattcatgcgttcgctctgagtcacggaacgatatttatgtggatggtctttttcttgttggaactaatactcacgggtcgctgttagacaagtgaccggtgcacgccggggatcgagtcttctttcggtttactcgttaggtattactgtgaagacatttttaagttagcgagtaaattcatgtttggttaatgggattgaccgaagaacacgtcccatcttcgtggtcaccagactgaaggacgagagagccgctgcaggcttgtaacaatttgcccttgcctcggaaggactcgaggctgtgactgttgcttgtcggcaaccattacctgatgtgtgatgaaatgttggccttgaacatcactccaaccttgttttttcgcttattatcgggttgtatagtttatttcgaccggtgctgcgctagcggcgccctgtgcgctcagctgacctcttttgcactaaaacacgtttctgtggtgagtctcagaagctgcgtacagcaccgtcacagtgacgagagagccagcgtttctgtggaactgcgtgtttctctctccaaatactattgtggtgcttgcactgaagacacctcggtagacagttttagggctcattacagtgttcttgaaggacgaggtgaaacacgcacatgcagtgacgctctcagttgtgtaggggtcacttcagtattatatctcacggaagccgcggtacattccagttttattctcctgtactgcaccagttatgacctgcaaacaaaatcaccgtgtgcggtttcgggcgacggagtgttttgtttcgtgtaccagaaaaacgacccagcaatcaacctcgtagaaggatgattaaacgcaccacgacttccacactgcattgttaatgatacacctcatcagcacctcgcagatctgcttttctgattgtccacgaaagcatcgcaggcgagttgcccggtgggaggagtttgagagactgtcaaagaatggagattggcccgcgctaatgccatagtctcagatgttactggggaaaagctagaagggtcaggctggcgtgttctgttttgttgtgggatatcaactttccgtctgcaacgatggcctgggatacatgcgtttgagaccgtgccactgaacatgccctgtcgacgacaaagtgcggaggaaactgtggaaaacaaccgaccgttgtaggagggatgaaagattgtcctcgtcagttttcctccggtgtagacaaggtcacgagcaaccatcgttcccagtatgacatagcagttgctgtgctgaatgctgtaaaacctagagttcgcaggaaaaccgttgctccgcagagcagagatggcacaaggtccggtgctgcacaagctctatagaaacactcccgcctggcggatcgacactcgcgtgatttgaacgagaacttgaccctattaacaaaacaaggaggacgtgcttgagtaagtcgcaagaaaaaactaggaagaatctgcgattatccgggtcatcgcatcattccagcacctaccacaaacggcgtgctaatcccaagatttgtccgctaggtgagggcggaaggacatggtcctcgtatatggagccactgagcggaagattgacggcggatgaagcagcacagcgtgggaggaggaacaagtaaagggctggtacatattcggctttttcggcatcaccaatggttcccgactccccgtctactttccgtgccgcagcgtactgtatctgcgtgacgtacacgctcggagttttcgttttcgtcaggccagactgttggttgatgccacactacaagttgccagatgaaagcttttcgcaatttgacccggcatgaaaagacgaatgagctctttaacgtcattcgtagttgattttgtgctcgaccaacaccggggtggtgctcctcagcgcctgttgacatgccgctttcagggtcctctccacggtagctgtcgcatatttgtattactcggcagaccggcttggtacccgtacttagtgtctacgaaaacgggctctcaaagtagctccaacaacagccactatgaactctttccacttcgcgaaacgcgtcctacgggccaacacacatgcgacaaatgcgatgcattctttttctcaatttcgagctggcggtgcgcgtttggtgtcactggcgaggagtgctgcctgttgactaactaggggtctctaggcgggctctgctctgtgtcttgtcgtttttcgatttctcttgttcttcacctcgcatttcttttacactctactgtgacacccttttagttcctgatacgggttgttttaatctttttttcctagtagcggaactttcctgatcggtttctgaattctttgacaccacagtgtcgtgcaacacctcggaagggacacatccgtcgccccgccccagtgtcttcctctgcacgcaccgagcctagttctccagaggcaccccattgtaccagcaaggcagaagttggatgtcaccagcttctcaaggactttgttttaccgtggtgagtctcttagaccttcgcggcagagaaggtctctaaaatatacgcagccaactcgtcaaatcagtctcggcagctttcgcggcggcgctatcgcacctggtggactccagtcgccgctttttaggcatgggattccggtcccggttgcacgcgagcagaacgtcactatttatatcacttagtgacagttttacttcctagagaccatgccctaggcgcaacaagctcctgccgagcggcagttcactggcatcgaca

SEQ ID NO: 1874 - DNA, 4764 bp, Toxoplasma gondii
cgtttggctggttgtcttcggttttgaggaaacaggcagaaaggggggcgatcttaaaatcctcgttgcgggtcggaagagcagagactccagtctcgctgccttcttcgcgagccttggctgctgcctcttgcgccttcttcgccagcgccttgtgcagagctgcgaggcccatgccgacgatgttctctgtccgctctgcgtccttctgcgtcggtggcgagctcgccgcgggaagcgaaggaaacaaaggatctccagaacctgcaaagccgaggcggtccagccgcggtccgccacccggcgcagcagttgaaacagaagagtcttctgcaaatgcagacccaatagagcggcccgcgcgcaggccgccacccagcggtgtggtaccgccagaggagttgggtgcaggtgcagcgggggagctgcctgcctgggtgccggagtcggagggactggcgccttcctcgctcccgtcgagggggaaagcatttccgtcacgaggcgactggcgctgagaagacaagggtggcgaggaggatggcgcagagggggcgagaccggagacggcgactgaagaactactggaggcgaaagaagcggtgaaaaactccgtggaaaccgacgaactggcgcctgacaaggaagacggaccgcctagactcgggtccatgagaagccccatagaggaggagacgcacgttgcggcgttctccgtcgaggcggagtcctcatcgtcttgcagcgcaaaatgcattttgcggaggaggtcgtcgtcctcctcctccacggtgaaagatgcatcgtacaaatcagacgagacagatcgactcagaaaggcgccaggaagcgaggaagccgaagactcgaaggaggaggaagtcgagagcggaggtgcgccgccgacagcagcggacggaacgtccgctgaaggcctggcctcagactctgccgggggatcagcggggaggtgagaaacgtcattttgttcgagacctacgtggagttcagacgaagacggaagatgcgactcgggggaggccgaagcgtcctcgctcgagggctctgccatcctggtcccgaaagggggagaagatgcgctgatcagactgccacgttccccagagccaggccatttaatggatggggaaacggggcgctcaagatacaaaaatccggttcgtaccacagaaaaagacggcggtcaaaatctgcggacgcaacccgtcgccacgagacgctgaaatcacttttccacgcggagaaagggtgagacgtttctgcagagaactgattatagaataaccgtctcgcaagaatcgcgtaccaagatgcatgcaacccctgcgaaaaacagaaccctccgtccggccgccgccaacagtcggcaactcgcagcgtgtcctgtttcctctcggtcgccgcagaactctctctggaagttccagacgtttattttcggattcttcaaaaagtgaaaacctaaaactctggttgccgcagtacatgagtgaaccgctggagtgctgtctactcccggtataagtacagaccgtgtgacgcatactggcagctggcgagtcgggtcgagagtccagctgctgggcgtgccaggctgcaaactcggagacgcgtggattcaagcctgtcccgaaaagcaaatgagaaccagaaacggcgctagacactaaaagtgtttcttagtacgggataaagtgcagagatacttcgacagagctcgtctagatgacaaatagaagcccgcctgtttgttacagagttacggttaaggagttcgcatcactcagaagctcactaaatcacgctaaaacgtcgctgaacagttcttctatcattttctcttacaactgccttggttgctcagctcacgacgaagttcgtctctttgccgggaggattttcgactcagtaacagaacgtagccagcgcgtggcctcacacgtgtcacaccaagagcaaaactccaaccatggtgcgagatttcgcgtggatgaagaattctttatcatctgttttggtgtatcctcatctttttgagtgacaacacaaagttttgtccataagtgtcccggattcactggtaattttggcagcgccggggaccgccgagaagagcatgcggccgtgccacgccagcccgagtagatctgctgtcgaggcttctggatttccttttgttgatcagcccgccaagcaggcacaccagtcactcttgatgtttattttttggaacttcaggtactgtaatgttagttttaagtcgtactgctttcacatgctggatattctcacgatattgattcggtttttcattcaagcctacgcagtgacacgaacgggcagatgcagcatagttatggcgggtgtaggtccaaggcccggaagtttatggcagtttccttgggtggagttctgctgcttttagaccagaaagcctttgcgaatggggcaaatgaggaggccctgcgtgggaactgggtgtcaaatgcggagagcgcccagagccaaacggacacctcggccggagttgccatttgtacagctgccgaagacgacaatgtcacgccatctactgcgacactgtctttgtcgcagagttccctcacagctactttggcgtgtgtcaatagttagaacaaggagcagggcaacaacacggctatgctggcaagtttgaccgctgtctgcgacggacagactacaagaccgccggcttcgcgtgcaggcgattgcaagatcgggaatgaggtcctggacaattcgtgacgctggcaaaatattctgagatggtcgagagctcggatggacccaaataaacagagacgagaaggaccacgaagagtggacgctccagctaaaggaaacggatcttcctctaacagacaaaacattctttgtcggatgccaaaccgttgctccggcgtctaacaagtcttgcaaagtgacagtgaacgtgaatgccagaccatcctctgctgacgacaaaaatgttgtcagctgcgcatacggtcaggctagcaacgagaaggccgtggaggtcgagatgtcagaagagaagaacactctcaccgttgactgtggtaaagacggatcgatgcagcctacagactacacaactcagtactgtgcacccgacacagctaggttggacgactgcgcaaataactatttagatattctggacaagtttcacagtaactggtggacgagcatagaaaaaaaattccgtgttacgctagctatcccgaagaccgatttctcgactgaagaccaacacgtcgttgtgggatgcgccgcccatcccacatctgcaacaacgccccaaaaggcatagcattcgtctgagtttgtgtctacaccatcatcggcgagctctgccttttctgccttcaatcgtcaaccagtaactggtaccactggagtggctgttatatcagcttttctggccggttctctttaagcatggtgacgagtgtaaagttgttcagaagttttaacctctttctgtgtccggttagcgtcaaatgactatgcatctgtgtagtggtattttctctcatggtatccataactctctgagagatgtatctctccatttttgtgacagaagctcgttgtggtcctctttcgtcctgcgtcgacaaggcctacaattcctggcagaccagcggactgagaagccttgccgttgacaatcagacatgcagaccatgtcacacacacacacacacacacacatgtgggggcattctcctagactgaatgaatccgatccagtttgcagaaaaggatttcgcattctggatgcagccctttcgggaagaaggtcatgtgggaattatgcagatatgtaaagaaatatccgtctgttggttagttgatctgcgtttgaatttgtaccgcagtgccttaagctagcgtcgcgaagacgtgaacagggattctcttaacagaggccctatgcttaaacatggagcctcaaacgccttttcgtgaagaaaaaggatgccacatcagagaacaccgggatgctgggattcattcaaactcctgtagccgacagtctgggcgcagccaagtgcaggcaccattcaacaaccttgttgtgcttgcgcagacgacaagggcaggcggcagagtgtatttctgctatcagagaccctccgcaatacaacgcagacttcttgactgctgatacacaccggtatttgtggtacaaactttttcccgatgtcgtagccggtcaacacagcctgcccgtagaagacaaacgcaggacgaaggcgcaccgcacttgtcagttgttctttctttggaacaattaatctgttgtgtcttacgagttccggcaccccgaacttgacacctgcagcaactgcacgaatgcggtagtttagcaaaatccgcctgttgtcataatgctgaacccagccgaaactgaagagactccacctcagtagtcaaacaggagacctccaccacacatgtactaacaaccgcttccaccttttcaagtaagaaagaaccacacacaaagcttgtctgtgaaatccgtcaaaccggccccgataaaaattccagccagcctacggttgcctgtgtgcctgcggcgttcacccgcccgcgccgcccgcgccgctccccctgtccctggcacggacgcagtgagtgcctcgcagccagtaaaagcaaacctgattcattttttatcgtcgggttgcattgttgtttcttgctgcttca

SEQ ID NO: 1875 - DNA, 946 bp, Toxoplasma gondii
accagctaatgagggaatctgaaattcatcactgaaggacagcagagaacatagcataaacacttcagcagttcggagagttggtccatcacgtcgttgtatctcacggagattatgttttaatcacgagggaaaaggcggtgttgtttatgccacatattccgacaaccgttgtcacaaggcagttggaagcgactaagatgctgtgtagatcttgttcgttagattagttacagtcaccagcataggactcttcagtaaactttggtcagcgatacaaaggctgtgctagcggtcactcaaggagacagaaagcgatatggtcacattttatatcgagcaaatacccatcagttatagaagagggcaagtgcaagcaggtattgttattttcgccttcgatgtcagagaggctggaatgccctagaaggggtctgcggtgaggacagggtctcttctcgcaattatccagatgcttgcgatgagcggagaactaaaagcagctcgttttttccatgaagaataggcccagatctacttgagcggggtccagatcgaacaaacacgtgggccggggcattatatgtttttcattccagggtagacggaattgcggacattcaatcgatctgtggctatgaaagactaacctggtcgcttcaactgcctcttcgtttgagtttcggctttttcaaagcccctaggttggaaagagacaaatttctatggaagatgtccttgagcttcgtctcttgcttctctggtcatcggtgcagtgactcgtggatatgggcaaaagaagctttgctacaactaacgtccacacaaaactgaggcataacgtggcaataaaacagatgctgaaacggccactagaatgtgattcattcattttcagcagctcgaacgagagaggtggtaggttaggacaagtctgcaaaagcta

SEQ ID NO: 1876 - DNA, 2689 bp, Toxoplasma gondii
ggttctttcccatcactgggctccactgaatttcaaaactgcaacaggacattgcagctttgttgtggggcgccgcactctcgtttccggttgaaattgtttctcgttgcgcaagaggcttggcgctgagatacgtcgtaaatgaacaagccccgtttagtgaatgcaattttcttgactattttccatcgtgccaagatgacctgcgagggcagtgtggacgtctaagaacgaagagtttctcttctgatcacgctctgatacatgcgtttgggcttctgtttcatgcggccactcgccaggcggtgacggagccagtttgatgcacaaagtttgccccctatcgcattcttggttcttctccgccgaagggtggcgatagggcgacacactgacttactgcatcaagcgaatgtcagggacatcaacagtatttttgtgaagccaccgaatacgtttcgcatcgttggatcttcgtgcagtcttgtggattttcttccagaatgagcgatgtgggacgttgaggataggaacgagaggatagaccacccatgagggtaccttctgacaggaagtagcgttgttgtgggtggtatggctgaagattgaattccatcactggctagctgtaggtgtcacacaccaccgtcgcagacacctaaaatagccaacaagctttgttatctgttacgggagcaatagaggatgccttacaagcttgaggctgtggtcctcgagtctgataaggcggtgcgggcaggaagcacaacagggtcattcatggtgaatctcttaccggaaagtcgacggctgcaacgaacccacccacacaagagtaactccagagcgaagagaagttttctcgaagcaactcggattgacacagtcggtcagcgacgctcattcttcgcaaattctaggtgcgcttgtcgcctgacttacaatattgggcagcgctttcttctctcgacgtttctgggaaccaagggtagaacgtaaccgtggagtgttacccctatattggacatttgttccactcacgaaatgcttcaagaggggtgtgaccacaggctccgtgcactgtgcctgtccacacacagggatgaaagaagcaacgacaaacgaaataaagtctgaaatgtatcagagctttttggtgcttcttcgatgcctacgacggagttgttgaatgtatccgcgggggaagtcctctgtggcgcataacagagagggctgaatatcagtgtagggattcggcaacatgtcatctactctgattaggaagactctgctatgtgtatcttttcattcttctgcacgacaccgacaagcggtagcatgaacggccgcgcaccgtaacgaaatccaagtaccaatatgagagggaatgacaacggacgagcattatgacacaaacacagttgtactgcgcgtgctcgaaaacgtgattcaggttgaacaggttctgcagcaccagaagagcatgcaaaacaccaccacgatactggcttcctcggctaaacatccagtgtctgcgacccgatctaatggctgactggatacttcggacattgaagagcgaggtagcagtcctctgttcagcgggctcttgtgtgtatttgtttctctgcagcaacacagaactggcatctggggtttctaccatggttagacatgcgtttcttatgccagaaacttccacgtgtagtatacattagcttgccgcgtcgctgccaccatcacgaggccagaatacgacgtacgcgtggagtggagttgtagtgtagcagtgtgcattaatatgctccacgcagagacgcttttcagggctgagtgctaacacgggaaacgactagagaaaccttctgtacgttccccggtgggacgtagatgattcaacaaacacgggcaactacgatcgccgtttgtacctagctgtttggggcatccaaggttgtcggttgctgcagtggtcgccaaactaaccaaacacattcatattctgcaacggtacaatgcagctgggaaaagccacagctttagtggcgtgcctgacacaggacatcgcggatgtttgaccggctgctattcctgccactgagaggtttttgtacacatcacgaggacaacccatcgcatatttgaatctggcaagccttcatacgaggcaaataaaatggatgcatcggcctttagagccgttttcgcttctgaactcgagatgctgcatgtcgcgaacgaaacaacagtcgctccggcaggggctggaccctgtcgtggatcacgcgtgttcccaagagttacgtgcatgcagctaaaagaccttcgatgcaggggaaagacatccgttctctccttccgaacgatgcagtcctcctctgagcacacggtagaatctctctaattttttagaggttacagtgctacagcgactctcaaggctttgcttccagtggcatctcattcgtgtgttgtaaacccgcatccctctacgcgtcattcccgttctggggctgtggcgaggtgatccctaaacagtttcgactgcacgaccgctatatgagaataaagatgtaatgaccatgactgaacgctacatgtactcaacggaatctcagtaacacagtgttcctctcttggaggctgcgaggtgccgactcgtgtgtttccatctgtcccgtgaccgcaa

SEQ ID NO: 1877 - DNA, 1925 bp, Toxoplasma gondii
tggtgacaagtgcgactggctgaactggatcgtttccgttctttaggaacccctggaggagacgtggtttccctgtgtgtccatacaggtgaggaaagaagtttgtggccacaaccaaaagcgtacctcctcaatacccttcgtgcgtcctccagctgttctgccgtaactcgatggggtgcgacggccacgatgctcttccccaatcgaatttctgggccaacagcaggtggaatgcgcccaatggggaccttgattcggacctcctgaggcgctttgaaacgaaaaggaggcatttccacggagtgcacggaaaacaaatgtggcaacacaagccaaaagaagagtacggagccggcaagcggtcgcagcctgtggccgtctctggcggctccagaaggcgaatttttgcagaaacggccggacagaaaataagtttgtgcgtggaatcactgtcgcagtgtgaagagggatgtgctggaatgccctcgaagtgtatttagccgaaacaaagaagaggccgaagtgaactctgcctgttctggaaaggaactgatgcaaggaaatgacagcgtcacttgatccccggagtgttacgtgtacagacacctcggcatctttacgattgaggacaaggcaggacaccgacggcaagatggcagaggactgtgtagaggctggcgggtggaaggggattttcaggcacgccagaaaagcagcgagatgtggaagaaggacaggcaagacaatggaggaaaacagtgaatggtaaaaaagtctctccggcaacgaaacgacacactagcgaaaggacgacacaggcagcatcgtggagcggtacatagtgtcagtgttagttttaacatcgggaccttcagcagtgagacagaagcgaaaagacaggaagcaaaactgtaagatccttgggaaaaatagcgttgtaaaacgcctctacaggcgcatgcaaaaatccttcggggaatacaaacgccgccctgtggtacggcaagttggaaaaggaacaacgaagaagcatgaaaacggagttccgtcacagagacaaaatgcgccgttatcttttcacattctgccggaggcccgaagaaacgcgaattacgtttcctcggccgcgtaggcgcacattttgccgggtccgatgcacagaatttttacgggaaattgcagaacgctggaggatcttttcccttttctggaagctaggggagcataggcagaattgaagggtagcgaactgtgtcttcgaactgttttgcgtttttcaagatcccgtttcccgccgagaccagcgataacactttttcgtgcatgcgagttgctacgcaaataagctttcgcctctcatcacgactggactgactgcagatttgaggaacttgccagccacatgaatctctgcggattagtcaaagcaaagtggcaactcttgatgtgctcagacatccgtcgcttcctctggaaatcttttttcgcgctgagcttacatttccttaactgtttggaagagaaagctcgaccagcgcacgcaggtagtccactagtagtcgagtctacggcagcgacttcgattcgcacactgacctgggagattgagagatggtggttcatcccgagaagcagagtgaaaactaacaatacctttgctcacttcctcatcatggggaagagtcacagcgaaaatgtttgcatatctggttttctgcccgttctgtcgtcgtcactcgtccttggagctatagcactcgctggagaggacccacgacacggtctgttttattttcactctttcagtcgcatcggcttgcagcaactgatcaaaaaaattctcaaagaattcatcacgacgatgttagtccacgaagtaatacgttgacactgatctcgaacaaagtgcgcagatcaaaaca

SEQ ID NO: 1878 - DNA, 4701 bp, Toxoplasma gondii
caaagaacagagtcgcgactctcagtgtttgtcggcttgtcttggtccgcgttttccctctctgtcctctggcgagcatctgagattttggaaacaggccctgcgttgcacgcagtgcggcgacagctcgagtaagcttgacgcaaatttccagaaggtgtgaagacggaaggccggaggtcgcgcgaccacagcgagcaggggtgcacagctgcagatgagactcgcttgcatgcacccgcagaagtgatggaaatgcatgtatgtctgtccagtgctcggttcctctgcgcggcgaacggggcttgagaggcgacggcttgtgagcacccctcggagcagctgtttcttacttccggcgctgcgacagaggcgacggaatctgactccgcagaggcatctaggcgacgagagacagccgacgttctcagcaaggaagaacgacatcgagaacgcgcgagaccgacgctacgcaccgctccgcggcagtgtgcgtggaggcctcgggcaagcacgaagccttggcagactgacatggctctcagtgccgcttccactgccaaaggcgaaaaaagttcagggcggtctgtgggagtccagacagaacgagcagaagcgtctcgaggattgcccgccacacgaggaaaagtgtgcacaatccctcgtaactgtacacgagtaaaggggatctctggagaagaaaaaggctttccggcgggcgttatctcgacttcagctgaagaaccttcatattgggctgcgtgcacgcgcgtcctggtctagaaacgaagttgaaaaaagcttgccacagtgtacgtcctctgaacgtggcaaggctcggcaggaagaggcgctctccctttaaacgagtggcagtgacgccttgaagacaaagaaaccgcagatcgccacagatttgcgtcagaaacaaattcgaaggtttttcaaggcaggtgcagtaacgcagcgaccttaaacggaggcaaaaggtattgtgaatggggcaaacgcccgcgtccagtggtaagctgctttcgaattactgtccagtttcgaggccgaggcactctgggatacccacaggtccgaaaactgtggacatccggacacagacggaaggcctctcgtcctgctcacagttccacgtcggtgaaagcgggaaggagtttttgagtccgcaaagtggaaaaggaaaacggcgacgtagtgtgatgtcttgtgcccgcattcacggttgcgaaaaattctatgcacagggtggatgtctcctgagtcactggaacttttttgctgtatgcgagacttcacacaaacttgtttagacgttccttttgcttggcgtccaaaagaagcaggacaacgccaccccgagaacccgtggacatgcagtttcaacgcagcgttcggattggtttcggtgtatgatgtcacggtgaaacgattccgctgagatgccataacctatgatagccgatacagcatgagaaaatgtttgacaagtggccgcgaactgccacccatccgccgtctaacatacgcggtaaagggtaactccaactggaaacgcaaagaaaattcgtgtcaggctcaacctaggaatgggtccacaccgccaagggtttcgctgcgatggcggaacgccgccgtgtccacccacttccgtctgttttctgctcagcaagcatgtgacacacgcattctttgggtctgtctttctttactcgtattctttgtgaaaggggccatgtctttgcagttttttagaaggaaggatggagacaggtcttacatgcacacgctccctgcatgcttaatgttaatcgaaactaagcccatgtttgaggtacaggcaatcgagttccccatggttgctgtttaccacacccctcactcgactgcgtaagagagctaaaagtgttgaatttcaatatcgagcaacattaagactactttacatcggttttgcatgtgctacgcgtcaaatgagatccggagtcaccaaattccgcctgattgctgcacatgacaccgccccacctgaccgcagaagaacgctaaaagtggtgaatgttttcaataccgtacggcattaaacttactgatgtcggttacgctctagacttaatatatggattactgttacagcgcatattaatacttagaggaaacgcgtacttagatgccagaatgcagaaatcccaaaattaccgaagggtgagctgctcttctcactccgttgatacggattctgtctctcgctctgctgaaggaggaaatctccgagcgtttcttcactacacaagacacatggaagtccaactgcggcattctccgagcaagagattgcgatgttcttgtcttggagaggcgacaagttggaagaagtggaaacagaggccgaggagcagctttttcgctggcgacttgcgtttgacgtcttcactccaggcggccccggctgcagaagcctaatgtgaattggagaaaaggtagatgagatgcagtaatatggtaacacgtgatgtaaactcggcaagaggtgggtacgcaagtgttgtagtttggtgactttgttagaccaacctccattttttcctcgtcaggtcctgtgggacctgttttaggtgcagaaaaagttcttgtcgttgacaagaaagaaaaccgtcttttcttagctctgtctatttgcttgcttttattacagcggaaatgccgtgctacacattcccaactgtgatggtttctgattggcttttcgcggactacgcgagacagtcggattcgcaactgccattgaatcccaagtttccccatctgttacggagttcctcaggtatcggtgtcctcagtctgactggcaagaaacgggacactgggaacggtgctccatgagccgacacagctggattgttgcaaagtgttttctgctctctcctgccttctaacaggaaatcgtgggcagggtgttggtgagtgttctatgcagcacaaactagagcgtgttcggttccgtcaacctgtcgtctacgccaggagagttcaacagatgatggtaaaaggtttcccgctggggcgttgggtcataatcccgccaaggaaccagccattcccccctcgcttgtaaaatatctcaatctttgcagagtcaagggggttttgaatttcattgcttcccacacacgcgccggcagtcgggaagcgtggctagagacttcagcgttgtttagtactctatttccgtcaatgccaaacgacgagcagctctgcacgacagcggcgctgcgcgctctcaaaggttttccgccgggaaaactcgtccgtttttgacgacggcaacctctgacgctcgtaccaacatcacctcgtcggaggtcagcaataggttgcctgcaagaattcattagcatgagtggttactccctacggtgacttcccgtacgattcagctcttttcgttgacgtgtccctgtaccattgcgtctcagttcttgcacctgtgcacaatggtggaaggcgactgcgacagcaaccagccttctctgtatctgctcgttttttctggaatattggttctgccatactacgcatagtggacgacgagtgcgatggtaacaagacttgaattctacgtagtcgtttttttctgaaagccctactctttgtacgaaacgccagcgtccatgtctcaaactcccatagcttcctgtgagatgcactatgttttcaccagatgcagcgaaggtggtcctacgcgaacctcgtgtctcttcgagaattttggtttatgcacgagactgctgctaactcggtgacacgtcgtcgaaacgtagtcgcttctggaagagcacgggagattgcccgagatcactatttttcaaatatcgtgcgtcgtcgtggcataaagcagcttgttgtgttcaagagccagttgtgctagtttctgttttcgtcacttggtggtttgctcgtctcttgcggtgaccttgtctggtgggtgttctgtttatccagttgatgatgccgagacatcattcgcattggtaggtgtttctcgcggttgcgcaaccgatgttccccgcggactggcgtgcgactctctcaacggcgactccgttgcgtttcgtcggtggcaaagcttgcggggccacggagaactaaaaaaccgaaaaaaaaacagcttctgtgtttgccttgcgtgctttccccttgaggaagatggaaaatagctggcagccctaaacggtttgactgtcggagttgccggtttttgtgtttccgtggacaagatcggccggggcctgccgttcttgtaaattcattccctcctgtcttttcaccacatcgagacagttgttacaccagaaaaatagcgggtaagagtgtctgattcacaaaacgcaaagtgcaagccgattgaacctttccgggcgactagcagcactctactgtgtccgtcgttgtggggaggttcatttccgcttgctgccactttttgcagtcgcaagcgccgaaagttcgaggcgtttttgactttctgtccgtcacttctccgcattgggggtttccttttgaccgctgcgccattgtctgaacggcgtgggcactttctctgcgttgtctgcgcccctttttttctcgcttgtctacgccgtcctcttttctccagatcccctggaagttctgcccaagcactgtccaaga

SEQ ID NO: 1879 - DNA, 3456 bp, Toxoplasma gondii
attcgtttctcatattctcggtctacaccaaagttacgcctgcttcacggcgccgaagattcaccgccacggacatttgattgcaaaatggccaactactatgtttcaattttcatctttttgggttagatgtgccgacattactgtttgtcgaacgcccgaggatgaattacatgtagattaaagatccgatgactttagctggtatctcctatacaggtggtggtccgtcacgtcccccaaaacaagttcgatgacatagacatgcccatggatagaacgagagtgactggctctcaacaaggactcgaggtccactcagcgttgacgagcgccaggtatttctcagcgtttcacgacgccacccaccgcaggggtgtaggaggtgtcttgcaagaagacacagaatgtaaatgtaccggtaaatataaaaagcaatacggactacaccctgttcgcctcactgcaagtgacgaactcaaaagtcactgctggagccccccagtcgacctcttaccgaaggagttcgcggaaggaagcacggacgcattggcgcacagacagttacctcatgagacaaatgagaggacggcaatctgaagggagtgggagtggctgtaggcaaaaacttgtcgcttcgttgtgggaggcgcacccagtcgtatttctctcaggacccaatcaagcgacattatccacagtttattccaaacttgcaacagaccgcgggagcagaggtaatctgagaggtaactccgttcttggaaatcgtcagactttcgcaccctctgtaatgcctgttgagtccttgcaggaaggtgatgccaagagttcctcgccctgcattctgctgtatgcaagggacgccgttgcgcgcgtatctttgcgacaacatgcatgcagatatggatcattcctccaccagttgaaagaacggatgctcccgtatcaatgttctgctgtctaccgcgttagctcgtgcagatcgaggagaagcgtcacaacatccagaagaccttgaaactcttgtataaggaacagacacccctctgaagcgaatcgactccccttcagacttttgagcaacttttttctgtaaactttgtcgtaggcatctcgtgcttcctctggttcctttctgactggtcttttgaatttgaattgacgctcccgatcgcgtaagatatcagacagtgtctcccaaagactaactttccatccacttggaggctgaaacctgttggtcaccgttgaggactcctgtgctctgatgggatcactataatagagacaggggcagagtgcaaggcatttctgtgcctttggggactatggtgaccatatcaatcacgaacgtctgccatgtggactagactacgaagtttcacgtctctgggcacaagttcgatgccatacacgtggtagcccacaagtctttttgaccaggctgcatatcaagaatttcacaccgtcgtcagtgaggggttttgcccaggatttcgacagactgggacccagaagcggcattagtatcacctggaatcctaccagcagttgctcctgtgatctatctctgagcctgccgagttgtggcgtagggagtttgacgctttacggatgcgttgaatcgagcgtgtagtctctgtaggtgagggcaattccatgcgctagaggttggtcttccggtgttctatttaataacatctgagtacacgcctcctgtctctgcaggagacgcagtacgaaacggtcttgtttttccacgtttggggtgctagactccacatttgatacgaaaagcttgcctacgtactccttggcgcagtcaagtttcttatatcttgcacaaggcaaacaacaggggttcctcctgaaccgaggatttgacctacgcggagttgcgctctgttgcctccctcatccatcgcatggcacatggaattaatcggagtcaagtcctgaaaagcttctaaaacgtttcggcttgtgtggctgtccgcctccagtcgcaggggcggacacaaaaacgacatacaaccgctccatcttctcccataagtagctttcctgttccagccctcccgaagcaacttttgtctctcaatccgcgcacaacttcctaccctgctgtgaggtccgaccgttttactgataccgccagatcagtcacctatggaggccgcagccggggagtctcccgcgtacgaacccgttggccacggtttaagtcaacccgcgagcgacgccatagaggagaaaacgttctttctagacgagagcctcccgcatgtggtgtgtgtttgatgctgggtcgggctttgaatctgttttgtccggctttgcatgagtctgggcgaacgataaactctcgactacaactgtttcccgagcggagagtgtaagaactcgccggagcgagagggagatgcacaaaaaattctcctgtccttgtttctgggaccgcctgcaggctagaccgctccagaagtgcgatttgttttggtgcacgcgatctgaaagccctagcgacggcgaccaccaaaactggtgccatccctgggcgcatgacgcacatcgcatccattgttgttgagcactgcacggaaagaccgctgcatggtttcctggggatgctgtgttcctatcgtgaccgtcaccattcaattttctgcggaggcaagactttgggatgcacagcgggacaaaatccacactgtaacctgacagtggccaaggctgatcgatccacagaagctagtcgataacaaaaagagacatcgccgcgttccggttttttcagatgacatcagatccgaggttgaacgcgctacggctgtttacacgttagcctttcggaccctgcgacgaacaacgtgtcatcgctgaaaaggctccgctaactggcaagcgaatacagtacaagacatggtaccgatccagcctgtgaggcgtttgcatggcctggcacggtgtcggtcagtgacgaagaacgtacgcgactctctaatcattgtctgccctgttacctcgcccaaaatatgcaactggctgcttctgcggcatcggcgaacaggatgtcctcgtgcaaattggtgtcaaacgggcggagtgaaactgccaagctagttatgtggtctgcgtgaaacctaggtagatcggtaatctaaagacggcacagcacgcccccccatcagaaaggcccaacacttcaccctggccgtttctgatgcgtggctgtggcgcgttatattcatgacttcgttccttgcaaccgcctgccaaaaacaccaccctgactaacgcagacctccaaaagggtccgacaatgcgtagatcggggcgacgaatctattccccggtgccgtatcgaaagcggaagtaccctttgtaacgaatagccgcgtctcttactccctgcccaaatagttttaggcggtcgtttctttgaacgagata

SEQ ID NO: 1880 - DNA, 4190 bp, Toxoplasma gondii
ttgtctgcgtgagaatcgacagcgcggtatccctcgggtcttaacggatccgacatcgatgagaaacctgcgaactaacttctgtatgtggaactcttgtaaagttgtcgcggtggaaggtttctgtttttcttggcgtgtatttatagtgttctgcctcttgcgcggcttgtctcctctgctttcgaatgatgcttttttctcgtgggcgtggtttggttgttcatcttgtcgcgatcccactgttgatacaaccctggatacacagtcgttgcagagaacacaggactgtctgaaaacgaacgcgagccgtttcctttgtggtggtttttgtgaatgcaaggaattcgctggtgctcgttcaactgggtctgtttctacattagtcctcatcttagctttgctctgctagcacagtaggacctggatccactaaatagagacctctgttcacgcttctgtgtccggaggcacgagtttagttttttccccaggtcccagctgtggagacgagctgcatggacaacgagatgaaacacacctgacggaggctcgcgttattggaaagacgcagaatcctcaaaccgtttttcgggttgcgcccataacgcaaccgatgtggaattaccttagattctcaggatattgaaatccaacatgtttagctgtctgacgcagtccattggggtggtggattacaccattcaaaaagaacctgctggccctatctcgtaaccggaggcgtattccgtcttcgccggcacgcctcattttccggtcttgtctcaatcgcctcccaggacaggcaatcgttaaattcttaggtatgattcgaaacgcacaattaaaattggaacaaagtacggagtacttggcccggaggtttgttacgttttgtagacaaatccatgcagaaacttggcacgccttactcaatataaacgtgagcattgcgaaggggaaaatgttcagaatggaaagtacgaatcgtgtcgaacggaaaattcgtttgtcacttgcaatgcatagcgtatgatatggtaagaacttgagtgccgcaagaagagtggcggtgtttgtgatttacaaacacccaacgtagctcgcgttttgcctttctaaaaacgttgccccgaagtgacgcactcgaatcctcaaatgtgtatgaatggaagtgttcggacgttgcccgagcctcacagggaagcgaagattggtgcttagaggatcgtctcctctgtttcggtgctggggaagaaagatgtatgattcttactcttcacaaagaaaaacgcagaagagacgaaattgcagcagagatatgtacaagaaacgagccgggaaagactccacccgtaccgactgaggcggttttttgtgtgacaagcaagacacaaaatccaagaaaggggcaggtgccgggatggacctggcgaagagcactcaagaacaggcgcgaaggtgaaataaggagagaaaagggcggcacaaaaaagagaggagaagcggacgagatgaggcatacgttcgcaacgcgccacggaactgcacagaggggattcagtgaagcgtgaaggagtggccagacacaaacaaaggtcgatcaccggataggagatcttgacagtctttgactacctgaaccaagatctgttgcattatattgcgcattttagcgcatcttgtttgtgtggaacgcatatgactaatagggatttgagagcgggaaaacggcagggaagcgatcaaggtaagccgcaaaaccatgttggtgacagcgcttcttttcaccatttactttttcaggccttggagggaagggcgtcgtttttgcgttttcatctggcggaccataccttggacaacatagattttctcgaaacactgtattcataactcagagcgggatcgttctgtgtgtgtttctgtgagcattcgaaacctagaaacgttggagcggctaaggtatgcatttgaacttgtgattgcggacacacatgaaagatgaatagagcgtttcgctgggcgtgggtctcagagtattttgctccacgatttgaaaaacaagacatgctggcaaattacgagtcaagctgccttgtaggggagagaaaaaaacggtcatctccggggagttgtttcactttgctgctagccccctcacagcggcgtacgtggcgccttttggaaggctttctgggaaaggaccggcgttgtagcaaaaaacgcatccggagttgatccgaaaaagacccagccggacgaccgcctgaagtcgcctgcctctttttttgggatgaacatggatacacttgaccgttttaatctatcaaaggaagaactattttgtgcacctagaagaacatgtgcgtcgccggtgggcgagattgacgaagcgccgaaaaatgacaaaggggcacaccgaaagcttcgaacacgcaggtacccgcacttcaactttccaatgaacttcgcttccactcgccaacttcgtcgcgtcccctgcctccactttttccattcgtttcggttttttccgcttccccgttcctccagaagatcaacgcccatccctcaagcacacagatctcctcgttagggagtgagcgtgagggctgggaaaaatattgaaaactctttgcaggcaccgccccgtctacctcactcacgcttcccttcaccccccagctctcggtcctccactctgctttctctgctgagctctggcttggcttctggtcgtgtaccccgaatacctcaaacggcattcgaggtcccctcacaccgaaggagtcgcccccgctgcgccagctgctgcaccagccacgccggatgccaagagcgcctgttgctgttggtagaactgagcctgcgtctcaaacatttgacactctttctcgtaatggaaaatgactggcgcagcgagagtgatggccgcagtcgacgcgacccatgcgactgtgctcacgagccagtacgagtttgtccacagccgattcaggcgcttgtggactctgggcggaagcagcgaggacaggaggttccccattttggaggaaacaggagagcgagtgacgcagaggcgaaatatcgaaaaacagagggccaggagactccaggagagggaagcgaagctcgcgacagagacacacgagtgcagatggagagaatctaagaaaccagccgagaaagggtcctggaccagaaggaaaaggcaaggaaacagatgcagagccgaaccagcgagctggaaaaaaccgggaaaccgagaagtcgaagaggagggagggaaagggagtaaaaacgcacaaggggggacgctgtggatgataggaaaagatttgccaaggaaaagaaagtcctttttcaggacaggtttggtcacccaagttatcttcgcagtattaatacatatgctcaatggtctctcctacgcgtttctgcgcgcgtcagggtgagagaggtctggggtgcgtgtggcacagcgacgattgctccggctcgagagaacagcaaaagtaaaagagcgagaaagacgaataagatacagagggagctgcgatgaaaaacagcttcctagtcttgagaaaatgtggaggacgaaacacaccccacacgaatcgacggaagagcaagattcgcgcttcttctggcacaacgcatgcacgctggaaaagaagcgcttctcaaacttgaccgaatttctgcttctgaactccatgtccctctgcccttttgcaggtatttcttcactgcttcttgttctcgtggtcttcttctcctagaaaagtgccttggttaaaccgagcttccgacctcgaccttccttcgttgtctcagggtcccttgccactctggctgcagctgtctgtctctctgtcccgcgcgcgctctgttctttttcaccttgcacttcgtttctgttctttgctctctgaattgtttcttttcgtgtctcctcctccagtctttctttgcctcaggcttaccagtctccttgctttgccgtgtgtgccttctctgtctcttctacttcgacctaggtctctccttttgtccagttgagtcctccgtctcctctcttctctcttcttccttgtcttccgtctctcctttcctttcctccctcttctttcctgcgtttttcctgcttcgtcttctctaacgcattacacgtctcggcggcaaga

SEQ ID NO: 1881 - DNA, 1647 bp, Toxoplasma gondii
cagctgcttccgcaggtaaagcaagcccaacaacatacgtaaacatatatacatatatatatatatatatacaaatatttgtgtgactatttgtatgaacgtgcatacgaatatgcatgtgaacgtgtatgtgaattttttttgaacagttttttgaatatttgtgaatattaatatgaatatttaagtgaattttttttgaacagttttttgaatatgtgtggatattcatctgaatatttatgtggtttttgtaaatagttttttgaatattttttttattatttgtatccacttgctaccgcgtggcgtcttactttcgctcaagtcgttgaggcgcttgaatttttggtccacgggcctgtcgcagttgagaacttttttgtaggcgaagaccggcggtcctgcagcagccgtcgaagagagcgaacggctattttccggctttctctgagccgcctgcaagttgcatgcgccgcatgcgccagcacacggcccagaagaagcgcatggcggagaaagaggagacagagaagaacaagaagagggaggagagcgaggagagagtgaagagaaaggcaggcggctcatggcgaagagaggtgagacgacttgatgttttcgacgcagaggaagcgccgggcaaagaaggcgcacccgaagcggagcagaaaacatggggacgcggaggaaggaaagcggtgaagaaatcgcgacagctcctctcgcagagctctccgacaggagggcggatccagcactgaagagcgcaaaaaagaattcagggagaaaaacggcgccttcaaaggcagagagcggctgtcggagtttactctttttggatttcgacggatcctggcgaaagaaagctgtgaagagcgacaacgcaacactgggtcctctggatatggcagcagaggggagaagctgcacttgaaagcaggcaggtaaacagagcgactgcggtgaatggtccttcctcttaggctctgaagacgagggaaaagagtcgagctgaagcgttgaagaagtcaagacaaaaaaagaacaagaagcgtggaagaagcgccgtgtaccgcgcatgtctcgagaacagcgcgcgtccggcttttctcacgcgaggcgggcaggcgtcctgtttttttcgactttcctcgcttctccgcggagtttcgccgtttatttctctttggtctgtcaatcgcgattcagaacaaattccgaaaggaacgagtgtgagtatggtcagtcctcagggagggaccctggggtcgactcagacgggggagggcgccactgacaaagaaaacttcctgttgacaagagatcgtctcttgccttgaaagtttcctcagagacaactgcttctctcgttgtaccagctgctttaggaactcttcatcagcgcccgaaaggtgtatctctttgccgcttcttttgggcagtgacgctccgtcagtccacgtttgcgtttggagtttccttctcgcttccgcgccttgcccccctcgtctcgtcggcgtcggaggcgctgcgcttcttctctcgaatttaaatcgctgagaagcacagtccaggagacggcgtttcgagccaactttcgtcggaaggcgataacggcggttcttttctctctccgagacaaga

SEQ ID NO: 1882 - DNA, 3847 bp, Toxoplasma gondii
cgttgtaataaagtcgccgaacgcatgccgtcggcgaacagttagaggcagcaccataccctttttttgtacgttttcttcgccgtatgccgcaaccagcatattgcggactgcaaactcttgctgtagatatttgacaaggtcccgtagtaaggaactacgccttcggaataaagacttgcgcacaaattgcaacttcactgcaaagtgttctccggtggccaccattgttcccttgaaggcaatcccacgggtgcctcgcccaaggacgggacctcgataaagtacctcatacgttccgccgggctcatcaggttccagaattaaaagtttcccggagggaaacttctttgcaaacagccgatccaccgacgaatctggatcaggccaaggtgtgacgtctggcggcacaaatgcagcaacctgagatttcaaccactccctacccactgtttcgatgcgttgccactcttgccgttcgctcagcacagcattgtcctctgatacctgaaactcaagcagcaaaacaacgaaccggtgtgagcgtggttgacaccactggaagtgctggggcgtgcttcaccaaagcgggggccaatacgaaacttggcgacccgccacaacaaacgatgtgaccggcgaaaggtgtcacacatttctcccccttggcactctgtacaacatgatcaaagatcaaacctacacaccacaataaactcaacctgatgaatcgtagacgggcgggtagaattacgaagcataggcaacagggtatttcgagtgaaacttgtgcgacgtacgaagtgcactcacctcatcgtcatccttcgcctggaggacggcttctgactcgggcctttcactctgctccatactctgcttgtcttcttccgccggccgtggtgggtagagcgttactgaaaactccccgtgattgtccgtctcccgcggtaccacaacagacgcatgcaggttcacgtcgctcttttcacctcgattctgcgcatttgacctgtcaccaggcgcacgcgccgtatctgataggacggtgggatcatcaccttccattcctcgcccttcctgagcaccctcaggtcctgtttcgttctgcagctctccttcagaagttactgcgccctgaacaacggaaacagtgctggagaatttcgacgtaacttgaccaacgaagcacacacactgccccatgaggatcgcagcggcaaggacaaaaaggtttcgcggcatcttgatctcatgacactgacaaaaaagatccttgaacattagttgctcacaacacatgagagcacccagatgtgaaaacatgcactgtcgattcaagacgagatgcagtctcggtgtcgcgcgtcgttttggcagtccagtggcacgtctctgattcagtcaactaacaagccagtgccgaccgcatccaaaaaaatgtagaatccagacactgcgtcaattaccacaatggatggaccgtttcgggtcgtttgcgccacaaacatcgacactgagacaccaacgtctacctataaaaccgttctgctgcttcactcgtcatatatgggtaccgtgcgtattgcatagcctaatcaccgcatgcgtgcacttgacacactgtgtcttacggattgtggcacggtagagcagaaatagtgtgatgtgcacgtgcagaagattcgctcgagctccccgtacgttaccatggcgttcaccgccaccgtcatgacgggtgcgtcgcaatcaacgtagtaaaaaaaaggtagtcgaggcgtgtgccagcagtgtcatcgtcgcactgacgatttcgagtgtgcagtcggtcggacgaagaccgaaaatgcatgctttctatctgcggaaatagttcccggcgccttataaaccaaaagtgtcattgcaaacgaatctgtaccgcatggacagctataaagtagaactttctagatcgttatgcagcgtctgcacctcgctgaatgtgaaactgttttttttgttgttcagcacacgcggtcacaatcagacgattttggggtacaccagctagctcacaaacagctagcgcaaagggtgttcgaaagtacacatcaaaggagtgcgcaaattctcctcactactgtttcacaggcaagcgtgggctataaatgtgcacacaggttgatgaaaagctagacactagaagacctatgaacattacgttggtctgcagcgcccagtagcttccatcgttcttgtgacgaaactgattgtcgtgaacagcggcctcgaaaggcaggttgttaccacacaccaacctagcgagacggccagatcggcagacccaatttagcggacgttgccgacaagagtatgcggtacacggcggtaagtgcatgtgacaccgatcccaatatggcggctcaaccggaaatttcaccccagagccgttttgtgaatcaggaagggaaatcagatatcttcgtgaatttaccaccggacacatgccacgccttggggactttgcccgggctgtaggcaaaaccagctctatcgagagcgtggaggttccacgattcatcgcccaccatttgttgcccagacgtctcactctcgctgcaactagtgctttcttcgggtcacacgctctctgtcgcccacagttttctggattttccgtttccactcacgcagcacttgcgacctgtgtgtctccaactagcttcggggcgttgctcttgctttgtcgacgccagacgaggcgttgcctagagcgagagactatcggatccaccgacttcacataacctgtgttacatgcggccgaaagacatccaagcgacccaagagctcttcgagttagtgtgtatgtcgatcccgtggattccacggtactctgcacttctaaaaccgcaaactgaggtgccgtagaaccctttcgatagagtttccttccccagatggtctttttgctcactgaaacccgactctgcatctcttttggtgatttacttttgtctcttcttcgtcccatcccccggatgcgtgcgcggcggcaaacatcaacggcagagtgctagccagcgaatgcggcaaatgggaggggggtgagacatcggacgaaaagtcagaaaagtgaggattaagaggtccggaaagaaagggggagaaaactgatatatttaaatcgctgctagcactgtatagtttcttgcacacttgctcttctcgtgattcttcgcagtggccgcccgcggcctcccagccactttggtgggcgccaagaccagtttcctgtgttcgttcgtgctcatattgcacattagcaggttccatgttctccgttctcctgaagtgtggcgtttccctctggctacgccctttttcaccctttctttttgcgtgtctccctcggttttcacttctacatggtcagagaagcaccgtagactcgctcatcgagtctgccatccttgtgtctccattatcgctgcgcatgcaactggatggcagcttgctccgtcttttctcacaggacaaactgtctctctttttgtctctctttgcttctctgtcacttttttcgtctcgattattctgtcctttccctctctcagtttccctgtgtccttcttgtctcctgcgtcacctctccacgcgtatttcgcgccgttcttcaccgtctgtcgcgcggtctgtcgcacaccgtcttctccgccctcctccctttttccacccgcgttgcgtttatctctgcccatttcttccgtgaacacacattatttgctcttgaactggtgaccagtaccttttcaggtcgtggaactctcgccttggctggcacaaggagacgcaaataacacca

SEQ ID NO: 1883 - DNA, 3667 bp, Toxoplasma gondii
acgttttacatatcgtctaaatatacatttgcgtagttctagcaatcctgcaggtactgataccgcggaccgaactgcggagcgcagaaaaagtagagcgaaggaggggaaaaaccgaaggacaggacagagcctccggaagcccagcgttgggcgacggcaccacatgagagacatggcttcactgctaaaaaggctgctgtttttccgaaaccgaagcgagaggacaagccgtgaaacactgtgaattcgtgatccccctgtgcagttctgtaaagcgacaatcccctcgaagtctcctttggccttttcacccgccctcttttgttcgccgtctgcccagtgacgagcacctttcctcttctgcgagatcgcgcctgcgtcgccgcgctgtctcgcatgcgtcctgcggtgtatggacccccggtgtgtgtttggttttccctctgttagcctccaaggcgaagcttgcggagcaggaggcgcaagacaagttcactcgccatgtctctgtcgacctcgtggacctcaaagaagacccagtgtccttccccttcaccttgaaacagcgctgaagcgttcgaacgaccccagtctcgccaggtccgtctctgcgttttccttgtgcgagaggcgcgcctgttcgtcgaggcaaacgggagaggactggcgtcagccgttctgcgtctcgcgtcgtgcgtcttctccttcgctcttcgacctaagctgtgtccgcggaagcttgacgagctcaagcgacttccatcctgcggcctcccgcgacggaggccgtgcagcttccactcgctgtttctcagctgcttgtctgccgccggctgtttcgtctctgccctcatctctgccgcctctgcgtttgttggcgcgttctggcttcgcactggcgcgcgcgagtcgaggcgtctccggcgcaggcttctgatctgagagaccttccgacgaccagcagcgtcgcgaagagtcggggacgcgagaaaaaaccaagacgagagaaacgatggcgggccgccaccgaaggaactcggctggagacaactgacacgaggcaaaacgttcttcggcgacgtccgaccagccgtgacattaactcgagtcttcgcctgtggatgactctcgacttgcgcaatagaaacgtctctttgtcacctgaggattcgtcggaatcctcgcgtcgaacgccgttcagagcgattgtgttctaggcgcatcttgtcgaaggatgcctgttcaaactctcgccacagctccttcacaggcggctcagagtcgtgacatgaatgcaccgacacccggctccccggggctactcctctatagagtcagatacatttttacagaaggaaaagattcactttccctgtagaccgcatcgcgttttctctcagacactcttcgctgctgactggagatcgtatttcgtaagcgtctcgaaaccgtctccggttgggccttcttcactcgggaaacgtagcggaaatctggtgcctttcagagaggtgctcggccggaacaaggagacacgagaaaaggcaagaagacgttttacagcgattttctgcactgcatttcctctcgccttcgacggtcacaacctccgcctgctgaatgcagtctgtcgaggtgtctgaagaaaggaagggaagaaaactcccgccaaaacaccgcatatttccatcctcgcttttccgtcgaacaaggaagagatacaaagacgtcgcaaaggatgcttgcggtgtgaacatcggcaacaagaacgctccaaacagatgcaagagagcgccatttgcggtcgacctcgtcgctgcgatcagtgctctttgtgtctctacgcgctgcccctgaagtcgtcgatacacagctgaatctgcgtcgcgtaaagaactcttcatgcgcgtagtttccacggacaatgcctttaaaagtcgccttcaagagacagtgcagctcgcaacaagttgtgtcgccaactatacgctatagacctcaccatcgtcagtaaacactggtgtggaatctgaagagcgcactgctctctcgctttcacgagagacatgtcgaagtcgtgaattgcacttatctaacgcgcaggggaagccctatgcgctcaaccgtaaatcctaaagccttcacagtaaagaaggaattccaggactgtattaaaactgcaaactctgcccaggagcttgcgcccacggcgttggaagcagaaaaaagaagcctggagatttcggaagcctggaaatccgcattttcaacagtcagtgacaggaaatgtaacttccgctcttctctgacgttgcgaactcgaagtgaaagagaacgaagggccttccgcgtcataaatcgacttccaccttttttaaaccgttctccgttttcgtttcaaacagaaactcagttttctggcagagtcctctctcatctcggtcctcttgtgcatatcgaggagccacgacaaacagcatcattgtatgtttgcttcctatgagtatatgtatatatatttatatacatacatatatatatacacatagatatgtatatatatttatatacatacatatatatatatatatatatatacagatatgtatatatatttatatacatacatatatatgtatatatttatgcatatagaatgttatttggagccgaatgttttcgttcctttgatgcgtggaaatgcagcaggaaaagcctggatgttgtaagacgttgaagacgtccactttctacgtgtgtggaaaaaggattttctcccttgagacgagatctgatcgagtgtcagtagaaaatatgcagccgcgttgtaatacgcggtgtgctcgcgagacatcgtcggctgttcgtcgcacacaaggacttcttttctttttcttccgtgggcagttttcagcacagcggcttgagaagggccagagggcgacgttcaaccgtctttgtcaaagagctaaaaatcgatttttcacggatctccagtttttctcagcagatgtgcaactctgtcgccgttcttctctgctcccagctctcccagcagtttttttttccacggctgcgtcttcgctgcttctcgcgtccgagcctgcctcttcagtcgagtaatctcgtttctgtgcgtctctgtgccgttttcaaaacagtggcgacgaagccgatcttctctttgttcgcgcagaaacgctgtccgcgcgaccctctctctcgcaggactggttgaagcgttttctttgctttcgcttttcctcgcttgtcgctgtcttcaacgtctctctgtccctgcgctttccacttctcctgctttctgcttcttttcacggcgaattctccttcctgcttggctcccgttctccctggctgtcgtactggaaagcgaggacctcctggactcacaggacatcgacttcacagtcgagacatgaaaaacagccgcagcagccgcggctgctccgcatgcagcgacgaagaaaccgctgacgagaagacactcgagacctgggaagaatgcgcctctcggaaaatggacatgttctgaaggaagaacgtctgtccttctgaatatgaaaaattaggaaaggcgagccagaggcgagaggaggcacggattctttttcctcgcattctcgaagtctcgggggggcagcca

SEQ ID NO: 1884 - DNA, 1901 bp, Toxoplasma gondii
aaagaaggagagaggtcgcgaaagaaacaagaatgagaaaaaccggtctgccttcttgagcgtgtacaggaagtgtgaggtttcttgcgaggagagcgagagaatatatatatatatatgcatatagacatgttcacctatttgcgtagatgaatatttgtacctttgtcggtttttacagtggtctcaggaacgaagaacaaaacatgcaggtatcgcgttgtgtgcacatgccgcggagcgcttgtctccggtgaacagagaccttcaaggttgaacacggtttgcttccgcgtttacattacacaaaaagcattaacgagctcccagcgaaacaagaatgcgatctggtgtgaaacccgccactttagctggaggagataatacttctctgcaaaaagatgctcctcacttcctcttttctaagacgccaaagcgacggcatggagctgacagacgcggctctgtctctcgccgaacctacgacgcagtcgtccacagtcagtatcacaaaggtccatatatatatatatatatatgtaggtggatgtgtaaggaaaaggagcagctgttgggatggatgtgtaacaaggtaaatattgatgaataaatagaatattttgtgtcgttgagacaggataactgttcacggggctgtgttggtcgcgaggaaacggtgcatttggcacgacttcctcagcgcgccttttccaacctcgttctctctctttcgcagtgtcattctctctctacatcgaccttttctctctgtctctctcccatctgtacatttagccttatctccgttttgacctgtctgtttttttcttctcttttcctttcttcttctcctctcggctttcttcttttaccgtagttcctccttcttctatctctctcttatctccccttccgtcctgcctttcttctcgtagactccgtctctgtgttctgtttcctccctcttcttccgctcccttcttctctgtgtgtctttccttttttgcgttgaacctcaatttttctgccttcttttctcggggagtagcgtcgcagaccatctcgttctctccgtctgactgcctgacgcaatttctcgcagtctctcgagcatggctcgacgccgcctctgtgaagtcaactgggccagagttccgcaaataaatctggggaagattttcgacgttcttaaagcgcgccaattttggaagaggccagtcctgcgcatgcactcaactcttcgctgcgagctttgcatgtggggctctttgtttctcttttccagtttccttcgaggctcgccgtttgtggccctattctctttcttttttcgcctccaaaaaaagaaaaaacttttcaatcttcatctaagaaacatcttatgcgtccgagcgactgtttcccccattccctcccgcggtgtctgtacacgcgagccgctgcgcaaacttgcaatcgaggcgttgagtcggcagccaccgcgaggcgcacaggcagtcctggaaatgctttgtcttctttcgcctcctcttctttttccttttctccatttccttccttactcgtattttctttcttcttctgaaaagttttcgagcggctttctcgcctcctgcagcgctggcgtaccaagattcactgccctccgctcgcatctacttctgctgttttctctgtgaaatttctcttcctgtcgtctttcctctctcgcatctcccttccgtgctctctttttccgtctttctctccatcctgccttctccagcttctctgtctgggcgccgtccccctagcccccaaggcttttccttcgcttctcggactcctttttttgcgcgtttcttcctcgtttcctcctcgctgcgttgttttgcttcgtgttgctccgctggcactcacaa

SEQ ID NO: 1885 - DNA, 1055 bp, Toxoplasma gondii
tgggagtctttcaaatatcgtgcgctgaaagtatgcttggatctgaaggtagaccagcacccgcgattgcaacttttgttgtctggtactggaaactgccaaattttttgtccaaaacgtgaggacactatatacatgagtatcagtggctcgtgcgaccttggggaagccgtggggaaaattctaatggataaacgcagtgaaattcagccatattagacattgcattcggtaagcttaggggtcgactatactggagaggtcgtatcgtgactccagttttgtgccgttgtgggatatcgatgacagcggtgtgacttgctggtactctaggtggtcgcgaacaatgcggactctacattgggggctgtttaaacgaatttttccagttgccagatctagacgtgaggacaggttatctcgtaatcgtgcacaggccgcacgcttccacagttacgtgaaaacagttggaacgtctagccgtgtttacgcgacttgtaggtactactgcagcagcggcgatactcacgccttctggtccttgttcggagtgtccgtgcctgagaggacagaaacacaattgcattcaccgctgtcaactgtgtccctgaacaaaagttcatctgcatcgtgaagcaggttggacactcgacacgaagaacgactgagacgagttttctaccaggatcctgcagagctacattgggacccagcgttacattcatggtgaagttacttaaaaatatgattgaatgtggctttgcgaatatagttattctagaagaaatgaactgcgtcgcgattcgatgccccacttgtcgacatccgcatgcgtaggcaattttacgcagtgctcgacagacgacacagcttttatcggttgcagtagaatcgtcttagcaagaaattctagagtttttttaagtttatgtgatgaggtatttgaaaaagataccatgtgcccaacaggctggtgacgtgcgttcgccgcaccccgcctgtagagccgtaactgcctggcaggacaagaagtaacaggaatctatcgctgaaaa

SEQ ID NO: 1886 - DNA, 4004 bp, Toxoplasma gondii
gcctgttgagcaatcgcttgagacataatgcagaacggacaacgtattttgtgttcggaatgtctgtcactaaacaaagcgttaaggtggtctccacaacgacagacaaacgtgttttttgtgcactcggtggatcgacttcctcttttttgtctctcgccgacggcactgcttccgagatcgtaggggcggcggttgtcttcttttgggcttcgagttgagaaacaaggcatagagtggaagagggcgtctcgtcggacacgtggtaacgcctgtcgcgttgtggccgtttgtctctgccatctccaaatctctgtttgtcagtgctttatggaccgcttgccccccgccaaatgcctgttaatcctcgtctgtggagtgtgtcattcactgttttttattccggtagcggttgcatgcggtgttcgcaacgcccttcctcagggtacttacctgttggctgcgaggcgcactttccatacgtatctctgcatgttagtgtctgttatgccgttaaatctcggacccacaccctgggcaatgatagagatcgcatcttgccaggatcacataggccatgtgcacgcgaacctcagcgtgtagacatgtatctatctatgaccttggctgcatatatatatatatatatatatatgtacgaaggtttctggatttacatatatatgcaaagataggtaggttgcgtggcacggtatcgacctgctgcggcgagagtgtgaagcgaaattttgtattcctcattttctgaggaaagctgtttgcctggcatcttttgtgccagtggattaagtttcgctttacgattccgagcgagttcaggctggacaagagtgtttttctattctatgcagtcaataacggggtgggcaaacaaaagaaaaaggtagacgcgggaagtgctttgggagcgttgcgggactgtgacttcgtgtgtgtaccatttcttgctttccgtcgcatgcatttcgctcttctgtctcattgcattgaggcttcgaaacaaaacgtattttgcagtttattaccgtccatatgttgacgttgaaagggacatctcgccgccttacccctttgtatcaccagtttggcacctttaccgcctttcaaacgtacattcccctattctttttaagggaaatcacctacatcgcatcctacggcgccaggaggcttccacggatagtcctcacgaaaccgttttgagacgaacatgcacatacacgagtgagaaaatacgatatacgtgctagctttactcgctggacacatcgaggggaagagacagctcaacgaagaagcggagtcggtacctcataaataacgacgagcacggatgaagcggaaccttccctcttgtttcctgtttttaataaaagtacgagggaggaatgtcgggcgtttgtcctccatatactttcccgtagttgcttgctgagttcctcggcttacgctgggcgcactgacacaccacatgtatctatattttcatgacttgtatgcgttagttctgttccagacctcacgttgtcatcttgactgtttttttctttttcagtggccccagcgtttctcccgacccggagaccttcatgctttcgtggaacaagtagcaggtggatgaagcaccggccgcgcggtccgcacaacttgcgacacggttcccgaaacactgaaacgggacgaatgaaacatttcacgctgttttcaactccgttcctcgcccttctgtctggcgtttttcgtcggtaacccatttggatgggccgttcgttttgttccttttgcaactcaacccagatacaactagcttgccacatacagggttacacgtttttagatccgtgtaacaggaaagtagaacgactattcgacaccctctggcttccccagtcagacaatccaacaaacatggcgctcgtgggcgttgtgtctctctgttcttgaattttctcctaagtccaaatctaaaagtacgaaacccttcctgtctcatacacgcactaggaacgcgactttgttctcacggcggcatcttgtggtggctgcccaatatcgggtcccctgttttggttaaagagtgtggcctttttgagtctgaatgttttgttaagcaggtattctttcgtgcctcttcttccgcatcgtccagttccacatatctccattttccccatgtgtctcctggaaatcccttcactactttgtcatttctgactttcgctgcctctctttagaggccccctgtgttgcctcccgcaagtggaccgagccgctagcgctggactcggtcgaacacacgttcgattcgacacacctcgcattccccgctgcaccagattttactgagaaatgcctgttccactggtttgaatagagtcatttgagtagctcgaggtgctataaggttattttcacggatctcaaacctttcttcccgtgttactgacagggagcttgatttttcgcgacagcaggctagatagtagccgaacccgaatcctcaacagcccactccccacgttgttgcatagtccgtccacgcacggagcggcgttaccgacaaggaaattgcatactgccgagattcgagactcttctcgcagatctatctcgcgtggaagttgctgcgtcagctgggaagctggatcccaaaaatgtctcgatatcgaagctgcgattggggttgaatgccgctgctgccaaatggccccctatttcttcgctcgcaggcaggttgcccggcacacgttgtcacttgtgaacggtgatttcctcgcttcctggctttagatggcaactcgtagacgcatgaggaactgacacacttgaaaaaaggtgcggactttctgaacccttcctagaaattgacacttcatgctactccacagccggccgctcactccgtctctgtcacagttccagtgcgacacttttttcgtcacgtgcgttcctaggcgtgtccagcgcggcaactccactttgattcttcgagtgcgtttcctgagaactgctcccacgtcgctggggaaaaacccaacgatatctacaccttctacgggaccgaggtcgactgtgcatccgtgctcagcaaaccgggactaaagagagacgttgtctcagggtagtggttttgttgggaattttgcagagcaaaggggagagcctcttttagaattcggctgtcgtctttctaactttctacctcgagggtgagagcagttgtggagtagtctaaagccgtttttacgcaactagcggcacgagatcctcgccggcaaagattggagagtgaccctcaacttttttttctcagcgcgtatctctcttcgacagcctttgcctttactcggctcgcagcgacgcatgtgtgccatgtccttccttctccatcgatttttttcattggcgcctgtgcttggcgacgcatttccgtcggtgttttcccattctcacttaccgcctacttttcccttcatcccctttttctgggcctctccacctggcaagcttctcgcttggactaccaagctcgtgacgaactcttccatctggagaggagggtgtggcgctctgtatgtagtgtctgaggagagggaccgatttgcacagaactgtagtttttcgggactaaggccaacataatcaattgaacggtctgttcagccagtagttcaccatcaactacctattttcgacctggtaccgactgtattattgcggcacaggtgttcccagcttcggggttctacagttattacgaagctcctctctccctgattcctgacgtacataatatacagtcgtagcaggttgaaggcaccttagccttctgcgccgtctgtcttcgtttaagactttcaccgttttttctccacgttcaactgtctcacctcactgtctttctctattgtttcgtaccaggtgcttggcaaccgagacaagtcctgggttccgctgggttcgatgtctgtttcagaagagga

SEQ ID NO: 1887 - DNA, 4967 bp, Toxoplasma gondii
agcgaaggccacaaagaagcaggttgggagaacttcgcaggcgaaggcggcgcgttcttcttgcctgacgacgtttgcgctgttcctcgggtccgggcctcgcttgcgtgctacccagcaatgcgttcggggacgcgcctcttcgcggggaagcttcactgctttggagatagtcggcatccgaaactagggactctctggcaccatcggagacaatcgaagcggagtcgcgcagtcagtgggaacgtggcgtggcgtgtggtgccgcaccacttgggggttttcgcggggcgcgtctccgcggcccagatggcgcgacgcagacacgttccgttcggccgcgacttggcgcgctgcagaagctgcggggaggcgcggtggggcggcgagtctgaggcgaatgcgctctcggtgtcgggcctgagtttgcccgcgcgcttcgtggagtgtggttcccgcgaaggcgacgtcgagggtttgcatacgcccctcggcggactcccgggacgagcggccggacccctcccgccactgtaccagcgaatgatggctgcttcagcgccgtggtctgcagacgtccgggcggccagctgcggcggcgacctggcacataggagttctctcacatgcagcaaccggagcgcgcctcacctgactggagttttggctgcagtcagcacagacgagttggaaacctcccaggccgacgcagctgacagacggagcgtgagcaaacccgaacagagcagcggcgacacagaggagaaggctcggtcgtcttccatgttggcggcagccgtgctcaagactgcgcaaaaactcgagtggctgctcgaccgctccagcggcgcagctggcgcgggggcggcaccagcagagaccggcgtggccgaggaggctggcggcgagacggctcctgggagaggctccgaagagacggggaagcgacccctgcagtctcacgggacgtttgagagctccagcagatcgcagccgttccgcagtgaaagtattcgccacccgcctctcgtgcctgtcgctaaagatagccgaggaagtgcagcggccgttgccgatgccattggggggttaggtgaccgccggggcgggaggtctgtgaggggattgggaaagacaagtgacaaggcggggaaaagtgcgggcagccgcgcatcctcaagtccaggggatcaagccacaaacgcagacgcagcgaaggtcggctccagccgcgccggtcgggtacaggaagcggcctctgaagaggcgccacgttccacaccggacagacagaaagagaaaaagacaggcgagaccggcggctcgaagtagacatagcccaagggtgaaaattgcagtgccttcgttttgtgtttacacgtcagcttagattttgcagaaagtatctagggaaggggtcccgccgttgttgtgcagatagtcgcctttgcactttgacgggaggctgtctgcagaagaaacaacaacgctccgtggaagacaaaatggcaggtggacgcggagaggatcaggtggtaggaagtgaccatgaagagagacacgaagacaactcggtagtctgcacacgagtctactgtcacaaaccaccaggcagatgattcgagccgaggaggtgggccgagtcgttttgcgatctacgactgggaataatgaactggtgaacttcacagcccgtcgatggaggttggttccaagcaggctacacaaagtgtatgggtcgaggccgctgacagtttttccagcaacttttttggctttagggcattcgagtgcgtgcgcctcttccaggtcgtgaacgactctgccgctacatttggttgcgaaacagattggccccatgctcgcgatgacgaattgcagtcggcgcggaaaaaactctcatgcactctcttgtggtttttcgtcggtactgaagggtgctaaatgggggacgcactcgatggattgtggcgttcggacttctccagcgatcagaacatcgcgtagaaaatggttactggaaaacttactctcccgcatatgtaaacgcatgaaatgatgtatttgcgtgtaataaactgtaaacgagccgcttctgcgaacgagcacagcaccgaggaacgtcggctcttcggtgtgctattagatgtcttgtatgcactgttgacgatagtcaacagccggcagtcctccagtagcaaatcgcaagttttgaggtggtaatgaaaggcggcaacgttaggaatgagtcctcaattaacagctgaaagcagggatttcactgaaaacaattctcagaaatcataatcattgtgtaagggatgtcggcagaaaaaactactcgagcacaccagaatctgaggcgtaatcagtgttggcgttcagacaaacaatgtttgtagaccgcaattatcactcttagtgccctcggggtaaacatctcatcgatgttggccttacttcatgtttttctaagtggtgtgttcattattccaggggtacaataaatgggcgtattcttcaattggggcagccacttttagtcatttgatttggcgctgatccctgcacgcccaatgttaattatttcacgcagctggcaacaagttctgggtacgatggaagtcggtcatttgtcagttcctcgcctttctagttctcccctatgaaaaaccatcagcctacaaagtggtcaagttgccaatggatgacgctcagagaaactcagttgctgtgctcaaattatgtggcatatcattatcaccaagcgtaggcatactcgactcaaacacgacattcgcccgtgaaggaacggcaaagtattggcaaagccatgctacccgacattctgctcatagtgtccgtctgatgattacactggaaaagtacgcgaagaatgagggtgaacaaggaacaacaaaatgggtgtccctcgaagtacagagaaaacacttcaaccaccttgtgtgttcatttgttgctacaagcaggagagtacctggtttagccttctgcaaagcagcagaggaggcgcataccaaccttggatgtcagcgttgcgatgcagagccctctcaggcggtaactaaaaggagcaacaagatctgcatagccatgttggtaccgcgtactgacttttaactcgacgtgaaaggcggcactgaaatctctactcgacgtgaagacactgagatttgtattcgctgtcttccgatatagctacgtggcggcacgcagcctgttgttgcaccttgtagctattctgtgtcgtgctaccactcttcaatttgacaaaaagcccaccggtatctcacggtgataaccgggctgtgattcgtgcacggcgtgctagggttacggccgccatacagttcggcgaatcgcggacgagagttcagggtgaagagatgctgtgtcgtcatgttaaaacgttgtttcctcgagtatatctctgtttttagcaccgatcttcaacgatttccccgcctttgtgccaccatgtcacctgtcgtgtctactttggggtggtttcaagggtacccagctggactaggaacaacggcgctagcactcgctcgtgtctgaccggtttttgttgttagctgcactggaatgtgacgaggtagaagaatgacaattgcgaagactgtggactcagtgacgcctcctgccgacggttttctttgtctgcccagaacagcacggaatcaagatgaggatccaagtatgacagtgaacacacagacggggaccgtccagcctcccatttcgagtgtttctttccgcctctctgtaaggcgagcctgggctatgtctgtttaaggtggccgcgcttacggctcatctgcgctcgcagatatgttccgcctgcacaaaactacaacatatcaataagttgaagaagcttttcccccctcaccatgtcaaattttccaatagtgcttggcttaccccggttgacacacattcgatgtgcggttctgcatctcttcgaccagtaaagagagttgtttcacccgtgatcgagcgccagcttgctggtgccctgttcgtcggcagctccttacggtgaacgatcagtccgctgtggcgcacgccgtgccacgagtttcctgtgagtctgagcaaaaaccgacttttaaaaagggaaggtgggcggcactaaaacagaatgacagcaagtatgacgaagttgatttggataatcctcgcaggaagcaacacacaacaactgaagacttatacgcgtgtgagcctttacttgagtgtcgagcgaacaagactcggctggcacggatgctgccgcacaagtggcagcagtagctgtagagctgacagcggcgtatggaaggacagcggctcacgggaaatcgttttccgtgattaaaaataccctaaaatattggttacgcgcaacttggtggatgcggtaatatcatgttacgaaaatctcgcaggcttctgccgtcatgaatgcggacatttggtgacttccatttttattgctcgggagtgcaggcagctgcccagaaaggcgtattcgtccggcgtcttctgtcgcaactcaagttctctacgcagcctccaggggcgacaaaaactcgataactgtttctcatgggcatttcccaggaaggactgtggccaactgtctttgttccatgaacctgcagtcaaatctgcggcattcccttctcccgtaacgctgttttgctcgacgagctaagcgccaaacggggtgcgtggttccctttccgtccagagagggaggagacatgcttttctcgcgccgcggaggcgacttttcgttagagaaagttttttcttgttagttgcctgttcgttgaattgtcttagacgtgtggaatgccttgcctcgcgagccgtgcccctggtgaccacagtaccctcgactctccatcaacatcacgtcttaatctaacagatcgctcgtggttctgacaaaa

SEQ ID NO: 1888 - DNA, 4865 bp, Toxoplasma gondii
ttgttagtcgccacaaagatcgcgcgacatgaaaacgcctattcatacgagagcgcggttcagcttgcggaacgatatagcatgcatgggcttttaaccgatgacagaggcatcggggacctctttgggagtagtccgcacacctcgggagcttctggtgaaggccatttacagatgcacagatttatctacacacctatttgatttaccttgtgccactcggcgtgagctgtcggatgaagtgccttggacagcaaagatggctccgacaaggcagcagacagcgagctttcttttgccttcgagactcgggtcgccgtgtcggaagacattctggaaatctgaaaaggtagagagtgctggacaccaatgctttttatgaagccaccaacaggattcctgtgttggctccccgaaccggagactcgacgacagccgaggtagcgatggcaaaaagaaaagtttgccttttccgacacaatacagaagagagtcccgcagattgattttcaggcatgatatactttaggcactaacaagaaaagcggggtgtaggcggaaacgatgataaacgggctcgaatcgacaccaggaatgccttctacaacgaggtcgcacaggtgatccaccgaacaacccctttatggggatctactacgcagataaagtttagtgatactcacacgtgtttcacgaaagaaagtctcgtggcgcctctgaaatgtgcagaactcctgaaaagtgcgagaccgacgcttcggccaccaggtgtctaggaaggacgcgcaccgcagaaggaaactgcagtctatcagtcgcagggtggaagtgagacggcgccagattttcgataaaacaaatcatcacctgacaacgcgcgccccaggagaatgtgaactcgtctatttgcagggcgagtaccaccagtaccaaaccaaagaaaagtacgagatgtgtaaggagaaaaaccgtcgaagaaaacacccgccagcaatcgcagagacggagcacgaagtcaaaatggtgtcatgagttaagaaaacaccagggtcataaatggaaaaagcgaccgaaattagtgtgatgttctgcgagtcagagagagacgccgcacaaaccaagtgcatgcgcgagcgtcaatcgcatgtcagcacacccgtacccgtccttcattcctgtgcatgtaagaaatctgtagtgtgtacacacggtgacaaatgcagcatgccatagcctattaccagaacagtaaagtctccctttcctatgaagtgactttctgaggtccgccaagtagttgtagttttgtctgtttgctctttcaatggcaagcaggggtgtggtacgccatgtattaaccccgtgtatgtttttgattttatcttaattccgttttcattgtggggagcaaacaccagtacgactatgcgagaaaagagagcgagtttctaaagtcgcaaccgcctttgtcggaaagcgggcttgcctctaggagacggtgctgtggagcagttccctcgaagagcgatacagtttacgcttgatccctgtctggttcccacttattttggcccccctacaaaattaaactttcggcaggtacaaggttatcggattttactggcagctttgtaacagggcggtctcttgctgactgccgcagtgcgaccctctgtacgacaatacaccgtgtagaagtctcctctgtattcgtctatgtaatcgttcctcgctgccttctttagttcctttatatatatcagaaaaatatactagctgtacccattgacactcctacattcgtttttgcgaccccttctcacatcctcgaggtgggggggcttcgtgggatccgccaacgcagggatcgaagacgtcatgtctggagcaatatcatgatagacggacccctgcagggaattgtactttgaaacatgtcagctcaatgtgctctgtaatatttgcggccgaattcaaccaccttattgattgcgattgtatggtggaggcactagggattctcggaatatccgtagtccatgacaacaagtacagtgcactggagatacgtctttacgctcaacccctgcacaagtagccttagcaagctgggaaggatgagaaaagtaaacacccaaatcaatttgtacgaagaacgtgtaaatcattgacgtgtgcccgatggaggtgtcgtttgaggacctcacgtaagctgttctaagtactgacctacatggcgtcgtcctcagcacatcatcgcggtttgcgtgcaccttccactgttagtggccatccttggatttgcgtttcattatttcctattcagcgagaactggtggtctgtcttttcttttttttgacttcttgcagcctgcagaaattcggaggcgcaaggtcacagggtctgacacaaaaagtgaacgtcacaacctgtacgagggcgcagatgaaggtgcgctgcactgctgggtccatcttgcaataagtaaacccatcgccaccacaaggaagaactgtgccgcgtttcgttttcatttgataaaactgtttaccgttttgtctctgtgtatcacagtgtgcgcacgattcgtagggcagatgacgcaccttgaaccacgcagcgaagcaagagattctgtgcccgttttcactgaatgggtgtgcatcttgcaaagtgaagttagccgaggcaccttcaacacgaaaaaacgcattttggttcacacgctcgttgagtgtgcctcagcggcggcgcctggaacttcgacattccatcacagcaatagttgacagcttctagaagcaccagtggttcactgcgaggcaaagtgacacttagtgtcatgcttctgacgtgtgtttggctcaggctttttaaggatgtcaccacctgggcggtggatttgtcagtgaaggacgcacatgacagcgacacgcagaatcacctcggagctgacgccccctattcagaattatttggcacacacttttcgatctgactactagctttaaagtatcatcgcatgacattttatagttggtgcagcctatctttttataagctgccctcgtgtcagaagggaggatctagcacaaaagtgcctgcccacttgacgcaaacattcagacaagtgatccgatgtccctcgaagctgaggctccttctcaaaagcacatatggcggatacaatatgtgaaatcaagagcagtttggcacgcttcgtaggaggctgagtacggcgcgggttgcatgtggtctactgtgagcatgttacgaccaggtgcttgaatgttgcagtcccccaacggagcatatgtacattcacctttgatgtcgcatcttccatggaaagcttcaaaacgactggaaataacaggagagacaatccagagtcgccgagcggtctgacaggtgcggaacctgcttcccgagtctcatgtggatccgacgaaccggaagaagtacggcattcggtacggtaccagggaccttgatgtggcctatgtaataggactgtagagaaagggaacgtcttttgattgccgggagccattaaggttgtggaacgcggagtggaccgcacgtttgggctgcggccaaatgggaccattcctgtgatcagctgttccccccgagctggctgtctcaagggaatatgtttggaaagagggtagcagggcacatacaccccatacacttttcctctacgtgcattcatatttggcgctgtcttttgctcagtgactcacaaactcgaagagaccttgcagccgtttgttgtgccgtccgctcggtggccgctgctgcacgagtgcgttgcttcgaataggacacgttcacgctagatcacgcaagtatgcaagttcacgcagtagcggtacttctttttcgcgtcaatcgcgaaaatacccgatttaggggccgggctaggctgtcgccttgctttactgtaagaacggcgcctctgatgagcctaggtgtccccgcgcctcaccgccgacggcttcgcacattccgcaagaataaaaatacccactagttctgcaggtcaaaacggcggccacttcagacgctttccacatgttatggactaataacgtttcctgctgttgttcgcgcagcacgtggtttttcttgcgggtattttgactcgctcagcgggacatcagtacggttgaagtgtcaaagggtcaacgggtcgatggactcaccctcagagaccgcctcatttcggggtcctgccgggggagtttctcgatccttgtggaatgcaaccacctcaagacgcttgcacagttcacatgttcctttctcaggaagaaaacgtagccccatcgctctgagtatattgccttaaaacaccaacaagcataaactgattgccactgctgtcgcagtgtaccgcctgcgaaccgtccagcagcagctttccccatgcggcagcccattcgtcgagggtcttttgtgacggtgccccagcttcaacacatcgctgttccctcgactagtttgtgcaaccttttgggtcagacttcaccaccggctatcttccaaagttctttggggtcatttccacattcttgtcttgactgacgattgacgcatcaatccgactccacgttcgttgtctcctatcctccagcccgacccacgcgtgctatcgagaggccgtcacatgcaacaccttaactgcccctggccgttccagcgcaatttctccttccatttctcgccaagatctactgcccctgctttggcacttatatcctcgccttcttttgcattttccgtcctcggaactcccttctacaacacagtgtccgcatctgctgccgcttctctctttcgggacaattcgccgcca

SEQ ID NO: 1889 - DNA, 1579 bp, Toxoplasma gondii
ctaaataagtcggtgcacgtggcatggtaagagggcggttacaaccagcggagagcatacactggaagtgcttaccacggaagagcatttgtgaaggcggatgttacttttcttaccaaagtagtacagatataccttgattgtgggacatcaagatacatgtctggccagtgttcgcgaaattcaggcacctgctatcactgttgtagccatgaacaccaacgctggcttgctgcacttcttccccgcggaccgtgtgctgagtggctcagtcgtttctgtgaatcaccaatagcagcgtgggagagccgctttcgaataaccaaaaagctatacaaacaaattaatcattgttcagcttcagcttgaaaatagtattgaggtacgcgctacctgagtacaacacaaggcatatctttttgggtaggtactcgtgcttcgatgcgaaaaagggagaccttgtcaggagactggaagccacgagcgtcagatctccagggttgctacttcttgtcggggctggaggttttcttctgtcaccgtctcagtgaattaacgagtgtctctcgacaatatatcgctaggcaggaccgtgaaatgtggagctgtatactaaaaacgcctagccgcacctacactaccactgagcaggaaagcgtggaaattgtaacaccattccatcttgtacgaattaaatcactttgtcgctgtgacaagacctatagtgaccacagctctgtcgacttcggcgtcgcagtttagggtgctattaccgtagactccctgattgggacaactctgcacatttgtttcttaatgtggagcaacatcgcctgctgtttcttgattccttccggcacaacttcgccgtcactttctgtacccacaaatccaccaaagtccgccgaaaaaggggaaaggcagccatgtgctcaagtgcacgggtttgacatcttggaaggggagaaactcctgctccgatgctcctcattcgacttgaatacgcgcacgggctggatagctgatttcgctgtctctgacttcttacagtgtgtatgccgccgtctcgagtttaacgtaaccaataattttacaaattgacacgtttttctcagagaacttacccactctcgcgtataaattgccagtagactgcaaagcgcacgcgatttattcatccttgcgaaaaggtaccctcaactgccgccctcccctgcgtgcttctggacagtggtgtgtaggctgccgtcggtatgcgtgcggagacggcgagacggacgagtgagctgcgcagcctgtctctcaattttcatacgatgtgccttgctgtgtgtgaagctttctcgaccgttgggtgtatgtcggcacactccccttgttgctggttttgtggcttatcttcggacctccgagactcatctgcgtaccgtgcatgtgcgattgccttgtatcgggcgccgcatttcttgtctctggggaagacacgcaaacccgacggttgcgcgtacttgcaagattgtcgctctctgtgaagtttgtgaagttttggtatttcccttccgcattagaaaatcgaaaa

SEQ ID NO: 1890 - DNA, 4210 bp, Toxoplasma gondii
gaccttatctgcatgcgtcgccacacgcttctcagaaggcaagtcaggaagcgactgaacagagaaagacaccttctccttccccaagcagggactatttgcacctgggagctgagttgcaggggaagacagagggagaggggaaggactggcgcgccacggtggatggggagccgagacacgactccgtctgcgggggacaaaggtgcttggtgtcgccggggcagcgaggcgagtcaaggatgcatgaggacggggacgaggaacagaaagtggagagacgaggaaagaaggatcaggaacagcggccgaggcggcaataagactggaggaaaggtgtgactgcgaaggtgcggacaatgcagaggcggaggcggaaggaggcagacaaatacgcccttgctcaagggacgcagccgcgcatttctcacacatgactttcggtgaaggcgggggagcttctggccaaggccaagcaagttggcggggctgagcaggtgagaatgcactcggaccggcgaatgctccactacgctcggactcacgttttttaggcagcgcttttaacgtcgtccctgccgacggctgcgatagccgcgtatccacttgagtccggacagaaccgcctgcgggaggcgagcgcgaggagggaactgtagtcgattgttcgcgtccgggggcgaccgcggggggtctgtcgtgcctggcagcagaacgatgagtacgcggatgcgaagtgacaagagcggaacacgcgtactgctgtgcgtggttgtttccatggtcctcagtcaacaccttttgtttcggtgccggttcgcggacagaaaccggggaggttttctgaaagacaggcgccggccgctttcgcaggaaacacgctgggattgctgccgctgagttggcgtggacctgagcctcgcccggcgaagagccggtctccggatccgtcagtcggacaacttgaggaaacgagttactggtttcgtcacgctggaacggactcgttggcgtttcctggcgaggagagacgctcacgctgcttgagggaaggcttctgtgtgaagacacttggacaaccgcggcagttctgacagaactgaaagttgtgacggttgtccacgaagttgcccacggcgcaactcccagtttgcggccattctccggtggacatacagctggagctgtctcgtcgccgaggaacagggcagccaggcgggtcagcattttgactcagaacagtacaattgcagccagggagaacactcatctcgcattcgcagacatggctacccgcgcaatattgaaaatgcagtttagaaatgaaaaatctgccgcagaaagaagtgatcgcagaagtgtgtgcctcgctaaagcgggcgcaaagctctggccacctgaagtgagccttcacaccacagtcggccgcgtgaaactgcgcacgaaaacgaaacgtggaccccaaggaagaagggttgagaatccggccagaaaccaatagcgatcttcatcgatagcacgaaaaaagagaaatagcgtcgaataatgcccggaacaagcagatagaagacctcatattgcaaatagctatcggaagatgtgctttcggaccctttgcgtacgctgactccgtccgcagctccgagcattcatctaggaaaaggggagacgagggagaagcaggaacagtagctgtttcctaggacaaagtaacgattcagaaaaagagggctgaaaacactatattccatgggatgtctctggagcacgtttcagccgacgctgtcgccaatgtcaaaaaccgcgcacagaaaagaaggcgcacgttgcgcaccgagagttgctcacagagtaacaaacgcataatgtcggtcggctgttttggcgcagaaaaagaacgtgtaacgtcttactctggtgttcgctttgaaagacgcctcagtttcaaagacgaactctccttgctgcaacacaaataggccttttcagcactacgacctgtgtggttgatagaagcttaacactgtccccacaagacacgcgagacgagacaagaaacaacgatggaggcgtgaaggcaacaagaacgacaaattacagagcgaattgaatctttcccccttctctttccccgcgctctccagctccacgagaaaccttggtgaacggcactgggtagtaagctgacagggggtcccatcttgcgcagcactcggagccgggggatttgcacgacacagaaaaaggcagaaactcactggcctactaccttacttgctcctcctgcaagtcaacggtgctacgacaatgactactgctcaagcattcatcacctgtcggaatacgtctgtgtttctctgcacactgtgccacgattgaacgtcatcgaatccgctctactattgccgtccaccagcgacattatatctgatcgagataaaactcatgaaagaacgtgttctttaaaatgattgcataccatgacgcttgtactgctgtgatgaaaaccatacgtgattgggcagcctgtctcgcgcagttgccaccagaccgtgagcgctcgcgtcgtgttgggcagcaacagaagttaccaatttcgaaaacgctatgctccacgcagatgcacagtgaatgggagaaagctgagcactaaaacatggagcgaggaagtgcttgtacatttgttgttatccaaatgatgtacgtactccgtaccaaaggtgccggagcatgacttaaagctcgactatctgggctcgaagcgactgatgtttagcgagtgggcgttgctacatgtgtagatgcatgtgatgcagagagaaaaagaactcattcgagtgcagtttgtggcagagcagggacgagagtttctcgagttgcactagtgatggcgcagctgttcgcgtcgattccactcacgaagctcacaacgaagatcaattattgtacgcgctttcatttgatgtggatttacggccctgtcatgtgacatgaaaacggtcatgtctgctgcagaagatgtttcacgcatgaacgccagcgatctaagagtgcactctcccttgaagttctgtccacgcaaatctggccatcacaccatctagacgtcagagtgaacacgctaggccagccgaggaatcggtggaatagaagggtgagagtcaatgtaaaccgcgaatttgcatgagtcaattctcggcgttgttctcagttgggttttcttggtcagtaccaatgccgcggcttatattcgggagcgaatataacgttgagtacaataaattgaatcttttcttatcttttcccgcttcacagtctctcgtctgaagggaaaccgtgcaggaacagatatcactgttttctattgtgtgttgaattctggcacggagtgccctgtttttctgtttccgagatctgtgcgttcagtttgcgttggtttttgagtcgttttccggccagcgagcgtgtccacggtgctgcatgtgccataccagaagtgttcgttttttgccattcgtcggcaaagtcctgggatcttcgcggaagtcaagctcgtgactattattccaatgcatttgccaggttgccttcctgttgcgaccagctccgttcatcgttttctcgaaagatatcctcagtccgctcggcggactgcaaaagaacagagtccgtcacctggggtgccgtggcagcgactgttgcgatttccgccgagtaagatgtggcgtttgagtcaagcgctccagtcacttgccatttcgttcgcttcacttcaatcctcttatatgtttttcgcttgacacaaatcaaatgtcttcctcctgtggaagtattccgacctgccacgatatggctgttccggagttcccagcaccgcgcgtcgaattctaggtcatccgccacgcggttcactctcgcgtttcgttcagcgtttcttcatgcccttttcaagaaaactgtactcagacgtctctttctattacgtctgttcttctccacctcaatcgttgcgttcgtccctacggaggccgcgtcgaagccctgtcttccaaggcgccactgccactcgcgaacccctgaaccgtcgacacctctaacaactcacgacttgaccgccacttcgaaacaagtcactagctctcaatattcgaagctgctgtctccgctccaaggggaaccccgcacccgccgttttttctcgcgtttctaa

SEQ ID NO: 1891 - DNA, 2986 bp, Toxoplasma gondii
acccggaaacacaaatcgttccaacatgacagtgctgacatgtttaaatctacatttttcctgacctggggagtctgcatgccgaactactggccgcacagatgctgacatgtttaaatccacaaattttgtgacctggggagtctgcatgccgaactactggccgcacagatgctgacatgtttaaatccacaaattttgtgacctggggagtctgcatgccgaactactggccgcacagatgctgacatgtttatatctacgtattttgtgacctggggagtctgcatgccgaaccactggccgcacagaagctgacatgtttatatctacatattttgtgacctggggagtctgcatgccgaaccactggccgcacagaagctgacatgtttatatctacatattttgtgacctggggagtctgcatgccgaaccactggccgcacagaagctgacatgtttaaatccacaaattttgtgacctggggagtctgcatgccgaactactggccgcacagatgctgacatgtttatatctacatattttgtgacctggggagtctgcatgccgaaccactggccgcacagatgctgacatgtttatatctacatattttgtgacctgggtagtctgcatgccgaaccactggccgcacagatgctgacatgtttatatctacgtattttgtgacctggggagtctgcatgccgaaccactggccgcacagaagctgacatgtttatatctacatattttgtgacctggggagtctgcatgccgaactactggccgcacagatgctgacatgtttatatctacatttttcctgacctggggagtctgcatgccgaactactggccgcacagatgctgacatgtttaaatctacatttttcctgacctggggagcctgcatgccgaactactggccggacagatgctgacatgtttaaatccacatattttgtgacctggggagtctgcatgccgaactactggccgcacagatgctgacatgtttatatctacatttttcctgacctggggagtctgcatgccgaactactggccgcacagatgctgacatgtttaaatctacatttttcctgacctggggagcctgcatgccgaactactggccggacagatgctgacatgtttaaatccacatattttgtgacctggggagcctgcatgccgaactactggccgcacagatgctgacatgtttatatctacatattttgtgacctgggtagtctgcatgccgaaccactggccgcacagatgctgacatgtttaaatctctatataaagatgcagatatataaatacatgtcgactaaggttgagaacgaggctgtattcatgcgtcgaaaagtgaagtgtacgcgtctaatcccttaaatatgtctgtacatctttttgatactttctgtttttgctgtgtcttccggccggtcgaccctgagggagaccagcatggagactggggaagcagaagccgagaaaagaaacacagcaagggaggaagatacacagagcaagagagagagatggaaaaaaggaagagaaggaaaagatgcagtgagggagagcgggagaagtgacggcttttgcagcgcgatgttcgcttgcgtcgacgcaagaaaaagctcgaattccttccagaatttccggttgaatcctgaggaaaaaatacaggcgtttccccctttctctcccgttttctcttttctcctctctttcttgttctgctgtgttctctctgtctctctttttctctttccaagtggacctcgagagaaggtgatggaaggtgtgaacgctctttgaaaaaacgaagcattcgcgaaaaagaggcagccatttcttgaagagacatgccgcttgtctcgcggttgtcttttccgtcgggggggggggtcgcgcgcgtcgaattcgccagccgttgtccagtctcgtcaccatctttctgtgacgtttcctgcttgagtcttgcggtgtgcttgtccccctttgagtttttccttacatgttctctgttctcattccttctcgttttttctctcctttcctctctggtgtttctctcctcgacggaggctctgcacaccgcgccgaccccctctcggaaggaggccaaaggaatctcgcgcatgcaacttggatcccccttcgagctctggtctcccttctctctctctctcctttcttctcgttcgcctttcttctcgttcgcctttcttcgcctcttctcgccactgctgcctccgcactgtcgctctcggacaagtttctgttcgcagattgcgctccgagagcgcttctgtctctctgtctctgtgtgtatgtgtgtgtgcgtctctctctctgtagcgttacaactggttaaagagcgacgcgagcagaggcgctgagaacgcgagcggatgtctctcttcctagcgagagaaagagagacaccaacgaggaatcacaagtaacggcgaaggagaaatggagggaagcagggtggactgcacactcgaactctggtaacgcaccgacctctgtcgaagactgctttggccgcccttccggttcccccccccccccccccgttcttccgttttgccctctcgttcttttttaacgaaaaactggaggccattcttcactgtccctcgcctttgtcgaagaagggtgtcgagcgactgtgtatcttcgtcgactcgtctgcgacggatcttcgcacaaaggcgccgtccggtccccctgactcgcgccttcttccctcctgttgagctcctcttctctttctcgtcggcttctctgctcgcttcgccggtcttttccgctcctcagcgtaggttctgagaactgcctgccttcgtgtgtgctccgtcgcgttctctctcttctcaagcctcaagcagctcgcgtttgtgccctctccggcgtttctcccagcgccgctgtccgacgttcggctggaaaaaa

SEQ ID NO: 1892 - DNA, 3120 bp, Toxoplasma gondii
tcttcaccctctgctcccaggaaaatcaaatgttcgagctggtgagcgactccaggaatcgctggagggtcgtggaaaaatccgcagccgacagacaccgcaaaggatccgacggcctcttcctggtctgcaatggcgacgccttcgagcttcagcgcaggcactgaaaacaccgagtacgcgctcgtgtctctaggcggctttcgcacgcgcttccgctccgccagctcttcgtctccgtcctccacttgctcgccgttcttcgcagcgagacgccgcggaaaggttctcgactgcgcgacggtcgacgcaagcgctgcgcgaacttccgcaagcgtcggcagcggatccggcgtctctccaccggacgtcgagtctccatcgttgacaggatcggagctgctgtcgggtcgcgtctccgcctccgcaactgacgctgcatgtgaaggagaggacacagacgaagataaggtcctcgttgacgaagcagaaaagccggaagcgatttccctcaccgcagccgcctggagttcctcttgcagcgctgcctcgagttcggggagacgagcggaggcgtttgccgcgcggcccggatcctcttctgtctcccgcgaagaagacagactcaacgcaggctcagagcgagaaaggaaggaagctggctttcgcgcagcatccaggtccgcgtgcagcgcccttgtctggtgagatggaagagagcgcgaggacggagagatcgattctgacagcagcgaaaagaggggaaggagcgccagaagaagaaggaaagtcgagcgaaaaagacagggcctcctcatcttgcctaggaggggagaaaacgcgagagagacagcaagcctgcctcagaggcgccctctggtgatgttgaacagacatgcgtctccgccgaggaaaccgggggagtcaacagagccgctctcgacaaggacgcctttctctggtaactcaactgcgggggagaaagaagggaggaaggggagaaggaaaaggcaagcagacctgaggatggtctttggtcctctacgcggacgtccggaaaagggagcccaagagagagcccggagagagacgggggagacgagcttgctcacacggagggaaacgcgaactatgaaacttggaaacaaggaaaggatgaaaaagccacaaaaaaagggaacaaaactagtgactacaccggtctttctcgggccaggaggaaaacgaggtgcggtgcctcctgcagctgtccaagggaatgagatggaagcagctgtgcttacggacaagaacttctgaaaataaaactgacgtacagcggaaaaggggagaaaagaaaggagagaagcagagggaattttcgcccccctgttctcgattgaaagacgtcagaaatttcctcgcggacaccatcgacttgtggaggggaacttggcaggctgctctcccctgcgtgtgcctctctccacttcggaacggaagacgactgtcgttctcgcggtccacggaatctgagccgtccttccgccttcctcgctgccgcaaagatcctgaatcttcctcttctccgcgaaaaatgaagaagttccttcttttgcgcgctgcaccccgattcaagcatcgacgcgcgcgccaaccatgcaagagtacgtaaccgcacagctagccactctctcccctcggcctccctgccctgcaaagcgacgagaactcgtggaacgggacgacggctggcgtcgcgagttcgccgtgcatgcatcgatgaagcgcttgaccttgaagcgattctgacgcccctctctctctgtctcaggtctctgcacacccaccgtggaaccttttctttcgccaggcagtcgacacaccaacctcctccgccttgcttccacgtcgccttctcttgcaactcagggtacagctgaaccttttcgacaattcttccccgtgcgagttcccgcgagtcgtcgtcgcccctcccagaaaaagccggcggcgggcggtgacttcctgtcttctctcgcgaaacgagtcctgttcgcgagcctccgaggcgaagtttaggcgcagctgaaatgcatcggggtggacaggcgagagagacgccgcgtggagcagtattttcagctgcaagtcgaagtcgcgcaatcccgaggcgtggagaagtcgagagggagccactgcgcgaaaaagaactgcgaaagaacaaagcagcagctgctgcggagagaggcggcgcgcggaatgcgacgaggaaacttgaaaatgacctggggaatgtctctctgaaaagtcatacacacgcaggaaagtaaaacgcagatagcttcgacaaacatcaaaacgcgggtcacaccaaaaccagtcgacctgagcactctgcagcgaggacttgcttctgcctctggctgcaactgaggaagaaaaccgtggaaccacagggagacacacttccaacattgtggcgtcgctaggcggcgtcgttctttttcgacggactgtttgctgaagagtggacggtattgtttagacatttgtcgcggtattgtcttcctgtttcttcactttagagattgaatggtaggacagtttcgatcggatacacgcgagaaagcgcgagagatccccaaagaaggggggagacacacgactgcttctgcaggtgcaatgcgatgctgtggcaacgcggtgccgttcgaaactttttttcgcaatttgttagaagccgtcttcacattcgctacattttatcacgcaaaagcggggaggaaaaagatggaaaacgcgaccgacgcttcccgaaggtctggcgagcgcgtgacgctggaaccgagatgtacgttcaccagccagaaagagagttcctgctcaacgaacgcgacagtccagatctgatgtccctcccattcgttctggcggaatcgtcggacttctcgttcctcctgctctccctcctttctcctggacctcgtcacttcggagtcgtttctcggcaatttctcctctctcccctgtagtccgttgctgatttgctacgccgttgtcctcattccgcgtcttttgcgtcaatacggctgcgtcctccccctcccgcccggtgtttcttgcttccctctgtcacta

SEQ ID NO: 1893 - DNA, 4620 bp, Toxoplasma gondii
ctgtcttgcttcgtttcttggctgtctcgagccctctcattcgactgcaagctgctcggtcctacgtgctttgccctcgttttctccctcgtcgtttcttccgtttctcgctttgtctgtctgctttgccagaaacatcaacagtcattttatccagcaaaaaagtcggagagcgaggaggaaacgtgggtagcgagggcttccgcttcctcgtctttccctcgttgccagctgagtcgaggcagccgcgatggcccaggtggacgaacctcagttccgaacgatcgtgacccttagctgcgtcaagcagtcgagtgtggcagatacggacagcagctgacagcgagggagaaactgaaaacagaaaagaactgaggatcacaaatacacggaaaacggtgactctctggaagtcgtcagttcggccatagaaaaatcgaggactccccgcaaaacgctttaaatagccctcagccgcttatgtggaagcccatcagaaactccgaaacagccctccgaagcgctgatcaagaattttcaaagatgaatactcccagtaccggggtgctgaccacacaggggtacatcggtagtcgtttttcccgtgttgaaacgagtgataccacgagttcgacgtatggcgcttagaacgcaaagacgaaacgcgattcatagccagaccgacgcttgcacgtcacccccgttatgaattcacaaaaacctgcgagtcaccgtatgcacactttgcagagatgagatggcacggtgacagagggaaagaaggagccaaaaggcgatgagaagaagcggcaggaattgggggaagatcggaagagggagatgcgggaaacgcgaaagatcaaggggggaacaccacttacagccctgctagctacactctttaggtgaaaacccgactgtgtggaacggaagaaacgcaattgatacgcaggaaacgagttactgctctgaagcgacagaaaccgcgagtcttgatggtcaagacaagaacgaaatgcggacgtagaaagaaaagaatttcgctggctagttgtcattgatagctgccgaacaagtacaagaaatgccttgacaggagctgaatgcaagttagttgtaaaacattgagaaggcgtggaaacctgggaaaggcgcccatacaatcactgatatacgcgtgcttgaccgaaacagagacaaaggacctgcggtggccttgtcaaaaaaatccgcttctccgctgcagaataccggcgttgcgttccgcattccgttagctgaagaacgactctcgacaccagaaccccctttttgccgacacacacgagccacgcaacatatcaggactgcaaacgctgctcaaggttagaggaactcgcgtgaaccggctaaattttgtcaaacaaaagaaaagtgaaacgcgaacttctgccgtctctcaccttgagttgctggctctctcggtgcgtgtctcgttcatgtcagttttctggtcggcatccgtctgctcaaccgtccaagaaatccaaaggaaatttccgattcgagtgataagaaacccacccacaccttcccactgtttgtctagatactttgtaaggtacacacttgcgctacaaaccttttcccgctgcttttcctcgtcgctcgactctcacttgcatgcaggggacgactcactcgttgttaaacaaatacaagtgacagcagtttcaacgtggatttcgtgaaggccattaccgctgtgaaataatcttcatgtcgtgggaaaatgtactccagcgatttcagctttcttcagcagtcgagtaggctgcctgcagaaacgaagaggtctgtgtagtctgtatcacatggctggagtcacattcaggatccgacgtaaggcaacgtctcttttactcacgcagtaagacagaaaaaccgagcctgacaacttttgcctttggcagagattccccttttctgtccagtggaagttctcactttgcttagctgtgtctctcctttttccttcggtgtgtcggaacggaagagtgcagcgactcgaagcgaagtcgagagcgcttaaacgtgtcctttgagctcgtgcttgcaccgctctctttagccgccatcatcctttcatccaagatatttctctccatcgcaggctagggctaatatcctgttacacaattatttacatcacacggcttctggtgcttcgatatatatatcctggcggcgagatggggagagtgtttccaacacaaggggtgttgtagccgagaatcgggtatcttcttcttcgttaaacacgttgagaaaggtaagagcgaatatcgttccatggagccttcccaggctgtgtggatcgccgttcaagtggtgctaagagaatgtcacgttcatttaaactagtgaagcgaatgaatgcacacaaacgagaacaaacaatcaaataggagagcctgcaatgttgccgtaaggtggaatgagggcacgaaatgtagaagcgacgaatagtagaacggactctgggtgccagcgtacatacgcgtatgaacgtgactggccgtagcgcgtccactgtcatttgcctccggatgcggaccagatatcgccgctctgggacacgctgcacatgctataaccttcaaagttgagccgggaaaggattcttgattgttgattgtttgtgaccgctacgtgagttctcaagcatgtagaggaatacggcgttgccgctggaaacacattgactaaaaagggaacgccgttatgcttctatgaggtaccttgctcactagcagccacccccgtgtatgacagagaaccgtttcgttcggacttttgtcttaaactgacactggctattctccagtttgcacagacacacgatgcgtcaggaaatacaacgcttccttcgacgaaccgttctgttcgggctctctagagcgacggtgggactccgcaccgaagctgtcgagaagtaggaatgcttccggtggcaggaacttctccaattgcaagggtgtaattcatgtttcatgtcctttccgctagaccacaagctaccgacggtctgtggttctttatccaagaaatagtctacggactcacgccgcgagagtttgcctctagacgttctgaaagaattgatttttctttctaagtctcatgaatccatgaactgtggctatcccccaacctctgcatgtggccgtctagaccaggcggcccgccgacggtttccaggtgaaactagcagtacaaccttccctgcaagatcgcctccactctcaagcaccttttgccgcttcagacagttggcagcagttctatcatggtcacaacttaaccacggatttttgttagacaacagagtccgtgaaactcgagaaagtcaagtcaacatcactacaggggcaacgcccgaagggggcttgctacggtgtacttacacccgccgcttcgctgcaagtccgcctttgcattttgagtgctcccgtgtatagaagaagttacaaaaccactccacatgggatttatcggattcttttcacttgttctcgtctctcttataactcgaatccttcaggcagaagaaccgtctgcaagaagccgcagacaatcccacagacatatcgcgcctgccccgcacggtctcaccgaaaccatcttggaaatggaggaggattacgtggctgtaacaacgaggcaaatcgccgatggaagaagtcttctcatagtcttgcagaaaaagtcttcttagcgacgatgagtggacacatttcacgacattgctcactagctcgcttccatcgtccgagtcgtctgcggtcagcttctgagagctgcatgcagtgtgccagctagcgcacgtgcccagaaagacagtcgggaggcaaaacccctgaggaaaagccacttttcccaattacagagagactgtcgcctccccgctttccctccatctccacagctggattgcacgctgctaacgaaaagtaatcgcgtcttttcgggtcgccacttcgagggggccgtctgaaaagaagcaggcgtagaagaaacagcagacgaatgaggatctcgcaacttctgtacagggtcacagcgcgcccaacgggctctgagctgtgtttgttgtatttacttcgagtttgtatccagctgtagttcttgaaagcctctgtttgccagagcgaagtttccttgcgctcacggtgtctcctgaacacatgtctcactgtgagacttcttttcgtgcatgtgaccatccactgctggttgtcattcacctgaagtgtatgcgaaagtgacagttcagacaagggctgagatatgaaaagaacgagtgggtttcctcttttgcgcctgtttactcttcgtcttttttccgctctcccggcacgaaaagggggtggtgaccttcacggacagaagcaagcgacaaaggcgccttcaaaacttctgtctccgtgaccctcttgaagttcttctttcccccgttcttttgtttcctgaaaggcgcgccctcacgacactctcgctgtcccgcctcttcgtcctcgttttccccgttgctttcggtcttcgttcttctttttttcttctcgcaagagccacacgaca

SEQ ID NO: 1894 - DNA, 2422 bp, Toxoplasma gondii
cgcatgctgttcaaccaacattatggcttctgtcgctgctgacgcgggtgcccctctggtgcgagcaggtgtgccgccgatgcccctcaggagcgactgggtgtccgcgaggctcctgtcatatgaagaatctgctcagctggtttcatatagcatcgacgattgcctgtgtatatacaccctctctagcggcatcgtagttatcttattattaaatgcgggagcataatattggcctaccgctgtacgttcagtcaacgatgccacatcagaatgctgataacactcagcctcgttcacggattgacttgatatgctttggagagacattttatgtcactgatttgtctatcaatttgttctgcgtgtcgaggaccctccttgttaccggcaggcctgaatgactacttcccccgtggccctcacggtcactcgcatgaagcgcccactaaaacataccttacggtcgcgagtgcgttctcgtgacacattctagccacagtagcatcatgtggtaagtcattcctgaatgttctcctttgttcgagctatcggacacaacattcgtaaataatgtcgccgggattctgtgcgcagcggaatccgcgagtctctccattcacataaccgtactctctcacctaggcatcatgcaacccaagaatcattcagtaacacaaacaaagaaggcacgatcatgcgtgcagctgctgagccccgcgtcgttccggctagcgtctttcccctcttgaagcaaccctagacgcgcacctcacctagttagcaagcagactgtcacagatttcttacgcatagctggaaaaagtgtccttcgagaagcacagcgttagcgtattcgggtacagccctccaacttggacattgccgacctttccctactacgcatccggttgtttccggtcccctcaagaatagtaaggaatctgtgacaatatgcctgctgaccaggtgaggtgcgcgtctagggttgcttcaagaggggaaagacacaagccttcggtctgtacatctttgctgcgctttctattagcagaagaagacttcttgcagcccaagctgtttccattaacgtaagcagcggtcaatatccgtaccgttcaaaaagaagcttttttggtagggtgagcctgctatgtgccttgcatgcgctcagccgaaaaaaaacagtggtagccacaactggccaaggtgacgcgagaagtgtcttttaaggcttcagccccgtccttttccctcctaatcttcgaattcttcatgtgctgaactgggctgccaccgggtatgtacgttatcatgaaaagaaccgcgtgaaatatatgcagctctttttttctcgtgaccgtcactcagaggtgccgacgcatgtacaacagatacactagcacccccgcctctcgaacgctgtgccacccacagccgacgagaactgatccgggttttttcacgtatgaatgcagttcgccttcactgatgtggtaaaacaccgcgcgtttgtttctgaggaaactgcctgtcagcgacgattttaagttttccgtgtcgaaagtgttgctcctgtatcctcgtattcacattttatactgctttttgtagcgtggctgttggggggccgcagccgcgtggacgactaaggacgctgcgcttttgtctttccccgtaccatcttttcattcaatgcctttttatgttttatacgttcaccacgcgctgcacagtttagtatgtgtacaatagactcttgtgcaatggggggagcacgtctgctcccgtttctccctgcacagttttcatgcgatctgtctacgcacttcggcgtgaagtagtgttgcgctgattttttatatatatatgcacacaggtttgctcccacatgtggaaatccttctatatgcggggttgcccttttttcccagttcgtcttgcgtcggtgcgcactgaagttccggcgtagagagcgtactacctaaagaacttccctcgtttcgggacaggtggtcccgcttttccagagcggaagacgtttgcagtcgtcagctgctgccaggaccccctcgctccttttcctcctaactcatttccatggttctttttcggagcatccaggagaagtgtctgttgggatagcgtcgtgactcgtcattcccccaactcgataccgtgtgttttctttagtttctgcttctgcgcgggaaagtttgccttttcctctccaaaggtccctgcctgcccctttgatgcttgccgaggaaaccccagctacacggtcagagccaactgggtgtgctgtacacgccgttgcgcaacggtcggaactcgcaggatctgcttgtacgtacatcacggtagagtccagttctgaagagtagcttcttccttcgccctggcttgttttccctcgaca

SEQ ID NO: 1895 - DNA, 1941 bp, Toxoplasma gondii
gattcgaaatctctgcagccgaagacagagatagggcacagtatgtgacggcaaactcaggaatcatagaacgaacgatcaatcgttttttctacccagaagctcaggcagacaccccgccttatgcacaggtgctgtctatccccataatggcaagagcgtcttcgcaccacatgcctacgacgacgagtctcgataaccgaagggagtagcgacacccgtgagtctttgtctcgaagtcaccagaggacacaacagactttccagcgtggcgtgttccaggcaaccaataagactaccgccgtttagctggcgctgaagagcatttgtcccggcgtgaacgaaatgatcgtggaatgttgcgtattgcaggactagagcacttttggcagtgaacaagaaccagcaagggttctgtttgtcgtagatgcacattcaagcaactgacaacttcctggaatggtaaaaacgtttataggttgctttgccaaggcaaaggcagtgcaccgtgtaaacctgatctccagtcatttagagatatttaaaaaacggtatacatagatatatgcaggtagagacttgtagatacttgtagacggacacaggtacagaaaggtgggcatcgctactggatggtgctatcgaactcgattttgcgggaatatctctaaatcacggacagtggaaatcgctgttctcgacattggtcgctgggaaactacattagacaccagcaccctcgatgcgaataggtcatggccatcagtgagcgtgtccttgttcggtttcagatgcaagatcgtgcacggtacaagcacttgatattccctagttccacttttggccagagaaggatctcggttaaccggatctgtacaccataccctcctctaacggcagcagaaaagtggacaagggggaagtggcgcgcgtggacattctgatttgtcgggaatcacgcagcagtttgcagcggagacgaaaccaatgctgttccctgccgcgcttcttctgtcagaagatccgatccagttcgtctgaagcacgagcatgcgtttccaggttcgattgattccactgcatgcagcgtctttcgcggctcgcggccccgctgcacgcgtcgtacccgcgtttcctggctcttctgtcggccgcttgagcatgcaagaagtctctacacagccggtcgcgccaaattgagtgaattccctcttcgttgttgtcccttgaaagaggaagaacgtctaggatgctgcgtcgaagcatgcggatggcactcaaaagaggaaaattgaggcccggcactccctgctgatcgctggccaagatgctgtagaagaagcgttttgggtgtcagcgcaggagacaggagcgctaggtcttttccgctcgactttcccgggtcacgtgttcgacagtgtcgattatcgttctttcctcgcgagtcttcagttgcgtcctggctgccttgctttagttccttctttttccccgcggacaggaccgcgtcgtgtctatagtgtctttcccacccgctgatttccattttacagaatttcgttgggatggccacaccccagacggttctttcctgccttctttcttccactgaacggtgtcactggtccgccttcttggcgcgtgcgcgagttctgcgggcgccggtcggctgtcgcgcggggctctgcgaccggccgctgtcctgattaaatggttcctcgtcaacgcgtaaggagcatttgcagactctgccgtatccgtacaaacctgacgcggagtctggtgtgtcgcagtcgaggacaatagcggcagcttcccctcggatccaggaaggatgaaaaatgctcgcctctatgccgagtgtcaagtcttgcgtcaccgtgtcgcggcttcccttccaactttcttgagaaaaacgaacgttctcgaagacctgagcca

SEQ ID NO: 1896 - DNA, 2142 bp, Toxoplasma gondii
tccgcagacatgatagtcatcatcttcttgcggatcgcacggatttgggacgtctgggcgtagcaagtgctcttcacctgctcgggtctgtacatgaatacatataaaaaccagacaagtaaaagttgctctccgtaataacatctgaagaaaatctcgaagattggggggggagatgtaggcaaaacacagaggtgtaaagccacctattttttagcacgcacctcctcttggtgaaggcaatgcagaacattctcaaagtgtagccgtccaaagtcgtcacgtcaacgaatgcctcaatcagggagtggcacttgcggaccaaggagcagatcttgtcacgagtcatgtccattccgtggaagtcagtcaagcagtttctgccctgaatgtcttcgcagcagagcttgatctttctgaaaccttgatcttcatcgttgttcagatcggccaaattcacctcgtaaacacgtccgcgaagaccatcaacggccaactctgataacagaaagtaatgagacacagattcaccagtgtatgttacaagaaagcggcagtctaccggtcgtcctccggcacgagcgtgagcatgcatttgaaagtgacgcccacagccgcgaaaaccatcacaaccaactctgcaccaacgagtatcctcagccaactcaaaaaaacccatacagcaggaagcgaaagcgatgcaagactcaatacactgccgtttcttgatggacttccccagcaaaacagaacgacgtctggactacacacgggggccgctggcttctgatttccccgcagattcgacgcaagcgcgcttactagtcccctgcgattttgtgacgagggtctttccaaagtttcggacgttgaaaagagtgggggctttcaggtcataccactccttcttcaggaagggatcaccaatcttcttcttgccccccttctttcccttgctcatccgcttattctttccgatcgccatttttcctgtctgtggtagaggagcacttcaggcaacgatggaaaacggaaaacagtgtgctctctgcacgagccacacttgcttggaaagacgaaaggaataattcggcgccagcgcgaacaagagggtcgaagttgcaagtagggaaaaggacacgtgcggtggggtgcgggtacgccgaaaccaaccgacgtgttggaggcagcatgcggcatgtggggcctacggcgccatctcggaccgtaggtgcatgcgcatgcgtaaaattgcaactgttgacttccggcgtacgtagagactgttgcgctttgcatcgcacagcgggccaaggactcgtcgcgtggtgacgagaaccgcgtctcacatgcagccgcagcagctgcagagaaacgatgccgttgtagctggtgcaattcgtatgaaaaatgaatgcgcccgctaaactggaagaacgtccattgcgaacatctggcacggtcatcgatactacgacaaggggggggggggcgtaatctacggtactactggttgttagaggcgttgttttggagtccacctgcgctggatcctggtgggaaaacggatggacaagaacatgcgtatgcatcccgaagggagacagcaggacttttgtgtttggtgagatcatgtttatatcgttgaaggagcgtaagtggaagaggacagttgaactgttaaaggcgtcaggatgattaccggcggcccgtttttttttttcgcggggtctggttccctctaaagctgctagttcaagcatcaattactctgtctcacggtaggcgggagtcatatctgtgcgaccatgtgaatttacattgttatttcattgaccctcagacgactacaggactgtggcggcgtttcttgtgcactaggtacaagtctctacaggggcggtggagcacccagcaccgaagaggcacgttctatcacagcatgaactgtttgcattgtggcgatttgccacgcaccaccgttagcatcgcctgcgctttcttaaaaggcgttgccaatccaaatagagttgcttcctgtataacggtgtactgtatgtacagtgtcggcccagctgtaccgcgcccctagcgtcacgaaagatttgcacttttggctaagatatccgctgatcggcagaa

SEQ ID NO: 1897 - DNA, 1054 bp, Toxoplasma gondii
aaacatggatcgttggcacatacaaactgtgggcgaaccggagagaagcgctgcatgccgtccttcggctgcggagatttgtggtgttctttgctctcccacaagagacagacggcgtagaaaatggacgtcgtcaagtggcggagatgacgatcagagacacaaacgagtcagcgaggaaggcgagaaaagagaaagtcgaatgggaacagtgaacacaacatgacagagaagcacacactgcgaatgcgtaacgggggaaaacaaaagcgaagcgaacaacgaggatagagtggaagctaaggacgatgagaactgggaaagcttcgatggaataccccgtgtaacgcgttttctgaataaaaacgagtgatgcggccccttgtgcaggatgcagagaaaaacgcttctccatatttggcgtccttcttcaactcaaagctacgcgacagaaaaccacagggcctgcctcgcgccatttttcttgtgaactggcagtacttctccgaggcggcagccttctctttagaaagcattctttagtgcaagtcgctttcgccactcctagaacattttttcggccggctttcgtttctttgcgggtgcatgaacgcgcttgctcgagcagtcgaagacactgtcatcatctagaaatggtccccacgagaagtcgtagatgccggggccagaaatggtcgagagccaccgcaacgaatttcagaaatggcgaaacgcatatccagctgcgcttccaaaaaacggcgagcgccgtacttgcccccccgtcttgtcgcaatcccgttggcgggcagacccacagaacgaaacaattccacccccgcacacctcgtctttcaaatgaaaacctgctccctcgcgttgtttgagcagattaagaacttctcaaacaacagaaagaggaactcggccgtggaccgaaacgctcggagaagcgaccgggaagctgcctcgttgcgcgcgcattcacaattcaagaccccgtcgcacaaagggggtgcgttgctcaccaaatcaaaaggaagacgagcaaaga

SEQ ID NO: 1898 - DNA, 1740 bp, Toxoplasma gondii
ctcgagctgctcccaaattttggtaaacacagtggtcttctccgtacgtttggtgacgccgtgaggatcagcactgatatcttctgatttgctctttctgtctccgcttgacattgcgtttcgacaagattccgaagcattcgacagactggtaggtttgttgcctcgagtagacgtgtcttgtgtatcttcactgtcaccatgtccctcaacataaaatgttgcaaggtcttctgttgagttgtttgcggtcgttggatccgccaaggcttccttcacgggcaagacctccactttagccactggatgctgctcgggggaagaagtcacctgtgtctcaccgcaagcattgtcctgtactgcaagtcctccttccgggtcgtgatgacagctttgggtttcacactgtgctccgaattcaccaagagtggatggcgtcggctcgcatgttagtctgttggtgtctctatctaatgcagactgagaagtttttgtagttttttttccccgagcgctccccaggctgtcatcggtttgtgagcacacaggctctccccgaagatgcacatctcccatttcgccggatatatgacgtggcaaatcagtggacactgccatgtcggcaactggcctgtgtggatcagccgcagccgaaacacttgcagccactggagtgctgtccttatccgccatgccttgcagtcgttcggggtaccggccctcgattatcagttataaaatcacttgactcgcagctttaaaatagggccaaagagcccttcttctaaactattggtgaacaagtctcctcaggaattgctaagctgatggataataatcgcagcagttgctaacgagagagacctgcagagcctaggacacaaaagaaagactggtagttcttaatagaggtgaagcgtgatggagaagacataggaacaacatcaaactgaactgcacacccactcctcaactgttatcacggtgtgccggtaaagcgagtcaaaaaccattatgatggtcgaccgctctgcggtgaacgatataaaaaaccacagaagcagcatgcaaacaacaccctgtggctatggtaccattgaaacgccacaacaaacacaaccaagccgccaacgctgctagctcttggtttctgcaatatccttgaggtggacgcaaggtcccattaataatgaaaaattgcttcaaactcagttcttggtgcagccggaccagcggcggccgggcgactatcgctggtcaacagtgaatcggcacagcgaaagcagagtcgaagcatatgagaagtgagtccaccttaagcatcatttgaaactggtctggaaggtgaaaacaacaaaaagacggtgtttcttcctgggttcaacggggtcgggaactcgcttcgccggtaagctagtcgcagttcgcttgcgtaaaaaagcgcggccgccacgttggacgggcggtcacaaccacagtttagaaagcacaacgacccttattccgtaaggtgaatttttccctccagtgcttgtccctcttagaattcaggtgtacttagtcatgcgagcggaagagactgaccgatttgaggacgaaacattgaacttgttacggtgtacatccaggcaacggatgaggaccgcacctactgacgagccacagtaggcgagatctattttcccttttcaggacgaaggacactagcttcagttggaaaccctgtccaccttacaagca

SEQ ID NO: 1899 - DNA, 3827 bp, Toxoplasma gondii
aatggcatgctcgcggatttcaacataggagcagcgcacagagaactcgtactcctggtccagccacttgtgaggctctaggttccacgcgagaaactgtggcgcgttggttcggggctttgtccgtggtgaggcgggatgccggtaagaggcaatgtgattgaaaagatcttgaagagcgttgaaaatcacgcccgggtggtcatgcgttccgaaaagcgtgaaggtcttcccgctgcctttgcctccgcacgcaatcaccgtgctgctgattccctgaagaacgcagtgaagcaaaagccactcaaatgtctgtatgggatgtccgtccaccggagagaaaatcactcggaaagaaagtggaaatggccgcctcgtctcgaagcttgttggatactggaatcatccgctgacactacgtccccatattactattcacaactcagggaatttcttgagagggagcgacgcagtacagaaattgacatttctcaggaggcaggatgcgacttctgcattcagtccattcaggaaagaatcgacaatgcatggaaatacggaacggcggccttcaaacggttcgttacattcaattggaagtgttaggactggaaagttgcatccgattcgcctaaataacatatttcagtcttagaggcgtatttgtctcgccaccactaccctgctggacaagatgctctggtgtgttcatggagatgtgaaagacttctttttcggcagacgggtaatcaactactttcggaactctcagaatcaacttgtggacgttcttgaatgggttttactgccccacttactgggctgtttgttgcacgcagttgtattctcacgaatcatgtgatcgcatcgaaaactcacctcagtcacttgaatgacaagaggctgcacaatatttttgtatactcttgtcgttgccgtgccttcgtcgaagatgctgcaaaacaagtagggatttacgaggtaaaacacgagcgcattaatcactgtctcgcgatatgtgagtataacttttgttagaagctctttcagaagtaaaaatcgcctgtatctgtaggcacaattactctaggtcacataaatagcagacggccccgtacaatcctccctaatagtgtgtcgagctgacaacgaattaccacattctaggaaaacagagctctaaagaaccttcagacactttttcccccctattactagtatgttactacctggatctgactgacagcaggccactggcaaatgaaagtgttcgtccttttctgaaaaaggcttctttggcaagtacaaaacgggtggagttctgagaaagtggaatatcggagtgttctcccgcgcacatcagccttgctgtatgctgcgccaattggcgctgtgaataacgtagtgagacacgactcatcgggagataagtgtttcagagtttctccccttttagaccgtaactgcaggggcgcgttgcccctggcactggtggaaagcggaaggactcctttggtttcccacctgccgctaaaggtaaattctgcaagagaagacgacgagtgcagaaagcagcctgcatcgcgtttctgttggtctagagtgccttgcgccgcgggatcggaccgggacagtcttgccttctcggtgtcgattccgacggacttgggacctgaaacaaagcaagctgaacgggcaccctccgcaatccgctcaacagcgagcggacggaaacggacagaaacttcagattcaacttctaccgcggtttgcgcggtcgaagtcgggtcagtcctctccatcagccccggaaaagtggaccgcccagcgatcgagaccgcgagtctgtctaaacttgaggcgaaccggcggagggggttgttttacggaccaatttctctcaagaaagggggtagaaaataactgggaatcccaggcgacgattgtaaaaaggacaagggcagaccgctcggtggatctgccagaaaaatgccagtactcgttctactttttcgccaacgatgtatccactggaggggtacgccagagggttgtcttgtcatctacacggggtgtgactcctctccacaaccgagtcccaaaatattggctggaagagggatctagacctttcctcgtgccacagagaagacgaaatcatggttttaaaccagcaggttagttcacagaccaacgaagacaaccatgagaaaagaaactggaacaagagaatcgagtgcctcttttctccaggggagggcagaagtggctagagagtggtcctcgtgaacgcgacgccgtaccaaaaacgatcttccacgcacatggcgggttttcccaacatagttctgcaaacaccgtcgttatcgcgggagttcccgtcaccattgaaaaggcaagagtttctacatcattctaagtgttctgcgagcgatgggtctacacatttcatgaagcttccatgtccatcgccgctcttcgaccgcgccgcaggcagctgacgtctcaaatcccgagcagcccccgcgaggtgtagacaagacgacgcagcaggttctcacttgcgcggcaccgcagttgatcaagaccgcgagtcaactgtgaactggttattctttccgtcgacaaggcactgaaatatctaaaatggcgtatgtgcacctgatcttctcggctgcgactgcggaaaacgcaaaagttttcatttcgctgctgcttcggtagaagacacggaaaatcccatcggtaaaagttcagtatggtcgggacccctaggcagagaagaaaaaagagtgcacgtctaagcgaaatgcgtaactaggaggggtgtacatgcaggggaacgactgtcggccgaaagcaatgtcccactttgggggtgatacgtgatttacacccgtctttagtagacttacggaatcgaatacgtcttcggattgccaataagaagcaaaacttaccgtaagcgaacgggctaacagtatacagagcagcggaggggggctcggcgactggtcacgacacctcccaacagctgactggttctgcttgggggcccatcacaacgatattccggaggattttcttgtgcacttctgaaaatgtcttctgattgcgaattcacaagagcggtagatggttttaagcgaagggcacaggcggtcgcttcatttatcggtgcacacttgctggcattctgcaccgaggggaaacggttttaaacagctcgacccatgtgcgttatgatcctctgcgctctggagaggcgcttcgataacaaattgacaaggatgttcttcacattttggtgttgtcttccagggaccaaatttccgcctctttttctgcatagtcagaagttgaatagggcgctgtcttgagccgtactcttgtaacctccctccctgcgtgtggcaaaaaaatgggctactctccagggcacgatggtgtgctgatgaaggaaacgaatgtccattttggcttgtcgatgtttgtggataagcttccccgatgctctggtagctgcatgttaacttagtagggcgtgcatatacgaattgatggtctatcgctctggccgtgcccattccctcgcctactacggcttgcgcgtatatatgtgttccaaaggtgatgcgcgtatacactgcctgacggtgttttgttgtacattaaaggtcagttgcttgatatatacatatatagatagatatctgcataggtttctttcatgtgatcctatttctgagcgaggttacgcactctcttccccgcattcacgtctctgcaaaagcagcaaagcttgtgatgaaggcaacggaacaaaa

SEQ ID NO: 1900 - DNA, 2130 bp, Toxoplasma gondii
tacggttgcacgcaaggacagttagaaggacatggcaagaatccttcggggactcttcacagatgtcgccagtatatttcacaccctgggcaagcggcgcgaccttcgtcaggcgtttacaggctcggtaggcgacgtagggaggtcttttcaccacatcaaagtctcagaacaggctacaccgacgatgacttgaactggaacgcgggcttccttagaacaaaaggaagcctcagctcagcgaaatgatctcgcgcattttaaaagctcttctctagactgactgttgtctagaagcagactgcgttcgatgcaaggcgtcgttccgcgtttcaattccgtctcctctggcttgccttctgggctgagagcagccggggcgggtctccacagctgcttggtcacttgccattaaaaagctggcagcttgtcaaattgtctgcggaggctgacgaagcgccgccctctggcttctatgcagacatcgatcctgtgaaaagacgagcgagaaccaccgcttcgttccgtttaccttccgcacccaacatcagtgtggacaagccgattccgtaagaccgcgacgaatcctgagtctacgttcggagacgaatcctccggaaaggccatggagaggtccgttggcgtcgccactttcgctaaaacaaaatcggcgattgaaacgcgggccgcatgagacctgggtatgtgtgtgtcacactcatcgaatgcgaggcagtcaacgatgcctctaaacaggtccaacagtcggaggcctcccaccggctcaacttgcacggaaagggggaaatacgttcttagttctcatccgagagacaaatactcactgtgtgcgtttttaaagtcacgcacgcttgcatctcaaccagaaagatgaagatcaagagtaggatgaccgggacgacacgtgggtggcgggcttcagtacggtgtgtatagtcggaagggcagaaacaagagagaagcgatgaagtggcggtatatatgagaggatatacggtaaaacaatgggtgatgctcctacgctggggaatctctgcagcattcgttgcgtagagaaaaccgccttctcattgacgggcatgtcgatgcatgcgaagctgtagattatctggcgcatgcaacgcgaaaattccgcaaccagtctgacactcgagaagccattgccagcctgaaactggagtcccgacatcaaaaggcgcctgggcgccccttcatcttcggtctcaacgaaattcagaaatgccgaacagactgaaaacagacaaagcgaaaagatgaactcgctttcgaagggtttgagtttgtgtagagggtgcatcgacgaccggcagcgtttccttgacgctgagcatgcgctagaaccgacaacgagagactgaggggtgagctggcagagacaagaacaattgctgtttttgtgggctgacccattttttccctcttagaccctacctcgttttccgtcttctctgacacgcctcgcttcgacagaagcggctcgggacacgactgccagtttgttttttctcgagagtctcgcgttcgtcccttgaggtggattcgcgatggcccatcggtggcagatttgtactccctcttttttggcagaactcgtttgtgtcccattcagctgatagctgcggcatcactcccgggtctagaagacgttcgagactgccgctgtctttcatcgcttctcccgccctttctccgtcaatgctcttgtctgttgtttctgctgtgtcgacttttttgtgcgcactctctgccttttcacgcgttccttccctcgtctctatctcctggttgcgttgctcgcgctgtgttccgtcgtccacccccccccctcggctgcctggaagaggcattatggcttgattagcaaccaaaggagccgaaaaacgtagagaagaccatcttctccgtcaaaagggaggcagctgagctgtgcgagacaacctcgccaggaacacacatctacagacgcgcggcatgtagtgaaatctgagtcgggacgggtgcgaaaaagcctcatttctttcgtggccgggttcccatccgcggccgtgtgtttcgtttgctgcttccttctttctccttcgcgcaaaa

SEQ ID NO: 1901 - DNA, 3101 bp, Toxoplasma gondii
cctctctcgtggtgttgcttgcgtggcggtgatgggaaatgagttccgaggagctgtggtactttgttgagaaaacattctgatgaggacaagccggcggtatcgccggtcgtgcagcggtgccaacaggcgctcgcaggttgtcctcgaaaacccgctgaatgtttccgctgtgggggaacaatagcactctcggggtgttttttggcgaaaaagacatggttcgattgacacctaggcctcgtttaagtgtggctctgtgggtgcatgcacggtgactgtgtcgtttgttttttgtgtagctttcaacttgtagagcctctgttccagttgcttggtgctgcatcgaaatcgagctaataatgtctcgcctttgcttttcccggcttctcccatccgcttcctttgcggaacggtcacggttctctttgctgtctgtagacgcaaggatcgatacgcgccaccgctctttctgcgcgtgtcgtctgggaaagcagtccgtgcgcgccgccacgacgaccctttagacagccgtcgcgtgaactccggaagcgtagaaagatgttccgtgtgaaagcgacgtgcgataccttttgcattagcgaaagaacggcgtattttttcgccccgtcgttgagatggaaaacaagcacccgcattcaaacacacacagtggacctgtcgaaagcgcttgtcactcggtcctctggagcgacgctttccagttactgttaataccggatttttatttcatatattgcgtgaaagacgagagtgcacagccgttaccaagccgattgaatactgaaactcacatatcgttgatgaggccctgcaccggtaccgtaaacacccagttgatcgcgaagaagaacgactctccggcatcccaccctggagcgattttgcattaaatccttgctacccttgtcattgctgtgaaagcattttatgttaggcgtcaagaactggttaaagccccaaaggcattggcacggtcacgcgctatccagaatgtggaactaactaagataaacacccaacttcactgacaaacggtagagcggctgtaccgatgtctagggattcccgtaaagatagagacatgtgtgcttacggcgcttttgtcgtttcacggctttcctgggtgtgcagagcatccaaccgagatgaagcaaaactaccagtggaaaaacaaaagcgtgaacgaagccaagcccctgagttgttttcagctctagaggattcaggatctgtggccatgtgggcactgcatgcgttataaaaaaaactgaatcaagggaaaacgaaggcagagaccttcggaagagagaggcaatgtcactgactaaaacctaaccgtggatcagagtgaaaaacctgtacctgacagatgctgcgggggttcgttgcagctttatctccgggacgatatacgattacaagacacgaagttcagtgtagaaaggcttgtcacattgaataactttgacaagttcgatacggggcccatgcactacaaaaaagtctttttcgtgagatttgtgtctgtgcaaagtgtccacgttgtcggcattctactgctggcgttcgtcgcctggacgagactgaattcttaacggattttcatagtagcaagcgcagagtctggtagtacgaggagatgcgataacacgtcctggcttgcagtttctcttggccaattcggaagcttctttttatcccagatctagtgagctctcctactctttgcagatctgcaccttcatttctcacctcacaagaatttttatggctacgaagctcctcaccggtaggtccagcagagatgtaaaacggagatgtagtctacaacaagaggtgatacgaggaattgtggtcggggaatgcagcaactaaaccgaatagcagtattttatacaaccatgtgtctatcagagggagctgagctgctgccttgttcgcaagcgggcccctcaagaggtgagttccagaaaggatatgaccttccctcaagcaagcggcggttaagaaaattggccgttttcatgagtgtccgtttccctcgttttttgctcgttgtctagtcgttctgcaactcgttctctgtcccttgcggttatcggattcggcgaggaaaactcaaatgaccaccgtagtctatccgattccgggcagtttctcgaaaagaatactgcccccgtctgcagaccacaaggtgtgttaccgtgtttttggaaaaggtttgaccgggccgttgtcagacgctaaaggagggacagatatgtgacggtttcaacggcactttcggggttttcaagatttccaaatcacaacagcgcaggcgaattctgcgtcgatgccctttagagtctgttcgagttaggctcaattagttctggagttgtcctgctcatgttcagactccagttgtattctttgatgtttgtggagatgttcgcgctctgaggagaaacatgcccagtagatgagttgagcttttgagggaaccgttcgcctgtgtttccctgcgttctgacaaagagatgtgcatgtgaaagtcgctctgtcgctgtggaagtataatcgaactgttcatcggagaagtgataagcacataggaactccttttgcacacatacgcagattaaatgatctgtttttattgcttcgcatatcacatgagggagctcttttcctgaagaatgttctgaaaggaacggtaaccactgtggcacgtcccctttctaacctggctaaccacaaaacactttttgtcgggaccgcgatatctttatttttatctctacctttctccaaggatccggtagagttttgttcttttgtttcgggggtggtcgctcactgttgaagaacggacggagttctttgttcgatcgagagaaaacaagctccacctccaatgcagactagaacgcatgcacgaccgtttttttcgtcttgaaatcaagagcaacgtttcaggctgccacgaatgttccaccagccaatttggtaatatcactcgttgcactttagcgctgcattccgccgcgcaaaacaatctcccctttctcagcgaaccagcgatcgcagaacca

SEQ ID NO: 1902 - DNA, 1296 bp, Toxoplasma gondii
aggcgctccttcttcagaagaggaaacgcagtcactgtatgcccaagaaggcgcggccggggcgcctctgaggcagcggcgggagctgcgtttcggcgccgtcgctctgcggtttccgctcggttgcagggcgtctcgttccgctccaggagtgccacggcctccgagcctcgaagagcgccctcgaacgcaggcgacttgacaaacgccgccgctggctctccccctccggcgcgagcctctgcgtcgccgtcccgcctcgacggccggaagccgaggtccgcaggggcagcgaatcctggcgcgaaggacggactctctcccgcggcgaactgcgccgtcgggaccggtgtacagacactcgtcccggcggggagtacaccggcatgctgactcgctgcggcatgcggcagggtggctacgaggttttccggagcaggaaaaaggaaaaactgcggcggacatgcagagagggaacggggagccgatccagaaggcgtctccgcctggagaggcacgagcgccccgctggcgcagacggcgcgacctccgcccggggcagggacgcagacattcgacgtcccgggtgtatagacacctgggccgtcggcaggcaggtagccgaggggatggggatcggcaggcggacagcagacgggggtggctgcgcctggaaagaagcgcgccgactctggaaaggaggcaggaaactgtggagggagcgcgggtgaggcgtggaaggccagagacggatcaggcactgtgtcggcgaccagcggcggacccagaggcaagagactctggggagggagcgcggcgacggcggactgacttcggtcgccgggagcagcgaagagtgtggaagacagagacgcaggtgtctggagaagatgaggaccaagcaggcgggaggtttgacatcccccggcggagaccgacgcgaaggccgccgcctcctcctcccgcctgttgccggcgcggccaccaagcggagatggtccgtgagccatgctgagagacctcggttcagactgaagaggcgacttcgagaacggtccggtgccgggatttccccgaagaaggtcgagagctccagagggccagcgagctctgcggagagaagagccgcgcgtagtgtctgctcgacgccggattccgagaaagaaactcgagtttcgacaagaagaagagacttgagggcagggctgatgtctcggggaaggacgagcgagtcacggccattgaagaaccggagagaagcgtctcggcatggcagacatacgctctgtgagaaga

SEQ ID NO: 1903 - DNA, 4410 bp, Toxoplasma gondii
cgtgtttgatggagcagtattcacagagcattcaatggcaacaatccaactgtccgaaatatagtatgagctaagatgactttgatgaggtgctacttagcgtgtctacatcaaaacatgtccttagaaaggaagcaggagatttcgcaggtgaaggtcacagcaggcttgacaaatgaatgacacagacgtgagctgtcccttatcgttttcccgaaagaccttacgcttccacgaatgcgaggtagatttgcattgatcaccttccacttgtcaaggaaacaaaaaaatagggaggagtgtagtagcttccctcctcctcaactgcagaatcaccagtcatttagtggagcctacgcaacatgccatttggcctcgactggtgcagcagctgacgggaccctgagtatttattccgaggtgtgaacgatgcattccttacctctcgtactttctgttggatgcggcacagcttcgagaacacacacacacagagaaaccgcgaataacatttatgttgaagctggatccccttaatgatggagaaggtaatctgaaagggtggtacggaaggtgatttcccaatcaggacgcccgtcacgccgacatacaccagacgacatcgtttgatacaggacattttgatgcagcggcataaggatcttgaattagaacctaatataagccttcttaggccataggcctgttctgaaccgctgcagcggcgtcctgtggcagcagagaggaagtagaacggcatatttagtatggttccctacaagctctatcaaaagccgaataaaacagacagtccgtttgcaaagcagttgtgctccgagcaaatgtgtaagcagggaagtagctcagtttagctacggctacgttgacacgcgcctttaattaacacacatctctctactgggaaaaaaactggtaaaattacgcccaaaacctttcattccattttttgtgcccgaatagtcttgagttgctgtacgaccaaactcaccctctgagtaatactttcaggaggttcaggcagaggcatttgctcttgaggttcagtttcgtccgtcatcttgacttgcactctttcccaccgaaagaaaccgctacggcacagacacccgcgaaagcgaaataatgttttgcctgggggctagtcagaggaccgtcactccgctacctcaaaggaaggactaacagaagccgcgtgacgcccaacacatcgcacgtagttgtaggggaccaaaaatgcgggggcgcccgaataccgcacattcgtttccgaagtgttgatcaatcgtttattcatatgtaagttccaacaagcaataacaccggaccgccaaacagaagaagatcgcggaccatatgtttgaagaagcgaatttgcgcataactggggcctgtacagcatgaagacgggacagcgtctcaaagtaggaatatcgtaaccctcgatcatcgagagactccgtcgttctttggctaaatttgagaaacaaagagattggctgtcattgatacttccacaacactctaacttcgcctcgtgtatcatttttgagttcgacaaagaaatgtaacatgaattccagtgtcatcctttctagtatcattcagctaccgtcgcgtattgttgatcaccggctacctgcaccctcgcatgaagagtgacgcggaaggtggagctcttccttgttgcctttggaagtggccgagacagtgtgctcaaagtaacgcccgagtaaacagacgatctgcggtggtctgctacccagttaccatggagtcatgtcatgtctgcgtattttcacataggtttcctgtgttcctctcagctagccaagccatctgaacgtcgttgacagcctgctagccgcttcctgtctctgaggcaatcgcgacagatgttgccgccaagttgggcgtcgattcttcggtgttgtcggtgtataaaatgacttgtcctagtaacagctgtgctcggacgttcactgtgtgcattgcagcatctgctgcaacttgtgcttgtctgcagttcggttcactactcgcgctcatgaatgctaaggaagttgctcgagcgtgaagtcttcttatgtaacgttcgacacaactacgaaagtcagagagtatcagtctgcacaaaccatttgacgagattatagcatgtaccagatgatgcggattatagagaagcgaggatacagcagccgtcggtctgttactggtgcccccaacatcgttgttgaccacatgcagccgtatgaacgtctctctcacaaagctgtgatgtcctcaccattctggatcttcgagctcactgccaacaataagataaaacctttgcgctcccatcagacaaggagttaatcctatacaacttcgccgtggagtcacagcaaagtgggccatcatggccacatacgcgaccgcaagtcgaattactgtagaagtgccactgcgtattacatacaggttagtcacaagtcagtgctgctcatacgtttgctactttttcgatgcatcccacaggactatgagcccttcagttctccaaatgtgacttcgttttcactttaaagaaagccgtttgagattagaaaacgctgtagcggagggaagcataggctttccgtaaagcaatttcctttcgacttttcgtgtctgaatcgacgtgcggtttatacagccttcttccggtgttattcacggtcaaatagaaatctgcgggctggttgataactgtccaggagcactattgtttggtggagctggtactttcactcacaacagctgaaacagttacggaatttctgtttctgttgtctaccatagctgtcctggcagttggtaaccattagcgatgtcgataacgaatgtgacgccagaagtgctaggatggccacgtgccacggaggtggcaagtgaaacggttggcaggtgccttctgtcgctccccacagaataaagtactgggaatgaaccaccttcactgcatgaaactttcttctcgagcatgacctcgcgagaagtgaagtcacatctgcgcttgattgcggaaccttatgattgcgatcgctgctctgtcacacggacacgcagtttcacatccagcaagattaccgaacagatatgacaaagtgccacaaaaaacagttccactcactggctctggagtctccgtagtcgtgttaatgaattcaccttgcaatgtgctcctccgacgtacttgcctgtcgcgaaagtctgcaacgctcctgcctcttgcttcacactatggagcgcaccggctttttggtttgatgcaactctcacacccaaataacgcagcatcagtcagtcgggttgtaacccccacagagacgtttgcgttcccgcagctcgaatgcactccgtcgaagcgaaactaggattctctacaccagttgtgttcagagacagcgacgatgataagcatagcaagacacatacttttcctcttgcgtaatcccgctaacccgacttcactccccgagtgtgcacggcacagagaacttcccacattatacgtgcaacgacggcttcaaagcatcaatagacaagcactcctccctcatcgttacacctctccttgtttccggcatcttcacacttgctggcacacaacagaagcaactgtggctgacacgtcatagcagcaacactttcgtctcgatccgaggcgacatgaccctattcaaacaaggtcccagagctggtgctggatggcatcatccaaacgggtttctttcttgacgaaaccgtaacgtttgctaaactgtaacacatggcgctagggtgaaaagatgcgcccgtgtttcactgaagacccaccacgttgctgctactcgcagactgtggaagacacagaaagccatttaatgctgaatgaccatttttactgtctttatcctttgtatttctttcactctcaaagtaacttcaccctacggataggcctattagcaagcaagctttccgacaggatgaaaatcatatcctctgctgcctagccgcgttggggttggtgttgccaggattttttcagcggcaacggggttcggtgagcgatgaagaggtcatcgccgaagcctgcgaacgtggctttacagagcgtttgattggacagtaagctccaagtccttttgcaatttctttttttgcctgcatgcaggcagttttaccttgctgttttttaccggccacccaagctgtgtcttttccagtgatcgaggtttgtcttgtcaaacgcagtttgagtaagctagcgtgtcttcatgcgatgcattcggaaatgaacaacatggatactagtccctatgcgccgtttttcgtggagagacggttcttcctgactttttctctttagtttcggcgggacta

SEQ ID NO: 1904 - DNA, 2800 bp, Toxoplasma gondii
ggagagaacgtttgcaagtctggacgacgcggacaagacaacatcccgcgagaaggaagcggagggagaagacacaggtgcagtgtcgctgcctggggggcgcatgtggcagcagcagacaaggagccaagccgctgtgtctcccgatctctcctgtcccctcccgcgaccgcgtctccgtgagcgccggacggcggggcctgattcggtggccaagtagacgccgtggcggggtgatcacggaggcggtcgagagtgacacttgcgcggtagcccaaatcttctatttggcggcgaatctcctcgactgtcacagtaggtgacgggaacgaagggtcgcacgacgctcgatattcaaccgtcgctgagtctaggatcagattgacggtgatcgacgtcacaccaggcagcttctgaacgtgtttttcgatgtgtctcgcgcaagacgcgcaggacatccctggaaaaagaaaaaaggtctcacagactcgttcgcatgcaaacgaccctcaatcacaccgctcgtcaagggaaacatgtgccacagtttcatctcggtcggggcagaggaatcggttgaacacgtttagtggtgaatcctaaagtattgagctggcggttcgattcaaaatccacggcacactgctttagctggagagacggacgccgatgtgagctgcgtggaccgcgtaccccgggacggggaagcacgcagaaagcgacgcccattcctcgtcagttcacacgaacacgatcggacgggaagcccgaacggagctaaacatgctctcgagaagctgcagctgacctagccgccttcaagaacggacctacagacgcatttacagcagcacattcatgctggcgtgtgcgcacctacacacatttatttttttctagatgtaaaggcttcgtgtctcagctgcgaatgaaaaataactggagggcatgcagacgcggcatcgaggagcaaaccgcggtgaagtcgaaccagctagcaaggatggagtcactttgcctctgatcctcggagtgcagcggcacctccattcagctttgtgctcccttgttactgaagacgattcggacaggaacgactggtcacgatcagcaggagtacctgagctgagttgaaaacgtctggtgacaggtttgtctcaccttcgacctggagttcggcatagtggagctgcgccgtggaacgcgcttcttggcctccgtacgtggcatctgcgccgcgctgcactggcatggccgtctcgtccgctgcggcgcaagacgagggagaggccgaaacatccgccgacgtcgcagacgacgaagagttgttggttggggcagcttcgttcacgagcgacacgtctagtccgagactttcgatcacggcggcaatctgcgcttgcgttacgataccgcgctgaaagggaagagacaaaaaggaagggaaacggcgagtgacaccagaaagaacatgcgagaagcaacgaatacgcgtcatacgagacatcgagaagaaaggcacggggagagacacacgcaaataagaggcatcaaccggaaacaaaaaagagagacaacacacccagtgtgccacggttttcagagaccgtaccacttgctcgtggttgccagggcgtctaggcaggaatgcatgttgggagtggcaaatcgaagagacaaagcgcgtccacagcaccttacagatgcgttcgcatacacgtatacatattgatttatttctacagctgtctttaccctgctgcacatcgttgcacggtaatgatacgccggtgtctgtgcgactgtccctacgaatataaatatgcagagccgaagtttctttcgggtgctgggacatttgacgttcagctttcaatgccttactgcagcagagggtcttcgacagcaggcacccgaagtggaaactttgacgcgtcccgcccgaacatcgacatcaacggcgagaatctcggacgtgaaggtttgtttcactttgctttcgatattcctggcgcaattcccgcaccgcattcctcctactctgaattcccatacgttgaagggaggagactggggactagatgcggcggggaaagggacacacgcagaagtcgagggttctcctgtcgggggctcatccatttttatttgttccggagaacgaggtacggggacaagctgaaactaccgagactgcggcatgaaaatcggtttcttgaagcttcggagtgcggaattttctggagtgagatgaaattcatgggggaggacaagcagttgacgacaagagtctctacttggaaactttgctagacaggaacagcaggcaactcaacttcgcgcacacagcgacgcgaagttgagcttcagtagcgcgcggagacgggatgtaggcgtccaaccccaacacaagggggttttagatgcaccgtgttcagttcgcacgtaggcgtttcatccatcaccgcgtgtctgaattgccaaaaactggtgactctggaaggtgtcttgtctaactgagttcctcttgtcttacacccttcctgcgggtgatccgaccccagcagttgtgcccccctccttcaccgctgtcgtgtagggaggccgatagagtttcagggcgcacaaagaaagcgacgtgccaaatgaaggtctaggtgccacacatattgtgacactcgacgttttcaatctcgtgttgaggctccgcgcaactggaagggttaattgcataagagctcgcttcagatcttgggcttgggcatggcgaaaagcaaatgagcaagcaggccgcggccta

SEQ ID NO: 1905 - DNA, 1502 bp, Toxoplasma gondii
aaaattcaggaaggcacagcagcgcttctgcatgcacaggtgaaacatgcggaagagacgagcgagagcaagcaggcagtccccacctgcagtatgtagacagcgcatggagcgatgatttgctattgtgatttgttcgctttttcggtgtgccgacactggcgtgagagaggcatctcgttcaccaagaaggacaggcactgcgtgaggcctcgagagaaaaatctttttccgcgcggaggaacagaacgagtctgtatctcgtgacaggcaggagtcctagggaagcataggagacagaagcaatgctgcaggcagcacagtttaactctggagaaacgagcacaaaggaaatcctttttaaatagatatccagggagagatgccaagtgccttctccgtacgtcgtcgctccctgcgtactctaaagtcgacgaatggctctagacagtagagactcagctttccctgttttccaaacttcacactaggcagcgctgcggtgcttgtcgttgaggaatcgacgaatgcttgttactgttgttctacttgcctcctgtcgctcgtctttgcgtggaagcgcgtccacgaatatagcgctagaaaacagccgacagttcgtcagaaacagagagaaagagctcgacagagtccgcaacgagaaggggaggtcgctgcaactcgacagttcctgttgcccatctccctctctccgtgtcgattctcgttgtctatcacaagaaacgagggaagcctttgcgcagcaaggttacgctcattagacgcgttgacatcctaggtgttgaatcgtatctgcgggacgttcagaaatccgcagagttgccccagagacacaatcgatccgtctgcggagacagcaaaggcccccttacaggaggcactctgatgagagcccagggtcgctgtgttggtggttttcatggcttttaattggcacacagcgaacaactctttcgggaacagcagactgcgacgctccctcgaacgcgccttcgaggtgagagaaaacatgacacacctctttctccaagtcaccatgaacgctctgaaaaacactcaacgccattgacatatatacacaatatatatgtatacacatatatctatgtatatatatatatatatatatatatatatatggtgtggggttctgcggctttgtttggttgtgcatgcagcggatatttgtgttcatgatatgtttgtgaaactgctgcacagggcgcgtaggtggagggcgttagtctccgccgtatagagcccgatggtcttggggataattcactcccgctgtgaggaacatgcgtcagatgaagagtgcgaagcaccgaggagcggcctcaaacctctcctctaaggagaagctttctcttcaagatagacggcgaagctggtcatcagaaccgcgtatggctttttattatgcgtttttttcaagacccacaaaaacagaaaggaagcgccagtcacaagccagccaa

SEQ ID NO: 1906 - DNA, 2546 bp, Toxoplasma gondii
cttcctctttctcctcgtgctctcctgcattccttctcttctttctcgcggctttccgactgagagactcacgggatcgccgcggcttgtccgccgagaggcctcggccgcgagaaaggagttgctgtgaagcgcctcgggtcgaaggtgccggcgaagctgcgatggccgaatggagaggagacgccgccgagactccagagcagggagatgcgaggaacgagaccaagacgcatgcagcgcagaaactcgagcagccgcgtctctcgaggtcgactggaagacggagggaaaaggatagagaggaggaaacaagacggaaacagacgcaaaagaacaggaagcacaaagagaaggcgaagaacgagaacgaggggaacgaggagacgagggggaagaagaacgagacgacaaagaagaaccaggtggaaacgaggaagatgaagagggggagggagaggaagacgaagaagatggaagaccgggaactccagaagctgccggagaaaacgcgagagaaaccggtggagaaaccagtggagagagagacgaatcagaaaactgaagcgacaacgaggcagagaaatccgacagcggtgaaagccttgttgacccagaggacagaaaagaaggaaactggagtgagaaatgtttgccctgaacgaccgcagagacaggaaacgcgacgcgtagcgaggcgctgcatatttcgcgaggttcgacaggacgaggaacggacggggaaagcaaaggccagacaggagacacgagcagcgaggagagagaaagaactcgaagaagaaccgacagagaggaaatcattgtccagagagccgaagtttgcgctcggatgaagctctgtggaacagcgtttttcgaggccttcgagggagaggcaacgcctcgaagaggcgagggagacagaagagaacgagaaagacaacggaggacagagaggacaaagaggcggaattgaaaagagcgctctactcagcgcagaagcacaacgcgaagaaagcagggtacgagaagtcgagtctttttgcctgacagagagacttcggcgaacgcgaggggcagcggagcaaagggtgcgtcgagagaaagcggacgttcacttccgaagaagacgaacaagacttggcgaagcagaaaagaagaaggagaaagaggcctccgttccactctcagaaagcgcccggctgccgcatcgaacaagacaccgaaacctgaatttgaggcaacatgcgctgcaccgcttcgattgtctgcatgcgcgtcgacgacgtccagacctggttgagtctgcgttttccttgcctccggggacgaaagaacaaagatggaacattcttggaggagagatatgagaaactgctttttcggaagacttctctcttgcacagaggttccctctccctcgtaatttttcggaggttggagacagtctctgtctgcttcctcgccagcttcgtcagcgacgcatgcgcgacgtccagagactttctgtctcctgaattgggggggctcatatccccctttgctcgctttgcattccatttgctctcggctctcgtttctccttgggtctcaaacctcctattcgctgcggccttcttgacctgcctcggttctcaagttgctctcctctgttcgttctccctgagcaaagacggctcttttttttctccgcggtctttgcagaacctgccgctgcaccaagacctttcgaaacgccttgcaggctctctgtctgcgtttcgatattcaagagtctgcatggcctgtcggacctgcctctctgtgctctgtagacacacacagccggactgctatgtctctctaatgcgtttctactgcatatatatatgtacgttatatacatatacatataaatataaatatatatatatatatatatgtacaacgtacatctatatatgcatatatatatatatatttatatatacagagatatagatgccaacgtgtagttgtgaatgttcatttctgttttctctgtttcttaaagacaggaggtccggacatgttgcagatttgctgtggttaccacgagagcgccgatccgttgcctccgctgcagttggaaatgaaggagactttttctttgtcgactgaggctcctgaagatagagaatttctcggcaaatttcgaaagatcctctggagcaccgctgtcacggcgccgccgcgaacagcgcaggcagctgtgcatgcgcgcgcggatggcccatctgcgaagcaaggcgaactctacagagaagagagcaggtctcaggccatgagtgcaaacaagaggagagtgtgatctgcgacggccgctgcaagagcctgctgaagccgtttcttcttctccacctgcgccttctcggtgacagacccaaccgctctgctccagaggcagagaacaaccttcgtctctcactcccgacgagacgctcatacgcgaaccgcggcgagactgagcaccggaagcagaaggaagaagaagaacaggaaggaaaaggaaggagaagcaaggaaga

SEQ ID NO: 1907 - DNA, 1915 bp, Toxoplasma gondii
agaagatgcacttcattccgtctcgcctcttgtctccttgcaccttcctcgccgctctctgggtggctgcgtcggctcggacccgctgcatgttccctctgtctctgccgctcctcgagcatcagtcgctcgcgtcgtctctgccggcgaatctcctctctccgcttctcggcctcctcctccaacgcggcatcagtcccggcgcccagctgagaggctgcagcctgggcagccgccgccgcgtcttcgcgcatgcgcccccagaatcgcgcaactccctcgagcgcgttgcccccgagctcgcgggcacgcgcccgcagatcttcggaggagagatcggcgccgaacgaccctgtcgcgagaccaaatcctgcacctgaagctcctcctgcctctgaggtgtaaacgcgtttcgcttctgcatcagcgcctcgggtagcctctgcagcagaggcgaggccagggcgcctcgcggcgcggctgcggccctcggcgcccgaccgagtgtcgaggtcgaataatccgtgccgaggatctccaggtgagagagaggcggcgccagggccgcgtctgtggagatcggcttgcgaggtgccaggcgaattgctctgcaggcgacgacgagacgagcacgcagagtcggaaaccggagggcgagactcccctgtgtcacggaccgcttcctcaaacgttttatccagttgggaggagaccgaacgcgcggcctccagcgccgacttgaacagagaatgcatttcggtaggccggggcgcgccgcaacaagctggggaaccaggtgtatgtacactctgaggcccagagtggcgttcgcggcgcgcgcgcgtccaaaaaatcgcagggttccctgagcacgaaaacgtcggtggtgagaaagggcactggaggcgattatttcctcggcatcgaggaagaagaggccgagggtgcacggacggggggggagggaacagtcagcaaacgcggaacgacgaccactcgctcctcagaaggcacgaaaccgtggttcaggacggaaggccgggaaggcgggcagagcggacagaggcgtctcaagcctcgtcgggagagggaaaagccgcagataaacctggaatcggagagaagaaagcgcggacgaaaggacgagaaatgaacaagacaacgggacagtatccggggctggaaaaagggatggagggcgacctgtgctgaacttggagctcccagggaaacgatgaggcgcacggtttccaaagtggaacgctcggaaaaaaagaaaagccgggaacttcactaaagaacaaagagagttcagcccttctctctcgcgtattcaggacagccgtcaaccgggcacagacgcaagaggcgggttcaagaaaccgacgtctcacatcgaaactgaggtgcagtgtaaaataaaagcagcagttcgttctacaactagaagagaaagcgcttccgataaaggacagcgccgtggcaaggaataccctaaccgcgctagcagaacaatgaaggaaaagccgcgcgccgatttgcgcgcgacgttgcagagcaatctctcagttcacggtgtttcccgttggaccacatgcggagtcggaaaaaaccgaagcgcatgcgcttccctccagaagattctgacggtgagtgccaggaactgcgagagtagagaccccaatcttccagttgagatctgtttaaaagtgagtgcgcacactccgccaaacaaagcaacgtggtttcagtttctcccccctgcggaacgacgcatgcgacctcgtggtcacttgccgtgagcctagtgaccgcaacgtctgcacgctaaaccgttaaccctgaactgtcacaccaatggacactgtcaaaatctctgctggccattagacacatcgatacatcttctgtgata

SEQ ID NO: 1908 - DNA, 4013 bp, Toxoplasma gondii
ttgaaacagtattggtatcctgaacatccgccgctaatgacgcgaaccagaagccccagccgtggtgctccaccactgctacgcgtgctacctttggctgcgcttgaaacctccacagtctgctgctgtgctgtctccgactgaggtatggtggcgtctccgctgcctcgtccccctctgtctgctcgttgctgacattgccgtgtaggagacacatgtgcgtcaaaaatggcgtttttcgccttcgcatgctgaggggtggatcctccatcttgctgccctggaacccccaccacactcgccgcccgattagcacctgaatatacaccatgtgaaactggagagtcacactctatagcacccattctacctgccgcactgccggtttgagaggcagcggcgtctgccagcgcttccgtttctcttcgtttagcccaaatctcggtaagtcgcttgaccgccgctggagacatgtggataacggcatcgccatctcctttcagcatcaggcggcctgtctgtccgccccccgaagccttgaaagcctcctccctaggtgacctgaaagagaaaagcgatcctgcgtcatgcgcgaaaaaccgacaagatgaggttctcgcggagacatcatcgcacttgtccgtcaacactgctctcggtagttttctttgaggaagaacaccggtgaaacccgactgctgcctaccctgagaatgcaccactgcggaagcggcaaacgccgaagacgaacgagtagagaaaagggagcaaggaaaacgaggaaaggaacacggttcaccgtagcagataaggggggatgtggaaggagatgaaagggaaaccgacttagtttttggtaagaaaaaaaaccagccgtgagggtgtcctctccgccttaaaataacatgggcggccatgatggaactagcgtggcaaggtacagggtagcgcgtggagatacgaacacatgccgctacaacacaggaaaactagactgcatcattgcggttaagccatttgtcagaaaacgccgacgcgctgcaccggaggcaccagtccaacgaggctacagctggaaaggagaaaaatgcgcctttctcctgcgattcacggacccgatgcgatggtatcgtgcgaaagaatacgaaagaaaccagaaaaatcatcgagaaacggacatgatacccactgtgaaacaaggctttgctaaagtaaaccggccgcggcaccagtagagggggatgcgtaccttggtatatctagataaatgaacaccgaatcaccgcctcaaaactcccatcgtccgtatttagcggcatactgacagcaaatgcaactgcgtcgtagaacgacagggaacaactatttcctgtgaggagccttccccctcaaagaactggaaaaaccgacggaggggaacgcgcgctcgcttctcccgaacagagtcacattcgaaaaatgcatcgaggaaacccgataaggctgggtgaaagaaacgcacgccaaaggggagcgtcctctggaaaacgaactacatttatcgaccgcggatcgcggacaaaaagtaacatttcatgttctcagcgacggatgtacatgttgtagaccggcgcatatttgcgagcattgatgtcgcgccagagctgagccacatagtaaaccggaaagaaaaggattataaacgctggcaaaacaagagactcaaaagcttcttcttccacagagaacacataagtgtggcgctgctctgttccatcccagctacatcaagcgacctgcttctgggcgccctcagccccataggacccacattcgttcccctggcgcaatactggtttcgctcgaaaccgtaggcagcagatgggtaactgtcaaacaagattaactacaaagtagcccgaagtccacgtgatggacagcaacgccgaagttgtcgcaacgatgggcgtggtcagcgtacggtggccatctttgcggtattccaaggacggatgtcgctccttcgaaacgcagaagcagtcttctatacaagagcgagagctaaaaaggcaagcgttgattcagaaactgagaatcctgtgaaacattgtacttgttctgtaacttcttcaacatttcttccatcgtataatcccgccttgcactcggcttgtgtgtcccgccgtacaagtttccaggtgaccaacggcgccgcagcggtacccttggctggtgacgctctgatatttgcggacgcacttttttctacctatttacctcgtgcaaagccaagctacactcgatctgagccgaatctttctgaaaagtgaggtccctttgacctttatcttgcagaggaagatatcggacacgacacctagatcggtgaaacgcacacgaaatgcggtgtcgatatacatctgaaaaaacactgggaacagattgagacgatatgccggcgaataaaagaaagcaggattctacatctacctcgaagtacggaattgtatctaagaggatgatcccgttcaagtatggacgacctcgtgtctgcttgcctcgatattcacgtcgcatattctaagtgcgtttggggtggcttctgcgcgaagacacatgcacgtgattattacattttacacgatagtggtaattattccgtagaaaaaaaagactgaaaccactagaaatatcagcagtttttaatgaagttttgtggctaaacgcacctcgatcaaatggaaaccgaccccccggtaacctcatggggggtgtttcacctaaacacctgagtaccaccagtggtcctcctgcgcagactcgacaaagagctaatctcaaggatctatttctgaacagatatcaaaattctttttctgtacagggaaatgtgttcaaagacatacacaaactttacaaatttcttggtggaagcatgaagttgtggtagccggagggtctgtataggtgtcacacacccccttcggtgtgtgtggtggttcttactacctcgaatagttttcggctggactgccttgtgtctctgcatacgccgacttccacgactgcgcttcgaatacgatgcggccgaggacacaggcagcggtagttgtctgctctgttgttgcgttgccaagtcacgccggcgactccgaggcgcttacgtattcgattctcagggttgcgggcgccaagagagcgagagattcgcacgcgtgcagagcggcaagaagggggggttccaactcccgtgcaatgggtttgtcgtctagtctcgtttccgaaaacaataaacttccagccttttcggtggtccttgggaggcggaactggaatttccagtgctcttggttgtacgcgacatatcctcatacacggatttgcgtacacattatgggtagatgaaccctgcgtggtggttcctctacagtttttctcgctttcatctctgggtgtgtttgtatgcctcccatcttcactccttttttcgagccgatctttttgttcattctacatatctgagattatgggtttttgtctcgtgtcacgctcaaaaacgtcatttttctcccgggaacgttgccggacaagagggcgggaggaagagaccagccagcgggtgaagctgcctatctcgcaaaactccaccttttctgtttggccttttcttttctaaggcagcttaccatcttgcatgtttgtcaccctgtgctctacggtccttccctcctcacgcacgcagttgtttgcctcccgtactttcgttgtttttcgtccacccaccagagttccgacagttgttctttgccactttgatcgaatccaaacccggcgccgctaaacagttgcttttgtcggtctctcacatcttctccttttcttccgtgagcgtccttgcttccgtgtcttttgagactctgtgacgcaccttcctttgtctaccgcactctcaagtgtcatcgtgcggcccgtcgtctcgaaggtgtatgtacagctgacgctctggtgcagtgcgcatgattgaaacgcgaaaa

SEQ ID NO: 1909 - DNA, 3040 bp, Toxoplasma gondii
cgcggtctccttccaaatgttagtctgtacggaatacttaggtctatctatttatattaacgataatggatttggtaatggtctatttatacttactggtatacatttcagtcatgttattgtcggtgctatcttgggaaaaacattttaagtcagagtatgggagttttaataggggaatctataggagagcctgtgactcaaatgactttttttttcattccactgcttatgctgtaggaggtcttcccctccttcaggcgccggtgcgacgaccagtcgctcgacccattgaaggtgcctgtgtttattcattctgggttgtattagtgtgaacatgcagtatcactgagtttaacagtatgctcctgaatgtaaacaaaggactcctgaatggttgtcgatccagtagctatccgcacacctgtgggcactgtggcacacacacagctttctctgctgcttaaacggacaattttcgtcactattccatttttcagggtcactgcatgagactgtcacaacattttgctaggtttacacacaaccgttgcaccacttcacgaagtccttccgtaaatgacccctctctgcgttgaagcgtttgcaggcagaactgcagcatgcggaagtagttgtgtgtacgagcacaatggtgagactcgcctggacgctaaacaagaaacgtgcttgtggaagcgtctctattttgaaagggttgcttttggtcagttgcttctcgtccatgtgctccgcgtatgttcatgcgggcttttgagtcctagagtgttttctaatagtgactcgttagcgccaagagttcggaaaccgcactgcaatcgcacccacgagctcgtttgaatcttttggcttgacagccggatcttgcagcggagatggttgttctttttctctatatggcttgtgtggtgtctgacttccatttgcagcagcttccactcttccaaattctcgataattcagttggtcaaaaagatctcgtcgcaccaccaatcgccttacgctgctcatcactggccggatgccacaataaggtactagcggggaagtcccagatgtgccaggttgtgttgcttctgcatgatacagattacagatcggaagttaatcttgcaacctggtgttcagatgagctaacattaaacattatcgagcagttgggctaaataagggaagtccttactagccactggtgagttctgactctgtggaattctcattttccgcagatggaagatacgagggacaccctttcctgacgaggtgaaagagcctcgagtgtctggttccgtgcgagcgaatccgagaacttgccaagggaggagggactcacttttcttctattccgcctgttcgatggaatggaaaagttcggcgcttcatttaacgatcgcgaaacgagccgcaggcacagttctgacaacgtcaccgtggagctacgttacccgatgcgtgctgttcgcctctgttgacaggaaacctgagtcacgaaatggtgactgggggacggcctggcggtttttctgacgttatgcttggtcacgatggcctcgctgttattgagagcttccaaactgtccagacggtcccaaacaccgacagacagaaagcgttttgttcggcgtgcaagcttggcgacctcgattcagtcaggcacatgctcgaggaaggagacgtcaacgttaatgtatgcatatcatccgaggctaattttgttttcgggcaggttactgcctctgtccttcactttccttcactcgacgttgctccagagcgtatcgaactgcttgcgtgaagccgaaatcagtcgtacttttttcggccgcaacagaacggaggaagagttgttctcggtcgtcgaatagctgatcgcttcatatttgcacagtgtggaaattcatggtccaagtcgtcagaaagcacatcttgcgatgcaggagactgggtatcgcgaaggtgtgttgatgaacaacggggctacgtcagttgggggagcattattgaaactctgaagtcaagaccatgcaagcagttaacagtttgtgtattcttgggctaaataacaaactggtttattttaatcgaccgcctacactattagctcctacgcatcttgtgtattcctcgtgccttgactgccttctgtcctgccctcggggatattgcctctgcaatgcagttatcctggcttggcttcccgtcggccttagcacttctcttacacttgtcgacttttcgttttctctctacacagttgcgagatgagtgggacgcattccctttgtactacgcctgctacggaggtcatttggatgttgtgcgactgctcatcaactacggtgctcggtgccaccctgggacatttgacggagaaaggtaagcttccgtattctaattgtttctacccaatcataaggtagagtgcatgaacgtcgtgcttttcaaacacaccggcaaatggatctacgtaaggcagatcgtgtagcaccgtcatcatttctgtgcttccacatacacaataatcggatatttctgaggcatcacttttgacacgtttcacctctcactatcattcgatatcttttgcttcgctgtctttttggttaacccggaaaatcgtgtctagtttgtgtgtttgtgcacctgaaactgctgtaaaactgtcgagtactcttcctgaaaagagagaacagtctccgtccagtttgcaattcccggcctaaagtgctcattaaagcttgtgagaaaccgataggaggcacctgttgtgcgcaacacagaaatgggacgctacgtccagacgttttgtgtgcaagtctcgttattgccacttcccgccaaatcagttgacagcatttcttcggtacctcctcgctgccatccaaagttctcttattctgcttttgtgttggtcgaggcctggtctgggttgcccatcctccttcatgtgttccctcgttcaccatctccgtccattctaattgcttttttgttcctctgtactatggttccaggtgta

SEQ ID NO: 1910 - DNA, 1974 bp, Toxoplasma gondii
aacattcttttcattgttccacaacttctttgaacgtcaaagcgacacgacacccctttttcgctcattatcatcaggcggtctcaacgtgggcatctcatatctcgagcgtctgaccctctcacgaggagactccctgctgatatgtctctgggtcacttgaaacaacgcggcctacttgttttttgtggcgggaacagagggggcgcgaataactggattcacagatcttcagtcaggaagagttcacgatccttcgtcagccttctgcgcagacacttcgttgctgccgccatgtctcccctcagccctcgtcacctctctgtctctccccgcctctcctccgtctggattccctgtctcttcggctgcgtctccggtgagtcctcggctttgtgttccctctatgccgcttcttgttgccttgtcggacgcgctgtatcttctttcgaatgtgcctcctctcgcttctgtcgctttttaacggacccctttcagcaatgcagcttcccagcaaacatggatggccgtagagtgttgaaagccgaagcgtttagctgtggacccgctacctgcgaagagagagagcagccgagggtgagaggactacagcctgcggcctcgcgagcgagatggctgggaatctcgctgtaatgagacgaacgcgttttacgcacttaacatggcgcaagggaggaggcgagcctgggagcgggggaaaaacacggggtcgagagacggaaacgaagataaccagttccttcaaaagggaaagaaacttttaagagtttggaggaacaacgccgtggcgtgtggccgcggaaagagaaaagtgtagacccgtgtcctgtttgctacttacacattgcgcgagcctccagtcgggacagcagaaaaaaggaaggcgcccgcaaagcgaaagcggagaaatgcgcagattgctgcttgtcaactgcacagaagagaggaaaataacccagagtgctcgacgagaaactagaagggatgggagtccacttcgaagtgcgagtacggaccaccgtgccgacgcagccgagctcactggctacgcatcgatgtttggaattctcgaaagggccgcatttcctcgtcaatacaccctcaaacaaatcctctctgggtctccgctgctcctttttcggggctcgtcccctctcttgtgtgcgtggcttggctggttgatagagaggccagcggacaggtcgacacaggtcatcgctggttgaccgaatataagctgcctggcaggcgcgcaaagacctagggtgttccaagcaggtcatacgagatgaaaaggcgaactgataatggttgcatgcagcagacagcgagctgacatgcgtttccttgtcttcaaaaagaggcgaagaagagagcagccccctcgagctggaaagccagttcttttcaggccgagcgtgtatctcagttccttggctaagaagtgaaaagcaagcaacgaagccgcgagacgggtccgagagagacttgaccgagagaccagcttgtgtgcgaaatcaggcgcggtgagtcgcgccgcgaaggagagcgagcaggggaacggggacgaggatgcacacaccacgacgcctacagagagagacagaggcttcaggagaaagagggcaaaggacgcagccagctgaaggagcacgaggcgaagagacggcagaagaaaggcgtcagcgcgctccaggagacaccgaccaccaaagtaccggcaacaacggaagatgggggacggaaaggaggtccactacaggaagggagcagatcatgaaaagagagacaactcaaaagaaatacaactcaaaaaacctcgtacaacaccgagttttcaccgagataaagatgcaactatcgttgccttctgacttgcgatcgtcgttcgctccctcctgctctgcctcttcgtcttcgtttctcgtttgccttccctgctcctctgcacca

SEQ ID NO: 1911 - DNA, 2392 bp, Toxoplasma gondii
ttccgtcgacttctcttcactccatcgaggcaaatgaaacacatgcgtctccctgcctctccggaagcggcgctgctggactcctgtgacagaggcgtctctgtctcgtccactggcgccgtcacatctgccattctaccccaacacttgacaagacgcgaatcaagtcggagaagaagaggaagcagagaaagaagagacagagctcggaatggacatgcacacgaaggctcctcgcactggatatggaaccagtgcgcccaggtaacgacacccgtatgactacataaaagtacatatagagatgtataggtataaatatatatatatatatataaatatatgtacgtatgcgcttggatcatgtacaagtggcggtgggactagtcatacagggaaagacccttcgtctaccgtgaggtgaaggagcagaaacaactagagagggttgtgcggtccatgaccgcgagtcgaagagaaaggagcacagcccgcgtcgcgcgtggcaactggagaaaaaaggaaggcgacatatcaaggcggaaacgaacgcaaacgcaacggccaacctgaaatgtacgagggaacacctttaggtcaccctgtcacttccagaagcagcattcgcgttcccggggtacatcgaactcaacctgctgtcttcaccgaccgtattcccaagcagttgaccgaacaaatggcttttcattgatcccgaagaagcagactgagaacgccgcccgccggctagttccacaagaagcgaagccgccaggatctgggatttacagcgttccctctttctcctcaacctgagtttcgcgacgaacgcagccacaaagctgtcaggagtgccacacacatgcgcaggacatgccagacaccagcaaacaagaaaaactgcctaaagaaagcagcagtttattagaaaagagactgaagcgcggctgaaagcagcccggttcccgatggggcgactcatctcaaagtcgccacatcgacgaggtaactctgcgatcaatagtctaacgaaagacataaagtgtgaagtgcagcaaaggggacgcaaccatggtgacagcttcagagttgtgagctaacaaaaagatggaaaagtgcaatctgcttcaagagaacgctcgatcctttgctacagcgtttccagtgctggaaacagagctccgaatgcatgcacgttcactacccatccaaccggccttccgaagaaaaccgcgctggaggtttcggagaaaatcgaggacgggtgtcttgattttactggcttctgttggagggtttaggtttgttttcaaactcagcaaactcgtttttcctttcgttttttacgtgtgacacgtcaagactcttctgtgccagtcgtctgctaccactgtagcgtctggggtattcgctggaggttcgtgccacacagagtatgcgcttttctgtgcgcaggttgccggtggaacgctcataacgaaggaactgttctgggttgtcgcctcaaaagtggattcttgcctgcctggactgttctgccgcgtgaaagtaggtttttagcggctacccaccgtacgtctgttcctgcgcgccaaagatgtctgctgcggcacccgaccgagtgcgttgcctgcacttgctgataaagcacaacgaatcaagaaacccggtctctcgccggacgaaccaaccggtgacgaagtcgaaggaccaggcttgggacgaactatccgtcctgaagtccagcgttcgccaggaaaactttgcgcagcttgcgaatcagtacagcgactgcggttcctttcagaaaggcggggatctcgggtttttcacccgaggaatgatgcagaaaccttttgaagacgcttccttcgcgcttcaagttggggaaatcagcgatattattgataccgactccgggttgcatctcatctacagaattgcgtagattgtgtggcgtctcggaaatcgctgtttcgaattggctctactagggggtgaccacgtggtgccagagtggaactacggtagaaattgctgttgcgaatctgtgtattccgtattggtgagctggatagttgcgttgtaaagttcacttcgcaaccgcagcgtatcctcgcttagcaaaacgggcagcagaggaggcgttgacgttgcagtttcgttgacccgcgagagggtagctcgttgcattggggagaaccaggcggtacccatcgaggatagagttcgtttgttcgatacaggcgttccgacggcattgaggggactgagacccctccggttttctaccgtaaacagcttgcacatccagggtcgcttgcgtttttcctcatgcacctgaagcgcggcacacaggccattactctattgttttttcattttttcacaa

SEQ ID NO: 1912 - DNA, 2289 bp, Toxoplasma gondii
agaaaagcacaacctcacgaaggacggtctcgggtgaattcacttggaagctccacgcagcgttcgtttgtgcgtcgtcgacaggtccggggagtctcacggacggaaaaagttttcgatgtcagcagagagagcgctgcaagaggtgctcgagattctgccgttttctcgccgacggactcgctagagagagagacagagagacgtccgagtgaccctgcgtctcaggtcgcgctctgggaggcttgcagcggatggacccctagagcgaggagggaccggagcggtctcacttgcacttggcgcttgcggctgacttttacgttttctttgtctgctgtccgcagagatactccacgcgtcggccggcgaccttcgttgcttccttcgcccagtgacgcagcgaggagacgcgcccagcacacaccctgtctcgactggagaagcggagacgcggcagtccccgtaaatcaccagttctccacttcgccgcgaccccttcgaggagccttctctgcaagacgcctctttccgtgaaggagcatggaagactgtgcaagatcgcgcgcgttttcagccagagaagccaatttccttctgtaacgcgtcacgcgggtgcaccctcgcagacggcaagagtttcctcagtccgagaacggcgacttgcacaactcgaggcctcgtgaagcgcggattccacagacgcagagccggacggccgtggagcctttgcgtgggcgtcgcagttcggtcctcagggcagaacggggggagcgagtggattttccacgagacgagaagtcaggctttgcagttggggagagtttctcggctttccaaacgaacggggaaacggtcgcgcagaacgcgtattgcggccgtgcagagagtcgaaatcgacgcgttgagtccagtcttggacggcgtcacggaaaaaaaggagggaagagaaagcagaagagcgaccgcgagaagaaaaggaggagagtgaagaggagaggagacaggagggcaatcttcagttcacattgcggaggaaacgcatttgtttccgccggcgtttctcgaagagcaaagtcacagacgctggcatccccgcttgcggacgatgcccgcccccagagaaagagtgccagacgactggcgaacagccacggcgttctctcggactctgcgttcagagacgtcagctgacgcgcctttctttctcttttttccactgttcttttcttcggatccgaggcacgaggtatctatcccctggctgtccagtccaagaaagcgacagacgaccttggacggcccgggcgcttcttcgcctctcctctccggacacactgtaaaggtccatcgctttctcgtggcaaatggcaggttcccctcgtttctgagaagcgaacgcgggatctcttgacgcaaaccaggtctccagttctctgcggttgtcgaaaacgtccctccctccctccggagaaacgcgcgtccgacttcgcgcggctctcactcacaccccagcgcgagggcgggcgaggcgggcagacatgccgggtggagggtctggatttttcttttcgacaaatctctggcaagactggatagtctttcttttctgctgccgctctcgttctttcgttcgagaagggatcttctgtcgaaacgaagactcgactggcgagacttgtgcccctcccgctgttcccgacaagtgaggcagccacacatcgtgcggatctcgccgcaagagtctgccaagaatagatttgcgttttcgtagtcttttggacgaagaaaggaaaaccttttcgcgtttctgctggcgagaggtcgaggagaagaaaagcttcggtctgtccaagagcgcctcttttctctctgcacacccgccgttccgtcctctcattcctgtcctctcgcgtcgtgtgtcttgttcacttcgtggctgtcttctctcttgtctggtgtttgacgtattttaattcgttatctcgggtgttcagaactcccgtttggacctcgtgctcggtttttgtaggcagtctcctcgattccttcgcccagttccctcgtttccttctcctcgctcaaccttcccccttgtttcttctcgtcctcgtcacttctcctctctcctttcgtctcttccgctttcacccttcgtctcagttgcttcggactcgtcgtccgcctgtcccagcagctcttcttctccctttcctctttctctccgcgtgtctcctgtctcttcacgaattctccgctcgcgtctccgccctgccttcgtcgtcgcga

SEQ ID NO: 1913 - DNA, 3752 bp, Toxoplasma gondii
tacgtcatcccagaaatgcggatcgttcctacgtcctcagagtaggcgggtgcatgcagagagggagaggtcggcgcagcgccggcacaaggcatgcctacgactttgcgtctagtgatcctcccgcgtgctctgtgggaagttgtctcttcttggtagcttcgttctgtgtctcgcggaacgtcggatagagatggaatcatatgacatcggtttttacgagattcctacaggccatcgagttcgccacgaatgacgtacaaacccaactgagcaccctacgtctgattctaaccaactcatcgtcactgcgaggtgtctcgagtccgcgagtgttcgtggcagttgccgaagactttccttgttggctgagaaagactgtgacgtatctattctgtctgcgtcttttccatttccggtatccttgtgcccagaagactggactcgctgttcaaaatcatgtccgaaatggctgcactgaatccggaccccgacgcagacgatggagacgacgatgaggacgacttcatcatcgaggctgacgggctgggagaaggaacgtccctgccggtaagttctggataaatgcgcagaactcaaagtgttggcgtcctaaatggcacacggcattatttaggttcccatcggttgtgcttgagacgcagcctatggcttccattcatcactcacaccaaacgcagcaagtatttcaaatagccagtcagtggcctcaggatgtagaaccatccggcgagccctcaaggaaggatttcactagtatcaaccgcgcgaaaattttttctgttccaaaacggtttccaggggctcagacagaaagtgcaggcaatcatccgtgcaaggatgtgttcttttacttgtacatgcatgcgtttgctgtgcaccaatagtgatatcggcggttcgaggtcagaagcatgagtgcttacgcaccaactaggcgcttatgaaacatatgcttgagcggatcagaccacaacggtgcaagggaagcgcgaacacagcggtcaggtcgcttgcgtgttgctgattgcgagtgtctatgggaccttgagaacctgtggaaacaataggagaagacttgtagtcaggtgcgagtataatcattattgacagagacaatcttccagtctcgatgtttgttggccgttcttcggaggcgaggaatcgtgaggaggccgccaatcgcttcaaggacacgttgtgtatcttctgacaccaaaaactgttcgtttgcatatggaaggtctctcattcgaaattgaggcactttccatgcggtcgtgcatgcagggaggctgggaaatcgtcgaggacggtcagactggaaacggcgcgggtgaggacggaaacgccggcgaaccggaggatgcgcggatgatgccgaacggacactaggcagcgttgaacaacgcatgtagacgcaggctgaacacttgactagaaacaccgttctgtctcgatggaaccccctttctgtgacacgccgtatcttgaacacgagcgcggcttccactcagtgcacactccccggctaaatgccatgaaacagcttgaagaaactttcgcatgtgttcatggagccacgcgagtcggcgtgatcgaacttgtggatcctggagtatgggtggacctgattttcgcgagacactctgtgcctcttttcgaaactagagtgcgcgcaagtgggtcctcgaaagtgcaccaggacccctcgaaacagtttggggccgggaccgaaaggactggcagcgaaaaagtacctaccattgtgaataactgcttaacagcgggtggattgcacaaatgccgcagcaagcgggtgccacagcaccggcgccgcggaggtttcacagcacctaaggtacgggacagctacgggcttccaggctgcttaggtccgctgaagatttgtgtcgcttctcaaaatcagcgacgcaaggacacagcttcgtgagagagtaaccgatccctaaagtccttcaaacatggagtcagcggggcctctcgttggactgtcacgtgatgacacagcatgtgaacgcactatcgtgaatcttggctctgcaatacgtatcgaatgccccttcggctacagacgttcgcacctctgccaagctcctcaatcaccaggtatcggagaaaagtgaggcacagtgcccgtagacaggcgaaacagtcggaagaggggaccaaggtagagctacgcgcgaaagagggcgacgagtggcgctgcaaatgcgggggactgaggcagaagtgttgaaaagagaacgaatcagacggtcaaactaaggacaggtagagacgacttgatggcattcagtaccgagacccccgaaacgccgacgaggagtcgatgccctcggcgacatgttgccagcactcagcaggtggctaccgaatgaaagtttatcgacgtgcacagccaagatgcgccttcacaccacggggtcaaaggatacataaaacacgtttcctcctaggtgaagacagacggattgtgcagtttcgagtgtgttcgactcccggtctcttgagcctaacggtgacgcagataacgtcgcctcgcgccggcgctcttgagtgcagccgtttcacgagcataacgtgtctcgagttttggcgggaagttcatctcgcgtcccgactgcggtgccttcactcatttgtcggtttcgaatagcagttcgtaacatccacatttgtagttcagattcccacaaggtgacagaccttggccgcccgcccatgccttggctcataggtaacgcgccgactgtcaggttccaccttgctgtaggcttcgctaacgaaaagagacgccatttaaggttaggttgtacgacaagcgtggtgatggtctgctacagcttcagttgggttgatctactgtggccgctgcattcaggcgggaacaattagaatcaaacagcgggcggttcgcaagtgtactgtcgcaacggccgggtcctccgccacatgtgtcgttgcagtgggtcttgctgccgttgtttgcagccatgtggtagtgaactacccccgcagtgtacatcgcagacacgcgaaaaactactttttcatgtgccagacatgttgcggaccccacaccaactcgttcccggcagccactgagccttgtgagctagcgacgcgtcgcgtgtctcagggtaccggagaacaagctaggggtttctgatggtaccgtaaccgccccatgagcgccgggtacggtcggcagagtctttcccacctgttcaaaggtgaagaccatcttcaaattccccgccacggacaagctacagtacgagcggcagtcgtttgtctccgacatcctttgttcaggcttcaatcgaatttgtttataagctgcagttcctgcagacttgctgacgtttgcctcgagttcatttcagacaccggatgcgaagcactctcgtctctgtatagtgaacattcgcgtgaacgtcgttctttcagagacgtgttagcgctcacttgccttggatgttagacttacccagaacgccttctccaagggaagtctcttctgcattcgcgaacagtgacgaccgggctcctgcagcgaggactctttcggtcacgaggttcacagggcgtcaacggaagcactttgttgcctccgctcagcacgaagtgggccagggcgattcggccgcgtgctgttcgttcacttctctggtctgctgcagtttgtgaatggcatatcgtga

SEQ ID NO: 1914 - DNA, 1904 bp, Toxoplasma gondii
tatccggaaatttgcttcaagctcgtgttctcctgagaacttcgtcattctggcgtctgcgaccacataacttgagcgaactcgcaattcagaaaatacacgaaaaagccgcgtgatgcattttcgcgtgttttcaagacggctaacgggcacgatcactgcgtgagtaagctttttgtggatatagaatatgcgtttgtgcactttgggtcagttgttgttctggtcgatcactattacgttgctcaaaaactggtgggcttaacggagagccaccaccatagcagaaaagacacaattagtctgccctttcgccgagctaccgaaaggaaagagtctcaacaattggctcgcaggagggaacctgcttgatacgcggggaacagggaactacagaccgagcattaagatgcaagtcaagttttcggcacagtggagtggttctttttgtggatacgcatgcctcacgactaccaaaattaatgcctggaagagaaccgaagctacagagaaaagtccatccactatgttgccttcttttacatgggccacacggatagagtgcagcagtgcagcatcaggcggctgtttgctattccctctggtagcgtgcatgctgccgagagaccaccgtctctgggagcgctgaaaatgtctacatcgcttctaaattaagcatacaactagggggaatgtgtcagaaagcacagaattttgagtggtgagaggccatgcacattcacagtgtcgaaactgggagcctgaagcgtcgaaacctgtttacaaatactatacttaaatggctgagtacttcagttctacagtgtatcatttttttcaagcagtacttgcaagtttctatccgcaggcttaatgtgcgcatcaatgatgtgacacttccgtgtttaagtggaatacgagttgcatgaagatggcgattttttctgttaaccccaggcgacacttccgagcgcgacggtggcatcatcagagtccgatccgcatatagtatgttggcgtttctcctagagtacaacccatcgggcagtcagcctaccatcccgatctattgtatacggtcaaaagatcccagaaagaagcacacgcaatcggctcatcggcatccacagccctcaaaatgtgccctctgcctctcttatcggtatgacggtgtagttccagaatcgctccacagtagagccaccacaaaagtggtgagacgataccagctcaaacttctctattcgtcgccaaatagaatgaccctgccatctctcatgccaaaacgaacttgtgaacctcttacagcggccaggcaaatattgcagaggctgccactggaggcgaattcggagtcacccgaagaagaacgacgtgacgcacctggaggctgtggtaacacctcttcacacggtgtgacgtttataacggtgcttgatcaactggaaagctaattacaagctacggaagatattcttttttcaccgtcacccgtgtgcaagcggttctccacaaaggaccacgcaaagccaccctgtttacaacgacttccgcgccattgccaccgtgtactaataactggtgcatgcatgctcatgctgacataccacttggacggtatcatgaaaaactatctgcaagagtgaaatgcattaatcccccgtcaagttgcgagcacaacgacagctgttttttggaggaaaattaacactggttggcagtcgaagagagagacttcctggcgtagtccatgtcttgtattcctgcgtcaatgcgttttccctgcatgttgtctccgtgagttgagttccgtctcgtcagaaatgctaatattcctgcgcgcaaaagaacaagtttttctattgtcggtgacgtctcctgtgtctatgatggattattgttta

SEQ ID NO: 1915 - DNA, 2043 bp, Toxoplasma gondii
tgccaccctacgcagaatgcctccctgcaagacagctcgggttcttaacgtcatacgcaattatttgggtgggggttgaaatagactaaacgaggcatttcttcacagataacaatgcaggcggagtgtgggcttccccaacagctgtcatgctcttgtgtgctgtctgattgtttctgtcactcatcagagaacgacaccgttttgaggcgaaactgccataactttgtttgatcattcatatgtcatatgaacatactgtgttgtcgccaatcacatttccctcttggcttcgacaaactgttaacagaatctgattaatgattgaggggctgtgtcgaggcacgcgaaactaaccatgacgaccatcaaaagtctcctcacacaaagacatgcttagataaacatacagtgacagcccgacattcttcactgttcgactcatggtgtcagctttccagcgtgtttcctgtgcttcctcttgtgcacagaaataaatgagctcttcccacttccttgagtgtctgtctgaaaatgacagttttatttgcgcatatatcgctttcgctgatagtaagtgtccgcttacctctgccgtctgctcctcagctactgctctttctgtctgcaactgtgccgtctccacctgagagggagcttccacttcctttacggctgctgccactccgtctaactgtatatccgcggtggcctggtgtaccttcctctgtcagaaactcatgataagacaacctgtgaggtgccaggtccgttaaatacttacctcagcttcagcatcttgtgtacgaaatttaggtagcgccgactgacgaaatacatttcctcgcgttacgtgactcggtctgtgcagctatcacccgacgcacctgtatctgttgcacttctctcttcacaaaatcctgtgtcgaatctttggaataagtgccgtgttgattcactggcaaaacaaacctcaccagctcggcctctacgcttttgcttagtttgtgcgccttttcaatcgcgacttccttggtcttcagcagttgctcgtctaactgggcggctttttgctcggatttcgtatgagcttcgcacagagcagctagttccttttcgagggcttggacttcctgtacacacctggcttcgatagcgtaggcagatgcattcacatttgaaagcgtaccgcctcggcaacctcggcatcctttttggccttagcctccacagctttggaaaccagtcgctctgcctgctgttgtgtcacaagcttcgctattgcattcttgatgcgtacagtgttcgcggaatctcttgtctcgaccaggtttttgagagtttttgctaaagtagcgagatgtcagaacgcattccctggtcatgcgcaaacacgtccccaccgagttctttttcagcttccgcctagatgcagcgcaactgatggagagaatgccttccgcagacagaagattgtctcacttgagttttggaagcatccgatgcaacagcacagcagcctgctccatctgcggcgtttgtgaccggcttagcttcctcaagtggcacaggagggacgtagtcggtcctgccagtctctgccccttggcctgctacgaagagtaaccagaaggacaaaacacctaggaaatcaatcaaaaatatggtggtcttcattataacaaaatttctgtccacgtttgacggcgttttggaggctgacttttacagttgcctgcgcgcgcgcagaacgcatcggtgtctgccagagtagtgtacatgcgcagtgtagcgacacaacacggttgtgcgttgctttcagtaccgttctacgtatttgatatggggacttaccactattttatttctaatcgttttggattcgtgcgattctgtttctgttccgttgacaacctcgtttatgcttctagctatatcctcaagtcttgtcgcagttagctgtaccatgtcttgtctccaccagcgagaaatgggatggtaactgctcgaaatatgcattgaagaagatcgattcttcagaga

SEQ ID NO: 1916 - DNA, 1760 bp, Toxoplasma gondii
ccgagggtcgaccggacagggaatgcggtcggctgtagaaatttctcggcattcgcctgcctctcgacaggaaaattggctcatgcatggaagatccttcttgtcctttctcgtacctgtctcagtaaacaaagacgcatctgagccttcccctggcacccctgcacccactctgctcccagcgggagcagtgctctccacccgtgacactcctccatgttctcggccctccgttggcctgttgcttgataatgaagacgaagagagagatatggaagaagggacattcggaaaagatctggattgcgctccagacgaagagcttgcctctgaaagcatcggattcgaccaatggattctgctctcctctttactggtcggaacgcttctcctggggtctcctgcctccatcgcggcgccgtgttctaaaaagcctggcatggaagaagacggtaggtgaacaaaatgcgacaaacctctgttttaggaggcaattgactcgcagaccgccttcagcacgaccagtctatacgaaggaatctcgaaaacagaagtgggattacgggttacaacacaagtggaacgacggtttacgaatagtgcctgaaacgtcgatgcagtaacagcttaccttatccaggtttccaattgaaacatgaatgtgacacctatgagaagcgagaatgcgtgaataaaaagttacggagaacagagaggaaatcctttttttaagtccaccacacacgccaccgcgcaacgccgtgcgaatacgacatttctgacctcaaccgattctctgaatgggagggaatgatacgcagtgagtgagtccagtcgcctaaaggaaccttccaggacgagaaacgaacgagaggaaaaccagaggaatcggacacaccttgtttatccttgaactttttggttaaggcagtccccgtggggcagacttgccgcatgggaggcaataaacagcgataaacttaacagagatgtggatcaagagccagagcgtttgcgaggacgaaatcaattgtggtcttctttgggcagttaacctcaaagggtcgtcaacattttctggcggattttcgcaagcatgcatctttgtcttgcgcatgcgcatgcgcgggctggaaccatggggccgagtgcgatggaagcaccagcattacaacatacgaaagtgcgtcgcttttgcgttcgaatgccatccctttcttcctatcggaaagcagcattctctacccgtctgtcgttcctctttgtcgaccctttcagctttggcgcgcgctgccatcagtcggtcctttccgcatcatcaagagagaccagccaagctcctgtggcagttttcctttaccttgttctgtggacgtcacctttttcccttcccgtaagaaaagaaaaacactcagtcgaggagacccggcatcgtccagacatggataccgggttgagcttcgcgacttcgctggtgtctactcccctcgtcagacgcgtactgcctccccgtccccatcgtcacctccggttcctgccatccttttgctcagcgaggcgcttcttcccttctttggcggtcttcgctcgcgtgttacatgagcattctcctgcgtcaccgtccctctctctcttgacacctgtgtccacccctcttcagttttctcctgcattctttcctcctgaattttctcctgcgtcctcttctcttcagttttctcgtgcgctctgttccggccgtgcctttcgctcagctacca

SEQ ID NO: 1917 - DNA, 4719 bp, Toxoplasma gondii
gcaacgtgtatggtgcctgtatacatgcacatatcgtagcataacatgtttacacttaccttgacgtggccgttttcatctctgtacttccacaatttctgcgttcgcgagggcacttgggagaatagcttttttaagtctctcaacctggggaaacgctcattcgcctgggacgaggggccgtccagaggctcttcgtcgctgcccaccgaacggcccagcgttcggttacctctctgcggagaagattcattgccctcgtgtcgggaggaataaatgcggcgtcgactccgaacccagctgtccgacgactcatccgagctgtcgaggcgactggatatggcgatgggctgcagaagtttatccatttttgtggaactgactgagacacagaagctggtctcaggcgaggggcatcaataaaagacaggacgagaaacgtgcgagcagcgggactaatgcagacgacgaacaaggagatggcagaaaaggagagattggataattagaattcgaaatgacgtagatagagcgataaaaacacggcgagtgctttccagctccaacaggcaaaacgaggccatttgtggcaggaatgacagacgaggaacgatgacgttccatcggaggcaagaaaaaacatggattttcaggccttcagcggaacgccatgtacatgacggagcccgtaggcgcagatgtggtacatggagggaaaactcgcccccggaaaagtacagttgcctgtacactgtggcccgaaagaaaggaaaacgaggtgagtttttgaaactaagatgaaggaattagtcctgaagcaaggaatgagattaatatttactgggttctacagccacttcctcattcgtatttggcaaggaagcccgcaagtcaccagtgtatgtacaccggaacgatgtaaatctttcctaggcgtcggcatactggtgagcggtaagccttctttcaccgctcccggagtggggcactacgaggaaaagcggctacatagaaactgaactctgtgctcatgcaaactctgattcgaggtgcttttctcgaaaaaaacggatttacttgtccgcaccgcaaccagcaagctggacattcggcggctgaacgaatgtcaagtcttcaaacgacagagctgcaccggatggaatgcagcatggctatggaacaatatcgcgccttcatgcaacttgacttttacaagacagaaaggcacaatgaagacagtttgtcggggctggaggttcacccacgagcaagaaatgagacgcaagaagacgaaaagggccgcggccagacactaccgaatttagctcgcattcgttgcaggtgctcaccagcaaacatatgatgccacttaactcggcgcttaacggtacacactgctcatttaaaaggaggagagtgaacaagacaaagggaatcaccgcggcaccggtggaagaaaaaaactagacgacgcagaagccggttgctacggcagtgagacattcacgtctcgcgatcaaagagactgcggcaagacacagacttgggagagcgagttctaccaaatcgcggacttttcgtgagtatgggtttccttagacaccacggagcgcatcgggtttacaaggagagtcaacagtcaatgccgttctgcgttccttcccatcctatggccccctcccctgctgccccgcgaaaccgcttgctcgtctgtcacccacgtgcaggagaagtcgactgaacagtttcccacagttttgtccaagaaaacaattttcgtctggcttcccgcttcgtaatttaaggaaaagttgagaaaggaactagaaaaattagcctgtgcgttgcttgtcatctggtctgcaacgttgttacttttggtggcacgcaaacaatgccatgctgcagacaacaccgcgcgcgtgacgcggagcggttgcgtctgctttttgcatttaaccttagggcaggcaacacacgcagaggcttttgagttcaacactgccatctaggcattgaccatggctgtaatacgcccgagattcgaatctatgtggctaatcgaggagacgaaagtgaactgcttgtcttgtgcttgtcggaggccgccagtccgttgtcgagctttgttggtcgattgtgtgaccggaagggatgatatcgcacaaaaaacggatcactggtacaaagctcttgatctaaatcactaggaatggcgacgcggatttattgcagtggagctgtgggtcaacggatgggttctcccttttgttggaatgcctgaagtcgcgttcctctcgtcagagcagcgcacaagcctatgtataaggattttcacaacgaattgtttccaacggacttattggctgggaggtccctgggaagaagcgaagccagataacaccgtcggtttctgtggcaatgtcccttaagttctcgtgtctgacattacagctattgaggagataattcggtgcatcccacgcgagactgtgattgtacttttttgaggactgccgcgccaaagaggacgcaaactaccgcaccaagttgcagtacacttacattagtccatatgaccagacctagagacacgcgatgcgcgaagcctctaaaatgcctctagagtgcaataattaaacatcctcagttaacgtagctgaatggtgacttgtcgaaaaacatcagtcaccggtcaccgtgcgacgaatgtgtaacggaatcaaaaccatcggacacggtttaacaggctagaagtgcaggcaaccagctaaccattgttgtggaagggcattcacaaacggcgggcaacaaacaagaaggataacgaatctcttcttgttgtacgcttcggacaacaagagacactgctgggttcctggccgagagtaacagtttgtgctggctgctcccttcagccttatgtgaaggtctaggatgtgtctcgcctgcgagtggcttcatttcttcttcgtttctacctgcgttctttgaatggttttgccgcgggggcagagtatcccgtgcaagtcagtctaatagttctgtgtgctcgaaccgttcctcgagttccccgattcggggcatggcggcgcggcgctgtcgaggggtaaaaacgtgtctggcgctagcgcgtaccacagcattaagtggattttatctattgtttcagtttcacctaacgtttgtttcggaattgtgcacgcccaggttgttaggaggctgtttctggatggctcactcagagcaccacttcggccccgggtacgtgaccggttccgaactgggcgcactcccgtttttcaacagtcagctcattcctggtccagcagtgccccgcattccggttctttcctgttttgctaagaacatcagcactgccctttagagagcttccgcccaggaaatgacagcctgtgtgacaccggcaaaaaccaagcctgtgagccccagccccggcagctgaaccactgtgcaggttgaagcagtttggacttgattctgggacaacacaaagtctaaaatctctcccaggtcgatcgatgaaaaacacaatgattctcctttgagtctcttattgggtgctcctgctcttttgcctttcttcgtgtctccttttttatgagggagctagaaggagcccttgagtcgcgcaatgagcggactggctacgcggatgcgccttagcgggagcggccgcagcgcatcgaataagtaaggcattgtgctgaaggagactcgcggcttttggtctggagaaaacggacaaaagctcaaactcacgaaaaggatcccagtcggcgcaaaaaagccccgcgctctcttcccatcgatggctgacgctcaacgcgggatctttatctgcgagtaaacagccccccggcccattgcatcggtgcgcattgcgtgcacgcagttctcgcctcctcgcggtcaaaacaaaaaaagggtttcgcattctttcatttcccggccttctgcacctctgctccatccgcttcgagcataaaaggatttcttcgcgcgttttccgcggaaaccacggcagaaaccgacaaccggcagcgcccactagcgatccgaggattcggaaccagttcgtggcgacctgcacatttcccacgagtgccttcgccgagatctttgttttcgccgcctttgagtttgtgagaaaacacgactctgggccatcattcttctgaggaatcgtggagagggcgctgctgccgcgaacaggtcttttcctgcgacaagctcggccgctggttcgtgtcgagaacgtttgtggattcgaggacagctctgtcgagcatctgttccctcttgtttgtctagcaaaactcagcttcgtttgagtgtttctcgccgaggtctttgtgcacaacactcccgggtcctccctcgtgcgcgagcgtcgagatctcgtctggctgaagttccaaggtccacttcagtctcacttcgcaggcatttcgttctccgtctttttcctctcgagaatctcacacgcagtgtgacttctcccgtgatctcgttaggttcaccgagccagtgcgacaaagacgttcaccgtgcgctatctcagagtgggaacctgctttcgcagcccttttttttcacttccttgtggagactgcgagttgaaaacgagcggcgtttgctgccctggagttctttcaccagtaccttttcctccgcctccacaacacgtcttcgaga

SEQ ID NO: 1918 - DNA, 4683 bp, Toxoplasma gondii
ccaacagtcacgctggaagcctgtgcccatgacctcaatgactcgagggtcttccctgcgaaaagcaaaagagaaacaggtgaatcgaacatgcatgcagtctgttctgacacagagaacctcttatctgcttccaacagattgcggtgacaaggcagatgcgcaggtctcgggttctacgtcttaaaagaagctgctgcatgccttcccctgctcacgagaacctacaaacgaagaatggtttctacgcacttagagttgggcctccttcaccgcgcctgatagcctcattctcctctctgagagcaaagggcgtcaactttccactgcagtctcggtctctcattgtttcccgttctgtgatcctctcagcgcgtgggtttcgcggatcttttcgcttacttgacgaagtcccaggtgacagtggcgggctgactattttgtgtgatgagccaggtgccacctccgagtccccagagaatcagtccggcgcccgtcgcgaacagtccgacgctggctattgtgttgaagacggtggaacttttcttgggtccggggtcttggctcgcgcgcttcgcctctgcctttgtagcctcatctgaactcatcgtcccggaacgcaggtctgaactggcgccgcgggcgggcatcggatacagaatggaggcgttgtcgtgggcggcgtcttcttcgggtgtctgcgcctcgaagggcaacgcaggattcccagccgcgccggtcttcgagtgcttcagttcgctggtctcgggcgaattcacttgtgcgggggacccctcggcctttccgacgaagctgccgtcgacaccacccgctgctgtgccgtctgacgggttgctcgctttgccctcagaacttgaggcgccggtggaggacggcgaccgcgaggctttcgttggagtcgacggcgcggtcagcggctgggacgagctcagctgccggcgttgaaccagcaagtgccgcaggcgctgaacttgctcttcgcggcgggctgcggaacgaacacctgcagacgacggcggcgcgccgccgtagaaaagcaaagatgcacgcagcctggagagtgcatggacctcgcctagtccctcggaaaacctcgaaaatcgctcgacagaactcgcgactggcagagtcagagccgcggcgcagtccagctgtgccgcgcgcaacactgcggcggctgcagaagcgggcaggagcccccctcgaggcaggaccggcggcattttcgagcgaacacggaaaaggaaatgaggcgaaatatctaggaaagaggagaaacaagtggataaaacgaccgggaaaaaggtaagccccgagaaggttctgccggcacacgcgtggacgcacgcgcgaaaaggtcacgtaaagcgcgtgtgtgaggtgtcgatacacttgaagggcaactgggttcagtatccgtttggacttttttttcaggaccgtccaaaacgcagactgcgagaatcgaccagcttgagagtgtgtttccttctttgcggctcaaaagacaactggtcacaacagaccatttccctcgcgaactcgtgcgcgtctactcgcgaaaaactcgcagtccagatcgcgaaaatcgctcgcgtgccggaacctagatgggagtggcctcgggtgttctgactgttgtttgcgttttcccacgagtcgctgcgtttcgcaagatgtctgggatgtgcacaaactgcacacgcacgagaaaactctctcacagagccaaaagccaaacacacgccgtcgattcaccacacacacgcagccccgtacccggaaagaccgcggacccagtcaaaaactctcaaaaacctgcgagagaaacgctcgcggcctctgcctctgttcgccaaaaccagcgtacaacggtcgaggatcggacactcagtttgatttgaaacaggggaagttccgaccctacaacggtacatgcactagtccaccagaacggggcctttgtttttgtagcccacggcagcttggaatctcgtgatttacatcaacactgccaaaaagggaactaattcttctcaatgaacgcccgtcagcgacgacgaagtgcacacaccacaggcttctccgctgcatgtttcatctggacagcgacagtctcggaagccactctcccaagcttcgaagcgcgtgtcaagggttttctgctagtcagcctctctgcaagcgcacaggcgcgtcgctttcttttgggtaccacacggcaaaaagcagcgttttgaagtcgaggttcgagagaggaaaccgactcattttatggtgcagttgggagttacagggaaaaaatatctagtagtcggggctacaagggaaaacatcggactctcatcgggaagtctaggcaagcatgctattttgcaattgggattctagaaacgcacatcacttcgcgaggatggttccagagaaacacgccgtaacgcaattgtgatctcattagaaacacactgtatttcaggtgcgactccagcggaacactattacgttctcttgaaaatgcgcccctctgagaggacagacaccttctttgttcgcggatgagggtcggtcggcagcttccttgaaagaacgaaatcgctgattccgaattccctttttcgagatacaaactagctcctcgacagaaggctgtgttgttggcatgaccattcacagaacgctgttagaagggaaaatacaatccaagttcccctcagacggggcaagagagcggtgctcttttgttttctgtagcgacatcgcgcatttcagtgttcagctaaaaacgtttggagctacgtgcacacccagtgtccagaagagggataagatgacggttctgacgggaggaaaaagactggagtgtgtggccgcaccaaagacagttgacatctgtacagaactcatatccattgtggtagtctcctgatgctttctacagaatagacgagcccttgttggtttgtttcgcctggtctagttaggcgctctaagttactgttccccctctggaacaggtcagtgagatggtcttcatctgtcacatgaaactgtgtggaggctgggagcaactcctgatgcactgttgtcatttcgtccgcttcttcagacgagacagcacctccttttcgcttctgtcgtaaaccgaatctccaccagacatccgaacagctctcaactttcccgttgtccatcaaccagtacgcgcatgatgtttccaccctatgtgtcttcccacctcgcttgttgtcgctgagtgtacaccatttcagcgaacacgaaatgagggccaatgagggcaaacggacggtgctaggtcgcgcaccggcaaaagagtataggactcccacgacgcgattgcaagcgcagacttcccacccttatttctctttttctagttttcgaaggtaaaccttgtttccgtctttccggtgcttctactctgctctacagcgcggtccactccacgaaagtcagtttcgacttgcacgaacaacgagaattttctgccctcagagtccccagtgttcttttgtggaactcatcctttcgcttctagagaatgtgttgctttccctcgatcatttttttcggtatgctcaccgcgcgtcagggctgtctgttgaaaaccgaaagaaatcgacaccgttcctacaggctgaaaaacggagagagataaggcacttttcatccaacgaaagacaagaaaatagcagcagcaaatggaattcaaacgttgcgtagttactccgacaggtttccacgaaaaaacacaagtacagtcaatgctactgggtgccggtcggctcatatgccagaatatgcacataccgagatatgtgtatgcacaaaactgtcgaaataagaagatcttcgaaaaaagggaaataacagatgcatgcacagaactctcaaagtaaagagagatattcagaaagaggggaaatgagtatagtaaacagggaactccccagagagacaggagaggcgagagagttgttgtctcgaaagccgctctctgcaacgagcacacgccgcgaatttttttgcatgcggtggagagactttgcatctgaagacgacgtaaaaaaagtaaattggcttcgcctttcttctttttcactagttcatgtttttgttttcctgaggcaccctttttctcattttctctgtttgacgccccgcttcctagcgctcaggccccgctcgttttcaagtccgttgtgtctccgaaacgcactgtcgcatctgcaggcatttttcttctgcattcttctgtttcttctctcgctttttgtctgtgtggcttcttttttgctgagtttccttgtgtctgcaaccgcagcttcttccgtacttgtgcggcagcggaggactgtccggtctccttcgctctgctgtcgcctgcatctcttacgtccggtgcactggattttttctctttcttcagctctgaaacagcgatcgtgcacttgctcgattggggagagtggggttgacggaaagagcccgcctagaaaaagtgaggtgtatgtacactcgggcctcaccaaccgtgaaagcgcgcggagtcgcgcggtgtacatacaccgcacataagcaacggggcaggagtctccgctcgactgtctcgtttttttcacttgttctcggctcgggacaata

SEQ ID NO: 1919 - DNA, 4152 bp, Toxoplasma gondii
catcaggtggagtgctggaaaggagacgtctacgaatttcgagaaggcggagaacccgatttttcacacagcgttttcgtctgtcgcgtgtacacggtaggctactaagtacttcctctgctcgatgtacttttcggtgggtgtcaccggcagtcacagccatctaactgcagaactcgaacagtcgtgagtgaatatgtacggcaatgttattcagagtgcgacggttctgcaagaaatcgaaaaatatctgtgttcttttcaggacacagccactaccaaggaggcgtacaacgggtgcttgctagtacatgtttgtgctcgctcatccttgagccaaagaacgagtttgtcggatcttcggcaggcagcagctcgtatgacgaagtgcctgctcaaagttcgcgaaactcttcgaccgtgcgtgaagctgaaaaggcgccactctctaagcataggcgaatcaagtcttgccaagtcacctggagtcttccccattccgggagacggccgtagaatgtaaagcgactcaagtatgttaggagcacccaggggtcttcggatgccttgagctcgcgcgtttacttccgtgccttggcatgagcttgatgttattttcggccgtttcaccacaacgagcgttgtcgttgtcgggcgcgggtgcacgcatcgtccctctagtgctgcaaccaatttcgctgagtgttgttaaaaccgctgccacgtgggaacactgggtagaaaggtctgaatcgcgattcacctgtacagagacattatctacttttgatgttgccaacttagttgttatcattttcaagaggtgattccgtggagttgggtggagacgcgaccgtgctcagtctttgtcaggtgctgaagacagcagaactcccaacgcagaagcatggaccactaacacgcctaagatacaaggaggtgaccaaccacataaacgatcgccgttccctcagaagcgcgcgttagctcaacttgtgtaactttagacggcggctatctggtggtttcatgcagtagagccgaggccgtacgatataacatcgtgctgataagcgtgacgaagcttccaggaagccccatagtatcgtgcaacgcggtggaacaccggttgtctctatgctcgaaaccagcggtgctggtatatttgtttcgcttggcacttgaaaagcgctttgcaagcctggttcacgttttctgagagcagagtgcacgtaacgccccacgaaagtgcgtgcagatcgaaatggtggagcgtctacgtaacgacaggtattggagcaagtttgatcggttctacactacgaagtttcctaaaaatacttttgttaatatacccgacaaatggtcgttatcattgttgcacgacttatgggagcgattgacgccaggccgcgcaaccgacttatgcccatgcaacactcactccacccaaacgcagaaattacatttgacagcccatgtcatagttcagcttattgtatcatcgaccacactcaaaaatgctctagcttgaaaggcagaggaaagtaattagcgcaccacaagctggaagaagatgtaatgtttggctgttcagtgttttgctggcaacttaccgtgccgatgaacgatgataacggcagcaagaaatactttttctgtgatgcgcttttcctggatcaacagttggcgtcactccattttgagtgctgcaaactagaatgattcttgtacctccttcgatggatgcttcgagagcggatagtcagcagcatgcttcccctccggtcttgtaactatgggacccgctgctcttcagagccgtctgtctctctgccatacgcgggcactctgtgtgctgcatttgtgtacccaaggaccggggcccgtaagcctgaaaactaactctcgtcaacgaagccgaaatcaaggagttgtatctatgcagtgttctgtgtgttccgtctgtctcacagcgcaactgctcgcgggtggcacgcaagaacgggcaaaagatgaaaggcggtaaggacatgatgcagtctccgtgccagtagtcacaacgtacttgcagttcctttttaatatggtaatagtgcctgtaaggttgaaactacaagtagcggctactgatgagctagactgccaagatctgaaagaacttttcggacttcaaccccatgttaatatagcgcttcgcatggttactttgtgatgttgcttcagaaaaaacaatttccctgagtatttaatggccacaaccacggcaaccgattcggttgaaacatcgttgacgaccgtcaaccgtctaatttttcagaacgcctttacttctgtcagatccccacatagtgctcatttcagcatttcgccacggatgtcatattattccgttcttgttttgtggcaacacaggcagcatcgctacattctgcgctgtgtgttcccatgaggtcagatggttgctacacagccgacgtgatgtacagccaccaattctggccgttagacccatcttcctccaacagccacaacggccatcagcgactagttcggtttcgagcgagtggactgacttgtcatcgatgactatccctcacgtttgcctactggtgggccacgtgccacctctgccgaagagtacctgccgtcaactttcttgctgctaaagtacgctctatggcgtgttaacaaatctgaactcccgaaatagtgagacgaaggggatattccgtggtaggcaaccgcatcccgccctctcctgaaatctaccgtatgctgcactgtcagtcgttctcgtgcagcagataaattgtcttcaggtgacaaacgggtcttcatctcatgttgcgcgagtgtttgtgacaacacggaatcaagatgaagcctcacagataacattgtgggtccagaaattttcccctgttgtcaggggctatgcgagacggttacatgatgagaatgctctgtccaagggagaattacgactcctgacatccgtcgtcttcgatggcattttcattgccgaacaagtcgactgcgaactaaagcaagctcatgtcggcgatacctagttttatggaaacctccgcgtagcagaagcgggaggatgtgacataactatgctggataatcctgaagaataaatgcacagattgttatgcagcatgcggctgtgggttcttgtgctacccgcagcgtcatacttttcgttcgagttgtgctgccacagaaaatagaggaaatcaatggcgttgatgttgaaccacataccgttccaagctaagttctttcagaaatgaacctcaaatctgacaagcttcaacggtcaatcataattacaggacgtcaaaattcacagccacaaaactgccttcatattaacaaaaatgttcgtctcgtacagaccaagcattccctggtaacaatgtgatcccgtacagcattttttatcaaacacgaaagatgtgcaaggatttaatgctttcttcagcgaaacaaacacatgccggtgaggaattttcgtgcgaagccaccggaatccgcactgggacccttcccagttctttgaatggggtcgctcgtgcgtgagctcctcagtgaagtccgacgagagagaatgactcccggcattagccaattttcctggccagacattagtacgatgaagaaaatctggatcggcaagtgcttatttctacgggagcagctggcgtccagcctttacggtggggctttgggaagtgctatcacacgtacttatcttcagtgatgcatggcgattttggtaagtgaatccgatggattagcttgctatagacacaagtaagtacttaactgtgtgcagagaactttttgagtggggttttattgctactggcgaaaccgagtgtttcgtgcactacgcaaccccgcgttcggcttcaggcatagctcgttgctggtcacaccaagactacgttgcctaatgcttggcaatgacgccgccgcaaatttttaaaaataacagcgcataatccacgatgcataccgtgagacaaaatggttgccctctgaattgttataatctatactgaaaggcactgttggcgccggattcagacaatgcatgggggtagacgtcaggctgaggaccgcgggcgcgaacggcca

SEQ ID NO: 1920 - DNA, 1832 bp, Toxoplasma gondii
agctcccgcatttctcgctgcagagatcttgtcagagagtgtttgcccttgagccaacccctgttccctcaaacttcgagtcgccgatgctcgtcccctcgacattcgttcaatatgtttttgcactgctgaggcaaagcggctcgtcccgctctgtggaggctggcgacccagagctggctgtatatcgttgatcgacggcgactcttccagtttcagttgcaccgcctctgttttcgattcttcagctccggtcgactgccagcagcatcggaccgatctgcttgccgtcacagtctggaagtggtacgcagcggtgtgggcgggagtcggcgaagacggcaaagcagctccatccaaaatagctactctatgagcggttgcacccagctgtcgggggactggaggacacaaagatgtggcacttgggcggctgtaaacggtgctgcaagtctgtttgtgaagttgtgaagggaacctcgggcaatcctgccgcttcagatcgacggggtatctcattgtccacgtagcgtgattttgagtttgcatgcccgtattttccaggggcggcgatggaaattgccgggatatcgtagaatcaaagtcgcgagaaacagccgcgcgagatgtgcctctaggtccggtacacgacacggccgtctggtcaggggccaccccagcaagagcatacacactctccccgaggccatgagatggaagggcgggatgtgacatcattgttgtcacatcctggaagacgcatatcgtcgcaatgaattggtcgccgtggaagaagacacgctgggaaaaactgctgactgaagcgtgagtgacctcactcagaaacgaggggactcctgttctgttgggtgctcggtcccttgccgcccatggaagtcctgaaaacggtaagcaaatgaagccactggtgggtgagagaagaacccggcgctcagaatttctggagggaaaaaaatcttgacctcgctccctgctgcggccaggagacactcgtgcactagctggccaggagtgggaacagaattgcgcagcttaaaagcaggccagctgcaccaagattcatcctgtagccgaaagacgggaccagaggacgaaggaaaccactcaacggggcttgcaaaaaatgtcgttgtccacttaagattgtcggcggcgacgtcgtccgcaagcttcaggtaagagatgatgagtctttgccgtgagcagaagtacgtgcactggcggaaactggaatgtgaaaacgtcaagttgctcatttccctccgatttctgaactttagatcaagagactgccactactcgccacgaattcatctcttcggaatcactggtcggtatcggacgaagtttcggtatctctgggcaactcgacggctagccacgtaaagggaggtctggagaaggtaatcataaacgtcggagtcgaaacaaccgatgagtaaagtgtgattagagggagcaactgactctggtgcgaaaaaagcagctcttctggacatggaaaagcgtgatcgatgcacgcgttcacctgcgtcgagtgtgccatcatcggaaccactgagtcgtctgcagctggacggggccgcgagcggttgaacctcccgacaagacaccgctaatacgaggggacacaggtctcagttctccactcgttggcattctccggacgaaactcgagataagtttggctgaattccaagaaggctaccaaacgtgccacacaggtcggtggcaacaaagcacacaataaggtggcgaaaagcccgaaaccgaatcccgacgatgggtgcgcccccacgtgcgcgacgcga

SEQ ID NO: 1921 - DNA, 1838 bp, Toxoplasma gondii
ctgctgtgacgcattttatccgggaagaaaagaatctctaaactggcacaaagatttaggttccccgaagggctacgaccgcacagagtgtggtgaacgccgtttcaactgagcacactagaggctggagaggactgtgttctcctaaaccagctcctgtcgtggttctcggcatcaaagtgacgacagtagaaaatatctttagtaaaacaaggggactgtcttcctctgctccgggcacacagacacagatagaccccagtgatcattgtgagcttactgcctactggactgctcagtttgagccaaggagttcaaacaggacgcaacagcaaaacttagaggttacggaaaaaacaagtgtcgcgctaggttttacaaagagtcggccccaaaagtctagaaaaagctcatatctaattagctaattggtgacgtaatagttgtaccaaggcgaagatcagtagctgccttgtgaggggaaacctgaataatattctaaataatttgaaagcagtttaagcatcaaaatatttggggaatagactccattagttaaaataatatttcctactaattataaaatgtaacaatttaaaacataaaaataaattatcgtccattaaaacgtttactagaattaattattgaagacatctcacgacacgagctgacaacagccacgcacctccggcagcatttgaatcaacagttctacatagattcaacctagtctggtgaggttcatagcgtcacatcgaagtaaatcacacgttcctccgctcgtacgagcaacgttaacttctgaagttcacccttgcgagtgtctcggggtgcattgccagttttgtcctctcttttgagcatgcagaagtcaggtgtcgttcttggctggcgacgaagatactgggcatccggacgcccggcagaaaaatgcaattcgaattgtcgagtctgtctggcttccacgagcgtgctgcctcatgcttgattcaaatcatcgcgggacctaatttagagagcatatggagggtaagctggaaactttttctgaggtcagcatctcgggtacgcagatgcgcataagggcatgtcgaaagtgcaaccagaacggtttttgatagacttttcacttaagcatattagcagtatctctggttgatgtacagcagacactgtttggggtccactacctagtcataagttgctgttccagatattgaagattgtgcgcgacatagaacttcacaactttgcagacacgtctgccgaacgccgtttcaattgagcacatgagaggctacacaacaatgggttttcctaaacaccagctcctgtcgcgttctcgtcatcaaattgacgacagcgggaaatatcgttggtaagaagcacgcggacagttttctctgcttggggcacacagacacagatagaccgcattgatctttgcggggttactgtctcgtggagtcctcagtttgggctgaagagttctttgtgtacagtttgtaccgcacacccggaagcagaccgtcttcttcgaggaccttatgcgttcgcattggcaaaactcaaaacagaacgcagaaagtttcgcttacattttagatggtcatattttccgtagccgccagtttttgatgggcctagctgttgtccatatttcccccagctagccagagacgcgtttcttccttgaactgggtattgtcttgcaagtgtgtttgtcgccaactaggcatgagctcgtaatttttgaactccaacggaaaccgttgggttttagggttgttagacaggcgaatgccgtgcctggggggaaaccagatacaacttga

SEQ ID NO: 1922 - DNA, 4401 bp, Toxoplasma gondii
ctcctcgtcgctctgctgtctccatggaggttctgaataagagaagccgacgcgagaggtccacgcgcggctggaagtagagcgcaagcgaggcctgcgcaggagcaagaaggaatcaacgggaggaaaggagagagagtcgagaaggcgagagcgcgagaaaagaaacgggaggaagggacgcggaaaacgaaggaaatccgtcagtcgctcgttcctgggggaaccgaagaagaggggagacacgaaacaataaaagccagcgaagacgaccggagaaaggcgaccccacagacggaaccggctctctgaagaccaaaacgaggaaagcctgctgaagtggtgtagccaacttgtattgagggtattgacaactttgctggtgcaagaagtctggagaagatatggcaaggaaaaacgttccttgttctcgcgtctcccttttcagtcttctcttctgggcttcagcaaccttctcgtcctgctctcccgttccgtctcttctctccctcgaataccgccttcctcgcgcgtctttcttctctcactgctctgtctctactctcgtctgttctgtctctgcagtctcactgctgcgctgcgcctttgcgaacgccctgcttctctccgacccaccgagaggcgagacgagcgccgagcctctgaggagcggaacgcaggaaacccggagaggaaaggggagatggacaggcagcagcggaacgagcagaatgtacatcggaagagggaaacgagaagacgacgtcgaagaggtcgagcaaggagtcaaggaaaggaacgtataaggagagagtggagcaagtcagaggcgacagaaaggacaaggaagacagaagaaggagacagagagaaacgggcgttgttttgacagctcgatgtccagcgtatatctcaggatcacagagggtgcgcgtcgttcggcgagaaacggtacatgttctctggagcaaatgtgcagcgagagaactaacgtcatttgcttggcaaaagtcgaagaaggacagacggcaacagaagaaaagtaggaaaggaaccatgagaaaagtgactccgggcaaccgaccccccgcccccacgattcctcggtggctagctctgggcatccagagctgctgcggatagaagaagtaggtgagaaggaaggtcagtttcggcgagacgaaaatctcgttctctctgcgtaaaagtcaaaaggcaaaggacaagggaagcacagaggagaaggcccaattccagtcggtaaacgagtcaggaaacgctcggaaaaaacgaggatcatcgagtcgcccggcgtccccatgcacatgcatctcacgggggggcaagggctaccacgggtggataggtttttgtagagttttctctcgtctctttcctgacaagaatgcttgttcaagaaaaagcctgctagacaaacgagccagtctttcaggatctacaatttactcatctagaaaaaaagtatggcgtcgccctccatgtatacgggaggagggaacgttggatgagttgactgcgtgtagagaaggaaaagagtagaaaaaactgtggagacggaagaatgtctctccccacgcgcctctttgctttagttagaagacgttggactgggtcaaaaaaacgtataaagaaaaatgtatctatatggagtcagaatatatctatatatatatatatatatatatatgtttgtatttgagatatacgcacatctatagggggataaatagaagtatagatacctctctatctctacacgactatcttataaagatttcgagacatgcttgcatctgtaggtggctacaggaaaattcttttttctgtgagagagttccgtccattttcaactgggtttcaccacgggtgcttttttgtctcggagtttctttcttttacggcggaaggagtatatcgaaggacggaagtcgtacacaaatctgcttgtgtgggcatgcgaacggcgcagaaggacagactccacgttacaagaagtgagagccggaaattcgctcctcatataaattgctcggaactcgaaaaccgcatcgttctgttggaatttcttctgttatgtgcgagactgaataaatctccagttatgaaacaggggaagcagttccacgtcatcgtataccgacgacgccatgaaatgagtagagcagctgaagatgtcgatcttcagtgctgtggaaatgtctcaggtattgtcaatcgcgttgtcggtttggaatcccggacaaccgcgtgagttgttcatttctctccttttcgtcttgcgatatttgtaaaacatctgtaccacgagaggaaggacgaatcagagaacttctctttaagaaatctcttgtgttccctgcttatgataggaaacggcagaaaccgtcgctgaagaaaaccacgctttgttcgaacgctttagaggccttctggaatttttagtctccgaaactgaagacacctccgattttcaagttagcttcaattccagagagaaaaccaagacagtcgacgcagtccaacttttccgtggctgccgacagttccgtttgtttactttcttatgctcttttagagagagacacaagtcaatgccttgttcggtgtcgaccgtgcgatgctgcaaagagagggacggtttggctttgtggggagagatctgctacagcacaccgttgtcttgcaagacagttgcagaaacgtgagtgaaacctgacggcgagattccgtccagtcgtgtgcccggccgagtttcttccgttttggggaagagcatgatgtttctgcaagctgtcttttctgccgtttttcgtcacattgacttgcgttctcctcctgtcgtcctggaactgaatctggagcgaatgtagacgctgttgcgcaaggaccgagattcctcctcttcacgctaacggagagtttcgctgagactggaggatcctcatggcgcgctgcgcctgcacagcatgtgtgtagaaccacttcgagtttctcgagaaacatggttgggttttccgtcgctcgtggaaatgtgtgaaccgcattcggggacgccttcctcggccgacctgcgtgctgcatttccgtgtgtttcctgtttctcgcactggcaagacagaatgaaattcgagcagaaaaatgcacacgcacgagacttcagaagttcccctttctcgtttcggagtgacgcgggagacagccacagcgagactgttcccttggggcgactacgactgagaagcggactcgctccgcgttcaacagcaggatttttattccagaaaagttcctgaaggctttctgtggaaatggaggtccagctagagaggcaccaccattgcaggctccgcagtctgcgttttcctgggaggaatccgcgaaacaagagtttgacgtaaacagacactcggaaaagaagcgagtcccgaaaggcagcgatctgaaggaagctcctcgacaactgcttcaccttcctgcgtttctgttccccacgaattcctctccctttcctcgccatttttttcgttcgctgaaaagcttcttaccttgccgctaccttcgacagcctcccagctgctgggctggaggatactccgaaaaagaacgttcgtccgttctgttttcgatcggcggctgttgccttcgcgttcgcttccggttcgtcgagcaatggaagtcttgaaaacacaggactcttcgctgcgtagggtcacccccgtcgggccgtctttgcggtgtgctgagaaaagcggtgaagacgcacagcgacagagcgagacacctcacttttcgtcgtcacacaccccagcagacggatcgtatgttctctttgcttctttttccattcttctttctcgttccctcgtctcctctctatccgcttcgtttctccggcgcgcgcgcttccgtcctcggcccggcggctttttgtctgcgcgctcccctggcgagttgcgaaagagactctctctcccggaccagccgactgtctctcaacgagaagaaaaggcctttctgcaagagcttctgtctcgcgttctgcgtcgcgacaagctgactacacacatgcgcatgcgccgttgtcggcctccttcacctcacttcgggagttttgagaaggcctttcctttcgtctggacgtctctgttcaagcgtcgattcgtgtcacctcgtcctctgtgactttctttcttctccttcgccttcctctccaaaaacccgcggcgtctgctcgtcctcccttccttttctgcttctgagcacggaaacgccggtccctgcccagcgagacgcagaaagagaaagggtgtgcagaagctcggcgaacagaacgcctttgtcctcgaatcaaacgttgccaccctttgaccaagagaatca

SEQ ID NO: 1923 - DNA, 2584 bp, Toxoplasma gondii
ttcttgccaaagacagcggctgcagtaaatgtgttttcgactaggagtggaactttagcttctagagctgtccagcctctttctttccgctgcgaattctggagcccgcaatctgttgtctgcaattacacatatctctcctccttgtttcgtctgagcaacgttagggcagggacaactatcctaacaccgaggtctgacgttaatttcgcggagaagcgaaagttttgtccctcgtgtgttccgagttcatcggcagattccggtgcatccttgagttctgaaggacacaacggtctcgatttcatttgcctcctctcttgtctgttcaggagtctcacttgcccgaattcctcaggttttcaactgaagttaattcagtgctcttaattgctcttcggccctttgatgcgcgttggaagcagagtgatgtccagccctcaaaaaacacggtactgaaaaggcttgcgtcatggttcgatcagattagcagggcaatgatcagcaagggataatcctggaagcctgttatttggtgatggaactttctccaaggccgctttgctcgctagaattgggcagagaaggtccttttcagaacaggccttttttgcctctttatttcgtaaggaccgcttttcctgctctgtcgcttcactcaagggcaccgtgtgtgtggagacgacacagcctctccacgctttctagtcagacaacacactgtgttcacaaacggttcttacccctcgcttcaccgcgttcgcaaaccccgcatggcaacttttctggctgcctaatgacatatttcggtttctcggcaattgctcgccaacccaggagtgtatttgttttcgtccataagtcaaagcaaaactctgcagcaagctcgctgaccagaaccaagccgcggtgtttcgtccgaacatatctcttgccacgggacatgctttacacgagatcctgactcttttgctcgggtgccgaccggcggttcgggagcggggtagctttctcctgtgttgatcggattgaaaagctgccatcttcgaggggttcaataaaggagaaaaagatgtctcagcatcgtcagtgcgcccacgagtgacctcaaattgagacggggttcgacggcgtctgttggcacagtcacccgccactcacaggaacaagatgccggtatacttccctcgttggagcctgaatgttgtttcgaacgacggtgaatcacgaaatgatgagtgaaaggcattcgatcctggtgtgtttcgatgaacagctctctctgacgtggcgagacgaaaaacctgcggctactagcaggcgactctacagactgaacaaacccagcgcaagtgacagttcctcgcgaattcctcaccgtttggttttatcacaacgttgccacctgtgtgtcgactcattccgttctcgttcctcaacacgattcactgctgaaaacttttcttcctcgcaacgtcctgacgactttttcgtggcgaacgtggaccccacaggcaatccattgtgttgcgacctgccctccggacggtttacgactgcagaatgtcaccctttccccggaaagcccgataggttcctgtgtaaaagaaagtggcaaggcgtgcggttttgaacgaggaaacagccaaactgcccgcgggtcccagcaggccggttgtgcccagagattcacccgaaaccttctttgcgcagttccgtgcgaaagtccgcctgcacagtccgtacatccgccgagtgtgtctggcgcgcgctcgcggcgccaaggcagaaaagggtgacgaaatggaagactgagcgctttttcctgtacggtgtggtggctttcttcctggccgtgtgttgtgcccttctttctctcctcgcttcccctgcacctgctgtgcgccgcgagacttccgtcgccacgggtgcctcgtttctgcgtttctcggttcctgtcttcccctccagacgagccaagcagacgaacgactgggagaacgacccttctttgcgcactgggcggccttctgagaaaactttcccctttctttctgtcgccttgcaacttcctcgggcacttcccccgtttctctcgacacaaactttgcatgcatcgaactcgctgcgcaacccaggtttccgttctcagtatcgcgtcttcttcgcagctcgggcctttgctctccgttcagcgaagcgggcgagtgtcttttccgcggcctcgagtctgaaaaatccaaaaaaatacacagctgtgacctctctccgcgcgcgctccccccccctcccctgcctcttccttcccctaagcggttgcccccagggacttttgattctctccgcagtgtttcttactgagcctcgctctcagtttcgtttcctttctgttgctgtctgatctcgcgtccttgcctgcctccgtcttcgtctcccggctgctgcctgttttcgaaaaaggaacgctcacgccgctctccgtagcggccttgccagagcagctgctcgcgcgattgaacttggaacaaagagctcctgaggtcgtttcgccggtaaagaaggtcggggcgcgacgcaaaagcca

SEQ ID NO: 1924 - DNA, 2511 bp, Toxoplasma gondii
ctgctcattccacccaagaagatagactggttgtttagagtttagcattttgaaacgtgagcgagtagacagggagtctgcgcatagaactgggcattcgtcctgaccactgttgcatgtgggacgaatcatcagagtatcggaaatgttgatttgataatttgcatctcctcaacatagctgcaaaatagaatgcacgttctataataacgtgctgctctatctacatatcaggctgtagagagtcaacaacttccttagctacctatctatcggtatgcttatcaacctacctacccagcacatgatgtttgtgcctgagagtcctctacttgtgtccacatttgcggttccccccgtaattattgtttctctcgtatgcagagactagacttatatgcatcattcaccttcgacaacggctgggtatacatgtctggttgtcgcagcacacgctgccacagaggaggttagaaggaagtcgacaccggtcctattatgtactcgccaccgagccaatgcggtgccgtacgtcggagcaataaacaacgtaaccataatgaatacgtatgtatagggaggtcactatatacatatgggacctctccgaacgtcgtacaaggagcacagccatgcacaccaacgcgcaagtagctatactttgatgctagttgctgcattcgcattgtgtcgtttatgctttcatgcgcaaaaatggaagcaagaatcatgccgaatgcctggttctaagtggactgaatgcaaattttggcaagttttacatcattccagagcccttcgttatggacggggctcctgttcgggctgctgggttacgtgactctgtcagctttgggttaatgtaactagatgaataacgatcgtacacatttggtgggtgggtaggctgctgatggttattttcagcgattaaaacaccactagcgaactcttctgggtacgcacctaccaggcacctgccgaccactcttcacatgccatttatctaaaactttttaaaatagaattatctttgaatatgaggatcgacatcgacaagctcttgtcagcttttgatgaggggaaattgtgactggcgattatcccggataacgcaattcgataaatctacggtctaaacatgtgcaccgcctgtccgtgtaaccagcaaacctcaatgtgctttttgttacgcggcgaactggatactttcatccccactcgcagacgtcgaggggggatagcatccgcatgttaacttagtatcagtaagtcaggcggttcacatcggaagtgtacgttgcttgccgttcattgcattcagaatacggaactcatctgaactatttatgcttgtacaggtgatttaatggaaccaaccttgtggcttggcctttcggtgtcaagtggtgggaacctgggcgtctctaaaaggatcacgactgcggtaccgacgatggcactttacaacccgtatcgataaacagatgtttagagtacacatatgttcctgttccagacagacaaatcaacagcgacgcatgaatcaacggtcaacccttgcacgggctatctggcaatcgttctgctacttttcaggtctgacactgctggtatgccggcgcggcgttaatgccgcgttctgacaacaaacgtgtaaaatgcttttcagtgccgcagctcacgctttacaaatgacttgactccatcctcgtggaccaagccaacttcttgcgcgcttcgtcgactgatagttagccgttcgccgattgtgcttcggaactaactacataagctcccgctaagaaccccacacggtgtggtgttgttttttgcgacggccgcagaacaggtgcttcttcacaggccccacagggccctttcaaggtggtcacagttttaaggtttcattcttattcccatttcttctgttacaagacggacggtgacagaggagcgtattcatctgtttgccgggttcgcactctgaaccagttggctgttttattcgtcactaataaggccggggctcggatcgccgttcagcgggcttgttggtctgtgtcgactttgtttggcacgcctatttctcgtggcgccgtaaagcaattcaaaggaacgcgtggggcatccgaacgaactcacttttcctgggagtttgttcggcttccggcagatccattgtcattgcttgtctgagcgaggacatccaatccgtgtttctgtgttgtcttagcggctggcttttgtgtcagaaggaatcggagctcgcagcgcgtcggtcaaagctttctgagacgtgttccttacactttggtgcctccatctttatacctgtgtgcgactgctcggcctactgtgaatagtctccgagctgccgtgtcggccgaggcttaaaccgatgatcggatgcctactgaggcacagcagcactgtgcagatactttgagtgaattcgcaagtgtgaattcaccagcaggaatcgtggtagactttgtgcggataccgtca

SEQ ID NO: 1925 - DNA, 1584 bp, Toxoplasma gondii
tagaagtggacagcacagaagcaggaaaggtggagacaggcaagaaaggagaggaggacgggggaagcggaggagacgcgggaggaagagacggagatgactgcgacgtaggggaggaaggcgacttccacgggagcagggagtcgaaggtagacggcggacagttggtgtacagcgaggaggcttcgagagaagaggcaggaaagcaagaagttgatagagaaccgggaggaaggagcgcgtttgaagcagacacgggagaagattcagagtctatgtctgtagcgctggaccgcagactcgcgtggtcgaaatccatggtggtttgcgctttgaggcgcccaaaacgaagcagagggccttggtcagcgacttgtgcatctcattttcctgtctctgtcatcttgtgtaccgcgcccgcggcctcgcgtttcaatggcgaagggcgaggctctctctcgaagacgccctaaagaaactcccgcgaaaaaaagagcctcacaggtcaggcacacgagtagcctcgcgcgacgcttttccggtccggaccgggtgtatgagaacgcctgaggtccacgcctgagaggccagaggaggcgttgcttcgcgcgttactccgttttcccttcttgcatgttcgccgctttgctcttcgtgctcgtttcgaaaacgtgtctcctcccggatgatctggaaactgtgtgagacgccttattcgtttgaagaaagcggcgggggacggtcgtgtatgttcccgtaaagtttcgaacagtagacgtaaactgggtcgaatagcaaggggcttgccagatcgaggttcctcgcctctctggagcgtcgcttttccttcacgagaaaagccacaaagaaaaaaagaaagacaagacacatctcacgtgtgatgttccctcgtccaactaaaaaccataatgcagcgtcgtggcaaaacacttgcaaccttgcgactcgccgagacaccgagatcctgaggtgtatctacacgcaggtctctctgcgcgaaaactccagcttcagtgtttcatacgcaaagacctatatgaagctgcgttccaatgctgcgatggacgtatcctttttttccgtctcttcgcaagtctccttctcgagactcttcttccgtgcgcacgcgccgtggaggccagctgactggtgtgtctcgagatcgctctcactgtgccgtgtgcccgtgcatgcagttctgggcttgtcggcttatattagggcccccaattttagcttcgaggcgggcgcggccagcgttttattagccgacacaggaccgcggcgggcggctctcaattattactctttttccctatcggcttttagaacgaagagtgtgccccgcatgagcgtttttcggagagaggggaagagcgggagacacagaatcgcgcgcggtgtatgtacaccctgttctcaacggattcgaagtcgccttcccccggtttgctgcccgcaggctctcttgttcactttctttccggtttctcgcgaggcgttggacaggggactcgaggcccgtcagtttcgcgcgttttcctgttttcgttttcctcaaaa

SEQ ID NO: 1926 - DNA, 1859 bp, Toxoplasma gondii
cgtcgcagtggtttctgcatgttggacaccgcgtggtcggtttttttatcctggcatgctcttccgtcagcgcccgaggcggacacttccagggcgttaattttttgtttaacgcgttaattgtgtatgctgacccgttggtagaccaggtcgggtgtacaagaatgctaagaaacagagaactatccagaaggagcagctgacagagacgttagcacttttggggccccagtacagtggatcttcttcgaccctcggacacaaggttcatctcagactgctcccagctgtcgggaacgtagcattggcgggacacctgatgctcatgaactcgcctttcaaaaaaaggagtcactgtggttagcgagcacagaccgaaatgcaatttcacaagccgtggacggtgcaggtggcatacggaattgctgtagatcccgcgtagctactgcttgtgcacttcatgtgacccagctatgcattttgatgaaatcgacccgctctttttgacagtgatacgagatattgatacatgaatcgaacgccacgacaggtgctttgttcgagaaaagctggcagtccgatcgtatatttcgttccagggaccgtaccttgagtactagcgtgaatgattaagaaactggtttgttggcaagttatgtaatcatcagtagtactgcaccaggaaacgaatacgcagcagcgtcgtgtgccagtttagaatctggagccccaacgcgtgatgggaagtcgcaccatacaagggattcgtttggccttatgcaatgaactggttagagattgatattctagcagaatagagaactgttttaaccaagcagagaatatgtcgcggaaacgttcggagacattacacgtcaacaagtggatagagccagtgcacacatgacatctgaatcacgaaaaccgataaaagtttgtctcctgtccccttaatagctatggaggatgtggtatatacgcttgtacacaatgggtttatcttggtgatacttgtagacccaagtatgtgctccgtcgtggaagttttctctagctagaagaggcacaggaaaatgggtgagaaaataccaggcttatgtcccacctttgtctgccaaaatcggtccgcgctagacgacaggtaagctgtgcgtgacaagggagtcactattctatcgcgagtcgcgcgccacacacattctgcagcttttttgctgcccggagctgctgtttcacacgattgatagctggaccgatgatcgcgtaatcacggctgtgatgagtaagatatcgtcacgctcttgtcgttcggcaacgacggtacaaaaacagacgcaaagtttgcgttcgctctcgccttgattttttcgcgggacaccaatggcaattgcctcggagcagccgaccattctccggcttgccaaaaagcattacatgcggaaccgctgtgcgtgttttttttctgaatcgtctatatgcgtggttgaatcgtgaatctcgactaggacgagaagaacacacccccggttgtatgccaatattgtacagggagacttcgggaggtacctacacatgtagcaactgctcgaatggcttctcgtgctccctgccactcaaaggtgtatgacttcttggcgttggtatttttgctctttcgtaaatttgggagattttcctcggggaaatagcaggtttgaaataccacttgcgttagcgatttgtcagcgctacgctcaaattgatatgcatacccatacctacgcacatacacatgtttgaggatatagtctgaacgagtgtgttcaagatttctcttccctggtagggagagaattgtatttcctgccagctgggagcaa

SEQ ID NO: 1927 - DNA, 2681 bp, Toxoplasma gondii
aatcgttgtgtattgtgtcataacgaggtcaaactctgctctgcaagggagcagcagagcgttcgcgtatgcggaggctggtaagagataggggtatctccggatgtgacggactgcacaaatttcgacatcccagtgtcataacggcggccccaactggcatgttttgcagcttttccctttcggcagcatgaatcaatgaagaaataacatggggctgccacccatcctgaaagacagagaattaagccacgttacagtggtgctagtcttatgcgtttattatgggtggcacactggacggtgtatgttgttgattctcttgaaacagaggtttctcgtttgcgtaagcattcgaatagagctggtcaccgtgcgatatatctgtacgcggatggggggatggcaggcaaccgcgctatgttgaatagacaacatgaaatgttatccgagggagttcgtcacctgcatctggaatacccgttcagttcgcgaatgtgcgtaccgcggcagcatgttccgccgtgctgtgcgcagcctctaaaggcggcagcagcacatgcaagggcgtcttcaagataccaaaaacttaacaagcgcatatcaaatagcgtggcagccatgtggtgcacctgtggttgtgtgtcctctaatcggctgcctcagcatactggacgacaaaaattgttcgccggcacagtgacggccctacagtcgtgagaggagtgaatcactaactggaacagggggcgcgttctcggcggcgactacggctagagatccagcaggtaatgaacgagatggctttctccttatttgccacctggcagtgcaaactgtacctcagcgccaaggatccaaatctatcgcatgtcgaacacttcgggtcgcgcatatgctgtgtgtctctagagcgatcactcttagtcggcaggctactctttgttcctttcgcgcatgcggaataacagttgctcgttgcatgttaaatcaaaccgtcatgttgatgtgatgtcatgaattgagaagcatccgtcctatccgtgacacaccaactctcgacactacaatagctgcagaccctaggaagcacagaagctcaatgagggtaacgttttgctgtgcccttgaaaatggaatgcgctagctaccataaaaaacggtttagctctgagtttgatcaatgagtgaaaagcaatcgctagcatcgtcagcatccactaattgctaccactcctttcgtgcccgtatgtctcatcggcgtgaagccctacactgcgcaatgtaacgcttttgataccgcaacttaagcaactcagcgagccgttctccctccgtcgagatagccctcgtctacagaatttcaggtacctattcgccagatcccgcgagatgccgtttctctgacagcccttctcatttactcttccgccttgccggtataactcccgctgccctatgttgattctctctgtgtcactaagtcaaaggaaagcaccttcgcagaccgccgtgaccacaacaacgtgcaaatttaaggcagatgaaaacccgcaacgctaaagagttgccatcgccgcagtgcccgtgtgataaggttacaggatgcgctgcaccgactggctcgtcctgtcgagcctttgaggctaaaccaccatacaatttgtatacgtctttcagcggaccttaagtgattatgcagtagtatacttgcacctgtgccttgagaaaataatctgcaacagtcctggtcaatgaatacaacctgatatccagaattggtagaaactaccagcacctctaacacgcgaccagtgacgcccactgccacgaaggccgttgacaggatgtctcacttttccccaggccgggtttgcagttaaggagaagtctacggatttagggtttgccgttccagaagtgttgacatggttagcacccgagttatgttgcgaacgctggtaacaaaccagagccttgcagaaagcaggcggtaacacaaagcttgtcgtcttaattgtggcgaaaatcattacgtgcagcgagcgcacggagtcaactactattgagcagaagtatgcttgtaccatgggggggcttcacagtgatgagagaacaggaaccacgcaggaatcctcgtagacgttttagaaagcccagttttatacggcgacgtcggcgtgagacacaaatttacgctgatcgtagcggggtccccaaatatatgaattgaacctcatccttgttgtgctattcacaatgtagccttactttgtcttcagacatcgaactctctaccacatcgaactctctaccgcggcggacgttccctactccatttgtccaattccctttaggtgctcttgcctccagacaagaattatcgtgtcactagacttctatcgaagtgcctcggactttttggcagtcctgcccgaaaaggaaaacttctaaagcgcgccatgtcgaaactcaggtcgctgcaatgctgtcttgccgtcgttcttgatgctcgaaagggactagcctggtagcagcagcatgggacgttggctagtacggagagcttttatcccattctcttcgttctttcgtttgtttggcaaaattgccacagtttgcttgaatctttgagtttcttgagtgtctaaaagattttgtcgaacagttagtgagcacca

SEQ ID NO: 1928 - DNA, 1482 bp, Toxoplasma gondii
caggtgtgtgttggcagaaaacaaaggtcggaaaccagaggaaaaacagaaactcacagaataggcgctgccatcgtacgcgaccttgagcagaaagtgggctgtaggtacagcgtcccagttgaatgcgcgtttctgcttctttctcttcgcctcgccaggtgacgcagctcctgcaagctcgcgctctttccctgctccagaagggatcgaaaggggagaaggagaggaagaggaagaagatgaaaaagaaggagaggaagaagaaggagaggaagaagaggacggagaggaagaagaagatgacaagactggcggggaaagagcccccgtctccatggcgacgaaggagagagggaagcagggaagaagacagataacaaggtgaaggaagttttccagatgcctcaggcgtcgacagaactcaaccttctgcacttgctcgcgtcagcggccgactcaggacagcggggaaagcggggacggcggaatccacggaggaaatcgaaaacatggagaaagaaaggcagcgacacagagaaaaaatgcggaagagaactagagaagagaggagagagaagaaagatccgtcgggcagatacgaaacctgcgtagatgcgtctaccgtctatacgaccagtccagcgaaggccccaatgtgaagagcagctcaagcccttcgcatttgtcgacagcaattgatgaaggaagaaggcaaccgacgaagcgcagtatctacgcgttcagcgtcgcgatttcttttttgtcgccttcagtgtgattgaagaaaggttttgattcgccaaggaaaagaaatcttccagagcagttgcaaggagtccatcgagactttctctgcgttgcgaggacttgcatgcgcatgcacacttgctgccgaacctttctctagagactcgacaagagttatcatctcttttctcgctctctttcgctcaaactttctcgctttttttcgtctcccagcgagggtcttctcttcttctgtctctgcttgtttccgcgtttccctggaaagcatgcagtggcgagggagttgcgttttagcaaccgagacgaaggagaaacatttcttagagttccttgcgatcgtcttctgtcagaattctcagtttcttccagctttcgcaggaagaaaaaaccactgcaagacttcctccctgacctgcgaaggaacgaggcggatccgcacagctcccgttcctgtgttatcttttctttcctcttggattcttctcttgcgcgtttcctcgccgcgtctccatcgcctcactttgttccttctacagcatcacttcttgcctctctgtgttgcccttccctcttcgtcttctctctgtctcctctctcttcttccctctccgctggctccctgctccccaaccgtcgctctcctgttccactctacagccgcttcgtggacatctttcgtgttccagatctcgagtttcccctgaccatcca

SEQ ID NO: 1929 - DNA, 1536 bp, Toxoplasma gondii
aagtcgcacaaaatatacacataggcaggccgatgcatagctggataaaagtatacgcatgcagatatatatatatatatatatatatatgtataaatatacatgtatctgaaactctcagatgattctatggatgtagaaagacatgtgcctctacgtgtgtgtcttttcgaaccgcttcttatgtgtgtttgccagagtggacatgttcgtctgctgttcttgaaaacgacagtttaaaaaggcgcataccgacgcctcatttgcagggggggacgaggtactcgcagcggtggaaacagaggcgacgtgagaggtcagaagactgtcatcccacacagacaagccacccgtgaaaggagatgccatggtgtctgcctgcaaaagacttcgttctctgttcttccagcaagaaaccgcttccctgagacaaggaaacggcagacaacgtagaggagagagacggagagaagaggatcggcgagaagaacgcgagtgaggaggcgtggaggaagaggctgccccggcagagtagatggcagatgtcgaggtcgaagaagtcggcgagaagggagagaatctctgaggaaagagaaccgttcctggagtcggtgaggaagaggacgccacagtggaagcagttcggaagggaagaggaagaagcgaggagagatccgacaacagaaaactcggcgttctcaaacgcattccaggagagaaaaaggcgaggaatgttaccgctctactgaaagccactatattaaacgccgcatgcagcggaggaggacggagaaaaaagagttttaagagaatcgcggggacaggcgaaaaaactgtagagaaatcccgaccgacgtagccgtgtctgcgatttaaaaaaaacctcgacgcgaagaaagaagaatgacaggactcgctgtctctctcgtcctctccctgtctccttccacagggcgatgcgtctccggtgtcttcggggatcttacgagcggaaggactggtcgaagactgggacttgaagatgtttttgcatatttgagaccaaagagacacccaacctttggaaaacctcgctaggcttctctgaagaggacagagggagagggggcgtgtctttccgcttgtctctcggcttcctttttttacgtctttgcatgcgaaggtgaagatgcgctttgccgggcgaccctcctggaagcctttcgtctgctgatttgcatgatttttttttcgaaaggaaggaatttttcaggttattcgacatcggttatgtcctaggcgcaatatatggattactgttatccctcgtattaacagcgagagaaaactactactcagatgctggtctatccctcaccgacttcttctgtgcataagctgaatatttcctcgcggacagaagccgccgtccagattcaaggccacgtttttttctcctctgtcgcttgcttctccagcgcccgttcaaactcgagtttcctgcctttgttgtgaaactccgaatcaacgtctgctcttccaggaaagacaccacca

SEQ ID NO: 1930 - DNA, 1873 bp, Toxoplasma gondii
cacaagccactgtgtcaacaatattgattccctcgacgagtgcttaactgaaataaaccctgtccagttgaaattacgtgagtacgcatgtgtctgccaattcccggtttcaaatccttccactcctctgtttctcccgatccaacatcttcttttgaagggtctcgatccgctgggtggcctcctttaattgcgctttcatgtccgaatcaagcttgtcacaccgctgcctgatgagagacaagaaagcaccgtcaagagatgtataaaagcattaacgtatgtataatcggcatgaaactccgagaggtcgacttacagttctcctcgtatgtagtccagtcgtttgttcacggtcgccgttgcgtcttctcggttttgtctaacaagcactggtcctacaattttgtacagcactgagtcgtcctggagctggcccagttcctgaaaaagacgaacgcaacaaaggatcgtttctcttcagtttgccggctctcagaaaggcaacccctgcgtattcgcacaagagactaaaccatgaacgttccgcccaggacctcaccttcgcaactccttcgttctcgttctgttgtgtcattagcttattcctcatctggaggttctcttccatctctgggagacagcaccaaacatggacgaatgccgttcactattttaaacgcaacagcggaaacacttggacggaccgaggtgtgccgtgaccatcaacaaatgcagagaactcgcgggaaatcatagaaaaaagcatttgctcaggagcaagaagtgtaagccgcctaactgaaagctctagctgttagatcggtgacgcgtgtgtgagcatgtcttaacagagtctgtcagcggcaagagaccaacaaatagcttcacaggactcctctcctgtgtcaccatgaaaagcaaacacaatatttatatctgttgaagaaggttgtcgcgagtatgcgtgtcttcagcgctcactcccgatgaggcgatcgaactctcgcatcgcctctgtcaactgctcctgtgacatgttgcctgaatcggtccgttctgtttcatccacggccacaacggactagtgttccacaacagaaattaaattggaggtggtaacttgcagaacgtccataagtgtctgaagctgcacgcttcgcacaggtatcgcagttcgcgcgggcgtttaaaaaaaaacgatgtttgcggatctgcctacaacactgcctccccctactggttgcatgtgagtgcgcccagcctacgccaaaagacgttttactcgatgcatgcaccaccggtttcagctcgcaaccacggccaggccacggccattcatgacagtcgaaacaccacacctttaacactacccttcgtgacttcagcagtcatcgaacagctgagcaacaaaatagcggaagggcagagcgaccgtttttcgtgcggacggtgtctctttcgaaaactacaacagtcactcgctgccgctgctgcctcgtctgccacgccccccgggggaccccgcgtgccggtcgagttgaaaacgggctgtcggacgactgtgcggttattgtcttttatcccgcttcattcgtcttccgctagcttagcaacgtcccagggtcgggtgcgccacaaatatgttattctcactcctgtatagcaaccgttgacgggaatatcaccccctattatctgctttcacggatactttcttctccgtgttccccttgcgttgttctgttttcgaactttcgcggttttgtccccttggtcacaatcctcggagcgtgtcggtgacgttgtatagcgttttgcgtactcatccctttcgaccactggtgacttcttcccttccgtgctaacagca

SEQ ID NO: 1931 - DNA, 775 bp, Toxoplasma gondii
gtctccgtgcgttccagttctgcagcttgacaggcgaaagagcgaagagagaggaggcgacggaggaagaagttgactccacagcatgcgagaggaggcgaagggggtgaagcattttggaaaggaagagaaaccgaaaaacctttgaaatgtgcgaaaaaggcgactctgacgaaaaagcagagaggcgggagaacgaggtcatcaagttcaaagagcagacacagctcgacaccgtgtcttcacgggtgtctgcgctcgagacgtccccgcgagaaacgtctctacggtgaagagcgatgcgttggactctactcacccattttcgtttcgtttcgcgctctcgttattcttgcgcaacgcgattggccctgggaaaacgaagagaacctgtttcaacggaggcgctcgtctgtcgctcacgctgtctcattgggaagccagacaaaggctccgttcatgttcgtggagggaagttgtgaagaaaacggatacagtcgagttcacagctcttcaaggcaaggctgcatgcagctgaaaaagcgaggaagaagatccggaggaaacgggagcccccccactcctagcgagtctgcagcaggggaacagaattgcgtctgacgaggaacgtctttgttctcggaaaactgcagagaaagcaacagcagaagcgaccgaatcgaattcgagttccggtgcgatatggggaccgagaaaaaagtgtagaaatggagagagaatttttgttggcggctaagagctccctgttctcaaa

SEQ ID NO: 1932 - DNA, 4258 bp, Toxoplasma gondii
gaacagaacgaagctagcggcattcgtgcaacttttctgcaatgaatgtgtacgagcatttgtctctacagactgtctgcccattggctttagcacgcaaccgcatgttttgcgtataccggttgctggaatgtgcgactcaacagagttcagtctctttcaagctggcacacgtcagggtctcgatgccatgataaacgcaggcgaaggagcggatacagctcataatcctgtgttcccggtagacgccgtagaaaaaccagcataatcgtgtagtcttggactgtgtagactggacctaaactacttaattgttgtcagcatcctgtgacctggttatcgaagcatcattttcttttaccaagcgcaacaacacagcgctgaggacccgtgacctgttgacgaatattagtccaggggtcacttcagccacgtttttgcttagtgcgtacaagcccgcttcctttcgaacctctttaagaagcctcgcgaggagaagaaacaccattggtatcagaagggcagcagtctgaagtcttctggttggcggctctgtcgctgggctaaggcactttgctgaagccctgtcagccttggacattcgacagcacacgcacgtccacatgtcgatttcgtaagctcggtcatcgcgtcgcatagttcttgttctatgcctctacgcaacagctggacatttgggacttattggagacgtggtgtttccgtcttcagcttgtgcggatccttggacaaatcctgcttgcactggttgagccacgtaaacggcacagcctcaccactgttgcaagtgtacaaccgcagaacaatagtgcccgaactgctatcgtaccacgagagaacagaggatgcagaataagcgatcaactatcacattttcggaaaactaggtatcttagtcaaagagtttttaccaccattcttcctggagctgcgtcgaatgacgagagcaccttcgccttcagaagtccacggctgcttctgcaagcgattgaacgtatggtgtttcgtgcaaattttcatcagtttgccgaatgattacaatttcagctctcacaacctggtgtcataattaatttcagtcagatgagactagattttgcaagtgatgcttttcacagtgtgtgcacttgcacaccagattgattgtgtattacaagatagagtggcgtatgtgtccaagccactgaatccctcattctggctctgtattgtctaattaaggagctgtgaaccgatattttcggataagtgagactcgtggcgaccgagccaacactacagtgcaactcttgggacacaagcatggcagaggggctttgcagtgatcgaaatccaaaagaccaacatccgagccctcgcttttgggagcttttaaaatgatatttggaattgctgaaggcagaaatttgctgcagctgttcacccagacaacgaactcgacaaggcggatccgtgtccgaggctcgacgagggcgtttggcgcagtcggtagcgcgtgggtctcataatcccaaggtcgcgagttcgatcctcgcagtgcccagtgttttacctttgcatcataacaatagtccctgtattgcatggttctttgctctggctatgacctcttgcgtcgaatcttctttcccccccctttacggctacaaatcatattctctgggtcactggtaggtgcggatccagtcgctggggtgacaacacatgtatgtgcataaggcactgattatgccttaattcgaaacattcgtcgtcttgcaatacggaacaccatgactacatgagttaaaaatgattacattgtatctgcactgcagcgtggaaggcggagccctcttcgacgtcaaaatgccttcctccttcgggccccacatgctgccgagttttggatgccggtgttagcgtttgtgatttcaacatcagaacatcaacacagtgaatcatctctctttttttcctctgaaagggcgaatactttgggaaatgtttaaggcgcgtaggaaattaagggcacacgtgagaagtttttaataagtttccttcctttcttgccaaggcgggccgttggctgaacatccctccggagatacaaccgtcgcgctagaccactcaaaccttgctggcgacatcaggcacactcttgaagagctgtagtcattaacaacgttggttaagtataagcatagaaccaattcggtagttgacgactacggcaggcaacgaatcggggtaagtggcactgtgtcgccttccctctagcacactgcccttaatttccagggcaccgcaggacgtcgatggatgatggtgcgtttgaccgtaagtcggtgaatgttcactgtttcgttattctggtacggaaacgtgtgaaacctttgactaccatattgtgtaactggaaaatgtggaaaccaccacacgcaaggcactttccactgactctgcttctgtcataagtttagtgcttgatacgaccaccgactgccatcctgatgcccttcgaaggccgtagctgctttgcgcaccaaaaaaatactcatagcatatccccttcttcttatgcaaagggtggaagaccgcgacagctaatacacgagagaggagaacgttcgtgtccatggagcctagcttagacagccctcctggactgtgaaacggactgtgacttaaagtgccgacaatttattccacagcggctctttgtgtttttgttttggccgaaaggttgtcatactgtgcatggtgaaccactttcatgtatacgagaaatgaggccttctgttttctgttcgcaacctggtgctgttgctggctacggcagtcagcatagtcaacaaggtgtgcccctgatgatccatgtattcgaatggatgatcctgaccgccccacctgaataccgcacatgatcgtccgacgccacaaagtgatgattcagatactagtttacgcaatgcgagagaggaacactgaaaggacgcactgtcgctaagcgtgtgatagaagtttcattttgtactcagctgctctctgctgtctgcgagcacgttatcaaatcttggcactcgagcatccggcttcaggttcaattgtgcttacgcaagctcggcattgctgctcgggcaacctaaaacgggggttaggaatgatagacgcatgtatacgggtctccaaccgccagagacagaaacaatttttgaaggagcatacgcctctttctttcacgttgcagtgtctcagaacattcaggactgcctcctgagaggtgtctcgtcttgactgagtgtgacccatcagagctcgtatgaataactatagagccagaagcaattcctaccacagcctcgaatgcccagtccgttccgaggaagcacacggtcgttcatacggttagacctctcggacagtgtcaggcttttccgctagaaatgacatcgactgtagcagtccttctcccctgcttacaagcaatactgaccacttcgaacgtttttctgaagtcaccgattcgcgcgtctctcatttcgcgtgttacgttctgcgatctccgcattgcgcgggcaaatgcacagtgacatctatctaaaccgtttggtgctggtgcctgtttaacgtttcactgacggatcagccagggagcaggtaagacgtttacggggtgagccaattttcggggaaaacaagttgagccgttgtgataaggtggccggcgaagacaagttgcgggggtatcctttctttgttggtgcgagcagttaccgccgcgcatcaatggggagcggccacaactagcgagaagtctcgattgtcgatgcgcttgtggtactttttctcttctgccgttgagaggtcttacagacaactttttccgcacagttccgtgcctagaggcagaatatgctcaaataaggccaccccaattctcaattgcagcacaccggctcggtacagggagatgaggatctacgcatttggcctatgacgtacagatgtgttacgacaggtagtctcttctcttcttgcaaagtgcatcatctgctagtctaccaaagccacgaacgctgtctcttaactcagatttcctgcagccttgcctaatgctttggatacgagatccctttccattgtataagttccgtgtgtgtgcggttccttgtctaacacctttttatgaaagaaggaccacaatcgccatcttgtttccgtatgtctccgatcaccgtaacgcattctaaatcga

SEQ ID NO: 1933 - DNA, 2315 bp, Toxoplasma gondii
agttttcttccacgactctgttgcttccgcttcgcctttttcgacttgggtcgtctgtctcggagactcgctccggcggcgactcctaccccaacgcacatggagcgagagacagatggcctcccagcgacgtcacgacgtcgaaaggaagacacgagacagcatttccgcgcgagaaaaacagatacgcgtctcccctggatatatatctcacgcgttttcgcctttttttccgactatatgcatgggtttctcgcacatgaacactcgacacagagccgcctcctccacgtcccccagagcccctcctggagtgtatctacacctggtaggtcgcggcgagacggtggagaacgccttcgaccgccggtcgctgagctcggccgagtcgccaggcgacggccttcttgtctgttccgttggccgtcaggtcgaagacagcgaagcaccgcagagaaggagcggcaggaaatggtgaagaggaagcggacgaggaagagagtggcgaacgagtttcaggcttctgagtgagaggaggggaacacggggaggacggttgagtgagagcagctcccccgaacagagaggcgggcgtcagagaagacagagaagaaaacagagaggaggactcgcggtcagacgcgccagaaacatgggggaaacaggcactcttctctcgatcgcgcatcccccctcgcgagcgaggagtgcaggaaaggcggcgcatcgtgagggagagaactcaacgcgagcagagaagttctattcggtgaagcgaggccctccagagcggaacgagaagtccacctcgcagtgcatgtacgtacatgtacgcatatatccacgcctgcacatagtttgcggcaatcctagtacatatattattctagagtcccgagaagacaaagcaagaaaaggaggcagaggaagaaagcagaaaaaaggaggcagaggaagaaagaggcgaccacaagaacggcgcctgactgcggacgagacgcactgaggcctctgaagtgtcagcaggagacgatgcgaagaggacggcgcgaggacaaaggaagggaaaagcgaaatgagagaatcagcgaagaacgcaactacgaaaaaacgcgcgggtctccagagcgacagccctcgaacaagagaggtgcttttagagtctactgttggggaggaacagccaagtccacggttagctatttgaagacgttttctgtgttagacactatggagactcgtgacagcagcaaagtagtacggacaagaattcagtcccaaaaaaacaacgagcctttgagacgagcgacaccgcgccgcaccgaagaacggacatactctggacgtcgtttctcccaagtgtgcgtgccccttcgctgaagagaagcgggagcgagaaagaggcaaaggatacgaaaaaacagcaaggaaagaggatgaaattgcggccagacttggacggaaaggtcagaggcgacccgcgatcgcatctctgtggagagccgtgaggcggcatgcggagagggagtcctcgtccgacttttagctcgtgctcgccttctctgccttccggtgaagtttgtttctgaagccaagcaaaccccagtttctgtatttccaacgaaggaaaggaggtttcagttgcgcggaaaagcgcttgcggaaccgccgcgttctggtgggtgtctcaaatatacctgagcctgagaagagaggactcgctgcatgcactgcaggcacagcgtccggcgtgtagaaaaggaaaagcttcgttgtttctcgcgatttcggcatcattttcaccgcttgacggctccgcttctccttttttcgacccccgaagtggttgtttctccatactggctggtgttttgtttcgatccgccgcctcgacggcctcgcggcgacggtcttggtaggcgacatcctgtgctgcagcaggaggttcaggtcgtttcgggccgtgaaagatgtttgttcctgcgtgaaagtttcttttctttccgagtactcgtctcgtgcatccacgttcgtcttcttctctgcgcaggcttcacccttccgcttcgccgttccacgcgcatgcagccgtgattcttcccgcagcctaccggggaaagcctcgttcgaatcggcccttgaaaaacgctgcaagttgcccagcgcgctggagagccttttcttctttcttcctgtccgttattgtttctcgtcggttccttgcgcgcgcctcgtcgctcgcactcctctgcggggcctctggctgtgccgcagcgctccgtcgcgccgcgtttcggttcctgttcgagacaaga

SEQ ID NO: 1934 - DNA, 1847 bp, Toxoplasma gondii
cgacgaaggaaggcgtgtgaacgaaaaggtggtggagagcagaagaagaagaagaagaagaagaagaagaagaagaaagcgaagcgaaaccacagaggaagagaagaggcaccaagaaggcgaagaagcagaacgcgaagaagaagtcaggagcagaagaagacggaagaagacggaagaagacggaagaagacggaagaagacggaagaagatggagtatggaacaaaaagaaggcgagagaggacactggggaacgaagccgtgaaaaaacagatctggtagaagagaagaaggagacgcgaaaggacgatattgcagcttggagagtctacatggtgttgagaacaggaggtgtatctccggtgtacgtacaccgggcctggcctggatgtctcttgtgggtgcttcgaagaacagagccagtgagacagggagagggcaaaccaccagcgcaaaacaagactggagagtggacaggaagacggagttttatagccattctaggaaaacgctctgaagtgacatcgtaggttgcttgatcagatgagaaggcactcctgcgagaaaaaagtcgacaagaagagaaaacggcggaacgaaggaaaggggagaggtagagaaaggaacgctagatgaaacgggcaacagaaaggcaaagaaggcagaaagagaagaaagagaagaaagcgaagaaagcgaagaaaggaaggaacagaaggaagagaacggaagaatgagatggacaggagggaagaaagagtcgggagcgaaccgcccctcttcctcttctgatgtcccccttggtacggaacaggcttgtatgaagtgtaagcagagagaagaggcgagaatacgaaagagaataggagtgaaaaaggtctctttcttcctgccggttttccactcttcacaaacaacttgtcgcagttgcatgcagccgctgtgtccgcttgcatgcgccgcgagctgtatcacctggcgaaatgaggagaatcgcaccggaaaaggccatggtttttcgtctcttcacggatcgttcaagcctttcgattgcttcgaaacaaaggaccagtttctctgcgtcggctctggcggtgtcttttcatccccctcaagggttcttgcccgctcggatctttgggtgactgtaaaccaaacagcgctggctggcacttgggctgccggcttttccgccgcatttgtttccgaaacgatccaagggagagctggacttttgcatttttccatgcactttccgttttcttgtggaaccgtttccaggggacagaagaggcatcccctcgagaatccgccgacgacgttctcgcggaatctcaagcacacagtcttcgtcaagtgtctcgtctccctcggttttcttgtttacgttttctgtttcggtcgtcgccttccgtcgttttcttcctcgccaactcctcttcttctccgctacatcatttccactttcttttcgctcccctcctcctttctgatttgtctttggaatgtcttttcttctgtctgaagtactgttagatctctctgtgcgtctgtggcttccctcgtcttccggcctctctgcccgctctctgtgccaggcgattcgtcggtttcccccgtttttccgtctttcttgccggcactctctgcggccttcttggccttctctctcttcttcttccccgggcagtcgaaagacctcagccgaccgtcgcttcgcgcttacctgcacagaaaaaccacccactctcggctcctcggcagttgcccgtcttcgccggctcgtcttcgccagtccgcggcctgagcactgccggtcggtcttcgttcctttcacctgagaaa

SEQ ID NO: 1935 - DNA, 2818 bp, Toxoplasma gondii
acggccagatgttgtacttttgctttgcgggcggatttttgtttctgcacgatatgtggtggtcagatgccaatggtgtatttggtgcacgcctgtcgttcgcctgatataatacctggattctgctccgcctttcgtggtgcaagagtttgcctcaaggctgagccatgcagtgcgaaagtagtgttactgggacagcttcagctcatggaggaagccaacattttatgcaacaggaattatctgcggcctaccggggaggataagaggattatttcgtttttgtacactcaggagtactagccgaaattgtcgtcttggcgtgaagacctagctgcactaactcgtgtgtatcacttaacaacgcttttcgggagcttgttctagacccaaaccgactgcattgctttccgcttgagggcgtgtgtagtttaccgggtgctgcagatggggaggcggcgcatcggtaagcacactgaggcgagacaaagcgtcacggctttcggtagagaaggctttcgcaacaccgaaggcgctgactaaattggagtgaaaaagacagtatcaagcaaggtttatgctacagaaccgctctagatcttgagtgtcacgtgacttcggttggttatggctcttaacaaataaaaggcgtggaacaagcagaggaaataagcgggtcagcgttagcgtttgagtgtgctggggcaggtagtccatagggatgcacaagactatcgtcacgcagacatttcaacatctgcaagacacctcacggacatacgttaaacgttttctggggagcgactcaagacgtatgacatgccctatcgctggctgtgtttgttgatgtgcgacactgagaaactggaggagcgcactcattggcgtcacgactttcactattggatgcatacgcgtgatgtggaggcgatcgtgttcatccatgcatgcaccgttgggaagttgcagaacccgctcatatttccttattttctggtcttgcgtctgaacctggcacacgagtttaccacgagcgactttcttcagtttcgcaggaggtggatggtcaggcgatgaaaatagcgtcaggagtcaacgaaaaacttgattcacgatacactattcaagggaaagagagttcgaatggatgaaaacaagccgcggtttcatagtaagtgcagctgcagccagatgacggaggagcgtggcgcgttccgtcctgtgacagttttggtacagagacactttttacagagcgaagagtcagtactatcgcactggcagcagtcatatctgagataggaaaatccataagcgtttgctgcagaacataatctacgactttggctacttgcttatatcttcagtgtctttgtttacctgacccaagttctggggttgttttcgtgaccgtccagttaagtgcatcaagcataatggtgttcaaagtaaagccatgagctggtcatttacagcaggagagtgtctgcggaagcaacataacaacgtagtggaacgccgctcccgtgcacttcacattttattctctatgctattctcactttttagttcgactgcacgcgatcctgaagcttctccgagtctcccaagaacttcagttctggatgagcacactactcctacaaaaaggacatgcaaaacttaaactttttggattcgcatagatacctgagccccgcggctgtcaaaccgggcaggtgccagtcaacaggggtttcccgctggatgaatccgacacattcggttcgatctttgcacggaacgtttgtaggggagcctagtctgagacacgggtgggctggtgccagtgtgtagacagaagactctggcgacatctccgacggttttctctttcctaggaaatccgtaaaataaaactgtcaccatggcttcgatttaaaaatgtgttgccacgtgcgtgcagcgaaatccggtcagccggcgaaatgcatgcgtctccagctgtcgacttccatcgcagcagggaatccaacatttgctttcttgtttctgcgcgtttattcgttgggtgtgatcgggcttttcagctacattacgagagatgtcggacaaatgtaagtttcgactgccctcgttgctcgttttaccgcctctatattcctcggtctttcttcggcgacacacgccatattcgcgcctttactgcgggaattcttttcttgctcttgcgtcttgcatcgtcggcttccatctcctctttttctgaaatagcgacttccctggcacgcattggcagacttgggctccggcagaaaggattcccgcgccttttccgctcgggctcttcaggcgccacgttggtgtcctttatacacggaagactttggcattttggattttctgcttcggctttccgtctctgcggaagtttcccttgctgcgttccgggagggtcgctgtgcccggtctgttttcgtctggatcgttcgtttttggttttggcggctgcatgctccgcaacaacggatctgcatctcaaccctcgacctttttcctccgtttgcaccaactctaaagaaaacgcagagacgtaacagccggaaagccaccacatcattactgaacgcctcctcttctatcgtcggcgtagagctgcggcggccagcggcctgcggttctctcccgtttctcgcgtttctgagcttgcatcttttgtctgccctgtgaaagccggagttcgccagcgacacagacctcgtcctcccccgctgctctattggcagttttttttctgtcggtctttcctcccagtcctaggcaatcttttgctccacaa

SEQ ID NO: 1936 - DNA, 2390 bp, Toxoplasma gondii
ccctcggagacaagccgatagatgtacaccgcgtctcggtcgtcgacgacggcgaggaaactcgcagggaagcagcgcaggagcttcacgcccgcctctccccgcgtatgcggcgggggcgtctcgaacgtcgcgctgccttcgccgcaggactttctcggctgcttgcagtgagaacagtttgcgccagaggcacccgcgacggcaagaggcagacgtcggagcctcgcgggtgcgcgcagacgtccgggagggcctggatgcagcagcagctggtagatgtcgccgagtcttggttgccgtcttcttcttcgctcgctctctgaggcagcggcggacgcgtcgcagggggcactgtctggaacggagagaaagacggcgccgtccgccgtcgaggagaggaacggagaaactttcacggacgccgcgccagtcgcagcgcgcgcagccgacgagaaacgcgaacgcagagactcggggaaagccaacgaaaacgactccagacgaatcaaacgaaaggcgcctcgacgccatcgaacggtggggcacacccgcccagaggaagaagcagagagaggagaagagaggtccggctgtacgtacgaggggaggaagagagggagggtgccggtctccgcagaccggaagagcgggtggtctgagggcgccgacgcgctggtttgtgacgggaggtctcgcgcaggacagctgtcttccgatcccggcgccgcaggaagcaagacgacggcgtagacgtggagaatcgagggagtgaggaagaagaggaggtgcgaggcagcaggaaagaggaaacccacaggtgcaggcgacaggtggacggagagaatgtctccgccaggcagcggcccgactcggagacagggcgactcctgcgccaagcaagcgagaagcagggcatcgttgccccgagagacacacagcgcctgcaggggaggcaggagctggtagcgaggttcgcctccgctctggagacgtgccgcaacctctggagggaagcgtctccgaaaaaccgttcgaagattcagagacaccggcagcagcggcagaagtggacgcttgaacgacgcagcgaccgagcaggccggagacagcggagagagaggagacagcgaaggagaggaggagcagggatcgacggcttcgcgagtggagagagacgagaaacggacgggggaagttcttcgccgcctcgccgccgtttcctccttttcacgaaagtgccgctgaaggaactcttggacaagtcggtagggcgaggagaaaggagtcaaactctcctggatttcttcgccagacaaacagacgtcaagatcttctgccatccgctcctccgccgcagccaggagagacacacctcgcttctgggacaaagccagccgccggaggccaggctctggagcccagaggcgcgaggatgcctgcgcggcttcgcgacagagcgcggacaccgttgacggcgcggagacaaaagaaggaagcattgactcggcgtccgcctccctttccacctcaccacatcgctcggcttctcgcggcggcacacccgccgtcgccggctcgaaagactccaaaggagccccaggcgcctctccctccatggagcatgaaagagagaaagagagaaagagagaagggaggaggagagaaagagagaaagagagagagaagggaagagagaaagagagaagggaggaggagagaacaaggaaggtgaaacacacgaagaggagggagcaacagtgggaggacgaggaaggagcgggagaaaggatgagaaggagagggagaggaaaaaaagcaacaagacagcgctcgagaagtcgaggcgcagattcacaggtgcatcttcagtgcagtgcgttgcggcaggtctcgaacctacgcccgcagctgcagaagagagaacaagagagcagagatgtccagaaaaacggacagaagaagatagcggaagaaaatcgaagaaggaggacggagacgacaatgcgtggagggacacaggtatcctgtgcatgcaaaggagaccggaggagggagggcaggttcgcagagagcgccgctctaatccatttttcagaagcgaggaaagggagaatttgccgccagattttcccgttgaaaaacgcgaaaccgactcgagggatcggccagcctctgggttgcggtgtacctacgccgcaccccacgagatcgtgtgtgtcggcgtcctctctccgcctcttgtttctccgttctgtcgcagagaaaacttgggcgagagcctccctgaagaacgccggatttctgaatttctggaattcgagctctgtgcgagtcgatctccaccgtcgtttttcgattgctggcaggacatggagctgcttctcgca

SEQ ID NO: 1937 - DNA, 4276 bp, Toxoplasma gondii
aagttctgaagataggcgccttggctgtctgtattctgcgagttttctcgactccgcagcatcagcggcggcgacggccgcaacaggcagacgtcgtcgcttagcaggagcgcctcgtcctccagaggcgaagcagagcacagctgagaccctctcatcgcgcgttacaagcagaactcgtcgttcaggtcctgcgaaggtcttgcttcattgcgcgacccaagttctattggcttaactccatcggtcctcgtagacacacgagtgcctgagagcgagaccggcgcggccgcaggttcgatggatcgaccccacccagacaactctctccgggccaccggctgttccacatcggcgaccttctaggcgaaattgaaagtccgcgccgagaaagtcgaagcaggacggtggctgcacacacaccgtcccctcgccgcagcgccgggcaccagactgcgtgaagccgcgtttcgggatcggggacgaggaagacgcgcgagtggcatgagggcagaggagaagcttgtgtctccgcaggccggggaccctgcaggttggaaaagcgtcaaacgtcaccactccaaagcgcatgtcccttcagcagaagactggacacacagaaagagacgaaaatccctttcaaatggactggtgggggtgcgcagataaggcgaaacggaggctccaggctttttttcgccacagtggacagacaccgaagcccgtcagttcagctagttgtcgggctgctgtctatctgcggtccaggactcgagagggcattttgcgcgagcgacacaaggaagggaataccaagcactgcggccgccgaaaagcgaagggaaaggaaccggtcgaggcaaagaacgcctgaaaacggcagatgagaaaggcacaaacctgacgcacgaactcgtattccagcgacggttctgaactcgcaacgtgattttaagccgattcaaaaacgcacaaaagaacgagaaccatcttctgagacaactttggggtttcagacaaggcaggaagggagcaagagggggctttaaagcttcttcgtcttcaagaattgggaaacggagagaggcgttcagtgtaaggcagcacacacgagaactggagaagccggtttccagcgcctgaagtcgaaaggagaacactgtgaccaagaagaaaacggtggggaaagtcaggctgccggatgcaaacgggtttctcacgtgaaagtgttgtcttgtcgcatgcgtccccgaaggagccgcaagccagcacagcaccccagcagctttacaggcggtggatgtctgatcggtctccgcgtcgctcccgttattttcttcaagatttacgtcgaaatgtcacgcatctgcatgtgttcaagtgtttcggcccttccgcaaaaacgtgacgacaacagcgctcagggtaagtgctttcagacgaaaacgcgtgcgaacgcagcgtgtgcacgccgcgttcgtccaccctagtatgaatgcgcatacggtggggcaagacaccatactatgggaacgaagatgccaaaccttttccgtcacgacgaaacagtctgattcagatttcgttccagcaaaatcaacagttctgcttcccgccccggacactcttttttgcatgtggtcaagttccaacttctgagagctaccagattttcccgtgtgtcaaccgacaaggcgtgggtgctcgtgacccgttgtttgtgtgtagaaaagtgactgcttaagcaaggtgctcccgttgacgtcggatgaggatctgctttcttttttctgtccatctgcgcacacagacacaaagtaacagtgcaacaccactcccgcgaatacgcagatatacacacgaatgcgggaaaacgcaactctggaacccatgtaggcagtcgggaatgccagcaactttatcatccggaatgagagacagctgcattgagaagatagccatgtgttacaactctcttacggagaatcaccttagatggacggcggtacatgctgcgacctcgtgtatgtcttgtgcccacctgactcctcagttcaaacagagctgagtttacccggatcaccaggaaacgttgatttaccttttttacaaagtcatttttactcagatattattgttggtgccttaggtatcccatcacgtatgaatttagggcaattatttgaagctttagtcagaaaaaagcactcgcagactgataagagtaggaagtattcttttaatagatgacggagccggaggtggcagggctaaactgtaaggtgtaaaagctgcagtcggtagcgctcggcaaaaatcctcgcgcatattcggtggacagacggggcagcaaggcaggatcccaaagcataaaagtaagcctctagtagaaggtcacgcgattcaaacggatcagtcccgaacaaagaaaatcaattctctgtcttacgtccccctgtggccgaaatcgacatcatgcgtatttccctgtagcattgaaccgccctaaagaacggtgcagctgacctgtttcgtagaaatgcctccattggatggagctgctggcttctagcgcgtgtcatttgtcttcgcagtgtagacagaccgaaactagaccattcgacacttcgaaaaggtcttcttgttccgagggactgccgaactgttgcggggtctgacacgagggctgggttaacgacgtcgaaggcagtttgtgctttgccagtcagtagcctcaggattcagcacaaagactaacctgctgggtcttacagagacatgtatgcaatatgctttagcccctgacctgggttggctcccgctgagatcacttaacgttcacaggccgcgtgtgactctgcttgttactgcaagacccctcgttgacacaccatcgagttacaggtgtgtgtctatcttcttgtggcattcgcaaaatgtgtgttaccccctgtattttaacaacatggctgcagaaagcgatgacagtgacgcatacagtgacgcatgcagttgcacccatggaaacgtgacagcaagtctggaatcgatcgaggtgcatttcacaagcattccgcccagagacgaagaactttcccgcgtcctcgactcggtgcttgtcaaatgaactccctcacagggcatacgatatcaagttggtctatacggtgtagataaccagacaaattttcccgcgtgaccgtcccgttttttagcggagtgagcagtcacatgcctatactcaagccacaggaacacagaagcgatgaactggaaattcccgtgttgaggaagccagtcgagctggtagctgcctgcaagcggatccctctataaactcaagaggctctgaaggcttaacttcctttcgaaggcaatgaatgtttgtttttgctatagttccgacttcgacacatgtgtgacttgtcaagctgtggcgtccctgacggtacacggtttctatgcaggcgcctctattcatctgcgctttatatgcttccgcaagctgaagaaaagcaaataccgcgggcttcgacaatgtgttgccgcagcttttgttcttggcgcctgtagcactcatttattatcttttttttgtatcgtgacacgtgtattatgtttcggtgagggacaaattgcgattgtttagctatttaagcccccagacaaatataagtgcatgtttcttcgcatccctggagcgggcgccgctgtgtccggccgctactcagagaaacggtactgcctactggcaagcgactattgcatatgaaactacattgttgctagcatgtacagctaccactttgttgagctttatttcgttcagttgtacaaaagaatcttgaaaccctttctaatgtggtgccgtatgtggggtgtgatgccgcatagttaaaaatatactgcgagaaggaaatggcaaaacggtcctggaaagacaatgctgccgagcactcattccgctgcctcccgctctccaatacggggtatccattttaacctgtcgacgctgttcttgtccatggattgttcgttttccagtgggtggctccgatagttgctgcggcgcgcaccattacatgtctctcgcgagcattttttgcctctccattcgcattttttttcatctcgaacatggttgtttttcccttatcgcctacagtcgctccctcccagttgtagctgccgtttctggtgtcgttaaaatccgcaccaattactaataatgagtatttgtgtctgtgcagtgcgattcgcatttaattcgctggta

SEQ ID NO: 1938 - DNA, 3268 bp, Toxoplasma gondii
atcggtttatatcgtgtttaagttgatctgtttctctgtatccgtctctcttgttctccgcgttgcgcactgcgtctctctttcttctcttcttcctttcctccccttttgtctcttttccccgttttcccaattttttgtgatttttcattttcctttttcaggagaagcagcgccaactggacctggaagcgtcagcggctctgcggagcgccccgcgcgcggcgcctgcgtctcctcagaaggtcgagggatcgatctctccggcgagcagcgtccctccatctgcaggagactcgtggcgaaagggtgaccggactgaaaccgcccgtcgacgggtgcctgctcagagccagggtcgcggagaacaggacgagggcttcgagcgctggagagaaggaaaagtgaactctggaaacggaaacgacgaagagaagacgcgacccagattccgagtcgcagccgctgcactgtctgaacacctctcagcgggaaaggaaggacgcgatgaaattcagaacggagatgcgcagaagcccgaagacgacggattcaccacagtgtccaggaaccggtaaggaagcaaagaagtccaggggggcaaagggagtgaagtggagatattcagtgggagaagacggggggaaacaggagagaagtagaagttgaagagtagatggacgagtgcggatgtcaatgaattgtgatgtgttttgtgtgttttcagaagaaagtgaatgcatcgacgcagggaagagagtctcaggaaaagggatgggtagaacagcggcgagagacgcgctcgggagacgggaagagcagaaacggagtggggcagatgtccattcgagagttcgctggactccgcgtgacgcttcacaagtgtttctcgcggtgtcttgaagttttcttacacttctcgagttaccgcaagtttttcgggtgtagactactctctgctgcggcaaaaccgctcctgtctagtagcagagccggaacgcggttgcgaaactataggggagaggggcagctctgctgcagctcgggtgtacatccactgcagagacgcgggactcgcgggtagccctgggcaagctgccatgaaagtcgatttttctgcagaacagagggcgctgcccgtttccagagatgcagttaagcacctgcgtttctgtaaggtgtcgagttttgcgtaggttcttgtcagctccgagggagacttttgtacgatgtgcttgtgtctgcatgcgcgcgggaaaagaggtgtgtgctacggctgcgcgggcaactgaagatcgcgtttctcgtggctgaggatcgatgtgagacaggccagagtgttcagtgacgttgttttttgcgatacatacgacttcgtttcccctcaactcgagtgggagctccaccaaaactagaagaaaacggagtgccgccctagtggtggtgtatcttttgccatgcagagccttcttcgttcctctgaggcgcacgcacattctttgctcccctttccgccgctgacacgctcgtgctctctactgggcacttaatggaaaacgcaaaaccacccaccccacagaccctcaaaatactttaaaacgagtatctccactcgggtacagcacataaccaggccatcgaccctatatatttcccgatgtatcgcggaaaagaacacaatttcgagcatttgagtggagacacggtccgatggcccggtatttctgtgttcatattccggctttttggcgcagtgtggcgattgcaagtcgccatcgcaaccagccctctaagcgtttctctgggaagttgagcgcccgcgtccgttcgcttactgaaaaggggtcgacttctgaacggaacagcccgtggaaagcgcgcggacagacttaccgctgtgctagcgtttagggtaacacacggatgatggttgccatttgaattaactgcgagaggaagtaattcagatgcgagtgtgatcaggtccgtccccccctcgtacgtactatctctgaatccgtttcgcttatcccgaaaccgccaaccccgcctctgcatgtgcctgtttaggctcttcacagcgagacttggggtagcagtgaaaggggctcgaggcgcacgatccctttcctcgttttttttttcgtgcttcgcttccaacagaaaacactgtggcaggcgtagagaggtgatctctcgataccgtcgcagactgtgcatccactccaggacctgcgggaagctagccagagaaaagtgtgtgtctcagcaaggttcggagagcggcggggtggaaagaagcaacatgtagtgctctgggtcgccattcacttcgcgtggaaacgccctttgctttatcacaacgaaattctcccctcagcttgtcgttaagagtgcggctgtcttcatctcgtgcccccatccccctggtggtgccgtgtcgaagccaagacggcccggcgtttctgtgttgtttgcgatttcatttgattctgcgcggtgcaaaacggcctctcattgcgtttctaacgctcaaaaaagaggaagctgggagacttctttttctcccgcgaaactgcgtagaagttttttcgaggtcgttcgcacgagtgcgtctgccccacatgcccgcagcgtcttcccaagtctttcttccgcaaattccggtgctctcgcgagcttcacctttccccgagttcccgcgtcttgaaaacgcggacacgactctttatgcaggcgttgtgcctctccggtccctgctttccggccggttccccgtggcttgatatcgtgcaaacgccggacctgtaccgtttcgaggagctcgaatctccccggaaggaccgataaagaacacggctcacagacgccgcgtgcttgtcggagttggacatggtcaacttccgagattttcccaggtatcttattcggttcattgtgagtctcgtctgcaggacaactggatgaaacaacctttgttcttgtgggatgattccgtcctcagcactccgtgcttcgattctcggccgtcagctgctttgtcttcgagagagaagcggcctctgaagaccgcgcctgcttgcgctctctaaaatgtagcgtcgtctcctgtttcccttggcagccaagtcacacgcgccgacgcctgcgtgggtggccccgtctgcgtcgtcacacaggtccatgtgaagcgaaggtcacttcctgctccgaagaacgagggagaagacaatttacaaaattccccgcaaatcacgaaaccctgcca

SEQ ID NO: 1939 - DNA, 1823 bp, Toxoplasma gondii
agtcaacacagccctgtcagctgtatgcaagcttctttccatatgcacaaatacagacgcctggaagttggaaactattccgtaggcgtcttcactgagacgggttgccgcagccgtatctttcacctcccgtgctgctagaagcagcgcattttttaacaatgtcaatgaagagccaatccagctggcggccaccgctggcttttgtagagaggaaagacgtgaagtgggattcacgttcgagtgaccctctacacctgtgtctgctgatcactaaatcgccaccgttgtttcttttgagcctgcctcataatttcatacagagttagatatagggccttcatgcagaaggttagcaaatgagcaaacacaactatttgtctccccgtactgatctagccactacaaacacccaggtgcaccttaactcacccactttcatctgcagcagcagcagagaacaaacgcatcacctaaagcagcgaagtctaccacacttgctggacttttcccagttggttgcattttcttgatggtgtttctcctctgcattccctggcgctttcaccatcgcagacgaggagtgactgcgttcgtcagatcgcgagtcgagtaacaagcaccacactaagatacaggagaaccgcaaccgtacaccttccacttccggctgggcagctgaccaagtaggaagcactcctgccttctcccaatgtggaatagtggaactttgccctcatcagaatctgcaggtactggcaatcgctacagacagaacttgtttcgcaaaggtgacaacactgaaacgcctctcgctggtgcataggtgacgtcatccgtcgactgtgtttactacagcaaccagaaccgaatatcgagttctttttctggagctgtttgacgctccgtacagttttaggtgcctttccaagcttgcgtgtccacacaggcacacaaatagaatcgaacaaactgatacggtcttgtacgtacgagcctgaacgtgacagcgccgtaccttcacaggcacggcgggtgagtagtggcgtcaggggggaacttgagtgggaattcgttctttgaagagcagactgagtgactcttttggccacactgtctcttttgcaacctgagtgggcgactcaacgcgccaggaggtggacagaagccgcaaagaacgtcaatcgacgcaggcacgtggattagacacatgcatcgcgagccggaaagcgcttttctctagtcaactgcatgtgcccgtttcgcattgtttcgcaggagtgcgtctcgatagaaacccacagcttcttttaatctgcaggaaagagggaaaaggacgtttctgtggatcgacaagcgagaggaactttcccgctggtggggaacgcatctgcactcggcgtttctccagcttttatccgatttctcaacccccatatacggagggaacggggtttctcgcgggtgccgtatcgaactgtccttgcgccctttcgcgaagctaccacgcgtgtctgtttttgttttgtgccgttttctgtctgcatttgccggcgtttctcgaaatttctgacagccgctttcgcgatcaccaaagagcggaccgtattcgcgctcaactgcgcgtccgcgtcgttgactggtcttcttcagcacgacccgaagtctgtttcttttcctcgacggccgcgggaattgccgcgagcactggacctctcacattcgtgcaactgcgtcgaaaagccgaggcggaaggccgttcgcctcgtttcgacctgccgaggatctaggaacgttcccgctctttttcgcgctcctaaaaa

SEQ ID NO: 1940 - DNA, 3770 bp, Toxoplasma gondii
tgtcaagccacttgcgaagaagtagccatgaaaatgttgaaccagtacatccaggcagagaaggatgatgtacaggaacagaaggcactggcggctctacaccttagagccggacaagatttgtgcgtcagcggatctaatcttcagctagactccgacctgcttacagctgcgtgtggggacttactcgattctcggcaaataattaaaagtacctttcaacaggtaacgaaggagacatccacatggagtgccacccgctctcgcatcctcagcgatcctggatcccttgtattcagggttgctttttttttctggttgttacagaatgcacatacaaagcgacgtgctgattgggaagccgcttcacaacagccttcttggagagtctcgtttcactaaacgggaaggccacagacagaacggagttagcctgtatccccaacggcatcgatacatgcacagaaactcataaaacatgactactagatactcgctctcaacagtgagctttacatgaactcatcatgggaggaggcattcaaacatgaggctgcgtttcttttcgctcccccttttatacccacctctttcttctttcttccttcgtttttcatcttgctggccgctagggtcgcgtgtgcctggaacaatgcccggcgaaactcaaagcctgaagacgttcaccggaatggatgtgctgcgtttttggggaactgtgcagataagtgacgaaagcaacgaaccaaccgcagacacaaccaatgcgcgccgctcgtacttggctccaacaaaatctgttcagaatcgactacgctgtacacgaacgctaggagggttgaagtgagtagacgaaaaaccacgttatttcgctagcgcctttcaagtcacccttgtatccactgcttgagacgatctgtggtgcattcggaatcaattgcacacaagaccaaacaaaccgtaaagagttctaatattttgtgcacttctagaagtgcccctctgaccagagggaagggattgttctggggaacttgtcctgtttggtggacggcaaactagtgggcatttcgcagcaaccttagtagtgagcaaaaggagctgttctcaaacaaactgttcgtgtcagctaattgaactagtcaagtatcatgaatacagccagtagatgctctttcgacgtccatgaccgatgttacatttttgattatcttctctcccaggctgcgtagaaggccgctccggaacgactccggaaggcatccatggcgccgatgtgaattgtgcttacgtcgcacgacgccctacaatttgtagtgttccatatcactcctcgacgctgtgagaacctacgtacttcagtgtctgcgtttttcctatttcatgtataccggtctggatcgcatatcaaatacacgaacacaatgtccacctataacggggtctaacactacatggcctagcagtgatcttcatattccacccgtgatgcataggccatgtggcagtctcgacttacggaaaaaggaggcaagaactgaaagctttctatcaacgcagtgtaactttgattttggcactcggggatcctaatggagagtgtgcatggcgtgtgtgcttttgggcagaccgaaaacgctgaagacaaacagtcgaatcccattgctttcagtgagaagagagatgggaaaaccgagcacgaatgccactgcggatagggctgcagttgcaaaaaatgaaaacaaagaacagctcgcaaaactgcagcggagacaaagctttctccggaattctcgtcaagatcctaacaccgctctgaaaggacagtgcccattcgatatcgaacccgatgcggcagtaagcggtcacacaccaaaggtcgttttcgcagacagcctgtacagttcctcaagcaagaaatgtctgatatgcacatccgtcccatacatcaacaatgctgatgcattctgctgcacacttcagtgaaagtacatctactcagtttctgctccatacgagtttgccatgttaacctgcgttccctacaaagctcgactgatatgcataatagcaggaatctttgtacttccccgactctttttcttgtgccttaaacgacgctctgtatagtacatctctcgtcacctttgaagtcgacgaaaatataggaagcaccatagagcgtgaacgcatgcataagtgtgtttcaccgcttagcaccagctgttcgtttttccacgttatttgacactatggattcccaccttactgtagtaagcagggaaggatacaatatgcgttggcagctgctctcttgttgcagtgtcactgtctttgtggtatgtgcgaacgaccgtcacttctgcaacagattctcaatttggtgtttccttattgtcggaaaaccttgtgtggctactcaccatcaccgcattttgatgcgtgtttgtagattttccatggcttcaggataggcctctcatacaagcaaactatcattttcagaaattcgtcgcatttaggccggcggcttcgggttgaactcgctgctccaaacaaagacctccgtgtatctcctgtggtctacaagtcacttgcttcttcgtatggacagccaggtgtctccgcagaacacgaaagtaccctctcaatgaagggaaaagcctcttccactttcacctcagcccaccccacaggaaccattgccccgggactctctgctcaagtaagcaggttgtcgagcagagtcctacagaacacatattggagagttcgcaaacatattgttcttttgatttcatcaaaactcaaaacaggtgtagacaaatcggcagtgttaaacataaaccgagtaggtcaaagaatgtgcatacatgcttgaatggacaaacatgcacacatacctccttatttacgtacatcatacatgcacaccgatatccctgtttacataatcaaacatattgttgtctagaagcttgtctccttcacctaaaacgacgacttttacagcctgctttcctacacatgcttacatggattcaggtagaggttcggtttcagcctacatcttttgacgacattactacccatctactgttgcatacagatgtgggatccttcagcatagcggtgagcgaaataagataggagaccagccgaatcttcagcgcccgtttctgcgaaggtcgatgctggaatgttgtcactcacctgccggaagcttctggaatctgaatgagacagttatctcggaatgccgacacaatcctagtttgtgttttggacgggctgggtagcgcaagacagtttccgtttcacagttcccttcgcaatgaaacctgtactgcaagtttgggtcgagcgtctctcggccctccagcgtctctcgggtgtagcagtgtgatgtggctgccaggggaatgtcaccaacataggaacatatttcgcaagtcgcctccagcattggagacagcagatgacagaagtccccctaacttctgtccgactcgtcacaaacctgagaaagtcacaatgagtcctcaaagtcagtttccgttctaaacaatacagttttaagttctatcacgaacctctgacacaagatataaaccaactcgctcctgagtcacatccccgacaccaactcagaggcaatcagcgagtgaaaaatcctagaatgattgatgaagacgtgaagaaacctcgcgccgtagaacacgcttactcagcgtctttattgatttagtctctgtttccccccgagttca

SEQ ID NO: 1941 - DNA, 2773 bp, Toxoplasma gondii
cgacccagctcgtgcacacttcagggtcccggttcataaacctcaaggttatatttgtgggagacagcggaactcgagaccgttcagctgtcttcctcaatcttgcggtctgcgtatttgggcgatcgcaagatgcggcaccaaattttggaccttttttaatgattctactgcagggaaatgcgaagtcctcaaatgtggttttttcatgaatccccaatcgacacgatttttagcaacttgtaaacggcagcactggcacttcagtttaggctgctgcactgtctaaacgccttcgacggcagcagtgcgttacctcacggtcaacaaaaacgaatgatgaagtttatctacttctgtgccactgcattaaactatgagaggcgggaagaacgcttagtcaaaacacagcgttgtcagtgatgacttaacaagaggaacgacaatattcgatcgcatctccgtgatccgccatcggtgaccgccggaatggaagattctgtccacgcgtgaaatgatgcaaatattacgctatgtgcctgtctgcctagcaccaggtagaatctgtgacatttcggttatccgtgttacagcaataccgctcggttcgagagaacttgacgcacctacagccctgctgcgagcgcgactgtctcctacgcgctgcaaggcatgctggttcccacagactgttgcttttagttctccatagatagaaggactccggaaggtcccagtctgacgagtgtcggcaattcgtgactcttcgaaacttcttccactgtcgccaacttcgcttgcggcacggtccccgagagagtgtgaacctcgaccagaatccgtggaaccgagtgaaaactgtttcccgtaaatattttcccttttcaacattctttcggagtccgcacaaaaacgccaaaagtgaagatcctctgagagtaaatgcagcgtgcgccgctaagcaggtgtatgtacgctgggtccccgatgaaccaaattcaacagtcgttcgagcgctgcgtgcgcaggaaattcttctacaacgcggaacgaaaatctactgagtctgtcggaagaagactcctcggcaagagcttaactttgttgatgtggcgcctttatcccgtgagtcgggcaaatcagccgtccgcggattcgttcagaaaacctgccagcaccatacctgacacgcttcccacagtcgtggccgtcggcgggatgattcaagtctctactctgtggaagtggaaccaaagttttccatcctcgctccttagcgcagaatttccgcaaaattcgccgtccagaccgaggtcactaagtcgttgtctggtgaacgcgatgagggcgggcgcggctctcaaggcacaaagattcagcagcgcatgcttgaggtagacagatgaggcggccggatttttttccggttttcaggcaactgaactgagtcaggagataacacgtcgcatctgcaagggaccgtcgagtaaaaatcgtacccccgttgtgttcgttctgtggaaaacgcaggcgcggtcgcgctcccgcatgtgcatgcacgcggtactcgaaagaagggcaaagaaggtcccttctcctccctcagaagaaagaccgagctgccagccgagctcccctgtcgactttcatactttccgcttcggagacgacgaaggcacagtcttttgcagacgtcgctcacaccgtggttccgcgtcaacaaacttttctttctgtcttgcggagggaaagagatgaggttctcgtgagactggtccgaggttgccggctcgcgagaagaaccctgaggctaaagagaaccggacgtcgaaaaggagttttttctgggtccatccgtcgctcttttattgagtgaattggctcgggtcggcgagaattattagctgataaagcctccaaggagtgcctgccctccgaccccttttttctcggcttctgcgctttcgttaccttctctgctcggggcggtgccttccattgcctaggtatccgcagagtgcctgtgcagcagggcaagagtgcatttttgttctgtctcttcaaagtcattcccataattccttcctgccgtgtacatccgtctgccttcccttttcgagcgacgaagcccgctcttctcggcaaaggtgtcacctttcacaggagtgccaccgcacccgctgtgcggccaggtccaccatccgaaggcagttcgacgacgaggcacaccggcctggtgagagagtttcttgcgtgtttcttgctccccgttgtctaattcgtacccagcgaaggtgtcaggactcgaaagcaaggcgctctgaatcgcgctctcagtcgagcggcggtatcgcgacatccctccccggccgggtcgccttcacagatccctccggcgagtctcttcctctgagtgttcctccttgctctcttttttgcgcgaaaacgaggtcgaggatgggttttctctaggctttttcgtgtagtgtctcggaccccgttctgtactctccgtctgtcccatcgtctcttccttctccttgctctctcccagtcttcgctgcctgtcttctgtatccctgcagacacctcgatagcctcaccctgccactagcctcctagccacgatgctcgccgcgcctcttctgttcacggcttaggatttagctgcctccactcgcttttctggtctccttcccgggggtttccttctctgtcgttctctcctcgcgctttgttctcctctctctttgttcgctgctcttcgtcgaca

SEQ ID NO: 1942 - DNA, 2392 bp, Toxoplasma gondii
ctgcgagccgtcgcgagtccgatcccgaatttgcgtcacgaaatagtgatttttttttcttcgtcagtgaacaacgagaagcgcgctctggcgctcggggaaaatcaaaggtgtcttcaggtttgaagaagtcctgctgttcgagagctcagagagcggccagctctcgcggttgtccgcgtgccgcgcattcacgcagagttcggagacgaaaaacgagggggcaagacgccgagttgtctgtggcgccctcaaaggacgcgctcgcgccgtacttgtccatctcttgccacgaaagagcgactcttttgcgtctcgtactccggaatcgcgcattcgcaatacggagagagtctctgcgtccgcctccccgtcggatggacaccggaaacgtccttcgcgacttgtgactcttgcggggaatcggccagactgtttttcggagacgaaaacagctttctcggcatgcagagcgaacaaagcgttgtttcaaagtatttttctgccgcctacgcggggaggcacccttcatgcggagtatcgcacgcgtcgcctctgtctcaacgttgaaaacatgcgagccgcttcgaaaaacctcttcacttctcgaattaaccacaatgaatcctcgatgctgacgcgcagcttctcaggggaacatcttcctcagctcgcaagctgcagcctgaccaagtgctcccgaacacagggaatgatggttcactcaagcagacagaaattcaggagacagacccaacctaggacgagaatgaaaaaatacgaaattctagagagatataccgtaatgcagaaaatagagtacacattgaagagatacaacctatggcaggaacacagagggaattctgttggattcatgaggagagttcgagagacgaacccagcaaacgtggagtctatccttttcgacaacggaagctcaggagctgcacagggcagtgccccggcggaggacattgagccagggacttctgtatctacctgtgaagctaaggtgattaacactgatcctcctgttacaggagatccctactcgcaacagagctgtaaggtgatcgacggagactctgtcaaacaccgtctgtgcctcccgaaggagatccgatgtaacgaaacatgcaccaagatggcagaactggggattcccctgccacggagaacctgaacttctttacgcaaaacgcatctgtctgagcttctcagccttggagactttctcctgctgtatggaggtcggattcttctttttttgtgtcgattcttcatttcgtgtctctgcgccgcttcgcttcttccaatcagcaggcggggggcgtctggaggaacttttttttgtggcgcgtcttttcacgcatgttcgtcggttttgctcgcatttcttagatcgcattcctggtctcttctcccttttttggtgcactcgacatcaacgcgagtagccgtgtctgcattccaggagtgctggagtgtgtgtcggtcctccttttaccggggccccttgacgaaggcattttcacgaagtcgcagagaagcgcggtttattgaacagcattttccgtcgaggtgttcgttcaggtcggttcagcgaaggcatcccgctcaaactgtaaacaagcgagagaaaccaaccgaactcccgtcgaagtgcaagggctgcaggagcgcccgctgcatgcgtcgaagcgtcacagcgagcatgcgatgtctcgttgctggatgcatcgcaagctgaggagagacacgcgtttttccggcttcttggttttctcggagtttctttctacagcgtctccacctttctcgaagtcttcactaccgccctggcatgtctcttcagttggagaagagtgcctagtccctgcttcgtttttgctggagttgtgtgcagggaaatcgagggatcgccgtccctcggacgaggacaacccggagagaagatggacggcgcagctaaagcagggagttgtttttatccagaacccacgttctgctttggtttcgtagtgtcgcctgtctttgcgctagagaaacgacctggttttcgcgactccgcatcgaccggccgcgctgatcgtgccatgagcctgtcgctttctcgctgatttctcgtccccgagagaaaagcacgagatctctgacttcatcgggcgacactctctttgtttgcgttcttcgtctccggtcaggtttcctcgacttgcgcacagctgcgggggtatggtcgcccaggctctccgtctccgggcaactgccagaagccgcgtttctcccggacaaaagcactcttactctcttgcacaaattcttcgcctctgcgttctgacttgacacactcgtttctggaaagagttccgccgttcctcgcccataa

SEQ ID NO: 1943 - DNA, 4204 bp, Toxoplasma gondii
acgccgttctcgaggactcgcatagttgggtacaggaagtttaacgttttgcgcagtgtaacgctttgctctgcacaactgccttcaaatactggaagctcctccgctacacttccacacaaaaatgaagagagcagcgaaaaagtgtgtggtggttttaggcggaagcggcgtaacgaagtcactggcaagcgtaccttggaaaactctgcggggatctttctcttccagagtaagcaactctctggctgcagaacgaatcttagcaagggcgtactgcacgcgccacacctctcgcttgttcttcagaccgtactcgcccaggagtttcatttcctggtccaagcgttcctggagagagggaggaaagagagcagacaaacccgcacgaatgggccttttgcacacgcaacgcaacgacttcctgcacaagagggtagatccaaggaggggcgcgctcgcaaacacgccacctcagaggtacagcacaagtttggacggtagagtcatttgctagcactacggggcacgaggacttataagggaaccagcagatacatgcaggtccaaagactgcaaacagtcaaacaaatgcaggcacagaagcccaaaacacgcgccgagtcccagaaaaatatttgaaaacccagacgctccagctcacggaggaacgcagctgaagcgctcagtggcggaggtgcctaacaacagcctccacaatcgccctgaacaatgccagatgcccccagtactccacagccagcagtgacacgcgcgtaagcatgggtgtcccgaaaaaggcacaaaaacgcacgaacatctcccaaattgttgaaggcatagttccacacaaattcccagctgcgcggcgcggccagcacatgcaaaccttcccataatgcgtagttgacgcgaaaccgggggcaaatgcaggtccgcttcatcgtaggactctccatcgaactgccgccctttgaactgacgaattgtaggggaaacgcagaatctagaattccaaattaggtcttgaaaggactccaccccacagggctcttcgaggggtggcccggcagaaaagcaaggaacggggagccaatgcagtaattgtgctagtgtttaccttttcaaagggacgcttgggactgcgagcagtcttgctatacgtacggtaggacttcgtcatgatgccgagggaggtctacaaaagagagaaaattgccccttcttcccaaaataaagaagtccacacaacgcacaagaaatcgttccctccgccaactgctgccgtaggggacaactgggtgtctcccatccgcgcgcgagtcggcatggtgtttgcgactgcatgccgccaccactgaagccgaaaattctccggtttccccgtcagtcttggtaggtgtccttgtctccccatcgcgaagcggggccgtctcgattataagacgaatgtacctcgtattttacagggtagccgtgtcgcaaaaacgaaaagagtgtgtcttcgaatgctgttttctgcgcgaattcgctaccgctctcgcgtgagcatggaaggactatgtgaccgaatacaaaaagcttacagaaatctctcgacgttatatagcgcgaccgagtcgttcatgcctagaggttgctgactgatccgactatgtgtaagaagtcggccgacaatgaaatggagaacttccactgtctgtgaatccgttgcgagcaacatcatgggaataacggagtaaaccgtggagtcgtcaaccagattttctgctaacgtatctgcccggcaccatctcgactcttgtgaacgaatcaagagggtggggagctcattgtgtagttgtagacagcttgcttgtgcaaactcgtgcccacaaccgagtagctacagcccccgcttacgtcagcgtcagtgagaccacgcctacgccgtaggaagttagtgagagatgtggtggcgctacccctttttgttgtggacggaagcttgaagacctgcagcgcgtgcacacaaagcgtgcatttatggcttttctggcaactagaagggtcaattagtagcaaacacgtgaaccagcatctctttgcgggaagagtgtagaggaaatataccgggaacgggtcaacgggtttccggggaagggtattcgagcaattcctgctgttatgatcacgagggtccttcctttggcgtatgtgtaacgcgacggtacgatgttatgtgaacgcaagcagggacagggtgcgctagttttgcgtctaccgagaaatttttgtttcgccacggatattgccaggtgaacttctgggctcacataggtcccagcatcgcaccagatgcagaaaattgggtaggggacgcgccagtctggcgtcacaacccatctggatgagttgaacacgtgaacccgcctgcttcctcaaaagactcagaccttccatcatacttatataagggaccccattgtctctcaggcagttgtttgcatacgaatatttgagaacggcatcctaaacgtcttttccatgcgcacttcttcagcggtgttttcacaccacagtttttactttggtgaatggtcgactagaagcggtgccgctagactggttctctctttgttaagaaccgacaattcccgacatgctgaacggtgacacgctgagtgggacaggggtgcggaatcgggcaacagcaaaagagttgttctttgtttcaagcggtaacagcccgaactattggggatacagacgcatcccgtgccgatgcttgccagaacgttttaccaatgttttagcgtgactattgcccatcctccaacttaaacaaacgggagaatgtgcgaatcacgtgtcatctccagtgcaatgtagtattccctgtttattgaagaatcacggcgttgggagtcgccagacgaccttctgccactgagaagactacagacatgcgcggcgataacgccactgtcgacgcttgcttgaaatgcgtggttgactagacggaattggaatgtgttgggtgtatagaagacaaggactaaatgtacagctattgaacgacgaacttctatttaagggtctcagttttcctcgacgctatggcatcgtatcgaatgagctgcctcccacaatcaagattatagcgaaagcaacttgcgagttaatgaaaccagatcatctcttcgcgtaaagctgtggcgttgttttgactggcatacagatgccagcgggcatccattgaactcgtggcttaatatttgaggcctacgcttgggtgcaagtcacctgtggtttttcaggtcgtctagactccttaatacttcttgcttgtgggcgtctctaccgttgcttcttatactgtggatgctctttggtgccgtctcgtaaagagaggcaaacaattcacgttgcaaaacacgctagggaacaaatttttgaccgcgaggggacaaaatgacgaaagaaattgtctgttttactgtctatggcactcctttttcgtgacctcattctttcgcttccttcatgagtgcgttggcactcctttcttggccagtgactctactattgttcatctagtacagcgtactataggagatatatgcagccattttggtattttcagattccgaagagaaagacaacaatgcttgccagtttccccaacgggacggaaaacgcggtaaacaaaaaaaacatacgagtcctagactagcaccgacaggaccgccagtgtatcgccccggttctgttagaagcgtctctgtctctcccaaattggggcctcgtgggggctgagcaatgtttcctagcagcgttcatggactggactctgagtgaaaacaaacattggtggggcgagacacagaacggttggtaatcacgctgtcaagcgagaaaggagacgtcgtacggaaatgggctaggagcaaagccgttcccgctacaccccagcgacgggtccctcttcccgttggccatttcttggacggaagtcaaaagtttcaggaggatcggaagggatgaaatcgaaagaactgtgcactgacgtgtgaatgctttccctctctccccggagaatggcctccgggcccctcctcgcgaagtcgcccgctagccttgccggatgcacccaggaagcggacgttctgtgcggcgcccgccgattcctcctaagttcgtctgctgacgcagtatggcaaga

SEQ ID NO: 1944 - DNA, 2270 bp, Toxoplasma gondii
tctcgaaactgagttcaagcgtctcgacactgcaagggtgaggcgtctgggggcctcttccctctcgagctccgtccttgcgcgacctaccgtgtcgcgttttttgcccgcgagttgcgtctcctcgctctgcctgcgctgcgcggagcagccggcggcggcgtcgcacctccttttcgacgttcccgactccctcgtcttctcctgctccctcggcttttccttcgctctcttcgtcgccttcacacccgtccaagatcttctcgccgacgcggtctcgtcttctcccgcgatgcagcaaactgagctcctgtgaaaacccctctgcgcggtcatcccaaaaggaagacgattctccccgagacgacgaagaacgagaagaagaggaagaaggagatgaaggagacaggttttgtgttcgggtggctctggtcagtggagcagcagcctctgttttctcgacttccgcgacgaggtcgttgaaagactccgagagcagattctcctccagacgctcccgctgtctgcgtgtggaccgagaggcgaaccggcgacagaagaagaaaacgggtgaagcagcgaagactcgcgaggcgggagaagcaggggaggcagctggcgaggaacgcgacgacgcgacggaaggcgacagagactccgacagagaaggacagcggacagaggaagccgagacagacggaggcgaagagacagtggacgacggaaacacagacaaggagcgaggagaggagacagaaggggagaggagaacgcgccaagaggatggaggaagagcgtgaggcaaggacgagcgagacgacgaagcggtcctttcgaaagaggaacggttcctgctcatagacctgtcgaggtcagatgaggaactgtgaggcacagaaggcagaaaccacaacagagaagaaaacgaggaaacgtccagtgaagaggagacataaaggaacttcgttcgtctctggaatgaagacagagacgcgagacccccagaggcagagcctgaagttttctgtgcgctgctcgggagcgatcctgcgtatctcagcgccattgcgatcttttcgttctgtatattggggagatcttgcctcttgacttcgcttctgtttcagcactggagtctcttccggccagaggccgagccgtcgaggcgcagagagaggaaacagatgcgagagaaacaacggagaagacagacgccaggaggagggcaacagaaactgaggaaaacgaggaactcgatggaaaagcgaaagagcaacggagacggaaggctgcatgagtcgcaaaaacgcagcgagggaaaagccacgacacccgagacagaagccaagaaacagtcgcatgcagagccggagagacgaagacagtcgcagcgaggcggctagggaaacagagagagagggaaagagagaaggaaaaacggtgagaaaaaagagtaagagagagaaagcgagaaaaagcgagagaaacagagagaaagagacagaaagcgagagaaggagagaagaactcagcagattctgctgcacaaaaaaagagcgcgaagaaggctgtttgtagtggaatacagtgtgcacagaaaagatggggaatgtctctcttctcttttctcctggatcttaaaggcgggactttctcgctgaaacgctaaaaacgctccagttgaaacacccgcgcgcatgcagtttcgtttgcatgtgtacatacactctggcgacgccagcgcctcggtgacgacaggcgcttctttttttttgtccacggtactgttttccttttccccgctctttctgccggagagaaagctggcattgttctccttctctctcgtcttctgttcgtttctctcacgcagctctctctggctgacatccgtcttcgcttctcttgtcgccgctgcgctgtgccgcttcttgtcttttctcttgtccccgttttcgctccattccttttcttctcgcgcgaggcctcctgcttgcctcgacggaagcgcgcctccgaagcaaggatactggtgcgtcggtggcttcctcgcttcttctcgccgttcgttcccgaaggcgacagcgccagacaccgtcatttcgtctgcccttcctcgatggaaggacacaaacctgcggatgtgtaattatgactgtttcgcggagcgcatgcagaggttctgtgtgcttgcatctgcacagacatccagggaggcaagacgctcttccgttcgtctccacgacctccaggcgagggcagagcagcca

SEQ ID NO: 1945 - DNA, 2396 bp, Toxoplasma gondii
acgaagtagttcagctccgatacgtttccgtaggcagtgaggacgtcgtggagcatatgtgcgtattcgtcttctttctctttctcctctcctccgcgtggagagtctggcgtccggccgccgtcccacagtgtctcccgcgtttcagcgtctgcggcgtcaagcacgccgccaacgggtaccgttcgatacgctctggatctgaagcaaaagtgtgcccactcggggaccgaagtgtgcgagagaagaggggcaccgtccaccatgacgctcaggtcttccggtgactgtacggcggagacagccggcgggagaacagcgtttgtctctccctcgcttctcgcctccatcgccacgatgcagttcagcggacagtccgagctgcgataaagggaatgaccaaaaggactcgtttcgaccaggaaaagagcccagtttggaacaggggtccttcgatatcttgggtggaacacagagagctgaaacgcggtttgtaggagcgtcgcacttggagtgccgacgagaacagcgcaaacgggtgttgctccacccgacgttcgcgggaagaaggtgcactggagagaggaagaaacgacagggtcatggggacggaaggaaagagatgcttcagcatcctctgtccggtgcgcgcatccttctgcattcgcctctgcgaatgcactttagagctggagagggtccgccgtctggatgctgcctctgtctcgaggctcggcagggtgtcacgacagagcgagcgcatgcagcttccgctagcctcctctcttccgtcgcatgtgcgtggaacgagggacgaaggaagcggcagtgcgagaagcaagaacaagcctcgggaggaagcgccgaccgagagcacactccacttcttttgaagagccaggacgtcgtccacctgaagagcaagtacccttgcctcaaggcggacgcgcctacaccccgttgtcttgtttttcgaatctctgtgtgcaaggcaaggcgatctcgaaacagacgtgacgaggtgagcgtttcggagtgagcggaaaggccggaaggcgagacggaaatcgacagcgacgcggatgtctacatcggaaggagacagggcgacagccgacacaagcgacacactcgggacgtttcttccctgtcagattccacaaagcgaacgcaggacagcgccgaggaagctccgctctccgctttaagtgactgacgctccgattgaagacatgtcctcactctccagcctcgttctcggcatgcaccgggtgtgtctagacacccgagccgcagctggcgcggccgacgctctcgaaacggcgcgctgagcagccagctcgagtgcatgcactgccaagaagagagacctctcacctttcttcggaaaaagagtcgcacaagtcacatcagctcacgaagtgcggcaaagtcgagaacaaagtggaagcgaaccgccaaaagcagtcggagagagggcgcaacgagacaggcagagaagtatccgctcgcccagcgcgcatgcgcgaggtcgacctttcctgctcaaaaagtcgcgatacgccgctgtctccagagggtgaggcaccatcgagcagccttgcacgtcgccgacttgcgtgatttctctcgattcattcagtgttgcgtgtctcgatcttcaaaaacgcgcagactccacacagacgtgaaaacaagctaacaacagcctgttttcgtagacttccagtgcatgcattccggttgagcgaggtgtatgtacacctcacaaggcctgaggaggtccgaattgcgatgagcgcaggaccggctcttctcacttccacgcgctgtgtcgcacccctttcttgagttttttgaatttctttgacggacgtttcctctcaaccgtttttcttctcccgaggaaatctctttacgtctctgtttttctgccgcaaacgactctgcgtctcctgatctcctgaatcccccccaaagctggagttgcatgcgtttttcctcggactgctgagcggtcgttttccgcagtttcttcttttccaaagtctacactcctcatcgtttgtctgaaagaactttttgacgcgaaaaaatgcgtcgctagcctcggcgcctctcgttgtggtgtatcttctcgcgatctgcgggtcggcatgtttccgcgctcttggaagaaaggcaatcgaagctgagtttttaggaattccattattcttctctcccgtttttttcgttccgtctctcctctgcagaatccgttgtctggtctttctccgtcttttttcgctcgaccctttctgtgttcaacgcgttaggaaccttcctccgttgcttttttcggccctcctcttccctcttctacgctctccactcacctcacttcacagacaaaa

SEQ ID NO: 1946 - DNA, 2893 bp, Toxoplasma gondii
aacaaccgtgccaaaagctcaaacgcgagcaggagcttaattgctgcagcttgtggcacaccacgacgtcggtactttgcagacagttctgtcattgcagctgggtcagtgtataagaacgatgcgacggcgagtccaagttcgcctgtatctcttaattcggggcaaggccctttggcggcactccccagtaaccgcgcgtagaacaaaaagtcgtatggcggattaggcagtataacggggaagacattgccatccccagcatttacttcaaagctgtggaagacagatgatagcttcccgctttgtacccaacgatctatctgttgaacgcaatggtcgaagacctcgtcccgttctcctcggcaggctcttctagcatccattacccgtgggagtagtcgcagtttctcgaggcagctgcctaccttaagacgagctctatctgattcgcctagacgctgctgaagctgcagaagtgctgcgtccagatcactggtttctgaacttacatcaactggttgttcgtcaactggatacactccactttgctcctccgttgagggctcgtttgcctccctcaaacttctcactgcgctgtccaacatgttgctaagcctctgttgagcttgccagtagtcttcctctggtacctgctgctgtatctgtgcaagagttcccacttcgagccgcggccgctcacgctgaggcgtctcagctccggctgttagtctcttctgtccacccgtagcatcgtgtggctggggaaaagcttgaaatttgttctccacctgtgataccttgttttcgttgaaaacggtgtcaggggtgtcagcatagccagcgataacgcgctcaaagcgggttggcctgcgttgcgagcctatgccattttggactcccaaagctgcaacagcgtaatttgccacaaccaagcaactcaagaagtgccaaatcctggtcactctataaagatagggtgtcggcatttttgtgtcgactacacagagctaccacaaacgatcgatactggaaggactgatgactgtctcaaatcaccacaataaccctcaagccaaattcagcacggcgggattttgaactgcactaaagaaaagaaaaattgaccacatatattgacactgcgcagaggtgaaacatgcagaatcaagctgtcacagccgaactacctcctactggccacctttgacagatactctgtggcgtgtctgattcaacaaggtgttctgctcgttcgcccaaccaattgtgggggcatgtcgaaaaagaacgtggaagagcaccactgattaatgcacgcaaatgacaatatatcctggttcttttccggggaatatcggaaaatgattttgaaataggatgccggtcctatcatgcgacaccgcgtcgtcttgggatttttcagcctgagactagcgaaagtggtactcacgtgagacaagacaaggaccatgggcctcggcccggctagccgcccggtgtggtggcccagtgctgcagacgtcgtttgatgcttgttcaaggcaaatctttcagctgtcgcaaatagaacgggagctggcagccatcatgcatcagcaaagaagatgcagcggcaagcgttcgtccgacacgcacgcatgcctatagttcattcatttcttgtggacttgtcgctgagccaacaacttaccgtgtccacatctgttcctccactgttggtgtttgttcacggggcactcgcagtgccattgttggacgtcgaggtggtgaacgcgctgtgacgctcatcttacagaagggcattaccgtcaagggccgctcagggttctgtgattgaggtaggggtgatttcgatagattcctcacaatgcactgggtagcgggaagcttcccagcggcaactgaaaacgtagacaacgcgtaagttactgttgtggtacctgtagtccgactagcagcagcagaggagcactccgcggttcggcagaatatgacactcgtgactcatcagtggtggagctttcgttttgacgtcgcctgcgatattgtacttctctttggtctactgacatatcctatatcgatgtttcagttcccgttgcaacgtctcgggcggtctcctctacccacccacgcagagtgtgtctctcttcttccgcgctcggatggattggtaagtgtagtgtcactggctaacacaactggcgtcacagtttgtgtcttaagcgctggcaatcaaaagtatgctaagcacactttctggagcccagcacccaagcagcatatttctcgcgatgaagtatatctgagaaatgcacactttgcgcgagttccgactatagcaacacttttccgatgggacaccacccctgactcagagaatgttatgcagctcagatctggaatctggcggcaatccgagaagcgatttgaggtgagtcaacagacggaaaactcactgtggtggttgttctacagtctgttttccgccacggcatctcgggggcagcatccgctgcggtcgttaactgtttgtctcgagtctctgctgttcttccttccccagacttcttttggctaagcccttttgatcaccacacaccatttggaattgatcgaaactgagaaatccactcattccaacaaaagttatgggagatcctgctcactatatcttgaaactaacgatgctctcacgatgctacccagcgcctttggtatcacgattatcgtatcttccgggttgttgcatatcagcgacgcataagctgaagaaggttgctctgcacctcacatgagctgtgtggcctgctacccatttcttcttcgactcgtcgacggaaacagagaggcgacaccgcttctcgccactcagcactgcaatctgaga

SEQ ID NO: 1947 - DNA, 1720 bp, Toxoplasma gondii
tagcaaaggagaacattacggcaccgcattctcgtggccaaagccgtggaaggcgacttgccgtacggcagagcagtctgcccttgtcgcaccgaaggggctgcatgcgtcgagggagcctcacctgcagcaggggtcctttctgcggtcctcggtgaagtcagttcctgctcaggggaaatgtccttggattccgccgcgcgttgttgcggcttctcgcggttctcaaaagccttagacggtccagaaaaagagctgttgtcgacatgtaccgccagacgaattttacccgagagatccacgtcggtctccgcacagggtggcttctcgcatctggagcgctcgcattcctctccgcttgattctccagccccagtcccgtcatgcgaaacgaaagaagctgccgggtcgaatttgaagctcggtcgtagaatcgggggacgcaccggctcttctctgagaacctgcttcgttgccaggtgtagagcgaggtcaggatggtagcctccatcgtgtgataaggggtaaaggggatttaatggcaaccgcacgtcgccggcagaagacaagccacttgaagtatttgagagtcggcacccgcccagtgacggtgttgacatctgtgctgctctgttcgagtcacctgcagtcctggagtcctcgggagaaaaccttttcgcggtgcgtgaggaaaacgaagagtgaggtccaccaggacctaaatgggaagagagaggcatttttcgcattgctggtcgccttatgggttcttggaaacaggtgagatgagtcacggaccgacgacggcgacacctcgctgtcgcgtgccgtgctcgcgaacgggggcaaaccgaggtgagtagacacgagtggttgcagcggcaaaaggcaagtgagtgaaagtaaagttgatccgacagcgaaacggtcgaagtctagctgcttggatgcaagtttaggtttcagtggtgagagtggagagagacgagtcagaaaaaagagtttgccatcgatcacaaaaaagggaggaaccaacatgtaaaaaccgggaagagcgacgcaggtccttcgtaactaatgcgagggccgggagtggaggccggaacgcgtaccccttagtataggtgaagacactgagtgactgagcgtttaatgaggaaagactgttttgctggtagatggtagcgaggacaccgcgtttactcctcaaaaagtaagcgtgcccacaagaggacccggttggttttcaccggacgtgaaggctaaatgttggtcaaaccagctcggcctctgaagagagctttcgggaaagtcagtgctggttcatgaagtccactttcactgtgcgctggaaagcagtggtctgcgaagaaccaccgcaggactgtttaagaaagactccgttcaccggttcaaatgcagaggaaggggcccaaccgacaggaagatagtagattggcccgaatcctttggtccacagaaaataacgccggagtacatggacagactcaaaaagcgaaaaataaccgagttgcgagacaaaagaaaaagccgtaatctgttcaatccggcactctctttgtcttgtcgcatccgcgtgcggttgccaactacccagcggcagctgaggcggtcccagccatacaaacggaataccgatacaagcgggattcgttttcagcccgtttttcgatggatgctattccgtagagccaaagaa

SEQ ID NO: 1948 - DNA, 5010 bp, Toxoplasma gondii
ccgcgagctgctgcagattggcggtagtctgatcagaagatccgaactgagaatctacagcgctgtcgcttctgttcggggcgtggagaggcacgcgtctcgcgccttggtctgtctgtccaggtggagcatcaaggtgttgagcccgcgccccacacaaggacgcttcttcggtagactcgaaagaaattagctgaagcgaggatggcgagtctgctggggacacggcaaccaactggttggacgaatttgtcgcgaagcgtgagctttcagtctgcgactcgctaggacggtccgtctgtgccgaggcaacgtctagacgctctccatttaaaggtgcaactcctggagccgcatctcgacccggattgttcacctcgccttgtcttccactgctgacgggtccttccggctctctcgcgtagattcggtcttttcgactggcgacagaggggagcgggacagccgcagtaggtgtcacggcagctggtgtggaggaatcagctgtagttgtcaacgagacgaattcatcgcccggcagggggcgtgcgcttttgcctggagtcgacgatttcagtttcacatctggagatgaaggatgaagactgcctggagttccctcgcttgtttgatggagaggcgcagagcgtccgttgggatttcccacggcaaggtcgggaggcggaccatggggggctccttggacataatcattgactcccgccatcgaaaagatatcgaggaacgcacgtgatagtttacagtacggctggaacttgcttcggcatgcatgtgtaagcacggaatatgtctgtcctcttcctgttcgctgctggcacgtggcttgcacgcaggggccgctgaccggcaaattccggtaggcacgggtagtcgaatagttcgcttcagccagctgttacgaagtactgactgcacgcatagagaatggagacgacctttgttgcgtgatacgtgaacagctttgaaaaaagaggcagacaccgccagtcgcttgttcaagtccgacaccaaatctagagactgccacacggtgattcacagtaccaccgaccaggcggaaacgtctacgccagcagagtccttgagacttcagccaactgatggaaaagtccaattgcccgggaaaaggtaggaagacgaagaacgagtgaacttcgtgaccatacggccctgttgaagaggcgtctttggcggatcctgaatgacgaggtgttgaggccgccgacgcaaaaaacgaaaccgacaggcatacggccacagccgactttcaacagttgagcacgttaccgtacattgaaaagacatgggaagtgacattctaaaaaattcgctttctgtactgtcaactttcaaacatgcttgaaaaaacgagacgatgtgtccaagcgaacatggggggcgccgacgaaaaggagaccccagcgctggaagactccggggcaggaccaaccattctgaatttgcgccctacggagtgtcacttttctgtataatccgctggtgtttgtagcccaactttctacctggtagcttggtagcaggttacacgtttctctggagacagcaacggcgtccagggtagatttgctcgcagaagggattgtggccagctaccgtccgtcgctcggtgtgaaagatcgagccgttactagacaaattcgatctgccaaaatagtctcggttccgtgctgactttgacatttcgggtaagaagttagacaagaacaatatgagtaacaacatataaatgcaacatacgttgattccaacctttgggatccaactgggcgatactagtgcctctctgggcggcggagcagtcttttgcctgtcttgagagcaagccgtccaaattcattttaccgccaaaatattggacaacattgcgggaagcagatgtgctcgtgttcgtctttcacggactgcacccttctctaagttaaaggaatttggtaacagctgtctgtaactctctatttcaaagcaatttcaatcccatggtccggccctaagtggccgggacgaacgatccacagatagctcctggaggtttaacaaacgcgaaaggaccattccctcgatattaaataaaacacatcggtgccaagcgggacatggatgaggagtgagaaaggcctctctttcgataccgtggctgaagccccttacactgtttcttaccgcagtagaacggggtactgagttctccgtgaggcggttgctcctgtctttgttttggtggcagtgtattctatatagtgcgttaataggcaggatattgcttaccctatcaagagtactcttctcagattaccgcaatcttaggaaacagtcttgtacgtgcatgctgcatacggtgttgggagcgctccacacttttacagctccctctaaaattgagatccgcggcaaccacaaggcacacctgcgggcggcacttgtgaaaatcgactgaaaaagcactagaacatctagcagtctagaacgtgcccaacagccgctgttctgaagcatcggtgcagttgatccttcatgggcggtgttggcttcaaagaaccgcacacttgcaaacgcttctcatggctgtaacaatggctcggagtggcatctgttcgcgtgtgacattcgtatcgtatgaacaatttctaccaaaagtctgtcattgaagacgcctcttctctcctaggaaaatacttttgtacaccggtgtaatggtaagggcagttttacgtgatatcgcgcagggatgaagatgtatgcaatggaagaaatcctccgtccaggcttgagctcacaacacggcagaagtggaatttcgcggccatgcgcttctgaccgtaagccaggtgttgcgttgccaccacaaaacggtggcctaatcttacatgtacaagagctacagcacattcgcctagaaaggcagcatatggtttgaacgttcatcgttcaccagatatcatttcttgaataggctgcgcgttagctttttcttatgttttgtcctccgtgcgcggaagatctggctcccactgtatatgcttcgtgaatggccgatgtctgttgtcgaagtgccgatacgcgcgtgttcttccctctagatagctctgcgtcatcctaaaccgttaccatagttgtagttgcgcatgaagaaacataaagaacagtagcgttggatgcaattcagattagagtcagcagaacgtcttcggaactgagcatacgacccatgaaaatcaggaatcagcatatggggcacttataaacaagaggacctatttgaatatataccgtcgtacttacaataactggacaaaagaaatgccgaagaaatccgccagcggaagctggctgaggtggccaagcacctcttgaagatacaggcagttttcccacgccgggactcgaacccgggtcgcccgggtgaaagccgggtatcctaaccacctagactacatgggattgcaagtttcctggtgacagtcacagcgccaaacactcggtttcaggccctttacaaatgtcaaatgcagaagacagtggttggcggcgctcgcgaacattgcacgatgtcgccgatcaccacctcgtgcagttgtttctcctggatgtgtaacgattagtcacaaagacaaaaccattaatcacgaaagcgaaaaagcttcagaccggaagaagcaacacctcgataactggatttctgcgacagcaggaattcgtctttccggcctgcaacgtttccggcttcgtgattaatggttttgtctttgtgactaatcgttacacatccaggagaaacaactgcacgaggtggtgatcggcgacatcgggcaatgttctcgagcgccaccaaccactgtcttgtgcatttgacatgtgcaaagggcctgaaatcgagtgtttggcgctgtgactgtcaccagggaactcgcaatcctatgcagtctctgtggtgaggacacgcagctttcacctgggcgaaccgggttcgagtcctcgcgtgggacagctcttcaaactagtatctaatctccgcgtctgtcgcgagcaggaatgttatcttctcagacggcgacgaggcactcatctgggtgagcgagtcaccacgtggccccccaatgtagctgagagtcttcgttcttggtaccatttaacatttacgtgtaaattgcacgctggacggtgtcgatcggagttggtgagggatacaaacaggataagtggcaacgcccaatttataataacctactctaacatacactctggacgtagaaccttagcgctctatcgagcagccttcttgtgcgtaggtgtggtcgttcaccgtgtagatcgcggtcaagcacaccgcggactgacctcatatccctggccacctaccgacacttgctaaatacgaagaaggcaaaatcaggtgacggctcacacgctggagacactcagccctgttcgtgtatataagttttacgacagcaatgtcaccgttgtaaccttcagctagttgccgaatggtggcaacgagcccatgttacattgcggtttgagctagggttctacatattgtggttcagaacacaacaactgttttgggcatgaatgaccacatgcagcggatctacgaggccgtttaactcgcagcttgaatttcatttataaccatccgtatgcatgttccaccggactacgcgtcggttggtcaagaagagagtactatcgctccctgcaagtcaatcatggagcgctttagcattgtagcagatggagaaatagttgtaacttgagtttttcatccgacaaagcattgtgcaaccagccggtaccccgtggccaattctcacatcagcgttttccacattgatggatttctattataccgtggagttccgagtaaacttcactcattgcaggaaagagggaacagctcacacacagaaaaatctagcatgaaaatcctctaccaaacaagcagttacgactgcgaaaagggcgcat

SEQ ID NO: 1949 - DNA, 3505 bp, Toxoplasma gondii
ctagccgtaatcgtgtgacccttttctgggagcgggagaacgaatagtggaagtggaggttcctggaattgtgtcgtttttttagaccccccgtgatgtgggcgatacgatgtaggcaagccttatgtccgcctgcagctggaaaagaggctttctgaatcttgtaaacctcggttatgactgaagtgccgtgctagatggtatcggatttatgtggtggcaagcggaattccacgaaggcgtgtacgcgacacacatagcatttctggtgtaactgcctcgacggactctattcctagttggagaggaggaaacagacatagacgttcagcagtggtgagatcgcagcaagtgatgggacgtatggtaaagtgttttttcccttttcgaaatagactgccttcttttcacacaattggtaatagtgtaggggcgtatgcgacagcagcgctcattatttgtgtttgtgttttccgcggtcaccgtgtattttattggtctggttcacgtgccacaagactcagtctcagtcttctctcgtacgatgacatacgggaaaaagtgtcatggtatcgttctgcatccgatggtgtcagagctttcactcaacgaccaacactgcagccattgcaaaaccaattctctgtctgggcagttgttacttcaatttatggaacaaaatgtgttaagacaccgccgttggggtgcttcctcaaaaaagcgtgtcgcagcagctctgcagcgttatcgaggaagacagtggacgcccaacacgttatttccggcgaaatcctggattccgcttagagacacacgagagacccaatagctgctcgcgtggtagtcgtgtttgagacaccaatttcgatttttttcttttgactggagtgataccaaaggatgtcatcaaacgtggaggcaacgaaatctagtttgcgtcagcattcgcttacggctgatggaaacgctttggcgtagaaaccaaatacaacagcaacggacatacaatagattgtgtatcgtatgttcaacttggaaacagtgaaatgcatacttttgggtgggctacagctttgagcggcgctcgtcgggcctgcattcggtgcggggctccgggttgtctatatgggttcactgggtcggagaagctccaggtgcacacgtggttggtaacgtcagaacaggatcacttccacgaagaggccttaatattttgcgatagcactggcttgacgcgacggggataaaattagctttgaggataccgatgagaactaccaacaacccgacggcattcgtgacgagtcactaatacatcgagtgagttagatttgggttctggagaaaaaccacacgaatgagcgagtcgtcttgcgcatgatacggtagaatccaagtgtggaatcccgtgcttccagccccccgttgctgggagcaggcccagtgcggaggcgtttactggttgctgcggcgcagtccacgacggcaatgctctccctgtctgacccactgatatgaactgttcatcttaggttgcctactgtatgccctagttggcatgttgtcgagaggctccgttttggcagtgcatagtgaaggcgaaatgatgtaatgccgacctcgatgtttcatagggaaacagcaccaggagcactcactgtttcgtctggcatgcatggactgccattttagactgcgagcgattcgcgcccgatccgcgcgacgggctgctatcggtaaactaacttccgcgtactcggatgtctccaccatccggcagcatcgggcacagaggatgctttaattggaccgccggttgatttttgacgtgaggcatcgcgatacagttaacccaaatgaagaaacttgaggaaactaaaatggtttgttcaaccgatggcctgtgggtcagaacctcatcgccgatcgagactcacaatcgaacctacgtgcattcgaggatatggaactacctcctgttgtgcacatgcggagacatgtacaaacttcgatgatggtctagagcgtgatgttgtgctcagttgttattcttggggagagggtgctatgggtagcgagtccctctagggaactgacacccgattgacgttggtctaaggcttccgtgagagcagcccgtagccgaagtcagcggacgatgggggacttaagtcaatgtactctgttcgacagttgtgtcccgctgacgaactttaggagtacgtcatagcgtcccaagttccccgcctgctacccgggctccacagagcgaagaagaagtaacattgaccattttgattcccccgaaatatcgtccccacactatcgaaaggaatgaacgacagcgtgtcctgaccaacaaaccagcttcggcctcttccttacaacaattgcagaattgtgggacggaggtcctgcaagagcatctaatcaggaacacaggcaatatgtccgtttctccaacaaatgccaacagtcacgaacttgccatgagacgacgcgccatggtgacggttcggtgtgctgcgtggtgtaacggggtcgcaagagccgcgtctccggagcatgcgccgttcgttttttcagcgtgttgactcctagacaagcactgtttcattttcttcgtacccacaagaaccgtttctttgattatgcacgtgagaggaagtacagtcgcttttttgcagcgagttcatctgcagtgcaacgtgagttttcagtgcacccgtttgtgtgtgatgagattcgtccactagggacagcgcgggcggcggcgtggaagcgctttgctgctgttcactacttcgcgaggacggtgtctccaagttcgcacgcgtcgggggccaactctgcgacatcggttccctgcttcacaaatcaaagacctttagtgaaagaatcctccaggagacatcatctcggggccacccagaaaatctctttttaaagaccggagagtctcggaagacacgctcctccttttgccacctggggctctctactagaaacgctgtcttgtgccggattttaccctcgcctcactctttctgatctaccgatttctcggataaataaataagtgatatgtgtcggatactaagcacagaacatggtggagacgaattgtttgaagctggtgtatcttttcggaagagttttgtcatgagcacggaaggagacgacagcaacttctgagtcattgcttttcctcgtgtggataaacacgcaggagtctctgcgcagcaaatccgtcctccaggatatctccggttcgactgccagatcaatacggaagttggactgggaaggctcatgactgaaaggtctcgttccacagcggaagatgtttgggtaccattttaggaggaggaaacgtggtcaggcacaacatcgcgtttaccggaaatagcaatataaaaggcgcgacgagttccatcatcggagcttctctcaaggattggtgcccgtttttacagcggttttgcgagcacatgcggagtgaaga

SEQ ID NO: 1950 - DNA, 2890 bp, Toxoplasma gondii
gatacttaacgactttcggtttgtccagcatcatcgccgcttgtagcatcgtgtattttgtccccgctccgctgcagcgaaatccgagagacaagccgcatgctgtcgaagcatgttgtcagcataataacgtggattacagctgacaatgaatattcgaaatgcgtcacagtcacaaatgctgttcgacgtctcccggtggttgaattgtacatctcgtctgagttatagattgaaaaagcccgcctaactgctagtacacctgcggcgacaactctgacagtacaccacagtcgcaagaggcacagttcaacatcctgcacgaacccccttcccctggccttccctcatgttcgatcttcgtacggatataatctcagtgccgtctgaagcagcagcaccgcgttaaatctcgataatattgattcaacttttcgggagggggtcagggttgaactaccagcggaagcctgtgtcggtgatctgggcacaggtcacggtcaacacgaagcgtataaacttacagtgctacaaggaacacggcaaggggatagtgtcaatcgagactacggatttatggatcgtcagattgagaacacaagagattttacacagtcaccggacaaataaactcacattgtcaccggacaaatcacttcagttgtttctccgagcttcggctctgatgctgtgcaaaagaatttattttatcgcatggtgctgagaccgtcacttaagtgatgaggttcgaacccacttaccttgctgttataggaacaaaatttttgttccagtacggtttttcagacttaattttgtctatattctgtgccacgatggacaagtacatccgtttgctgtccgggcctgccatgatgctctgggcctcgtcccgagaggaaacttcaccaatgagacaagcataactagtcgtgtgagcggcagtaacgccaccaactacgaaacctcgagttgattgagattttttttatcagtagcgctatccaaaatttcctgcaagccacccccgtccaatgtcatagtagcggaaaagggatgcgtcgcgcatataaggaaatgcgtggtccgtaacgttggtcctagaggagggaggtagtttgactaatggattctccacccacttgaacgacagtctagctgctgtcgtcgatgcgatcctttgtttgctgagccttgcgtccacgtgtcaacccgctagcagggtcaggcagatgttcgaacaatcgagaacatcgtgcgtatgtacaccagcatgtgagatgcaaaagggcactctctctgggccaaagaaaagtcccaaaactgcgccacgtatgctggtgaaggtgaatcagtggcagggttcgcaaaaccgcatatacacacttaaagcatgagattcttcaaaagaagagaaactgcattgccccgctgactgcgcgaaacctggcatgaaagggacactgccagtaaagaaaaaacgctatctgagcaacgagaaacggcttgctcgagtgacacgtgaaacatatgttcaattatccactgccggagcggaaattatagtaggtttcatacgtaagaaagcctctacgctcccaggagagatcacaacgcgggcaacgatcaatgtccctcaaccgtgccgacaacaaaaaatttgataagggcgtccacttttgatgcctcgcaaggttttgttaagatgaacatgtctacctggacatactgcgtaaaaattggcgcacaagacatgatgttattcggagcaaacaccggcactacggacgaaaaccttgtcagggagaacgagacacgctttctgcctacacgcgtcgctctgaaagagcaggcagcgagagaggtattggcgcttccttctctcgtcaccgatgtcctaggaaaaacattatggaaggtttgttaactaaaacttcatatgaaggtagatgtgttttactttgtgtaaactcaccgtagtacagctagttgacatacagcatgctagttgagtttgcccgtggcgttccagctgcgcttttctgctgtgtcccccgagacccaaactcggggtggtatagtggtcacttgcaagtcgattcatccggtgaattcgactttactttcgtctagagtgcagacgttgcatccgaagggtgttgaactagggacctagctgtgtctatgctgtgtttgcagtaatatgcgtggccacacagtcagcggataacccgctgttcacactcacgcatggcatgcacatctgatacacgacctgatgaataacaagtgctgtgctgcaaatgattaacagacagcctagtcctttacttgcagaggtgctcaatttctcgtagactggactttcattccacatgaatgtaggtgggggggacacccgcatcgcagagaacataaattgtcacgcgtgccacgtgcatggtggaaagccagcagacgtcgtgagggcttccgcctgtgttcgggaggatttgacgcggtgttccttcttcttgaaagcccattggcggtcggtttccagttgggctatgtaacaaggcgggatgcatgtgttggtgtagtttgcaggacgctgtgttcgtatggagctggccacatcatcgcgtccgcttgctgaacccctgagcctcaatccgaacgtggaagcactgttttccacccaggttttcaaacgcagataacgttaaatgaataagtatctcatgtcgattctttgtcccgtcatgtcgccgcaacggaatgtggtcctagattcttgagcgtgtttctcttcgaagtcaaccggatgggtacggctatcgaaaagtcagaaatgttgagtcgcaacgctcgaatacctctacctaagcggagcttgatttctcagtca

SEQ ID NO: 1951 - DNA, 2105 bp, Toxoplasma gondii
acccgtatctgcctagagagttagaaatgcaaacacatgcaagcaaatccatatatatatatatatatatatataggcagccgcgcatagacagatttagacggacatagacagagagatagacgggaactcgtacatggatatatatatatatatgtagagagatgactagttactgatagatatgtatatctgtgcgtagacacacacacacacacaaatataagtatgtctgtgtcaatgcgtatgactgacgagagtgcatcctgaagcttggatgttgtactggttaatgcagtggcactgagcacagtgttttttgaagaggatccttccgcgctcgacgtctccgtcgggcaggacgaaatcgtctggaacatcgtcgtcgctgaacgcgcgtcgcctctgttgggagcttcccggttctctcgagttccgcgacattgcgcagcagagaaacggacaggagagcgggcagagagagaagggagaacgacgagacgagaggcaagagctggcgactaactggtggaccccgcatagcgagaggaaaaaagcgaacagaggcagcggttcgagcagagaggaagccagcaatcggaagagaaagcaacgagacaacggaagaggcaagaagaaaatgtcggagcgagaaaggaaggaaagaagaggaagaagagaggaaggcgcgaggagagaaggaagagagagaaggagagaaaagagtgggaagaggaggaagagagagagaaaaggaagagagagaaggaaaacaggaagagagagaagaggagcgagaaggaaataaacaggggatgcaggaagaacacaggagactcggggatccccaagcgaccagaaagacggaggaacagatattcgaaaatcggttagatgtaagctggcagatgtgcaaaggcaagtgatgcgcgacttccaagatccaccaagtccttccgcgcggggctacagagtctccggcgcagggtcttctctgaaaacaagaagcgtgcgttggacggctgcagaaagaagcaaacgcgaaacggagcaaacgcgaaaaaacgagagagacggtaagccgatataggagagaggaacagaagccgtctgagagtgtctcttgctttctgatctgcgccgcgacgctgcgaagggttactagatgttgctcgtcgcgttctccctgcgacgctgaaaagaaatggaaaccgtctacagttttgtgagaaaagccactgaaaggacctgcagtcgggcgcaaagtttccaacgctgtcgggcagacggacggccgcgcagacgcggcgctctgccggttctgaggtgcacgtctctgtttgctctgtttgtctcgcatgcgaagactctcgagagtttcggcaggttttacggctttccaagaagcctttttccgcatgtgttcgtcgcgactgagagcgagaggagtcgcccactctgcgaagggaaaaaaccgcgagaaacgcgacgcttttttcgggcgcggaggggaccgtccggcgctcgagcagaagtgtgccgagttccctttgtgccatggttcttttgagctccttcactctttccaactcgcggtgtgcgccattcctctctgtgcccgccagaagctccagtgtatgtacaccccaagtcgaccgtcgggtgtcgatacacctgagcgagttcgtggcggccaaaaacccacgcggcgggcagaacggacagaacagtccacatctgtttttatctggatgtccttgttccgatttttttagtcctgttttccttggcaaaactcaggttctctctgctgcggcgtctcggcactcctgggccctgcagggcgtctgcctgttcatttcttttgatagattccttcacacttctgtttttcttttgcctctgtgcttggttctggctctccatctcccttggttctctctggacggctttctccaactctttccgacgtcaccttttcctgctttctttgccctgctctcagaccttgttttctgactcgaaactctgccttcttctttcttctccctttcttcgttctcctcccgtccttcgtcctctgtcacttccgtttgtctcgacaa

SEQ ID NO: 1952 - DNA, 5012 bp, Toxoplasma gondii
aaacatggatcgttggcacatacaaactgtgggcgaaccggagagaagcgctgcatgccgtccttcggctgcggagatttgtggtgttctttgctctcccacaagagacagacggcgtagaaaatggacgtcgtcaagtggcggagatgacgatcagagacacaaacgagtcagcgaggaaggcgagaaaagagaaagtcgaatgggaacagtgaacacaacatgacagagaagcacacactgcgaatgcgtaacgggggaaaacaaaagcgaagcgaacaacgaggatagagtggaagctaaggacgatgagaactgggaaagcttcgatggaataccccgtgtaacgcgttttctgaataaaaacgagtgatgcggccccttgtgcaggatgcagagaaaaacgcttctccatatttggcgtccttcttcaactcaaagctacgcgacagaaaaccacagggcctgcctcgcgccatttttcttgtgaactggcagtacttctccgaggcggcagccttctctttagaaagcattctttagtgcaagtcgctttcgccactcctagaacattttttcggccggctttcgtttctttgcgggtgcatgaacgcgcttgctcgagcagtcgaagacactgtcatcatctagaaatggtccccacgagaagtcgtagatgccggggccagaaatggtcgagagccaccgcaacgaatttcagaaatggcgaaacgcatatccagctgcgcttccaaaaaacggcgagcgccgtacttgcccccccgtcttgtcgcaatcccgttggcgggcagacccacagaacgaaacaattccacccccgcacacctcgtctttcaaatgaaaacctgctccctcgcgttgtttgagcagattaagaacttctcaaacaacagaaagaggaactcggccgtggaccgaaacgctcggagaagcgaccgggaagctgcctcgttgcgcgcgcattcacaattcaagaccccgtcgcacaaagggggtgcgttgctcaccaaatcaaaaggaagacgagcaaagatgagcattgtcgaaagaaaaagaaaaggtgacttcacaacgcagcaaggccaactaggtcgaggacatcggcggctgtgcacagtcctattgaaagggattctgtctcccaagaagaggaaagggtacctcgtcaacttttcagatggcttcactcaaaggaaagatcagccagaaaaactctacccagtcggcgaagccacagttcggactctctcagatagcaatgcctccatttttttatggctcgtctcccggggggcgatgccacgcataggaggggcaaggagacccgccttcgaaagccccgaaaagtccgagagacagcggaaaaaatcaaagcaaacagtgaaacaacgggaaaccagcccaccgatcaccgattcacgcaaacagaaatatcatttggaagacagccacggctgtattttcaaaatgggacctctgtccgcaccacgagacgagcaaaagaacggcacctacggatagatttacgtgtggaacggctattttctcccaagtgtttcactcctagtgaacttgcacagacttctgaaagtaccggcaaaaacttgtcgtttcttcctctgcgcaacaacgaacagagacggtcgacaagccgtgactttgactggacacgggagaagtggagtcacctggcaggacattgggaggccgagaagcggaggaacaaacaaattcggcaaacgacgagtacgccccagagacgagcagaaagataaagagttcgagactttggccaagaacacaatctttccgcaaatatctcgacgcttcacaattctgggcggtcgagcagctcgttttgcaagcatggaacatcacacgctttttcgagggttgtgaggaggcgaggaggaagcgctacaaaagcgaatggaagtgatgagattgaagaggatgagggcgagagagatcctctttgtttcttcctccgctttttatgcagaagaattccaaatggtgaggccagtctcgcagaaaacgcctgacgcggcttcgtcggtggcaaggagtgtacccgtggtcaacatcccggtgcactcctctatgttcatttctgagtgaagaacgtaccagacaagacgccgatatttctactatattcgttgaaaggagggcaaggaggaacaaaagcagtacgagcttcaacaaacaggaactgtgttccactagaagacagacctaagtgtgctgctctgacactgaaacggttcacaggctttcctcttctactctcttctacagctgtcgctctctcatattcaacttcatatagacctgcatacgcctacccacatttaccgaaggggcttgcaggacacggcagcgcgacagagagtcaggtcgactaatgtacacaattacaatatagagcacggtctctcatctttttgtcctgtggatggttgggtcggttctggagtgacttttttcgttcccccgtcctttaaattgtctcccgtacagtcgatgcgcaccagttgcaattaccaatgtatgtgtctcccttttaaacggcggatactgcatcaaacatcatcagacgtgtacataggtaaaaatttattaccgcagtgcatcgaggggaatgcaacataaagacttcttgacatacttctcttcggccacccatgcattcacatatagtggcatgcaaaaagttagtacggttcaattatgtcgatcaatatgcataccaaatcacgaatatgtcgcttccttcaggagaaagatgcaaacagtcctctgacactgcgtgtagtcgatccaccgcgcgcgaaaacaacgttgtctcgagttcactcccaggacatggagggccttgtgatgccttttggcctgttctgaggattttcatgaaacttccaagtctgtaacggagaattcatttccactgttctgtcgagccctttctgtgcaacgataaggtgaggggacaggacgaaataattcaataacatacaggcaggacagaatgccaacaaaccagactacaacagcaagtcacatacttcgaagttctggaacagggattagatgtcgaggacctccaagcatttctttggaggaaaattcactcagagctgcagtgctttttcttcgaggttgcgtgccgcggaaatgtgcaatacgcgaatcgagcaagcagctgctgttgcatcttttgttgacaaagttgggaagaaatctgaagcgacgaatgtatgtgcggggctgtgtttgtacgcgctgtctgacttggagcactcgttgatgaaaaagtttcggtgtaacgctagtgcggtacacatttatgtatatataaggaacttctatgcatgcacttcgacgaggctacgaaagaatgtctccgtacacacacgacatgaacctattagaggacagcgaccaacgtacatgtgctttcatgtttttgcatgtatttccacaaccactactgaagtctctctggttagcagtccatgaaccgtaatggcggtatgtatccgcgtatacagagtacatacatgcatgaatgtaaatctggaactccacatcctgcgaaaatcggggcgtgccgaaggtggcgcgctgcgcaaagagaaacttcctccttgtctgctggactcgcgaacttcactccgaggcggtacatggggtaaggatcgacaacagaaacttgattcaggaacctcgcgttcaccccatacgcatctacaaagagagattctctcatccgtgaaagagtgtatctgccaacagacaaatatcagaaccaaacgtttagatccagcatcgattgcgagactgctactgtgtagccaaactcaaaactgggtgtgccgcaaagacgtctctgtctcgtcttgtgttttaacggttttagttcactttgttacgcgccaggtgtacagacacatccataaacatttataagtaaataagacaatacaattatggagaggtgcatgcctggttctggaggacagtacatttgccgatgaacttgccatgcgggaagacgcctcggcagatccttcgcgctgtggctcaactcaacgaggtttcccagattccctccccttttcgcgccgcgcatgacgcgtggaagtgagctgtgtcgcatgtttgagccgcgacttttcgctttaaaaaccacggactgtgagttgtgatttgccgcaaattccctctcagttctcattttcttcactgtatgttgactttttcgcggggaagccgacggagcaaccgtgaggaggagatggatctctaaccggaagtggagcttcgattggtcactcgattttgcctgcatgtgcctcacttttccctcccgattatcgtccagaattagctctgttcttttagaaaagggataaaaagccaagctctcgaaaaatatttggttttggaccgaacctcagcgcttttgtgttgctcgtctacatcgacggatcagagagtgacagacccccttggcggccgtggtgagaggatcgcgagacatcttgaggcggcttacactcgcaggcaggaattcacaaaacacctgctgccgcgttctcttttctcctcctctttgtcgtcgatcgttttttctttttctttttccgtctcgttgtcgacctctgtaacagcctccttcgtaggtcttgtcaagcgccgcacgacttttccgagccgtcaccgtctcgattttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcctcttcttcttcttctcgcga

SEQ ID NO: 1953 - DNA, 3319 bp, Toxoplasma gondii
ggcagttttcatgggctcgaggtcttaaaaggttcgagtggtttcccggatttggcacgaagttttcgggaatttccttcagaatgctgaaccattgggcctttcccagttcaggtccctgagttggtgtgtattcttcatctccctcctaggggcatgcaggatcacaacatggacaagggacatggtgatagtgtctttacgtatggtcaaagtggacgtttttccggccgcacttcccacgagcggtacaaacgtatttcttgtctggtgctggtgcaccatggagctttcatgactctgtgaacccaaacgtggacactcaaagtccaagggttcaaacagcgttgagccgtaatggcggtcgtgtgagacagactgcatcctcctttttgagggattttgaagaaggcagccatggtgtacgacggttgctgccaatcgaatgcaaactctactccagatgtactgcccctaccgtgacggtcgtggcaagcacaatagaagttcgctcccgtaaacaggcattcaagatctaagccggtagttagcgacaggtcgtagggcgtttctcaacgcaagtgcacttcatgaagataggaccaccaatctgcacccgtgcatcaaacgcccaagcgagccggcatttgctaaatgacactctgcggccagaggcttgcttctcgcgctgtcgaaattaaatccgacttcgtgtcagcagactatcccttagtggtgctgacgaatgggacgaagaagtgttcacgtgtggaccacagcgaaagatatctaaaaaggcatgggagcagttgccacatcatcgtagaatttgacactgctgggtgtccctctaatcagtattctgtagtggcagaattgcagccgattccagtatagagtgaaaccacttctgattctggaagaggatgctgcgagactcacgcaacttggtgccctgtccgcgcaatgtataactacaggacgcgggggccatctggatgggtgagacatgtacaaaatttcggccactaaacattcagctgagggaagtcatgcagaacagaaaaatcgtgttattaccagttgccgaggcatgacagcgttactctctaaacatgatggatgatggcgtcatgatcgacgcccggtagcgtcaaaaggccacctcgttgaacaacaataaatggaacgacgcggccatattcaatatcaagtagacagaggttccttaaaataaaaccaccttcgacaaactctaaaatttttgtactgtggcagcttggggccggacgcgctccagcagaccaacttcagcttatctccacagacctggaaaagtgacctacctaacagggtaggtgttgctgagactggaaatatccaggaattattcagcagctaagggattgattatagaaagcttgtacatcaccaccagcattgagtcttgattctgatcacaacatcaactgatgttgctttgtgccttctctcagaggaagaggaaggaaccactgtccatttacctttgtatgatctccacatgacagacagtcatgtaattctggaaatcatagaagcgataatcctgggagtggtagaggtagcccccacccggcgtctcaaaaacatcgttagacagaagatctctgtaaaagcaggagctccccaaaacgcgatgatccccaaatatattttcgaccagcacgggtcatgaacctgaccttgggctaccatccatagtcagtttctgatctagtatacccaataaaatatggagcgcatggatgcacagaatggacctgaatcctctggaagcaacatcacatctcaagggcacttcactgttctgcaatactatttctttcgccccattcttgtactgcacggccacgctgcgtccgttcccccaggtaaataaagagattcgagacgtagaccagtagtccaattcgttgtttgtcctttccagaaaatggtagattgcgtaaacttctgaatcccttgtcacaatgtgtgacagggactccagtttcagctgtcatctgattggaactgggttctcctcacaactcgttaccggacacggctcgtgtctgcagcttgaagctggtgctgtcgggtgacctgcgtccgctgtgcaaaagttcgagttttcttttaaaaataggggcacgtaacatcgaccagcggaggtcgtgcaaacatgaatctccttcggtcttagacttcctgaaacagcaggggaccgtgaagaaatggttcgagagtggactgtggactgaaacagtgcgttccaacgctagtttgagtctccaacatgcctttcaccgagaaccgtagggaacgtaacaaactaaggggactccgccggctgcgttcaggttgccagtcagtacatgtcgtttccttctcagcttcttcacccaaccccgctcgctcgaattccctcaagacactgtgagaaacacgcgcaacgccatgctggcagcaagttgcgttgttccagcgttaccgttttgcgcccccttaaacccttccacaaagcagtctttatgatgtgaaaaatcatttgttgtcccttgaatctgtttgccaactgcggcaacagacgtgtccgcatgtggagtagctgcatcgcgggtctgcgagcctcatccgtgcctccgtgtcttgggttttttttcctactccgcagcttttcagacacactgcaaatcgagatgacacttaaaaataggacattttaattcgtggatgaaatgggtaaatgagcgagtcttctggttggttgcggcttgccaacacacgtctcgctcccgtcggaccttgctgttcatttcttttgtcccagttaacgaatctctttctgcgtttcgatatacggtgagatctctgcctcgctgtttcttttctggagtcttgccgaaacccgctcgcttccaaatgcgagatccgtctagtctcctctggcacaaaatccctggttctggcactgcgggcatccagttagccaacaaactaacggggaagagcacttctcagccgctttccctcttttccttcgccttcttgggctttataaagttcttcggcgagttcctcagctcgcctcctcagtcgagttcttttttggcactgaaaccggcttcacctcattcgacgccggccgcgtctcatgtgtgccattttcttcagtgattcgaactgtgaaaaagctctgctttcctactccatgctgcagaacagtcgttcttcttgattcgtcggtttctcgaccaattctacaggtaacactccggaggtgtctggtgtcaga

SEQ ID NO: 1954 - DNA, 2137 bp, Toxoplasma gondii
tgtccttttcatttgtacactttcgtttagcgagagatctgttcctgtttcgtgcaaaaaacagagaaggcgagagcctgcagaatttgaaataagagacctctcctgacattttctctgtcttgcgacgctcctctttgagccaggcttcagctgtgggtctccaattggtggcaccgctaaagtggggagggggaaattttgagaaacaaggctgttgtgcatatcttttgagcggcgtttgtcaagagtgactgttgcccggtcattcgactaggaaagcgcgtgcagacgcaagcatatactgaaatagtacgcactgacactcattcggaaccttctatagttctttcatgctaaatcatgtataccgtaactcgtcgtttcttacacaaaaaacccagattaaatacagaggctgccgcgtttggcacttgtttgttgtaggcggaacacttggctcactcagtctatcggacgccacgtcacagtcgaaatgctgaggtcctcattagcgaatgccatcggaaaggaacgctggtactcagtctgtcctctaaggataagatctgctgcgttttttttatcaccgtaccgactgagactggtgactctcgggatttgagcacagaggactctttcttgagatataaactgcgatttgtggtaatttttggcacaaggacatttccgcgccgctccaattgtttccaccggtgtctgtgtgctaataacgcagacaacacacactagcagacacgtgcacctgcattatggtggaaatcacagaatcatggtattctaaaccctccgctaaaatgtgtaatatgaagaggcgaaaggttgagatgaattctgcgggtcgttagaaacacactgaatctaacgactgatacaactgtggtcgcatgaccgccttgctctgagaaaggtctaagtctcaccgaaaagtgcagcatgaagttctactaccaaaatggcgttcgttaccggtgttcccgttccagtctcctctgcagaacaaaatgttctactacagttaatgtatttcctaatgcattccaaaatacgcatcttttgtcgcgcgtctatggtttggggttgaccctcgtcgcgtgcacgtctccggcagatgccagatgtagaaaaaaccaagataaatgtgtcaaggtcaagttttagatcagggagtgtgtctagcgtttccaagaattcatattacttctgtagcaggtagatacgttgtacgagccttggtgcgtggcatcgccttgctcaatgcgtgatcgttttggaggcatactttgactacaccgcttatgttagaacgagagaccctaccgtcagtgtttagaactgcctttgccgttgatgtatctctaccttcgttgatcagaaatcggggagagtaaccgtcacccttttcggcgaatcgcagtgtgacaacctcaacagcatggtcgggaggcttttgccattcttgaatcaaacttccctgtctcccatatcgaagcaactcgcgcgtatgttatagctgcatcacttgcgcggaatagatccgccttttggctagacactttcggttctcttcaactgcaaggacagccatgtctgacattcaatccaattccattgaaggttgacgttttccagcagtcttaaggcgtcgtgttcaagattcatgtttcgctgctttttaaaaagggcaccaatagggaaagacgttgctttcacttgtttggctgttactttgtacccgttctcagttgtttcgttgtgtttcgcaacgggagtttcagtcaactgaattgggctttttctgctccctctttcttgactatttttcctttgctgcaggttcacagttgtctagatcactgctcgacggtaacattgacttccttgcctcctagtatcctgcgcattcactgcctctttagtcaaaaaccgattaatcgcatggtatcacgacaacgcgcttattcgggtggccgaaacgagttgtggtatccattttagctgcattgttactcgtcctgacaaacgaaaatgtggcgtcaggcattttcacgctcagctgccgttcgcgagacatgtcagcacagaatccttcagcgagcgaaaccggccggtgtta

SEQ ID NO: 1955 - DNA, 2387 bp, Toxoplasma gondii
cagctgttcaaacacttcacaccataagctgtttgcggagcttcttgtatcgacattccagagcgaacgtcacggtggattctgtcttgtctgagggagaaaggaatttttgtcctttcgttgtcctctctgtccggcacattccgcccgagtagtgagtggggcagactgcagtcatgaagaacttggtcagctgttcctcattcctggaatcagtttcctcagctcacactttgcaagggaggattgtccagctggagtcacagtttaataggcgatcctcgcacaagttttttgccgacgctgaaggtgcaaagtgactagtcagccgagtgtggaggaatttgagacagcctgatttgcatttggtgaacgtgattgagctttcgagttcctcatctgggcactagagacccccgtaatgatccacaaactgtttccggaactgtaaacctcatcatagagtaccaaggatgctgcatgcaagtcaagttgggaggtttcctccgtcggaactgattgctacgcagccggcaacttgggcgaggctgtctgtgtctttctcgctccccaggggagagacacggactcatttctcagtggcattcacgactgctattcctgaaaataccaaggcctcgaggtgtttaggagccaaaaggacttcgcagactagtccacaacaggaaatctatggtctgtcagattctctttcgtagagcttatctagaaatgttcgttcttcaaagctacggtggacaccggcggacgggactcacttttttcctccgtctggtccgcgtggaaggataaggggagaacatttgcagaactagagcttattgagcaccatgtactaacgcaacaaggacaatcaaggtaatttgtggcacttcttggcgcagatccgtttgcgtcttgtacgttctcagtcggttcgctgtttgaagaacacccttgattttgttgtaaactgcagcgcgcaacagcctcgagatcatttcgtagaaatcaatgttacgtgcgcctgtagaacacgactctgcttccggagtgtgcgtccttgctgtagaagattgcaaaagcgccggaactccttccctttctttgttctgctcgcaccttgacttctcctagttgacgcctgtacaccagcagctgcagcagcatgctttcgcgacgccgaaagtgcgtggaacttaccgtttctacgcggttttagtcttctcgcggtaaatgcgaaacacgagtgccttgttcagtcgtctccctcctgtaacgaagaaagtggtttctggtttcaccgccgtcagctgccgagcaggcacttttttgcggctttcgcagcgcgtgcgactagcgaagtctacgtttcacggcagacagcagactctggtttcttttttctcgcgacagacgaggatgaggatgtcgggaacgaggagatgtggaaaagaactctgtgcaaggataaaattcccaggaagatacgagaaagcccttcattcctactttgttgtgctgtgtcgctcaagttcgctcatgaaacactcgattgtattggcagagttcatcgtcgatgcggactcacctggctagctagtgatttttcgcgccttttcccgcgggcgttttccctgtttgaaaagaaccgttttctcgtgttgctttccgtatctccgcgttcggtgccgacagtcttgcgtacctgttttttcggtttcctgccgacctcgaaacgcgctgcctaaaccgaatctgaggcgtcactgttcgtttcggagctccggtcttcttcgcctccgaggaaccgcgagttccgccgagaaagagcgaaagagtaggaagaaacgcaaagaaacttttaccgctggacgttctcctgactccgaaggccctggacaccaaaacatagagtcgatgtgtgcgtttgaaagtcggttcggactcaaacgttgcgcgaaactgaggacgttctgcgtaattcaaccaacccctcgtgtggctaccacgttcttcagtgcctctctgcaagtcacttcggttttttcgtcaagactggctcgttcgtttccactgagtctatcagctctgtcgatgcgccttttccgcgtttctgtttctctcgtggacctcgagcatttccacttgtgcggaggtcgtcgccacattttccttccacgtctgcctcattgttttttactgttcagcagccttctctcaagaactctccaacgcgttcttccgtttgcgttcctcaaaacgctctcgccgggtttcgaaacgaatcttcgaattcggcaaccgcgaccgagtcgtcgaagcgtcgaccgctcgcctgaaagcttctccactccctcccctcgcgttcttctccgtttcctcta

SEQ ID NO: 1956 - DNA, 3950 bp, Toxoplasma gondii
tgctggagagtgtgcggcagatcgtggaagaagacaacactcagttcggggagatcgcggcggagttgtctgactgcccttcgagtagaaagcgcggccttctcggctggctttccccggagagcgaggaaggtcaatcggagaaaagcgacacagagacgaaaggctatagcttgccggtggaagtggtccaggctgctctccagctgccagtcggagccattagtcacgtcgtggaaagtgaaaacggagttcaccttctgtaccggattaaatgaagaaagagaatggaatctttaacgttgaaaacaagcagcgaaacgcaacgcaacgcaacgtgtcgccttttcaaccagttgggacccacccacgaaaactcctgttgtcggaaataaaacggtctctgttgtcgcggcggagttcgccggctgtctcgactcccggcgcgggaacgaacgcatttcgatttctctctgtgtgtgtaggactatggagggagatctcgtcaatgactctgaaggaaattcttgtgtagccttttccgaaggaagcgcacacgaaaagcaaagatagacgaacgcgagtttccgtgaagagaagctcattccaccctccgatgcaccttgcttcgaaaatcgggagtcaagagaccgggccatgccttcgggcgtctgtttctccccacgctaccacttctggatgggtttgttttactgttgttggcagcagtcaacggcttggtttcgggtggattcagagaaaaaagggagcttcccttctgccgctgtaaacaacattggttggacctccccagttctgaacgaggggggaggggtgcgcgttcccagacgaaatcggctttttcgattggcactcctgacaactttgacgtgagagacgagtgcattttcgatatcctttttttgtattgtctcggttggactcatgtaaactgttaactggatacctgtacgctctacgagaaaggagactagccgtgactgcactcccttctgcgcaagacctgtgaagacgcatgcaccaaggaagttagtggaatagaaagaaacgaatactcagggtaaacaagggtaacaagtacattccggtcacctcactcctggtgctgtccccaactaaccgcaccgtgtgggctggctaggtgaatggccgacgcttgataagaaagcactcactgaagaaggcgttttcgacttctatgaactgagtaaacaaagtgctatcccgcaacttgctttctaccgcaagtcctggcatcaagacgccgaacaggaccagctctgagagaactcctccaaataaccaccgacgacgttgtagatgaatttagatttagagcacaccgataaaagacaaggtgtgcctggagtgaactcatagatttagactgagtgttctcggaaccctggcaacgcacgacaccttggatccggtaaacacagacctcaagatctaaaccagatgtccaagtcatggacccaagaagcgcgactcaacttttcccccttgttactacactttgcaggggtgccggcatccgaggttccccgcttgacaagattgacaaatccgggataagaaggaaccctgacgacctctgttgcactaatacacggtggtcaaagggttcccgtacacagggaacatgacctcacctttgctgtggtatccccgttaaaagaaacaaagatcttgaagatgtaagtgaggaatccacttcggcaggttatactgctcaaagctcgcacgaggggttctcttaacgtgatgataaatggaaacacacctcgtttgaagcgtgtcagtgtgtggctgcgatctgcttcaaatgcatagactggagtcatgcttttccaacgaaaatttggcacagcagttcgttcgacgctcaagaaccattccaaggaaatcgataacatgttggaaatcaataacattttggagtttccgacgcagtgccgtgatgactcctgggtgccacggtacatgctgtcgctgaaatctcgatagttttctgggtcggatgtagtgacgtctctgtttcgttttatatgcggttagacgtctgccgattccttttttccaagccttcactcctttgcttcgtgtctgctttcagttcttttctctgacattccttcgagcgcacacgtcagagtccactagaccttcgggcacccaccaagcggtacttgatcacttcgctgttcgtatctttcgcggcttgtctccacagaaatgaaattaaccttctgctcttgagattccaacgtcatcccaacacgagttaaccataaaaagaattaaagcttgttcgggtacagtcaagaagctgcaaacagccagcgtctcctggagggtttctccggggcccggcagcccgaaacaggcgagcacagagactgctgctttggacagagaagtagttatctgcaagtttctcgtttcctcattccgctagtctttctttgttcttctctcattcttttcaaaccctcagacctgcgttgatgttctactgcggcttcttgcagagcggcgagagcgctcggaccgcctctacagccgctcgtcaccccggtggacgagagaaacctacgggaaggtgacttagagaaaaagaaaactcgtaaatcggggctcaagtccgattgttggtgagttcaaggctcgctttccatggtgtaacttgctgcctgtggccagagttacaggagccaccggaggctgtcgcgggccgaaggaggcgtcggtggatgtgaatggcgtgcgcaggaaatgaagagaagacccgttcatcgttcttggtaattctcctttagtgtaaacgactcgatgaaggaaaagcagaaggttaccacgcgaagaaagagaggaaccctctgatatccttgcctcggcaatgctccaagtaagcaacgcaggaccgtctctcagcgcctccgcgccggtagagagtccatctccaagtaacatggggcattgagccagatgtacgtcctcgctctcaagaggttctactacaccatattcagctaaaaacagaatatatacctctggatgtccaaaaagctagaatagatgttgatataagaccctattgctacaaagaagttaccatatcctcagcgcaaagccggcattaagaacataaagatcatagcgacaccatgtacctcattcgactttcttagcgaggataagaaaaagagaaagtgaagggagaagacaaagatggactcctcgctgtctcggtggagcagtcacagtctgtgttgactattcagagtctatgtggactcctcagagggctaggcattcagcagcttggtgcctgttcactttcgtttcgctgtggtcttctttttccctatgcaggtccatggctttgctgcgcccgaaactcatgcatgtgtaacgagggagcttcttgtctgaattgtctgagagtgcgcggagtcgcctcgagtctacgcgcgcctagcatatctgttcacactggatttctacaggcgtttgaatagaggcgtagaggctggattcatttatactctcgggagaaactatcttgttcacaacttccttggcgcatgtgcctgtacgggaccttgtacatgttttcatcacctttacggctttcgtgcaactctccacttatgaacgcgttgctcccgtctttctgctcggattttctttctaaagtgtttcgccatggctgcttgactgtgtgcgcatcttcgaggcggccagttatggagagaaatcgtcgctgtttcttctacatggtggcctacactctttcgctgttattctcctgatcttctctgtgcaactcaaaggatgcgttgctctgctccaccgagttgggcgctccttagcgcagagtcttagggtcttgcagctgcttctctgtctgctagttgcgagaa

SEQ ID NO: 1957 - DNA, 1748 bp, Toxoplasma gondii
tttttgagtctagtgacccgacaccgacgtgcacagtatataacacctttcataatgagcagtagaaatcacttccgagaggaatatactgtggcgcatgaatcgtccgcccgcgctatcagataccgtctcgagcgcagcagcaaagagaatcggctcgacagtgtccaagcttcgtcgaaacataaaactggtgcacaagttacatcggtgcagcatatttctcttattgatatttgaaatcataacggtatttgtctaacacctgccgcgtacgaatcctcgtacagtgatctaaaactccggctgaccacatcagcttatccacgaaccgctggcctttttcatgtttggtctgtacggaagtaaagtctcggtatctcgtttgtacaggccactgttaagtgacagaatgtcaatgcgatgtagatatcaactgccacacggataggccgacgagccacccatcactgtgctatccacgaacttcagaaaacggaatgtcgaccgcgtaccaacgacagagttccttgttacggccaaaacaaaacacgaccaactgttggttgcaagagaaaaacaataaatgtcctttcgtgccgcgttccgacagattatgcaagatcagccggttaaacagccgtgatatacatccccagttctgttatcgtgagttgatgcagaactgccttgtccgctaaggaaaggggagccattccaatccattgaagtcaaactgctgagcagaaggcaacagaaacgtatgtattctcaagcacgtatgagctctgaccggggtcgatttgccgccgcgtgctacgctaggttctcggtgaagtggtggcttttgccgcggattttttttggcagctcacagcatgctctatgttctccagtgaaaaatatgagctttcactaccatgtttacggaaaaaaattaccttacatcccttgcatgcttgctcctttttttcgacgcactgggaaaaatctgcaggacagcttcttagagacagccgctcactagtcgcttcttggccctcacccgcctatggaatccaatattcttgctaaaccgatgaagctgcacatgttttttactgaacggctgaagcagatatcttctaccaacaaaactgcggcaacaaaaatcgaaaactggaaaccagtttgccgggttgcacggggtctgcttagcccggggcgaccggactcttcagagcagcggcctcacgtgtgaataagtcattagacggatttgtttctcaaaacagaggtaacaaaggattgcctttccccttcagatgaatagatattgtcaaagagccacgcgagcgaacagatgcgtcatcttcccacccagcggcacggtgcatgcgacgcagtcgggtgagcgcgctggcgacggcgtttccatcaaacttcaaccgtcgcttctttccaagaagagaaccggcagactgccactacatataacgccgacctttttaacggtttttacattcgcagtcattgtcgcttttcccctgtttctttgagccttccgtgacttccgggctgatccaagttttgaacgggacagtcaagcgccatccgtctctggtcatttcgttcccgttccaagtcccgttttaaaattcgatgcctaccaccattttcttggccatgttttgaaagtggctcgttctccgtggagagcaattaggtatgttttgcgcatttattccgcttgcctaacccaggaagaa

SEQ ID NO: 1958 - DNA, 3767 bp, Toxoplasma gondii
aacgctggcttccgtcggacatactaggatatttagccaacaaagaagaatgcagtgaagaagaaagacctgcaaggtttgaatccgtagcttttccgaatccctcacactgcccactctcgtcgacaccggacaacggaggcattgtccatgttcttgagcgacggcatcagccactgccatgtttgaaggttctccctcccctgttcctgtcgacaggccgcagaagaaaggtgctctcttggtagtataaaggacacgttgtcttttcttgtcccccgatttgcccacgatagtcggcgtcgggaaaaaccctgtctgaatgtacacctatttccaccgtgggtctagaaactttgtagagggcaaatggcgacatatacaggaaagtccgtccagctcggttgtctccctccggacggggccagaaacacgtagacatggagaccaatggatcttccagaaaatgaataaagagttttcctggatgcacggaggagcgacgctaacgcttgaaacgtatctcatccaccaggtctctacaggcaaggttagtcccttgtacctggcgcactttactgggaggcgtcagcatccggctcaaatcgttcattcagctcgacttctaccctcacatgaccgagtttctgggctgtaggagtgttcttcgacagagtgcctggctgtatccataactggaaaacccagtatcgtcgccatgcctagcgggtgtagcggttgtgttggtgtctccttcaaaattcgcccttctactcccgtctatggagagggaaatccagagggactgttgcgagtctctcagtgcgagacgggttgcacagttgcggtttatttgccatagcacgttaccacgaagtgacaccgagttcgacacgggacggcaacttccaatgcgactttgacagagttagcttatggacacactgcagcactacggattctcagactacgcttcatgggtcactagctgctgacctcgagtaatgatggaaatgcgaaggcggaaagcaaacggaatgtgagtcgctcgccctgaaacggcggcagctgtacagctttagggggacactacaggacaacgaacgaagttaggaaaggagaaactgtcggaaacgtccttccgtggaagacggtggacaagcaggcactcaattgaatggttttgagcggacacggatgcagaaaaacggaacaggagatgaagcttcggaaaaacggtcgccatggcttgaatgacctcgtggcgggcatgtctggcttgcagcgcttcgctctgttggtcctgtgatgagcatctaaacccttttgctcggaatgctgggcatccagctatatttcttcgctgttttcaggggagctgtgactattctttgtttttcaatgtcaagtcacactaagcgttcaagcctcaacgcggatagcccgactgttctcctgccccgccataatttcaagacatgttattcttcttcattcgccgaggggtcacaaatgcctggctagtcgccacagtttacaccgcaggagacgaaaagaggaaacatgcgtggcaattttgtaggaaaacgcgtcgaacatccgttttttattctttagatgtcactgggaaaaaggaaaaacgcgacagtgtcgaaggcacatccatgagagacgccactctcactctagccgagtataaggatcgagttgtacttgttgcgcaccactgctgagactacgacgcatttgcttcagtgtgtgaaatgccctccacaactgtctgagtggctgtacaataaatatcaggtggcaacgaggccttggcgtgctttgaggaaagccctgcagtagattcccttactaattattgcactttatccgggttcgtcacagtcgaaatacattcgacacgagcgtaggatccaacgaatcgctgtggtgctcgttaccgtagctatagatttggattctagagtttattttccaacaccgcatagcctagagtagcctcttccttcactcatgggctgctgccgctcacaaatatacgatacttgcggacacgtccattgacaacgcaggtgcatgtcatgttcgatccgctgtcctgttttcgccagtttctttgtcttgcttcgctgctggacttgccaatcgtcgtcaagcctttcctcgccgaagaaaacgattgaggatacggcctgtgcggcgatgtgttcgatgcaatcgctacctcacaaaagttaaacctcaacccgcagaaaaggcggacgccagaataacccactccgttcctcggtttgcagaaaaacactatatggtggacgcatctgaggttgtgaagtgacaaggaacatctgtcgtttcacagcgctggccacagaacagtgccagaggtgtggtgcatggtactatgctgcagtttccgtgtagctcaacccggtcgttttgcgtcctttcacttccttgggacatggggtgaatatattatacatggattcccgcgttcctcgaaatccgagttcttcgctgttcctgtgcctttctttcagtactgcgtccagagccggcgcgaaaccggaaagctccggacttctcggttgtccggcgacctcagctgtcaccctctaacaacgacccgcttttttctttttcaggctgagttctgtcagcgtaggaaatctgccttgcacaaacctatctgtaaaggcgagcgctgatggcgatttcgtaagacggcacgaattcttgtggtcggcaacttaggaaaaggggttccggaaagaacgagtctcgttgtcgcgttttgaaaacaacggaacacaagctgcgacaagacctctaacttgtcgtgggagtccggcaacgaggacagtgctgatcagttgttccccctatcggagaagaagtgactaaccagtgcgcatgtggcagcgagtctgcggactaaacacggaggccgcgtggcaaagaagacaaacgaataaacggtaactcgggttggcaaaagagagtggcagcacaccgttgtctgcacatgactcgagctgtggtctggtgccaaggtttgtgtcgcggcaaaaatcacttttccctgttcgttcccttcgcctttattttagccacatatttgccgcattatatctccatccctttttctttgtggtttcgccttcttgaaaagctgtaatggtcgccaggaaagcgttgacatgcggcttgtaagatcgatcgctggctcggatgaagcgggacaaaagacgtttccttgctgttttcgcagacgtacgccacttgttgctacttgtgtagtgcgggtataaagcgccacgcgagaaagcgtttcagcgtctgtttcttgtttcccgttgacgtgactttttcacaacgcaaaaagaagacgaacgtctgaagataccgaacaggggttcccgattcgccaagatgtttactcctgcttcattcaccccgtttattcacagaagtactcgtacgtacgatatgcagtgtgcacacatatttgtataaatgtcacccgtacctaaagtgactgtgaatggacatattgtttcgttaggagacaacgagcggaccagcgtgctcgtaccacagcacgaggaagcgaccgcgtatgaacctacttttggttctgtgactcttaaccgtctttctgcaaccaggaccatcatcctggggtaaatcgacgcgggaaaaggcactgagcccgcgtgtgcgccacctctgtgtgtcttttgtcacttcatgca

SEQ ID NO: 1959 - DNA, 2137 bp, Toxoplasma gondii
tcatgcaaaaatcattgctggctgctctcgtaccaacgacggaaccactgcaataaagtctccacagggtgtatgtggtcacattctagtacatgcgacggtgcgttggctgcggaaagtgaatgacgtgctactgccgccgtttcttgtgtgtagaagacgtgtagcagtcacaaagaaaactagctttcctgagtgtgctggtcgtgtaaaatcatgcgatggtaaatatcaggtgctgggtctttgcacttcttttgcatgcaccaacgacttttgaggtgggccatcattggccacacgcatcgtgggagctgccactttcaacttcctcttccaaaatgggaatgaagtgtcgtattttcagtaactatcaattcacagacgtttcgcttcggcagcccaagagcacgccccaccttttttcctgtcaatccaagaaaccgtacctaaccaacgggtgtcatttaactaaacttctccgattcaccatcgaatcgcacgccggattccagatgggcatgcaccgatataaagtggtattgcggttacctagtatcccacaacttcaggttgccggtttcctaactcatgccggagctcaacagctccgatgggccgacttcgggcagcatgtattcacctcagacatcattttaatccagagaaggtgctgatggtgtgtccagcatgttctctcgcatgtcccaatgatcgaagagaaacacttcctgatagagtgattcaaatccttaggtagaggcctggcgcctatttcgactgtgcgcctccgtcaccaggatgcttagtttctcatgcagaattcctccttttgaaaagacatttaccagtggtggcaattctgagtgcacaacagacagcttacccagatctgtcaggcatactggcgctaacagcatctgggcggtagcgtgcattgacaagctctttacctgttggtattcagctgtacgccggctccgtgcatgcgtagttcatcttgggcagcagtggcatgcagcatcctaataaaggcatatcttttaccgagtgaatgactgcagtcttacaacctagttagctgctatagaagccgtggacgattcatgtttggtagttgcgacgaacaagacaggttgggagttcctgtcgaacacattgggtatagtgtcgcttcgtgtgtgccggagtcgaacgcctcacttatccagaggcacgaatgacgcttggtgtgcacgtttcatgtttcctggtggatattcatcctgcaggtttgactgctggcctgctaatagctcaacgggagcccagggcccgcctcgtccatgcgcatgcaaccgaaaatgaacatagcgggtgtctctaatatagttaggcaactccgtatgatgtacggggtttcgcaaggaagagctgacgccatgtcactccaacgtcgctccgcttctcaaatgtattttcattcttcgtgtgcgagagttaagcgatgactcaagatgctggcccagtctgcatgcaaacagcggtaaaatcgtcggtacaccgggctgcctgatgtcaatttaccgacagctggatgaccgcgaagaactccttatgacttaaaaggcctctattccctctccagtgtattttgttctttttctgtccttccagcgagtcttccgtcttccacgccgctgtcgtcacgtacttgcctcaagcagaccttgccgtccggtttcctgaagatgcgcggcgaggactgactgatcgcaaggttattcctgcatcagtgcagcgtgcgttatgaccttaatgcactttcacaggcaactggcgacgtctgaactccttgtttgccgtgtttctccaaattcttccactgctatctctcttggggcatcctctgtgtgactgcctcattcttttcactggtcagcgaaggtagtctgcgcttgtgccggccaccggttctcgttcatttttcagcgtgtacaagtggcaggtactcatcgtgcatcccactctttctgggcttctgttttccgccacgtatcttgttgccatcggcactgcgaatcagctacgggcttgccactttctttgtagtctacaaaagacatctcaccgagtgttatcccagtcaagaaccaga

SEQ ID NO: 1960 - DNA, 1948 bp, Toxoplasma gondii
gttctggcagtcttggcgtcgacgcctccgtgcagttttctcttctcgccgacctctgccggaacgcctcgcctcttcttccctccctccagggagacgccgacagacgcgcatgcagccgcggccagcgcgcgagccaccggcgtctctgcggaggaaggcaaagccttgtggagagacagcagtgagtctccgcccaacgcattcgccagacaaggtgtcgagcagaaccagcacaagacgccgtccaccgtcaactcacacccttcctcaagagaagaagcgactggagaagaagacgaagcgccagaagaaagagaaggggacagctgagtgtctatctgggaggcggtgtgggatccagagggggaagtgtctccgggaaggacacaggtggtgtggggcgaggcaaggccggcgtcgacgggggcagggccaagttcaggtctgtgaggcgaaggagaaggcgaggagacgccgggagccgacggagactgaaaaggcttcagcttcagacagttctcgcagaacacagcctcggagagcggaaccgacgcgccaatgggccagcagatcagaggcacctcgacgaggatcgtctcctcggactcgagcgcccgcctcgcctgaaggaatttccctttgcatgcgtcgaaggagacagagaagtcatacgcctccgtcatcaacgcgtagtcctggaggtcctccatttggacaagcaaacggctccacgaaagatagtgagaaagcgagacggagaaggagaagacggagaaggagaaggagaagaagaaggactgcaagacaggaggggcactggaaacgagtgaagaaacttcaaagcaagaaggcgaaaagagatagaaggaaaggagaagaagagagaggacagagacaagagggtcgcgcgcggaggcctgaaagtcggagaccgcatgcaaagggccaagccgacgcaggaagcagacagggaaagtgcgagagagaagacgagagcagttgagagaggcgagacgaataaactatgacgaagcaacagaaaggaagagacaaagaagaagcgagcgggcagaggtctttggggaaacgatctccgtgtcggtttctgcggggccccctccttctccaaagagaaaaacgcggagcaccttcctcgtactttcctctttcttctgtgaattttgttccttcagacatcttttttcaagaaacataaacacaaacgcgtcctcctcgtggctggcttcctcccgcgtcgctcgttcagaagttctccttccagatgcgaaaaaaactgcatgcgcatgcaacggcagaaaaggccaacctcagtgtgcatttataagatctacggcgcaatgcaggaagcggcgtctcttttgtttcctgcagaagcttctttggacgctacaagtatcttttggcggatgtaccttcttcttgtatcccgttcactggaggctccgcgcctcgatgggcactctcctctccgccgcgtaaaagggcattctccggcggtgtgtctccgttttgcaagaactttctcccgttttgcaagaactttctctctctctctgtctctctcagcgttcttcagaagtcgaagttcttcctccttcatgacacacctgcgttgcagatctttccccgtccattcagttccactgcgtctccgttatcccgccctgtctctccttttcgtctcgttcttctttatcggtcgtcctcgtctctgctttgctattccgtgtcttcatcatcttccttcgctttcctctctctcctcgcttcttccctgtggcgttcctgcctcgctctctctttattcctcccttcttttctccctccgtcttccctcttcctttcaatttttcgattcggcctccttctgcgcaactttccttcttgtctctcttgtcggtgacctccccaccgccagacacga

SEQ ID NO: 1961 - DNA, 5003 bp, Toxoplasma gondii
atcggaaggtaaagacgtaatctctctaacggcggtgagatgcataacggcctccagtggaaaaaaaaagtcttgtcctgtgagaaagtgtaccgccagtccttaaagttggcgggggaaatggtcgacgctaatgcatgtgttaggcatagcgatatatatatatatttatatgtatatatttatatgtatatatttatatatatatatatatatatttatatgtatatatttatatctgtggtaaaaagcacgtgtgtacgcgtctccacatttacagggatctgcatgcatatagaacagcggtgctgggacggaagaagccaaaaatggcgcaaaggtgaagcgcagattccagtggagagagccagtgagacagcaggggtgttgtcgctccgacaggattcagatgcacacagatgatgcaacaacaaggcgtcgctgcaggaaaagagtcacggtggaaaaaaaagtagagggaaggaccttctcacagtgtggactgcaacactgcaagagatacgcctgccccgtggaaaggaaacgcaggtctacacacccacactgacagacctctgcgttgaaagctacatctgataggcatgcacccccggttgccggttctgcatcaactgttgctcgaagtggaaggcagcagttcttcggccaagtgaccggaacagaagcaaagtcaagaaacagagagtctccaccgtccccttcactggatgcaaagcctacctcaccgctggtggcacgcttatgaaatacacacacaggctgttctcggaggcagcatgctgccgacgaacaacgcagtaacttcgcacgtcataaacggcatcgatgaacgcaggcaccggttatttctcacgagccagtgcattccaacgagagattcacgaaaaattgggaacgaccgcgactttcttcgtggatcctcccccgagagggtcggaggtgcacaccatgcacggcaggcgtcggttcgaaaaggaagatgttcaggtcccaaagcgggcacctgagtcgtcttccctgaaaactgcgctgaaaacagacgcctttctctctgcgagaatccccgtttccccccgtttctttgcctacttgacagttttaaggtccgaacagaagacggcacgcgcgcccgtcctccacgacgtctgtgtccaccttgcggcgcctcgagaaaaagtgcaaattggaagccagggcgcaagttcgcggacgcgccgctggtgacgcagagaaacggaaaaggcgtccgttcctgtagattctggcaactcaggaaaagaggatatccgccacggcgtagcgcagccggaaaggacccagaccggaggaggcggcaggaggcgacgacgcccgcctctcactcttggctgtcggcgtaaagaagactggcagtcgaggagaaacgccgcgagcggtcacagtttgccaggcgcgtcaaaaagtgcacaagttggttttgtctgcgcattttacccgcttcttttctctcggtggattacgggaaatgcacgagacagagcgggaaaggaaggcgggagaaagtgcgaaacagcgaaagacaaacggtggagacagcgccggatcgcagcagaacgaagcagctctgggatgcggagaagggggaaggaaaaaagcagagggagaactgagaaaagagtccgtctttagcggagctttttgactagacgtcgtaaagaaagcgcagttgaaaaggcagtgcgtctctttctccggagggcacttccgcgcctccgcagccgcaagacacaaactcccacgggaaaagtgcagaaaaccagtacaaggtaaatcagcgaaagcagtggcgcgaggcctgtaatcctgcctgaccgtagtatatgcaaagcaggaatgttcagaagacgataaaacagacgaaagtacgctgcagagtacacagggtttgtgtaccctgttgcggttgatttctttctgaaaaccccgcgaaggcacagttgctctgtggtgtgacagagattgcagtatttcggtatcgaaggtgcgacaaatcgagtgtacacgggtccaaagtcgagaaatcggaaaggcatcactcctgtgtttcaccatctctgcagacactattttgccaatcccgagccccgctcttttctgttgagtgcagtgtcttctcctgttcggggatctgcaagctaaagcgagaaaccgccacagaacaccatccgcaacaatcttcttcacgaaccgagtgggaagcagcagtcctggtgagaagtgccaagccttcacacctgaacaagcaatgggccaggaagttcgcgtctaaaaaaatatggctgagtcctctgaatctttccgtgtgaagagagcttcttcaccttgtgagagtattacgattccgttttctggaagctgcatggtgtgtcacatctttagatcttagactcggaagcgcggattcaactgcagaaacaaagccgacggtgagcaaatccgttgaccgatctgatcgacacgggcatgtgcagttgaagtgtcgacatttctgtgcctgtgaaggcttcttggttctgcctcagaaattctcatttgtagggaagatgcgttctcggtagactcctctcccacatgtaacatatgtcctcactctcgagatggtgcattccatggggggaaaagcctcctaggctgcaccgagaaagcgagaagcacaaatttctcagagatttcccttcgcaccctcgctctccggttatattggaagagagaaatctacagagaggcacagggtgtttccggagtcccccggtacttcgttgttcaatctaaatgatcagaataccggttccgtcacgtgttatgcgagttttgtaaactgggatgcatcctaagcaaatacgcgaccttttcctttttcccatcaggattctccttcttcttccacagctaagttgtgaaagactcctctccggcaaccacgggtatgtgcagcttcaacgatttagatgatatccattcagcaaggggggcaccgcttaaagtgagactcgcttaccgttgtgagtgctcctgaaacgatagactggtaaacatttgaaaatgtccctgagaaagtaaatatgcccggctacacttttcgtcctagaagtgaaggaaagacgacacatgatttatcctagatctgacgtgtctcccaatttcgctagcaggtttacactcacctagaaaggctttgtcctttgttccagcgctcatccacaaccgccagccttgtacgtgaacataatgtcagaaaacttggagacgtgacacgcagtttcctgggataaccgctgatgtttcttcacctttctgttcaactcggtcagctgactagcatttacaattatcataaatccagaactgtatacctcaaatcgaataaacgcatgagctccttacaccccgttcctcacacggaatccttcggtccaattcttttatcgcagcaaaaatagaactttagcgtgagtctggactccaaaaagtagcgctacagcagaggttagcgcgcggcggcggcatggatttccaccacttcgacctgtgtttttgtctgctgctcaaagcttgcaccgccgtatttctctcttctccccttctcgtgttcacagctctacaaaccgtgcgcggaagtcaccgactccacaatcggaaactttgacctgttcaaaggcttcacgttgagaaaccgcctaccgttttccccttctaaaacataccgtttggtgcagtccatcagttccctcacgaaaaacgaagtgttttcgtcctcacaggatcggaatgcgtagaggtgcagcggctaaccgcaccgtccaaacctcggaagaacattctttgtaaagtgaaaaagaaaagcagacaccagcacactgtgatgcagcctgtcccgccctgcaaaacggcaagcccccgaaaaagaatcctcagggcagcgtgtggagttgcctgatcagtgtgaaggctttcagcgatcgagaggttgcgaaactgcgagagacttcgctgccacgagcagattttatctcttccttttttttggaattgcgtgcatgcaaccattgctgtctcttggtttttgcccaccgggttggggcttgctggatgccgtcactgtgcctgggcaggaagggagaaaaaactctctgaacatttcatcgcttcttgtcgctcttgtcgcgtctctgcgctggcattttctgtgggattttcggcctttctttcgggagaaggatgaacagcttttatcttggttagctgtttcctacagaagcgcgaaccagctcgtctcccctgggatcaagccagtgctatcgagtccctcccgaaatagtcttttctcccgtctgcgttaagttggcaaacccccgcttttgtgcgatgaattgtctcgaacacgtggaagcatgaattgactgaatatctagcggagaaaggagcaaagttctctttctcgggcgccgtgcaatcgttccatcgtctctccaacaactcagctgagtgtgtgaatggctgagtctttaccgttctttttgctcgttccgttggcttcaggcgctttgaggaagcaggcaatgcacgcgcggccttcgttttttcgatttcacgcttctgccaagagctaggtttcgccatccgaaactgccgtacacctcccctcgtgaacgcaagctttgtacaccagcatgcttcatctcttgtcctgtctccaaaagagaggtttgcatggttaacagtccgtgcgtaggcaagagtaaggatcaacgcgtggattgctgtgtatttctgtagcactgatattgaggtcgatctccagagttccgagagcacgctgcgttggggcctttgcacgctgcttgcgctttgcgttgttgtttgataacatttctttttttgaaaggtctctgtcgactcattcggcagcagtccctgaaggacttctttctttctcatttcca

SEQ ID NO: 1962 - DNA, 2446 bp, Toxoplasma gondii
cttgtcgggtgcgctcacctccactttccgttgtcgcctttacatggagctctgggcaggaagacatgcatttaaatcagtctgtaagctgtcaagaaataaccgacttgtgtgggagtggcgcaaatactgcgtcgatggcatgcctcgcctgtcgattgggttgtctttgcatgcatcctctggaacgaagaacgtggaagtgccgcagtctacgcatattccgccgccagtcacttaagcgtttgttattagaggtgtgcttaacggtggtccgataaagatgcgcaacagaaaaattagagtgcgatatacacagtcgtttcacaatttgccactctatcgacgatcgtcgtgatccaacataaagatgtcttaatattttaagagtcgcttgtccagacaggacacagaagtggtgtttcctgacagtagtgcgtcgattctttttcgtgaatggactttagcttaccagtttcgtttagtaattatggcaggacaacgtttcaaggtggaaacttgtgagagacactgaaacacttcacgaaagaactcggagcagacgtttcatgaagacttgaattagaacgacgaggcagcctatttgcccacccagatttttcggatcgtcgcaagaagttagcgaatcatagtgaaactcacaatttcaatatgccgaaggcattttgctgctaatctagcgtagaggcggcttttcgaatatccaaaaaaggtagagggctatgtgcataggtaactactttatacagctagacaagctagctgctcagtgaccgataaaaaaaatcatgttcttcattgtgtggatagtgttaggagtgttaacatctcatattgatatcattggcgaatacgccagcaacaggaattctctttcagtagtgaccttgttgccggtatctactcagggaggttggatctgaaagtaactgctttctgatatacatgaaaaggcatggttgccactgtgccgtttcaaggtgaccgcacattccgcagttgcaacaaacgctcggaccaccacgagtcaggggtgaatcgagcacatgttctagccttctatcccaagcccgaaggcgagcgctaaatggaaaaccgaagacgtccgatttgaaagagtgcgctagactacggaactggagcagcttccatggcggccgtcacaaataaatgtgcaaccgtggggtacgcgcgctgttgccggaagcagtggaagtgtacccttttagagaccgaaaccaattcaaggtgtcgactgcagcctcgtcatcgaaggaaagaggaacacaccagattggggcaatcggttgtgcaggaagacttgtgctgggaaggttgctgacacacacatccaacaagccaacgtatttaagtgcactcccgggacgacaggtgttgccgcctagttttggagttcgtcgggatctacactattcgcatacgtgtgaaacaccactacttatgctcctggtcagagtaactacgataaatggcctaatgttcgactctcgagtgcctatctttaggatcttggatatctgtcctttttacagtccaggaagctgtcccgccacccgcgcacacccccctgtgttgtcgccgtctagccagcgaagtgctgtccctcgtccgcagctgctgtctacagagttgtgtcggcggtcttcccctttccagcgccagggttcatttcatagattgccaaaaacccaatatactgcatttttttacacgcggcacacagtgaaagctctttcgccttcagctcatcgcgcttgcacccttcgattgtcagggtcggggcgagcgtctagggcgcaaaacccggaacatcgacgcccgggtgtgtttcgggttcgattcgggatcggattcgggtagttagctggtgggccctgttgacgctagatgccgggaggcatacggttttgttacacagcttgaaaggaacaagcacacgagcatcccccttctcgctgtagggacctggagtgtcttgcaccgtggtggcattgggcgtgtcgctccctgtatcgtttttccccatcttgctggatgaccctgctccagaagggcggtcgattccaggttcagttcaatcaaggcactcgacgactgcttggcccttttgggtcgccaatccacggctgcgaagtgtgttggtgccaaatctctctttaattccctcttctttcgcattgagcgcagcttcagggaagcactgtctaccgggcaacgagaaataaatagtgagacagagtggagggtttgcgttggatgtctagctcgccgtaggccgagggagtgacatgtttcgcttttcctctccatgactgtctcggaagaaggtttttctgatgccgtcgcagcttgccaactagccaaccattaaagtctcgagttcttgtccccggcatccaggaaa

SEQ ID NO: 1963 - DNA, 2143 bp, Toxoplasma gondii
aagagaaggatgaagggcttgcctactacagaactctagctatgttacactcgtcgagcaaacgcgacgtgccgccttgcgagtttgaaatagtgaaacctttggctagcagctaccgcagaaagcgaggcttcagttttcccactgttatatcgcaaatgatattttgtagcaatcgtactctgtctaaatttccccctcaaagtgtaatcgatgctttgcttaacggttttttcggcgtctttagccatcatggccagcagagcattcgcagctggtgaagcagcagtacctcttgcacagaccggaaatttcagtgccattgcagatggcggagcagtgccaccaccgctctatcatatgccgatgtactcaatgccattgcaattctctgacctagagtctagggcaccgttacccactacatcaacaaatatcccggacgtaggccgtgcttctcaacctggcggtgcatcacttgagatgttgcgacagtcgtcttctgactatttacacgctgccccaactaatgaccagcagcccaggaactccatatctccggtaataattgacatgccagatgattttcccgtttatgacattcggaggccggagataaagcaaaaccaagcgcctatccaacgtaccaaacgcttcgagttaggggaaaatattccgattactttctccttagaacaggccaaactgcccccatcagctgacggcacgtcagcgcagaccaagcagcggttgcaagaagggagagatcagacgggatcacctcctggattccattcggcctccctgggggggccgcattcttcccaaatgcacggccgagcagaagcagcaaattcatcacagtctgctggactgtctttacgacattcatggctattctcttccactcgagaaaaactgtttgatgcagttgaatttatgaaaagcacagggggcgatctccaatacccagcacccgtggttgtgaacccgccaggctacttcgttgacaaacccttgcttcagcctgctcacagcattgggactcccgaaattcttcatcggaaacccgagcaagcttacccccccttcgttcctgcccgagaaacgcagttgtcaattcatggagaggggacccatctagtaccagatatccatgagcagctttccggatcagaaccagcagtgtctggcagcatggcggctcctcagcacaacgtatacgtacacggcaacagtctggccccatcgccacccatctgggacattcctctacccaacgcagatgcaccctccacctatacggctaacgtgccacaaggttacattgtggaaaaacctctcctgtctatccgaggagcgaatctagcgtttccgttggcggcaagggcgtaccagtttatggtcccacgtgcagagctatttattgcatcatcacgatacgcagaggagtatctggaccttgtcgcagctctgtactgcctattccaaaaatggccctgcaacaatgtggaggagtttgccgtgcagacacgactgcatcagcgcaatgcggcgacaagcagttcaccacaccctgaggaagcactccctagttagcgacaatatagtttttgcacccctctgtggtttgtcatgttgttttgaaagagactatctttctgcaagggatgcactgaacttgaagcaactatggtagtttgtacggaactttgaacttcccttatcagaagacagtacaatgcaaacgggtgcatgcggtctctacgccacaggtggcggcttaaaatggggtcaggtcagatttctattggccgacgtgcacccggttcaacatcagtatcggacaacccttgtgctactgtggatccgatggcgactggttgtttctgcctgcatgtttatctgtgcaaatgacactgtattttgtggacaaaacgaacagttgtatggtttctctagggcttgaaaaggtgtcaatcctttttcgccttcgcatgcacacgggtgctcccaatcccaggggcgtcggggtctgtgcgtccctcgcgtgactcgtctggtttccgcagcgaatatctctattgttaagaaagcatcagttttttgccggcgggcacagcagtaatcatttcggcttgta

SEQ ID NO: 1964 - DNA, 1369 bp, Toxoplasma gondii
aaaaggagagaaaaggagtgtcggtgaggcagagcgaagacggtgagacgaggcagacgtcgaagaagagcgcgagaaagatgggggtatttgaatttctcttttccgagttcgacgtacagtcttgcctgctccgttgtggccgacgatgacggtgagcggcttctcaaaagcaatcacctccaagtgatctggcgcaaagcagcgaatgccctgaacgccaaggcgttcgagggtcgccatgacttctggaaaagatgtttttttagcaaaagaggagaacccagttctggatggggcttggaaacgggagaaaacgtccagagtcaggacagacagcagaagagagaagacacagaggaaaaagagagaaggagaagaagagttggaagaagcgtcagaagcagaggaagaaggtgaggaagagagatgaagttcgcgtcacgctgtgagacggactcttcctctgaatagaagagagtctgtgaggagcgttgtcggtctgagcgttatttcttgaggaagcaagaagctgcatgcgccagaaaaacgaggatgctatcaaatgaatagaaagccaggaccactgattgatgtctatgctccgtctctctgcggtgtgtcacccttctggtcactcctcctctacaaagaaagcacagacgggagatggcccgcagaacgcctagaaatctctgtagagaaaagaagaggcgtcaaaagacatgtctctgatggaaagtaagacgtctctccgccgtcggcaggcgtcgccgacaagacacccaaaaaggggggcatgttggcgtggtggcggaagagcgacagaggcgagtcgacaacgacgctggccgctcgagctctttgtcgacgaaagaagagacccccttccccagagaactcgaggagaatcaaaaagtgaatgcgtcgaaagcgcccgagcaacgtgaaaagaaacgcaggaaggcgcttggcgtcactctccgacttcgcccttgagagtcggcgccagtcaggtgtacatacacctcacggagagtcggtctctcgcagcgccggagcaatggggccatacaacgcagcgcgatgggtgtttgcgggtcattgtgcaggagttcgcgttggcttttctagcttcttctcgaaagcctttcgtggaaattcattccatcttgcgcatgcagcagagacgcaggcgcatgcacacacacgcgcgcgacttgactcgtttcgcgggcctcagttgaggaacggagacacgcaggcgcaccgctgtctcgacagctgaacttttccccgagtgctgctctgacggtgagtcgaacttcctcttgtttctctcttctctggagcggattttccggggcaa

SEQ ID NO: 1965 - DNA, 1783 bp, Toxoplasma gondii
tatccacactctgcctgtcgcacgtgttggacattcggcgagaccacttcaggttctcggctggagccagttccacacgaaaatccatctttttcgtctccatcgtctctcagatcatatcgtttttacagctcattcaatgactttctggttgcgatcccagtgttttcaggggcaacactttacgtccgccaaagaagtaaacagggcgggctagagaagtgaccagctagcctggataggcaggtgacacttgtgtttgcatttgacaatcacgagtacttggcacagcggcaaccttgaaaagtttgattaacagcggttcaaggatgactctctcgttcatgattgcttcgtgccagaagaaagtgttaggagtggctgttctatgggttgcaaaaagtagtcaacggttgcgtaaacatgcctggccggtccggcaacggatacatgaacgggaaacgcatcatcagaattgaagaattttcttttggagagttggtatacgtcgccccactcagtttacaggaaacttcagcacgttcttttgcgggtttaaggctggctcagcaaaatacgaagcaaagtggacctacgtctctcggaggttcatctaaagcctgatttatgcggtgtccaggggttcccccagtagcacccccgaaactcgctagtccctatttgctagtacacagccgagaaagctagtggctgtagtcagcaaatataaaacggaaccatgcttccacgatgtctaaaaacaggtaactccacttatataaacatcaaatcgtgagaatagaagcacacaagaatacgaaagaggtggcgcagctttgtcaatccaagtccccaggcgagctagtgctcgcccaattgcgacgtgtgtacggaagcgccgaaacatggccctagacaaatgagtttggagagaagaaaaaactcagaatggcgttttttcgtcattgtcgattttcgagttgtaggggagtctttcgaacgaaaaactacccactgaaataggtaatttctgccaagccactgggtcatctacataacgacatgcatccggagaccttgacgctggtcaccgtggacacaccactgcttgcaaaagtctgtgatgtcggctgtacccatggacggagtcccggagcaaaaatgcctcgtgttcgctagtcgtaactgttttgccaggctcgacttctgtgcagtgtattttacttcgccaatagctggctggcggagcatgcacagccagcatgcacgcgtagtcctggatttttggggggttgcggcttctttgagttgcggtgttttctgaatctgcttttctgcgtgaaaaattcccaagcaacaacatttcatgccctctggaccccgaaaagttgcctgctgcatgacagatggacgggcccttggtgaagcgggcgcgctatcacgggacgcatgctcatccagtgaggcaatcttttcagaaaatcgaggtagtgaacagtattgttcgcttgaactagtagtgttgagtgaggcgtcagactcaacgttttagtgtgtttcgctgttgtgcatcagcaactgctattttgtgagctgtatgctacgggtaatctagcgtggtttctgctgttctactaaaatcagagttgtaatccttttcactatactggagtcaatacgtgtagatttatcacattgttaccctcctaccgtccctagtcctgtgcggacccggcgcctctccctgtagcaaacatatttttccgatgttttttggcaggaa

SEQ ID NO: 1966 - DNA, 2069 bp, Toxoplasma gondii
tgctgtgtcactgctcgttcagcgtcctactgtctgctgtttcttgttcgcctttttccaccacatggttttgcttagtccagtcgggtggtggaggagtctagcaatccaacgaactcggctgtctgtatcttgtagctgctgtcatatccagacttctctcagagtgtctcgctcttctcgctgtctctctgactgctgtcaccgcgttcgaatgtagaatgctcacatgttaccatgaagcagcaccacttttccagagcagtcgctggttgacaagtcgcgtctaccccataagctacacacacactccctaatatatatatatatatatatatatatatatatacatatgaagtaacgaaagtacttctgtgtatgtggacctctcctggagttgctggttgaccaggctcagcgacagtcgtcagcactctcttttcggggatagcacgtggatactgccacgaggttctctatcttgagtctttcgacgcaagctgtgaaactctgggtaaacgcagaggtacactatggaagatcttctagtacaatagtgaggtctttagaggtaccaccttagatggatctacgccagcgagctttcgggtgcatactgaaagtggaaagccgtgctgcagatgttcattaagtgaaaggcgccacgggaggaagtttggaagtgcagttttctttcgaattgcccctgaggcagtagactacgctcagacaaattggctcagatgtgattaacaccgggaatgttttgactgaatgctccgtctatatggactgcattcggacagaagcaatctgacgtgtaaagtagaactcttgaacgccggcaagcatctgggatgtagctgttgaagctacggcccttcgccatcccagacggttcgtatctctctgtgtcgacagaaaacataagcagaaattaccttttacatcgtgcatccggtagacaaacagagtgcagatcacttcaattttgcccagtgggtaaagacgaatttgggttgccacgcggacgcgaaaaaatccacggctcgcagtggtcaatcggtgatgcctgctgcacttccccttctcgacttcacgtttttgagtcaggctcttcgaacagtgaacacctaccagtgaccaacatgctttctcaactcgaaaaaggacagtgtgtgcatcacgtgcgtttcgcttcggagcgttctgcagtatcgaagccgcggatctacagtatggtccataccgctgcccgacgcatctttgttcgcagattttttcccgcacaggtagtttagagtttgcgacagtttcaaaggtacctggatttcctgcgcagttctctccgctaagtattgcggtggtggggcattcgctcgagctttcccctcgcagctcctccaaaatcggcctacaaagaaaaaccccagattgccctagttctctttgttatcataatacatggtgtgcagttggttataattccccaactgtcgtcttaactatgctgtgcggacgcagtagaacttggatccggtaaacgaaaacctcggtaagacacacggacggggacgccaatcacccctcgctgtcgcaccagcttggtacggctgttcctcagctgccaccgatcgctcttctcgacacctacttgcgggtgattgtcattcctttgtgtggtttgtttgtctcctgtgttgacgcgaacagcgtttccagtgatttgagagctttgccgggggacgaggacttccagtcgccgtacccttcattttcaggtactgaactccgttctgcgaattgcaagcttgcgcgaaacgtacctcgcaatccagcggcatccccgatgaaacagatacctgtttcaaccctctccgcttaaaacgaagaaaaagcgctccagagagttttgaaaccgcgctctgacgcagcgtttgtgtccgttgaacgtacatagctttccgtatctcccgcttgtgtgtccggtgaggacccccctgcagaccatttaccaggaacagctggatttagtcgcgttttagcatttgtaccccagcatacagcca

SEQ ID NO: 1967 - DNA, 2164 bp, Toxoplasma gondii
accaacgtctgaggtttctacacgagtttcaagtctgcgtcgatcggcgcaagcgcccttcgcacccaggcacaagatgcagccggctgctgcattcgcagtgtctgaacagtcactggaaaaccaatgttgcctgtcccgggccggtcggagcaacatcccagcgtggttgcggcgactagaaacacagaaaaagcacactggtggaagtcaggagttccctttgaaggcagaggaagagtcaactcgacttacaggcgaaagcgggggtgcagatgaacccgcttgtgcgtgagacggacaatccgagggatccatctttccagacctcatgtaggcgcgcacaacagctgcgaccaatccctcttcgatggaggcgtggagactctgagagcagaaaaagggggaacaagagcgagacgcttggaacgcgtggatcgcgtccgccagtgcgcttctccaccctctactgcctcaccgctccacaagagtcccctataaacacacgcgaactgcgctgacacaaggcagaacatggcatgcccgggaaccccgccggtgtctctgcctttgcaggtttccttccccttcccttactttgatcgttgagcgaagcgccgctgtttcttcttctggagcgtctgagccttcgccagtgtcggcagagagcacgacctttcgttccgttcgtcgcgagtcgagctccagaatcggctccgcagcctcaagaggaaactctgccgtcaggactccctcttgagttccgtcagaaacggttacttccagactgtggccaacgacggtgcacttcacctgcacaagagcgtccggcttcttccctgtctgcgtttccagcgtcgtgtgcgggcgggcgtacaggatagtgactgtgaagaaagagcggttcgtttcttccggaggaaagtctgccgggtcataaacgacgcgggcgacgcggccgtccggcagacggacaaactctcccgacggcgtgctaagttcagaacagcgtttttgggaagacctgcagctctgctcggcgcgggcggcgctcttcaccggaaggaaaccgcgatcaaggaacgcagagtggacggcgagggtcagcgcctctgcagcgtctcggaaaggagtagacttcagcagcagcaaagactggaaagtgttcgtttcgctgtctacccgggaaaggtcactctgcgagactggcgaaaccggctggtgatccggaccattcatctcagcgcaaaccaccgagacgccttgctcgaaaaagctagcacggaagctgcgtgtgcacagaaacaggagaaacgcgacaaagaacttgacgtgaagtgaaaagtgactcgaggtgctaacggccatgacatcctcaaaccaaaaccacgaactctcaacggctttttcgccgctgcatcgacgagcgctgccggaatgcgaaaagccggctcaactcgagaaaaggtggactttcgtgtgactcggagaacagcggtggagtccagttgaaagcgagtgcagcgatggaagataaaacattgcggagatccttcgagctcaagtttcgagaaaaagtcgccttcttctccatcaacattgtgtctagcatgtcaagaaggcggcgaaactcggaattgcagggtcgagaaaccagctgtgtatcgaccagtgccgactggacatgcacgctgtcaaagcacagagaagcgtcaagccattaacaaattccagttgcgaaaacaatgtctgtttcctacagacagcggtctcttgagcagcggcgctgcccatttgccaccacttgcgggagttctgtcacccagagacgactggagggaacaaatgtttggtgtgcttggttgagactgcatgttgccggttctggtccaaagatacttctcaaaatttggaggctccaaaacttcttggcaaaaggttttatttccgcggtctgagcagttgtccaaaaagtgcgttttttgcagtaaccatcttctcgttagtttcccttgaattgcgccagcaactcagcggtgtctgcctcaaagattgtccactggcgctcgtctgcgtcgtgtggatctcttcagcatccgtccgtgtttctcttctgccgtggagaccaaatagtggattctaaggttcggataataaaaggcca

SEQ ID NO: 1968 - DNA, 1911 bp, Toxoplasma gondii
ccatgaaaacgcgtagtggtcgacaagtgaagctcaatcatgcacgtttccctggtctccggacttccggggagctggtgcccgcatgaaaactcgttctttttggtggaagtaaggggaaacagcagtacttgcaccgactttttccgacgcatacatcttcagtaccgcttccacggactagtcctgcagctccgagaagtgttgtcgatccctggaaccctctgtgtgcatgttggcatctgtgttgttggaaaacgataaagtatgactttttcggatctggccacttgctgttcggcccgtgcacgcccagacttcgttgatattggtggctgtcgggcatcttcagtcaagttctttgagaatgagagcgcatcgcgatgctcgctataccgacaaagaatgtctactttgcacccctcgactgttacgtggtggcgtgggacacggaatcacgcgtcgcgaactccatttgggagttcgctggggtggttgcccagaaaagagctgcgctgggattgataaaaaagcgtgggttccctaaaacggcgtggcaggattaatcgctttgacaccgggtcttccctcacaccgatatcgctctgtcaacctacgctaatcaatggttttctctgtaagccgccgtgccaacgcaccataaagaaacgaaaacttacaccagacaaaccactttgctctgtctcccctcgaagggaaactttttcgcaagaatctctgctacagttccactgaaactgcagccttgactgctttgcctcaatcccacataaaccgccagctgcttcccgaggcacccactgtagccagatacgtatagtgaactcttctggtttgaccctaagtacggactgagtcaaatagatacaaggaacttgacacgccttagcagatctacataaacgacacaagggtatcgcgcttttagatcaatcgtacagaatatcaaacctagtggtgcgaattccttgcagcgcctgttgctgcaagctcgaattacaacgatgcattttcagattcctgtgtttctgagcggaaagaatgtgcatggcagcagttgtgaatttctattacactgtatagcgcatcgactgtatataccaatcccccgtaagacgaggaatctacaacgcataccagcagagacccaggcaccgcatgcagcatttgtgttcacgtattgcaaagaggaagaaacaacacggaatcaagacgatgtttggaaaatgagtgaccctctgtgtcccttcactgtcaacctggcatacgaaagttgtcaagtgctgctcatgtgagctcgaaatttccttgcctttggggagaaaacccccttccgaaactatcttctgtcaaaaaccccaaacaactgaggcgtcaagtcttctttcctttattgctgcgcgctccgtgtctcctgctttcgagggtctgtctccggtcccgtcttctcttttatccttgcaaagtaccaacgcttgcatgcacacaccgtgtacgcgaacgtcaaacacagagaaaagcatgtgtcgcttgtccctgctggaagactacgaactcgattctctgacactttcgcatcgtttcaccatcaatccttctcgaacttgagctggcgtcgtttgcttgccattcccacgctgcgtgcggcctttttcacggcagaggggacgacgaacctggttagtggtgcttgtggcaattcgcgccttctgttccggaggaatcttcgtcgaggaagagcctaacacgagaagagagactttctccccatttgctttctctcgtgggtgaaaggaattccgtttcgttcgtctgcaggcctcgtattttaggagcgacaaggcgttcccctccggctctgtcccctcgcgaacagtgaagaaccaacaa

SEQ ID NO: 1969 - DNA, 1943 bp, Toxoplasma gondii
gacaaagcgggatattgccaggaaacgatgggtacgtgcacggtgtgacggccgccagttcagagcccacttttctctgcatgttcagggcaaaaatgcgtttttttgttccggacgagacatgcgtggaatcaactgtcgaggcgatgccttcatgtccaccgtctctagatttcaaatccagatgtcgtaatccggtcgctctcgcgcttaccgaggtatcgtcacgtccattccggggtcacatcgccgaaaagagccggacaggccggtcccgcttgtctatgttcctgctccgacttcgacaaacttgaattcgtcttcggaacgagaccggggggacttttctcactaaactcaccgagccaaaaagtcgtcttcgaaccccaacacgagtgttcgagtggacgagagcttgacgagctatttttgaaatggccacacgttaaaacctatgtcgagtgtttcttggaactgtggatggaaaagcagcgcatatggaacggacgtgacacgtgattggcttgaacaaggtcctaatggggaaaaactttgaaaaaaaaacatggagtgccttcccaccgtacacataaaaaggccaccgaaacgcgagacgcgcctgtgtattctgacaagcggaacgaacacagcttcgacgggctagactcgactggtgaggcagcgcaaacgaatgtgctacggaaagaactttgacagacgtttcgaagcgaaaaggcgaatctggaagacgggaaaggaatgcagcgtccctgctgcacacgccgagagtagtttagtgggctgcagggttccttctgacacgacttgagagagtgcgaaacagtagcactccgagtgatgctctctgagtccaaacggagagtggagaacaaatcgattggcgaactccaggtgaaacacacctgttgtcctccgcacgattgccgattgaatgatgcagcgctttgccgaatgctgccggaaccgtttgcaccacagacataccgagaagcagcatgccgttttgaatggtcaagatcttttcctctgcggagggaaccgctgcttagggaccattgacgcgtacgttggcgggtctcctttttctgcggcagactcaagtgaccatgcacgctttgaaaacgcatgcagcagcgtatacttgcagcacgaaaagcctgtcgctgggttcggggtgcccattctccgaagcaaacacatcttttccgtcgcttcgttttccctcttgaaagaacattcgcaaaaatcggtaaaatggtggctacttcaagggtgcttcttgcctgaattcggtctgcgtgcgagtcaaccaccctcagcctcgcatatatggggctggggtgaactgtctgaaccgggatgtagcgcaaaacggactcttcgccatctggaattgggagagtgcggcacggcgtctgttttctgggacgtgccgttgctattcgcttctctcaagtgtatcagccgcttttatttaccttcgacaacgacctggcagaaacagccaggagtgtgcatactgaatgtcgcccgtcggcgcccgtgactccccctgtgtttcccggctccaatctgtgtgagtttttaattcaagaacatccgcagaagttctgccttgggcattgaagcttactgacagttcaacccagcatcattcaagttagtcaactaggattaagaacgtttgagtatttcccatacatcccaggcgtaaagacttcgatgttctgtgccaactcgtgtaaagttgttttcgttctttctgaccagctgagtagaagagcggcgccaagttttttgccggaagacctgttgcatgccgcatagttggaggtaaagggcatgcgcgaggctccgacgcgcgttcgagcaccttgtttcactgacactcagccaaggcgagacacaggcgacagctacca

SEQ ID NO: 1970 - DNA, 4153 bp, Toxoplasma gondii
cctgtgtgtttgcctttttatgcggtgttactttgtgcagacaatggggcattccgaccttccagccgtcgtcctggactctcgtggactggaatggcctcgtcggcactgactacccctgcggggtcggggcgctgcggaacgttgtcatcggtaagttggagcttctgtttgaggattacggaaggctcctttcacagaatgtttacaattgatgtatggcggcgggctctctcgtctcgttctgcgaaggcggggggcgttcacgcgtcgagtcgcgtagccgtttgcgcgtgagggcgagggtacgtacaccaggagataaagacgcgagcgcaaatccagctgtcgcgacggacatggacagcgagtcggttttgtgttaacagatgcgtccaaatgttgaagaatggtgtctgtctgtgtgatcagtatgggtgaatttggatagcgacacaccacacacgttctgcgtccgtgtttctgcctgcttcttgctgcagtcgagaaagatgaggacatgcctaagggacagaaagcagtctacgaataacttgcgccgatggagggaggagcacgctagggagaagactggagacaagcgatttggcggatgccagaaatggtagaacagagaacggtgaaagggaacctacagcaagaacttctccggaaccggagagacgctgggcatgtctactgcgagcgcgtgtcgccgttcggagctggacgtccaccgttctttctggttccacgtcttattttgcttgacaactgccgtggaaatacagtacatgtttcattttgttgctgttcgcctttgatgacgacgaaaaaagaacccaaattcgccggcagagtccgtatttcgaatggcgagaatggtgaagcaggcaaggtggggaacgtgtcttacggcggaaatgcctgtgcacgagcgaatggggtgtgttaaggctttctgactggaccattcggtagagtcctcacatggctgaaacagacagaaaagaagaccggattcttaacaactgggaaagactgctatttctgtactcacaccgttagtgaattgcagaccacccgggcaaagcgcatgcgtgtcacgtcgcatcccggcgtctgcggcagttgtttttcagccgaaaacaactccatgacggaggtttccctgctacccaaatctacatacttcggggagacgcagactccataaaaagaatacagatatgcgttaactcgggcacatctgaataattcatctgccaaaaagttgcagaattatttgccgacgaaatcgtgtactgcactcactataggtacacatgtaaagatagctgagtatcgttctatctacacaattcgaggatcagttggagctaactgttttccagatcttgccaatgcacatcgatgacggtgaatggtatgcgacactctcgggggggctgtcggttgcccgaccgaactggatttctaaacatcgaaagatttccttaactggatataacgtgcaaatgcggtggggacagaacacgcttggcatcgtgtggtacgtccccagatatcctttgcgcgggaggcgacaccaggactcgggtgactcaagaactttcgtaccacgttgcgtgaacccaggattctagacttcttcctctgttatgcagcatatcgagattctggaatgtggaatgtgtagctcaggaaagcgtagcgttttgaggtgggctgtgttgcgatcatcaagcgagaaacgtactgatgctgaactttgtcggttcaacgtcactcctttgtagctcagacaatgccggtaggaaacaatgaaggtgacgctcatcggcatcttcaaacgacagcacgaatagccgccgacaactcacagagcaggcgagcactggtataccttaaaaggatcgaataaagtgcttatcaaccctagtgctaaatgctacaagtcgtttctttcacgctggagccctccaaatcaacctctcgtttgcctcgttcaacgacacgccagttgagcgcgatcgctggtcgtagaagtaatgcaggagaaagaggagtttggggatataccacccgtgttggtcgagtgatgcttgagaagcttgagttgtgggatattctacgatatacagtcggccagggtcttccactcagcctgcactgtagctgagcaacaccggtacgcacctagaacacccgagagaaagcaactgatcctgaagagccacgcgttcgtacgaaaaggacttattttgacaggctgagtaagcccgcggtaaagcctcagtttggaagcagcggaattcaagaaacaggactcgcctcacacgagaagcggtgcctgtctgcaccctttctccagacttgacagcattttttcgtattaaatgaacagaggcgtgacgtattcgatctggaatattcgtctgagggaaattacgcatcgcagacgccatgaaacaactatcgcgcagcctttcatcagatggtttcactgagcatgctgtgagaccgggctgacaggtcctatagctcagttggttagagcatccggctaataaccggaaggtcgccggttcgaccccggttgggaccactcttttgtttccgaaccatctctttctaggcattgagccatgtagtacctgtctgtgtctttttgtttttcctctatttctgcatatacaaatgcctctcgcttttgcatctccgtgacggactagtggcatcagtcctatgcagtcctcccatgcatccgcctgttcgcgtgactgaaattccttccggtgcgctgttgcatcgcagtgattctcgtatttcagacgaacttcaaggtgctcgctatacaactcgcgcatccgcgattttagtgtgatgagcagctccctgacggccatctccaaaagtacacttccgacaagttggtagccgggtcctagatattaatttactcaatttaccgtgcttcgaggcactagttagttattcctgtcttgtgtgagacatggttccgatcggtgcgcgtcgtccacgagacgagacacggaggtctggctttgtggctgtcaaccaggcctacccacagcgtcagcgcgaatcttccggtcatctgccccttgacaactatgtcaacgagtgacaaatctctagatgtaggtcctcgcgtgctactgtgaccggaaaacacatagcccacagcggcaagtttgtaagaaagaattgctgttcgccaagtctgcctttcttgacggcagacagccaagttctgaggaacggcgcagcacttggcgatccgtgtggcttaacagattcagctgtgagaaacagcgtccggcgttttcctcattttgaccgataaatgactgtggttctgcggtcttgaaggcgccgttttctgtcgactccctccgttttttcaatcgggaacgatgcggtaccccacaggaggtcactcgtttcttgccgtcagcgcgaccgccaggcctgttgcccatgaagaaattagtgccgatcgtgtgagacctggatacagataagaatgggacacgcaaggcagagcgtctgtttgcgtagtgacatgctacttgcgtagcacgctaataaacataacgagtggcgctaccccttgacaggatagtgcggtgtgaccattggttcgctgggcgaatttccggcaaacaaccacatcgcctgacgcgccagttgacgtcgacgtttgagctgtgggttcaactgttgcctttataagttatgcagttactgcgttggacagaccaagccaccgcgcctgttatttgagtccatggcactggcagcctcgtggacgtggcgtgctacatatccacgagttccgttcgctgacgcgaaagacaagacatgcgctacttatcttgccagtcaactgctatatttgttggcggcgtatgtgccagctcacgcactatctccgctgtcgcttcaggcggactggctttgctgcttcaagagaaagcacgtctgctggatcctctcacgtctttgcagagcggcggggagtggtgcgtgcttgcgccggcagtgtaatgccactcgcctttcggttattctcctgtctcggcgtgttgactatcctttacgatacgaatagccggtccacgacgta

SEQ ID NO: 1971 - DNA, 1295 bp, Toxoplasma gondii
gatccagcagacgaagatggcgtcggtctcaacaacagaggaccgcgcagtggaccgtcggagaacgacgaagcagaggggagcagaggggagaagaggggagaagaggagagaagaggggagaagaggagagaagaggggagaagaggagagaagaggggagaagaggagagaagagggcgaggcgactttgaagagcctcgagtagcaagaaaaacggccgcgtcgcacgcatcactcgccgctcccgagcgccagagggaggctgctgcgcagcgcaaagagcgaaccattcgcttcaaaagaaaaaacagtctctcgctgtttggaaagacagaactcacaggacgaagtgccaagtcagtgtgtcgttcatatccggctgtaactgcgcatgcggcacgccgccctgcctctgcaaaagcgaaaactcgcgcgcaaggcggccgggaccgaggaaggcgcctcggcctcctcccttgtcgcgggacatcgaacagacgcttggagaaacgcagcaaccgagaggagcggagaagaatgcgcgaacaggtcgacagagagcgaagcgggggaacagagaggagaacgcacgaaggaaagaagaagacgtggagacgaagcgaagcggagacaagggagacaacgagagagcagagcacaggggttgcctctgaaagacttgaagcgactgagaggtagctgggcgagcagccactgtcgacaaggagagcagaggcgacgggagctacgaggaagaacaagacgaagacgcggtcagaagagactggtgtctcgcggcaatgctcgatggaggagaagcagcgtgacggaactgctgtgagttacggaaatcgagttctttccgctgcgtcaagcagtccatcgggatggccttttgaacagcagttgccctttctttccttcgcgcgctcgggacatgcagaaggttcgacagtgagtggggggcgggagagaggatccgcagagtgacacccgaagaagtcacgcgagacgccgcaggtccggaagtcgccgagacgagtgcgaaaccagcgggccgtgcagctcgcgcgacggaagcgacggagggaagggggaaaagaggagcagaaaaggaggagtggaacgggaggcgtcttcgccgctactgtgttctctgcggggcctcgcgctgtggtgttccgctcgaaaggacaacagagagtgaacatcccgcgagagagggctggagagagtgtgcggcacagacagtgtctgtttttcgcggaaagccgacagaagagacgcgagga

SEQ ID NO: 1972 - DNA, 891 bp, Toxoplasma gondii
gtcgaccaccttgttgttgccaagatggacggcactgccaatgaaacgcctctggaggaattcagctggtccagcttccccagcatcttcttcgtgaaggctggcgagaagacccccatgaagttcgagggctccagaaccgtcgaaggcttgactgagttcgtcaacaagcacggttccaagccgctcaagaaggacgacaagggtgaagaactgtaaattgttgatcgtatcagtctgttccgtttcatgtgttcgtaacaatgttcgtacatgagcggttgaaacacggaagccctgtttggctcatgtttccgtcaatataacccgacagtaaattgttctggcaaactttcgatacatgcatgtcatcggttacgccggtgccgccaaggcaaacgcgaagttgtaaatacggacaccgaagcttaccgttcgtcacttcactgtaccgctcaatcttatcacaagtaaccggtattgctctcggcacgctggtgagaagaccgcggcgccatgaagttgcaggttgtgtggcgtcgtgtttctgctgcgtcagtagatccgatcagtacaaaacagccgaaaattggattaattcttcaggatatcgacgaggatgttggggctgcacggttctcagaacttcagtgtatatacaggtcgtcgccctgtagcaacacatcaatgggacctgcaggcatgcaggtgtttggtttctgtggtatcatggaagtcaatcagccgggctagtaaaggttgaggaacggcaaaaattaaaggctgtcatggaacaacaccgggaaacagttgagcgagtcataggtgtgatgttggagaaatgtctcgagtggcggctactgaagcttcgtcgcgggacgacacaggata

SEQ ID NO: 1973 - DNA, 3273 bp, Toxoplasma gondii
ctttcggatcggaaagcgccacaagcaatctttttgaaactggagacaccgtgacgctccgcagggttgaagcggttcggcagagctcttcagaaatgcgggggagagaatctatacggccctttgcaacagagaaaaacgtcagggcgttttcgggcagaagcgaacctgcaggctgttcgtccagccaccagacgccgagagcaaagagagcgaggcgcgccgggggggcaaggagagagagggagaggcgccagtgaaggctcggaaagagcgagaagacgaggagaagctgctggagaagaatcgcccagagcgcagcgacaagcagcagcagcagtcgcagggtcaccaacagactcgagaaggcgagagaacagacagacgcgccggcggagagaagacgagagacgaccgaggctggcggcggcgacagctgagccttcatatacgcgacagggacgaagggatgaactccagtgctttcgtcgccgaagacgcggtacttttccatgttggaagtcggcgaggacgcgagggacgacaggaacgcttgtgcgagaagactgcagaacagttcgcttctccacggcgagagaagacgactctcacaaagatgcagagagaacgaaggatcacgagaggagagaggaaggtgcaagactaatgacagagatagacgagaaaggatggaaatccgacgtttcagggatcgaggagaacaggaacaaccgacgtttcagggatcgaggagaacaggaacaaccgacgtttcagggatcgaggagaacaggaacaaccgacgtttcagggatcgaggagaacaggaacaacgagatgatgcgcggttctggaggagagagccgcgaaaagctgcacccgaggatcttgagaagcagaaagactgaaggaggaagagaaaccagggcaagtgaggagaaaaaaaggaaagaaactcgaaaagaggcggacgcctgaaactctctcgaggcgacagaccggcgcaggaacgcccaagacgacgagacacagcgcggcgctgtgcgatcccgatagaacgaggaaccttgattagttttgagtcctcttactttctgcaatacatggacgaaacgaacatgaaacggctcgttttctgtcagcaaaaaaaagaatttgcggaggggaccgccactccgagcctgacggtgctgcagcgccggtggacctacacctcgccggttctgcagttgcacagctgggtgagactgatttctgcggcggttctcggacattgagagagacggttttcgatctaaggcggaagcagaaagcatggactgacaggctgaggcgagaatggggcggccgtttctccttcctgcatgcgtatagatacatacacacaggccggagctggttgagggcgccggtttttgggatcggtgtgtgtcgaacgcgacgcgtccttcacattttcttcgccggagatctgtcgacgtggaggctttggactttgcggaagtcctctgcccgcgagagaaaaaacgtcgagtttcaagcgagacacacacacacatatatgtacagctgcgctccgccgctctccgcagcgcagtcaaccggcagttggctggcggttcagattcgctgcgtttttgtcccttttccatgaaaacggacgcctcgacgggaaaatgcgttttctacgacacagttcagctcgcctgtgcgcgcctctcccgcctggctcgcttcactgcgaacgtccgagcctggctgcaccggaggaaccggaagcaaaagtgactgcgagaccctcgggaggcggtgtgcgtccagacagcgcggccgcctgcggtttttgcgctcgtccggtttctcgcgttttcgtatgtcgactacagcgctttttcgcagcaatcttggagcgggttctctgttctcgtcggccaacgcgtagtcaggcggtcagataaagcaccgaaactgcactttggggggtacttctcgcgcgagcagcagagtttccagctccgctccgcgggtgtcgtcgcttgagccgccgcctctctctcatccctcccccgcggcgttttctgcgtcttctttcgagcctttccgcaggagggaaccagagaggacgttctccgcgtttcctgctgcagggcaggttccgacgcttctcggaattgcttgctgcgcgcttcgaacgttcgaggtggaaggttcgcctcttcgttttccagagtttccgacctgctgagaacggactgttcgccggcctccagcagcgagcagcacctgggagagaagggaggcttttctctgcggcgcgatgggtcttgccgttcccctccctcgctttcctcgcttttcgaaggattgagaactgacctcactctccgactatttcttgtttttctcctgtcgctcggcagccacagcaccccgtttgaatcgaagaaacatgtccaaagtctcctcccgcggcttcgcttctcgtgtgtctgccgacttgtcgctggagaggacctcaggggcgcgcatgcttcgctctttctcctcggctgtctctgcgtttctttctatttctctgcgtttctttccgtttctctgctttttctcccgttcatgtcctcccattcgcgttctgctccgtttttccgccttccattccttcttgcgtccagttgctttcctccactccttcccactctctctcggctcggtgcggctggccggggcgtttccggaaagtcgacaaagcagtctttttgtctggggaagttccagacggatcggttgacacgagaagaagcgttggggaatggtcagcgccgacgcgctgttctgcgagagaaaagtcccgcgcttctcccgagaaaagcggccttccttcctgttccaagccttcaaaaagcaccctctcctccgtcgtctgtacaccccagccgctggagacgatcacgacctcgcagctgcatcgtcctggagaagcgacagacttgtcctttgtaaggaagaacgaacgcgcgaattcttgtcagaagctgcactgtttccggctcttcgtctctccgattcgcgctcctctcaagtttttctcggcttctctccagttctcatgttcaacatcttcccgcagtcttgctcgcttgctctcgctttctcacgctcctccgtaggtctggtcgccggcagttctctgtgtccgccgttcgtttgggtcttccctcgctgcttcgctgctcttcctctcccgacgagctgcagaaacgacgacgccgacaa

SEQ ID NO: 1974 - DNA, 3776 bp, Toxoplasma gondii
tgtaacacttcggccttcaagtgttgtcaggcacttatctcagtacacccaggctggatgctgttgtgtgagtacatcgtgttcgccggagttgaacgggttttgtcaccaactgtaaagaaacgcagtagctcgagacccatttgaacggaagcaagaaaatgcatctgatttagaagaacgctctatcctcatgctaaggggacctttggtatcggtcaagacgcacagatgcaactgtagatccctatggagtgcaggagatctgcaagtgcttcagtttcagtcctaccggtgctgaaacgctagtactttaccttgggtcggattgactgccagtcacccacagatttgtcataacaagactcagaaagctgagaaaatgccacaatagaatcacatagagaatccgtatgttttggaatggcttcctcggaagcggagatgcactggctgctccgtttgaagcctgaacgttgaagggacaaattgacgccaaatacctatcttcttggtctgcatcgttacagtcctgtcttggtagaggggtgaatttgcctttttcactggtgtcagttcaatgtcatttcgttgtccgctcagacacgaacgactaccaggtacatccattctcacggaagtgcagcgctcttagtacacaaatctgactgtaaagtgtgttctgtgtacaagcattcgctttactagagatgccagctggttccaagcgtggcgttcgtagtattgattacaggaagcaaacgttcggggccttgctttggacgattttttgcttgacacttgaaagccgtcgaagttggctcccagttcctcaagaaaaattgcacctttccttgttattacagatgactccatctggaacaagctccgcttgtggcaaggtcgagccggttaccggggttcgcctggacagacacctgagctgccatcagattttgccaaaggatttccgaatgacgcagctgactcactacagaatacgcaccaaagaactttgcgggagattcgcgaagaaaaaaccaacaggtctgacgtgaaaaccttcgtgtgacgtacgaaaggaaaaaatgggacggaccaaagcaacaagggaacgagcaaaatgtgcaagtgactccgacagctctgagtgttctgctcccgcagcggaattcgtcaaagggaaagcggtcacaacgcggaaaaaaggacgactctctgagggagcagtatacacagtggaggaggtgttccttccgtcagtgtcacgcgagtcgctgttaacgtaagcgtcacctgtgcgctttacgaatagtctctgaggaactgtgttgtcaaatgatcaggttgaatccgtacagcgaaattgatattctctaccgacaaatggcgagcaacttggaaaaggttggactgaaccttgcgttcgattccctgggaacgtcatgactgggtgacaggcgatagacagagcacacagggcaggaataccgaagaaagcagctgtagacttcgctgaggtggaacatgtggcgacggtgggcactgacgattgttggtcatcgactagacataccgaaaacgactttcgttcaggcagccagggagcggctgaggtcgaaacgggacaacgtcgcaatgcagttcactgaggctggtaagagattgaccaggaaaattagatggcgtactgtttcaccgacggatcatccaacaggccagcaaatgcgtgtcctcaagtccaagctcaacaaactggctcaacgtatcgctgaagcagtgagtgcggaagtcagaaggcgtttgtgtctactctggttccacttgttcgcatcaggaggaggagaacccgaaagccattgctcgtgtctcagccgatattgaaacagaagtcgaagcaaccttccaacaaatgagacacaaaaaggaaaagaagtgtcctccaggcgcaagagctgctaatacggttcgtatggagaagcggcccaacgaagtgccgaaaggcaagcgctaccgttccgtgccagttgaccacatcggggacatccgtgggtccgtggctttcaagtgaccgttttgctgccaccggtgaattaccgtaatctaaggctttgctgcgcttgtccctatttggacatgatttagctgcgaaccgacgttttcgtgttgtcttgcagatcatcccaatcggttttggcagtgaagatgagatctctggtcattcgccgtttgcggcgactggacaaatcgaggctgttggttgttggcagctattcctttggctaagaaaagtcatggcagactctggaggcataccaacatgagttccactcgatgtgtgctacactagcctcctccgtactctcgtgcacttcatttcacagggctccaacatacgctaaattcaaagctaaacatcccctttctcagaaacacaattcccttctcgctgttagtgtagtcctgagtaccagaaaccgtgtaatcttgcggctgatgtgcggaggcattcgcgtatacgatgacgcttggtatttcatgagcttgcgtgaccgaacatgtgaaggtccaacgcataactggaccaaactcaggggctctctcaaataaacgtagggaaacgaaatttgaactttctataaaacctggagggccggacacacttgtccggtcatcgtgtaaggaactactcgcgcgctacttgcgacaattggacttgcattcatccttatccctacatgggagacacatttgctgcgacatgaacgagtctccatgacacttattccatcagaaaaatccaccctccttcactgagtggaatcccataatatggatcaagtcagacacggacacgtcagcacgtgattgagcaccggattttgcgcggcgcattcctggaacgagtgcgctgcgatctagaagagaaccggttgcggaactttctcttcccttataatcttctcagaaattgaaggcaccttttgagctattccgcgcgttttttttcgatcgacctacggactgacgaaactgaactagtcatgccgcgtccagcgatgcttgagccgctgtaaccgttcgtttgactcatcaagacagagttttctggcgtagcttaccgatccccttttgtaaccggtattggtacgagatcattttgcagaaatacaggactaggcgtcatcttgcgagtcggccgcaactgatactccacaacaggtgcttgctagttgacgtcggctacccgcctggcgttttcgcagctctcgctccgttgacaagctaacgttcgctacagcccctcaacgacaactgcggtctgtcgtcgctgttactcgaaaaccagcgttttctgtatgtgcattgatgaaaacgactctttatcaaggaacctgaccccagtaacactgtagatttctgtggccgcttctgtttccaagaaaggaagcagccccagctggttccgcatgtcttgcacccggatccgggtgtgatgagaggaagccattgtcttggcggcgagataaacgcagtggaaaagctggcacatctcgccttaccggaccccttttctccttgttttctgactcagttccgtccttggttgtgagaaagcctcatgagacttgctgaattccctgtaccggtcgctcggacaaaacacagaggaaacctggtgcgatgcagatgagactcgacggtcgcacccaggacggccacgtcctgcctttttctactcgccttcacagatctacgaaaacctcccgcagaca

SEQ ID NO: 1975 - DNA, 456 bp, Toxoplasma gondii
gttgctggacgactcgcaactgcctaggaactgatgcggaagaattccagtgtacacgcatactagacctgtcggctgcaattgggttcaaaaaaaaactgacgacgaattcgccgtgaatctccaatacattggcacaacactcgtcgaacaacaaaggggcttttttgcgcttgtggtttttctaagattgacagatgtaaagctgctgttactctcgcagatcccgcgaaaacgcttgcctttcggccgatgtgccttgtcttccagatcttggtcccgttatgccagcaaaccatctgtgtcagcagcacaggcgcacctccacaaatcctgttttttgagtaaagcaaggttcaggctttataggtcgcgctgcgcctttccattcacagcagtatcgatgtgattctatgtgtgttttcgtatccggatgagccttgttcgattcacaaa

SEQ ID NO: 1976 - DNA, 2250 bp, Toxoplasma gondii
gaagtttacttgcattgacttgtggcgtagtccttcgaaaccatatggacctttctaaatcaccggaacgcagagagctacggataagagaaacgcaggcatacacatttgcaaatgatagcgattaccgcttgcacgtagttttttggcaattttatcatccagctgcatattttctacttttgtctaaaaggggcaaaagcgcgctgagttgcaatatcgctacgtcctgttcggccagccggtagggtgccgagattggtagtttagcttccagaagtcagcaatgagccacccgagtcaatttttggttcattccacgtgcacgtgaattttaacgacacacgatcactactgggcgagaaacaggtgtttgctgccggtcttgttgccctgatgagctgttattgtaagctcctgttccgtagtgccaaacttaaaagtgcacttcttcttcagtgtaaaaatcctatgttcgagggagagcatcataaggattctgcaatcagactgtttcgaatgtcagttcattttccagtacaaattcaccgtaaaccgtcgcgtttaatctggattccaacggtccgcagctatttggttcccagtatacgacacctttcaagcgcacgctctcacatttgataaaacctatgcattgacctttgacacaaaacgtaatattggggcacataaactataagctgctgttcgcggatggaggtgttttttcgcgggatactattggttcagggaccgccctgctactttctggccggacgacctgatcaacgcagctaagttagaaagtgtcgtgctctggccactgaaaattgtcaacacacagtccgcaggctgcaaatactaacggtaacgccatcgaagtaaagttgcggtacatatgttcggtcttttctagcaactgcaaaaccctcagtggaaaggcactggcgcctgaaacgtagggagacgttccagtgcagcaggagatgctacgtcgatggagtagctgcgaccctgatgtatggttcatttaatatgtcgaataagacagtctgtccaagttccatatagggacaccgccgagcaacagccaacgtgtccgatgggcctcttctgcgcgagaccatgtagtgacgaaaccagaaattcggcgtatgccggagaacattgccgatatattcagcttcttgcatatcatcaacggtcatgtgttctccgtagctgagcattcacatctcgggaccagaactcattgtggtagtgtcaagactgcatgtgaccttcctgatcgacgagtgacttgcagacaaactctgcatgcgtgttgctacaaccaccaccagtccgggactcgtctgtgtcacttgcccaaaaaaactcaccaacattaccagttcttcactgagaacaaaaggatcttggccgcattcatggaattgatctgcgcgagtctataaatttaccctgtacagagggaaaaccatggtatgtcttgcatgttcacgggctaaagcggttagagggggcttcgaggcaagcggattgcatgtagcgggaaaaaaccactgacatgcctgactcagagccgtatagattctgttcaaccaaccactcgtttttttcggtttatactaactgtggcttgtgagatgtgtctccgtgaacagggttttcttcgcaccaccagtgccgggtcacccggtccctgcggtggcggtcacacccggggtcagctcatgtctttcatttctatttcttaccagcagcagctctcttgctgattgtctatactttcccctacattagtacagccgcagcttcgaatcggctttgaaagttttcttaagcttcatctttccgtttcgactagaaagcaatagtgttttcgaagacaggctgcatcaccggaacaatggaacattcaactgcccagtgacaccatttctatatttcgtttttactaggacaacttttcgcgccgtcagtttaccctccattcagcgttcctgaaccccgaatgcatgattcgttttcccgtggaggaccaatgagcccccggaactccttcgtagaatagtgtcaggtcggtcatacaagaggaatgacgtccgtcctcgtcacccattggggctgagggcatggcgtttcgacgagtacttctgtaaacatatctttgacatcatctgtcccgtctcgtttgatttgtggaccggcaggtccacgttcattttctatttctagtccacgaaa

SEQ ID NO: 1977 - DNA, 1642 bp, Toxoplasma gondii
ttctcgatgcagacaagttccactttcggattcgtttgctgcccatgcctgtctcaacaggcctggacgacagtggtggatctacacttgaactgatctccaagacaagtccggagtcgggcatcgcaggtgcatctaatttagcgctggcgtagctgtgccacaaccccgaaaaccagtcacgtcgttttctccctctcgcatcagaagtagggaggctaccatctggccaaatatctgcctcggtgtcatcccgcgtgcttcgcctgacggagcgacgtgaggcatcatcgtctgtctcagaatcagtcaccggtgcgggtgaaacgccagagggcgctgtctgtaccatcctctcagggggcgagtttccctcgtcgggatgcatcgatatcgaggggcccgactccgccccaccatctgcgactacgaatgggttcaccatggctatcttggcggcatctctcgatctctccctctgagtcattgtatgcgttttgttgaatacgaggaaaatgcgtaggcactgccagcgacctgtgaagcatggccttgtcgcggcgcgcaacagtggatgcaagaacctgtctagatgaaatcttgacggtctccctcaagcataagctagtggctcaccggtattgcacaaactgaaaaaataggttcaactgaactggcgacaatgggtgaagaaaaatggcagtcgcttgctaacgtgggaaaaatctttttcatcagcatacacgctgcacgcgctttgccaggcccgcaccccgcaaacggcgaaactaaccatctccgtggaaggcacgctcaaaacattgtgaagtggtaaataaaacacagcggaaagacaaaacgacagtaaatcttgctcatctagggtgcacaaagccacctggacgacggggaacatcgtcttgcgaacacaagtcacagtcgagtcttgaactggtcaaaatctgctgtccaaaaacgcttgtaacctgaaaagtgtgcgttaaccaattctagcaacagtcacaacacaactacatcgctggtttcaacacatatttttcactgccgccactacgagtgggaatcaagatacaagaaccaagctggcgaaacaggaacggctccctagcacggcagcaactcccatcttgccaagcagactgatcacctccagtattaccgccaaattcagaagacgttgacaaaggaggtcggagagttgcagtgctggagaacactatgttggcaaccgctggacgtagacaatgtcttcttccactgagaaaaatccatcgtcgcatgcgaggcatgcaattagcactgcaaatagtgaagcgagctcggcaactgaggaccgcatcgttaaggggtcggttacgagcaatccatggccggccattgtgactcacacagtgtgaggaggcaacaacatcggttagaacaacttgtgcggcgaaaccaattttgagagtgtcagtcgctcccgtatctcctgactcatccaacaaggaaaactcaaccgtcccccggtgtaatgacgccagcaacaaagggaggaacgtggccagctgggagcatggtctgctctcaagtttttgtcccccggataaaagtggaatcgctgctaaagtgactaccatta

SEQ ID NO: 1978 - DNA, 1922 bp, Toxoplasma gondii
gtttttgtgcaagcaaggacccttacttgtggccgattgcttggggggtgtggcttcactgcggtctaagaagggccgccttctttgcctccactgtacttagaccgggcacacggctttcttccacagccttgcctttcttgcagcagatattagggcaacgctacacccacacttagcctgttgataaagtgtaggcggctgtctgtagcattcatgcagtctttgttagcgcgctttagagtttccgtcgcgaatatgtcaaattcgctgttgacagcaaagatgaggtcccgaaagttgatgcacaaacttccacaacgcgaggcctgcatgtgatgggagttcaggtgcgccaaggagtttttagacaaaaagtgtccgtttgagggtagaagctcggatacacagacctcagctcgaaaagacaccactctcatacagcctctcaaccgacgacacttgcagaagggagttcgttgcctgaaccagcaaagaacctaaaattattaggtggcaacggagattttgttttcgaaatctagattcacaaaccgtagtgcgtacgatacgtgaatcactgtttttgttgaaacagagcgcgtcttttcgtctctgatgtgcagtggaagttgctgtgagggtcggggcatgcttcgtacggcgagctggtgggtgctggcttaccctgaagttcattagcggtcgaacagaatccatctcagtggcgtcaggacttctcatctatgttcttgtatattagcctttccccccgaccacagtttgcaagcctggtaatggtccggtttcgtatcggtaaaacgtgctacacgtgaggatctcagttctcaggtcgtcgccgcctcacgagttgctgatttgtagacccccgcgaaaatcacagtacctattcaaatgcacacatcaccaaaaataaagagttgcgccgcggcttcagcgcgttacgatgcatgtcgctgaagagggaaccgccgaggtcgccagatttttcgagaaataataatagcatctaggctgaagcggcacttccacttcatcgatgtggcctgctacatgctgacgtccaactcagactctacgttgtgatgcacatgattcttctgctaatcactgattcttagatgggtgagaacctctcgcttatgattcagcctcttgaggatatagtgacccatgacatcagtggatagcggctgctagagctagtaagagctacgttgcgctcagcagagaaggacggaaacgtgttcttttgtaaaaagaccaatgtgctcacgtcaacgaggaaaaaatcacgaacaatattgaggtagattcgacagaaacgccctaaataatcgcatacggcgttacgcggggatggtcggggaaaacttccagcaattaacggtttacgtggcaatggtagaaggtatacaccatcgagcaagggagatggtctcgagagttgaacacgtttatatggtagaaatgggctagtcgaggaagtctgtgatatctgagtggtacacaccaggtcgagatgcgctcgagacagcgacgcttgcggcaccgccatgcgtctgctgcgttctctgtcttgcaggggcgcgaattttgctcgttttgcatgcacgcgcggaggcaacaaaggagaggcacgaaaaaagagacttcgcgacagtagacctcgtcggttttcctcttgaaacaaggacttgtggacgtataacacacacggattgtctttgaaaactgtagcccgtgtttcgtacggcaaaaaagcactaggctctcacccgtgtgccttcccgtttcacaacgccgtggtctcttctccaacagggtgtttctcgctgcggttgtcggtctttcctccacgcttgatttcttcgtgtgttctccatcggactgtgtgtgca

SEQ ID NO: 1979 - DNA, 3187 bp, Toxoplasma gondii
gggaaggcccagccgaggagaagtagtgacggaatcttttctttccgccgcagcctccagggatgacgcagtgaaccgaagctgtcaattccgcagagctaaaaagacgagaattattagcagtgtattttctcactactcgcctgcactcttactgtcactctctattaaattggtgtcactggatgagctcaggtgcaagggagatcgtcgtagacactgaatccggttgcatgggcctgggtgttctatttgacgtattttttttatttcaaatgatagatagggcatgtaaggccggaggttcttaacccgactcaacgattttatctgacggcggactatcgttcctacctgagtctgtctcaagaacagaactgcactgacccgtcgctgccacgacgactgacgagaaacagcaaggcactgctgttcccaccttgtgtccttacatcataaacatcggagggtttctcttacacaaatccagttcgctttgccgctgcatgcgaatcttgaatccgttgtcaactaccaagctggctgctgcccacacgaggcacgtccccggcaactttttctggtcctaaaaaacccgatgtttcgccgaagaaagcgcgtgcgcactcgcgcctttcgctgacacgcatactgctcgctgtcttccatggatacgcagctaagcgtacgtggcttaaaagggaacacatgcgccagtttccgtacatgagaaaccacactaacgcacgggcgttttcctccctagtgcactatagaccgacccttgttgccgccgactgacccgcaatcacaccgagtattcgtggaataacacccacgggtaaacccctcttacccccttctagggagacctttgcaaatggttataaggagtggaagagctcctttggtgtgatatgagcgctctaggacgtgtactgtcgaccttccgccgccccgtgttttccccctgggaggtgtgagggcagagtctctcttccgatcctgaaatgcctgggcagtagtgtggtgtttccattttcccaggttgcgccgtttgcgcctgctgttgaaagagtctctgacagagcaacgcgtctgagaaagaggcagaaagcgtggtgacgtcgaaggagtggaaccaggcactggtaaggaggagaggcgacgaatttagaatatagcaaattctgcgactcagccgagcattttcttctgcgtccatgtctagacgggattcgcaccaagacaacttgcgagtccccagccccccacaaaaacgctcaaggaaattctcgctcgttgtcccgaaggaactctggcagaactggctacgagcgaacgcgagatccttaaccggcggcggccgagtttgctctttggatgtcgcctgcaacccggcgagcggaggcaacgctgtttcgtttcagattcaaggttctccgcctctgcttgtctcagtgacgaagcgttagtaaaaaaggggagactattgaacacgtacgagcgacttcgtagaagtttcagaaagggaagaaaactcttgtctccggcctctgtccctgacccagaaggctccaaagctgacagctgctggcgagacgggctgaacgggagaaggtcatgtttggtccccacgaggaggagaggacagacaccttgcagaagacggatggcgagatgatgttgctcacgctctttgttcgaggcacaggaaaccgaaaacgagtcgatgctcctgtcgtcttctgtggattctgcgcttccttctctatccgacctctcacaagtttcttccttattcctgtttgaaatcgccggcgtctcggtcttagaatccgcctgctcccatgcatctagactgccctcctcagaccgttctgcacacgcaccttcgtccctttcttctctgccttgttcatctccgtcactgttgccattgctgtcggcactgctccgacttgctctcatgcccactgaagaacaggaaaagaacgaggaaacgaggcggcctggccctctagctcccaatttcctcaaggcgaatcctgctctgctgttgccattctttccgaagtcccgttccgtctttttgagtcccgaagtctcgtcttcgtccctgtcatcggggtcaacactttcgcgctccctctcgcccgcgagcagggagttaactggagaggcgattagagatccaaggcttaccacagtgctcgcggtggtgcggattgcgttccccacagacaacggaggcgactgaatcacagaagacactgcagatcgactttcggtagacgactctgtgcgcagtttgtcaacggtgacttgcgtatacccttcggactcttcctcccgcggccccgtcccgcgtctaccccgccggctaagctggaactgctgcgacagagaaagttgagggccaatacgagagggacgagggcggcgagaggaaggcactgccgttgctcgaggcggaagcaggaggcttgctggaaggaaaaagaaaagacgaaggcaagtggagacttacgcagagttcccgtgtccagagagcagcatggtggaaggaggcggaagacgtcgcttcgaagcaaacgcaaacgccgtcaaagtgctgcccatacacgagactccggacgctctcgagtgcttcagtgcctccaacctcccaaaattctactggacaacttgaccggtagacagaccccgaaggtgaggaagcaaatgctgttggagacgggcactgagaggaacacggtaacgagggacaggatgaagatgaagtgggatccgcaacgaatgaggggtcttgcggtgagctcctgctggacgcattgacacacggactggaaggcgctgcagagaacgtagccaagcggatgtttccttccctcgcagagtagtctgccgaggagaaatcccagaaaagatgaaaatttcggactccacacttccactcgtaggcccctgggtggcgacatgcgggacggtcttgttcctctgcggagtacaaagactcaatacctggcgaggttgtctccgacgcggactgcctgctctccactcgggatgtagaggaaggaaagcgagaatgactcgaagaagataacgggtgacgacggaaggacgaagcgaaagaaaacgaggaagacggggagaggccacaagcaacagtgggggaacacga

SEQ ID NO: 1980 - DNA, 2204 bp, Toxoplasma gondii
aagcaacttacagccgccttgaaaagttcgtcttgcccagcaaatcgccccatgatggttagcgtcagcagggaaggatcccggtgtgttcagtttgtttccttgtattaaacagctcttggttggggcaatcgatgcacgagacaaattcgatcacactgctaaggtgtatagttcctcgacagagatcccggaaacgacagtgaagggcgaagaatatggcttttgcgcgttctatcgccggttcatgagttcggcttcaaccgtgccctgcgctcttgttgtaatcaataagccttctggtcacaccggagattttggatttctattctgtccaaattccccgttgaacaccggcaacgaacggcggaaggattatgcgcgtctatgtccatgtcaaaagagaaactgttatgttagatgccgtaggaagctgaaaacagagaccagtgccgggcacatcaacgcccctatgtatcgggcatacagagaatgcacaaagatacgaagagtcggagaagccacggaaagttatgccagacaaacgggggcggttgctaaaaggaagcaacctgtgatgtgttagacaggtgtgcctcgtcccaactgcaacatctaagactgagactgaagccgggacgtgctgaaaaatttctggagcggagtttgcgggagaaatccgcattcgagcacgccacaacgaaagccacagatgaggtcagactcaagaagggaagtggaatgaggcacatcccagatgaaaaagagtgcaccggttccggaaaccaacaaaggtgtacacacggaaacccgtagccgaaaaacgttttccaggatttcccaaatttgcgcgaacacttcgtccggagaagcagagatgccgctctggactggatagacctgagagtttccgagggtcagagattcgctgacacggcaaaaggaaaccaagacacgaccgcaaggaaatagttgtttgttagtcacttggtgtggcgtgtcgagtgcctccggtgccactatggcacttgttagaggcggtctttttataggtacgaatgaacacaccacaaaggcatgaaacaacgaactaaaacaagtgtgcagccgttgagaactggagagccaaggaagagctagggggaaaagcactggatgcaaacgtttggggataccgtcacatgcagttgaacgtgcttcagaaaagaaacgctgttcttgcgtgcgcagcatcgaggactcctcaaggctgtttgctatggtgtgagactcgcaacccgcagtcgattgtctgtcttcaaccaaacgatccagatgtgttccacttccgcttgtctcttccttgcctttctctctcattctgccttgtcccttttgaagaagggcgtgctcttcagaaacgcgatacctccaaaaccgtcagcgatcctctcaaaactggctcgacccggtctctgggcagcgcatgcacgcgcacattgtccacatgctgtggctttttcaactcggcgttttgcgcgaggttttgagattgcccgcaatgctgtaagggcctcttccagctttttactgattcgacgtcaggtcgcggaggaagaaggaggactttcgatctggcggtgaacttccaactgacttttttagtcagtcgtcgagtcccctctctgtggggccaagggcggcgaagttggcattttgttttccatttacgcgtacgtaaacgtctgcctatgcttctctgattctaggcactcttacgcgtaagcaaaaatcctgaatgctctccataagccgaggtgaggtagaaaagcggttgtcttggccctgagccttccgcgttcccgttgccagacgtcttgattctgcggcaaggcgccattttttgttcgccttctctctgtggttgaacttattcgttttcatcgatcattgcttcttccttctctgtcatgacggctactcattctttggtctagaactgcagtcctagaacgcagccgtcgcggctctcatcatctccttaaccgctgtttttcggctcacgccccctcggtatttttagctcttcttcatacctctacatatattactaggtttttctctcctgtttcgatattcaatctgcgacacaaagccatcgaccggcgcttctcgtctgagaacacacgctttcctgtttacatcgacttctcccgacagcacta

SEQ ID NO: 1981 - DNA, 2824 bp, Toxoplasma gondii
gacgaatgcggtgctccaggctcggcttcatgacattggttgtctgctcaaactgaagagcccctcgctactgctccaccttcaaaaagccgcgcagcagcaggctcacagacgccagcagcaagtcgctgccgcagccccgatcccaggaaaattgcgagctccaggaaccacggagggcgcatccactcggttcctctgatctatgctccatccagacttttctatttctcactaagagactgcgcgcgtatgcacctggacacacttatgtacgagtgcacggtggtgtatgtgtaggcatgcatcccgaaatctttgaatgaaactgagattctgaatatgtgcaaagcatgctcacaacgccagagaaacggggacaaacacacggtgggaggtctcaagcgaagacagagcaggaagcccgtctgcactacgaacagtcactctggtatttcttaacgcgacggaagaatctgggagtaaaacaatccccataatacaatggtgaataccgtaaggttccttcttcttaggtcgctagaaacggcgggaaagtcacggtcgtttatgggaggacgcgtttgtgttgaaagtaactggaggagcgatagcgcgcgcggcacctgccagcctctttaccaatcccgttgggatctggcacagggtctcccacagatggcaatgagtggaaaaggttccactttgacggcttattttgcttagggccaatgattcattccttcggttttgatgtaactctgattcgcgagaaacgaaaacagatcctcttcgaggctctgggcttcaacgccactcgtcacaagaaaaagagatccaagcagcaaacgaactctgatagaggttgagggagaaaatgggcagatccagcgagacatgcggattcgctccgatgctaccgaagctcttcctgtttcaccacccacaaataccacaaagccgaacagtaaccatatgatggaggccgaaatagcctcacccaagtctgacagaacagctgaaacgctgtcacttctaagcagaacagaaaccaaaactttctgcagatagtgaacatggatgttgtgcagttacgagcacaccgggtcttcccgcattctcggaagagtgaagaatcttgtgtgaaggcggtcgtaaacgtcgcactctagtacgattctgttggggctaacgaaatcagaaaaaacacctagacgttcgttttgcttgagcaacgagccgctgagggttttggaatttgtgaacctgcttgagaacccgccgttatgctctgctggacctagagtaagcgtaagaaccatgcatgcgtgccacactacacaaagcgccatgccccccatcttgtacgaaacatggtgattctgtaggctgttcaaaccttcttttcatacgtctcgactccaagaacacacggagctcgaggagactcgtaaatagatttgagagagtagaattataccgttgcgggaaagtgtacgcacgctgtgacctgctgagttgcttcagaggcgcagttttgcacacggcgcacgttcttgtttttcttttcttgaactcatacatttttctcgtggcgggcaattaccgctgttggctaggaacagggaagtgctattggcttccacaagattgaggcggcgcccgtcgaatgcggttgttttgttgatgcggcgcttcgcaaagtttcacactcgccgtcagccgcacagccgctctgggccaatgcagtagcgccggccgattcgttcttcctggcgtatccttccgcattcagcttcggaattgcaacaggggtccattttccagtatttctcttgaatgatgttcgtctataactccgtcacgtatctgagttacctgccatgctgtaaatccgcgcccttcgacgagcggcggacaaaggtcactgcttctcggttacggcaaccagtctcgacctaggaaccaccatctgtaaaggtaaactttcacgttctctcatccgcaacctcagctagaagacggaccgctatagtggtgctgtgtcttgccagatgcgtgtacgtctctcccaaatccgatgagactgcctttctagccgcaagagcctcctgtttctaccagatccaaagtacacttttctgtggagcagcagagagactgtatgcatgcagttacctgtgtatctgggcttccgccacccccgtttcaccgcagccgtgtaccggggaccctggcgataagtttgaaaggggattctgctggacacaggtcatgtcacttttctttcctgagaggctattctggtgttgtcactttcactttcgcgtttaaaacgacttcatcttccatgatttttttgagtccatgcgtgtttacttcttttgtcgtgctgtctcgagttgaggtgccagccgacttcctaagatttgtgtttcttactgaagaaagctgaagcttcgctcttctgggcgtctactccttcctggttataccgtcgctgaggacgagcaagtgtggtaagaggcctatttctggaagcaggtggggtgtacacggatctctaaattgggctgccgctcttctgtgtttgcagtctgaagaatctgcggtgtgttctgtctctggtgtgccgttcactggcaacgctaccgccgtatgccacggggagtccagcgacgaagtggcggttacttcagtttctcgaacaaaaccgactttcacaaacgccttccgtgaacgaagtcacattccgtggccagctgtgcgagaaggagatttcgtggtagaaaaaacgacgcgcttccggtctccccccttgcca

SEQ ID NO: 1982 - DNA, 1469 bp, Toxoplasma gondii
ttgtcgttgagttcagcacagaagacagaagagtcgagagaagaagagaagaagttgatgggtggggagagaggaacatggacggcagcggggataggcgagtccatggcgaaacagcgaggaagagagacagtcggggggggacgtcagaaaagaggagagacaccgtccccgcgttgacaacgtttccaacgcggaggcagaggctacatggcatcgggggagaaatctaggaaaaacagagcgaagagaacgaaaagaaaaggagaagcttgaacgcggggacagagaacacgcaccaaggcgagaacagaaaaacaaacgacaaaagagacgaagacacggcacaagggaaggacaggagagagaaggaggaacaacagaagagaacgacaagagagaagcgcagaagaaacaaagggagaggaggacggcagacagtggataagtcgaagagagacgaaaggacgatgtctgtgctccttcagagcaagaaaggatgcgctgcgaaggcgcatgtaccgagtagagggtgtgagtgcaaaggaagaagaagagccgcagggagaaaaaagtctttgggaccttccacctgaaaacgatgtcgagaaaatcgtcggttcaagcgaaacccaagcaacgcgttgtacgttttggtggactgcacgagtctgccgaggcgacgttcgtgccgacagaaaccgaaggaaaaaatcggctttcggacgtctccctcagccgtgtcttctcctcttatcacgaaatgacggagtgtgaacgctggaagaagcggccgagagagaacgcagaagcatcggagaagaacggataaaggagagaagaaaggagagaagaaaggggagaagaaatgagagaagaaaggagagaagaaaggagagaagaaaggagagaagagagaagagaaggagaggagaaagcagagaagattgaacgggagagaaaaaagaatgagaggagaaaagagaggagaaggaaaggaggaagaggagttcaggctacatgagagatcaagacagagagacaactccgccccccatctcttcgtttcgttggagaagttggaagagctggaagagaagaaggtgttttctctctttttttaagtgccgattttcgcttttaaagttctttttttcgcgttcgagggtcagagctccttcttttctccacagcgtccgagagagcaagacactgcagatgcggctgtctttgctcctcgctgtcacacgagcacaaagttaggcgcgtttcttctccggaaaaggtggagttcttcagagttgaagttactgaaacgcagtcctttccagttcaggaacgcccgagtgtctgtgcttgctctcaaggtgtctcgacacctggggaagagtcagagaggagctctcgcgagacgcaggaatgctcgacttcttgcagaaaggctgcaactctccttcgttgggtttcga

SEQ ID NO: 1983 - DNA, 3637 bp, Toxoplasma gondii
agagaaggcaaacgaggaagaaaactgcgagacaggatacagactagaagagcggaggaaacgagggcaaagaataacaagaggaagggatcaaggaaaagggcaggggacggcaatccagacgccgaattgtggcaagtctgattcgcgtctcccgccttgacttttgttccacgcgccttccgaggtggccgataagcacatccaatgcacgctcacaacctcaaatgcgcgtgcttagacgagtcacgttacttcacacaggccggcctgtcggagtcgaaaaattttagggactgacggcgcatgcttgctcgggggcacccatgatattttttttgccccaagtttgaatcaggaaacgtgtacaagaaagaggcatgcccatggagaaaagaagaatggaaatcgcaggtcatggaataacgcccagtgaagcatcctcctgagaaaatgaggggatcaactgcgttcaccagtgtgaagaattgaagcggggactaagaaccatttctcatcgtgaaagaacaaatgattcgaccttgggacacgacaggaaagctccccgttcaagtgaaaatggcctcaccagccgaacagaagagagctttccacaaccaaagtgtctagactttagccacagcgcatgctgtctcgaacgatcagccctcgggttcgcgtttcacgaggtaaacattcagagatagtcgctacgtttcacagattcctttgcatctgaaaatctgaaattgggaaagtggaaatccacttgacgaacagacggtgagacaggaggtcaaaactaatgtcacacttcagcgttttcgtcggcacggcaagttcgcttctctccggtggagcaagaaacggaaactacgggcacgcatcacttttcaaagcttgtgcacatctcttggatggcctggaagggggaaaatggcgactcaaagctgtgttgagacgccagtttatgagtttgatatgagctcaaactgcgggttctcaaacgcgttacagcagattggcatgcggtgcggtgcatgcgaccaagaattccgttacggattctgcgtggaaggctaagaacgccatccctctctgcaaccaacgcgataacgaggtcaagcatttccctgattgcgtcaatggcaaacaggccaaccttcctgagcccgctcgtagtcaaacgatttatgtgtcacatcatgtcgtcatatttccatcgcagtcatttgtgtgtgcaatcaactacaaaacacttcctctggcaatttcacaggcactagctttttgggtgcttgcgacatgcgaagcaacatacgaaactgcagaagtaagcggatttcgtccgatacttcagccagcacagatctgcaagagaatggcttaaagtcatgagaaaccacaatggtgtggagaacgggattcgccgtggacaaaagttgagagtggatgcatgcacacatcagaagtatgttaccgaaacccaaggtttctctgtgtaaatttctggaattaggctcaacagaaatcacaggcagaggatagtggtggtgtgcttgcggcgaatggtcaccatacagtgttgagcacttcgtaatggtgctttagtctaagaagcgtcaacgtactattatatcggcgactgtgaaaacccatgcgaagcttggtgatgcaaaatttagcaagaaggtggtgtattttcacctcgcagccgccatcgtgctcacgccggtgcctgtcagtattggttatgtccacggacctgatacactttgacgtacacggaactcggaactggggataacattggtccaacaagccattttgtatcgcatacttcacacgaactcaatttgaaacgagatgggtcaagtgacgcttctccttgtagcggccacctgttgggtaaacgtcgaggacggtgagtgctgttttcacaagcaatcgaaggtgacgaatgctccaactgcaacataatcttccgtgaacaagaaaaagaacacacaaggaatcacatagagtactatatacagcgcatctagtggaatcctttcccctctacgtcgtcattatttgcaaaagaagggaagtggtgcgccacgttttgggtatcgcaaggaatccctatgggcactaatcgctctccaaacctacacgaaaagttgaagtgaccattttggaccatgtagtcattccgtcagatagtttcaggtctcaagaacacagtagatccgcgacatgttctagagaacacggaaaagttcgtggctccgcaaaagcaaatcactaacttctccagcgccttcgacattgttcaacgttgttaccgcttgacagtcagagttgctacgtcgctgttttgtacatacgggaccaggaccgggtttggaccactgaagctgctaggagaatacggagtctcccccgtgtaccaccgtggatgacgaatcatgctacctcggccttttgtgcggacatccagcgtctcgtcaagccattctgctacagttcacaaaaagacacagattattgagaagggagtcggttttggaaaaaacggggtcagttttgaccgcggcttcagatctggttcatcgattgtgagctgctgcctctcattttgtactggaaatttgacccacacgcggcaacattacggtcggagcacctagcttccaagtcttctttgtggttggcttcagcagttccatgcgacggtggtccgagaccgttctctatgcagaggacacggctggaacgcgcctcaattgcgttgttgcgttaattgcagatatccaagtgctttttgtatgaacatctcacggaggcaaattttggcgatgtttgatgacttcaggccagttttgtactcacgacctcgagagttttgcccactgttgttaaagggagtccatttctctgttatgttatctagtcttcaatgtattttcggtgtgggacctgttgacctattccgatgtagatactgtcaacttgttctcctgggagatcgtttagctagaagaggcatgtgacctcgtcgttaccacaggagttcggctgagctcgtcctgtttcagttttttcagacatgccgtgtttaatcttgtctgtaaaggcgactcttgtaaacaaaccgctcagggagtcccgcagatggtgttgtccgcctagcagcggcctgcgacattgggcccgataagcatacgtgccggttcacagtttgctcgtttctctttctcgccttttgcgaatttggtgcatgtttgttttaaccgctgcggaagagttgcttttctggatgaaccatatttgttttgtttcgtgggtcttcactttttgcggtgttgcttggcaaagaaaccactaaacatgatccagcgtgcaagtagttcctccttcgcagttatgtgggaacgtgataaatattcattgtcaagaactgtcagacagaagttagttttttgtcttggcccgcctactgtttctcgacaatgtagcatcaacagaacgcgtgcggagccccctgttggggccacaaccctctcgaaccgttgctgaaatggaaacgagagacacctgcatttgcgacacgcatccatgaaagaagggtacccatttcatcgcccctcca

SEQ ID NO: 1984 - DNA, 4970 bp, Toxoplasma gondii
ccacaacttcgcccttctcaaggtcgagaaagtgaactcgcgttcctgcagccatgaggcacatccgcgccacgccggtcgcctccacctcctcgggtgtacgtccacccggttcctgtccagaggctatgagcatcgcggctttgactgtggcggcggcctcggcggcgcgtttcccctcgccttttctcttttggactccgcctttcttcttcagctccccctcctcagaactccgggctgccggtctcgttacaaaggcacaggccacgacaccgctgttctccttcccggcagcgacggcgcggaagaggtgctgcgttctcgcgcccggaagtccaaacggagcagagaagcgagagggatggagcgcagagaagctgcttgcctcggacagaggcaggcggcggtaggaggtggaagaggaggcgcaagacgcggaagcagccatcttggacaaactggagacgaagagagaagcggagacaatagagacaggcacaagagcccccagctcccgaggggcgtggggaagtgaggaaaacgaggaaagacgacgtggattgctaaggggaaaagcaaagtgcaatcatgaagtaaggatgctgacacctgcccagtgtctgatattgaattaatggattaagaatttaaaaaggagcgtggaacgtctgaggaaatgtaggcgcaggtagacaagaaaagaacttcaagtcgagagaacgtggaaacttcgatggtgctgttgcagagagaaggagaaacgagacagagagcaatgtggggaaacacagagagtgtggaaggggcgagaagaagggcaagaggacatacagaagagaaacgagaaaaaacctttgttcaaggctattgtctctcacgcgagggaacaggagccaatgttcatcgaacaaagcaacctgttcttgactcttgaacgtctctgcaaagcatcctattcggcaagtcaaagatcgagctcagggagtcactgttgactgagaaacaatgactttatgactacggaatgaagtgctaaagagttgacatgtgggtattcagggctcgagtactcgcagagaggagttttacgtcaataagagacgacatcaatacaaaaacagcaccgacttggatcccgccatcaggcggccccgctgtaactcccgtcagactaaaattccatgttttcccctgtcagaagtcgaggagagtggtggcgaccttccccacagagtttgtgtcgagagggaatcgagcaaagcagacttcctcggattccacacttctttcgtctttgtcctttggcttgcgtgtcgaccgccaaacttcgagtcgctcccgcgccgcgttttcgaactccactgcactggcgcggcaggaaaacgccctcaacagtttcggtagcggaatttcgagacgaggcagaaaactctgattgctgtggaattgctgaggaagacttaaatcgcgggcgcggagaaaaagcgacgaagtcgagactctcacgccgcgccgaacggcagctgtgcttgtggggctctcgtagttgtttgtctcggcagaaaaatgcggcagaaccgaatttgtaaagtctcgtggagaagcgaaggactcagaagagatgagattggcaactgaagaaaagaggaatcacggcgaacgcagagagactcaactttgagatgcatctttacgaaaacatgcaaggcgctttttctcgcggtgtgaaaaacggctgtcgggagaacaaactcgccgcaacctgcatgccggcacagcagacagaatctggaaacggatgccaacgggacacatggctttttaactttgattggtgcactcagtttctgcagagaaccgaaatgagtctcttcgcaactcaacaatttctcttcttaatgtcctggtgccggttttcctctattggtttcgtaccagtgtctgcagtatgggtgagaaactcgacaaaagagagcgtgggctagagttgatctttagactttacagtgtggcatgtttggttttctcttcttttcgaacggggacaaactaccttggagtgagctgcagattaggagaccttccgtagcttgtcatttccggttccggcaccaacagtcgatgctgctccgtggttcttccgtttttgactctcacgcgtgagctgacatctctaggtgatatctccaacctacaacaactcgacagtagtagaagatcagtctttccagtagaagaaagcatgtttaagaactttctagaagccagttggttggtgctctcagtaaccacaaagaactggttctctttatgtcgtcactgctgtcgtgaattcaggatcctgactactctaatgtcagcgaacataaagaacttgactgtctgtatctcaaaataactggagtcacagtcaggatcctatctatcttctgaagttccttgtccttgttgagctcactttgtacttgggaccagaccaaaacagttcacctatgctactaggacgacggagctcgcggtagatcttggggaaacgacttccgggttaagctgactcattttcaattgtttgctggtttttaggctaagttgcttctttcacgacaacgctcattttcagacaaggtcatttcgtgagaagtgcgacgccggcataagcgtagactagctgtcgcctgtagtttttcttgttttcgtccattcacgtgcactccatcctggcagcaggacacaaggaaactttgtggtgaatacgagaaaacatagtggcgccggctcggaagattttacgatctcgaaactagaagggaatttccagggactttagtgggaaaagtttgtcgccagttccacggcagactcaaggtgcccgttgttgtaaagtgtggacgatgcgcgcagttctgaacggttggacaaactccccaccccaagcctaaattcagctttgctagggcacagttctttaaaggggatgtagtgggtccgagttttacgtctcccagaaaggcacacatcggtgcgctgaaagagctacagcaactctgacgcgttggcccttggagtatggtctatacgtaatagttgattatcaaacgcggctgaagaacggacgccaccagtcaccgtatcagtaggcagagttgccgtatccgtttccgctacaagaacagtggaatatgattttttacgaactttccaatagaaatggtttgctcacgaagatcgactcgaactggtttctggtgacggtagatagaggtcgactgagcctggggactgcacttggacaccgaagagccggatacacagtcgctatgcttggccgccacaaactgaaagactctgtggatatggaaaaaagaaagcaatgttgtcgaaggccagacacattcctgttgtggatcgccaactgagaacggaagccgggaaacgattctccacatcgtcgccactgggaagtaaacagctttgttcgcgaaatgagaacgaagaacgggaaagtctgagatacaacccgccaagatcttctgaattggtgtgcaccaccaccccactgagtttaaaaccactgagctgcctacgacagctaaaagagcccctgaagctcgaatagtttaatatcatttaagcacgaacatagaagcatccaagaagtaagcatctatactgcggggttcgctctacagctccgtggtgctgaaaaggtctcttgctctccgaaaatacgtacgccgcaaaatttctcagcaatttactcctcatactcgtgtgattggcaaatgtccaaaactcgagaggcttcacagtcggagctggcctcgtttgcatctttccaggatgttcacccgcaacagaagttcagacattgcagcgttggaaagagcgcggccacctgttctcggaaatcttaccacctctcacatcaggggcatcgctatttcgtttaacaacgcttcactgccgccaccggtgtatccgcgttgaataccgcaagcgttgtggctgagccggaacattgatcaaacgacagcaactattctatgttgactgccaacaaaacacaacatgcgaatctcacaaccactgcggagttgcggacgccttcgtgattcgcaaaagatagctgctaggtaagttgagatattgggaaccacaacacactattgcccggagaagttcctgtggtggtgtttagcttcgcgtactccacagccagcagacaagtctgcactgtgtcgcgtcgtccgagaaaagaagcacttctgcattttccttttgcataacgcgtccgtttcaggggtgtgtgaggctgccgccatcccaggctgctaaaaaacaagcgtatgcaccactgaaaaagtaaaactacgtgattagtgcagaacgcgcgcctcgcctaccacgggagttgatttcgtttgtcccactggggccgcctaaagacttgcaacgtacgacggtatctcaggaggggatccttgacagtgtctcgctcctgggaatgcagcagggaagcaaactcatacgttacgcttacaagaacagtcacactgaggctgacactcgcgtgagtcgttgcctgacggaagaagagaccgttaggcgtctcgtcgtgtcgctagcaccaggagacaggccaacgctgcctagagtcggccaacgcggctgcactcgagaggcctgatggagaaaaggcaacttttgtaaagggtcatacagtaataaataaccattttcgaagcttatgaatgagccacataaggaaggaagccagcagcaaagcgttgacccgcacaccatgcgagcgcgcgagtagtcaacgagctgctgcggcggaatagtccgaatttgtctagcttttggccgctggcatgatgttttctacgaggtgatctaaccaatctgtgtttcttcgcggagaaagaatgtgtggtgtacgagcgtggagcggcttccatcaagca

SEQ ID NO: 1985 - DNA, 2507 bp, Toxoplasma gondii
tttccctctgcaaacgaaagtgtttacctttatctacacatgccagcagacagatacatacaaatatatatatatatataaataggtacaagtatatttacaaatatgtatacgcatccgtgtgtatgtttatcctgttgtcagacgaaaagacctgacgagctgcttgttctcgtctccacgtacagaagtgacatatttgaatgtcggttccgcggtcgggcctgcctcggtgtcttgagcagagacggaggagagggagagaaggcagaggaggaacagagaagaaaatcgaaggagactcttgcgcgtcgcgggaacggcagagactcgccgctgtctctggggaccggccgccgaggagagaaacgacatgttttggacacgcagaaagagaaaagggaggatggaagacgagacaaacgaggagaaagacgactgagagaggacgagaggagctctgaagggtgccacgaagcacaggaagaggacagtggagctcaggcgggggccgacttccccggcagaggagactgaaagacagagaagaagcgaacagacttgaagagggaagacaggtgaagaaagaaaagaaacaagagagtctcgccgttctgttggtgaagaggaaatctgtctaccagcaacagagcgcagtggtgaggaaaaccgggaaggagccccagagacgaaaaagctgaaaagcaggcgagacgctcttctccacgttcggtcagggctaagaaaaccacaagctgagaagaacagaacgaggctgcagtccacggagacagtgcggggacggaattggaaagagaggaacagcaactaggccgaggaaaacttctgcagcagaggagcggggtggagcgcgagcccagcagacacgccagggcgtttgcggacagaacggaagccacaggatggtgcgtgctacgaaaaaaagtacgcggactgtttggggatcgctttcgcgactctctcctagagaactccctcctcgtgaccagaaaatgcagcggcgcgcaaggccgttcaaacacgcggccgacactgagacagaacgagagccgttcgaacgcttgcgttgcttctctcaccaaaacaaagctggcgagtctgcctcactcgcaaacactgcaaacagaagagaagattcttcctctcctctccctttcttcccctgggaggacgcgctagcgagcgggtagctgcggagagaagatcacaccagcgtttcgtggaacgcacgctgcaactttgtctgttgcatgtcggagttccgcagaaggccttttctcgcattctacacaccgggtctccccttctgcgatgtgtggagaagacgttcatcgcgctcagcggaaaagaaagaacgcgtcgtccctcctggaagaacgcgagctggctcctcggccgggttcggcttatgttcggagaatcgaaccggctgctgtagtgtgtgcgtggttcgtcgatgctgtttcccgcgccagctcgcggaaaggcggaaagaggcggagaagaggacaaccgggagaagagcagcgtcagacgactatagagaggagattgtgagagaaaagagagaggaagagaaggggacaatcgagacagtcgaggcgacctcgttgcttggaggaacctctcgtacagccagcgcagttcatcgccagctgcgactccgcagcctgcaagacgcgagaggagaaaagcggaaaaagatatcggggcaatcgcgagggaaaagcattcatcgaggacgaagaagcgagggcagggaaatgttgcgtgtctctgccccgtgaagtcagtgtgctgtagcccgtgaaacaaactgagggtatccagtgaggttttcgtactcacgagtgctggatctccgtcttatcgattgcgagaagtcgaaagacacccgagtgttgtgcacatgcgtttcactgggcgtgtccgctctatgcgacttaaaacctcatttgatttgtcaccgattcgtcttcctcctccctctcggttcgagggctcgctctgcttcagcgtgaggcctgagggaactccttggttccgcactcacttgagaagagcactcgaagagcagtctgccgttctgtcgttttcaaaagaagagctgtggcgcttcgccgcccttcctctgcagtcctgcgctctgcaggcagcgacaacacaaacggtgttctcgtctccacgacggagcatcccgtggctgcctcctcacccgtaaaaattcagttagactgctcacacactcaagaagaagggagttcactcgcctagagcggctgtccatcatcggctgcgagtcgactaggtagaccccgtggaagtctaggcattgtctgtacggatctctgtatgtcggcggctttgggtggcttgtgtgtacgtcgacgatgaacctagtgagggcgaacgcgcaagcgacgaaagtttcgtggatcgttcagagcctgcctttcagtgactgggtttgagttcgcgaaccatca

SEQ ID NO: 1986 - DNA, 4434 bp, Toxoplasma gondii
aaaacggaagtggcccttgtggtgtgtatgcttcttacactggacatggcttctctcgtcctcgttttaactggctttgctattctttctgacactcataagacggaataactagcagcttgcaatcgacaagcaggttctgcgaatccactgagtccgctacttgcacgttacaccccccgtcgatttgaggtcgatgaccaccggttttgatcgagtcgatgactcgatggttgaactcttttccagcattccaaacaaggttcgagctaaccctgggtatcacataatgtttcatgcacgtgtccgtgactgtgaaattccaccctgtcgttgcttatttgtgctgacatacacaactttctttgaggagtctgtatttagccacgaatatcctcgttttcctggggcagcgaggggagtggagtgcagtatttcgtgtgaatgcatgcgaatacaacgacggatgtaagtaaatctgatatatatacatatatgtatatacgtgtatacccgagtgtggactcacttttcatcttttatgaagtggctatattcttcctgtttcctgttgcctacacggtggaaatggatgacgttccacttccccgaagatttgatagtcacgaagcaggagacgtagaacagacagacatgtcttcgttgattgatatctggtgtgtattgagacgggaaactgcggattcctctagagatggaacagcaacttaagataccacccgcacatacggagagggctacttcaatttcctagctgcgaaagtcagcaaactgcaagacgggcgtacgtttcaaagcagtgacagcacagttgccacattgtgcgatagactcacttgcgaattttatcgtgaactttttgggattggagcagagaagtgtttccattaacgcccttggagaattgtgatatttcctagtcggcacctcaagtactcttgcaggtctccatggcctgacatacgctgcctcttgtaacagatgtgtcacacattttttcggcatcggatccatagacaacgatgcccccggtccatctgcggtttcttccgcaaaggcaatccggaatgaaatgggggcaggattcaccctctatcgaacggatgcattttggcgattagatgttcttgaggaaagggtagtcccgacagcagacgaggaaataaataaccgggggcggccctgtctagccagcgacatgcacgggtgaaaaccccaacgtttgcaagatgcgagtgacctaccttgacccattaacaaaactgttacctgtctctgtgttgacacattttgttgcacttgctattggtgtgtcctggttgtgggaaatgaacagtctgatagtccatcatcgtatgaaacgtcgactggtacgtggtcttgcgagcagcgattcaaaccttcctctcgcaatcgaattttaaattggacagtagaaccacttgtgtcacacatcgcaaatccactagccttcatttgtgggcaattatgctgtgttatattactgccttaaccgttgtccgccacttcactttccaacgcgtgcatcgatttgagagttatctcaaataggtcgctcgagaaagatgcccctgttgtatcttggtccgtgaatggtgaaggaacctgcttctggtttttgagaaaacacgagattcagaagtgattctaggtgttctgcagctttgtggccatgtgttttccctggagagaccacgagaaccttctacaacatagttgctgagatgcgactctccaggtttgtatacaatataagcatgacagcgttgttgctagcgtcgataatcaatggtatacagatccaagcagcgaacaaccagaattccaaacctgccagggcaatgtcacccaccaaagataccctgccagatgatatccggccatatcatgagtccttggcacacagcgagcaagaatccgaacgtgaacaatggcaacagcaaggacggcgttggcctatcaatcatcttttttcctcactagagaggctcatggcagcggtcactgagtccatcagttttcatcaccagactgaaatcccctggaatcgcggatcgggaaacgcaagactgtcggtacatcgaggtcgaggcctgtcgcaggcgtcgcagcatagtctgtcacatatacgtcaccagagtggacggccgggtgcgctgctgcacaatatgtggactcctgcggacaggggcaccctattcttaggtggaaaaacgtatccgcgtagaagtcgagtgatatccgagacgaatagatctactggaggtcatccagtacatggatcaggccactccattccggcgccgcagatgaccagagcccctaaagaaaattccaagataacccaagacgctcaaacgagagtcacgagcttggaaaacagcgaagatgatcaatactggggggctcgtactcgcactccattctcggcctctccgacccccgatcacccgactgctggtggtatgctgccacacggacaaagcaatataaacagggatgttcctcttggtaaaaattttcggcaagatcctgaaggctcaacgcaccaggttggtatggataacggcgcctattctacagcggcaacaatgttgggcacggttacgtcgaagagcatgagtgtgcttgaccttggaatcgacgatatgcgggttttggccgacaccctatggaaaacgcgcacttcagcttacagtgagcggttggaggcagctgcgaaggctcgtgacgtacaggacaaaaatttctacagagggttgaaacacatcagcatgcaatcgtctgaatgccgcaggagaaacgagataagagacctagaaaggttgcaacggctggagaacggtttgaggttgacgcgaccttcagaacaggatagtgcaggcaatgaacgaaccagcaggtcgaaaagaagagcgcgaggtcagcaagggtctttaaccagagttcgcgaacatactccgcactctgcaatggatgaagaagaaacagagaggaatcatctgaagaaattgtcaactacaggcgctgcgaggaagccggtcatcgggagccatcagccatcgcgtagttcttttgaacggaacggtgaaagatcaagaccctccccaataatacacagcaaaagaaaacacgagcttctgacacagtcccttttaggagagtatcagaagaagaaggggtccagaaataaaggagaaacaccccgggttgaacaatctcataataaaagccccaatgcggctttagaaatggccgtctcaaaggatacgctacgcatgcggcatagcaaaagtaaggcgtcgactacaacaccagggacgaaagtagcgacacaccgccagcagctgcagcttcagacatccaagagaatcgacaaaacccgaccgttggtcccgtcacctggagtcgccaccgcgctgatgcagagcgtagctgaaacgctcttgtctgatgcgtcaacttcggctgcttctgattcaccagaaaaacaaaaagttcttaatctggatgaagaggtggaaacagcatatcaacagcctgtatggagtgctacaggtgcagaagtggatgggaatcatccgggatccacccagcagcctagcgggcgacgaatcgtcgaggctcagggtggccgtgtatctgaattcctgcctaataggagcacagaaaagaaagttgagcaggacagacattctggctttgaccaggctgcgtcacagtttccgaacgtggaacaatctaacggtaccatattagggcacgatatctttgacgcccctcaaaaacatccactaaatgaggatcctgctcccccgtctaagattcagagtaatacaacttctggtgaatctgcgtttggacgtgagaatccaacagctagtgctcgtcccgagcaaacaggttctcccgggtttggtacaatcatagatgcagagggcggcacagagactgatgtcggtcaggacgcggggatggattttgccacagaactgtccactggcttacggagtatcgcccctgaatcggttggaagatggttattgtctttacgtggaccaggcagcgcatcgctgcgtggaacttctggaagcacaacatatctagaaggataccagaaaaaagagcagaacgcgagctatgcaactggacgggctgttaccttgatggtggcgatggaaaatgccagatcttctgcacaacacatgggagacagtaagaaagcccctgtcaaagtatatggtgacaagcgtgagacgtttcgtcgccggcttcagttcaccagcaagaagacgctggtagatcaagccactccggcacggttcgaattcgttgacaatgaccacggcatgcaattcgtcaactggcgtagtttcagtggagagcgcgtaa

SEQ ID NO: 1987 - DNA, 2602 bp, Toxoplasma gondii
agagtgtggaaaacaaaatccggcacacaaactgagttgctccctaggcagggttcgagcgtcgcatccttgcaattctgtttggtacgcggacattgtgggaacgcgccgtatctcacaatcccggctttgaaaaaacatcatcaaagcatgcatacagttttgtatatgcgcggactggtttcttcaacctttcgttatgcgcgagtcgtactgcatgaaacattcttgttatcaaacgcaacctgtcactgaacaaggatttccagcacatggccaaaaacggcgtcgagtcgttgggctgcgcattcggagtcacagggcgtcgacgattactggcgtagagaaaggcggcgctgctcacgcacaaaaatagagactcatggagcttcggtacacagcgcggtgcaggccggagtcttgaaagggaaacgtgtgcgggcattaggctgtgtccgttctcaagaccgagaagctgtctgcatccctaaagcatattgcctgctcatctaaatctaggctgaagcatgctgtgttgggacctcgaaggcgtttgcttagtcgtcaacgacaaactgatgcactctgttggagtagtgaggtagtacacaccgaaagttcatcagtgactgccaccaaacgttctagttcggcaacatcatgaagacgacgcgcaactcaaattccacacgaatgcctgtgacgtctcgaacatccccgcagttcatggtatcagattgcccgtgattatcagttaccaaaacactcaacagtgtctaactaatgctcatcagccgcagcgactcggtggtgaagcgctggccggctagcgtactctcccaactgtcgattgcttgtagggaactaccgtgctagatgtgtgtgattttggtagcgcacagcaaacacttggaattttgatggggcagaagcatacgacttgcccaccattttagactgtttagtcgatacagcataggaaaacccatcgttgctctttggcaatctggacgttacgtggctgttcgtcccgggtggaagcaagcgtcccgcccgcagcgacgcttcctgctgcaaaatatcacattcctggttgcttcgtgaaccacaggaacattacggtctacgctatcgttttgagtctgaggaaatttcgccgggcttagatagcacacggcaccatctgcgttgccagggtctcctttgtcggaggaaaaaatgaaaacaaggggacatgactgattcaagcgtctgcgcctcctgccccacgcatcgtgtgctgtcgatgccgatggcatcattttgctgtgatggcttgcggcgggatggtacgtagtgtgttcgcggcgttaacaacgtcacacgcggatcctcttaagatctgctgttcttgagatggtggggcattccattctttgacggtgtaccgttttctgcgcttttgattctcagcattttgatgcaagagaaagttgatgtgtgcgagttggcatgtaacggcgtttggtcagctcctgaacggactgtgaccgttgtatttcatgatatcttcaaccccgataagcgggaggggcttgtgccactgctgcagagttcacttccatcaacggctgtatgcatgcagtcggttttaagaggaattggttgctccttagtggtggctgccaacacagaactctatcaagagaaacccaaaacgccactgtcagtccatgcacgaccactgtaacgtcagcgaatacgcccaaattcttggtgcgacataggcgccagacttcgaatcctagagcatgcctgggtcattcatgagtcgtacgtgcaagcaaggattgaaccgcaactaaagcacatacaggtcgctctgcttagaccaaaagcttggattacgaagtgcaacacggaagcacggacaacgcggagcatatcgtcagtttgtggcgactgtcgccgtgacgtcgcataagcagaaatgcagttcttggttcttggccatcgtctgactcacttgtatatcacatcccattagccctgcgacagaagaattgcttccttcctaccttttttgtcagtgtaaaacgcggagtcgtgtgtgcctccgctgaagaaaagctgaattcaggcgtacaggtgttgctcaccagcagtggacagtcgtccatcatcagaatgacgatcgagacgcgcggacggaaatgacagaaggcattccggctaaggccagtgtgacccaccagaatatgtcgcagcctccggtagtatttctttcatttagtcgatgtttttgcaatttcagcgttttgtaaggacgagaatttttctttttattgatagaatcaattgcgaggtcattgctttgtcgtgccttgatggcgtcacacggtctgccgaaccgccttccgtgcccccgcgcagagcgttttcattttaatgcggtttgggatatttttgccgcaaagtgaatgagcagacttattctagcgcctgaaatcgaggccctgcatcagggttgttccggacttatgtgggtagagtgggcaggaaagtcaattgcattctaagcgatctacagcagctgaaacgctataaatctgaatctgaaaga

SEQ ID NO: 1988 - DNA, 4520 bp, Toxoplasma gondii
catccacgtggatggtagcgcgttctctgtcgctgaaaagaactcggcgtgtaggtcaacaacttcctgagcactttccgaccacgaaagcgattgagtcacagccagcagcgagggaatcgccccgggaaagacaccttacggaagtgcgtcatcgactttttctttggcattctgagttcgagggagagactcgataacatgaagtgcactggaattgcgtgtgttgccaagtggcgagcaaggagtgcgagcacacacccgcacacacacacacacacagatccggtgcaatggcgccgtttcacattgtgactgccttggggaagtaccgccctatccacatgcaggttggacctttttcctttgtcgcctttcctttctcagtcttttgccacccctcttcacgttcctgtctcccgtgcatccgtttccggcctcccgcacccccgtcaacatgcctccctcaggatcctcctcttccccccgcatccgtgtgtcgctcttcggtcatcctttcgtctctttcgctgtcttagcgttattccgtccctctcttgcgcaggggatggttcacgaaggccttgtctcccaataccgccatgcagagagaagagcatctgactgaagacgtgccccgaaggaaaaccttacttgaatgtttgccagctgtgctttcctgccttgttctcttttggtgttctgtttgagaacaaggacgggaccctgtggacgaatcatggtggcgaggagtacggatcgaaacggcgctcaacgagcttgtagagtcggtgacggttttccacacttctttcgtggactctgactctggataaccccgcctttacagcaccccaaacatatgaaagtaataccgtcaggatgtctctttcagggcattacgaaccgactgcctctggcttcggggattcacggccggccgagtgtgtacaagagggaagactgtcgaaaaaaaacctcatgcaagaaaggagacggatatacgcagtgccattcactttccagtcaggagacagtatgacagagagtctaacagaattagggtgagtgctacggcgtgcacgtcgccgaatgaacaacaggaccagggaacacgagaagagaagtcgaagacagcactcgagatcgtgacacaaagggtggtgcctgtgtgtgggcagaggtgggaacgacagtggcgggcacgtcgttaacgacactctgaatcaaagtcgctagcaagtagtccagttagggagtctttcttcacagttttgcacatttagtgcccaaacactttgactggcggagatcaaggcttactaattttgccctccaattcgccggctaccagcgttggtaaggtcgagtgtggcgtgaaacacagcgttaatggtggttgcatgtgcgctgaagtttacggtctggctacgcaattttcgccgagaagttgcagagaaaggcggaagacggacgtactttgcagctactcgaaattacgttcaccgcaacacttttagcaacaatgttttctcgtttcctattattgtcggtgccagtgcacaacgggcgacacgtccgctcttaatcccggacagggagcatcttgttccggaactgacggaagtcaacacgtcttcaacgcaagtttccaactttgtcttgacagcattgagactgtagcatggttttttttgagattagagctcacgttcgcagcctgggaactgagtcgaaagattagtggtggcagaaccgagaaaaatctggtttactgtgtgtgccgccggacaacgaaattggtctttgtcctgttcagttgctcccgtacgatgcgtagacggaattgcaggagtgcgaacgctttcgggcaaagtatcaggatgattcgtattttggaaactcctaggcagcatatagacatgcaagttccagtgcaaaacggagggaacttggtctcttttctgcaaacacctgcgttttgctgtgaccggagcgtcatagcgactctgtctgacgctcgtgccgactccctgtacaatgcgcgaaatactgtattgaggtgctgactttagtgagatagttgatgaaatatagttaacaggtcactgtccacccgccgattcagagtagaggggaggtgtagatggacttgtacaacgtatgtgaaggtgtaaaagcattcaaaaattactttgctggagttatgctagacaaagccacacatatgttgacacgacatgcgtgtaggagtgatgttcgcgggggagcacgctgaatcgatagtcatctactattcaaaacttagtgatacagaacttctggatacttagtactccgctctccgcacgtcttccctaaacaacacatgacagtctgttccactttctctctaatttatgtaggtgctgcatacctgaaagactgccacaatgtacatacctgcaaggtcaaggtgtttttctgtagagaagagaggccccaaacatgcttgcacggctcaccttcgtttgtgattggagtgatagaaaacgagccaaaacgccgtttttctggatgaaacacttccaacagctctccgttacacagtgtaggtgggtgcagcaacgacaagacctctatccagacatctgattcggtagacatgctattcctcggagcctatcgaacggttcaaagtgctaaccttcttctgccggcagcccctggaagtaaaatgtaggcctctgggtcggcaaaaactggctacaaggcaaactagttatttatgtgttacgcaaacagcaaggaatcgctggtttacttataacacggcttgacgcatgagtttcctgggccgcatccctgggggaaattcatatgagtctcgagaaaatcctcacaactgttctttcgcttactgcttcaaagtcttctggtgaaggaatatgacaagcaggcgtgtgagaaaacgaaaattccagctccgctgctccggcgcagaagagtcccacaaacacagttatgatcgcaaaatagtaacccatggcttcgcccactcaacatgaagaaaacacttaaggaaccatgttttatcccagcatacgccttcggctagagaggcagatcacgatggaaactgacagaatgcatgctgtggatggtgttacactgacagttgtactgtacgtacagtagggctgggaggcaagtcagatcccgagcacatttactgttttcattccccctcactcaacgtgaaaaaacattcagaatacggacggtaccgtggggttgacgccctttcagcaataaacccgcaagaaaaggggaagcgtaccccaatctcgccccagggctacacaccttcttagatatgttcgaatagaattgccgatatcggcaaatggaggagtaatgcgctccaatattcccacaggaggcacacgcaaacagagatagtggaacgcttggcgacagatacggaatgaagaacatgagatcgtagtgtactacatttgagattgtcccgatgacggcgaggccgagcccggggcttgcgcatattgagcacgttgatagctgactacagaaacactaattcaaggacactcattccttgctgaatttccataaggaacatgctgtgcgttcttacgtatgtatcgtcggtcaagcggaggtcagacttgtagccccctggcagcttgctggcctgtggtgaccagctcatcgtggtcctgccttgccgcatgcagttgtaaccggctggccgaaaagtcgtagactgctcgcatccgctgatctgcccattttacactctttcaaagcacagtttacatccagatacaacgtacacaaataacgggcagccttcttttggtgagtaagccttacgttgagcactgctgatttgtgatcgtcgttcgtatgatccacctctacggcgatttgcctgcttccacccatggcgtctgtcaactcgaatttgccgttaagaaatgcgttgtcggcctgactgcaattcattaggcgtgtatcgttaactggactgtcaccaactgtgcatgcatcaagtgccctggagtgtggatgcgtcctttgatctttggtcctgagccacccgcgccccagcaactgtcacatggctcatccagctgtggtcgtgctgcaatttgcctctgcttcttgttgcggaatccgccagtggaaggtggaaagtttaacctttgtatacaagtgttgctctccgactggattcaggagctgcgagaaaccaccactccgtttgttacaggccgttgaacgagacgttggacaacccgcggcttggtggaaggcaccctgtgtcttatatccttacagcagctgagccttctatatcagcatgctccgcaagcgctctacactcgtgacgtagtcagggatcagatgacacctgattaatgtcgcgttttggcgtggtgcaagacccggtccaagaaacagacctcattcgtgtgtagaaggttttgtatgttcggcatcccctttttccataa

SEQ ID NO: 1989 - DNA, 1609 bp, Toxoplasma gondii
ctcctcgtccacaatgatggccactctgtcgtcaagatgtgaatagcctgacatatccaattctcgacctgcttgccctccatttgattccgatgtgacgggccaagcggtgacacggaaacacagccgcgaaattttctatccacctcttcatcagcgtgtgatgcagaggtgacactccagtgagcatcttctgatggcgcttgcgcagaataccactcggcatcattctgacagcttgctctctcgctgggaggcaccacaagagaagccacatggactcccatacagcaatcccgaccggaccgctccgagggggaatagcttgagtttccatcatcgatttctggttgagaggttctgcattgctgcatgcattggtcacggccaagtcgcacgccaatgacacggaatgtgttactactggcagtgtcagcgggtttggccatggtccactgtggtttacaaactcagttatttagatgctccagccagccgcgctccattgaaaacactcctcagggaaagctgcctacgtgcccgtccgcggccaagcaactggatctggcaatgaatcgggccgaaagtacgcattcctgggaggaaccaccactgcgtgcatttcacgacgcgcgggcggtgggtatgtttgccccttgcgcaatctgagcaaacacagcgtagagcgttgtcgagttttttgtggtcggtacgggattcaggaaggaaagaatgcggtgatatcaccatggtctcaataagcctctgtcccgactccaggtcggcttgtgcagaccgttatcacagacgcacgcagtcgtatgctaacgaagatctctgtttctggaaaaatgagttacagccttcggtgcacggtcgggcacaacagggctacacagagggaaggatgacaaggtgccggcaagaaacaagtctttgtggagtagtgcacgaatgcagctcaaaacagtgatcccagactcataaccagagcaaagatatagggcagttgagtcctctgcctcaacaaattcagatgaaggtggttggcggcgtgcccgagattgccttgcacaaatgtctaaccgcaagtagaagatctgtacatgcacgcagatgctctacgcactagagcgtcgacacaagaacggcgcatggagagtgcactccgttcttaacaggaacctgaaatagaagggaaatacagtggtaagtagcgcgccatagctgtgagtaagtttcaaaagtttttatttcagttgttttctgggcatctctacgtctgcaacgcgattgtctctgcgagcggtgaacaagcgcatgcgagagactggggcattgaatgtgaatcgatgcacctgcacagcttttcgccagcgctatttctagcgactggacatggtcatgtgacaacacggcatcgactcagatgggagtgagaaagatgcaaacaggtgctgaaaaaacaccacttaatagaggagacaaaccccggtggagaaagcgaaacgagactggaacggcaacgaaatagagaagacacagccccaaactcccgacagcgtgttgctctgtcgggcaggcaggccaagctggcaagccgctagca

SEQ ID NO: 1990 - DNA, 1887 bp, Toxoplasma gondii
cgacacgaaagtacaaaggttttccacgaaagccgtctgaggaatcaactgcaggaacacaagctcctctctgacaacagaacaactcgacgccacacacgaaacagtggacggcggatctacacctggctgcttccccaatctcttcctggctctctacatgaggcgtgcttgaaaggggaggcaggcacctctagcgatgtcaagaagcaaagacaacatcaactggagagccctgaggtacttgttctgcggcgaatctaacgagacggtttgcgcagaagagttgctgtgcaaaaaaaactcttcatgctgtagacacaaagtccttcactcccgtgaagttctgttactgcagtacatccgacactaccatcatactagagtactttttaaaaacgactccggctctttcgtccttcgacgctgagacgtcgtgactccgccacttttgttcgcgtcttgtatcctattcactcccttcagagtgccgagaacggacttgaagaacgcgcggcacactgccatgaaccttttgggaggactaagaggttcaatcgccgccttccgctcatctacagttccatttgttctaaaaaactgcgaacgaggggacggaaggacacttttttgagtacttaacactttttcagctgtctttagtggtctcctggggtggtggcgtacaacagtcataaagaactccgttatcggtatctcagcaatcacaacaagcatcgctgtctgtgttccgtagaaactggagacgtatgtcgtactccaggtacttcgaagtctctgtttattcgattgaagttgagttctaaaccaggagtccagttcgcagcttacactccccagaagaaatacgtctccggaaacctgagaagcccacttgataatgtgtaattacaaggaaggtgtagctgtctctatagagttctggaggggggaacccgtagtgttctgcatttagtgggggcctcgacatcggtgtggttgtttcttctgttctacaaacgatgaggtttctgccattaactcctcgaacgtgtggtgtccagcagtttcacgcaccagaacgatgttacccaagattcttcgttgaatttgagttgagtagccgactgtgaacttgaaagggcgcaaggtcctgtcgcgactcacttgaacatccggaagcctctacttttgaccagcatgcacgcgcattgtgtcgcgaactgttctctgtgactgacggggcaaatttcacctcccgtgagttgcgcagacatgctagatggggtccgcggcagtgcaacagacaaaatcggaaagttcctcgaaaacagcacttgccccccaggaaaagcgatccagaccgagatttttgcggcggttgtaccaccaccacctgtggctgtcccagctcaggctgttgcatgtctgcagggaaaaagcaggcgccgtttccgcgttgctcctgcctccttctgtttgcgaaatctgcgcctctttgacagctcttttctgtcggtttgtgaggatgccgcgagtcgggagttagttcccgtggtgccggatccacatttttctcaggtccgttttccgggcgggcgccactttcgagtttcagcttgcgtctcactagcttttttttcgtcgtcttctctcgcgcctctacgcttttttctccacttcctgcatgactcgaggaaaactctcccgtcgaatgtatgtctcctctttcgtaggtctcctcagctgtctgacgaacccccaaatgggttctgccttcccgtttcgcgcgcgttcagtgtgcactccttttcgcacttgattctggagcgagtgtctttttctccagctgtttccttctctcttcgtcttaattgtccgtcacaa

SEQ ID NO: 1991 - DNA, 2495 bp, Toxoplasma gondii
cctcaaatgttcaagacagaatggcacgaacattttgttcagtaccagatggggtcgggtaggcacaggtgcgaccgagagtaaacaaagtacaagaaacgggggtggcacattaagactgcagcaaaaagtggcaggaaaaacatgaaccaaaatgtaactctctgggatccgaaagcaggcatggaacgccatgaaactgagaagcggcaacgctccaagatcagagatctcggtggtaaaggactgtcattggcgccgctagggcaaccgtccaaagtagcaagtattgtatagcatcatgtcttgttgcgaggccgcatgtacataaatacgtatataatatcaggggcaaatcatcgaaaggaaacaaaacggcaaccaactcacccacaattgcctcaacgcgcacaaaacgcattcacacatatattcacagttgacaatcatattcagttgtaccatctatagcagattctggccctgctgaggtagtggaaaggatgcgatgaatgctcagtcacgtggtgttaccaccaatcggaacagcacagtactctctgtcgaatcgagcgcccactcgccccgagactgcatgccacatgcttttcctacagctcttccgaatcataaattgcctaccgtcatttctctggtgccgctacatacctgcggatgcactggttatgacgcctcccttctttgccactcgtttcgcgacctcttcatcgctgctgtcgtcctcgctgctggatgacgaatcagccttggatggtacaggcttctttggggcaccctttgcactggcaggcgcgccagcggcacccttctttcctttctgaaccttcatctgttgttcttcttcactggaatcggagtcgtcgctgtcgctggcaggacgagccacagctacgggggcagcctttctctgtgaacgtcaaagcgcacattgtccccaaaaaggctcaagggaaaaagaaacggaaagtttagtcatccatggtcactatataggtgtttactgcaccaggatgtcgctaaactgcggagacacggtgacttttgtcggtggcatgctacacttatgtggggttgtttcccaagtcgcggggagcgcagctgcgaaaacccagtcgccaaacccgtgagatacctatgtctcagaagttgcacgcacataccgtttgtcaagacagccaccttttgacattcctactcctccatattatttatcaactaaaaactaactgtcgcatgacgtcgttcggtggctcccgttggcagctgcgaaaatttcttcgttcccaagagtcgcacagcggcattggtggtctgactaaaggagccgtccaaattacgcccagtcttaccttcattcttcgtctatgaatgggtgactgtcaaaatattgcgtaggtccgagcgggggaaagatatgacgaaccccacaccgctttagtcgacacctatcacgcggcagaaacgcgtgaaacaaccaactcaagagtgggaaggcagcgaaacgacggtacggactctcgtgcgaaccaaaaggttccagactgaggaagtgggcaagtgtgacaacaagtttgccgaataataatcctccaccactgtggcgatggcaggagcgacgataagaactagtgtccacgccctcgcaactccttccgagaacgcgcatctggggacgccatcgcgcttagtggcaatgtcggtctcttgcagaaccgctgctgcctcgggtttctcctattataagccgggttgattgggctcgatttaatttatgtccggcggtaccctttcaggcaccaatcgtcgtgcggtggtggttcgccacgagcgccttaaaggaggcgatgtcaagagtacaccgggttcgagccacgtgttttgaccgagaactcgttgggggtcttggagtacctggaatacgaagttccaatcaacagtggtgcgatggcgcagaatggcttttttctgaaggtattctgtatttattcgggagggatgaattgtcgaggggcattcccggatgccagcccgcttctgaaagctgctgctcagatgaggcccaagagtcgagaccgttgagtagctgccggtgccgcattcagcggagaggttattagtgtggtgatctggcaaattggagggcagggacaaattcactgtcatggttaattcgcagtcgggagactgataacatgttgtccgtattgggttggagtggtggatcttggacaaataacagtttggagtcaaggtcttgtgcatgagagctagcacttccggcgggcagggacgcctcgatatttcgggcaaaagaaaactgtggctccactcgcgcccgcctgcatgtctgcctctagtttttaagaatcagtgcacacccaactgcggaatatgatctccacacagctggacaggactccatcatcgccactacctctatacatcctcattttccggttcagcccttgccgcca

SEQ ID NO: 1992 - DNA, 1469 bp, Toxoplasma gondii
ctctgtactctgcggttgatgaactatttaaacagctagagttactgtttcctcaaacttttggttcccccgagtggagaatgtagctcgtccccaactttaacgtttgaagtcctcttgagtttattgatctgcttccactcctgccagcctgtgtgcgtacactatgtgcctctctttattattggcttttctgtttcctatgtcagctgaatttgtgtaggcaggcttgtgtcacttcaaatgagccatggtcgattgttagcgatgacggcaaatgctcgagccatgaagagttgctgacaatccctccacatgacacagacgtagcgcgcatcttcagggaaggctgctgtggcatgttcaatacattggcacgggacgggacggatagaattatcctttcttgctagggacgcaggcgctgaaatcaattctgtgaacgaccgataaacaaaggctcccaagggttggtcctgtttacagcagctacatacgataccgcatcgaatcacaatgataatacatgagcaaggacacgtaatgggcttcagggaaccggaaaaatacgagacaccgacagcgaacaacaggtaccaacagtccccgtttttcatcgagtaccagttcctctacaacgacatactcctaaaacagctctcatgattcataatcactttcctcgcgaactagacagggggaatccagtgggattagtcggttacgacaaacggcgtaaaatcatagactgacgatggtttgtgttcttcgaacacggtaactcctgctgtgaatatggcatgcatgttgacggcacatttcaggaattggtcattagttagctctccagcaatggccatgattcttgagtaatctagtaccggagcttaaaataagaccgtggtttctcttgttgcgccatgaatcgggaagtctccagttgtcttgcaggggcaaaatgtaagcccgcagtcatgcatgacggtgaggcaatgcagactgaccacacatcagtttctctatcgagtaaaacacctgtagctttgatgtgctttctcatgctatggaagatacacttcaattcaaggagcaaagttacgcgagcaacgcatgcgcgatctttcatctaagctacccgtggctacacacgagctgaaggaaaaacgatgtccgaacttcttgatttgacggtgtattcactcatgcagatacacggctgacaagaacaggccaaatgaaggcgtctgcctatcggaaaaggcgcaaacaaattcgtgaattgactctgttgcatgccgctgttcatgtttgcatgcgtcagaaaacgtcggacaatggattcttcgtttgagatgtgccgctcatttctcactgccaccccgatgtgtttgtgtctcccacagcttggcagattctggcaacattcgggggggaaaatgtctttcgttttttcgtcaacgtcgctctaa

SEQ ID NO: 1993 - DNA, 1838 bp, Toxoplasma gondii
atttcccaggcatgtaggtacctaaggaatcaagaactcatgtttctcgtaggaccagcaagtataattgtcagagctcagaagtacgcctttgcgtatctccccctcgatcgagaggtatcatctgatatgctcaaatctgcattcatgcgttcagttgcatgtgtccatgcatgcgggacttctgtgttatctcgtctggcgcagccactcagtggtctcaggaggttttcgctttgctctcggtcctcagtttgatctcaaccatatcaaccgtcagcaggtaggcgattatctgcacgcagcgtccatagtttcaatgttcaaattcatatctgcccgttcattcacttggaaagttcctcctccgtctcgtgtcacgacttcagtcgttatggtgtccattcgctctctccatatatgtatctatgtatcgtgtcgttttggtccgtctcgcttttatccgttatctagctgtgttttcttttcttccttcctcgttgtcgttctcgctccttcgtttgctgtcccatcgcatgcactcatattgatggctgcctgcaactctctttgtgcagtacgaggagtacggaacgtcgtttctcgagcgattcagcgtcagaggtcgtctgagatgagtcgcgcggtgcgcccccaacgcagagaattcggaaaccatccgatgttcaaatatgtggaggtggaaatatgaaaacaaacatatgtcgaagtccttgaacgtcagcgcatacctacacaggcaaatatatatatatatatatgcatatatatatatatatatatgagtgtgtggatgtgcatgtctatgtcgggatagatccatgctggtgcgacagcctaaacagacgaaatcattcgatgtgcacacctatgtaggtcatcctgtcaggaaaatatgattcgaagtttgagggaaatgaagcgcctatggcgatgtagcatttttaggcgcatgcgagttttttgtgctacaactggcactgcctgcctcatctcatttgtcgatcactcgggcgaaaccatcgtccggctttcaaaacgctgaaatacaacgcactgatcgaagacccacagtcactacgtgatgtgcccatgcgggggacggagggtagagatacaacacctggctagtattatagatgggccaccaaaaatccctgttttcttcagtcacgaatttaatacagatgcccatgggttcccacggctgagagattgttaaaatggaagacaaacgaatttggctgatgttctctccagacgttgaccctccattgttcgcacccacaccgtgtcgctttcaccgcgtctgtcggagcaactgaaatcccaaacctggagagatgattggtctgaaccagctcggtatctcattttctaaacagcaacaccggatgaaagaagcagcaccaggtcgcccgtgactacccagccacatcgccgtgtatataggcgccgtgtataacgatatctgttttagtacgtgtagggatgtatatctacgcctactcatgcggtgtatatgcactagagcacgaggcgtggttttgccagttctgtactgtcctcgaaccggcttttacccacccgtaacgattaccgggtgtcccacagtcttacatgcatttgacggattcttgcaataagtttttaaaggttcgcgtcgatttcgacagctcgctaccaagaggtccaaggtcaattcgtgctcctctgatagcagtttcatcgaaacgtggaatggcgccacgaatcttccgtgtccaggcatcaatttgcgacggcttcggcgacgctccgctcgcgctgaggtgcca

SEQ ID NO: 1994 - DNA, 1896 bp, Toxoplasma gondii
ttgaatcggctaatgcgaggagtgacactgtggttactccactccacatcggtcgttttctagcggcgatgtcttttgactgctggcatcacttgagaatttctgcttcctacagcatcaaggtctttccacctcagtttcgttttgcggctgactcaatgtgtatcagggttgtcacccgtgtttatggcgagagacaattcaccattgtgtagcgcggtttctttccacgcaccatgttcaggcaccgatttcgactcttctctctggagttcctttcacatcttctggtctccgctctgtacctctcagcaacgggggccgttgcttcttgcgtgttttttctctgcgctaaaggcgacgatcatcgctgctactcttgcgcgacagcccttcgcctttgtccaaggtgccattcccatcctgttgctccttctctaactagatgttgagcgctaaccaatgcaccaggtgcttttgaggtacttcacatcttcactgtagcgtctatatatactgtagaagcatcctgcgcagtggctagccctcaacatgtagttagagaaggactctgtacggatgactttcgcctcaccaattcgacttgtaaactacgcaacggtcaggtgtaaacgcagcttcgtttcggtccctctaattctatctcatttcttctcttcctcgcccttcatctctgagctgtggaacagctggcgtttccgtcgaagtctaagtttctcccccgagcagccggataccaccgtactggatgcagtacacctgatggtcacgacagacacaggaggacgtaaactcggtgagcaaggaatttcattatctgatccattagtccaactcgtatgaaataatccaccgaagaagctttccacttcatgacagactcaaacccgctaggttaaatctttgcgaggaaaaacactcacggacgccggggttcacagacccgagacctggcggggaacgaggtccgttttcgtctttatgagaatgcgaaacgcgaagaaaatgagagattctgtgatgaacttggatttcccgagagttccgatggccgaggactcacggatccgtcctggtgatatacgcgcgttccttcgacatgtgcatgcagtctactatttcgccggttcacacagcgcgtcgtcaaagacacggcaaattcccggctaaatctgaccagaaatcgagtgagaatgcggatctttttaagcgaatcttaagcatctattggtgacttgtgtttggatgtacagggagtacgcatcgccagcagaactagactcggtgtcgccgtcgcgtaccgtttttgatgggattcggctgctggtgctgttgccttttggggtcttccgtatccccgtttatggatgcacccacgctgcatgcttcgtctttctttgaactccagtcgtccctctttctgtattctgcttcttcgtcttcggatccccgcgggttcctctgcatgcacactttgtgtttctttgtcattttctcctccccgtttctccgtctccccaggcccttgaggagtcgagtgactcttatcttaacgcatcatgcagtcctccgtttttcctaaggcgccacaaaattgttctccgcatccagttgccttacaaattgttcctgttccttgtcgctgctctctcggctctccgcgttgcatctagtcgccccgccttcctggagaaacgcagacccggtttcgcctccttttatctaccggcgcttccctctctggtgtccagctccatcgtttctcctcgtttcttgtctctccgtcgtcttggcattgctctctgctgttgcggaacttccactacgtgaaacgtccaggggacaaggcgcgaacagcgaaaaacgaggagagaa

SEQ ID NO: 1995 - DNA, 978 bp, Toxoplasma gondii
tgcttgtccagcaacgatgtctccagaaacaacataaatgaagcgtgcatgcaaaaaatgcgttctttgtgtccgagactttcctggacaaagacatcctgtctgttcctttcagtcctcctctcctgaacagttctctctgattctctgggcttctgtcttcgcttcactcagtcactctctttctctctagcttctcctctctcactctacttatctgtcaccacaactctctttctctctctttctccctccctttttcccctctgtttgtcgcttcgcttcgactctgagccgcgtgtctgttccagcttcctccgcttaacttccttcttccgcgtttccagggtgcgtacactccagtttttcctccacattctgagcgagagagtccagctttccttggtcttctcagtgcaaaaatacattgacgctcgcaagacagctgacggggagattctcgcagagtggctctacgagtaaacaacacgcatacgtgaccgactttcctgtttgaagctgcttctgattcggtggataagcaagttcctttgtctttcgttacggcgcgaaaaaacggcaaccgcctctcctgcttcgtcgcgcctacagagagcgagtgcttccctcggtcagacgcgaccaaatccagttccgcgccgataaagaagaaccacagatccgttgtctctgaacggaaaagctggaagaatgaagaagatggttttcaggtctcctagcttgcttcctgatcctccaaatgggctctgggcaccgttggggacgcgacggacgttggacatggcactgaaaagaaaagggagactcgcaccttgtcgacaaacggcgctgcatctcagttctcttgtaaaacttctcttataaaaccagctgcatgcgtctgtacgttttctgacgtctgggtgttccaagaattatttcactgcggagctttttccgcggcgagacgcaccgaga

SEQ ID NO: 1996 - DNA, 4651 bp, Toxoplasma gondii
acagaaaggaggagtgactcgaatgggatggcttgaagaagaaaggacttgcttttttacagccttttcatgacctactcgagagccggggcctttcttcggaggcgcggcggcattgcctcctccatggattctggatgagaacgtatcggcttgtcgcagcagttccctcagtttcgcctcgagttctgcatttgcgaggccgtattctccggagtgtctttccgcctgcgtgaaggtgtgcgtctcgtcttcaccttcgcgcagaccttcttcttcttcgtcttccttctcctcttcttcgtcctcctcttcttcctcggcctcgggagtctcttgcccgtcccccgtcggcttgttcccgggagacaggtcgtccacgttgattcgcctgtctgaagaaagttcgctctcgacactgcctggcttgttcgccgccacactcacgtcgaccgacgccgcgctcttctccttctccccctcaggaggagaggaagactcagttgcggtattcatgaggagagctgcgaaaaaagacgaggtcgggggtgcaaaagtccagaaaacgtcgcggagacgaaaagacttgcggcggctagaatggcgcctgaagtgatgacggctgtcggaagagaaaacagcagagtgcgagacgagcagcgagtttcggaccgcaaggaaagggagatacacgagaaaggagccgctggagaatagcagcgttaaaaaagtccagaaaaaaagaacgctcccttcggctggacgacctccggaagagaagatcccaaccagcagggggacgcgacccctctgggagcgcggagacggacgggggcgcgagagtctctcaggcgaattttggttttcccctttgagaaaagaaagaaaaaacggcgctgaagaagagcggaaattcgaaaacagccaggacgcatctaaacctctcccagatcctcgagggaagccacgcttgcggccggagcgccgcggcaagaggcggactttttctccctctcagtatctcgccttcgaccttcctctcctagttctgctgcgctttcagcggtttctgcaagaaagagaaaaatcaacaggggaatgtctcacgacggacttgcacgagccgccgcccgagtccgggtcctctccgtgagacggaagcgatagagaatgcaaagcaggacagcagaagcgagagccgagcggcagtgtctccctcggatctgcgcagaaaaatagttcctttctctgcttctcctcacacgaaaaaagcgggagaaaaaggcagcgcgtctgggagcatgcaacaccgtgtgcggtgcgagtgtgttgttccccccctgcacagagcgagaggcagagtctcgcgactcgggagcctctgtgtttgaaggcgaggcgcgggaagaaatacgaactaataggcgagttcgtttttcactcttgtgctgaatctgctcggaaaaaccgaccggtacgcgctccggggtgtgattggatagcagcgcgagaacctctggggaacacacacagacagaccctccacagaagaaagacgcataggaccgtgtttcaagacaaaagtgtgaagaggagggagcttgtcgttaggctttcgctgaaaaccgcggccggaacgaaaacaagcagacagacgaaggcctgcagtgaaaggaaaagcgtgcgaagacgcgtctgtccgaaattgttcgcttacgccaggggggtccgtgtatggcgagacttctgtcagtgaaaaacagaggcttcgtcgcttctgaaacgaattccacctctcacgtctgcgtagaaatccttgactgggccgcgttgcttgtggcatacggggtcttcgttcgcttttccctccgtcaagtgttgttggtcagtcgacgtcggaactcaggtccaagcaagaaagcggctcggtacctctatgtgtgtctatatctttgaattctacacaagccgcatcgaatcctagccatgcattcaacaatcctggtggttaaatatggcgaagagcttgtacgcgcatgccaccgacggggctgtctgcactccagccagagacgaaccgagtcggtagtttctccgtcctgtgtttatctagctagaggccaacatgttggcggaatgtacagaggaaatggtgacattcttttaccaatttctctctgggtggttagaaagttgtttaagccgtaacgcgacctcctcgtttccccagtgccattagcttctcttggggtcgctcgcagtatctgttctacatccgataaggatcccggttggacatgtgccctccataaagaactggccagatgggtctaagtcattttggggctcctgatttggattcagtggagaacttgctgttcacagttttcctatagtagcctcacctccattaacctcttaggtgaatgtgtctctactatggggtcttgtgcaggaggtaaaagctgctgcttttagcgtgatcgtattttcttcacagctcttatgctcgtatctactttgaccacgctcttaacaggcgacttcgttaggagtccacgagatttacgactcaatcctctgtggacactggcggccgtgtatgctgtcagcatctcttctgtttctctgtacattcagaagtctaaacacgaagtttcctttgttatgtgggggctttctaactctgtctactcatttacggcgagtgccctccgttgtccagctgtggtagtagctgtggcttgtgatattctcctgtcggatctcgcgtgaggcctctcaaaaagaggatgatcttcactcctgaagtcgagacgcgaccgtacttcacaggagtgacaatgatatggtcggtcgctattccgacatatactaggaccttgacgcaagattccacgcaccaagacccccgcaaggcgtctaaagagagggtggagaaaaagcgagagcaagagagacagagaaaagatgatggcgaactggcgataggcaaaaagcaactacaccggcggacggagaaaccggaaaacttgatatttctgtgccagacagacgcatgcccttaggcctgggtttccttcagaagcttcgctgcactggctgccgcgcagcgcctttgaagtgtagtcaggcgcgcttggcaagcatagaagcttgtggacgtggaaacaggaaactgtgttaggactttgcagcaaagcgcaagcaatgcacaagtacgcgagacggtgctttccagaacagataccgctgctcggagtcgtgaatcttctacactccagtacactctacaccactcgacccgttcggaccgcaacaacacactgttccgccaaagttttcctagcgcagtggtgacaggtatccctcctaaaactgctatttcgttagcggttccgtcacccttgactgctcgaggccttttgcatgagaagttaacggcgcaatgtcgccaaggaacactctggatggctctccgatgtcgtgaaagaattgaggaagtcaaaaactggcgacgtacctgcaacgcaacagacagcttctcctccgccagtccccctcatgcaaacagttttctgtctaccgacgccttgcaggaacaaacggaaaaaacatttgtggtctgaccggagatcctttctcgtgtcgtttccttccgagacaggaagagacaggaagatgacaacagctttgtgtagacatgacagtcttcctttttctttgtttgggtggctcatctgtcctgtgttcctagctgcctcgcctagatgcccccgaaaagcagaggaagacgcgcttcgacggaaaggcctttgcgccttcagaacgaacgaaaacaggagtgaagtcactggaagatcacttctgcctctccgactcagacagttgccttctggctcgaacgcatgctcgccgttgcaaagctcagcgcggcgataaactggagacaccgcgcggcgctggatccgcctgtctcttcttctcttctttaccatgccgggagagcgcgtcttttccaactgcttcttcccccgtctcctccgccgcaaaaatctgcggcgcgacccaaaacgacgtggaaacgcgcatgcgacaattgctgcctcttcgttccccgcgggagttcgtcttttcctcgttttcgcagagcggatccccccaagagaagtggaatagccgcgactccccgcggtgacgcatctgctgtcttcacccgactgcgtctggcccatgcgaagagtcttcttgctccactccagaccttctcaacagagcgttatcttctaaacgaaggactggacaagaaagctcttcctccggcgcctttttcctggacggcggagtccatcccacggtgccgttgccgagcctctgcatctatattggcttcccctgtggttcttctgtgttgttccacgcaaaccgaggtccaggagcgactcttcctcaactctggacgcaccttgactcctccatgcgtccgtagagattctggagaggcaacggactgagtttccttctccaggaccgaggaaacgcagcgagtctgcgtagacgcttctctctctctctttctctctcgcggggacttgctccggaagtttaagaaacagactcgcgcaactcgagaactcacaggaaagaacga

SEQ ID NO: 1997 - DNA, 2246 bp, Toxoplasma gondii
cgtcttgcgcagcatctgcaacaaccgctgacgcgtacgctacggatagggtggttcatcatccacctgcatatccatttgccgaatgtgtttcttcacgcaggctcagccattggctcgagactccgtgctggtcgcaaccggttacacattgagcctctcaactgaatgcaagagtctgcttcttgcatactgtggctatcactgcagctcgaccaagcgaggactcactatcagttatctgttaagaattgccacaacccccagtgtggggctttcctgtccacgtggacaaaccggcaagtattttggaaaacgctttccacggcctatgcacatttattcgctcgtggaactccagttttcaagtttttgatttatcccgtgtaccccattagtaaaatcctacacggacagctctcgtggtcgtaatcgtttctcacatctcgagtgtgtgtggtgctatgcttgtggcaagaaggcaccggttcgctctgtacagcccgaagccagtcgtcaaaacgcagcaccaatgctgccaccgtggggatagcccatcaggcagatcttctggggcttacctaatggatttcagggaaaacgttctgtataatatggaagagttgtggaggagtgtaccgtagtgtaggcatgtgtgtaggaggcacacgtcttaagtcatttgttgcacatttacgccgctcctcagtgccacgagcacaccagtgttcacgcagcatttcctgctcccctgtccgtccagaggtaccactgtttttaaagctggcgtggcactttccgcttagtccatgatactttcggctcgctgcgtcgaaccggttgcgaagtatttccttgccagcagaaaagtactacctgctcactgggtcgaagaaggatccgcggcgagtctagtcggtttattgtattcgtattccagagacggtatcaagaacgaggtgggacaacggtcttctgtattgtttggtcctctcgaaaggaccattagatggtttctcgtactgcaccggtatttgcctgtccgagtggcgcgtcgttggcgcctcgagtcatttttttcctgctccagatatgcacctcttcgtcaaagaaacacaatcccgacacatgcatttgttgaagacctgaaagtattccttttcaaaactacctaccaagacccatgttcagagggctgcatctctagttagcttcatagatcccgtaagcgtctctcaaagcagttgaaaaccattggcgcgcaaggtacgtgccagcacttttttggcaaacggaatcttctctgtgaaggccgcgtacgccaaaagattagtcgagaaattgatatgtagaaacgtgtcgcagaagttgtattacgatgcagtggtcacccttcgtctgccgcgctcgctggactgcagccacatgctgtcaaggaacgtggtgggagcggaagtggtgcatctttgcgtttctcaacagcatatgagaatttagtcagaatggtgattcacgcgctttcgccatttgaactcacgttaactcacagccacaaccattttctggacatgtgcatcagtatgcactggcacacgagatatgaacacatttgtttggatgtcagcgcgttccctctatcgacatccgcggggtcgaccctgttccgggtttcgtcaaggggttcgccgtccctaacaccgttgtattgcaaacattttgagtgactgtcatgtattttcacgagaacttggcttcgcatgctatgccttgactattctgtattttgacaaaatatggtgacgacaaaaccggtttgttgcaggatggtacctcgatggcttgacagggaatctcattcattcgggagcgcttgaccccaaatcaaacaaagcttctcttccgctttgtcggtgccactccaaatattcgagcgacatggtatgcgtctccgtttcctctcctcaaagacgcgctttttttgctgagcattgagccgcctttgttggcggacgaagggcatgcactttccagggcttcgtctggttcttccctttacaacgcccactttaggcagctagcatatgcttgatgatctgcgaggacgtggaatcgcgtcgcttttacaaggacctccgaacagaatgcctttttcttggtttttataacttgcgactcacgaggtgaccgctgaccccgcgtcagcaacgaacccgctctcaatggtgctgtgtccgcttggtgcgcaa

SEQ ID NO: 1998 - DNA, 4333 bp, Toxoplasma gondii
gacttatttcctacaaaagacgtagaaggctattttcaagttattcccgattttatttcaatttgtgtccaatttttaaaactctcttgggggagaaccacgacttctctgttctcaacggccagaggagactgtgtccggagagtcctcgcctgccgactcgaggtttgtgttttttctctgtttgcttctcaggcatatgaaacatgcacgcggaaatccctcgccgacccgagagcacctttgccgactgtcttcgtcgactttcaaccgcccaagaaccgcgcgaactaacgcgaaaaaaggagagaaaaagagtccccaactctctccagagcgaagagttgccaaaggaaacagaaactcgaaaaaaagacacaaaacatatccccttcatcgaaggacagtcctctgctcatatacgtacgtatatagatgtacatgcatttattcagatatatgcatgcatatgtatgtgtgtatccagtatacagacagacgctgagctatagcgacttcaacgttacagcattcttgcacatctacatacatatctatatatcaatatacatatatatatatatatacatatgtattggtatatgtggagaaggatctggggaaatatggagaatgaaatgtgtgaatgcctctctgtatgtttgcgactacttgtccttttattcgtggtggactttcgtggaagttcaggcaggtggacgactgatgactgtttcttgtgaccatgcgcatctcgcgtttgtcgctatcgccacaccgtgttttttcgaggtcggttgacagcgcgggaacaagaaaggcgaaagaaagttttttagaccttaggaagttgattaaaaggtcgagacgttcgttgatagaagcgccttgtgcctttgctgaagcggcgcggggtgtctcccattccaggccttttctgtgtgtcggaacgttgttctgtggctgattgagacagagggaacgctgaaggcagaaagctatttatttctggagagagaacccagacgtaatctcaagaatttcagtatgcgtgtgcgtcgacttgctcgtcaagtgcactttttctttccacttgagtcgagtaggaagagttctgatgcgcgtcacttgaacagacagagacgcgccggcccagatgctgtctgatgggtcagcaggggaggactgtaaacctctggaacgtcgcgttcatcggatcaaagtcgctctgcaggcatgtcacctgaaccttcttttactttcaagtttcttcagtcccgccacgcttgagacactttggccggcgagaaacgaaggctgttcacttctgcgtgttcctgaaaaacatttaaggaaagcactgcaaagtgatgtcgctgtgacgtttgtttgggagatgtctccaaatgcgatagattgcaccgcgaggaagcggggaaaaagagcaggttctctgtctttcgagaaacgtttcgatgaaacttctaagcgacacagcttctctggaacaacttgcagcccagcgctgtgcacaaggtaccacagagaggcacatggaaggtcacagaagacggggaagagaacagtcggagaacaggagacacacatcagttcttttttatcagattcggcgggttcctcgaaacagacgacgaacgactgctgtcgagagagccgccacttaatgcacctaatgcgcagaacccttgaggtgatctctccgtgaacgatggagaggtgaggccttccttctgcattctgtttctcgaaactatcctcgtacttggaggaaccttgttcgagacaggattcctagtaaccgtttattgagaggacatactcgagttggacttctggtataggtcttggaacagtgttccagcagaagtccgtttgaaggggaagtatcttttgaggtctgcggctgaattctgtgggaattcttccgagcccaaaaagcagactaccacaaagtctctttccagaaaaaggattttacaaaccatgtctgcgtccgactcgagagacagacaaagtgccttgtgttctcgggtcccctttcctttctcttcttctctcttgtctcccctgctttccttcctcccttctcctttccaaggtctcctgcaataagtaaatcgacatctctaggagatccccgtttgcaaaattccagaatcccacctctctgtaagtacgtgctggacaacgcacaaatacatctccgtttttccttcgaagtgcaaagggatgtatctactagcctcatggagacacttatcagtgtggccttgaaataaattagttgcaacagagaaagatgcacaggtgtagtatgaggcaagtgtgacggagccaagtccgttgctttgctgctgacagttggtcggtctacattattccatgatgtcggcggattctggggtgctgccgagcgttttcccgctagggttccaagtagcttcgcttttgagctctgtcacttttcagcttttgtcttccctgtcttttcttctgcacacaaagaacgccagaaaacgctcgccgcaaaaaaacggggaaacggcgagtgacgccccggtgtacgggcatctccctgcgatggattggggaaaaaggaggtcgggtcccgaattttttttgacagggtttccttaaattcaaggttctcccctcaatccgccttttcgcggaagagtcgagttctctgcttgccacagaggcgtcggcctggcgagtctcaacttgcagcgacctagcgagcgcagaccgggggtcgcacctgcgatttctttccgtggaaagcgttcttttgcctcgtatgaaacggaacaccgtcaaaaaagtaaaatacgagtcgggtgcacgggagaaataattaatgaaacctaccccgtcgggccccgtccccttcccatctagcgctcgcggctatcggggctctgcgcgtttgagtttcgaatggtttcgcttgttcatctgaagcaacgtgttccttcagagaggctttgcgtttatttgcttcgacgactcccagaaggccgcgcgttcggaaaaagacgcgaaaaaagcaccagaggtcgctgtcgtcgtggtgaggcctcaacaccgggactttgttcggttggtgacatccgttcccaaagggaacagggaagaaagtggaaaatgcgtttatctcaaacccttgcagctccaatacgctctaacattttttccttggcttgtgtattgcgtttgaacgccactcccgtctaatctaactggccgaaacctcgacactggaatcgacgggtcgagggctgcgtctgacgcatcacatttcagagaggtttctttcatatttctgtagctttttgagtttgacgcgagtatcttcaccccattcgcctcctctcgcgggtgtacgtctacacttttgcctcgcgagggttttacggcactccaggtcacaaggatcggatttgactgttgctcctgcgctctggagtttctcgccatcaagcacctccccttttgcttcgcgtgtctgcctccgcgttcatgcacacactcgcatccggaattccagaagtaatcggtcgaactttgccgggtttctctcaagcgtctcaaactctacgtgtcgtactgaggagtccactgggtggtggtgtacagtcctggacaactcagttgtctgcatttcatgagtcagactcagtgccataaatggcacagaatcgtctcttgcattttgcgcgtccttcacatctctctttcccaaaggtctcggttgtatctcatacatatgagtcgtcgtcagtatccttcctacttgtctgttctgagatgattctccgaaatttcgctttcacctcctgtgagagcccttccgttcttttcaccgtctctggggtcttttttttctgtctgggttcttttttcctgtctgggttcttttttcctgtctggggtcttttttcctttttctcccactgtgctcatattcgagcagggggagctctccagctacgtattcacaaactgcgtaacgtctagcccatgccaagggctcctagggaaggtcttcttgtcgaagaattgcgtgttcttggagttccttttccttttttctcaaaccctgcgcttcccctccccgcctcttgcgttggtgttcaggaaagcagacctttttctttcaaggatttctgtgccctcttttacgcaaacgccttcgactctggagccccgcagccgagaaacaggacatctttcctgccgtttcctcgagcttcgctttctcagccccgagcgcagctgctgcagcctctggaacttttccttgtcacaa

SEQ ID NO: 1999 - DNA, 4004 bp, Toxoplasma gondii
ggagagaccgataaaaagggagagaaacaagaggcagataaagagaagaaggaagagaccgatgaggacgagaagagaaaagagagacgaaagtgtattttgacgcctactttgttttgcaaagtgaacaagttcttcggcgtactgttggagttcatgggctcgtggtagcgttaactcgagacgatcggatcgaacaagctggtccaactgagttctgaagagaatggaaacaagaggggaagcgccaagtgaagaaaaaagcaggaggaaaaataagtcgaggaagctccaagaaagtgccacgacgcagaaacgcttttctgcattgtgcgtctgaaccgcatgcgcacaagagacgacgaggacgccacagcgccgaagcagaggcggaaggcaatgagacagagagagagagagaagcgaaagaaggaacacactaaaaagcagaaatgaagacgtacttgagcatgttccactggtggtgaggctggcctggcaagcgccgatggggcctccgctggacgcctttgttgaggaagttgacaactttactccaccccatattgtcccgagccgagaacaagtgaaaaaaacgagacagtcgagcggagactcctgccccgttgcttatgtgcggtgtatgtacaccgcgcgactccgcgcgctttcacggttggtgaggcccgagtgtacatacacctcactttttctaggcgggctctttccgtcaaccccactctccccaatcgagcaagtgcacgatcgctgtttcagagctgaagaaagagaaaaaatccagtgcaccggacgtaagagatgcaggcgacagcagagcgaaggagaccggacagtcctccgctgccgcacaagtacggaagaagctgcggttgcagacacaaggaaactcagcaaaaaagaagccacacagacaaaaagcgagagaagaaacagaagaatgcagaagaaaaatgcctgcagatgcgacagtgcgtttcggagacacaacggacttgaaaacgagcggggcctgagcgctaggaagcggggcgtcaaacagagaaaatgagaaaaagggtgcctcaggaaaacaaaaacatgaactagtgaaaaagaagaaaggcgaagccaatttactttttttacgtcgtcttcagatgcaaagtctctccaccgcatgcaaaaaaattcgcggcgtgtgctcgttgcagagagcggctttcgagacaacaactctctcgcctctcctgtctctctggggagttccctgtttactatactcatttcccctctttctgaatatctctctttactttgagagttctgtgcatgcatctgttatttcccttttttcgaagatcttcttatttcgacagttttgtgcatacacatatctcggtatgtgcatattctggcatatgagccgaccggcacccagtagcattgactgtacttgtgttttttcgtggaaacctgtcggagtaactacgcaacgtttgaattccatttgctgctgctattttcttgtctttcgttggatgaaaagtgccttatctctctccgtttttcagcctgtaggaacggtgtcgatttctttcggttttcaacagacagccctgacgcgcggtgagcataccgaaaaaaatgatcgagggaaagcaacacattctctagaagcgaaaggatgagttccacaaaagaacactggggactctgagggcagaaaattctcgttgttcgtgcaagtcgaaactgactttcgtggagtggaccgcgctgtagagcagagtagaagcaccggaaagacggaaacaaggtttaccttcgaaaactagaaaaagagaaataagggtgggaagtctgcgcttgcaatcgcgtcgtgggagtcctatactcttttgccggtgcgcgacctagcaccgtccgtttgccctcattggccctcatttcgtgttcgctgaaatggtgtacactcagcgacaacaagcgaggtgggaagacacatagggtggaaacatcatgcgcgtactggttgatggacaacgggaaagttgagagctgttcggatgtctggtggagattcggtttacgacagaagcgaaaaggaggtgctgtctcgtctgaagaagcggacgaaatgacaacagtgcatcaggagttgctcccagcctccacacagtttcatgtgacagatgaagaccatctcactgacctgttccagagggggaacagtaacttagagcgcctaactagaccaggcgaaacaaaccaacaagggctcgtctattctgtagaaagcatcaggagactaccacaatggatatgagttctgtacagatgtcaactgtctttggtgcggccacacactccagtctttttcctcccgtcagaaccgtcatcttatccctcttctggacactgggtgtgcacgtagctccaaacgtttttagctgaacactgaaatgcgcgatgtcgctacagaaaacaaaagagcaccgctctcttgccccgtctgaggggaacttggattgtattttcccttctaacagcgttctgtgaatggtcatgccaacaacacagccttctgtcgaggagctagtttgtatctcgaaaaagggaattcggaatcagcgatttcgttctttcaaggaagctgccgaccgaccctcatccgcgaacaaagaaggtgtctgtcctctcagaggggcgcattttcaagagaacgtaatagtgttccgctggagtcgcacctgaaatacagtgtgtttctaatgagatcacaattgcgttacggcgtgtttctctggaaccatcctcgcgaagtgatgtgcgtttctagaatcccaattgcaaaatagcatgcttgcctagacttcccgatgagagtccgatgttttcccttgtagccccgactactagatattttttccctgtaactcccaactgcaccataaaatgagtcggtttcctctctcgaacctcgacttcaaaacgctgctttttgccgtgtggtacccaaaagaaagcgacgcgcctgtgcgcttgcagagaggctgactagcagaaaacccttgacacgcgcttcgaagcttgggagagtggcttccgagactgtcgctgtccagatgaaacatgcagcggagaagcctgtggtgtgtgcacttcgtcgtcgctgacgggcgttcattgagaagaattagttccctttttggcagtgttgatgtaaatcacgagattccaagctgccgtgggctacaaaaacaaaggccccgttctggtggactagtgcatgtaccgttgtagggtcggaacttcccctgtttcaaatcaaactgagtgtccgatcctcgaccgttgtacgctggttttggcgaacagaggcagaggccgcgagcgtttctctcgcaggtttttgagagtttttgactgggtccgcggtctttccgggtacggggctgcgtgtgtgtggtgaatcgacggcgtgtgtttggcttttggctctgtgagagagttttctcgtgcgtgtgcagtttgtgcacatcccagacatcttgcgaaacgcagcgactcgtgggaaaacgcaaacaacagtcagaacacccgaggccactcccatctaggttccggcacgcgagcgattttcgcgatctggactgcgagtttttcgcgagtagacgcgcacgagttcgcgagggaaatggtctgttgtgaccagttgtcttttgagccgcaaagaaggaaacacactctcaagctggtcgattctcgcagtctgcgttttggacggtcctgaaaaaaaagtccaaacggatactgaacccagttgcccttcaagtgtatcgacacctcacacacgcgctttacgtgaccttttcgcgcgtgcgtccacgcgtgtgccggcagaaccttctcggggcttacctttttcccggtcgttttatccacttgtttctcctctttcctagatatttcgcctcatttccttttccgtgttcgctcgaaaa

SEQ ID NO: 2000 - DNA, 1876 bp, Toxoplasma gondii
ctcaacagtagtgtccggtccagtaccacatacgaagagcgacatgccgtccccatcaaggacagagcttcaaccagtagaatcactgatgcggctcgcgacttatcgtgggcactgtagtcttccttttcctcaggtgcatatcttcagtccgtgctcaaccacggcggtatactacccatttgcatgtataccttgtattggaaccaccgatcgctgcgactgcggcgatgcgaggaacacagcacatttgctcggcagtatctccgatgcccgtgggacaacggctgaattcgtcaggtggaagcggacacattgggatgccgtagtgcttgtcgcttactcattttcatccccttcacaccaaagtttcttcccggtctgctggaagaatctcaatattctgctcacgcccgagagacacaggcctgatagtttccaagacttctctcgtttggtcggtccgtagcatgtacaggtaacccagaaattagcgtgatgccgtagggaggggggggggcgaattcacttgtcaacagcaatactgcaagtttctgcacactgccacgacccatcttttctcccctgtccttctgtgcaacaaaggtggcggacattacgtgcagagttccagaatggcattcactcacctaaacatcacaggaaagcctgttcttaaatctcctacagtcatcggaaaggcgagcatccccggcctaggactgggacttcatggctttcgtcggtgccattcatacacgccacgtttcgtaaactcaggggggttcaaaacacagccaaagtctgtagaggatgtgaaggtggaatgccaaatgccttacttgtgtcgcgtggattgtcttcgctaacagcaatcgcatgacgggctgccactgctgaacatttacgacttcgtttatggcgtggcacactgctacctaacgcatttcacgatatagtctacgacaaactgatttagtgttccacttgctgcatctctcaccagagacccttgcttgctgtgtatatatcatatttgttgtgtaaggggcatgcattcttgtcactacctagtgatgtgcagcatcccacttgacttcgacgaagagcaggtataccgtcctcccgtgaaacaaagctgagagttccctgtgtcctcgaagaaacacacaccatagacagtaacgccgtgtggaaagagaaagtaaattgtggtacggaaaaggggcaaaaacgacaaacggatgacgtttgttgcaaaggatgcttgcagaatggcatgtcaatagaacggcctccgctaccgatttgttgcgaggacccgcgtcatattcgttgtgaacatttcttctctagcgcaataattttatgaattcatggcaacaagccgcggggaaggtttctaattttccatctagtacagcagggcggaaaccatgcgctagctaccgccctctacacttttccctgcaacgacaccagcttcggacccaacgctctctacagcgcgtcgcatcggaaacgactcgaccttgaccaccctcttttctcagcgttttcgagcaggaaaaaagcataccactttccctttttttatagagcaaccgaatacatttaaaatcgtttcggcatccaaaaagagttcgagtgctcgtcgcgactggtgcggatacatggtgagcagaagttgtcgagttccggttgttgctaacctcctctctgcgggagccaatgtgggagctaagccggctgcccatctaagcctcatttgttcgctgatctgctcactgcaacattttcttgtctcttgtctgtgcgtttgcaggcatatcatcccgatttttatggtgaatcgtctttttacagaaggcaggaa

SEQ ID NO: 2001 - DNA, 2183 bp, Toxoplasma gondii
gttctctgcaaatcttccctcacacgcggcatctgtctttcctcgacgacacacatcctctgtcccaaagcgcttcttttaccccctaacacacggcggtacccgaacatctgccgagcagctctctcgcatgtaatcacatttccgcatttcgaacacagttatccatatatatatatatatatatatatatatatatatatacgatatttgtacctgtaggtttgactgtacatacacgcaattgtgtatagcaacgttcgcagaaaatgcagctgtatgtgcatatatgttcatacagaaatctatggaactcgtgtgaggcattctacctacaaaactacatacacaactatgtattttacacatactgagtatgaatagatttttatattctacacagggtgtacaagaaactgttgcttcttgggaagtctcgatcgctattttcgaaatctgctcggtatttctacgaaacactggcaagcagggggagaaacaaaaatctcccttcggcccagaattggtaccgaaaaagcagaaattcgctgcatccttcccaacctctccctcgtgcgtaggtacacccgcacacgctgcaagtctctggaaagcttttcagttgacgaaggacacccttagcacacatcgcatatagtcaagaacatctctgatctcactacatcatatgcatgcattaatatacatattcgaatacgtgtacttacatgtacaagcacatctacaaaaaggatacatacgtatatatgtgtagaaggtagagagcgaagaaacgtcgtggtattttcttgtgtgactctgtcgctttttaaagctcagcacgaagaaaacgtgacgtgtcatccaatgcagacaaagagaggtctccggtgcaaatggaacattggactccacgatgcgcaaatacctcgttactccagaagggaatgcacaaaagagaaacgactgagagggtgggatagaggacgaggtccgtgaacccgttagtgcggggttcgcaagtgcggcatctcttttcttgtccggagagagaagtgccgttctgcttccaactgctttcactagcagccgttttgcccacctttatctccccccctcctcccccgcatttctctctatcggtaggtgtctgcccgaaaatctcccgagtcttctttctttttcggtttccgccgtggagaaagggggagagtgaagagttcgtctcgaaagtagaagagctctcgggtgtatgtacaccgcagcccgcctgggcagtttcgcggggacggcgtccgcaaggagaaaagttctagcaaagagcgagggcggcgcttgtgcccggctccgcctctcttctcccgaaatagaaaggttttatgcttttgcaaggtgtcgtttccttcctctcccggaaagacttctttgttcctctttctgctgctttagttcgcagaaaaggcgattttttctcgtccacccgggcctcgttgcgctggtctccgagttttgccaagcgtgttgacacccgctcttctcacgtctcaagcgagactgcttttcacgcttcttctcaaaagcacttcgacctgcttcacaaaagtgtctctatgcccgtgtctgcgttcttctacattcctcccttccccctcctttcttcgttttcttcttgtcttccgttcctcctcctgtcttcctccttttttccccttgtcttcctctttccttcgtcctttcttcctgtctccacttctcctgactctccctcgtcgcgctgttctcctctccttccccgccgtcgccgtcaacgcgtttgactctaacggggtgtacagacacccgactgccctactcaggcggaaaagtctggagcagaagatagcccctgcgcgcgctcttggacacgctgcgttcctcttccgctgcactttcgcactttctctcctctttggcgccgtctttgtctcgtcagaaacgaaaaggagaaaactcgaatgtcttcggaagcgcaaaaaccgtcttaacgcaccttcaggaaaaagctaggcgtatacagacacaaagagggagagtgctttccacatctttatgtgttgtacggtgacaacgaacctccaggaggttgtttaggcagaagaccagtgtgtcactgtgacttcatcctcttcttcgatcttcaataa

SEQ ID NO: 2002 - DNA, 4914 bp, Toxoplasma gondii
caagcggactgaatcaagcgactgcttgtcatcgatccaggcaaaacagcaaggtctttcgtacaaaatcgttccttggcagagcaactatcaccgatactcagcaaccaaaacatttaatagccgtagccgccgggagcagggttcccgtagccgttgttgtacccagtgttgtagccgcccgcgttggggcccccatatctcggaccctggttgccgtctccgcggtagccaccacgaccagcgtccattcggggtcgaggctcaccctgcacaacaacaaaaaaagttgaaccctgaattgcactgccacaggaaacataatccgtgtacattctgtgcctccttggttccccagttgagcagaactacaccatctgcatgtcattgaaaaacacagtaacgataaaaggaattggtagacgctgtctctacagatgatcctccgcgatccagaactgcgtaactcaaatcgaatacgcacacatgagaataacccctacacggagattaaaactccatagttgatgaaaatgaggagattattcccctacgttacggagccggtaaaagcttggaacgcaaccgccgatgcgaacccacggccgcaagaaactgaaccacatggcgagacacgcgaggtcggattcaaggaactcacctgcacgaagtcgccgttggggccagtcacgctgacggcctttctctttccatcgtggccaacttgtacgcggaactcgacgctctcaccctcagcgaggtttctgaaaccttgagccttgatctcagtctggtgcacgaaaagatcagtgccgtcctcggcagtgatgaacccgaagccctgcacagagcgcaagagatttaaagagctccggataaagagttcgagagatacaggtcgagaatgcaaacccgttccttgcacctccccgagaagcacccgcggcggactgcgcagggtgaaaaaagccgtgacatcttaggattccagggaaactgctgcgtccgttcgtcagatttaccttcttcgagtcgaaccatttgcagtggcctctctgaatttggtcctccattttgcgtcgaggtcggaagagttgtgaaaggtagtaagggaaactgaaaacgcacagcgcaaagaggggcaaaaggtgagtccgtccccacagagggcatcgcactaacaccaaactatggcaagattaccgcagaaaacggatgcactgtcgtgcacaacaacgaaggtacgggcgggaaactcgactggacggaagacgccaagctctcaaaacgatcacggaaaaaagcagccgcaattccccaggtttgaaaaccggtggacgctgcctccgcttccactccagacagttgcacgttcgttgctcccctaagttgtttatttttttcctcagttctaaatggtattcaaactacgcctagctcctcaccttaagaagatgcgaaaatacacgatctgaaggagcaaagaagtgggtcaagcctgtcgacgctgcagacgttctacgctaactctagcacaacttcgctttcgtcattagcgggtacccactcgacagcactcgacggcagcagtgagagggtgccgaccacccggccagtaactttaccaaccgggtctgtgggttccacgcaacctgggttttcgggtttgtggaggtgggagcgctgcaggctgcagcgagtgtctcggacgatgtgcggggaggttgggtcgacttactcctagctcgagagtgcagcgagaaccacccccatccaaaaaccttactcgaagaaacacccattacggtaggtgggaacggggtggtggatccgggtgctaggatgccacatctaaacaaggtgtcaactgcaagactccccttttaaattgcaactccacgtttgccctgcgcgatttgtccgtggtgtggctgcagttcgtggcaacgtgaactctccttcgatccctcatccggcctccctcgtctagtgcctgcaaaacacttcgctatgcaacagagtgccgctttaaggttcagcgcacagataaaggggctttccctggagctattttattgctgggcattacgcgggtttgagagtgaccgatattccaaaccctgaccgctagaaattgtagcagatatacctattttccacgagctgctattgcatctttcagaagtgccacagtcctggagagggaagcggatgcgtcccaggggcagcgatcacctcgttgggaggccgttgcaatgtatttacggtagcagtagtgcaataatatcttatgcaaacttttgttcctattagggaaacgagcgccatgtcggaaagctgtgctccgccagaatctcctgagaatagttcactctttagaaggcggcttcatgtgggacaaaagacagggcaacaagcaatttgttcagccgagcgcggacgcttgctgcgatcatgcagagtaaaccttttttcatggcagctctggtgctgttaactgtaaagcgaggagtgtgtgaccggcaactgccaagaggtgtctacagagcagtccacaaaaacagatattatgtcggtctgctcggcaagaaacattttcgacatacgcagttgaagtgactaaggcgcctgaatgttgtgttacgtgttcccccagggtgtccacaggcggcgtcaggattgccatccgtcaccagcaccgctcctttaaaagtaacagggatgttaccacatttgggttctgtgtctatgcggttttcagtagaatggacactggacagataaaacgagagcagcgtctgagaacacgcagcgacggctgttgtcaataggctccactgtttatgccagattacctcttagactcacacatgtcttctctgcaacctcccagaggtgggaacaggcaagaactgcaagaaacttcacttgtctaggtgacgaccctcttgaggagggacagactgacagcgcctttgtcggtgatgcactggtggtgaagagagcttctcaacagccatcttaattgcaccttcagaacgttcgtacttgtatgaaaatgaaagacgatgtctagggcaagagaaacggggtcttcaaacagctaccattgctcctgttattgttgccttcttgctgcatgttcgaatgcctaaggtgtcgccgagcagcaaccgtggatgaccccattcgcactagtctgtttccgaagatgcgcggtactcctattgaaccgcatcttaaatacctgctggctgcatttgatgctcgaatatttgcactaataagtaaagcaattaatgctcgtcagcgtgctaccgcccattgtcccgttttgctgatggtaggactttttgatcaagtggtaaaacatacaacctgagactacgacgatataaaccttggcgatagcggtcaagttaaccagaacgctgctgtgtcaatcgtgtcatcatgtggtacctcaacggttgggggctgccgcaatgtcctactggtggactcccacggcggggatcagctggattacaccttactgtcacaggctgacagcggagagatttcttcacattcgcatccgcgatactcgaccatgagttgctccgagtgaacacaatgcctcccctcacttcattttcccccaggggagccgcttttgcactaatcccattgttggttcgtgtagcgtttcccttttttctgtaaaacgcattccagcctttagcgaaccaagctgccatacatatcccttaagtagcactgaagctgcacataactcgcatttcattgctataaacagtgacacttaagtgagctggccaatattacacaatgtctttacaaaacaagcctgagtttctttctgaatgccactaccaccatcctatgcgaccaattgacgtttgttgacatcagttccgtactaacgacaagcataacaggatgcgagaaaactgtgtcacgatggcacacagctgcgttgccagcacgtggtggctgtcaagaagcggagctttcaacggcaaaatattctgctgttttttgcgaaggctcgagctctagctgtggtacttgaacacacgtgaatcaacagcgaaaaaatccatcacatgtatttccgactccaagatagtttcttctgcagtggatctctgggatcctgtgcagttccgctgtttgccacacttgtaactgaaaagaatatcactacgcacggttcttcccaagggcgtgaccgcgtgcgaatggctctgattcagcgctatggacgaccgtcttgatccgctgctccaaaatgtgatgtgtttccgacaccgtttcctcatcaatgacacaaagttgccttttgagcaaccattactgaggataaagatcgtgttaatgaaaaacagtcgctggcaatgagaacgagtcaaatagttcgcgcgacttgtggcttcgatgtatacgagatttacgcgtgcatgcgcgctagcgcgtgactcgtgtgtaccggtgtttttttttgtggtttgttccatccgagacgtacaacttaacagtccattttacgtttgattttgacttctgtctatcgtatcatgtgtattgtctccaggagaagtcttgactacactgaggtaccagacttctataccgccttctcttggaaaagcacaccacaacggatgtgctggctcccttgttgcttcaccaggagactataacctgtaacctttgcacgtgatgatgaacaactggaacgcgtgtgtgccgtgccctgtttcttcgggcccggaggtttgactgtataaaccagatacaggggagacgagctgttgtaccgatttagacaacgaccttcttcgtcggtctccgcagaccagacacatcttcttctccaacgctttgacttgctacacaaagccaccacta

SEQ ID NO: 2003 - DNA, 2533 bp, Toxoplasma gondii
aagaaaagtccaagagagagagacgggcaaaaagatggcgcaaaagaaaaaacggggaggcgcggagcagaacacggacgcgggcagacgacaagggaggcgagcgacaggtgaaaaccactggggtaccggcgaaggacggagcaaaaaaaaaagaaaaaaagagggattgaagaggacagcagcagaccggaaaaggaaacagaaggcagcagagaggaaaacgctgagagagaaggggaagagtggagaacagagtgattgagagagaagaaaagagttgtcagagtcaaggaaaaaacgaacgggagaaaacgaagatcaggttgaaaagaaggaggagaaggcggtcgagcgacacagaaaagccggtgagaaaaacgagagacaccacggagatgcaaaaagttcgagtccgaaaacaaaggacctcaaggccgcgttccaatgagggaagcggcgaggaaggaagaacacagttttagacagaaagaaagggccggccgagtcgcttgaggagagctcgtggagcgcacatgcagagcgcgcctcgcgccgcaaggctttccagctttctcttcctccctcatcctcccggagtccacatgcgtccagatgcaactgctagaagtccaaggattcctcgcggcctcgaccgaggcgacagcttcgcagagaggacggcgcacaggaagaacaacggacgaagacagggtgggaagcagatagcagcgcggaggaagcagagaaggaatgcatagaggaaaagagaaggataagaacgtcaggaaaaaacagaaagaaaagatcaagcgacaagagcacacacagaagagaacgaaagaagggaggagaagagagaagaagcgacgagaagacgagcgacgaactgcgagcagaaagagagagagaagacaggcagagaaggcagccagagaaagaggaaaagagatagaagagaacaagttgagaaagaggagccgagagagctgcagagaatcgggcaaaagcagacgcaagacaacacagggagagagctccgcgtcctcagagacgagaagaagagaagcagacgcgcggaaggagactgaaaaggcttcgcagcgactgcaagagagacagaagcagcggtgaagaaagaacgcgagaaacctttgctcaatctcctgaagaaagactcgcgcgtttcctctgtcgctgcgttgagaacggtcgccagtttctcgcgcgctaccttcttccacgttgtgctaatatcgagcgatgcgggtgcggcttcgacgttcgccatgaaaacagcgaagcgcttcacccgttttccatttttcctgacgaaaatgcccccttttctcgccgcagcccttgtgtctttctgcggataaaaagccgcaaacccactccgcgtaaaagacagagaactcagcctcgtccgctggcgctgagagacctccgtggaacaccgttgtgcgcggccgcaactgtttctctgaggcctctgaagcctgcgacactacgcgagcgcgttctctctctctgtggttcttttcctctttgtgtagagagcgtggagatgctctctgaggcgaaagagccgcagaaaagctccgggaaacgccctttcgtcgcttgtctcgccgacagctgtctccccagctccggacatgaaaaacagcgtggcgagcacgggagaggacgagagtctttctgtcggccgtcaggtgaaagtcgaggaggcctctcatacacgcagtgtgtgcatgcagagagacagaaagcgttgtgtgacggtcgcgaacacaggagcgaagagtccgagaaactctctttgtcgagaaaactcaagacgcagacggtgactgtgcgtggaaaatcgcgcctcgacgagtgccgttctgccgttcctcggtgcgcgcggaggtaaagagaaatagaggcaggaaatcgctcttcactcgaaggcctatcgtctccagtgcaacctgtgaacgattttctggtgcttcttcgttcgtcacttttggccgtcacgaatacagcagaaacctgcgaattcgttttttcgtcaaatcccttccctcctgtcagcatcaaagaaatgcaaggcaaacagcattcgcgacgtccctctgcctccattatcacaggacgaacatctctttatttcctctacacgttcttttctcaacgtttcgtcgtcctgctctcctgacaggtcgtccttctcttatgcttgccttcgtgccagttcatccggtttctcattccctccttcctgtctcctttcgcgtcttcgtctcctcgtcgttctgacgctgtctcttctcccctgtctctcgtcgttgtcctcattccaggttccccctgtttctcccctcgcgtcgtgctctccttccatcgccgctactctcccttctcctgtccgttctcccctctcgacgcgggtcccctgtcttctcgcgttcctccactctccgttctcctctctgttcgccgtctttttctcttttcgcgactctctcctccttcttcgcca

SEQ ID NO: 2004 - DNA, 1622 bp, Toxoplasma gondii
ccacagtcttcgaattaacgcttgtgagtttctcgcttaacttcctttgcacagagcctctataccgaagcaatggcttgtcaggtagatgctgtattgaagatggaactacctgagtccctgagggtctccggtgagcaattggggagggcggagattttgagacgattgattggcaccgaaaacgaatggctctgcgagaatcccgctcgtcttctcgggcaagcatacctgcaaaaagttctggaagaagacagatgactatgtttaatctcgtagaaaacacgctgaggaagattcacgaggttgtggaaacctagtagtatacatatgaaattctgatgtgacacggtattcctgaggaagcaactcgatttccgctgttgaattggctttgttgtctatctttccatcacttgtattacaacgcccctctcgaccgaacgacgcgggtgcctcacttctgtgaattaagaggacgaggtcctcaccagctgaaataagcgatgacacatcgccgttccatctccctgtggggacatactcttgttcgtgatcacctttttactacacaaagggagttggaccatccagatactgcaaaaactgtggtagccactgctacctttctcccactcagtggctagaacgaagaaagtgcgctacccgtcactgaaccaaagcagatgaataggggagttcggaggtgttaaacctcgtttcagtcaagttagctctaataaatccccattttctcaactccgtgcgcttctagcaatggaaacagggaataacaggttggctttgtgcgacatagtagggaccacatcgcgtgtttcatagttgcctagcgctccttaccgcttcgactgtaacaaacagccccagcggaaggctaatgaattatcgctgccgtcattcgcttgtataggctttgcccgagaacgctttgccccgtcgttgtgtcaccagtgcatactggctgtgttctaaagtcgtttcaggtcacgtttctactcttaagtaaaatagtagagcgtgattctctctcttggatggcatgaatccgtgcatgtcacagagatgcgaaaaccgcagaggcggagggtcggtagtgacactgcagtagggaagagcctgcatacatgcagaactacaagcagtgtcagcaaaggacatgcgcaaattgatggcccaaaacggacctcctgagttcagtgcttgcttgcacgccccttactgacgtgcgttcttttctgcagaccggatcagcggtagtttgatacgaagccacggaacacagcacactgcggaaagcacttgaactactacactcccgaagttctggagtagttatttttttattaccgttacggagcttcgtatatttaaacttgccatttgtaagtgtaaaaatttgaatgattaggctgcgggagtgtcagaaaacgacattccatcaagtatcacgggcattagatgcacactgccatttgaactaacagttgccagcttgttgcatgcgcccgcaccggcttccgcgggacacattgctgcacttgagcgaggccgcacacgtttctttcatttgcattttctccgtattctcctataactaggaa

SEQ ID NO: 2005 - DNA, 2176 bp, Toxoplasma gondii
aaagaaccagtctccgtaatactttgagaatggtctcggagttgcttagagattcaactcgagatagggatgaggaccacaggtgcacagacaaaggagagcaaaagaagtggagacagtcagtttgccgtgaagataagtggaggaagaaagaggggaaggcgtacgtgctgaaatcaaggttttcttggtctgcataaatcttgacagaggccggggaacgcccattgtcgccgccaatgaggtgaagactggatatctggtacacgggaaaaaacaaatatagcaaagaaacactgccagttctcattcggttcttgcgtatgcgcgtgactctggtgaatgccgaaatcggtcgcccagctagttggaaaacacttgtgtctcagtgagctaggaatggacatgcataataaaatggaagtccgcttttgagacaaaagacatctggtgtagaactgcggaccctgcgcgcgtgtcaggctcggagtccactagcgacagagcgaacaaccgagagacaagactcaccttgcaaggagatttaaaagggatgtgaatcatctgcaaatgcaggacaagcgtaaaaaacgctgtgaatggaatgcacagcccagctctgtgactccatttgtgtctaagaaagaaaaggtgcgcagagggatcggacgagataattcgttcgattcactcttcgttgtgatccaaaatacagagccagtccataccagctcagggtcgtcctcttcactgcggcaaaatttcgtctcatccagacggtcttcatacgacttgaaaattgttctcgccgagttctgaacctgcaaaagtcacacgcgatgggcacagcatcgagcagttcggtcgctggcgaacatagaaagaggcgaacggagtcacagaaagttgcgcggcacattctggtgtcgcggcgacgaaacgattgcttgttgtgcagtacgggaatgaactgttaagatttttcatcgtggcgcggcgactcgtgtaggacctaagcatagagtacctgctcgttaagtcctcgaataccctcgaggttgatatacggcaggaggaattgtgctcccttcaggtcgatctcgtgcacacagccacattgtggcccatgaacacctggcattttcagtgactggggcagaaaggagtattgtttcgatggccagcccgctgtttagccacaaacacgccaatgtgccgcgaattcggcgacgggctatgctttgaagcaggcggttggtgacagattggtcttgtcgtgcagtcgatactgtagaaaatgaattcctcgattccacagacagaaccttttcgttagataccagagcctttgttaacggacaaataaaacgaaacaaagtaaacgcttcgcctctcagtcactttgcaacgaaccgtccgtgtgcatgcgcggcagtatctatgcattcagaacatcgcagctgccacgcgaagtcgaattcttcggtctagaccatccacgttttggtagtcccgctagcaccagtctgccatcttcgcactttctgtatgtgccacctcacgcacctaataaccatttctcattctgggctcattgatccatttgctgaggaaagtctggcacagtccgcaaaacggctgcactccgagcttcaagttgttaccgaagccgtccgccagcgggagccggtccgccacatgtagccgattgtccaaacgagcagcagctgccaacgcacgagttacttgcaccactaccccgctgagccaagcgaactggaaacagaacccaaacttcgaagaaattgcagaagatcactacagcaagcggcaacaaccgcaaaaggatcaaactgacagcggagctgcgctcgactttgacgtcgagcacgacccttccgagccctttagaatgataacacaatagaacttggatccggtaaacaaagaccttcaagatctgaaccagtattccaactagttgacgagtcatgaactgttgacgaattaacattcgagtgtatgtacaggtcaccagtttgcttggtcatgcaacgtaagacggtagtatgggttctcattttccgcgaggcaggcactaacaagactcgtgatatggtggtcagtcttttctagggctgacaaaactttatagaatcaagcactgtggtgaaga

SEQ ID NO: 2006 - DNA, 3241 bp, Toxoplasma gondii
ggggaagaagtgaagacaatgagaagacaaaggcaagaagccagaggaaaaggggctgtagaagactcttgaaagcacctgttgatacagcggagaaaacggttcgaatgatgcgtttcagtagcgttcactgccgcactgtcctcgtggaagttctcctggggcccactgtgccaccggtgagatcacagggaggcctgggccttctcatcgaatgggaccgaccttcatgcctgttagatcactactgttcagttggcgtatagacaaggcactccaggtagtcacaactcgaactggaggcacaaaaaagcgcgtccagagcgtagacgatagagctatttgggcgggatggaacacggggagaagtatacacgcttccgagaccggcgaggtgtttttcgacttagagaaagggaacgaagcgtcctcagaacttcgtgtgaagtaattcagaactctcaatagaaggtaacaacggttcgttggacatagagtgccaacggtttacaaacgttccgctttgcctcgcttcattgccgacggctcgacccctgcggcaacatctgccgggagtgcctcccggtttgttccgcaaaggaacgagaaagtctgcatagaagaaaaaagtgtgggtacttcatcggcgttggtgttctccgatttcttgtttgctcttcactcgagatcatagggccggttccacgcgggcgcaagcgggctgccttctggggtccgcgggtggctcccgggcgccttcgtttctgggacggtgagacggaaacaaagaatgaactggaacaggaaatgagagaatattccacggaaagaggcgcaatggagggaaaaaggcgatcgccacagcagctgtgcaccccccgtacgtgaaattgcctggtggttgaacctcgaggtcacgcattagctggaaaacacatggaaagcagcaaccagggacacgaggaaagcaaaagtggactagaagaaaggagaaacagcttttaaaacagatgctcgcggtgttccctggctctcatctcgtcgatgcatgcaaaaacgaacgccgtagccggacccgctgtgcgagagcacgtctccccgatatgcttcaggagagcgggtggttcggaaaagggagagaaaaaaagaggaaaaagaagagaaaaatgcacactcccaggagacagaagatatgctgaatgctttcagaggtagtcctgccggtacagttcaagcacggaagttccgggacttggcccagggaagaagtgacagaaggcgaagaagcgagacccgagagctggacagactgcatgcagcgaagcacagagacgagaggaaacgggaggtaaaatgcaggaaaccctgccttttcgccaaggctcggggcagcttttccacgaaaacagaagcgtaaggcacagagagagacacgttgaattttcggggctggcactgtccgtactgtccctccccgtgcctcgaatataagatcgtcgcacaccctcgcagtcgggcaaaactacttccaccacagcggcttaagctttcaagtgttccagagagggttaaacgtgtttagctccttatgttgccaccgggtcgggtgctggagtgctcgtatcgaagtgaaaaagatctcttccacgactactacctgcgccaaagggaaaaagcggatcagccgcactcttgagcccatcagggcctttgttgtgctacagcgatggtttcacattgatattagctatggattcatcagcatggatcaggaatggtacggtcatttgtgggagaaagtggacaggctctttgacaaggacgaggaacaggaacctgtgatagggtggtctcccagcgagcgtgcagcagcgcacaccatcacagataaatggtaaataagaattgtttggaaacatgcttctgtttagatgtcggctccctactctcgggcaacgtgccaaagatcgaaactttctggtgcgacgcgtatcttcgaataccagaatgaacaagcgttcctgtctgggaccctctagcagccgaagcgtaaaaactggtgatctttaggaagcctgagccacggaagcaaacacagatggtgacggaacgtaactcacaccaaggcgaaggtttcttttcagtcattacggaaaaacgaggatacccgttttcctggtgcgtgcttctatgcgaaccgtgaatttcaattgtcaccacgacgtatgagccgtaacgctcggtcttacaagaccgcaacgcattacgcgtgactatcggggcgtatcatatgatatgttgtttttattcagcactcgagttgcaggtagacgcacgtgtctgtttctgacgaactgactcatgctggcattttgttcgagagggcgtggtgtcttgtagccagggattcagtgcagccgcctcgaaataatgcacattctgcacaacttcctggatccttcgctaatcgtcagcaggcttcggggctccctgtcgagctcgcagctgaaacctgtctagcagaggctctgcgtcataagcgtcttgtaaaagacaatgccacgcaagcgtgaaatgctcacggtcctggaggtgtcgtccctcgaagttgggaaacacaaacaccacggagctatgccggtaccagggaacacaaaacagccactgtcaggtcgtctagccgtggtgtcgtcgttccctgctaggagctgccagagtcctgtcgtgctgacttcatccccgctccagacatccatttttagttatgtgatatttctgagtattcctatgatttgcaacttcgcctctgagatcgcttacgttcagtcaaataaatgttttcttttttttccacggcctaattcaaggacgtcgaatgagtgttgtggtattgaaaccgcttgggagacacggtcatacgtagcagatgcgtttgcgcagctccaagtatgttcgttcattgaaaagcaggaatgctgcgacatgcttctcttcgcattactgcctgttctacaccgggggatcgtttgtcagttccttcctcaatgtctcggtccttgtctctgccctgtcccaggggggttcttgcgtggagctgacggctagttgagagcccttattcaggggctgcgcagagtgctagaattgaccttctacttgtggctgtcgtcgtttcaggatgatgtagaagtcgcgccgaacttcgagaaacaagtcgagagtcacagtgaatctcgaagga

SEQ ID NO: 2007 - DNA, 3878 bp, Toxoplasma gondii
cttgtgcaggtctctggtcctgtctctgcgtatctgtttctctgtttgggaccgtttcctgtgtttacctttttctctgcgagaccgtttcgttaaagaggcagctgtagagacagctcaagtgagtggcgcttgtgaagggacttcccgagaactgcgtcctttgtgagtcgactttcgcagtcgacgaacaggcagaagagcctttctttgtcgcttgcaccagcggctagagaaagtctgagtctcgttttcttcccccttggagttgtctctctctctatcacgttcactgggtcctttctgttctctcttcgtgctctgggcgacagtcagtcccaacgaaaaaagctgtcagcggggatgaaagcgctctcctgttgcctgtccagcgcgcctttcgctcgctagtgcctccacggaggaccctctgtctctctcgcctcccttctcttacgcgacgagggagaagctgcgttttcctggatgcggccgagcgttttcgtgtcttcacaggtctgtagaggcgccaagggatacttccctccagggtggacaaaaggcgcatggaaaaccttcgtggatgccgccgcctcgcagccgccgccggggtcgccgagagccgcggcggccgcgagagccgtcgagcgcctggcgaacgaaggcgcgaagaaggctgcagaaaacaggcggaagatcgaagaaagatacgcggaaataaggtgagcagaaggaaggagagggcagaagagaggacagcgagcggagagggacgcggcaagaagggatgaagaggaaggacggggaagagagacgaagacaagggagtctccttttccagattcgacgactctgcggctacgtggggtgttcgacgacagtcgatgtgcaggatggcctgtcggtgctgagttttttgaattctttgcctggaagctcatggcccgactcgcggcttcgtgaaggaccgcagacagtctcggttcggtgcctgggcaagtgcgagaggaaaaaagcaccgggtacttcatgcggaagacgacgcatgcgattagcgttggagacaggaaagaaaacgttcaggctttcagggaggaggggggcgagtgccggcgtttgagcgtgagtgaggagtgtcgtttctgtttctctccaggcgacaatccttagaggcttactcgcggtacaatgcactggaagcagtcgaggagaagaagtacctgcctggattccataagatgaaaaagagctactcagacaagcatctgcagtgccatggcgaggagttgagcagcgtcattgcagagcacttcacagagaaagacctgaaattcgttctgccctggaagtagcagagaagccagagggcgacgagaactcccgtgaaaagaaacgagacaccacccccccagagcagtgagagggagagaaggcaaagcgtgcgagagacagaaagagaaagagagagagagaaagagaagacgaaaaagagaacaacggaggagcgagaagagaagaatacgatggaacacagtaaaagagaaggagagagaagatgagaagaaacaaaacgtacgagaggagggaagagtgcagcgaaccgtgcaagcgcctcgagagggaacacagcaaatgccgagatccaaacatcctcaactcccaaagaaagtcgaaccgagcttctctcagcgagagagaacgcgagcttcacatttgcgcattccctgtctgaggacgcctacacgagctccgacgatagcacgcttgaaatgtacatcagcaactataaatagccatagatagccactaaatacatcttgaaacattcaatgaaaagtcaaggcaaaaacgcagccggatttccctgcgttctcacttcattaccagtggtgaacgcgaagatgtaaagcgtatgccccttttctctatcaaaatcgcaatggtttttctgatctgtcaactcgctcgtcaaaaagacgcagctctttttctgagtccctccgagacaccaaagtggaaatgtgcggcgctacagtgtgtggcgtagcggtgaacagaggggagactctcgctgttcaagaagcctctggtgtattaacttccttgcttcttgtcctttgagatatcataccactggcgagcagggaaccgtgtttcagggaacggggattctttttgtctcctgtcttcctgtccttccttttccactcattgctgtgttctttggaagagaaaaaaactcgtaccggcgtctccctcttgctgtttctctgggaggacagaggagcatttctctgcattcgtcaaagcgtgagcgttggaggttttcggccctcctttgtaatgtctctctctctctctgttcctgcatgtcggcctcgcgttcttctcttcctcgcttcctgtgtctttctttccgatttcgtttttttatttcggtctctctctctctgtgcctctctctttttctctgtgtcttcccctgtctcctgggttcgagtctaaacgtccctcgctgtctgaagctgcaggtgttcgccttcctctgttgcctcttctccgttctcttggttctgtcgcttcttctttcctgtctcggctgttccttccagcctcaatcaacagaatcgaaagagccgagagaggcgaggcgagaagaaagaaacgtagccgcgacgcgtaccgacgtccactcttccctgaaaatatttctgtctttcgcacccacagagacacacctcttctcccgcgaaaaacgaaacagaacttctcgtccctctcctcagcttactcttcaacatgcactcgatttctcctctcgccgtgtcttccctctcggtataacaacctccccagcggttgagtcggaggacttttcagtttagcctcgaaggaagaagcaccgggagaagcagcgacgccccgccacacaccgagagacgtaggaaatatagaagttgagaaagggaggcgtggaagaagtgaagagaagactcttgagaaagacttctttccactggaaccgagcgcgtcactgtgcacttgcttctacgcgcgcaacgagcagcggcccagtggcgaagagagcctctcttgtgcctggttttgagctcgtctgcaaaagaaaagggggcatagtgagacatttttcagaaaagtgcgttctgtcttgttttttgccggtgttcttgcctttttaccgcgtaaaacctccggagacttctctctgcgaaaacggcgccaagcgagatctcagaattgctttccacgtatacgctcgtctgcacagctcgcgccgcgactctcgtcggtgtctggaggcggtcgcgcgaaaactcccgctgctttcgcccacgattctcgagagagcagatcgagcggagaaaagaatgcgaggtgtgtggtaaagtttctcgcgagtccagatttcctcgagttcgccgccaaagccatccccttctcctcgaggaagacgagatctccacgtcgcgagggggttcatgtcgatatcagtggcgaagagtcttaggagtctccggaactaggtctgccttttcctcgtcttttctccactcgagagacacagcactccagagagcgttcatgaagtctgcgtgctccgcggtttctcgagcggtttctgcagctcgatcttcaccagtgcaactctcccttttttccagctgtcgtcgcgccaaggcaggtcactggggcgccgacgcgtttcgagcaagacattctgcaggcgcctgcgagtgtcgttcttttcctcgcgggcttacaggcgctcggtctttccagttgacaggcttggcgagaaatccgctttttcactttccaattcgcgtcctcgtctctctaactcctcctccagagaa

SEQ ID NO: 2008 - DNA, 2547 bp, Toxoplasma gondii
cttcttgactttgtcgtccacgactttctcctgttcccgcaagagcgcttctcggcggctcaagagccccaacgccccgcactcgctgctctctctacacttccccgtctgcgcctcttggcttctcccggctgaaggaggtgacgcagaagcagaagagagcgctcgcgtggaagagcaagacgcatggcctagacggaaggtcgcgaggtagtctccgcccaaatgcagaagcggcggggcggccgacggcaggaggcagcctggaagcagagcctcggtcgtgagagggatgaaaatgcggggacagggagacgcagagacggcagcggctgctgagtcaatgggagaacagggcgaagaacatgacggcggagaggagggtggagcacccggggcgacatcgcgaggtccaacgtggaagcacggagaaaggtagtgagataggagagacgaggcggcctgaacggggagaaaaaggccattcgaaaaacagacacaaagatgttgtgctgtccaccggaaataacgcgggcaccggggcacctagagattcagagcttcaagagatcgtaccgagttctgcaaagctaaaaatggttccgcttgttcttcgtattcgccaacacagaggcgtagcagccacacagttctgtacacggtctcgagtccacgcgcggaccctaggagaatgctgccttcctcagcccagtcgtatccccttcttcgcttcgcctctttcttgtctgtcctttaagacagtgcagttggcatgtctacctccagggagagttaaacaaacagacgatactacacgggatgttcgcccaacctcgttttttcctccgcctgtatcgcgaccatagtctcgaccatctcctcttctccgctccttccacagctcctctacgtcgtcgtgttccctcgtttttcttttcttcctccttttgttcgctctttcttctctgcgcctacctcgtgctggtcaagttgcgtcttcagctcctcagcagcggcttcatgctgctgcagcgcgcgcatgaggtgtctcaccgcgccctcgacagaaggagagggagaagaccggttgagagccattccgatgcgacgaacaaacgctctggcgactctgtgctgcggccaaaaaaggagagagaacggctgttccccgtgagtcttgagcgcgaacgtgacaggacggtcttggaaaggaagaacgtgaaagcgggggtaagcgatagacgagaagccgagaacgccctaggagaaagaaacgagagggagagatgagtggcatcgaggagaaggaggcgagtggaaagcaggaaacgcaggggcccgccgaggggagagtccggtgcatgcagaaactttcgaaattccacttcttggaagagggaacgaaggcgaaagagaggaacaaagatgcaggccacagacattgaaggggcaccaaggaagacaacacttcgtcgaaaacgaagacttctcctgaagagattgttctgttttctctgttatcttttgatgttgatcgcgtcaactcatgaagtcagacgctgtctgcctggcatctgtctggggaaaggactgggaaaattgtttcaaacgagctctggagacaccccgagagacattggcatccgttcattgaactacagagaaaagaaaaccgaagcggccatttttgccgctgaaagaaaggtcgattcgccgatcgagaggcctccacatgcttcagtcacggcgtctctctcggaatgcgatttgcgcacgcgctggacggcagctcgttgcatgcagatttggcaaagaaagttccacatagagacctgagaagaagtttctgcccctcttcatttttgtctttcctttcctgctggtttgttgtcttttcaaggagcgagtgtgggagcctcagcgtgtgcaatttcttgcttcgccttgcgttcaacgtcccattgtgaggggccgcctagaacgagagcggtctcggattcgagcgtcggggcaacgcgaggcgaaagggattaaaactcggcaaaatcacctgggattgggtggaaatggccttgttgaacgcttgcaagaaggaaattcttcgagcgaaagctctaaaacctagggcgagtcgcgggtgccattacggtattgcgcaggcttcaaaggtttttcagttctgggcctcgagtgacctctgcatgggaggacatgtcgaggccggggacgccttcggattttttctagccagaacgacgaagaagtcgagagcggttttccccgtcagtttttcaaggtgcgtgtaccattcggctctcccccagtgctgcttgtttttgagtccagaggtcgcggtaaaaacctcctgcaagatccaagatttcttgaagctgtgtcccctcttcctccattgacttttatcttttgtatctcgtgaacgacttccttcgcaaaacagagacgctgtggagttcggtggaaagagcaatgtgtgtctgtctttcttccgagcttctctaagcaccacacgcggtgtcctcggcaaaa

SEQ ID NO: 2009 - DNA, 1617 bp, Toxoplasma gondii
aagcgagacaggcaacgcagtgagcaagcaataaaatgcagataggggaagaacaagcaggactggacggaaggcaaggcaacgagaaaagcaagcgaagagacgggaggacgtagagcaggaatcacggcgggaacgaggttcagtggctcggctgcgacctggagtcttctgttcgtcgtttcctggtatcctattgtgtggattatttgaggaaatctcggcggaaagactacaaagaagaaagaatgcctttaaatcccgggggggaaagggtcatcgtatccggggtctgtcgaccacgtcgatgcaagcagccgagagattccggttggggacggtggagtggacgcaaactgcacgagacaaattttagtggtcccggtatgaaggacttctggcttgctcgcgagctccaaccaatcattgatatatttgatgtaccgcacagcgactaacggtgtaaaactgtgtagcagaacggggaagagagacacgcgccgctgttgctctagattcgaaggaaggaaggtccccccgtctttcaaaaggatcgagaggcctgcgaatgaggagggacggcagagcttaatgtagtgcctggaaaccggtatcgaggtcaagggagctaggacagtcttgaattgtgccaacacggaaacggacacacccatatcagacacggtgtagcagcacgcaccaagcggtggcctgtagcgcggtttagtcaacaaaggaaacagagacttcaaacgattgcgcttgaaacaatgtgagcaaaacgccttcgcccgttccggacggcactgtcacaccgtggagctctccgccgccgaggcggaggcaaaccgctgacttggtagctttacaagtctggcgcgaatgcctttctcgccacgacgtctgcttgttccgcgatatacccgtcagggaaaccgtcattgtacccggaagggaaaaatccagatgtctcaaaagtgacgcgcgccagccgcgaaggagcgacaactgcgtgggtgccactgctgcttgaggtgtacatccactgtccggtgtcaagcacagctgcacgtggccatcctgtccactacatcaaaatcttgactctctcaaagtttgacgaaaaagcttgctcacacggaagagctgattgctcgtgtgcaagcgcggcctcacgcctgtgcttgcgatttccgcttagtagcgcggtgagaaagtttcaagcgctgtgaagatggacagaaaggggggcgcgggagagtgtcttcattgcatgcacagcgcgaggcaacccaaccaaaaacgagttgcacccttattttgcgcaggcacgggtcatcccagttacccggcacggtccctgcgccctacgacagggagccgaggcaggctacaccggcgggaagcccagtcggatctccgggagagagtggaacggaggtcccaccacggaataaaaggcgggcgactgcacagctcggccgagttgtcgacccagactgctgcagttttctcaaataagccggctgcggcgtctgtcgtttttttcgccctgcgttggggtcgccaacgaccaggtcgcacgatgaaaccgtgtttaccgtctgccaatttaca

SEQ ID NO: 2010 - DNA, 1942 bp, Toxoplasma gondii
caactggttctcatggtggaggcaccgtacacgacgccaacaaagaagcagaagcgagaattcgcagtgaaatccgatgtagtgatggtgggacgagcggaacacttcctgcacagtgtgctttggtccacacatgtgtccaagcacagggagccgaaaaatttgcgtcgctcacttgttgaattttttttttgacccagctagactctgcagtgttccttgcatgattttctggttttgtaaattgccgcagcgaaaaactggaacccacacattttttgggtactttaggtattgccttgattgtttccacctgcgtccaaggaaaattagtgggatctgcgtccacccgtgccaaggagtctacactgcgtgaaagacacacccaatccctgagtagtgaagagcctaacggcactcggccgaatcatcagtgagacatgagtgtaataaagcacagattctcgactcagtgtggacagactgatctggaattgcgctgcatacgaaaggagctcctgagcgctgaccggacaagatgcgtttctgaagttgcgttgctccaccctcgcaatattgtctaggtatctggcttcattgctgaatccgtgactgaggaacctgccacaaacgatctgccgtctaattgttcgcgtgaacactaaacacttcggcggcgtcgagaatcgtggtgttacggagaggttcatgctcgaaaattctgtcagaacggccacgtccgttcatgtcgctaaacagcagccacttgcgtgaccataacagagtagtaagccgtaatggtaccggttccggcatatttcgtgatgtttttccaaaaaacacctaatatcccgcgatatcagtttccgcgaagacacgttttgacgcatcccctttctgtccacgttcaatgattactagataccgtcctgctcccacagtttttgggggcctgcagcactcgacagtctgaaatgttttccgacggtcgaaaacggaatgccctcgtttttcgccagagcctggcgtttagttttctagccatcgtatgaaacgtgatctcctgccgtaagttgacgctgcagtcacaagcttgtgggcttcctggaacgcaccatttccgtcgttcgagtcggtcctcattagagaacggaacttagacaatctttcggctataaatgacatgcaactggcctttttcattcattcagttgcgtcctcaactgtaactgcttcacttcgtatctcattcgtgcaattaccgttgtaaaccagtggatgcatgcgctacctactgccaaacttgagtcccggatattcgatatggctgatagatctgttttctgacggtgcgaaacacttatataacgaaatcaaattcgtactttcatctcgaactcagttttttcttgaaagcgagcaaggcgttcgtgcgagttcaaaactcgagggaaagttgtgtgacagcacaaagaattgtcccgccgcacaacgcatgcagatgccaatgcgttgtggagtagcgtcatttcttcttgttgtgttgcgtatttttctctaaagtgggacgcagtgtacatcagtgactgtcacgagctctatcaagataccagctcagcacttgaaaggcaaagccgttctgggcgttcggctttttgcgtgacggagaaattcaccgtcattgattcaatatcccgttgaacttcatcgtacccgtggcccattgagttttatccattgaagccccgattttagacccggttttgcttgtgggttgagcgaacgtcatcgtccatgcgctgacactgacgcgtaggaccgtgctgcttgttttgctgtaaatcatttaagcagagtttcatccggcatcctcgcctatactagggtgtctatgtttctaattgatatcataatatccgcaggtatttgtgtttgatcaaga

SEQ ID NO: 2011 - DNA, 2749 bp, Toxoplasma gondii
gaagatcgcgccgaagtaggcgatcgcccaagcagggctgttgcatcccatgatcgcgacgcgagatcttctgtcgcacccgaggtacaggagacctttcgcaaacatgcaaatgtcgttccagtacccctgccaggtgtacatacaccagccggggaaaggtccctcgacgtacgaggggggagcggaggcgtcgaggctctttcgcggcaatagggaagtcaacatggatccgccgtcgtctttctcgacgtgtaaccggtcggagtttcctggagtctccgaatccgcgcaccgcgggggatgctgcggcgaggccccgccagcctcctgcgaggttttcgaggcgccgtctcgacttccagatgcctcaagcgtctccttcgcggcgcgcgctctctggagagagacagcgtcgcgcgacagaatgcgcggcgaggcgtgaggctgaaaagcgagagctggagagtctggaaaacgcctcacggtgtctgcaaagaagtcgacgaccgtcagcggaggcagcgaggcaggtccggactccgcgacgcgaatcgggagctccttcgtcacatctgtcgtccagaagaggtcctcacccgacttgctcggcttcaactgccgattcaagcgcgcggctgactgcagagaaagcactgtctgtacaccggcacactcctccaagccttctgcgcccacggacaccagccgccccgtcggaggcatgtccgaggggtcaaaaagcaacgccatctcgagaaagcagacggcaaccgcgcgacgaggaaaggcggcggaggggaagagccggatcgaggcaacgagagacgaagaaggccgaaaacgagaagagggagcgtggagaggagggcagagaaggaaagagaaagcaacacaggagtgtagaagaaggaccgcagagagaggcaaaaatgaagcggaagaagaagaaagaagcagaaaggaggagaaagccgagaggggagagcgggacggagtcgcggaacgaacgcgagaagaaaaagaagagcagccggagaccgagcagagcgggagggactcgactgcagcgggaccaagtcataaaaagaagagaagagtagtggaactggcgactctattcttctcgcctggctcgggtgcccgctgggctctgagctggctgcgatgtcaggagagcttgcgcgagctagttctgggggagctgaggagctttccgagcaaagaccccaagtttttaaagaacgcgaacattgtacaaacagcaggagactcgtcgatgcctgagcaactgaaaaatatgtcaaaaacgcaatcttcgttgccccgaggcgccaccaccatggcccagcagccggatggtcttgaatggcgggaaggcaggctgcggcgagcgtttggcttttcagatgcaaagggggcggggagattttgaaagtttttgactcccaccgcctttccttcctttcgctgttccagcaaattcgttttcttcagcggcgactgcgaaaccatcgaaggggagcccggcagcgaagctctccagggaccagtaaaaaacgcgcgcgtactgataggtctcgaatcgaagttcaacaggacacacacgccgacaagcctctggacggattctccaaaaagctttctccttcttctctctctgttctcgcctgctgctccgttttttatcccctttcctctttgccccgtcgccctcctttcttctgttctcgcggcgactctgcctggtgtcttgcgagagaagagagactcaggcgcaacaacctgccagtgggagagagaggacgatggcgatacggttggacgagtcctttttcgctgcatgcacccgagccttgtggcttttctcggggacaagagcgcagaattcttcgcttcgtagcttcgcgccgttttaaaccagttcgttaccgctcgaatgcgtgaggagacttgggggggagagggggactctggagaacaggagtgacggcgacaaaggcgcgtctcccagctcggtgtcttcttctctctcggggcgttgggtgagtcgccagcctccgctttccaagttaaatcttcttctcaccgtcctgcacctcgtcctcttctcttttcttctgctctctgccctccaactcaacggctttctccaccattcttcgagacgctttccgtgggcgcggggacatacggatacaacattcttatatacacatcatcacatatatatatatatatatatacatacttataaatatatatatatatattgtatgtatatatgtctatatattattcaatttattatttgtgtgcatgcaaacgcgagtgctagaagaagctcaatctagcctgcgtggacaactaggagtcatgtcggaggcgtccgcgttggcgcgcgttgtgactggcgaggcctttcttccagagccttgcccaggtgactcctagatgtcaaaaacggtttccaggagaaatcgcgaaagtggataagaaagcgctcgcggctttcttagccagccgcgcgccttccggtgtctgtccacccggcttcgctcccttctcgcacatcttccgaattcggatctcggtctcttcccgccacatcgcttttttcttctcttcgctgaagaggcgagaactcgagaagtccctcctttttggtagcgccctcttccttcttgcgttttcgcgttctcaggttttttcctcctctcctctctcttcactgtccggtcctccacga

SEQ ID NO: 2012 - DNA, 1092 bp, Toxoplasma gondii
ggaacgtgaatcgttagcaacgatgtttcgatgaagtgtaaacagaagactgcatatggtcaagacggtctcacacagtgtacctcggggaaggtcacaccggacttacgtccgtaaaaactggtttcatctgtgattagcagctgtggctgtgagtcgaggaacctcgcaagagttcgagtgttagactttttctgtgagtctgaatgtaatcgttctaggaaagagtgacatccaagaattctgaattgcttcaatagtgttcgcgagcgacagccgaagagcgttcaaggacagactcactgaatcctccacccaaacgctaggaagaactgcgaggcagaaattcttaatgcctccagcgctgcgatgtaaagttttcggagaaatacggactcgcgaattttctgagggcggcacatagacaggcacggtgtagtccgtaaatgcgccgttgcagacgtttgattcgctagaaaaaaaacgaaaatgggtgttgagagactatgtcggggagtgcggcatcgcgattcttcagtgaagaagtcataaagagtaacctaacacaaccaggaatgccatgtttcccgtgtgtcgctaagcgagtgacggattcttcacggtcaaaaggtgcctcacagaactgtgcacggcgacgtctagatcgtcgttttccagtaatgctgaacgcacaccgtagagtaatcggaaggaaactcggactttcaactcttcccagctaggtcagtgtaaaacttcccttttttggtgtcacgagtgcttctcccttctcgaactggagacagcccttttcgaacaccgcgtcgacttcagcaaggcacacaatgtgtattttttgccatgtctgccttcccgtctccttccgcctttagcaggttcttggcgtttctcctgtttcggcgatttcgactttcgtttcctcatcgtggcgctgcgtgggcatttctgtcgctttggttcacgccagtgattccgacgtaacatataactcgaagcgagttctctgcactctgcaagttcttcgccagtccttcctctcctgctccgcgtaaacacaaacgtctctcaaaa

SEQ ID NO: 2013 - DNA, 3361 bp, Toxoplasma gondii
acagttaaatatagttgcatatatggcaaatgattcagattttatacgcagtgatttaaagaattaataatatatattttttttcaaaaaattatacggacattacttgaattttaagctttcttttctctttgacggaagcaggaaagctttgcgatgtcctggactgtcaagagaaccttgtgtgccgcgtgttttgcaggcaaagagtcccctgttttcgggacccacctgtcgagaaaaatcgcgagaaaacagtgttgcacctcatgcatttcttcgcaagcactgcgagcagagaaggggctatgagaggtgcgtggcatgtttttcaaaagccgcggcaacgagctcgagattcatttgcgagcgtttcggcttcgacgcgttacgctctttgatcttcatggcaatcggaaagcagaggaccataaacgtaactcgctctcttttcgtgccagtattggtccaaagacgtacagaaatacagttcttcgcaaagtggggctgtgccgctttgaaggccagacgcttttatgaagacacatagcgatgttcaatcgcaacactgtttcaattctacaccgttgtacccctacctaaatgcatgaacagagcggatgtctctgaggagaaaacggagcgcagagggtggatctgcgtgcatgtcgtgtaggattgctgtgcattcgtggaggcagagaagcggctcaaaaatcttgaaaaaagcagatgcacacattcatacgtaagtagatgcatatgaggaaatcccgacggggaggggatgacctggctgcgtgagatgtagaatccctgagcctattatttggatggcaaagaaggttcttcgaaacggaaaggcaacccgagaggccataaaaacatgccagcgaggaatagacacaatatcttacccacgcgcgtgtcttgctccagcttgaaaatgctgcattcaaaagattctttttgcctccaaaaaatttttttaacctccaacttgttttcctcgtgagcgcaagctcagagtgggcggaaagcaacacacacgggggagttcacctgcgcatgcgtgaacgcaattttttttcaggagcgagacagcgggtgtcgcggacgcgacagagaccgaggcgtcgtgggagacattggcagggtcctaggcacgagagggagagttcttcgtgcgtcgagggaccgcaaaataaggatcaggtgagttttcaagggggttttaagttagaaacggaagcgaaggtgaacgagaaaacctgaatgtacggccagtgtaaactagcaaaggagagacccgccaagcggagacggcggatcttcgccgcgcgtggccccgtcgcgggccttcgcactgtgagaaaagtcgaaggatgttgcccgtaaggtgagacaaacatggcggctcttctcggctcaggcttcggaccttctgactcctctgttgaaatttgcatggtcggggtactggcaatcttcactctcccggcctcttccccaagaacttctggagcttttcaacatccaggtatcgcgactattcagagagaaaaaaccctggcgccgggggggtttctgtgcacagaggggaaattacgctgcgctccccctcggcgtctccgcctctccgcgacaagagacggcaacgtttttgtgtttccgagggggattcggtcctggccttccctccgcatccactcgtctctatttcctgggagtttgcatcttcttcgctgccgccgaaactgcagaaatctcaaaaaagcgcgcgaataggtcttgcccacgggttttcccgtccgaggctgctggcgccacgttgcgtggtgtgccgcggggctttgggtccccgcgggggtcgtcctccggttgcctctcggaattttgccgaattcgtactaaagcggcggtgaaatattgccggaccgaaaaagccaaagaagaaaagttctgcgaagctttgtcccggcagtggctctcgccgtcccctgtctttgcgaggttgctgtgcggaaaacggtttgtggcatttcgaggtgagcttcaggcggctacgtggctcaactctttccatattcgcgtgtatattgagttcgcttgtcgaatgttggcctgcgttggcggacagagggaaaaaacaccctcgaaagagaccccgatgggaaacgtcaggtgttgaccgtatcaacgacggtgtcggtgtgcttgcacgtttgcgaaaatctgtatgtcctttctgctccggcgattcgtgcgcttgccaaagaattcttgccggcgtgtgttattaagggcggagtcgcggactagttgaaagtctttgcgtcttccattcagacaggggagagccaagatttgagcgaggcggctgcggttccgttccgcgaacctgcactgggcctttgggtactggtgtacagacaccgcgtcgcagcggtacgcccagcgttgggactgagccgagattcacagttctttgtttccgctgaggctgtggacattcgcgaaacgcgagggcaaggaactctggagcgttcacgctcaagtggacggaaaactgtgaagagaccctgcccttcacatctactcgcgccgcgactgtgtctgtcgcgggttccacggggctcggcttcggacggacttttcacggattcggtggcggctggagaggcgtttctgaatgcatggccgtgtatatgtttcccttctcttccagccaaagaggaacgggttaactcaaaccggtaaccgtaactgatcgtagatttaccagtcagcagtacttgcagttcaaacagccgccgtgattcgcccgaaagactcaaggcgcccggagacgtgtacgtgtcttgcgaaacggtccatggatttcgcgccttcagctgcaatttcttcagtatttttgcggccgccaacttgccgttcgttccaacgccacccgcatgcctcgtgccaaggcggacaggagtctcccctggactcgccctgtgcacaaatagagttttgaggtcggtcagacagccgcctttgcatgtgacccctattcttagacaggcgccgttctcagctgcctcaaacgcgagtgtctctttcacgcagcgctcgacctcgttctcaccttacctcatatcctccatcaactccttccttttgcttctccccagttatgagaaacggccaaccgagttcttcatgagtgctgcgcaccaccgcccgattggactgctgaagacagctgaaggtgtcacacatcaaatccttcgccatcaaggttattccacataggttttattgtaggcgtttcggggtacgcaagagagctagatcgattcttccctgctttgcgcga

SEQ ID NO: 2014 - DNA, 2901 bp, Toxoplasma gondii
actcgagctcaagagcttgagtttcagacggaaactcgaagagggaagtcctgcggatgtccagcgatgggtgggctgtacaaacagcacgcggcccagggatgaagggcttcacagagtctcagacgccgcaagctgcgcgtgtcctggttgtaaccgacacactgtcgcagattcacatagtgagaatcttcaagctagcttccgcagaagaccggagatttggtttccacgaatctgaatttggccttggggaaaaaagcagactgggagttcgcgtgcagcagcgacctttccgtctccgaaacggcgaggtgagtgtcaaggctgtcgaggcgacgcgcggcgcgaatctagcgcgagcaaagaggaaatacaaacagaagaaacgcagaaaacgacttggaccggcaggcgacagggccggagctgtcgccgccatttctgcaaagacgctcaagggcgaaggtgagaggcgggttgctcccgcctgggtgcatggaaatctgccaagtgggtcgaagctgcagttgttttcaagccagaaaacctctccatattgatcaggagcccgaaacagattcaaaatacagaattttctgaaataccgggggaaacaaaacagagacgactggccactccaatgagatcacggccgcagcacacttcggactggaaactaattctcacgtgggaaaggtagggtggcaaaggaccgacggcgaaaggctgtctggaaacggaagagaagcgccggggcgtgagaaggatgaaggcgagcaacttcagcagtcgctgtttccggagacactcgtcctggtggataagcgggacgagaccgccgagagccatgtgctaattaaaagcgaggaaagagccgccgcaaaacgagaacgggtagacacagtgaacccgaaaagaacagaagggcgacggcagatcctcgtgtcgctgcgccgcgcgaacataacggacggtcgtgaaacgtcacgaggcaactgacgaaaatgagccagaaagattatccagaagaaagcacacgactaccgatccgcagacggaaccctgcgggttgcttttagcgaagaaactcgtgcgtcgaggctttttgaagtggtaagcgcagaagggacatgcgacacgagacgctagaagggaagacaagccaggtagacggaggtgagtacaacggatacaccatcatgcacaaaatcatagaaccaagtttgtacaaagatatttgagcaccagttttgatcgcaaaaaagagaacgccgagaacagcgatctgcccgcgaagttcgtgttcgagagaactcccgcggaagaaccaccaccccccttctctgtgtcgattttgctactcgtgcgccgctgtttcttcaattccctcgggtgtcaggacacccgaacgatatcaacggcgtctcggattttcgagggcggcaaagaagcgcagcggagagcttgcttcatgaatgtgtcatccgtttttgtccaccaaagttcggaccagtgggacaggaagatcggctacacatcttttcaagcgacggaacggagccgcgggcacgtaaacagtacacgcggttctgtagaaaacacgcgagagcacgcgcgggtggccgatgctggtcgcacaggctagtgcctcagagccatcgaacgcgatggtcggtacgagaaaaaattccattttcttttcgtcttacaggacgttatgtcaatggaaacttacgcgagtatggaacggaggattgggaaccagagtcttggcccctatctaggtaggcaagttccgccctgcaagacaccaaacaagaccagatgcactgaaactcagaattcagctagaagcagaacgaccccgcctccagaaacaccgttataaggtgtacaaactgtgagaagaggggttttgctagagtagagaaacaacggattcgacacacgtactccttggcaaacacaaggaacactgccggctaatacacgaactacgacattcggttcggcaatttctgcatgttgaggcagcgctctaccaggaaaactagggttcaaccaaatgtcgaccgcgtattctccgacttctgctgtgctgcagtagtacaagatgcgaatggtagcattagtcacttacacgctcgtctcgggcccacagttttgtctagttctctcacgcaagtgaggaaccagcattggaaacccagctgcggtgtgactctcacgcggtgtgccggatttgaggacgattcaatacttgtggttgcggctttgtgttttcaagtcctgtttctatctgattcccacagtatcttataacataaactgcgaatttgttttcgcgacatcgaatggaggaaggctgcgcacaacacgcagaacccgagacaacaacccgtgtctccaacgtagcacgcccgagttgggtttcatggttcccctgttttgcatccctcgtttctgcaagccgagccagcaaaatctgtcaattactttcctttcactcactcatgcaggactccagcaatttatcttgaaacaataaccctcactgtcgccgcgtccggtgacgcatcgggatcagctgttgaggggaaaacatagtcttactaattctccgttgatggtgttttaggctttctcgggtggactgacagtgcgttaccgtctattggttggtggcaccaggtgactggggacacaggtacaaaggtcatctgcagcctgagggctgaatttttcctctccggtagctttcgaaacaagttaaccgaccacacttatcaacccgcaacatcaaaggctttcaaaagaacgggcgacaccgagcttccggcggcccgtggcttctctgtttcctacttggtggaagcgtgtccccactgccggtagcga

SEQ ID NO: 2015 - DNA, 2474 bp, Toxoplasma gondii
gtttgagcacgtgctggccgaagaacgtgaatctttcttcagtcggtgtgaagagtttttttataaagtctgagtctctttacagctctgtaggtaaatgcttgaatgccataaaacagatatagtcgggcactctgcgacacgcacatgtctcgtggcaacgcttgtgctggagctctaaggaacacaatcagccaagtggtttcttttttgacgtttccagtgaggcgttagcgacaccaagctcgggtcgcgactcctgatgtttcttgccccctcgtggcgtacttgctgcacagtggagctgcacttctctgacaaaagaaaacgttcacttcgattctttcgttgccttcccagtttgaacgtcagttagtctgcctagtggatcatcgcaacacccattaatattcgtgatctgcgacagcacctagaaatgactgaagtgcactgcgcgtgaacgcactcaacaaccagaccccctcgtgcggaacctagaaaacagaaacagacatttattggtacgtggcgggacacgttttgaatcaaccattgctttctgcgcactacctgctgtcctttcaaaaagttgacttgaagagcttcctttcccctgacgccggacctacggctttcagcgaccaaggtccagaggaatacgtgaaatgcaggatatcctctcatcgacacctcctttgtaggtgacagctaaacgaggcgtatgcttcgtcgttgaattgtggtacataccgaacttgaaaattggcgttacacaaacaaccgatggccttagtgataccgttgaagctgcttcattgaactccagatcccttgttcacaattcacacccataatactagactgcctgctcactggcactgcttgcagaatggagtggagctcgttaaccggtttcggcgtagcagtttatcttggttttggctgcgggtgttgtcacgtctggactgtgtagacggtacatttacactttcccctcctgtcaaaccagtttctactagcggcctaccgtaattgccgctcgctaaatccgagttcaaaatgcggtccgcagaacataaacatgtttaaaacgaccctgccgcacccggggaggggggtgaagaggtcagaattcccaaccattatcaggtgtgcgcgtgaaccatgaagtcatgatgttgcagtcagatctcagaacctcagaaatttttgaataaagacaagcgatatagaaagatgaacctgtttcctactgagaattcaaccacctcaggtctctaattgaggccaacttttcaatcgtgtcttgtggtgtgtgtacacatcgccgattggcaatccgtgccgtgcactccagtggccagcgccctgctgtttttactgaactaccatcggagagacaagagtcgctttattcctccagaaaacatggaatgcttgaacatagatgcaactcctttactttgctccctatccttgggtgaaagctagctgtgaaagtaaattgtttgtcgtctccgtgacatgcatctgcgggcagatttcgcgcgaaaatcgccgcgagcgggtgaccgaggcgggaggggcggaaacggctttcgagttcttcagtttctctcccaggagggtctcggtgggtgggagcaggaagaaagaggaggagcgggaagtgtgaaaaggacattcttctgattacgggaccaaagcacacttgctgattttttccaccaaaacctctaattgttttctccacaactgcgcaactgcggtgagttcgcccgttaacctgctgcttggcgcatctcgcccaccggccctaggtgacacacctttgtctttgaacgctccgctaaacctgtatacacacacgagctcggttgatatatattatgtgcgtacgcatgtggtgtcgttcctttctgttgcgctcccccatctgttgggtactctttccttctttcttacaaggatttctcgtttatttcatccacatcctggtccccatgtcaaaggacgacttctcgccccctccagggtcgagggggctagaggtttcgctgtgctgttggtgactacggcggtgacccgtgccaccatgagccctatttttcctcatttcaagcgctaactccgaagagccatttgtactcagtccggacaagtttttttctcggaattgcccgtgttgtctcagcgtcttgaagacaagggctcgaccctggccacgccgtcaagcgactctttgtgctttgttcccttctattcacccttctttgtcagaaccttctatcctcccctttctggtgtcttgggaagtgggaaatgcacgtgacactgcaccaaatcggcctgcagaggacgttctcgcagggaagttaacaggcaaccagaccaagaacatcacacgctcctgaggcgtcccatcgccgtttgcggctctgccttcctctcgctgtcctttccctttaagaaga

SEQ ID NO: 2016 - DNA, 2559 bp, Toxoplasma gondii
ccgtacttagtgagagtaatcttttcaccgccggcgtttgagtcatccatataattaatttggaatacagcggtcactgcagctaagaaacaaaagtcgtaacgggtgctcttacccagaccacgtcaggagttttccggaaaggtacaaaccgaagaacacttagaagcagtgttaacttagaaggaccggatgggcaaatgataggggtggaactgaggttagagaaggcacaaagagtgcgttgaatcacttgttccgtgcgcacgcgtctttcccaggcaggtacgtgcgaattttcgaagcaggagcgcagagagagccacgcgtgcatgttgtagacgcatctgttaagtggatacatgcgcttctcgcgtatgggttgttgccgtacgtacattgcttccccgcaatgcacttgtgcgtttggtttggcgtcctctgaggttgagccaggagtgggacccccagcgggcggtttgagagcataaccgcaaccgagaatggtgcataactttcatcaggctttgcataggagtccggtcacaatttcaccacgtctacgaaaaagagcgtctggggactacgcgctacgaacctgaaggcacctcttttcgtggaacaagcaggaaacacatgatacgatacgggtgtcggcacaaacactccaacacagatcgatcaaactgccgtgcgtttagaatcgcaggctttttctatgtctgatatcttgggtcaaccgatccaaaatcgtgtggggaaatgacgccggttcccagacgtcactcacacaccgtgtcgcgattttgtcgtaggtcacggtgggggagcattagctcagagcagacagtctgtaagctcggcagtcaactacagggctaacacagaactccgaaaggcaacgatacggcctagctgccgtttcgccaatagagtacgcatggatgtattaaaggagtaccacgtgagtaggcaaaggctacggtgtacttctgtgtagtttcgaggtgagatctctacggaaactcttcgagttaaatgttgataacaacgctttctagcgacagcttatttgaaagtggggatcgcctattgactccgcagtatatgggattcccatcttgatcgcgtgaaaacgacacagtttttcaaatcaggatatcgaagtaccttgttagtacggtgcagacatcatcggcaattgagtgttccggcacgcctcgagtgtagagcagagcggatacttagcaagtgcgctcaacgcagtcgggatctgccccagtgattgcttcgtgcgagtgaacacactgaggagaacagacgcacagagtgcattatacgggccattcaactacctgggatggacatactggcactttgccctcgatttcttccgagccgatcgcatctgttgtttccatctgttcatcttgacacccctagaaagctgtgtgcccttttctttcgacgaaagagagagtgttattgttttgtttctacgctctaaacgctgttttcttcgcgctcgggaaaattcgagaatcacaccacggcaacagtcggtgtttcgccagcaggcgctacagcatgcatggatcaaaaagggggtcattaatgggctttgtcgccgggggcggggggacaacaagggggaaaccaaaggtaccctaagagaagaatcctcctatagaaaggagaaattgccgacatctctgaacgttctgttttcgtaacatggacatttcccgtgtcttgaagtgaggcggctgttggtggctctgaagctgccggacataggtgtatgtacaactcaaccgcgaacatttttgtggtccccgtgcgactttcccaagaaaggaactggggaaaaacgagatgtcaatgcgcaacacagtgtggaagcttgaacttcttttgcttgttttcccgtcttctgcgtccccaaaatgcagaagtaacgtccttttcctctcgtctcgtcttcgcagcaccccgcgtcgtccgtcaccaccaggagatgccgttcttccgtgttccactcttctttgatgtgactgagaattgctggcgctccagtatcgtcccgtgttctcgggaagacttttagttttgatacgaagaagataatcaagagaaagcgttgtattttccttcattaaaccgtctcgaagccctctgcaactaccgccgcggtgcagcttctgaagtttccggtcctctcggccaccactgcttatttatccctctctttggtccgttgttcttgcttttgtgctcctgcgttacctcatttattacggcagaggagctgttcgcttgtttggtcgttcctacgtcggtttctttccacgtctgccagtggtctgcgtgcatcgccctcgttcgccgttctgttgagcgtcgccacaactcgactgcggcgccttcttttttgtgactgtgctatctctctcttatcagggcgaggggacagaagcggcctcctgcctcttgtctgttgttcgcttccacaaagtctgttagttttggctgttggccttcgttttctctgcttcaaga

SEQ ID NO: 2017 - DNA, 1917 bp, Toxoplasma gondii
attacctacatctacatatggcttgcacatcggaaagcgactcccccaaaggagacgaacgtcctcgaaagtttaagaattctcgatctcagcagtgccactctcatgcttggctgaaaatatgtctgtgaagacttggagatctttttcagatcgcaggtttctctgctgtacctcctgtccgacgtttctgtggaaaaaactgggtctgcaaaactatagattacgttcatctccgtacgcatgcctttcactgcacatgccaacgtaatcggatctatgtatatttacatactacatggtgcacatacatacaatgtacacatctctttatatgtacgtaaatgtgggattgttgtttcaagaaatctgtgtggagtcgtcgctctgtgcattcgtctctgtgtgtgccttcgatcgagtacaccgcgtctgtctcagtcgctaggatactgaatgagactccagttaccagatgcagcagccctgttcttaatccaccaccaccccagcggactgcagaagaccgcgaaaaactgccggccatcaatatccgtacatcgtcgcagagaagtgtagacttccagtaatggctcaaaacatgcgtaaatgtatgctgaccttagtgggcgtttctctgcgtatgcggcgacaacgcgtttccgttttctgtgaatctcgcagaggacctgcagcctaaacagcccctgcgttatttaggttttctgcaaaggagaagaaaccagaaaatgcggttgttctgcaattctctcgaccctacagcctcctgtgtgtcgttgtaaaagacagcgaggaacgtcctagacctcacgaggaagaaacccgctattcttcggaacgaacagagtcaaagaactctggagagagtgtgtatatgttatgcagaggcacctgaggggaaacgtcgagaagcaaagaacgttcattgacaacaacggacggtatagtgtccgcactccgcctctgtagctgtttctggcgaaaaaaccggcggtttcggtccgatttttcaagggtcacccgaaaaaacacactctattttccactcgttcctcgtcctgtcaaagttctgttccaaaatgcggtgcttttcccttgtcgcacccgcgactaccccactctccttttttcgactctccttcgcggtcttgcctttcctcagttagctggacgcagaggcatcagtgtcttgcggcgcgtgtctgtccgagatttttgtgtcagagtttctcgggatttcacccagaggaacgcaaacggaagagagcgatcgttgcacctgcgagaagaaacatcgagtgacttctgtcgcaggaaaagcagaaacgttgtgttcccaggcactccccggcaggagcggaccccgaactagccacggctggaggccctgttattgtcatgcgaggtctccgtgaacagagaaagcgcactgtcgagctcttgtttgactttgtcaaggagacagcctttttcttcacaacgtattcaaaaaagccgtggcgctccgagctcatggcaaagatttgccgcaaaaatcttgtctgggtcgcgtgcgacttgctaacggtttctcgacctacgtcggcaaagcgacctggcggaaatggaggtttgaaatttccacgaaactcgacggtctcgctctgctaaagacttgcgagttcgttctctctggtcttctcgtttcttagcatgagttccttgaaagttccgcagccgctcgccccaaccgaatttttccacgcgtgaggtttgccctcaatttgagtctcgctgtcgaacttccttgggccctttggggtcttggcttttctcgactcgacaagagagcagagctcgctgttgccttcccagaatcacagtgtgcttctctcttttcgtaaagacgaggaacca

SEQ ID NO: 2018 - DNA, 3899 bp, Toxoplasma gondii
aaagaatccggtctattatcagtgtggtgaagttgtccttccgttgtccttagcgatgcggtccttactgccttgagaacggccacgggggtccgcgcaatccgcactttccccttggatcttctttcactgataatcccacgtggttcaaagcgtagacacgccagtaaaccctcgcgttctagcaccgtcgcccagtgcggtgaagacaagatttcgcggcgcattgctttgcacgtaactgtgagtgccgcgtaggcaactgaagctcccagagtctcaagaagcaaaccacagattgagagaagggaacaagttccacagagagatggtgcagatgaccggcaacttgagaaatgtctgatccggttgttttcagtaggctcgtctgcaggagaatgtgtgtagcagaccaaaggtgccgagcatttatttttaccggtatcttcctcgcagcagcgacatcgtgtcgttaccacacctgtttctgcacagagctgccttaggcagcctttgggatttccagtgaatctctccatggaagatgcagtggatgtgtttccggtggtacagaacgtgtccttaatcgtcgttccatttgcgtcgtgctgtcgcggcaacgggatggacgctgagatttccccacgcgaaaaccccgcgttcacatttgagcacgcatcggcgtgccttacaagccgcccgcgtggttcctgcatctcacgagcagaagttgcagatgccggatagttcgaatacttgccgcatgtaaacgtctgtgcacgccggggtttccgctggtgctctgtcggtttctcaggaaggtaagcaaacgcagcccttgtacggaccctcacggatgtgttcccctgtttcctcagagcagggagttcgaccaatttgaagattggctttcatgggaacggtgtctatccacaaaatactgcggtaacgagacacaggaagtccctgttatagaaaatgtcttatactgccacaccttgggtctccggtcatgaatttcacctgacggttgggttcgctgagacgttatggattcaagcttgagtgacaaccgttagctgcgcgcatatccgaggggaaattctggccggatagacattctacgcgtgtaatcggagaataaattttcggacgtgaggggaagtttaactgcagtatatatgtttcgggaatgtgcatgtatgtttgtgacgtggctttcgctggcaatcgccaccaaccaaacacaacttctattggatatttcgacacgtacagtcggtaatgcagaatttattaatctacgtgacacgcgtagagggatcggtgaatctgttcgaaaccaaatatacggtttcagggtttgattttttgatggaagtttgtggacgggcgcaatgatggaacgttgacccgtctcgatcgcaagtaaggccagtgtccttgtttccaagaccagtccaggcctagatggatgacttcatggggaattcagtcacgtgtaaaaaagccaaaggaaaagcgcacagattccgccgtttttatgcttctcctcccgggcaagaaaatgaaagatggggaggagcagcgaaagggaaatcactgcattacatgcgctgtcctctccgcttttcgggggagcttgttgaaggcacctttgactaaataaaaagcatcaaccggtacatgggcccttgcaaaggaggagaaattaataagaaatcgatacgaatttcctgaggcgacagacagaacccatgtgggccacaaccacccatgtgcagttgcctcgcctgtcgacaaccaacgaaaaaaagagtgtgttgatgagtcttctgcccgtggataagaaacgttaaaaaatttagccctctctcggaacacaaaaacaaggcgtttggccatgaatagggaaacgcagatgaggatggaatgcttatcctttcgggcgagcatgtggaaagcgctcaacatctacagccttcttctaaaagtgcctttcagggggtcttttattcgatacttgtgacatcttgagcccatttcttttacaagaaaggcttcagacagcggagagcacgcactgccatcaaaaggaaatcggcacctaaaaaaagccggaacgacgcagcgagtgcgtgccctctgttgccacaacaaggtaaattcagttgttcatgccgactgagaaatgcaatgtttttttcgcatttcgtgacgaaaaatcgattgtatgagagccgagaggacttgtattcacagacgaatccggccaaaagcccacctatgcgccttccgcgtgtgacagcacaacgcagcaatgcgtgacgccacttatttccccaagcctgatttgatgaatatttgtacatctctgacatgcaagaagaagagcttagattagagtttttgttgccgatcttatattcaaattctgtttgtgtgtgatgtagtttcactgtacgatccctcgcgtgaggccacttctgttgcttaatagttggcctacttcgtccagaatagatacaaaacctatctggcactggttttcgacatgagtccagcatgcatacacaagtgtgatatttccgtgggaagtcagggtgtatctttcaggacagacgtttttcggtacggctgcagaaattgtgggcttccccgcaaggccgaatagataatctgcgactcaaggtctttttcgcggggtactcactaccgaaagggactattcaactttgttttcatcatatctcgttccttttttagagtgtaactagagaatacgtcgacggcggccatatttcgtgacataaacggtccaaacggtccatcttcagtcaattgacaatgctgttgagtctgtctcgtagtttcgagctgtcccacctcatcacttgcgtttaaatccagatattgcgactgcaaagccctccctccgccacgagtatacaaaataacgtgcttccttctcaaactgcgggagccagttatgttcttcagtctttcacagccgcatggactcagttcagcatgcttcaccccacgcatgcgaacaagcgacgacaacggaacgcctaagttcgctgggagcccggaacacacgagtcactttaggagcctctcattatctcagatgccgcataaattccaaaacaccgtcctcatgattcggtgcagcgtatcaggctggaaaccaaaagccgcgtcagggcacaactttaaagaaccgggcggacggcctagcgccgaccgacacgggacgcacaccataacatttcctgtatgctcagcaaatatctctaggcatcttgtctcgttcaccaaggagaacgaaacactcgcggttccagtggtgtcggcggtacttcaacagtgcacacgtttcccatttctcttttttgtgtctcttctagtgacgcggcgctttcgttggactaagacggaaattggcgtcgcacgtggccgaattcacagccgcacctccctcctggctagcgatccaggggcgctgctcaatacgtaaccccaccacgctgtggactataaccagcagtcgatggaccgtgctttcagctgtccgtctgctccaactttgatacttgtggggggtacgaaatttgtgtggcgttttttgaagtgcatgtttcacagaggtctaagtccatagatccaccatcgagctggcccctgttgtcagggtttcattcggaccctaggtagagggcctgtctccgaggcagccacccagcatctgtcaaacggatactggacgctggacgttcttcgtcgtcggttttttctttttaattctgggtccatccctaagttatgttttcgggactgatataaaggtttagtgtttacgtcgtcttggacagctaatgttccaacagctgcga

SEQ ID NO: 2019 - DNA, 4999 bp, Toxoplasma gondii
aaatgagaacggagatgcatgagggaaacgctctcagagaagaaaacatgaggggtcgtcttgagccgcttgctgccattgtcggagaggggcgacgccgtttggtgtctcgaacatacctgggatgtctgcgatcgccgtaatacctaagcagcggtttttgcatgttttagaattggaaacgcccacacgtcgtccccatgtacatttccacgcatgcatgggtcgacttgttttttgcgttggctgtcggtgcactccggagaaggcatcgcgtgtttcgctgtgccttaatgccgtttttgacgttgcgtttgtgtggaggaaacaggaagagtcttttgaatgcaatcgagtttctaactcgagttcccgttttccaacaaatgcgaacatgcaggtatttgtgcctttttgcgcccatggcacattttttcggcggtattttgttcgtgtcagaccgataccgtcgttctcttacatgccgcgtcgataaaccgggctacacactctgttctgggtttcgcgccttcccctctcgcagccttgcttgggacggaaactctaggaatcgattcactgcacgactctcacatcccttcagtttgtatctcctgcaccagatctcatgtaaaaaaggtatgcgacagaagacggcttctgtgtggagatctaacctcaaagcgcaaagccaaatttatgctggcatgcgtccttggcacaaacgtggctgttttgcgcggcaacaatgctgcaacgcacgttccagtttcagtttccccagtgcgaattcgctgtgtcgagggactttcctagagtcagcgcgagaacacggaatctgaggcagtgtcgaacaggagtggacagaggacagagcagcttaataaaacggggtctggaaaagagaacaaaacaaagatagttacacagggaaggtgaaaacactgcagttttgtcggcgctgtggaggagccaaagaatacggttgctttcagtaccgggggagtccgtggacaaatcctcgacggcaaaaacaagaaacaggtgagacgtctttcctctgaaatgaagaacgagatggaaacgcatgcctttgtttttcaagactggaattgcctggaactcttacgagttttttccgggtgccatattcctgggaaccacttggataaagtcgagattcccaacacgcagcgggaagttgtttcagttgctaatacaagaaatgatctcggagaggttcccgcacctatggagttgacaacgactgcgcagacagtaaggcatgtgtcggtgacgagaggggaacagaacgtgtgcagaaatctcgagcgttttcgcatctttttgtccgtagacaacgtagcccgaagtggaccatctgcggactccaactcgtcgtgtgcactccgcagaaggtgatcgttgttgtaagcctacgatttccattttctgacgggagacagcgaggccagcttgagcacattctttcagtcgatagcccacgttcaatctgaccatgcattttacttgtgatcccagactggtggtttgcttgaaaagaagcgtgctagttccggcggcttctgggggttgcttgcgtcttcgtttctacccagatcatgggagaaagcgaagaagttacacatatcacatccattgccgcttctaagcagtggctcttgttcgccgtcggctttctagatcggtacagattgcctttggttcccagagcggaacgcccaggagttcccccactttgttacagggcttaaatcttaccaaattaaaagagaaagcctgggaggaaccccaccgcacaaagccacccttttcgtctctattcttttgttagcagtgcgccttgtgcaactctcctcaaatgagccttgtcgacccgcagtgagagggtttcacctttttgtctggttctgcgtgttctctccagtttcctggctttttatttttttctcaacttcggctgcccctattctgcagaccttccacttccgcgtttctgttcggagctgcctttccggacattgccctgtccctcgacattgaggccccacggagagtctcgctgcctctcctcgagggtgagcacggttccgcgccggtgagctcccgtcgtcttctgtctcttttgtctctctctggggggatcatggagcttcttctctctcttgtcgaccagttgttttttttccaacgcaaacgcgtgctttccagtatttcgcatgtaaaaaacctgcatctgaaactctcctcccagtttcgtcggtgccgggtgacagccctctacctggctttccgctcgtggcaacccagtgacggggatatagtgcacccggcaggtgacttgggcatgtctctacggagttagcgcagttgaaagggactaccgttctctttctctcgtattctttttcctcctttacgctcttgaccttttctcttcaactcgcatgtgcgagtggtgactctgcaagtttggccgcggatcctagctaccgtcgcgcagcaggtgcgtccgttttgccgtcgagctctgtgtgacctaacccgtctcttaagaggcggcactcctggcgggagtgtgtagcgactccagctcactcttgtccagaaggaagctaggaatgctccacaaaaccacgattctttctcggttgcttcatctgcgcccacaaactcccctcttcccgcctcgcagacgctacctcgggcgcgaagctcccgactcgtcagtctgtcgaagatccgtgtttctcttcttcgtgcaagaactaaaagggcggctgcgcgtgtggctgctctgaacctcttgcgagtttcagttcgcggacatataaaggaaaagaccagagaaacaacgaaatccgtgcagggggagaaagcgaatgcacgcgcgctcggttggacccacaagcgccatcgcctcgtcctttgtaaaaccgtgtccttcagggcggggtcttcccgggtcgaggagaggtcaccactcgcagtatttctctcggttttctggagaaaagcgtgcgaaaaagagctaacagcactgactggaggaagaaagctgcgatttggagccctcgttttctgcttctacagctccgacctcttctgatacatgtgggctatcgactcttgcgacagaagaacgaggctgcgagtccgcgccctcttgcatatctctggtctacgcagacgcgtttcttagcgagctttgatgcacaaattttctgtgtcgactggagaaattaccccagcttcctcgcttcgctgtagagattcgtattcccccctgttcacgctttttgaaaagccttccccgccaaaaaaagacccccgatatcgacgcgtcacgcaggggcggcctccagacaacgcaacacagatgctctttttttcgctgtgctctcttgtgtttatttttcctgctttctcgcaaagaacgagtagcaccacaaagcttgagacgaggttgcttttctgtcttctgggacttttgaccctctgcgtgtgtgtgtctgtccggcccccctcggtttcggtgccagccacagaaagatgccgataatccctgcacttgcgtgctgccttcgcgttgctctccctcttcttctgccgctttctgtatctcagacaaacgtccctttccaccgaagtgaaacgtcgctcttcatttccttcttagcgatatcgaccttttgactacaccaaacgcgtctgcgttttctccccgggtactccaagtgcgcggcgaaagtaggcgccgaggagagcaaacgaggtgacagacttactctgagagtcgaaccgcgacagtgtgtgtgtttaaaatgaacacgaaaaggcggtgtttgtttgtgtgaacgaaagaagcatcgagcttccgccggcaccattcagaggtcgccactactctctcagacaccctggcggaaaggatcccgcctgcttcctccgagagtctgcgcgcctgtgtgtccgcaactgaggctgtcagaccgctctttcgatatttttcggtgaaaaccagatagtcgcggattcacgccttcgtagagaaggcgagacactttctcccggcagtgcaacggaatttctttaacacgagttgcaagcttccacaacaccgtccgcgtcctctctttgccgcgcctgcctctcactcctctagcctggtccttgcgtctgtctcccgctttttcggtcacgcctttcaccaaaggttcggcggactgagacaaggagacaagtggaaaaaggggaaaggttcacggtttttccattccgtcagtgtgtttgtgtgcaaacgcgcatgtgcgccctgccctccgtctcgtttctgaaaaaaatactcgagctgccagccaaaaggcttcccaccgtccgcgtagaagacgccgcgctctcctgggtccgcgtgtggacatacacgttgcacgatgtccaggtttctctcgagaagatcgagtagaattttcgttttctaaaaactccgactgcgtgggtctctccccggacgcccagaaaagttcagcttccctctcagcatctcctgcgttttcgcgctagtgcacccagaggcgccgacccccgcgctcggctttccgtgatggcccagaggacagggaacaccctagacaatggtaaaacgtgtgcggcgcgtttgctcgagttttgaggaagctagtgtttgtacttgttcgcgactgcgagccgcagaaatctgagccgacttccacgcactctcaccacggtttctgccgcaatcctgtcgtggtgcaagcacatctcgacgctcgttttccggttccggggacttgccacagtctacgaaaactgcgttgcagacccgcgggagcgtttgtgcgaatgcgttctgcggctgaagaacgtctctgttcctcttcgcgtgcctgtctgcacagttggtgagtatggaaagcgcgtttacctcgtgagtccggagatatttttcgtgcgaaaa

SEQ ID NO: 2020 - DNA, 2083 bp, Toxoplasma gondii
agttcttgctctgtgttggcaacgcatgcacccgaggaacttgaagcgtctttttcgtccttctcttctccccagtttgagaccttcgaaaaggcatctgcatgcgcgcgtcgcgacctgccttctccgaatcgaacgcgaccgaaagcgggagacgcgcggcgcagttgtgtatctatttttcgtagttctgtatatcctttttaccgtaatcgttctgtttcggataggcggtacaccgcgggagcagaggagatactgtcaggggaaggatttcaagcagctgtgctcgattgctgcagacgcatgcgtttttcgaaaggacgcgcctggagatccgtttactagacaagaacgcgaaagtgaagaatgatttcaggcttcctccacgcttctttagccgctctaaagtgacgaatataaaagatttctctgggttttcacctagacaccacagaagcaagtttgaaagaaaacatgcgactccactttcttcctaggtacagactgtcaagcatacacgcagaaagagatgcaaaagccgttctgcggccaggagacttcagcaatgactcctgaatgtcgatctctacatgcagagaaagcgaacgagagacagagctggtacgcccagcttcctgtcgttgtgaggaggtagaaaggcgcatgagtctgtcaggatgcttctctacagatttccgcttcagggtgtatggaggcgacgagagcaaaaggcagagaagaagaaaacaacaactcgccgcccttgtgtcctcaataaaatgcttgaaactgtgtgctattcagaatcgcgcatatatatatatatatgtatatacatacatacatctgtgccgcaattgcatgtgcaccccacatacacaagtacacagacagaagcattcacatacatatactcagacatatatgaatatgcctcaatatggattcgcccctctaaacacgcatacataatatatacatatatacatatatatatacatatatatatatatttttaaggtatgtatgtcttatacattggtgtataggtgtgtcagtgtgagccaccctcccccgtacagtgtggatatgatgaggttttgctttcccttggaggacgcgacagtgtctctttgccatatgcagcttgataaaccgcatgcagtgccccctctgctcatctcttacgtctttctcctttcaactgtcgctgaaataagaattcttagaacaacctgaaaaagttctgcgacccaggcagatcggcgcgcctctttcatctatgtaagggaggctgtgtataggcgaagtcaccgacctgagaagaagcagggcggcatcgcgggaggcagcgcgaaaagagattgttttaattaagaattatgaaaaaaagcattctgtgcttctacgggagggaattttagatgcgtcttttagttttaattgattggagtcaggaaacattctgtgcagtaaaggggcgatcctctcttctttcttgttgccgtggcggggtgtctctttttgtcttctatcgacgtcgcagcgggtgtctcctggctcgctgcggcttctccgcctctcgctgtcgaagcctcttgtccaggacgagaaaatttctggttttctttctccagaaaagtcgatttttttcgtatttccgcgcttgcagatcctcagattgcgaaggaaaaagacgagacgaggtcgaggagaagtttctcgtcatacctcgtctccagactgcttgtcctcgtccctgtcgccctctgggctggctttcttctctttctctgatgatctgttgttttgtatcgtgtcatctgtgtcgctcgttcgcctccgttccctcctttcttgccgagtactcgtctccctgttctctcccgaccttctgctcttcctcgtttcgttgcctctctcacctgttgtcttccctttctcctctcccctttgttctctctatcttgttctctctctcttcttctctcttccttgttctcgcttccttgttatctctcccctcctttttctctctcttgttctctccgtctccggttcgctgtccgtgtgaatgtaa

SEQ ID NO: 2021 - DNA, 3051 bp, Toxoplasma gondii
gacttctcgtctgtgcctacgtggacagtttagcagttcacttttccgcgtgttctcgctcttttcacctgagtagatttcgactccgtagtgttcttcggcgactgcggcaagccactgggcgagctgtcccagactgataacgtagttttttcctttgttcttcagttctgcaggcaggatccaggcggggagggagagcgcctttgctccgctgagaaacacgaggacttcgtcctccgtcgcgagcgtccgaactggcgggccgccggctgtacgtacagcctgtgcggcagttgggccggcgttgcggcatctgtcttccgcttcgtggattccctgttctgcagctgaggcggaggccgtgactgccgtctcgtcgaggtgcttgtctctcagcgactgcaaaacgttgtcgacaatttccgctgcgtcttcgtctctgttccgtctccgacttcccgacttcttctcagttgcatctccatcctgcgggggatgctcagagaccgacccgacccctctgtcgactctgtctgtcttgtctgcggctcgggcaccctccgcgtctctcttctcttctgtttctctgcctgcgtcggcggccctgtcctctgtcccctgccttctctcccgcttcgcgtcacgcgtgtgcagctcgccccacagcgccctcagcttctccaggccctgctgcaggaagaccgcggcggcagctacgcctccagcctcctcggctgcgggagagaaggagacagtagaaggcgacaggttcgtcttccaggcagggaagagttcatccagagcgcgaggctcgaaaacgttcccagagagaatgtgcgacccaatgtcacctcccttgtcaatcacgcagacagacaaagacgcgtttgccgtctcgcaaagctgcttcacgcgaattgccgccgcgagacctgcagggccgcctccgacgaccaccacgtcgtaccgcatgcgctctcgggaagaggagaaaacgcgcgacgccaaagaagacgcagagaaaggatgtgaggaagaagcgagggaaggggcagcggagagaagagcagaagaggagacagaaggcagagagcaagggcgtggaacggaagcgaaaaaaaaggactgggtacggaaaggctgttgagatgaaagggaagaagaggtagaaggagaacagacagaaatggagacagacgaaacgaaggcagcaggagttgagggcagcgagaaaaaggacagagagtgcggtggaaaagacacttgggaagcaccacgagaggtgaagaagaacgcgcgtggcaacgtggaggagaacggagacagagaataggaagaagtcgaaacgcaggtcgcggagaacggcaaggcgttcccagagacaagagccaaggagacgcgccagggcctaaagcgacagaagagagagcgaagagacgccatggggaaggaaagcgggcacaaaacaaactggagagcaggttgggatcggcgacgattgatgcatgcacagaaaccacggtctggacactctaggttggagaacgtctgttctcaaacgcgtctgtgaacctcttctggaacgttccttagagagacggcggcagctcggctgggcaccgacaaagaaacaaagatcggtgatgaaagtcccttccgacaaatcctgttgagtctagtcacgaagcgcgtcgatctccatctgcaagtctccctttctcgccggtccggtaggtcgcaagacttggggtgtacgtacagcttcctgcacacgagccacacgcgccatttccccgtcggtgcatctgctctagcgagagcgcggaagtctctgcttctggcctcaggtggcaacgccttccacatggacagacagactcgcgggcggaaggagaggagcagctgcgctccagagaaaagcaaagacgaaaaactggtaaaagccggtcgagcgcgctcgcgagctcgcagtgcggtttcgggtctacaggcaggtctatctctgcgcagcaggcacagcacggaacgacgcctcaagaaatgcggcgttgaactcgcgcttttgtcgaagggagacaggcacttcttgccaaaaagagagaagagacagaaatgcgacagcggaaaacaccgctagcgatttgagtcttgccagactcaccgagtgcgctgtctcaacggttgccggcgttcgtctgtggcggtcgccggtcgagactggcgggtcaaaaagacggggaaattgcgagagaattggaggaaacttcgaaaatgaaaaggacatttccaaggaaagtgcttcacggaggactgggaggaaaacgaggacgctttcggaaaaagttcccggagagcgcctcgacctcgcagctgtctcgcgagacaccgtgaagcgttcagagcgcccgcgaagttgtcgcttctgctgcgcattttttctctgcagcgtgcatgtagattcgcggctcgaagcccccccactggccctgtgaagccacggcatggcgcgcgaatcatcaggaagctgcagccaaggagaaagactttcctttctgcgagcgccgagttttccacagtggacgatcctcttttccacgtgtagagaagtcgtctcttttttctgcacttgtggggctctcgcaagactgcacagctgcctcggtcgggcgaaagaagagaagcgcgcttcttctttcttcttttcttttgcagatgaaaaaagtctcctcgattttgactgtgagaagaagctggtttctcggatttgcggcctcgtgacgccagcgtgtctccgtctctcggcgtcctcagtccacgaccttgacaaaggcgaatcaagtcgtttcctccctcccttggggcaagcgaattgcgcgttccgtcgattctccgacttctgacgtcgcccccaacgcagcggtggcgaaacgcgtggtcttctcctcccgctttagttctcttctttttctccctatcgaaagacgaaccgggtcgcacagctgtcccttctgtcgggctccgcgcgttgtctctccgcctcacgcacca

SEQ ID NO: 2022 - DNA, 2441 bp, Toxoplasma gondii
atagagaggcctgggtatattggtagagaaattgatctagaaggatagatttaaagagagaaacagatatagatacaaaggtagatagacgaacagatctacgtatttcgtccagactcgtctgaggaagaggcctggaaaagtgaatatcgtgatacgcgtacagcttgtttacactttactgagagttgacgcaaaggctcactatgttagctcgtatcggatccatttttaatctcctacctggtctgcgtacacgtcacacaacagtccatctccaaagcgcaaacgtagagtttacggttcagctacacggcgaggtctggtttccaatcaaacagatccacaggatttcgatgcgaaaaacgcgtccgatacagtgcacctggttattcatttttacaacaaacgagacccttaggaagagcgcggcacagagtgcaagcgtccagatatctctatggcgcccggaagaggatccgcaccactgcttatgtaaatacgagcaagcagagcttctccgaaatagccttccgtctgttttttagaacttgtttttcaaatctcccgtaaatatatgctgcaacttgtgcatttgccagagttcaacatctagttagcgaggcagcagcaggatgcgatttcacggtgctgcatgctgcaacaccctctttcgtattcttttgtatgttccggagtgactctctctcgacaggagaaagaagagttttcatcaaccctggaacgccttgtactttctccactccccgtcacacttgtggtaggacggtcaagagtcttcttccatatctttccaggactctacggaatcctaagactgcatcctttcacggcccggctctgtcttgtgagtatggtcttccggagtatgagcggcgctattgcgcaagcaacattcatctttcgtgggagattcgtttctaacttacaccgagattttgctggggggtctagtctgaaggtttcgactcgtggtttagatcgtgaaggacatggaggcccggaacaagaacgcgattcgggatatgctttgtttcgcggatcgaagtttcggaacgcgtatctcatgagcataccaacacagaaaaaaggattaagtttacctttgctttcgtggacgcatcccgaagggtgctgtcggcgccgccgcatttgaaggacttacgctcctcttccacgccttgtcacagtcttccgcgccacactgggagacccgcgcatacgggggaacaaaaaaaactttccatctgcttttttgagcttttttccgttttctcaccaagagacgttattaagaagttcctgtctcaaacgaagagacttcctttcccctcagtgtctcccattgtctcgtgattgcggcagctgagacgaccagcgatgtctcagtctgctgcttttctcatggcaacagtcacagtggcggtcaaatctttcaagagaaaaccgtgtcgaactccagaagaacctagccgtgaactttcccttgaaatcgtgggttttcgctgtttcctctgcatgcataactatgctccttccggttcttcatccgggtgtgtgtatgcgacggggctctgcatttttgccatttttgccggccgagctcccgtttccccgtggtcgatttttgccgcgcgaacggcgagaaagcgacaccgcaggcaagcggagactcgtctcgaaggggtctgtgtcaaaatttccgaggaattctgtgttccacgcgttctgcctctgaaaaagacttctcaccgatatacatacacacaccaccagtcagctgtatgccccccgtgaaacagccaatgcgtttggcttgcgagcgcgtctaccgctcctgctgattttcgcgtccttttccccaaactttcccgctttttgtctcgaactcgcagctttctcgctgccgttcggccgtctagccgcgggcgccgtcccctttgtcgtgtgtgtgtaaggctgtcgaactcgcggccgtggacaggttccttctgaagggcgtctcaacgctttcgcgcttcccggagtctcgactccagtcgctcctccttttttgccgccttttctcccgtcgttccgatatttttgcttgcggagacctcctgtctcctctgccggagtttccgcgcgtccagctcctctctaagaagcatttttttcgctctgtttaggtgccgcggtcgtcaacgaggtttggacggaggacgcgcgaacttctttttcttgccagtctacgttttggccccaagtcgcttttaagaaacgcgtgtaaccacggacgcgaaccaagcgcagcaacttgaaggccgtctgaagcaggaacgggggcaaggtgctggccttcagcagtctgcgatctcgaaaaggtactccccgtcggccatgctccaggcgcctattctagacttctttttctccga

SEQ ID NO: 2023 - DNA, 2292 bp, Toxoplasma gondii
gaacttggagaggaactctcggtcgacgtgcttgaatgcagagatgatcctcgggcccagcgtaagaaacaattctcccacctgctcagagggcagaggaaagggacagaccagcgaagacggaagagacgaagggagcttgaggagaaattcagacgccggggaagcaggagcggaagacgtcgagacggcagaggtggacgaggggggggaagccacagatgtagatgaggcagatgatggggcgctctcagagctgggagctgcggtgggctggtacgaaagcttttgacgctttgattttggaaggggcttcaccagataggaagcaacgcgagacggaaggtgggtggcgcaaaattccgaacacgtcgccccacagtggccatcgaagagggcaaccaacgcagctaagagacatggagaacaagtggagagtgagagaggtgatgaagaaagaggtggacatgaaggacgcagagaaggcggatgggacagcacaggcgagaaagaggaaggggatcaaacggaagactgaggaaagctattagcttaacggcgttacatgaaggacagggccggaggcagtaggaccagaccttatctacacctcttcaagtgcagcgtctcgatgggatacagtttcaacagagacctcccgcactgtgtttcaagtctatgcttggtacacggaccgacaagtacctggaggagtgtacgcagtatgaagcactaaattgcaactcctcagacgtctgtgtccatgcacatacgtgtctagatgtgtgtgtgtatgctcgcgggcgactggcagacttctcaggagcttacctggactacagttaagggcttgaatcgctgctttatcttggccctcgaccagtatgctcatgtccgaaatgagaacgtgtcgatcttcctgtttgggtcgccttccctgcatgaagcgtgcgtccatccgaacttgaagcgaagacgcctcgggccgagatctcttcgttctgtctccccctccacttgacagcggagcaccgcaggcgtagcaatcagtctgggtgtgtggccttgagatggacacagaaccagaaaaagagcaggcaccagaagaagccggaggggaagagcagtcagaacaagaggacagcgacaagggagcagaagaggcgccttcaggaggcggcagactgtcggtggcggtctcatgcgccattttttctcccacacggacaataacggaaagggagagtctgaaaagatatgtctttcttccgccaagccgaaggtttcgcggacaaaacggggaaggtcaagttggaaacaggttgcaggtatccctgtggaattgcggaatggcatatcacgagagaggcatgacaagagaccgagaaacgtgggtgttatatggaggaagggaggccatacactccccggtcctgtgtcctttgtgatgatgagcgcctgagaaccgcaggacgcatgacacatataaatccacactgagggtgtgaagaacgcgcgcccgacagagaataaaacaagtcgacgttctcgcctgatccttcttgctctccgacgtctcgatgtattctgtcgcccgatatctctttgtttctccgtgtgtcctcccctttcgtggaggcgagacagttttacgtgagagcagacggttagcggggcggggtagaacgcagagaagaaaagccttttcgatcgcgcctaaagacgcgtagacttcacaaaaaagagtgacggataacgagataggagtgaagtagaggtaacacacagcccgccagcatacaaaaaaaagagacttgagagtcgtcgatcctcggtgcccaagaaacggaccgacccaccgggcgctggtgtagacagatctcgcgacacggaactgagatagagggaagacaactgagacggggaaaacgaacgttttccagggactcaccagaatttcacatgcttgccacatgtaaattcttcctcctggagaaaaataaggagatagaagaacagcataaccagaggaaggtgtccatgatactaatgcctctgcgatgggaccttgaggggagatgccacacccggtgcccgggtggtgtgcgcaagatacgaaaggaagaacaactctgcaaatcgccttaccttgtgggtatcttagtgtgtcacgaatcactcactggttttctgtctttcagtctgctctctgctaatcttacagtgacaggaaaccctgaaacaggaaaaagggagtacggcggcggtgaaaggaaagaagatgtacaatca

SEQ ID NO: 2024 - DNA, 3374 bp, Toxoplasma gondii
tctcctgtctccacagaaaagccaggagacaaagaagaaggagaagaggaagaggattcaggaggagaccaagacgaagaagagcagtgagaagatcgagaggaagacgcatgtactggcgcagaaggatgaggacgaaacgcatgttgacggtgagcgtgaagagaccggaggagagcctcgcgtcgggcgtcgaggcgctcgaggcctgaggtgtcattacacccgaggtcgagaggacacactttcccgtcttcgcctacctctctcacaacaaaatcttcgcttctgtagcgaatgacgccttccagtttggagggcctttctgacacgaacgctcccgctcctatctctgtctccgtgtacagttcttcatcttctcccggggagaagcgagaagaagcgaaagcagaagaaggaagagacggggggagacgagaagatggaggcggagacaacaaagaggaagaaggggaaagtggctgggaagagagagactctgtggcgattgcaggaggcgcacaggcttgctcatcgaagagcctcgggactccttccccatctgcgacttctggaagaagagtgcgaggcgcttgaactccgcgaagctgcagaacgggaggctctcgccaggccgcaaaggcgttggaggagaacgcagagcgagagaaccgggcattgggagagcgagaaaaagggaagaaacgcgcaagagtcggcatcgaaaaacgcgaagaagacccgcgacggaaagagtccgaaaaggaagagaaagaagaagaggatacagtggaaaaagaagaagaagaggataaagtggaaaaagaagaagtggaaaaagaagaagaggagtaggggagagaaggctggcagcagggatctgtagtggaagagtgtgttttgcggttattcctgtttcgcatgtatctgaaacgaacaaaagaaaaaggtgacctttccggcgagagaaagttggaacatttctgactttttttgtcatcgaagcgagagaagccgagacaggactgctgcggtgtctctgccgccgcaggactagagccacgaggggcacggaggagaaacaaaggcctcatttcgtccgcggaaaatgcgtcccgccagtcgacaagaaaaggaagagaaaaagatgcagtcgaaaaaagaggatttggaaggcgcgagcggaggagaccgaagagaagatgcaaacgcggacacagagagtccacccgttgagtgtctggacactggattcctccccagacagacagaggatctggagaggcagtttttccagtgaaaaaaaaagtttctggagaggaagagaagagagatggcagacaaggtatccataaaaaagcaagtgtaaagagaccgcagagttgtacgcaaaggcgcgcagtgccgcgcagaacgctctttccctgctcgagtgtctccatacgaaaagagggcttccgcaaaatctgcaaatgagttgtgaagacaagaagagtctctacagttttccatgatgaggagactttccggagctcttcgtcttggtagtgacgggcgtcatgaggcatctccttccaggaaaccagaagacaaagggcaaggaaatctgtagtcaaaggcaatgcacagactcgaaagccacacaggcacgttacgatatatatatatatatatatatatatatatataatatgtatataaggaaaaagctagatgtatgagcatatatatagaacgatttttatttatatatcttggtatatctatctatatgtgcattcatatatatttatatgtgcgtagatgcatgtgtgtttgtacgtgggtgtaggaagagagagaggaaaatatagagagctttgaacgcgtcgagtgacaggtagcgctgaacaggtcccagttgtcttcttcaaacggcgcagtctcgaaagcaacgagggattttttaacgagttccaggcacacataccagtaatcagaggcaaacctgcgttttgtttgtcagagaaggatcctgtggcgtccttactctggaggttgaatatggaagaggaacaaagagaacatcgaagcgcctctctattggaggcgtccttttcggaaatatgaacgcggcgcgaaaaaaacgaaaaccaattcgtccgtgtccaccatcacatcgctatacacatctgtgtcgttgtatgtatttcgtatggtttacttcgagactgtctgcgttctttaggttggagttctcctgggcatttcgtgattaccgtgtcaggtgctgcaaatatcagaatcgctacgtcccctccgtatctttgagaatcgcctgcaagcatctcaagatacatctaccttcgttttggcgagactctctgtgcgtctactgcatgcgtaggtgtgaatgaatggtcgctttgtgtgtgaaacgctcgagtgtatcagaaaggtttcgcatctctgaaagcgtttgtcttggttgtctgactgctctcgattttgtcggattctgaaaaagagaatctcctcgtgcggataaatcctcctctcggcctttgcgtttgccaccctccgccaggcacacaacttcgatctctctgaactggggaatagagacaaggaggcacatttctctatccgtgtattcatataaacacccgcatttctctgtccatgtctgaaaaatgacatgttttccatctacaattatgcatgagcctacacttctgccttgatgtagacaaacatagatttatccttccctttaaatagacgcagatttgctcatttacttatgcggggccaggcaactttttccacatgtgttttggatagttgtcaggagctgaaaactgacacagacaggaaagacagggacttccttttgacactgacagagcgagaccattgttcacgagtgactccgtggcgctcgacttctcgtctttttcaagcgaaaaacagtggagaagcaaggagtggcttttcggccgttcttcccatcgctcgacatctacgtggaaggcgaccttggcgacttggaggagttgtgcgaatatgcttgacgtaaagtggctctttgcgtgcccttttttcgcgagtcttgtgcctgggatatcctcgtcaaaaacttttgtaggtggaaatcgctctcgtgtgtaccggtggttttttatcggacggcaaaaggccgcatgttatgcttgtttctgcgagagtttggcgcgtcttaaatctacaacctgatctgcgattgcctgcgttaaacgcgttgcgtcaccagagcggtcggcgtttgtcttctcagtgtacttgcagcttctagtttcgcgtgctcaaagtctgcattctttgccccttgcgcaaagatttcaaggaagcgaaaa

SEQ ID NO: 2025 - DNA, 2125 bp, Toxoplasma gondii
acggtgttgacacaggatttagctagcgagcgatggtggaccgtcccggggaaaacacgtacggtcggttccgcatgtcgagagtccgtctgttctttttgagaattgggccatcatctttcatttaaaactgtgtaaggaagcacaaaaagcacagaactactccgcgcaggcgcacaaaaccgtcaggatgtgccaccggatgcggaacagagaaaaggggagaaaaagagacgacgaagacacatgctttggcccttttgagagcttcagggagcatacctgttgaacggcgaactggcgtcgaactttgtccgctttgacaagccgtctaaggagatggatcagccaaagaagaagcaggatgccggcaaggacgcagagagtgttgtgcaagcctggtgagatttccgaggccgctagcagagagcgatgcgacacaacaggcgccctgacgctgtcgtgccatatcggttctcttcgcttcccttcgtcgaccaaagagaaagaagaaagtagtgaggctgagaaagccgcgtctgccatcttggagaccacacgcgacggaagaagacggagtggacctgtacttatttcctgttctttccagcaattatcgttttccctgaatctcatgcagttcccttctccaacgacgcctttttcttctccttcttcctttctgccatccgcccaacctctctcgccgcccctcctacttcttcctctgccctgacgtgtgacttcctccttgatttgtctgttggaagcaaggaccgaagcgggagagacgaaaaggagatccacaactttacgagacaggaaaggaaatcgaaaacagaggggaaatgtctttttctttcggctttttagtcaacttccgcacgcgtccaaccggacaaagagagacgatgaaaaccggcgacgaggaagaggcacgaccggactcaagacggcgcaggaggcagccatatgcagagataagcgttttttctcaagagtgcatgaaaaacggtggaaagctggagaaaaggagacgagcaagtaaacttaactctgcagcagccaacgaagtcgtgtctcgccggattcccttctcgccgttgcttgggagacggcctgctgaccgcaggagagaagggaagaagtcttcctcctcagaaattcattttgattttcatcaaccgctagagagagaaaattcaacagtttcccgtctacaggctctggaccattcccgatctctatgctcttcgcccagcgacgattttttttcgcgcatgcagagggccagaggtacagcttcgcgacgggacagggcaattgatctttttcggaaacgaaggtgatttcaaccatatttcaaacgcgaaagggagaaactgaaatgcatctcggtttcttcccggtatctcttttgaaccataatccctttctggaagaaaacattcctccaggaaaagctgagtgtgctggcttgcaagctgactgacgatgaatttgcctatctttgtgatgagtgatttttgttctcttcatatcgccgttttgaagagctgcagaggaggtagagctgagatcttggtttaggcgatccacacgatgtctcagccaccgcgtagagagcacattggaagctggcggccggaacatgagttcaggtgcagcgttcatagactggggagaagcttttgcccgttttgttaggtttctgcagcgcttgaacccggtcatttccacctctgaagaaaatgcgagattgatatactgtagatacagatgcaaatagacagaagctaactcaaaaagatgtaatgctatcaaagtgtagcaggccctaggttgttctctttcctatatcccaagttctcctaagatcagtcagaaacgtttctatggggctgtgcacgaactataaacgctaaaagattttcaaaggcgaggaggctgcgggagctacgtagacgcccgagagaaaattttcattcacaggcttctggtcgctgtgcaggcaatttgaatcacagcggggcctctgcttcagatgcgagggcacaggctctgaggaagagaacctaggctccgccgcaaaaccgaaaaagtttatcgaaaacgagaatgacaa

SEQ ID NO: 2026 - DNA, 2608 bp, Toxoplasma gondii
caagttggacttcttttgcgtctgcgaatgcgctgttctcgcgttctgtctctccgtcctccgcctgcccggcgtcaagggcgatttcccgggaggcgcaggcgggcaggattctgtcgactttgttgatgacgatcaggagcggcagatcgaactcgtctgcgaggcgcaacacttcgtctgtctgcaggcgctggccttccgtgacgtccacgacgatgcatgcaaggtcggcgcatgcactcgcgcgtccgcgcatcgccgcgaacgtcgcgtgaccaggagtgtcaatgaacgtcagctgcgcccatggctctcccgcttccgaagaggaagacgcaggtggagaggaggaagaaggggatgcgcgaggggtacgagatatcgccggtgggattcggacagttactgcagaaaggttttgagtaattccaccggcctcgaagggcgcaacgagagtgcctgcgagtcgatcgagcagcgttgtctttccgtggttgatgtgacccagaagaacgacaactttcgtagaaggcagcgggctgggaaccgaaggagcagaagaggaagacgagacagaagaagacgagacagaagaagaggaggcagaagaagacgagacagaagaagaggagggagaagaagaggagacagaagaggaagaagaaaaagtagaaggagaccagtctggttcagggtcgacaagaacggggtgcaggccaaagagcttgcatgcatgggcagccgaagcgaaggggacgagaactttgcttttgttcacgcactcaaattgtcgttcgcccgtctcgtctcgccacaggtaccggtggggctcgggtgtacgtacaccgcacgttcggaggcaggtcgcatagtcgacgcggaagaagacacggagttcctgtgaggaaggcagcgagatgcgaagcagagagtgaggaaaaagacgcggcgaagcggagaagacgaaagaccgcctgaagaacagaagcaggccttccccgcctctgcagaagagaatggcgaaggacaagaccgaggagcgaaagcgaagcaaggagagaagaacgaggagagaaagaaggcaacggaatggcgaggaagagacagcagggaggtaaacagagagggaagagagctacggcgagcgaagctgtgaggcgctgagacaccgaccgagacgagagaggtgtgtctgggagcggagagcgtgaagagaagggcaaagagagtcacgagttccttcgcgtcaaactcgcaattgatttctccggtttcttcgtcctttaacttaccttcggtgccacgtagggcggaagaagaaccgtctttgttcgctgtctcctccccactagaagagtctctttcatgcgcgccctgccgacgggtctgtggcgccgaacactccagcgaggagaagagagaaggaaaaacggagacaagaaagaacaaacgccacccgagaaagaactcgagaagggagacgaaagcagcgtagacgccctcatccttcccctctcgtgctccccagacttcttcttctctctctgttcttcgtcctttcttcttctctctctgctcttcgtcctttctacttctctctctgttcttcgtcctttcttcttctctctgctcctcttctttgcttgccctctctggtcgggccccttcttgtactctgtgcgctcttctctcgggggctgcttctgcttgttttttcaccggcgcagaagttttccctaggaagaaaaggacgttgtgaaaacggttgcatgcacgcggcagaaacaacgaaaaaatcaggcgtccgcgctctgcccggcgaggacagagcgtcttggcccgactcccttcaggctgaaaaactgtcattcaaaagcatcacaagacgcactggcgagggagagtgtctctcctgtgttgcgcgccgcgagaccctacacggttggctaggagagacatgcgagagacagctgtctctccccttccggaaacagcacacccccggactcttgtctttctcgttttttgccgaacggcgaaactcgcctcagaagaatccacatttcccgctgccttcctcgccgtctctctgcctccggtggagtcgattctctccactggacctgttttcgcggagatcacatttcggtgtcttgctgctggtcacactcctgtctgccctcttttgccgagagtcttctctccctttccgccgctttcttttttcttctttcctctttttctcgtctttttcgtctctttcgtctcttcctctccgccttcttccccctccttcccggcggcagccttttcgcgggcccggaggaacagcgccggtcgtcttctcctctgctgccctgacgccttttccgcctcgactttgcttccgtcgttcccgatcaccaggtgacttgcggcttctccagaagcgcaggagactcgccgcatgctcgtgcgagggaggaccgccgcagctgtctcgcaggatgatggagactgcggcctgagtgtatccgtccccagactacggcgcttccatcctccagtgaagacactcttcgcctgctgcatgcgcgcaactcacgagtgctccagtcgagcaaga

SEQ ID NO: 2027 - DNA, 996 bp, Toxoplasma gondii
gttaacgacgcgtgggaattgttaccggcacaagtacgttatgtatgagcatgcagcgcttcgctgacaccaccggataggtcggcttgcatgtagatgtggagaggtgcattgcagggcgttggagggtaccttggaagtagcgcgcacagacgaggcaggcgtagacatgttggttggagagacagatgcagcagactttctcgaagtcaaagtcgagaaggtgtcgcttgattgtgcccaggtacgggcaggtgcggcgcagctgtttcgtctgcggtgcagagactgcggcggcggagggggaaggcgcaggcgtgcgtttctttgcagctcccgccgcctctgcaagggaactgccttcctgcagagatgccctcttctgcggtcccgcaggagactccgaagatgcagggctgtctgccatagagtctcgcgtgggcgggggagaagccgtggacggagacgtcatcatggtaggaagttgggaggagacgcgccttcgaacgcgtggagagagccagctaaacaagggagaaacagtcacgaagaagcggatttcattggccctgttctgcccggtgtccacaaagtcttttaatagtcggcatcaaagaagaacgccagtactccaacaagcctctacacagcagtcggggcgacgaggagagcaggcgcagagcagcagtgtgcgagagctgctttgaagaagactaagactgggagggaagaaaggcaagacagtccacgaggtaacctgccgatcggaaggcctttccgcgacgaaagagatcgaaatgccttttctcagagcgaggcgcgggctacacgcgagggagagtgactcagaggtgcgcgcgccgcgtgccaaggcagtgcgtggtgtctggcccagtccttcttgggttgacagaacgggggactgtcgttggagagcgcgggaaacgaggacaaaattccggcggcgagcgtcgtttctggactcacgagtccaca

SEQ ID NO: 2028 - DNA, 924 bp, Toxoplasma gondii
gaagtgctcgtgatcggcttgttcgctcgttcccaggaactttcaacggcgtcttacagtgaatggaaacccaaagcagagagttttttcgaaatatcgcaacatgcttcaaacagtaagttgagtgagtctgaaaccttgcagtttagcaggacaggctggcacaagcggtggattcgttgctgctttgtttgaggtttcggggatatccactttcgtggcgcaactgtcttctaaacagcgcaagtcttacgtggagaaaccgctgactgtcggcgtttttggtgaagagattgagggattgtttctcttaggaaacggcttgtgtcagaaccgtatcgaaacgctcgaaatggcagcacattcgtgaaaacatgaaacagctgcgctgtacgtacacttggcaaccgtttcactggaaagccagcagtgttcacatcgtgtaatcatttggtttgtcagtcactttctgctcgtgtaacgcgtgcctcggcggtttctcgaaactctcaaagtctcaacctgaatatcggtgtagaaaaacattctgggaaaagagggactcttttgtaactgtgtctgaaaagatatagtgtggcaacaagcgcacgacaaccctaaaaagatatggcgtcgcctggttgcctgagagtcgtaccttgcagtggccacagagcaggtaccgtgtgtgagttcgtcacttcccgtttctgcgatggacgctggacaccacagcagaccgcatgaagcccgctataagaaaagaaagagaacgagcaaagaccctgcaggcgtgtgccctcgagtacggaaaagacagatgctacagaagattgatctgagcacgagtgttgcggagagcttgtaaagttattgtcgcgataaacatggtggaaacaacaggaagaaaaatcccggcttcca

SEQ ID NO: 2029 - DNA, 1724 bp, Toxoplasma gondii
tctgcagtttccgctgtctgttctcttggctctcttttcggacgcaccggcgcctgcagcgctgccccaggcgttgacgactttttcgattttcacgggcggtggggcctttttttcgccttcgtcgtcgagggacgctgcggaaggcgagatcgagagcgtgagtccgtcggcgagaacaaggacttccggccgagtggcgtctctcttctctcccacaagcgcctcgtccaggcctgcgagcgtcgcgcgcgacttcgcgactgcctgcgtcgacagcggcgaagccgaaagcgccatcgagacggagcgagacggaaaaaaggctcaagggaggaggagaagaagaacggagtggaagggagacagacggggaggaagagggggaggaagacggggaggaagacgggagagagaagagaagaaaagaaggaagtggagagagtagcggaagggagaaggagagaagagaggagagaagagaggcgtttttataggtgtttaggaaggaagaaagaggggaaatgtggaagggaggacgagtaaacgggagaaacgggagagaacagagggacacgcggagagccgagagaacaggtacgagggcagaccgacaggaaaacaaagtgaaggaagggagtgttcacggagaatatgcaggccgcgcatgaaagaagggagagaatccgagagagagagagcctcgcggcgcaaacgcagttccggagaaagcagcagagcaagaagacgacttcgcctccccaacacagcgaaatgaggtgtatgtacacctcgttcgcgtgtctggacagtcgagactcctcgggatgaggtgtatgtacaccagagttgtctgcaacaggcgcttctatctttgtcgtctcggcaggcgcgccgtgagaagccggagaagagggaggtggagacacagccagtctcttctcctgagtaactcgaaatgccgtgaaggcaagtttttttgcagacaatttacacttcagacagagtcacgtcgcatccgctgtcggctattttgtcgctcgtgacgcatgctcgcctctcgcacgcgtccagttcttttcttcgcatgcattttccttttttctccccgctctctggcttgttctgctgttcacctgtcgcgttcttctccttctctctcgctcctctttctctcgattcttctgcccgttttttcgccttctcttctccccgttctcgctgcgagttccccccacaacgagggaagtaggtctgcctctcctggaggcggctgcagttcgttcggtcgcacaagggcggaggcatccggacagaaaagcgaggccagaaattcagccgatcgaagttcttcaagttcttgagaagctgtgccttctcgtcgcagcgtgttgttctcctctctccactcttagagtgaaaacttcttctcttcacggcctcctccttcgccttctcctcccttctcccatcggcctcccttccccttttctctttttctttacgcagaaacgcgagagtggagtctcttcttcactctcctcagcggtgtctctgcctggtttgtgcgtgtaccgcggcctcgacggcgcgtcgccagggcgcgattttctctactcctctctttctctttctccctctctccgacttcttctctcccgctttgcctccacctcagcgacgcttgcctttcgctaccgtgcgttttcttccacacttcgcaa

SEQ ID NO: 2030 - DNA, 4939 bp, Toxoplasma gondii
cttctagtgccaggtgtgctggatgttaaaccggattttcgttgttccgatggcaggttgtgtgcgggggggaccttttgtgtcagtgcaggcatcctcttgcgggcgatcacatttcgtgtgacactgcttgtgtggggatatcgtgcaacagcatgaccagtctgtgctcgaaaaacacgttcagcggcgggggttaagctaaacgcccctgtcgggggttcaggtacctcgacagccgttgtcgcagtcgtccggcggccattctcagaagagaggagggatacccaagggacgtcgccacgaaccgccattatacccaaacgtggtcaccatgctgacgctgtcgcatgaaggcactcccgcttctgctgccagctctcacgacgcagtgataaagtgagacctcgtccaaactaacgggcagaaatgcggctcccgcgggagagtccattgtactgaaaaggaaccaagtacaaccttccaggttaatcagacaagtactgcctccagaaagcgtctttgtcttcaataaaccaaaaaagcacaaccacgcgaggttccggcgtaaaaggtggggggagctgatcgtgcagtgggacggtggaaaccgcagtgcaacggatgcagaggatttccaccttttcccaaaacgagcatgagacagactacacaaacaaataaacggtataagagctcgtggaccggtggcatgaggtatcgggaagtcaagacatctcatattacaacagggtcattgaggcaaaacctgacgtgtaacactgttgccttgcgcatgaccggtctggacggtcccctgctcctacagggtcaaaccaatgcggaggacggtccccctgatttcctctcaacacgaaatatgatcgagcagacgacacatacgataaaaatccagggcctcccggagagggaggctgagcagtatctctgtctatttttagcgaacatcgatcccgtcgatacataagaaaagtcggtgggcaacaggcgacccggtgaggggggccaccgtgcagcgattgcgggcctgacagcagcgcccaagtggaaccaggccgcgcctggttgtgtacattcgcaaaagccagtcagtcaatggctgtcgtataagccgttggatggcagtgtgacagagccttcctgcaccggacagttaataaatagtgtcacattgtcccgtgcatgcgcccaccagcgcaggcaccggactgcagcttcaaatttagctgacggagactcctgggaagctaaaaaaaagtatgtgccgttatgatccgacgtgggactctatggtttgccgcgtagaatgacggttcttcgtgaggccacttacatgatgaacaggaggtaatggagagccagccttacgtactcattcagagggatggggggaaggagagaacatccagttgtatagtctaccgttcctgttgatgctgcgctagtcatttccgttttccgtccgagttaccgcacgaataaagtgagttcttttatgtagaagagctacggaggccgagcacgagggtacactgcgtcgcattattggagccacactacgaaaacatgcagtggagggctaccacatgcaagtccatcactttagttcctttttctcgtttcggcagagctgcgttgttcgttgctagtcagtgcacgggtaggctgcacaagtgctgtcacaatactggtaaaacgcacctcactagaacgaactggcctttccgcttttgttcgtcctgttcgcgcagtgtgagcttacttgagctccatcacgtagcgtgaaagaactgaagacgtctcaatggtaacgcagtcgtccacctaatgtatgcatcacggattctgttcgaatcgagctttttctctggcgctaacgtggatttcccgtgcgcaagtgtttccatggacctgcactgcatcttgcggcctactcaatcaaagatcgtatggtaagacgcatacatggccgtgccttggcttgacattgacctaaatgagcgatttcggaggtggggttaggagctctgcgtcaacagtcaactggacgcgcttgatttgccagcttacctggaatggacaagagttcacctacaggaaatggagacagagaagagaggcggcatatgctgttctgcggatgacgttacacaactctaaccactctataagggatatgtcgtaccacgagtgcaacggaatggacgaccatagcaaattcgaagcgtggtgtgcttccaacggcctcacctcgtgacactggttcacgttgacaccggaaagtctgtggatgccgtggtgagaataaaagtgtttcgccgcattttcatctgatagctcttgactccgtccaatgaagtagtctgctagatgtgcgggtagacctccgacagcatttttgggatggataagaaacaccgtgttaccctacttcatgtgtgactcaggagtgtcacaaaaggtggcagtgaactgtggtgcggtttttgagtgtgtcaagtaacgacttgtcttctggttgcctgaaggtgtacgaaggggttcgcagtcgtgtgctgcaagtcaaaaatcacgcggggggcgagtggttcgttgacaatactgtcgtgacctgaatggcatcaccctaaaatatgtgaaggggtgcacacttgagctacaaaccagtctgctggaacacatgttttggtgctcgccggagtgaacggaaactactgaatcgacgacgaaatgtcgatggggggctgttcatcgagcactacgagttcgtcatttgaaacgcaccactttctgactcgtccacccgcgagacaaaggattgtccacacagaaacagtatatgtcgtcagattgccacgagtacgaaccagaaattgctgttttaaaggcatcacgagtgtaaggcgagatgcctacatctagcacacagctcctcctctgctcattctgccaggaacagcacaaggtcgtaacaagcaccctcagtatccgtttaaagacatactgctcaactcggcgttgagagaatggaagtacagagaacacaggcaagcgtttccgcatgatggcagtcccgccgttgcggggaaatcagtggcgaaatatcgaggcggagtgctggctagcgtttgttttggaacagcaacatcgaaccgttttgggtgcatacgcttttatgggatcttgtgcaaaaggaaaggactactatgcgtgttggattttccatcttttatgttagtcgtagcatgcaaaaatcaaattcttcactttgcgttcttcggctctgtgtacactgtctgtggcgacacggttaccttaaagaagttttgacaagtgacaacagtgataaagagctggggtgccttttttccggtatcaaatagatacagctagtccagatcggttacgaagggctattagatacccttggttgcgggttctgaatcatagcacagacaactctagcggggcatccagacgggatttcccaaacgcgtaacgtctgcttcagaaaaggaggcgcatttatgcaacgacgtgacgtgaggggcaccaaacaggaggccccttgacgggaacgcgaagtcaagttgaggccgattctagtgcctgcggtttttctgaactgacgcacctgtccattcccctgtacgcagcttccagcttattctccgatactgccggaaacaaacgagttgttcggtaagcctgctgcggggataaaatattgtgtgctcaacgacgatgtcgggagaactgcggcttctactctaacggacctgccgcagtgttagagacattgtgttacgtaagcagcgttcaatatacttctacagtcgttgtctaaggaagtctctccgtcactgatagtcttatgattcgtttttgtggagtgcattgcacccatggttgccaaatgtctacatctcaccggtaccgatactgtgcgacgaccgggcgatttctgactacctgttgcacactttccgcatctactgtgtacaactatcttcctagagggctgttaggcgagccatcttcggagtctttttctactgtgagttcaggcgagaaggtgaagaaaaagggactcaaagacgataatggcaatacctcccacagaaggggaccttgcgtcacaaccgggaaatcaacggcaggtacctgaactttatggacccaactgccaaccggcatgcaatcattactggtggtatttttagcagaacgttgcggccaaatgttcttcagtttggcggctcgaagtgtgtccatgtggttgctgataatcagcatttccaagtcctgttcccgtcaacggggtgtcttagctagtacgtgttacatacgctgggtaccgtattggctgatgtgaatgctgcgcctcattagtaaatttacgcccatcttttcccgctgcttcgaacatatttggactgcgaaaaatgtggtttgaatgccgttggacgccctgggacaggtgacacgaactctcgtcatggttggctgacacgtcccgagtataagacgaggcttcacggctgctcccgcgcgacttgaagggaaaacagtcgcaagacaagatctcaagcagcttgactaggccgacgcgccgcctcttgcgttactgtttgttgtcgctcttgagcacgttttggcattctcagttttcccccgtcctccgtcctacttttctgatcatcttgactgtaattgaagcctggggacattccatcgcggcgccacattctggtttcttgtcaacactgtggctcccatattttctaagcctcggcgtctcgtcgacagcagtcgctgcgtaaaagtgtggtctgccggcaacgccaggcttgtttcagctctcctacaacttctttgcgtggcgcctcgatccactcgacacacgtcgacaaagaga

SEQ ID NO: 2031 - DNA, 2676 bp, Toxoplasma gondii
atgtcgaccctcgtgcgaacgagcaacgaaccgagttcacgttccctgcctccccactgaccacgaggactccctcgccttctgcgctctccccagtgtctctgcagctgcctagtgcagcagggggacagccaggacgcgccggcaaagacgcatcggcagaccgcgccctgacccagctgctcctctcgccagcgccagctgtaggtccttctcgattcgccggagccgccccgcaagactcagaaaggagagacgcggaagaaggccagggcggagcgctctggcctcgagagtagctcgaagagagacgcgacgagctagctctctcgagttcttcgcggatgagttgctggttccccaggtgtaaaagacgcagatgctcctccagggaggcaggagaggcagaggagacgccgggagctgcggagacacccgcggaggtggcgggcacacagggtggcgagaggaaggccgatgcgcacagagagaaagccggagaggagacagagggtggagggggaaaggaggagaagaacggggacggaggaacccctgcaggcgtcttctgaaaaggaatctccgctccgaagcacgagactgcggtcgacggccgggtcgagtccgcctcggaaggacaagaggagaagagacgaggcagaccgtacatcgggagagttgaacaggaaacacgaaaggccgcggaaaagaatttgtgtcgcggaggcccttaccacaaccgctgcccaagctgccctccgggtagaggtgcaccgagatggagaacgagagcagacgaagagagacaaaaagagggagctccaggcaaggagaggaaaacggggttgtccgacgcagaacgcgaaggagaggagtcacacgagcaattcggcaggacgagaaagggaggtggagagcaagaagaccaaacagacggagagtagaggacgaaaaggggagatatggaagccgtgatggtggagactgagactgtggctgccggcacacggccgccgtcgatgcaccgggtgtctggggaccggggtgagacaagggaagggtgtatctacacttgagcgggcgccagcagtgcggacgagagaaggcgcagactcgagacgcgcaagcgacgattcagtcgcgttctgttcaatatcaaatgcgtcgagcgcatgcagaggaagaacgcgttgccgcgagaggtatgtgcgtccgtctgggccgccgctcctgcgcggagggcaaggagtcttcgagtgtgtctcttcttaaacggagagaatcacagaaatccggagaaacacaaagggaggcaacacgaaaatggcacacagaggaaactcgcgagaaagcagactggtgcgcgcacacaggtattgtgcatacacctggcgatgtgtggcaaggcaaaaggagcgagcgatgagctctggtggtccacgtaattcacaatatccggtggcaaaacttgtcaatcgctacgagaaggaaaaaagcatcttccccaaccgaacccaggaaaataagacaataaaaacgcatgataagacctctcctcgcaaattcctctcccgcgcttgcggaaccctccccccggacacacactagcgatctctctctttgggtgtatatacacccgggaggcgcggcgagctgcgtgaggccgagccgctattctaggctatttgaccgagaaaaaagctgctgatgcccctcagaatctcccgcgtttctgccttctctcatgttccctgtttcctttcgagcaggccatattcgacacagactgtgacagggaaacagtctcgccgcctctccttccaggtttttccgcgtgcgctgtgtgtcgtcctgtcgccccgcggccgacaacggctggtgcatgcaaagcacactgacactgtcaaggatttttccggcggcgagaaaggcgcacttcttctggggaggcgaaaggactttcagtttgtaagtgaatgagaaggcgaggtcgagtccgttgttcccgtgtctgttcgctgcatctgtctcccaggtttctcgagcagtgccatccctggcaactctgagctctgtgtctttcggattccaggcgtgcattgttgtctatgaactttcgtcttttcttctgtttcctcccctcttccttttcgtggtaaattaaggcaacctcttcagagacacaatcacgaggacctctctgctgcttggaccccagttcttcgttgagacttgtcgacctccggctctctattccagcacacgtcgtactctgtctgtttttccccagagctatccaccgtgcgactatctctaaagagagaggtaggcccgcatgcagggccatttcttgcggctccatgtttttgtgtcggtgtacaaggcggtccacgtcgctcggtctgtagcatcggttcctctgcagagcgaaagcgagtgtcgagacacgggaaacaaggcgtgagaacggcgagaaggctagcattgcggcagaagcgtgttgcggttttttttgtggattttgaagagacctccagagaacctgcagagagcacacgcgtcgcccacgtctgtcgcgggtcgtcgaccagaagaagggtgactcagggaagcggatctcgggtggcaacagaaaaagaggaggcgagagcgaaggagatttccagtttgacagca

SEQ ID NO: 2032 - DNA, 4326 bp, Toxoplasma gondii
gacgcactgggcgtggtacctgcaacaccgttggctactgcaactatgaggtggacaaacttcacatggcaaccaatcgcggaccgctactcattcgttccttcctcttggctttaaagatatgtttcggttctttcccgtctctagctccgagcaagcgatggagcgaagagtgtgggcgacacctgacaccgagtcagcttctgtgattgactccctgagggtgttcctttgctctctggaggtgaccgacgtccaggaccggacgtgaacatggtcgatcgagtgcggtatagatttctttcttcacttttgggggcacagtttgaacgtgggtcagcccctgtagctcccaaccccggcggaggtgcagggattctgtcgcttccattaaaaaatccaaataccctgcaaaaagttgttctctagcgggcgggatgagtttacacgctgtaatcaggctgcggtttgtagggaaaaccgttctgaaaagggtttttgtgctttagactcttccccgtcacgctgacatcacaggttgtagttgttcaggctaccgtagaaggcgagccgcagcgttctttcggcgtgcttctcgcatgtcaaaaaagacgagttccccagctattcatcgtcgtagtcctcagcgtagagcaggatatgttttttacatggtaaaggctttccttttcggcgagcgtcgagccagtaccatgagacgccctgcatggctgcatgaggatctcgttagacgcttatcaaatgggaaaaactgagacaaatcacaaatggtttgttttgtccacgcgcagggctactccctgctgaccgagaagatctggaatcgaagcaatcaatgggagccaccgtaaattctttagcggacaaaaaacatgagaagagtgacctcgctgttgctgcttgtaatttgggagtggaagggcgcgaatcatggtaccaagacttgggaccctggtatgatgtgtttgaccctcggaaccaaacactgtcacgcgagggcagaactgctagtgcagtggtgcagaatgaggcatatgccacttaaaatttagacagcgcaagaggcagtcgtgcaaaggtcgtccattcacatagcatgtgcgaacgcagaaatgatggcgacggctgtcaaagtcagcgacacctttgtgccggacattgctgcagccccagaactatttggggaaccctcaatcgtcactttaacttgacaagcagacaatgaatgcgtttcgctagagttatccctctcgttagaagactgagcagctttcttttggcacccaaccacaatacttgctgcctcctctgggaaatccgtcggcggaatctggagtgtgtacgcttttgttgcgtcggtttccttccaccatgtttcatgataggtttcgatgatggaagtgtacgccttcagttcgcatgcagtggtgatatccttgtctgtgctaacgcagaagttcttcgtgtacgtgcttgggagaatttgtccttcagtcccgcaaaccagagtgaaactgttctgagaaggactcaaagtgatggtctgagcttctgcgttgctgctcgctccgtaggcgcaagtgaccgtctggtctttctttgcagttgctctcgctgtgactgttacggtcactttgcactggtcggggttccttgtgttttttaagcaaccgacaacgaactttcggtcagtatacgggaaactctccttgggcactgtcagcttcctggtagtagaagtgggtgtggtggttgtgtctttatcccattgtaagccgttttgggagccggcgaaaatatcgctgacattgatgcaagcatcacttccggcggatgttgtacagcactgatcgagactcgtagtgttttccgggcatactttctggccgctcgcgtcgtcgggcgcgcattttaggtccttttcgcaggtcacctgcagcacattcaagtcttccgacatggttgccgaaaggggttttggtgcggtatcttctttgaggcacttgcaggtggttgtacccttgtttgtgtctgcgacacaatctgaaaccgcggttcctgcggaaggcagggctccaccaatggtggaagatggggaatagccatattgcgttgacgtggctgcaaagagtaccataagagtcagtcccatccggaaagtgcgtggccatttccgtggagacatctgtgatatcgtagccgcgctctgggaacccaggcactgcatgcgagagccttgcatcatgttgttacaacgtatcaagtcacagacttaagtcttcgtagactgcgaacaatcaagaatcacaaacttcaagagtaaaacagttcgtacttcgaccacactgtggaagactgggacttttggaaggtctgatccgttgggggtgacgcgctcgggcctccaagacgaggtgcgagcgacaagccatggagaccccggcgtgtgtggagctgcagcaaagggtcccccggagggcctcttctacaactttgtactttctggggatggagacactagtgtcttctggaaaatagagtgacttttgtattagctcacgttgattttgtcatgcttcgagttgccgatgttcgtcttcgaaggtgggaggccaagtcgaactgtactacgagcgggtcactgatacataccttgcggttaaagccgaatccagatcccctcacgcaatatccgttgtcgcaacgaaagtggaagaaatacatcttttttggtagtccagagaatcccctcttaaacttctgaaggttgaaccgcaaacacggagtgactgttgggataataactgctatgcgtggtgtgtgcagtgtggatctacgctacacactgaggcagtgatgcgggtgaaggtttagcttgtcaccacagagaaggatattcatttcgaactgggaagacgtaattctctttggggtgccgctgtgtctcctgaagatcgtacatcgttctatccacgcacagttgaatcccgtctctcttgttgcttcctgctcctcaagcgacacggacaaagcgttatacctgatccagcatgctgccacgcacatgtcgtgcactgtgtcatagaccgaatctgtgttttaccgcttgtcagtgtgtgtgtagagacctgccaagaaaaatgcctgtttgaaagggtgtgccgtgatctcttgatccatctattttctaggatcacacacatcactacagagttagtgaagtctgtaaataaacagtgttcactcgcacgtttcggagagttaactttgttccaacaggaataaatactgagctgcccatgtccgcgaagccatcgccataacagcagagcaggtctgcaagggaagcgcggatgtgcttttgtttggtatggtgtgcagagtgaaaagcactcattaaaatgggttagctctctcctgattgtcacctgcctttattggggacaaagaatgacgcaaaatattgtttgactgttctctgagttctagcaaaaagaggtggaaggcaaggtgctgcattctcattggttctagcgcatgcgctgacagatattcagatctgtcactagataccaatgtctgtcgttctaattgctcaaaataccaagccccaaagggcaggaatactacttctggtctacaacataaaagtgacacgctctcccggtgggtggatgcgcgtgtgtccgaaaatggggggagaaaaggttggtcaggcgttaccgcggcaagtcaggtgtcctattctctcgtaattcccgtcaagccctccctggggttgtgctgaagatggaagccgtagagagcgcgcgaaaaggggaatcgtctgttacctgcgctggcgactaaggaaccccaggctccacagtgtcaggcgtccaaaaactcaactctcattgggggtgaatatcgtgttacttttgttcttccgttactcaggtttttaagcaggtgggggtattcaatagcgcagtggcaacatcgccatgtaatgcggctgagaactccctttggttcctccatcacagcacgcgcttctatacctgccgcttctttgtgaaatgcgaatccacctcgctagtctttgcaggtatgctgtgaaacgttttggcaggaacttcgtttttcgttcaggtattgccacatcttccaatcaggtttatgcctagcaaacgcggagactgcagattgaaaccacgtttctgccgcggcgcaagtgcaacgcgagttctattctgcacttcccctctatgcgcctttctctgcggatttagggatttcatcgatttgcttttctgtgcacga

SEQ ID NO: 2033 - DNA, 2246 bp, Toxoplasma gondii
agcatacaatgtgcctaggattctgtgttgttgttgtcgtgcacgatgctgacggggtctttgttgggtgatggccagaggttgcgatgtgacaaaccgctgtttgaggtggtcctggatgcgtcggagtgagcgcagtaggcgccccagttcagcaacatgtcgtgctgtgggagaccgatgagagaattcacggagcctacgcttgtgccgcaggtgaagatagctcctcaacatcggcccttaccgctgttcgtcttgctctgctgaggggactgcagccaaccataccagcaggaccacagatcggaattagcacacctcctggcggcagatcactcggcagcccgcatagctcccccagccctcatagctcccgcagttctgagagctcaagcaggtctgagagctccacgaccgccacttcgtcagacgatcagggttcgggagggcgcgaggagaggacgctagcgggcgcgacggctgtccctgcatctgctagtcccccgggtgcgcggccgcaaacaccccaaccaatgacggaaacgcttttgggtgccgcttcgccggcgatagagctcccgcttggcggcgcaacaccgttaggcctttctggtggctcgtcactgggaacgccgtcgctaggacatccttcaagaggtgcttcgtttccttctagcctgtcgctatttttgcgcggaaggcgaattcccttcagatgcccacggcctgaggcgtcggaacaacccgagttcccgggagattgtaatgactgactggccaataagacggagtacacgcatgctacacagagcactatattactcaacgcggggacacctagtgatacgaatcaaggcgtcccgcggacacggtcccgacgcactgcctgtggttttcgtcattactggaagatttattcgtagtccttgttagtcggtgacgcttcttgaacactggtgggcagcttgctcgctcggtacagtcgatgcgatgctgatggcgttccacactatatttattttgcccttttcccgctgatgtttcccggcagaactgacgagcgcgtcagagtaggggcatccaaggaaagccatacatgcgcatggtttgaaggaaattttgaaggtggcggtagttgaagtggaggcggcaagtcgctgactacgaggggcgggagacactgcacttgggggggacctccagggttgggggacgtgccgagcaaggtagatagaaggagcatgacaagcttgggatgtgttctccattgggtcccgacgagccaatcacgtcgctcgtctcatttggacagacgtcaaaaataccgacccgtctcacaaacgactggctaggtattacccagaggatacaccgttctgtgcatttgtcgatggatcagcagaagcaagccgtgtcgtctgcgcaagccgtgatttttatagggcgacacagtctcagcagttttgttgctcggggtcactcccccggtacactggcgttttcctgcacaaacaacgcgctgttatcgcggtagggaaacgcctggacatggccccttgccgtctgtagtgtctcggcgcgaaccagagaagtgaattcctctctggaagacagagttcttcttatatcgcccagtggtcacagcaaagcacaatcgttttcgtgacttttcatatggtcacctgttcttgtggccgctacacccgtcagacactgggagtgacactgtagatcgcaactgtgacgcatcaacgcagcgccgcggctgacgctcgcaccacccgattcccgtctctgaccccattagtcggtgtgacggtgatcctcaatggccagtcgccaccaaaatccttccttttccaggagacgtagaggagttacagattcgttcctgttgcagtgaggccgtatgtagagatgtcattgtcgggacataatggacgaagcagacgtccagtcttcctgcgtcctggttgaccgttgtcggtgtctcgtgggagttgcgtcacggtatttttccgtggaagctgatgttcggtagcctgggcccgagtccacttctcctcactcagtggacgtctcgtagaaacacaaagaagagccaagaaatactagtaaagggaacggaagagtcatcgcgcagaaagtggcctgttgattgcctccttgctgaattctaccctctgtcacagcaatcagcttttatgttactcttccacctctcctgcaactctgcagcgtca

SEQ ID NO: 2034 - DNA, 1458 bp, Toxoplasma gondii
tgttctttgcactcacagtttctttcgcagtagatgcagtactccctttgagcgacgcgtttgcggaggttgctgatgacttgctgcctctgactctcaaccatctgtccgatctccgcgagggtgaaagcgacctcttccccaggacgcagcggaggccgcaccacgcctgcggcgccctgactcccctctgcgggaggcgctcgcgtcgcgcatccctgaactggttcccccagcagcggtcgcgaaggagagaaagaagaagccagcgctgacaaggcaggctgaggagagaagcacgaagatgatgaggacgaaaaagaagcgaacggcgagcacgacggagagctagagaacgagcaacatggagaagaagcggcagaggaaggcacagaagaagaagagagagaagaagaagagagagaagaagaagagagagaagaagaagagagagaagaaggctttggccaccctgcagggtcaggagctgcaacgaaacaggtgaccggagtgactttacgagcggttgagaagcgaacaggggattcgcatccctctggacatgaacacactggaagcccagtatacgcgcagcttctgtgaacagtcatcgtgcttttggaaggtacagagagtcttcaagcggaacagaagttccggcactcgtcgccggaggagacgcggaagagagaggcagagtatgtttgccttctcggcaagaagaattgcgggcatggaaatcgaaaagaaaacgcagaaacagaaactcgaggtgcagagacccgtcgcagcggccgcgaggaagaagaagccttttctgttgcgttggatcgcgaagttcgcgcagatgcgcatgcgcgtgtaagagatgcacgagactgaggagcgccgaaaggaaatcgaaaacaggaagcagacagttgactgcagacacggaggagaagagaatcgaacggcattttgtgattcatatttcgctacggcttaaaaagacacttgcggaactcgacgactttcaggctgcactgaagctttctctatcggtgagcatgcgtgacccaagtgaaggtgccttcgaatataagccgaccccggtgactttgtccttgcgacctttgcgcatgcagcatgtcaaaaagccagaaaccgcctctggtctgtcgcgtggaaatgccaccccacaagaaaggcttcttcgcgcgaggtgaactctgacgtcttctgggtctctttcgccttttcttttatttccccttctccgtttcggtctttctttttttctcctgtgttcctcttccctgtggaaggtctgtctccccggtgcgtctgcgcaaattcgaggacttctctgaatctgtggccgtcctcgttgtcttgggtctctaagaccttctttttcttctctttttgctgtgctgctgtcgcctttcttcttccctagttttcaagtcaccacca

SEQ ID NO: 2035 - DNA, 4565 bp, Toxoplasma gondii
cacgagggaggcccatttccctagcctcttggtctcgcacaattgcatgcacgcgcttcgcctgcagttcattcagagccacgtttcggccgtctgcgtcgacgacgacgatgtcctccttgtcctggtgttcgtcagacccctcggagtcgaaaccttcctccagctggtacgcatacgccttgccgttccctgcaactgtagggcgaaggacgcgcccaaactgggcggcgttgaaggctagagagcccccaggacgccttcgagcaggcgccctgacatcgacctcctccgaagcgtcgttgaggcgaaaccccgtttcccggctcccctcggaggccccggggcctttcctcttcttcttccccgatgttccgccgctgtctgacccgcccttcgccatgtacttcttcaagtagtccagtttcgaagcactcgaagaggtcgacgatcccgagtgagtcgacttcttggaagatgaactcattttggggaccaaaagagggggagcaagtgtggagactgacggagaagaaaaacgcttcttggtagtacaatgaagcgctaggagaggagacaccttaactatttgagaaaaatggattacttgaagttatttctgtaggagagaaaaaaaatactggccgatgcggaggtctatatcaacacgaaagatgtgctgtaacgcaagaaacgggcgaactgcttcattgccattttcagttgctatacgggagagtaagtaaacgaaaaccgtttcctaaagcagacggaagccggcaccgctgaggaagtgaacaaatcagaaagaagtattcaccgatgccaccatgtccacggaggcaagacaaacacgtgggggtggagagggcgataaaaatggtgagcaattccctcgaaaaagatcgaggaaaatgacacgccttctgtctcagcaaattcttccgatggaaggtgacgcaaaagggcaatgcatgcgctctcgtgaaaaggaaacaccgcggaagccttccggttaaagtccttctatacaggagggacgacactatctcggagagccccttcaaaagtgaaaccggagaagaaacagagaggctacgcagaggtattcgaaatacagagtcagcgacatagcaaagggtcgaaccatgaacagatttcctgaagtcgagctcgggaacttgtttcagcaaccctcagggctatccgtcaacaccccgaaaccgggaaacagttcggcgctatcgaataggagaggtatccaacaattgccttccaaaggaagaacactggtacgggaaaggccgcgtgcaacattacaagttgtgtcccctgtttctccctggttaaccggcggtggcatcctcgtcgtcctccggggcacaacacaccccaaaacccgcgtgcggttcgcgcaaaagacggagattcagaattatgtgaataagaccagtttagtatccgctgtagacgcaaaagcaaaaacggagcaggaaggggagctttctaatgaaagccgtgtggcaaaaaaaccgactacacatgcgccatcacagaagagtgtgcctctccccttggtgaaactatacgccgacggccacagcttctccacctggagaaacaaaataaaaaacaaaaggccgttttataagacgagttgccagaatgctgacgaatccttgtctgatgcacaagaattgctgatcatgcaggggtcgcctcggttcggatacgtcagaaaaactgcatgcagaccgccacagattcgagcagtcgcaccggttcctgaggtttcgtttcatcctttcacgacttatccaactcaatatcacgacaggttgcttgtgtatccaaatgcatttggattcaaagcactgttctgtgctgtggagagtgcgggtagctcttcatcttagccagacacgagtacctgtcattcccctcaatccaatctgagtaggagattccctactgctctcatacacatattagactcttttgaggagaaacagggaaacaaaagcgcaaagtatctgcctgaatgcgaacacgtgagggggaacctcgatggttcaatagcagtagccgttgacccgtccatgggcacatcgacgagggcggagacccacaaacgctccactatactataacacttgagaactttttcgctactgaaatgagagtgaccaggtccattcaagcatagtaaatgcttgtaatcatgccttgttccaaggtcagaagaaactagccacatggtagctgctacctgacacgcaagtatgactgctcgtcgggcaacattcttcgtgatagaacatgtggagtttgttggcaagaggctgaaatgtggaacgattctgtccttagaaaacgcacaggcaaagtgtttctttcccccatgtcaggcagcgtcaattattgcgaagaccgcgatacgctggtgccaaacggtaaattggtgaatccgtggcccatgtacctactcacgggtgggccacaggtcttccagaattcgtagtgttcacgtgatagtgctcgttctaaaaatgtacaagttaattgcaaatgagtaaacctatgtactaatgttggcctggcgatctttctttctcaagctgccgaaggaactcgagcaagccagttccagtacgccctttctcgaaaacacaggcagtggcatgttttaggttttaaaatctgatcgacaagtcaggggtcttggcaactggcgtagcagcttctggtagattttcgcaggaaacgcttccctatttaatcatactcctgcatgctggcactaatttgccgtgtatcgcaggagtttgggtaacatcactctagtacttcagcaaagagtcttgtggtttcagattgtcgatcatctgtaatttattatgtgtctgattcagattacgaggcaaaaagttttcatgtgtgtcttgtgtcttgtgtccgtcataaagtcaaaaaagtgaaactgtaagtcaccaagtggggctgcggttcggtttggacgtcaatttatccgctttacaagactgaaggctccttagttagtgacttctgcttatgcagaggctatagcacaagagcagcgacaatatgagtggcggaacttggaaattaacacgttcttgctgatcatctcgtgggtacatccgtttccttcaagggtgacgagccacggaggccagattcaatagctactgtcctctaaccttgatgttctgcaaatatgcggcttgaaaatgatcgatcgtcccacaatcggtctcatatcactcttgtggaactgataaactatggaagacaacaaagctcgtatctggacagatatcaggaagttacgtatccaaaaagatggaacactagccggttagcctctccaaagaattcagaggagcgagaaagtgctattgtatttgtcttttgatattatggttttagtctttacattactttagtaggtacagctgtaactgtgcagtgcccccgccggtcttgctgtgagagcgatacactcactggttcttatttctcgatgctcaaggctgttgagcagactactggcgtagcgtatcccaaggtttcctgagccgcttttcattcttcttttactatctagttctgatcctgaatctggtcgcaaccattttcagttttccgcctatatcaaagccacacatcagtcaaactacgcgtagcagctagcagaggtaccggtggcgggtagaggttctaagtagatgcagactcgcgatgtccttgcaagccaagggtggaatatgcgttcgaaagtattctcttcacgattcagaaccgagacgcgttccgcccgcgaatgaagaatcacctttacaaatgagtgcacgtctagcgtttgaaggaacacacctagctgcatgcatctgctggactgcatgctctgagaagaatcgccattctcaatggttactcaaatgcgactttcgtttccaagtatgctaactagtgttcaaatggacacagttgcgaattgtctaaaagcgtgtttttaattctcgagcgcctgatgaagtagcccaggccttcagggggctgatacccggatctgcaggtagggctttcctacgaatcgacgggtgggtgtagtacggcttgtgaccgttttgcctgcctactgttcaagttgaactttgttatgtgtgtctggtcgtattgcaagcttgtgtcactctccattaagtcaagaataaggcctttcaggcgcagttgagtatgattcgtctgcaaaggcacagccaatagaaccggttctggatgtcctcggtggacagtttcttccgcaaaagtgcctcataactcctgaaatataagtgcttgtttgaatgaggcaattccgccacttttttctgctttgtacgtgggtgccctttcctgtcttccgctccccgagtcgcgtccaagccatcatgccgttgcgccgtccgctttgccccgacggttctctccagcaggggctttgaaagtggtatttaaagaagacagacgcgcttcaccatccttttcgctttttttctcca

SEQ ID NO: 2036 - DNA, 2134 bp, Toxoplasma gondii
cctttcaaccctcttttgaaacttgcatcatatttgaaagctagcatcgcagcttcaccagcccagaaacataaggaggacgaactggtcggatgctacgacttctgagaagactatgggattctacgttttttttcattcacaactcggacaagcgatgacgaactagcgggggcaaacactcgtccgtctaaaatttttcccgaagatttcgagctaagaggctgagatactatgccgaaactgtgggggggatggaaaggcaatatattgctgctgatgtttcaagagatgaagaggcgcccgtcacgatgacctcatgactggggatgttgagctgctctagtaacagagggccttcatgctccaaacaatgtctgacgcgtcgcctcactctcggcatttgcccaacgtgaacacaccatgtaacgacgcccacttcactgtccatactttgaagagaaacaaagatcctgtccacagataaatgcgtaatgtgtgaggaaaccttgagttaaccggaacctgggactgtcaaaaacttctgctttcctttgcttacggaggtctcgctcttcagctggcttgcaacattgaaaaagaggaactcacacacgttttgagctctggagaaaacgaacgctttcctgcaaatgactagctcttctctcctgtggagaccacataaaacaccgatgcggataccagctggcatacactacaacaactaaaacaagtaatgcggctgactgcaaaatcgaatgtaccttaccgtagtgcctgttgaacaaatcatcttttttctaggtttcaagaccatgagtagtttaacctgttctgaaaaacgactagtttgggggcattctactagtgtatttctgtttgccggagagaggcgctgtcgatgcccgtgtggactttcacgaggaaggcagtcgaatttcttggtacctggaattcctggtccctgttagctggttggcaccgcaaagaaagaaaaggaattgaaaaacaacctgggtgctacaggtggttgggtcttccctgtctttatcggatctaggcccttttgctgctgcattgtcgtttttctataccaggcagttcttcttctgtttcactttaagctgcgatttttttagagcacactgtggaaacttggcagcacactatcgtctaaatgggcgcgtacacacagtgcagcaacacgatgcgtgagagaaaaatgctctgtgctgcatgcgacgccgtagtttctggagccgctctttcgagttgtgcggcacaggaaaaaaacccatatcatgaaataacttgaagggatagaactgccatttccggtgcttgagctttgtgttaaaccaagttttctactgtttcgccttacgaggcttcctacagagctgctgcatgcgtcctgctaaggtaacacggtccacgagccctgttttccggatgcgtaaaatcatcgcggcgcgttctaccatccgtgagtcacaaatgcatagcattagcattgtcttttccccctcagctcgtgagtgtgtgcttatcgacttcacttccaagcagaaccagtattttctccagtcagtttggaatgcattggcgttggcaacctacgattgtggatttgctttttagaagtggcgggatatctgaaggcgtttcctggttcttgagagtttgcatcgttctatgtccacgcgtagtccttcggaatctgccctcacggggccagacctctgttttcttccgggcgtctagacatgtatcaagcatgcgatgatcccgtctttttgaatctcaacgccctccccggagtgttgtcctccggctcgcttccttggttttcgtgttcatgtgtatgtcctaaagtctcctagtactgagtatacactcaaggcggctcgggtgtctcgtccctttcgctgcctttccgtttctttctgggttctctccagagaggctgccttgaggcatgctcctcgcaaaggccagagcttacgtaaactgaggcgcatcgacgcctgttgaggaactcggcatcgaaaacgccttcatatttgtggagaagacaaacccgtaggtcgaattggtttttcattccagtaaacactcctggttggcctga

SEQ ID NO: 2037 - DNA, 2089 bp, Toxoplasma gondii
cacgatagccgtaaagacgagtgatgcgattcctatcgtggaacattgccgtgttgtgtcttcatgctatggaatggagtgccgtgttggctcagacgacagttttccagcttgaaaagccgccttaggaggcgatgtcaaactgactctgccaggtgaggcagcaaacgttgccacttagttggttcggtgataaggttctgtgaattatgttgccgtacgtgcagatatcgacaagcacaaccgtctcggctccgttgtacaacgccttttttacaagttcctttgttcggacggcatgttcccagaaacgtttcttcctctagcgaagcaggctgctttccggaaactgaaccgcaacgggtgcactatggcttctcgcaagactgaggaacacccgtttaaggagagcactggtgatgctggtggtgaagcacctgtggaagggcctagaggtccaacagcggaatgtgccgatgggccgtcgtcggtgcgtatgcccaggatgcagctcgcccttcctgaggcaatatcgcgacctgtgtctatagtgcacaggcttgacattggaaccagcggcgcactcgtggctgcaaagactgctgctgcagcagaaaatctgaagcttcagtgggcagagaggaaagtcctcaaggggtacatcggactctgcaccccagagatccactcgctccacgaggttgacgccccgctccgaaggcacccaacgcagagggggagaatggaagctttgagtaacgaaagcagatccagtttccatgatgtgtgcgacgaaaccgcacaaaaagatcactctagttatcgcattggtgcgaaacctggggtctctgtgtttgctccgcttggaggcaatggcgcgtatggcatgtttgcagcactggctctgacaggaagaacccaccagatccgagcacacctcgaatacattggccaccctctcctgggagatctagtttatggaaaccaaacagttaacgaggaactgcggaggttcgtaaagaatgttgttgtcaacccacgccatcacagggaagaggctgctacaaggatgacgagaaaagaagtacaggtttcgtgctgcgacgcagggccggatgtgttggcgcccgcgggaaatgtcaaagtgcacatgcgacccttcttacacgcttattttctacgctttgcccaccctcgcactggcgcagcggtcaatattaaagctctgccgcctgctgacatctgccaaatcgcagggaagataggtgtagattgggaattgagggcagatgctgccttcgaaagaattcatttgaacggattttagtatctggaagactggatgaacttctaaggtttttggaggccgctgctcctgaatacctggcttctctggcgaacgctcctgccacggcgggctgccttgtcagtggtattatgtagtcatcttcagtaaagttcctgtgggaaacagcattcctcagtttgtaggcgcctataggttgaaaacgaaggtagggggtacggcagtgtttttcattcgaaagaggcttcgatacaggttgaatgtcttcgttcacgtcttgagcagtgttcagtgagattgcaccgtgtgggctttggacgctggagctattgcagcgagatttcggtaagttgtgtgagcattgctcatggcattttccctggagatcagctagctatagagagcaaaaccttcctagattcggccactgtctacgcagggggtgcgtcccccgtctacttgtagagtcctttcggcgggagcgttgttccgtatagccgagcctatcatcctgagcaaggaactctggaggctcaacatacgatgttgctcgcacgaggcatgactctacaaaatggtactttgtagatttgctgctctgtcggcaaaaagcaatgaattcgaaagcggcactgcggagaaagattggtcgtgaggtgtccatacaccgaagcttagtaacatagctgggcactttattgaagagccggcggatggttcccttcgtcgagcactgctctctctcagacacaactagagatttatgagaagacaaagacacaa

SEQ ID NO: 2038 - DNA, 1385 bp, Toxoplasma gondii
gaacgcacaggcccgcatccgcacattgacagtgagataggagcgcctgtggggacgcatcgcgacagagccgcatcgacaagacgaaggagaagagaggaccgcctctcgttgaataaggaaataacgatgcagggagaagaagaggcagagagaggcaggaagagagtcttcggggtatgtacagggaaacaggtggcgctctttcgtagcacatttttgttaggactctccttctcaagcggcgggagccctctccccttcgctgttgctttccttaccatcgatgacgactatatgtccttgacgaatgtcgccgactccgacagtcgcaaaaagcctcgcctgctgagagtgaggaaaggtagggcaaggcgtctttcttgcaaagcaaccaatcgactctggacggacgtggagaggaccctccgcaggtctgcatgcattgcctccggaggtatctctcctcagtcgaccgagcggaaacgaagaagcgagagagagaggagagagaggagagagaggagaggggagcgacgaacgttttcctgggagaggaagcatcccagagagaacctggcgcgtctgcggaagacgcgagacaggaaagatactggagactggagcggccgccattgaggcaacggaggaaacgcgacacgatgagaaagtgaagagggccgagcagctgacaacgcgaggcaaatgagataaaaggaaaaggaaggagaagagaagcagaagaacacaatctcttccgggtttaagggagcaaaccaggcagagagtgaatgtttggggaaaagttgcaggaggccgaatgcgtaacgagagaaaggcaaaatgatgagcatgcacaggtcgccgaaaaagaggggacgttctttgtctcgtgtctgcgaagagagttctttctgcatccagagggaaaaaaacaagtcggggattacaagagaaacagaaaaagatggctttccttcactggaaaaatcatctcagacgtccgggagagattgtgcatgtgcctcagaaaaaaaggattttctgcgcctgcatgcactgcagtcgactgaatttctcgggaagaaaacagaccactgtggcagaaagtttccccccacatatctctggaagcaggaaatttttcgctcccttttctgaggagcgaaacgaacggcgacagagaatggaactggtgagagtcaggttcccgggaaggcgataaacaggccagtcgcatgtgagcacagggagtcgacaagagaaaccactacgacaccctccctcccccgtcttttcaggtacacgagaagaaagacaacgaacgcaaaagcctccagctgttctctcccgccctcttgtctcttccttatcttctctcacca

SEQ ID NO: 2039 - DNA, 2876 bp, Toxoplasma gondii
catttgctgcatgatctgctggagaatttcctgttgctgaatccgcatctgctcctcaaaccgcttctgcatctcctgcagcgcggagccggccgtgggcgctggcgcctgcgggccgccggctgcgtcgggtgtcagtgcgccaggctgcgccgggatggcggccgtcgccccgaaaggaaacggcggctgcggccacgggcaggcgccgggggcgggggcgcctccactggcgtcttgcgcaggtaagttctggaaaggactcgtcggtttcgggaggatctgcggtccacgattcggactcgcctccccgcacggtcccgtggcgccgagtgtatgtacaccacccgaggcctgcgtctgcggtccggcgagtggaaacgtctcgttccgcaccggcggcgagctgtacttcccaaacgctcctcccgtcgcgtgcggcgcggctggtgcgtgaaggaacgcagcggatgcggcggcgtctgcatttcctgcgttccccgttctcatcaaggggctggcctggggaccggaagcgccgggcgcagcgagcgtgagaatcgtcggtccggtttctggtcgaggaggagctggcggcgcgtggtctgcccgagcagccgcagaagagtcgccgtctgcgacgcgcatccagtggggacggttgtcagctcgagcaaaaatcagttctcgaccccgccccccagctgctgcgggcgggcggtctgaagcgccgagaggcggcgcaggtccgggaggaagcatgtcgacgaaagaggctgtctgtgagagacgccaagaaacgacgccgagcggctgtctgtgatctgcgggttcgcctttactcccttagttgggttcgcctttactctaggagatgcaacaagggatgcaaacaagtggggggaaggaggcggtctgcgggatccgacagggaattcaagctgcaagctcgctgggagtgcgaggaaaacagcgacggtgaaaagagaacgcgaacggagacaggctgtagaccgaatgcagggacgaggccagcaaggggtgaccaggtaggcggaaattccgagacagggaacgaatcggtggatctttgcagggtgctgtgcgagcgtttgccggtgacaagcagtggaacgcaccgagagaacggcagcgaaggtgtgcgagggcgaaacgcgggaaggaaagcaacatccacaggtaaagatagaccggacggaggtgagactaggtcgatgatgcgcgtgagagaaacggcgacaggcgttgaagaagatcgggacgtttcccaccaaaggagatctaggcagacatcatcaaggaattatagaggcggggaaaagtggagtcgaagcaacggatacagaaagagaactccgaaaagcatgtacaatctgcgcgccttctgtgcgacgtgaaagaaaaaacgaagcatctgcatgcgcgccacggctctcgtagctgcgcgtgaattttcgaggcccggtgctcacttccaaaaagagttaccttctgtcgacaggtgtctgcgcttctgcattatttctcattgcactcgaacacaagcaggcgcatgcgtggaggagtcgcgcttctccttccgtcaatataagcctggtggccgttgtttctgaaaaaaacacggggaaacaatccggcgaggaacatctatgacatctgtgcatcctagctgtgccgtccgctagtgcggaaaaagttcctcttaacacattttcattgtgaaagttggccgacgcagcagtcagtagggctgcccacctggggcttcggttctgcgagtcctctcgaggcagctcttcaccttgactaattgtgtcgggtttgtagttctccgaggaaatagtgccgtatgcagttatgtaagcactgacagcgatgaaaagggccggagacgtctgccgtctgcacaggcaaactagcctttgtaggggtttacagtctagtttctgatgtggcgacaagcaacactcgcgtggtaagggagtcgaggagggaattggtacatttagcagaggaaaacggacatcgtttcttttgtgaaaacggaaacgcaaacgtgagaggcaacacctcgcagtctgcctcaaatgcagaaacaaggatttgcgagtggaagcgcaagagtcttcgcaacactgaagcgtatctgcacagcagactgtgatgtggtgatgcgtacaatagaggctgaattggagaactcgcggcctttctggcacgataagtgaggtctgacccgccctttacgtttttgtacctttgctgagaatcgtcccgctcttgcgcgtttttaagacgcacatgttgtcactctgtcgccgtttctcgaactgaagaaatggcataaaggcattctcaaacgtttcaccgttacaggaaattgccggcaaacgcccttgtatagcgcaaatgaggcaaggcatcgcaagagttcagggcctcgatccagtgttcgtttcgatgttccaagtgcgcgtggtttgcaactctaacgtcgtttccacacttgtgttcgcattaaaaacgctgtcgcgacgaggtagttagcctatcccggactcgaaaggactgcgtttttgcaggctcaacgatcgagaagccagcgaaccgtcagcaattcgggacgaagctctaacttggtaaccaaacagtcgttgtcatggcaccccgacgagcaagctcgtagctgctgcttggctgctgccagagcctggtggagcatcgaccccgtcgataaaaatcggagttgagcacaacaagcagctgtcagaagtgttgttctttagctgcccgtaaatgcagagctctgactgtttgtcgagagcctcttgattcttccacgtagcagacgagta

SEQ ID NO: 2040 - DNA, 1985 bp, Toxoplasma gondii
ttgtgaatctttcagagcttcctgagtgtaggtcatcccttcgagagaatctccttccacatttgcaggcgatgaagagtcacttgtatagaatcggtaatgaaacagaatgtagttcgaacagcgtaacagttcaggtttctcgagttgtcaagtgctgcagcagagcaatacggaggctgttgtggttgccgtagtgtacccgatgatgcagtgcaggattcctatttcttccataaccaaatggtgggtacaatgcagttgactcctatagcattcagcattctttcctgtatcgcacacatgagaaccggatatgcaatttcttcctgggattcggactttttgcattgacagtgaggaattgtcaaaatgacacaagcattgcatcaaatgccacgagagagaatgacgattttcaacctcagtgtttgtaatccaccgaagactgtattgcttctctgatatgtcagagagaaactgaaatctggaatgtgcttcctagattggtacggtttagtagatcgaatcttagcttctcacacgctcgcagttatcgcacaagcgcctgaccaagtgctccacaacgctgcaccaagaaaagcaagatggccctcctgcatggtgcaatatctccaaacgggaaaaggctggtgcagtcacacctctgtagtgtacgtgtatagatatgcatgtgtacgcaatattcagttgcacagcgtagtgcctgacttccaccccctgtcacgggacacagcccagtgttgctaaacgaaagaagtttccgccaagagaagtggaaaccgagtgtatgggaccacaagttccatgagcgcctacaattcataaatcacgcacgcgtgtatgatgactgcgggacagttatggcccgtcttcaccgcaaggtcgtgaactacgagtcctcctgaaggtacgtttgcgattgtgagcacgaccacacggggttgtaaatggaaacctaatttcagtgtcgcgggctgttcgttaccgttcattcatatctgtacgtccgcttgtcgcctgagtgcgctttggtcgtcgtggcgtgagccatgccaatcacctcgatactcctttctcagttttccccgaagttcgtgaaaactaccagcagtcgtcggtggattcacaattgtgagagaagcttccacagattccctatagaatacgaggactgcatcctcttcaaaaacgggtacgttgcacgtgtccaacactgctattcgggaactttcttcccgccctcccccccattgcctgcctgcgggggagttacgagtgagaacacctttctagattgaagggaaatgtgcgaattcgacaatgaatttgacatcgtcttccgctaagttacgaagaccattgcagaaaaagtctacgaaaaagtcaaatttcgctgcggaaactccgaacggcgacaacacactcctcccaatgtttgcctggcttgcggacggcatgcaacgttaagcaatatgcatgctcgatgtgatcattgcaagcagccccgtatggttgcactgcctgaacggtcctgtgcctttttggaagggacatacggaatagttgaagctttccgtcatacagtcgttgctaggggggttactgcccttacaactcgaacagcaagccgactttgtaaacttctagcgtggaagggggtgttacatgtgtgtcatgcctagtcccccgttgttcgtcactcttaaaccagcgtgcatgcgtctgtcctttccctttcttttagaatcgatatctcacacgcgcttctttgagtttttttctcttcatattttgcctaaacaacgctatagactgccgctcccaccatctgttttggactgagccagtacattgcagatttggcgaatgtttgcagttttacttcaatctgtaaatcagttcaactctaagagctgtacagacatttttccgtgacaattccaaagaactgtcaaataaga

SEQ ID NO: 2041 - DNA, 651 bp, Toxoplasma gondii
tcactttctccatgaacttttcctgacaaggatacggctggaaaggaaagtccacctccacagagtcttctcgcttctccccgaacctcacgctgccgacccagccatcggctttcccggaagtctcgatgcgccagacactctcagagtcccctccctgcgcagaaggtttatgcgaggaagaagacgaagagactgaaggaggacgaggacagtgcggagaggagagagaagagagacgagtctgcgtcgccatggttgcgaggagagttgcttcgaggtcgaagggtgtttgctgtctcgtttcggactcggatggctgggaacgcacaatacagatttcactttccggcggttgccgctctcggctacaggcaggcgacgcctcaaaggtcctgctgtctcctcgctgcatgcgtttgtagcgtcttcgcctccattcgcagcgcggctggaggcagaagagaaggatacatctgctattttcagtcttcgatcgcctgtccactgggcgggaaggtcgcggtaaatccactggtcgagtacaggtgcatggctggatgagaagactagccgccgctgcctgagaggagacacagcactgtttcacacgcttccaccgcaatgtttttctccgaagttgtccagaga

SEQ ID NO: 2042 - DNA, 1965 bp, Toxoplasma gondii
attcttgctaaagtgaaataaaccgtgagagactgaaacatgaactggagcgtagtgattctgtggttggaaggctctaaataggagaggaacctttctggataaagagagaggcgatgttttttgtcaagcaatttcactcgcgtttggtttcctaggatgcacccatttggatcgacagaagtgcggtagttttaaccagaaacttctgtacgaaccacagctggttagccgaacaccctgtgtagatgcggtcagtcgaaccattttcgttttggccgcagtagcctaaaagactgtgtggatggtatttcaaccccaactgcatcacgtgttgaagctggaccagccaccaatacgatgggactcattgaaactttatgtgacattcccccggtgatatccactacccacattttcaaccgagataaagagcggagcgttctatccagttcagggttccaacccgtttggtgacccgtcaggtcagaacggaatgtaacatgaaactgtcacaggaaggtagcatgatagaggaagtcgacgcggagacatcagccgccccaactaattgatttgttctccacttgcacatcagagttcacaggcgaagaagtgtgcagcatctggtggagtctcctgtgtgtagcaaacgaggttcatggcttgggcgccccaacatggatgttgaggaagcgcaggcgactgattaaggtttctagtctactgtcttcatggcgtggtgagataccgcgtcaactggaactgcccgaacaaagtgtatcttcgttcacacagtgttgtttcttcgtgctgtagatgggagaagcgtaaaaccagtcgtcacgctcgatagaaactttgtgcggttattttattcaagctactgaccaatacttgctcatggccagggatgcatgccactgggtttccctgatacctcgaacaagtagctgcctaacaaccaatgtcgccaccattaataacggtcggctatatagaggcgtccgtcttgcaattagtgagacgacactaacaacaggaggggaatgcatactctgctcgaggcacatcgagctccgagtttgatagtcaatcacatcgatattgcagtcactcttgcaaacccgtaatccgacaatcgtgtatatgctggcaacgcgaggaatatagatgaatcccgcgaaagaacctcgcgggatgacacagagaggatatcatgtgaggggcagtgccgacgaacgatatgttgcacaatgcatccattgccccagctctacgtgtgtggcacgatactgaagcagtcactggagaacttgcttattttgccagcgcgagtgcggggattgttttataatcctgtgccgaaacctgaggaaagcacgtttttcgcagtttgccgcatgcctgggcgccacaggcctgctagccaaggtaatcgccattttcagtgccactcttcagaacacctgtatcgaaaacatgccttctcgaatgatatcgcttcccttttgtataaaacttgaaagctctcgacctctcttcaatgcgtatgagagagtgaagaggccacgtctgcacaggggacccctagctgtcggtcacattgggctttagtccagctcaagcttgaggaaagacggtagtttaaggagtttaatgcctccggagactatatgcaaaacagaggaaaggtgttgtaggtggtaaggataaatgacggtcatgggtctacagcaaacatgtctgcaactgggaacacggctagcaccatgctaaaggtcgtcgatacgagtgcaggaacagcgcaacccattggtagaccgagtcgcgtctaccactaacacagcctcattcaaacacttctatctaggcgttgcggcgggacagaaaatctagtcccagttgatgtgaacgctgtcacggtagtggtctgttctcttgaattgtgagctgagtggaaga

SEQ ID NO: 2043 - DNA, 1932 bp, Toxoplasma gondii
agagcgagaagaccgtggcagacgaggctttgcagaaagagcgaggaacctgcgacaaggaaggcgcgagagacaaagcagagcagcgccctacagagaggagacagaagaaaaggagggagaaccatcgccaggcaagtcgagaaggcgaagaggagacagagcggaaaggaagagcgccctgtccttctccccttgtgtcttctcgcggcgcgtctcccatggtcctgaaaacaaacgctgcgccgttccccgctaccaccgtggcaagctcccccggagacagttttccctgcacgcgcaaggtgtctgtacaccccaaacggacccgcgagaagcgttttcgagtctcgccattttctttctttgtgtctctggaaaggcacaaagcagcgcagcagagatagagcgcgactgagaagagcggcgaagcaagacgggagaagagtcacgacgaaggacgagaacataagaagaagcagaaaaaaacgagcagagagagacaacacgaagaagaggagagagagaagaaagagacagaggcagggcgcgagagagacctctttccagaagcggcggcgaggaggcagaaatggttggagaactcgatgcctctcagacctccgaccaccgtggagcgagggcaaagagccacaggcatgcaagagacgagaaaatgctgcggagtctgtggtgagggaaaaagcagatgcccgcctacagggtcgagatcagaggagcgtttaactgacaaacgaggagagagacggcgaggtagacacaatacgagtgacgcggagcaagagagcaggcagagaacatggcggggaaaaaccgaaagagagcgactaagagaacgcaaaagaagaagcctgaacacagaaaagttcggcgagagagaccaagagaccaagaacgcggagaatgcgaaaatcgacggtcggcagcatgcaatctccgctggggggggggcgacgcacacagacgacgaacgaacggagacgatgtcgccacttggcacacaacgaacgtttgtctccctcgaagaaagcgccaaggagagactgcagagaagcggagaaaaagagactgcagagaagcggagaaaaagagactgcagagaagcggagaaaaagagactgaccgcgcgggtcgatgtcgacaccggcgagacagttgggagcggcggggtgtcttcgccggcagatttgaggacagagaagaagagcgagaagagagagaccgcgcgcgggaaggtcaacgactgagagagagaagacagactgggaggagatgaggactttaggttggcgaggaacgcttcgtgaagagtttaactcttcggagtggtgacaactagctgattcgcgcaaagtcgagcgatctgtcgattccattgactgcgactgctgtgtctacgctgtcgtcagcgcctctcgcatcgtacacctctcttggcagctcgcggggggcgggggtcggtggaggctttttttttcgtttgtcgctctgcagattccccatctttctcgatttcgtcggattatctttcgagctccgcttgttctgtccgcagaaactccagctcttccgagagctcgcgtcgacactgagcgttccgcgtcctcttgtctcttccttctctctgtgtccctagctcttcgcgtctccccacgacgtcgctctttcctcgccaattctcgacctgaagaaaacagatggtttgcttggcctgcgcctctccctagaaacggccgcctcccttctctgtctgcgttttgccgcgttctcgaccctttttatcctccttcttcaccgccggaccccccctcctcgcctatccctgcttctcgctcttgttctcgctcttgtttctgtgtggttctcgtcgctgctgtttcttttccagcgactcgcggttcgtgcgctgca

SEQ ID NO: 2044 - DNA, 3154 bp, Toxoplasma gondii
atccacacactgggttggatctgcgcgtgcacttacgacgcattttctccttccaaggcagtggcttttcgcttttctccagccacaggctctgcccccgcggcgagcgaaactgtagggtccatggcgccagctagaaaagtggcaagaggcgaagacggagacggtggagagacggcgtggggaaatgcccaaaaacctggacaggccgagaacgaagggaaggagctttcctccagccttcactccttgtcagggttgttttgtggggtactcccgcaaacggagaacacagcttagatggatcatacgattgccttgtcgccgcccttcagaatcaggcttccaaacgagctgaaacagcaggcaggcgttgtcttcacacggggggccattcctttctggagaccaagatggcagatacgcgggaggataaagaggaaacggagaaaatgaaaagcagcaaaggggcaacggagagaagaaaggcggaaacgaaagaacagcgaaggatggagtaacatgcaaacggaaggtgaagtcgacacacaagcgaaacgaggagtgatgggtggcggagaataaaagagacacaacggcacagagaaagaaggcgaaggcgcgaggaaggagcaacgtgttgcaaaaacagtgcaacgcagagcgcgaggatgtaaaaaagtccaaaagtaccggagagaagaattcggactacgcaggggcagaagacagcaccacacggtgctgaaggaaactggactaaacttagaacaacgtaagtggcacaagacaaagcaggacgcaacgagtgacaatcagaggtgggaactggaacaaggaaacaagctgggggagcatgcacggcataagtgacactggggtggtgagaacgaaaggaagacaagggttccgagctcccaggtacacgacacggtaacaacgttggcgtatcttgcctaaaaccacggaaacacgcagcagaacatggacccctgtaccaaagccctgcttcagtgcggtacgcaactgcgaacagaggcctctacagaaaagcgtaaggcgcaagttaaaagggtcaacaacgcggctgggtagagggctgtaaaagaagaggaactgttgccgtagcattatttgtgactgtaacgccaggccggacggagacacgcacgagaaaggcaggacgaatggaggatccccctgtctgcgggaagaaaagacactcggagcatgtacacgagcaactttgttcagtgccacagaaagcggaaaataacgtggggaaagaaaagcgtatacgcgaattccaattttgtcactcgtatacgcacacggtagtcgagcacttccacgcagacgctttggttgcttgaatgtatagacagcgtagaatgcagtctcacgccaaaacaaagtcgaattttggccgcgtcgctcatcgccagtaacgaagaagtgtcccttattcaggaaaatgtgatttcgttgccgctccgattccgcatgcaatatgctcgtgttgggccgtggtgtgacctctgctcgccacacggtgcaagcaacatggcacccgtttgcgcggcacaaagatggcattctttggtctctcatggaagaccaaacttgccacgtgaaagctgcaacaaaaagcaagttgcgtgttttgacgcagagggaaagggtggggaactgtcttactgagctgaaacagcgtcgtttgtggatgactggcacacaggtggactcctgggtgcgagccacaaggtcggggacggctgaaaacgcagaagtagtgcgaaattaaccagaggaacagtttgagatgtgttataagctgtccttcactttctcttacgtcccacgagggtgcacgatgctgttgcctcaagtcgctccagtctcgctacccagacgtttttcagtgatgttgtccattagaggtactacgggtttcaagcgatacgctaaacagttgtgattgggcatttagggaaattcagctgcactgacatctggtccttgacgaaaattccggtgtatgccgtcgcattccccaccatatctacagtccactcctgattttggctacgggatcgaagtgtagattcctctgatataaatttttgtcggctgtcttcttttggagtgtattctgggagttgggctaccggtttagatcttgaaggtctattttggcactctagttcccagtgctaatctgtacggaatacttcggtctggtcgcaggcgtgttactgggcaccacagaccgttctctgctgcttgaggtacttagtgtagaaatgaatgtatgcaatctggctgttgcatcatgttgtgcacagcgacaggtggacaccatcactaggtgacgataaaaagatgcattagctctaatgcgtacagaagaaccccgaaaacttgcagtgctggataagggtttggcatttctccctgagagagagcatggaggccatggcattttgctcgcatattcaaccgattcaaacaaaaaaaaaacggaacgatcgagggctgcagtgctctccctctcctcgtattcctttcatggggaagccggcgtccagcaacttaggaaatggcttgaacaagacggaaacagtgacacccgaggtctttctcatagtcaatctgtaccgtacacgctcccgggcagacctgtctggctccacagtgtggaaatacaaatatccgtcgctctacatggggccggacagttgtgtcttatttcaaagagtagttcagttgacttaaacaccgatccgggcagtgcagatgtgtcttgaacacaaggtgtacttccgaacgtagtgaaaaccccggcaacagtgcgttcagcaacaagggggccaattacatgactcgctgcaggcactgcaaacgatactttgaaagcgtcgtgcaccgcactgcggtttgcccttcacgaggtggctgtaaagtgtacagctgtaagggaggcaaggacgaggaacaacttctggagatatgtggtttatgtggtagctgatagggtcacacagacgggtgcgttcggagaggtgtttaccttctagttcaacgagacagaattcactctcgtgctgctgcccggcgcttctgtcacttgtcccgttggagagaccttggcgca

SEQ ID NO: 2045 - DNA, 4896 bp, Toxoplasma gondii
ggaaagcgaggaagacagaccaaggaaacccacggtttctcgtcccaacgctgtcagatcccattgcctctctgccttctctcgccgaccaactttcgtcttcgccgcgagaagaagagacacctgtctcgaagcagaagaagctcgcgggcaagacgccggagtctggaagcgcgaacaagaacgcgcgagagcagcgggtcgcagccagcagttcctctggagttccctcacaagagagacacaaagagcagccgaacaagagttcgaaggacgcgaacgcatcgggtgtgaaagaccggaagacccagaaacgagacgaaaaacagggtgcagcgcaaaggagccctgcggtagaggggtccgcccaactgagcgtaggaagccgtgtgtctctgccttctggagtctcctatgaggttgtgtgtcttccctcgggcggttcaaaggggaagaaagagacggcgagtcctggggaccgtgtgtcgatccagtacaaaggactgctggcaaagaatctccgacgcttcgatagtgggagaatcaagttcgttctcggaagaggcgaagtcatcaaaggcatggagctcggcgtcaagggcatgcagttgggagaggcgcgcagactcctcatccccagcgctctagggtatggcagacgcggagcgcctcccgcaatcccgcccaacagtgacctcatcttcgagtgtcgactgatgagtctcgggtgaagcgaatgcaaaataagcgtcgtcgatccctccagttctgcagcaaacgtgaatcccggtggcgtactgaagtaaagccatactttggctggccttcgacacggtccagcagggtgacgaggacgacttccatagcaactacacagagtgtgggtgtttgaagcaaagggtgcgggggcgacagagaacaggtggataaatcggaaaaaaacgagagaaagagaggacccaggtgcaacgcatgaagcggaggacacactgaaagcagcgcggaaggattcaacaggctctatagtatcttgtcactccagacgcacattttgtgaacgcgcagttcacagatttttcagctagataatttccagtgacgtgctcgcgcatgttgtaaacgaagtccgtaatcgccacttgttctgcgggtgtgggcgatcccatcgttttgcctttgctttagactgctaatttttgtcgctctctgtccaggagagtgtgctcgagtcttgattagtcatgggtttctcttcagtttcttctgcgcctcgactctccaacgagacgagatggattttcctctcggtgggggcattgcttcctgcctcgtcactcaaactggaacgactgctccaacatgtattcggtagcatgcattcctcgactgtgtttccatttctcttccgcagctctaaagctggcggtgttacgccacttcatgagccgcttctgtcactagttcgaacgaatcgaatgaatcgagactgtgactttgatccgtcgaggaatcacgacgcgcagaagcttctgatgttcaaaaagagaagccatgaaaacgattgttcggcaatttactcatgttctgttcacacggaaaaatattgccgctatcgcatttcgcattcgaacgcctctcgatgttcagccaggcagacactcgttccgagcgggtcttgaggaaacgacggcgttgtcacagagtttcttggtcaccacagaacagatgagaaattgagcaccgagctgtcatctgcgatatataatatatgcctaggaaatgcttgtcgatgccactcggtacagcgtcgacacgcgtacaaataaagggcgcatgtagaactaactaatgattttttcaggggtgctgatgcttgtttttccggtagcagaaaaaacggcggaaagatgattgtctgagaaatcggaagtgagtagcacttcgaggattgtaaacttccatttgcgaaacgtcagaaaagtacaaggaacgatcgtgcttccatatcacacgttgtacgcaaaaagcgattcagccgcaattccacgttcgtcttctaagatatgatcaagctttgtgtgtgccatttctacattagattcagcttcattctcttgcgagagtttcgcgaggtttttaggataccgatagtgggcaacgagctctcgaataggattagcttctccaccctgtaatcaggatcgactgccggccgccgtaaacgtgtagatcgacgatgacccagcgctaccatctcacacatcgtcggctgtttacggaaaaaggatgcacggatttcgatggaacttggccgctgacgttgtaaatgggtcacgatgcaatccactggggttacttgtcgtgctccgatcacaactgaaacatctgcgttcccgatatggggcgtttttacatgaaaaggaaaggaatacatttgtaaaagggtcgttcgatgtgtcagcattgaaagaagctaatttaatcataataatggggaagagttgctttcacacaggcgcttgcgtgctcgaaacaagacgaaaaggaactgtttcgagtcgacaggttgccagagacgcagcagggtcaaatcgctagatcacatatccttctacttttgctgtgttcttgatgacggttcgagccctccgattgcgtttcacgttcttcatatccattggtggatccgtctcaaatgaagcacaaagttaatcccatttctgattcactgttgcacatagttgtaggggtctgtactaggtcatctcattttcccacttcagttaccaatacctcttctttgcggttagatggagagacgcaaacctgtctgtgaaggctcgtcagactggaacacttgttctttgtgcgaaaacatccaccaaagcactgctttccccatacgcgatcaaaagcataaagtgctgatcatccatagagccacgggcgtgtgcacccgttagaaatcatgttgtgtttccccccagggttttcatcctatcttatctctgcgtccaagcagcagatccgatgtcgactagaattcccttgctgcttctgtgtcacctttcgagtgcttccctcgtgcaacatatcgcaacctcagaaaaagaaaggtcaggtgcagcatacacgctcacagtcacacatttgccgactgaagaggcaacatatattataagtgtacagccaaaacacaaaactcaggagaggttcaatacaaatgtaacgtagttatcaaggtcgcgaaggagaaaactgttacaacgacccggcctgaagaatcaggagctgaaactcgacggtggaacatgacactgagagtctctcttttcagagtcgctgtcgtgttcacgcgaatgttttgaagcattcagcattttcatgtcctaccctcatgaacgtcttccgcgttcgtggagacgacagtgtggcgtccgatgctgagaaccatttgggatactgagtacctgaaaaataattcttcattgcatgatgtagatatgtacttggagacggcagctcgattttctaattttaggagttgtttgcagataacgggatctgagcattgaggtacttaaattcaattcgttgtagccaggggggcttggcgcactgtttacagtcaatgctcaagttgcgtttcctcaccttggaatgcgtggcgagtgcaccggctactgggacgttttctgattttttaggttcttcaactatggaattgatccatccaaactttgagtttttcacgtactgattgatcgctgtgcaaagagaattgtcttaaatatttttgtggtatcgatctcagtcgttttgcactgaacgtgggcaaagcgtgaaaaaatggaagaattcgtgcttctgtttgctttctaaaatctcaggtggttccttccggtccggcacctggaacaactgagtagaggctacactggggagatgctgaacaagttgtgatggaggaggcaacgtcatgttataatttgttatttcgtttgtgccttcacgcacctagtgtggtaaatcacgcattggattcatgcgaagtttactagcggaccccttccagctgtacctccttggtacatatgctctgacgccttagtccccctgtggcgttcaggtgtcgcaggcgggtgcacagcggcagaactctgctagccagtctgattacacgccaatatcagtttctcgacagagaaacgatcaacagatacctgctgccgtcaacccctgcggttttcgtggtctaacagccatcgaactcgctagtagtgtttttgctagaagtgtgtaatgcgcactcactcatttctcttccatgccacactagagccagaaacaagagagagccttctgagatcatttgtgctgcttacgcgacaagaaaatcggaactggacctcccgtgttctacgcccttgagctggccagtgggagacccgcagtttttttcccgcttgcgcggcttatcgtttcttaggggggaaaatgctgcatcaaaacatgcctttgattgtgtggtaccagggaagagtggaattgtgggtttgattggtagtgacggcgcttacgtcgcatggagcgacttaacaccagcagcgtgcgacctgacgtttcgtacaagcttcgatccgctaccagtcccgccgcagccaccgcccctgcacttgtcgcttgtcgggagggatgggctgtgggcaacctcgaggtctaagaaagagcacgaattcgcaggtacgttcgcttgaaaattgtttcgatttccagccacacaacaactaaacgatctttgttgctgatgtttcttcacacatccttccttggctttcttctgttcaacggcaacaacggcacctcctccttcaccttgcaagacaccgacagtca

SEQ ID NO: 2046 - DNA, 3567 bp, Toxoplasma gondii
tctctttgttctgcatcgctgttgttcgtctgccttcgttcgatgtctctgttctttccccgcgtcggtttttttcgttttgagttgcgttattctctcccttttctttccttccactgtcgctcgaactcttcgccagctgtcgagccgctttcgcccgcgcggcttttctcaccagcgtttctcctgttttttcttccttctcaggcacttgccactttgaccttctccccgaattctccacgcgccatatgtggcaatgagcgcagtttcctcgagttctctcgtctcgcctttctctccaggctcgtccaggttccctctgctgcggaagctccgagaaagaagagagataggagagaacagagaaaagagaagaacctggacgcaaacgtttgcaaagaactcgtgccctggagacctcgttttctgtcggccgcatccgatccagcttcaaaggagaacggggaaagccacagagagagagagcagcttgggtggaagtacatgtgggcttcgcgtggacttgaaagacgagatctgcgtatgcggggagcaaaaagttctttctttgtgtccggttcacttttcctcatcacggttgtgaaatccttgcttttccagcaactcacacaaaaggcgtctcaccaccatttctcgggccgctcccctgctgtctctcccgcatgcagctcgggtgtgtttgcgtctctgtcctacgaaaagaaggccctccttgctgggctgccttcagctcgctttgcctcttctgcaccagtgaaaaggagatctttcgaaggagagctcaggcgaagcagggaagctgcagatactgactgctgcatgcatttgagcctctcgggggtcgcgggcctgcgcgagcatcctgtacatttgaaagcctctgcagaggtgcagtcggtcactcagcgcttatgctgctctagaaaggttttcgaaaaaagacaggccagatgtgcgaggaaagaaaaaacgaggagacgaaaaggaaagcgaggagacagcgaagagaagtcgcggcatacacgcgagttctttgcgaagccgagctaccagagaatttcgagttttttgagagaacgcagaaaggctcgaggaaagacgctagtgatctagacgcaggaacgcagtaggcgaactcgagatagaaggaactttgtctttacgaggttttttagcaaagacacctttcgactcgtgacacgagcagaaatgtaagcatccgagccgcctcggtttcgcaggaccttcgttttcaaagagaccgagcgctcctgtagagacgccgggaagaggggcaaggaagatcaggagacaggaggccgacgcctgcagtgtgtgccagccagaaaacgcgaactcgcctctcacttgtaaataaactacggcaacgagcttagcgttgggagctcttgttctttctctgttgctgaatattcgcctccggtgtcgtcgagtttcagggacggtcttcaggccacggggcaggctgtggagtcaggctcccgctttggttggactcgcatgcacgaagagagcatgcagctctgtcttacgtacgtttcgaggttgatttttccaaacaagaaagcagtttctttgcgtttcacagcatggccctggagaggtagctttggccaaccacgcacgcgtgcgtgtctcgggcggtcggaagtttctcccgaaatcgtaaatgcggagtgcaacggaagtttacagacgattagcggagggcagaccctcagtctcgggtgcggtgtataaacgaccagaagagagaaggtggaggaaaagagaaaagagaggaagaggacgggccttctctgtgcttcgcagtcgtgagacacgcgacgaccagtttgggatagaatcacttgcaacaccgcatgatgcgctcgacaagaccattgaggcgcgctgtggcagcagcagagcctgcagcaagtacacgttacagcagttctactacaaaagcagagaaaggaaaaaactcttttcagtcgggactcacgcgcgaagagacttccaccggaaatgacacattggagcggaccgagagggaggggaaagagagaggaagaggcgaccgacggagaaaggaagaaagagagagatgaaacaagagagatagaagagggggaggaaaaagaaaggcggaaaagagtggcgagaaaggagacaacgagaaggagagaaacacagtaggaaagagagagagcggaagaggtgtattgtgactgcagtgtagtctttcaggagagagaacgctttccttctcttcattgaccctccagcaagtcgtcttccgcgctttgcatccccgaagtcttttgtgtcagcctttgaatctaactctcttgacctgcttctctcgtctcgtcgattgaagggtgtctctcagccacaggtgataaggatcgctagtgaaaagaagaaatcgacatctcaaaaccctgtgtgcctcgtgtgcttctgcttcctctttctcctacctatcccccttccctcatcatctttttctttccttttctctccgttttttctcttctctcaacctcctggacgttgcgacccattccagagaggcgacccaagcaacggacacacgaacttgttctccaacttctcttctctttcttgctttcctcgcactttctgtctgccgtgtctacttcccccttttcctccctctttcctccttctctccctttcttcctcttttctccgttttctctctaactctctcgctgtggtcggcgcctatcgggcagagcgccgctgggcgccgtctgcgcgagcgcggagaaagagctgtgggacctaagcggctttctgcgaggggcgcacaatcttttctcacgcgcgtttttgtgcggattcgcgagaaaagagcagggagacaaaccgtgcaccacacccttctgtttcagaaaaatatccaagaatctttttatttcttctctccacgctcttctctcgcagtcgatctgctccacgctcgttttggcgggacccgcgcgtctctctgcttccttcctttgttcctttcctccccatccacgtgtgtttctcttcgcaacttccctccctgcccaagtcttttcctctcttgttctctttatctttgtcgttctcgttccttctctctttgtctcgtcgcgcttgctcctccaaaacagcgcgctctgctgacacaccgcccatcttttcctgccatcgctgcctccgtgaggaacctccagtgagaaacagagttcgtccaagtccacgcttctggtctcgtcctcgaattctcctccttctctctcgagaggtctgtcgctttcttttcttccctagagctcggacgctagctctttctcttctctcgtctttttctccagccctgtctctgtctccttccttgacctcttctgcgtgctcttttccgtctacctgccctgcgtcctcctctgctccgcttgtctctctctttctctctatctttctctctttctgcgtctctctcgccgttcactctcggtcgcaagtgtccagtgtctctga

SEQ ID NO: 2047 - DNA, 1297 bp, Toxoplasma gondii
ttagcagcaaactctctcgcagtataaccgagtgcactactcctcgatcgtaggagcactctgacacttcgcaaagtcttggaagcattccaaaactcagacgaatagaccacgtcgaacttgttaatgaggggtcacttttgggtttgacttagattcagaaagaaagtcaagaggtcatctccgacgactctccctgcttcttcatgaagtcctcgagagcttcatcgtagagcgtatccagatgatcgcatatgctcgccaggtcgtcaaagctctctcgcaacagctgcattgctgattcgcctgcatgtaccggaaataacaatacatttctgcgcagtattttcagcgttgaagagccggtgcaaccgcgcagctgcctcatacgtaactacagttttcgtcgctatccttccagtggtattggcgaaaaacaattcatgttttcgtgtcggtggcactagcacagctatcaacatacctgttgtctggaggcggatattcatctccggttgtgttggatggggaacggaatagcctgcgaactccactccgggttttcgaacaaggatagatctgatggtgttacccaacgtatggtcttcgccagtaagggtaaaggtcaactgggaggccttgcaagcctcctgctcgtggacacccgctgtccacgcttttccagacggactggaggaagctccgcaagagcttcctcccgcaccgtcatccgccatgatagcgttgcctcagttttcctcaagctttcacgcgacaacgtttcacgtgtcgctggccgtcaccgagtctacgatccgactggagtaaagcagcagaaagcactcgctttaccaaattttcctgccgtcgactgttgttgctgtgtcgcagagtctgctgctgccacacgtatcttgctggagcttctcccactcctctctctcaccgcgtcagtcataacaccgggaagcaacaaaggtcccacttctacttaacaaaataatgggcagaggcgagagtacggagagtacttccaatatgaacggtgccgcagtatccgacgggctttgttaccgagcttcgcatgcgcatgcagagcacttggggcaaatcgacttggggcggatcgacatgtcacgacaccttagcataaaagaacacagaaacgcaaccggacggtgtagaaaaccagcaggctacactggtgtggacatacgcaaagaaaaaaaatttgcataccgcggcgctttgttcacgtttcacttcttcatacgtcccacagattgggaccttgcat

SEQ ID NO: 2048 - DNA, 1068 bp, Toxoplasma gondii
gtttggaagcgacgcacaagagcgagagaagccagaaggagacaaatgaggcacgccttgggaaagagaaggaagagacaaaaggcagaaacaaagtgtcttgccgaaagaccatcgcagcttccgcccagagaccacagtctttgtccggcagtcaccctgcatcgcaagcgctgctcggaagctttctatggcctctcaggcatgaaacagcggtgccttgtctgcgtgacctgcctcgctcctctcttcaccggactcttttccccgtccagttgggcatccaattgctaaaaggcgcgtgacaggttgaaaggcaggagacaccctcacccctgtcgccagctcttccaggctgacgcttgttcacaagcttgcatccccggtaacccacagacgaaaaatcacaaggagtagttgtgtctctctctatgatacttgaaagatcgagagtcaaaacgaggtagtccatcgagatcccgtactacggtttttcgtccttccgtcggtgactgttcagatctgcagattctccttcaggaatgtctcgaatgttcagacgacgacgttaacacaatcgtacatgaatacacatattgatggacagatatacagaaggatatagcctgattaagcagatagagatggacagacatacaagggtacacggctggttagatgggtagtgaaaggccgacgggagtgtaggttaacacagacgcacgatgtatcgagggaaattgagagggcaggagagaaagaaaaagaagtgatggactgccggagaagggggtttctgctgaagtcaaggggacgttcaaggcatcacaggtcttgtttgagcaacagatctctcgacgcgaatctgtcgcagctcgattgtacgagcggagacaccgcaggtctgagcgccgacaaagtcgagtaccggcaaaaggaggaaatttgaaagacaaccagattcttcgcctctcagaagggaaaatttccgtatcagttggcgttctggtgcagtaaacgttggcaatttccacgagaaaacactctgtgcattttcaccagcttgca

SEQ ID NO: 2049 - DNA, 1909 bp, Toxoplasma gondii
aagtcctgctgtttgtagatacacggctgctcgagtaccacatcgacagggcctgggggcttctcgcaggggatcgggccagagccggcgaacggcgagttcacagagcgcccagaaagcgaacgcgagaaagccgaggaggtgactggctggggcggaaccgaggcgagaggagacggtgggagcgcactggcccgaggcgcggcactgggacttgggggcgcgacagccgccgaaacagctgctgcgcgaatagctgctctcaaaccatcgctcttcgcggcctccgaacttcctcccgatgagacagcagacagtggagacacagggccgttccggcgagaccgggacttcttcgccggcaccgcgggcgaacacgatgcgtcggcgatgcgagacaaagaggccgcaggctcctcaggcgaagagacacccgcagagatcggcatcttgggcagccgcggaaacagttggccgggagaccaaggctgctgaaggcgtcgctcgatgcagcaggaaccgaactctcctcgaacgaaacaggctccgagagggcggagaacaacacaggcgagggggaggggcgatttgaaaaaagagggagagaagacgagaagagcgtggagacaggaaagagccgtcaggtctctgtcctgtgtgtgtcggattcggaatctgcttcaagactacagaatcgtcagggatgcgagttgaagcgaaacggaaaaaatggtgttccacgatactgaatgtcagtgaggaggacgaccacgaacttcgaaagagatgcaacatcagcgagttgcgtaagcgtccccgagcgaaaacaaagaacaccgggacactgctctgtacaggcgaactgaaaaatgcagagaaacgaaaactgaaagcaacatgcggcctcagaaaaggcatggcccctgacaacagacccggggaaagagcggtcacatcgccatgtaaggtcctcaaatgcccctcttcgtctgcgtttcttgtctggcttcttgtcaaacagaggaccagggggaccttctgacaactgacaactgtcaggttgctatcgcgcgagccgagagtagagggaataaaaaaggaggcattcttgactgcatcgccgtttccaccagggatcaagttttccgaccgtttctcgccccgcctggctggatgaattcgttcactgtacgcaaacttcaaacgctccacaagaagctgccgtcgatgtgcgctcgaagtcgaaaccgggaacgcaggcagtctatggcggagagcgcccgcgatggaccgatgaagatgggtcacacttcaggttttcccctcgcatatgtgcggctctttaaagacaaatacacccagtgaaaacccaagtagacacccattcgctgtccaagttgttcggagaaagtgaaacgtgatgcaaattcttgacggcagggactcctaccgctaccgactgggtacctacgaacaagcctggataggggatagctcaaattgttgtcgaacgcgagcggaaactccgccaaaatctcctaagaagcacaactgacagatgaaacagtccccgagaaaaaaataaattacactacactgcgtgagaacggatgaaccgagagaaagtcgcctccaggagctacctggaggtgagatacagaacccggcttccaggacacgcgcatgctgaaatgaggaacagaaaggggaaacacaacgacatatcgaaaagcacaaaacgcagcagtctgcctaaacaacctcgagcaaagtggacggaagtgggaagccgtaagttaaaggcgaccccgatgagtgtctgaggacagagaccagcggagcttagacgtgcctcggattggaacggctgcgggtgaagagaaaacagggtctctccgaacccggaaaa

SEQ ID NO: 2050 - DNA, 5011 bp, Toxoplasma gondii
aacaagtgcatgcatcagtgcacgtccaggtggaaaggaaaaagtcgagagcaattcagatattcgcatatatgtatttacagatacgcatacaagtttctgtgcaattagctgtttacgtccgaaggaagttcctgtcctaacggtagagctgtcagggacggctttgggtgtttcatttatgcacaagggatggaacttagttgaagtggatttctttcagcaaaagtcacgttctttgttttgccaaagcggggacgtgtcatcccatgtttaacccaagagcacgtttcgctttagatttttctccactgtagatgtcttagcccatgacgctttgcagagccctaaatgacactcgcgcttctacgcgtgtataaatctacgtagatatatatttgtatataagaatattttgtgtgtgttaatttctctttaaacagacatgtgcctcggtaggcaaaggcaccgtgcgtttgtccgggcgacaggaatggtaaaagggtcatcaaggttagagaggaacgccgtgtactcaggcagtttttaagagcaataggatttttgaaatgctgtacctctctctacagtgcctttcaatcacagcagtcgctctccgcgtttccccctcctggttctgtttccttgtgcctttgaaggaaactgagaaagccgggacagggcactattttatgcaacatgaagttccgccactgcttcttacttgcagggaaacacacgaccgccttaaaagatgaacttgtttcggtgcgaaaacgttcacagttctgtttgagtgacaacggagctccgtgtgaaatcgaagaagacgagctgaaactttccgtgcaaacgtctatttggcggctgggaaggcggcagtgcggtgttgtggaaaagtctgtcaaaatgtatctaggaaattcctcaggatacgggttctactctgcggtggctccccgtggtttgacgttgataaggaagagtcccgagttagggaaggtcaccaactctgcttcacaaggcgtttcgtttccagaacttggataaaggttatttcggagtgacagcgggtcattttctttaattgttcaacaaaaattgatcccgaaaaagccgtgaacgcgtcccacagtctgtgcatgaagccccgacttcgagggttcaccagggctgcctgacgtcggtcacgtaacttgaaagtcgttttctttgctttgtaaagtgaaatgcagggatcggcacacgcgggatagcgaggattgaagcaagcattggctgtgtgcttcttttgtctcgaaaggaaatgcagcagagcatctcgtcttcttactttgcgacaggaagcattccgcatgttgtgtgtgcataataatgatcccctacaaacaggaaacttacttgtttgcagaaaaaccaccgggcgactcgaccatgcccaatcgtgtggggaaatgaagtgggtcttttgccttacagaaccgaaacgcggcattttcgcccttttagaccggtagagacctcgaagtgatccaaggtgaaagagcactcttccagcgtttgcggtgagctgtttcaccggaaagtaacggatgtccaggctcgatatttgacattcactatcgttgcacactgctgtccaggcgaagtggacggtatacgggtttttcgagtcgtagcaaatggcaattgcgagaagaacattccgatcaatgatactacaagcttaggagccgttattaccacccgaggataaaaggcaactttaagcagagcgcggtacctagtttctccagggttgctagatccatttaaatgcaagttttattacataaaactacttctatgcagcttgcagaagaaaaaaggatggactgacacctttcagtggacacgcggatctcgaagtagttgcccggcaactctgccgatccctactctttgcggaatttgccttctttgctcgagatgaaaccgcagcctctctcgggttcttgcccggagggcggatgtttcacagccgaaactctgctgatgccgcaggagcttgcgctgattcggcaagtgtttgcggaattggatgatgatcgcgacgggtggctcagcccggaagaccttcgtcggagcatgctccgggacgggatccgcgtgaccaaggccgaggcggaagctttcctgtgggaagtggacgaagacggagatggcaggctggcactttcagacttcgctctgctgtacgcgtttgcgaagtgcgggatgcgccggcgcgaaccgcagaagttgtcaaactacttgatctaccgcttgatcgatttagatcgcgacggaaggctagatattgaccacgtctattcgtacctctgccacatcatggacaaagaggcggcgaaccgaaacatgaacaagatcttcggcttttacgcggtcgactctcccacgacagataaagtgaccccggcgcagtggcttaccatcctcgagacgtcgctctgggaacaagactgcccggtcgtggacaacgaaaaagccccctggcaaaccgacacgaattccgcagtcttcccgtttcttagagacaaggttagagtcagacccagagtagacgatcggctagacatccagaaactccgcgacacgaggaatcaagtcgtggcggaaaccgggacgattcctcgcgaaccctactcccgaggcaggcgttcgccgatctgtccgccgcaaagacggagcgccaaacggcgctagaactctctggcgaatgctgtttcacaaatgcagactcaagcactttctcgccgtgctgctctcccgtatcagggcgaagcagcaaaggtattttggcaaggtgcggaccacgctgtagccgcacgaaaatgcgggggaaagagggatgcgttggacagaaatgcagagaacgcaacgaacgtatttccaagacaccagttcagcagaggggggcatgggaacgaaggaagctttggggttttcgtgaacggagttagttccgagactatcttcagaatgaacacataccgaaatcgcgtacaaatggtgttttccgacgttggacgccatgcaaccgagggaattgatccagtgaggtgcctgggaattaagtgatttggggcagtctcgcaaatgcttcttgttttccgtttcggaacaggaaacttgcagagagggcaacagttcacatgtggctgccttttgtacgaacatacttcggtgtgaacaagtaaccatagtataggtaaataaatataagcatagagagggttgtatatttttgcaatgtattgaaggtacttttctgtgtttctcgcactttcggtggatagacgggacttggtagcagggatttcctgtcggcaatggtcagaggagcaggaaaacggatttcgcattagatgtgaatcccagggctggggctgtccttcacggctttttccagcacagcttcccacaagaccggaggtgtttcccctccgggcaaaatgcagtctctctaactcaaggatgagaggcaacatggaaatcttctaccttgttcagacttgaagtctggcgtacgcatgtctggagggacgccagaatgcagcgagttcctgaacgattacaggctgtaacgttgtattaatacagacaaactgagagagagatgcgcagtccaagtcttctgctgctgcttagatttacacgagttgcactgcagccgattcgagtgaaaagcttttgaagacttccttgaaaaattcactaagactccaccacctcggcgacaacttatcttctagaaaagaaaatctctggcatacacatatatatatatatatatatatatatatgaatatgccaatagctctggggcattacctctccctaccattacctccgactagataaaatgcagctacatatatgtatatatagctccatgagaggcgtagcaacagatgactttatcgatatatgtgtagggccactcactttgttctggaaagagagctttgatatcgctcgacgggttcgcgtctgtcgaggcaaagtgacaaggaagttacgcctgtattcttgatgctctcttcaccccgacgcgtgtttccccctggagttctctcgtgccctccttcacaacaattccgattaacaaccgaagaatacttgcagaaacaagttcctgcgccatgtcaccctgagaacccctgaaacgacctagaacattacagttgtggagcgaactgtcacgaattgttcgatatctgaagtaaaaaagcaactcgtgatcatcaaccccttgccccctgagtttgctggcctatttgaccgacaacttcctagaaaaaagattttctactgaaataagggaacacttccacgccgctctgttttcaagactctttcacagatccgcccctgtgtcgacggaaacctggtgcacagaaccggcgcgcaacgtccacatgaagtcatttgttcccattcttcctccgctcaaaaagccttgcctcgcgagcatttcctcgtcaaattggaagatccagaccctgtgtgtgtctgttggtaagcagaaaacgctggagagacgagagcgttcgcgcgttcgtgtctctcgcaagcatgcgaaacccagacgcatgcaagcggcagaaagaagactctgttttctctggcgaagacctcgccactgcgacagcgtctctgcctttttctcgcgtgcaaagctgcatttccccttccttttcctgcatgtcgcttcttatccgctggccaccgtcagtgtgctgcttgcttccttgagtgtaaacagacacctgccgacttgggcaaaatcgcacgcggagaaacccctcgactttagaaacaatcgtttcgcacgtttcgcgacgacgcattcgttttcgtttttctgccgaggtcttcttctctttcttctctgctcgactggcctacggagccttggatccgacgcgctgaaattccctcgttctccgcgtcttcctctgcaacacca

SEQ ID NO: 2051 - DNA, 4556 bp, Toxoplasma gondii
actcggacaactcgatcaattctcggaggaagaaagtgacgaagatttgatcccggagtggccgcgtccttcagatccccgaggcttagtgccagagggccctgggctgggagacgcacgtcacgactcgtacagaatgcagcctaagggaagagtggatgaggtcccgcagaggcgctggtccccggttttctcagaggagagagagtctatcgctgcgtccgagctgaagcgcgcgccgtcccggggggcgcccttcgtaggcatccgtggccgcaacccagtggggggcgttctaacagaaggtgccttcgggggtgcacgacaggggcgacacgagcgttttgcagctccagggatggtcttgccgaacactccgcattctaacggaggccggcccttcaatgagtgggagccgcagggtgtctatggagtcggagcgcagaggcggttccatgagaactacggaccggaagcgacacccaagcgactcgagttcagggtaccaacagtcaggcccggttttgtgcgcggcgaagtggcggacgcagaggctgtgaatcgggcgacagcgcatgcgttttgggctgcgcaaaaccctcagaatgccggggttgtccgaagagaacgcccttgggtcgatgagggtctgtccacacctaacaaggcgccgttctacgctcacgacaggagccacttcccagtcgaagaggaagaaagcgacagtgaaccgtcgaggcaaggggaaatggcgctgccagtcgccacccgagcgcccgagcgcactaacttcgagccccctgttcaacaaagagaggcagctccgcaggctctcgaaggggcagaacggccagggaaacacaggtcacggcagggggaaggcaacctcaaaggtcacgtgtgggggtggaagtaaggcggttaaaagaacagatccttcccaatctcggtggtgcctgaagcggcgccggagactccgaaaaggtggagtgagcagctgtagacgagtgcaagtggttccccgtcagacgctacagcagaagggctgtggttcttatttttgttgggacgtagtttacagtgatctacagagctcgtacgctgaattataaaacagtctatccccctacgcacgtgcggagggttcaccgagactgaccgcgtcctgtatttgtgaagtggattccttaacgtgcccaatggaggagggtgattcctgagtcccgattctatggaataggaatttttgttcccacaggcattttgggagtcgtgtgacatactggagttaatgcactatgagccgcccgtcgctccctattatcgaatgccgagccgatacgtaatctctgtcggccctgtacacttggggtgatacggtaaactaaagagaaggcattcttcatgctgagaacttttgctacaagctaaataggtaggcacactacagcagcgcatctgcgagagccgtacccgaatcgttccacactcgcggcttagtgatttaacttccacgtactagggttgtacagccacttctcacgaaaccagttccctcgcagtcaattgttcttgccaaagcacagagattggtgtccatggttcgatgcactagggccgacacgtcgtctcactttttggcgttcactagtttcccctgtgtagttctttgctcctggccttaattttaacaagataccgtcgggatatgccgccttctggccgtaccccgtatgactgaacgcttcgcatatggcatggcttgcgatatttcgctcgctatgtcagtccttagatgtaagtaattctgagggatcagcttggtggatgtagcggttcatgcactacggagctagggttgagcgacgattgtcggcgacctcaagaagaagtcggtgtgagttcgttatttttgtttattccggcttccgggatttcttgagttgtcgccctttcggtgacagccaagcaaaacaacgacctcggggaaaatgaatttaggataatagcaaacacttaccaaatacaatgcgacggacttcctagtgtaggcagcatagtgaaggagaaacgatacgtcaagaacagtccgttattttctaccgtttagaagtcatggcagcctgggaagtacggaagctcgctgctctgtgtaaccggttgtatgcacacgttttacggcaacaaagcgcctcatcgacaagaaactctgcacgtactccatttgaaagtaatatgccagcagaagtccgattcgacgtacaattaatctttcaggccttccttgctgtgcgtccaggatgtgcatttagccttgacccagtcacgccccattcaaatctcgtgtcttcctctagtcccggtaaatcgtgggtcttctcatctttcacccgtgcgccactcgttggaagaaaatgttgcgagaagagtcagaatgcatcacatagacgtagcagatgacttttaggtgagaatgcatctttgcatgtctacaacatcccagggatcaggtccctaatcgcttgcccctctaaatgttttgtcgtgtctagtattctcaccgacagttcggtgcattgtgccgtgtttcaataaagggaaaacagtttctccgatatttgctgaatcgcatctgtgttcagctaagatcatctgagtactgtgctggactacggactgttccgcatgccagattaggacgctatgagaggccatcgtgaatgctgtcgaagaggtcacacccgaggagacgagctctgtcgtatcgcctccacggattgaaaacagaattaatcagcgggcgacatagcagcttttcgaatcgcgattctatctcgaaatagttaaatgacagtgcagctagctgatacgcacatatctcgaggggcaacacagtgatccttgccggatggaaagctttggaacggatgcccattgccaacggctgtgttgtaaagaataacaatataccatcggagtcatttccttggtggtctgcggaatctgggacggttatgtcctctacgggcagatgaggtaccgcagcagtctcgtctttcttacagttttcaggcaaccctcagacatagtctctaccagccctgtcggtgagcattcttggcgcatttgcaatctacattgttaccacggctggcacgcagtagagggaagactcgttgcagatcgggtctttctcgatttcagctctcgaaggcgttctacctgccggggaggaacagggttcaggctaactataaaaagtttagttgaccagattggagagctgggagtcagtaggaatgaaatgggtttcgccagcggaatcttggttccattcaatgatgcggtggctggtcaaatagagaacgaaggagagcgcgacgaatgctgcaggcgtcctacacactgtctctcgcttcgcaaagacacccttgaaggagctgtcaccggcattttctggagttgccactatttaatgcaacacaccaagcgacggttttcagcttctgtgtactgtcaacgcgaaaacgaagtcctccgcgccttgcaagcccgtttgttgtggtgccttgaaacttttcggcaggaagccccccgacaaaggcgcgcagagtacaggtcctggcttactggagggcagtctcgtctgtgcatgtgttccgagcaagtgacagcagggacgcaggccaaacatctggagcagttgtgagagattgtgtgccacgtaggtagtcatctgaccttgtttaggcaactctatgacagggagacatttcgcgcaatagctaccagcgagcgataagtttgctcgtgtctgcatgaaaaagacgcaaccgggctgcttctacgctgcagcgtttgtgcttctgttgcagcaatccctgtggtgtgcatctgctctttggagcagcctggcaaataaaaatcggcagcgttacccttcttgaacacccgcgtttcgaaacgtccgttttcttggtcttttcttgaaaataggtgcttggcaaaagtccgtttggcgattttctgttccatttccgaaaaaccagcacccacgtgccatacactgactaccagtttcaccttcggagagcgtcttaccaaacaaacaaacaagatctacagtttttcaccgcactcatttctgttttcgttagatggcagagccactcttcaaagatgtgatattcgtccagggaacggcggacagcagcaagtgcttttcgaaaaagcttggatgcccacgaatctttgttggctggcatcggattggcgcaatagaccacagtgtctaaataacaaaaaaagagacgcgtgactgcctttgcggatgtgcgatgcagcgtcgcttgtagccaacacatcgacatacatccggatctgccaagatgtggctgttctgggcaacgtcctattgtggcccgcaccccggtttctttcagctgcgccttcacggtttcgaagaaatgaccgtgctgcatcgcagaagtccatcttgggaggctgtatatactttacttctctgaagtggtcacgcgtcactgtgtttgtgccga

SEQ ID NO: 2052 - DNA, 2880 bp, Toxoplasma gondii
catgcaggcgtgcgacaaaaccgtgatcgcgaggtattctgtgttacgggcggagcgtctgcggctgtccttcgaaggggaggcggcgtgacactctgagctaggtaccagacgaacgcagccatttgtgtccgtccgctctttcttgatcacgtgccattttattttacgttttccactggtgtatcttttccagcagcttatatataggctgccgcagcttcgtgtgtcacaagccgctgtagacagtaagcctactgcggcctccttgtggaaagccgttttccccagagtttcctgttttccttccctccgcgtgccatcttgtttttcgcccgcgcggatgtgttaatgcgataaataactaatgaagcaaggttatgaacagcttcgtgagctatattcccagcctccggcactgctttcctgttgtcaacaaagcggcgccacctggccttcggcccgctttaaatttaaaccgtaactaagcccacatgtggaaaccctatccacacaccatggcgtcctgagcgctctgcaagacttccttttccgaacaggggcggagaaagacgcactgaagctacttaacaccaaaacacgctctcgaacacattcaccgattaagtcaaacccggtgctacagatctgccgcaccccaccactcactaggagggggcacacccgcttcactgctgacggtgcccgcacagcaggtgcggcattgtgttgaaagccagttacatatatatggcttcctcgccgacggagagaagtgaaggaaggtgaggaatcagataggattcctggatacaggtggccgttctcgctacggcctccgtttcctgcgcagcaatgcacctactctagcaaagtccagaatggacggacgacttcgaggaaactctgttgtccgaaggttggaggaactttaatttataacagctcggttctgtcctaggcgtactacatggattactgttttcagtcgattgttcaaacatgcagtggatctcatttaagcgttgtgagtcagacagcgcccgagtctttacaggcgaatgccgtagtccgctgtcagcggtgcaggacctgctcctctctacgtgtttgctccgctgcgtgccgataagaagactctcaacgtgtgttaaacttcgtgactacacttaacgcaggaaaagcccaaggggagcttcattccgcatgcgtatgggtacgtgtgtatggaacgcaccgcccgttcggcagaatccttccgtcagaaggtacatttattttcgaccagtgctgtagcgattgaagctgacatgaatttgcttcggaccgccgaattggagagtgttgcctagaatgttcgcggttgaacacaagacttcgtagaacggtggccagcgggttgatcgcgcacccgcagggttctgtccaccggcatcgagccgctgttctacagcgagtgtgggtgggagagtttccttcctttcttccggttcgccgtccacagttcggcttgttgggctgccgggtttctgtttttccaatctctgagtggatttcccagagaatgactgtgttgcggccggtggcagtaaacccagtagattaggggttagtatggcggctgcaatcaaacgacgcaaactcgaaggggtaactgctggcctgcgctcgagagacaactgctgcaccacccaaaccaagacccgcgggcgagtcgcgttggacaggcgctgcggcgggaggggaatgcggcgcctaaggctcggcagggcaactctctcgatttctcgccacgcgtggttggtcgccccgttgtcacgggacaaacggttttggacaagggacacacagcgtaaagttcttcggaaccggagtttggctctccagaccagcggcaccacttgcagttcttcactggagaaccttgtccgtgtgttgcgtttgcttctcggcttcggtcaatgtacgcgttgcgtatcttgtagaccggccgagagttttacgctttgctgctgcttgcgcgaacggctggcaagtgtgtttgcagcccgtggagcaaaagcgtaagagccgtccttcctggaatttttccggctttacgctcgtttttgccgactgttccacacgcaatgctagaggaaagtttcaacaagggtcttgtggaccatcgtgaaaccagttggtcgctactgattctcagctacgtgggtcccaaagtgatgtgcttgacggctggaacgaagcactgtggactttcactgcttgtagctagagaccatggagagctacaatcttctttagaaccatacggctactttccttcctggacggactcttctcagaggggtatttcgcgttgcgagcgcttagcaccgcgttcaggatctagatgctggcaaacgactcccaccggtgttatcttccccgactttgtcgattctccgcgcctgctgccttccaactgacactgttcgcacgatacatctcaggacgtcattgcgtcttgcggtgtagcgccacagcgtcttgctggctcagagaccgtcaaaactgttcctctccgcaacggacgggtacaagcgccattttctcgactcatgcaaaccgcatttttgcggtctgtgagtgcaagggagttgccttcgctttacccagaacaggtggcttggttcttcagcacgaaccattccaatcccaccgggctggtggaagtacggcgcgctgggcacacatggagcaagcgcggcggcgctggtcctccgtgagcgtgtcagcctcctattgaccagcgatttgccagttgcacccttttcgttgagggcatctctgctaggtggtgcggcttcgtctctctctcgtcgctctctcctcaggccttca

SEQ ID NO: 2053 - DNA, 1870 bp, Toxoplasma gondii
aacgaagtatggttcttccgaaagagatgggcaacattgcgatgtggacaccacagtgtgcagtgctaatctactgtgtcccctgaggcgataggatggaagttgtcctcaccactatttctctgttgcggcagcagagagcctgcacgagcaaaggcaaggcgccttgctgaacacacagttgaacaggtattttccctgccgcagagaggacgacacgaatggaccttgtgcactgaagaaggagctcttcgttttccctctcaatgcaaggccactgatgtggggttgcacccccagaagattcgtgggcgtcgatcacatgaagcgatgacggtatctcgtcacaggtagcgctacactggtcagagttctgatttcgaatggggacaggcagaaacagtggactgggagaattcaaagaacgactcagtagagattgcatgaagtggagcaggcggccccagtcttcgggagatgctaacgctgccgggaggtctgatgctgaagcgtctgtagacagcgaacttgaagggcatgaagcagggcagtcgattgcgagcttctgacggaagaaacgagtgagctcctggagctcttcctcgacgaccgcgtcggttgagcgattggccccacaaaagacgctgcggcgtttctgcatgtggcagaatcctgtggacggctcccaaggagcctgattcgactccatggttctggaaaaaaactcgaaggtgcaccgagagaaacagatggattccgccgtccggagtggctctgccagtccggtctgccgcggcggtaaaatgtgtaccctgtctccggagcctactgggtatttctcgggaacaaggtgctgagcaaagaggatgacatttctcggagaagccagcaaaacatgcacgcgaaagttacacgccttatatctccattcgcggcttcggcgggtgatagctcgaccttcacttgaagggtcgaaggccaccgctaccacgtgtcaggagatccctgtttctctcgctcattgccaagaactcaagagagtatcatacacgaaacggtcaatcaccgcccacctggtgttcaagcagttgtcggaacggctctggaggcgaaatccgttggaactcttggtttatctttcctgcatgagaggatctgacgggaactagcgcatacgggcgacggacggatcggatcagggagttgaagtgcagcgctggggtgttacaatagatggacatccggtgcagctggcgtatgaaaagagacaaaagggtaagcattgagatatgaatgttcctgcattgttgttaaatggtaggggttcacatcaccgtggacgattgacatgggtttctctcggtaccggcgccgcccagggacggaccgaggcaccggggaaggagcggccgcttcaccgcagaaagtccaagcctggagtttaaaggatccccctctaatcaagccaggtaaaacgtgaccaattcgtcgcatatagacaaggaaagtcggtttaatgtaagtttggagtacagcagcgacgatggcgctcggcacagtttggtaagacatgcacaccacaggtggtacacggggccgacaagatagcccgcgacctctagaactgtgtgtggcatgttaagtgcctcttaggagcctgggtcagttgggaaacctgttgagtttccgctttaatgtgtaactgcttacagctagggcgttggaagaagagcaaggaaaatgagggtaaaacaggaaaagcaaatacgcgccgcgacacaattctgtcgaaccggtgtcgctgctgcatgcattcggaatcgagcctccgtgcccatctggggacgaggctaggggtgagaacggcgga

SEQ ID NO: 2054 - DNA, 1702 bp, Toxoplasma gondii
ggcaggtgttgccgagttatcgcacggttcaaagcatcgtctgctccggctaatgttggatctgacaaggtacgccaggtatgcgacaggatccgttgataatgctagagcctgtaactcatcagtagatggctttaatagccaataggaagaaggacgtgagacgaatatgggaggaatatggaagttacagaggatgctttccttactaagacctgcgcgaacgttggtatcctgtagctactactactagtattagcatcacggagtcgtcagagctatccgtcttttcatacttacagagttcgcgcttgacaaattttcagtttaacagtcgtttatagtaatggaggaacacggtgctaaagggtctgcatccgaatttcggacctgcttattgctgtgtggggaaactcccgaactccacattgctccaggactgtcgctcgttcacaaagcgacagagtttatttagaatcagcaggaaattgtgtcccgagaggaacaatgaagcaagatggtcacaagatgccttgttttctgtgctcgccagcatgccaaacccttaacctgcagagacaaaaccatagataacgagcgcgttgtagcttagtggaccaacaatcgcgttcagcatcagcgaagggcagctggtaacaaggatctaggtggaacggtggatagaggtcacaaatagaaaatgcatattgtttgagttaagccaaatcatcattcgcaactggtcagttcgcaacccatctggtgttgtatcagtagtgtcacacgccgccacttcaaggaaacagttaatgcgtcgcgctacacccactctgtcgcctcctccatcattaaagtgtcttttatcgttgaacgcagtaagaattgacagtgtccggtgcggtttgccggcctggtgaacctagcaacacatgaaacctgaactcgtagtcttgccggctctgtgcatgcgcgtctgtcaacatgcggcagcaattccgctgatttcttctctgttggtcgctgtcttttactctcgtgtaatcgccaccatgacaggtacgaagcccccagttttttattgctctcttcagtttctttctcctgtgtatgaaagtttgggttttctagccgttaactccttcattttgcgcttccttgtcgtggctgtcgagccccacatgcagcgatcgggctgttgtgactcggtatgtaacttcagcggttagtgactttttttcgatttgcttccaggctttcctgctcggggtctgtctaaaccactcctgaagtcattgtagctgtcgtgaccccggtggagacatctcgttccgagtttccgtttgtgacggctgacgcatgcaggggctgccatgctggggccgcgagctgcttacctgttgaacagcattttccccttctctgtaactcactccaacaacaactttcaccacattcttttcgattctttaggtggtttctcttccgggcaaaactcgcatcattcccttgtctgctgtaaggcgctccatcgttacccgttataacctagcggggcatatcttgtgtcagacccactcagggtcacgagcacttgagctttggtctttcagcggagaaaaagcgggaagaaaggtgactgcatactctgtttcaaatcataattcaactcccgcttttgtcgtcggtttctagctcatcgcga

SEQ ID NO: 2055 - DNA, 4032 bp, Toxoplasma gondii
gcaacaagtgcatctgcaggatcacgcgattagtgtagcactcactgttagccaagcagcaagcgcatatttgacttgttacctcacgagcgaggcccaggccgcggcgaccgggaaccgcgcagccttctctcagaagctgtgttacgctcaaaacgtgtacgcctttctgtttggtgtagatattccgttctgctgccatccgggtgcagtgctcctcgccagacaggctgtttcgccggtagcgcaacacgggtgttctgccgagagccgctgcgggcataaatcagacagcgctgcacgcactcatagcttttctgtagaaggcacttcaccgctttggagcgacgcacttcggccgggagccgccgccggcgcggcagccttttgcttgacacctcctcccgacgacggcgtccgtggcgcgatgcctcctgaaatactgattcgtttggccggcgctggcgagttgcggagcgtcgaagaagaggccgcggcagagtacgatctttgcctgaaggctggatctcgacaacggaaaatgtggacttttaagagaaagtacatggataacgcacagcacactgcgcactgggtagatgtggccatcgaggctgtcggcgccctcatggaaatgcccgaggccgtctggttcattccggacccggagacgaccgtgaacgagtatcgggcggtcattcaggagccgatgtggctgaagaaagtccaggcaaaattgaaggccgggctgtacaaactgccttatcacttcaagcaagacgtcgcgctcattttccggaacgcgcggaccttcaatcgaccggaagacagaccctaccgcgactgctgtgtcgtcgaacaaaagttcaaccggctttgggggtgcattaaccaggcttttcaacgggctgccgccaagtcgcgcagaactgcgacagacggggcacatgccaggcagtctccgccggtatcttcgagcgcacctggagaatcttcctcgacggtcagtgctgcaagctacttgcaaagtcaagtgtacgtacagccccagatgagctatgaacagcaacttttgtcaacactgccagctgcgggaatttcggtcggtggaatgggggcgcagccgacggcggagcgtctcgagcaagcggccagaggaaatgccacgcttggtgcgccggctgccttctacgagtccccaatcgattctcagggaacgggaccgtataacggacatcacgagtggaaggcaggggaggggatacaggctgggttcatgcctgcgatgcagcaagcacatcaaccaggaaacagagggcacatggagtaaaatgttgagtgtgtatcgagagtgcctctcatgttgtggcccatgtcagagtcgccgtgcctcttgtgcatccacttatgcatagtttcttcgatttcctcttgtccgttgtgtatggttgcgtcgcaacttgacttcttccggactaaagagcaggaaggcagtgaaattattaaactcccgttgtagcgaaggggcgctgcggctcgccttttagaaacaacagatttctggctcctcgcagcacgttcggtgggattgtactcgtgccagtttgacttggcgtctgccgtctcccgtcgcttttgcagtggtacgaggacttcctctgctcacactgcctcttttgagataccaggtcacgcaatgcgtggcttgagccggttgccggacagtgaagtagtttcttcaactgcactgctaccaccagaaaacgcagtccgtagtgacttacccactctagcatcccagagggacctgtcagctcacatacgacatggaacactgtcgacgtcttctaggcttcacagaagcacagcctctcggagccaccgatgggatatcatcaagcacctaacatctggacgggctcccatacgcgattcggcagagctcaccagaacaggaatgacgaactaaagtagcccttccctccagtggagaaatacaaccgacagctgcaggcccggagctcgcatatctgtcgggggtacaaatgagaactcaaagaagacacgaaggcgatggtggagcgaaatggaatagccgacattaattgaagcaagaactcaccaggtaaagcctcaacacagaaaaaatatctacgtggaggtgcccagtggtctctcaccaccacatcagtcacgaaggaaaatcattgcaacgacagaagtatggacaccgaggaacgacgagagggaaatctcgagatacgccccttcttcgtattggccagcgcattattcattttctgtgtcgctattgtgcgctcttttttttacgcaaccaccgtgagttgtatgacggcaaagggatgaagacaaagtcaccgacatggaacaaatgtgaaaactctgctcaaggttagataccggtggcgctgcggcattcgtttgtgctcgtgttcatcctcactgctatatttctgtttggaagcgagcctcggcagtcaagaactcctctgtttacactgtatctcccacttcctctcacctctgacagagaaaagccccccccccctacgccaactggaggatgtgaagttcacagacgcaatcggctactatggtcggaaaatgaggattttcaccgcgactgggttggcgcctatttgtgttgtagttcagagaagcgatttttgaggaaatatgttcaggcgcttgcaaaacgagcaacagctctcgcgctgtctgctgtgaccttgccgcggaccaggaccaactgcaattgataaagccattcgaatagacactgtccaactttatacacctactgtcgggtctttcagtttcaaagaaacttcttttccggtctagtttctatcttgtacccaacaaatggttcctgacccttttcttcgtcccaaagtataaagacagtggagtgctttacgttacattgtttggaactttcacttgcacagatgcccgaattcagaaaagctttttgcaaagatccatttttccgcaagtgccttagattaagtaatcgagctactagaacactgttgagggtccctgaatgtctgtggccaataaacaaagcccctatacgaggggaaaggcctcacagagagtggttgctcacctccggatggaagtgacaattgcctgtttggcttgacatgatctgttctatgaattgcaaccggacaccggtctcatagtgggaacattggcgatgcgatgtcaacaggggggccgggagtttgaggctccgttcacgcaggcatagttcctagtgtccatcaccagccacatccggagtccatatacaactactaacttcctttctctcagacactggagtctcacaaaaacgcgttttccaccagtcattttgtcgatactgcatggccccgtcctacctcacgccttgccacaaaggaggcttcgacggtcgtacatttcttcagtctgctgcgacgtgtttagtacctcaaccatgtagtaaattcaccctcttaaacagttgaggtatccgtgaaaggtcccttgagaaaacagagggtagatggttgttgtactaaagatcgaatactgattttgtccaatcagccgcagtgtctcttttccatgccagtcacgtcagcggtctagcagagaggggaggccgggtttgcatgcttcggtttatagacggggccgctattttctaagctgcatactgcggccagacgcggacgcgtcgtttccgttcctcagtcactttccttgattgaactgcttttcctgcgggcatcccatgtcctgatggcatcccgtttttatctattctgggcctgcaagtagcgtattccgtcgcgtgcaccgttccctcgttccgtctgcgccctgcggcgaaagtgtcctggccgttctggcccgttctggcctcggccaccgagtttttttctgccgaacaggcggttattctcaaggtaatttctcccaggagcacagctccagaatctcaggcaatttcttcctctgccggagccagaa

SEQ ID NO: 2056 - DNA, 1153 bp, Toxoplasma gondii
caagcgaggtcatcttggctcttctggcaccgatttctttaaaatttccagggagtccgcgatctccacttcagtggcgtcgatcctcctcgcctctcgtcttcttcatcctgtttttacctgctgtttcatctcccttctccgtttccagctgtcctcactctgctttttcctccctcttcctctctctctctctgtctgtgtgtctgtctctctccctgtctctcagtcgccctctctctctttttctctctctttctctcttgaattcttttctgcgtcacatctgacgctcggcgcgctcccgtctcgcgttctgtctggctgctgcctgcgcaacgggaggccttgccaggaagtcaagtgcagtgaactccaggaagtaaaacgcgcaggtggacgctgcacgcgcctgcagagaaaaaggcggcaacgggggcgagaagaaggacggctttcctgcgttctcagcgagttgcgaaacgctgcgggaacctctgcctctcaagctgctcctccctcttgaatatcctgaacctgtggcgcagtgcttcgctgtcctgcggtgtctctccttcctggctgagagctgcagcaggcgcgggggtctctcccgatgcgcggcgcccgtcgccgatcgaagaaaagctgaaagaagggcgaagtgacaagagaacgaacctggcagaagcaccaatggtgaagagaacaaaggaggagaggagaacgaaggtgtcaacagggagaagaccgcaaggcgctgcgagaaggtcggaaaaagcgagaagagccgcaggcgttggagacagaacgagagagacggggcgtctcgaaggagttgcagaggaacgacagacagcaggaagaaaggaaaggcgcgcagaagacaaaaaatgaaaatcagcagctttctttttgagtggaaagggaactaaaaaagtcaagatgagacagagaaacgcgtttgtccatctctgtttcacgctgtgaaaagaagcgacgaaaaggagacctgaaagccgcgaaaagcggcctctctcgcatgttgtctctcggctttctctctctcttgagcgcgtcctgaactgctgcgtttcactttctctttcttcctggaacgttttttccttagctctgtcggttttcattttca

SEQ ID NO: 2057 - DNA, 4164 bp, Toxoplasma gondii
atgttggacagttcgccaacgttacgggcacctcaaaggccatatactgctgcagaaggacgtcgtccgccatcatcttcttcagagcggcgaagacttcgctatccgctgccttattacctatgggaagtacatggaccttctccaaccatcgtttcttcactagctgcgaaggcggcgtcgaattctgagccccttctgcgtgcgtggagtcctcatttgcagaagcggagacgcctgcgtttaccgacattccctggtcaggttcaaccctgtttcgaagtggctgttcctcaccctccatcttgaagtcacctgttcggaattgcaggatccgggaaggtacggcggcgtggaagcaaaataccccgctccgatgacggtttcacgaggtgctacgtgaggctttcacgtatttgtttgtctcactttttcaactaatctgtggacgcaccgacgaaaaaacagcatgtgactgttaccgggtgacatgttcgtggaacagcggcacttgcagcaaaaaatcaaactggtgtctctgcctctgctgtgaagagaaactgggaaaataatcacgaagaggtcgaggattgagtctctccttgtttcctagagagatgcttttgtcttgcatcacgtaagagggatccgagctttgtgaatgtagcctgctttgtcgtagtaggtgcttgcatctgaaaggacatgccacttgaaagcgtcacggaagaaccaataaaaataaacaggcagtcccaaatgacggcaccgttcgagcattcgataagaagccgctagacccactcaaaaagggtgacccactgatactgatgcaccaacatggcagggatttaagcgcgatctgtttggcatgagacaagaatgaaataacacgtacactgtttagggggagaggatgtgactaggaggactctttttacttcgtaggtgacaaacactcagtaaatcttaagatgacacggcaacgacgcgcagcgtggctggctgctgccggccaaatcgaggtagaggaaaggcgcggtttgaatcattttcacaatagagagtgacaaaaaataaaaaaaacgatggcgccaccccccgtcactcagttgcttttcatctctggcgaatgaacgcatcgaaaacgaggaacgcaaccaggttctcacagctcaacaagcggcatgcgaaaaagctggacgccagacacgggcaaatcgcaacggcagtcattccgccacttttgtggtccagacctgcgcacatagagtgaccggtatggacaactacttattagagggtagggaaggaagaatttgccacatgggaaaacaaggcgaatgattgcgcctacacaacaaccaaacgaaactcgacactacgcacacaggatagacctcggtgggaggggggaacagcggtgacgtctctccagcgacagaatgttgtcttgtcgagaaatgcctccgcatttcgaaagagggactgagcacgaaccgaagaaagttcactcgcggaaaattatccactgaggacccagcgtgtttttttcgtgcttgctttcgattacggagcggtgtagccgagagcatactgacttcagcaaatgcgggaccgcctgtgtgatttaaaaccgtcggatacgcgaggagtacctcacttctcaacagacaagagtgcaaacaaacatctcttcacgacccaacgatgtggcagtggatattaatatgtctccgatgcacatacctgtcagagtaattaactgtcgaagaatgcgccttctaaacgctgtaatccaggcagtaaaacggctgctgggcgactccagagaacttagcagctaagattagcaagaaatgtctttaactcatttttcaatggaaaaccatgggaaacctgtagagaagcattttgctcggcactttctggtgtctcaggaggagtgttctgtcgcttctccatagcttccgtagaatcaggagtatggactgaactgtgagcggcaaacctgcacaattgctaatacccgcagccgtctgccacatctcgtgaacaagagaagtaccgcactccagcattctaccattcttacaagcacgtaattcgagacctctgacacggcaaaaggagttgccacctcgatagtggactaatggactgagctgtgtcaaacgacgcactcagcaattcttttatgtaaaaggcagccagcactccaccatctaattcaactcggttcctttactaaaaaatgaacacagcctaagcagaagaaaacagagttatcagagcccatcgagcgaatgtattttatgggatttctgtgttagtgcatagttcattgagctgaatggacacattttaaacaacagccgaactggagacgtgtcacagaattcatattgagaaccacccgagtctggggaagcagtcagccttgtctaccaaacgtagcaccagtttccagattggttacttcgcccgaaaagctgttacgcttgaccgtcgtcttatgccgtacacttatctcgacgctgatgatgccgatgtcgttgactcggactcgcgcaatctacgcggaggaggttttctgtgtctacgcgtgaactttacctaaagggccgctgatggtcgtgatcagtggcgtcattttctaacctaggcctgcaagttgcaggatatgcttcctttttgacgaaacgactgcccactgggagagaagttcaagaatgaactcacgctcattctttcttgcgagggttcactgtattgtaccagatcacgcattttgccctttcccctttgttcgcgataaaacaggaacggccgaaaatgaccctggcagccttggaaattgttcccttttagtcgcacaccacagaaacataaccgcgttccctctccatttcgatctcctgattttctaagaaaacggttcagttctgcaaagttcccggcacgagtgtgtccccggaactgttgcaactgccatgagggctggaggtaacctttcttcagaatatccatcgtttcgagggtggccgccttcgccagagctctggtagggtaccattcacccatgtctttccatcaaagtcatttcgataaatctcagcttcttgcgctgaagttcaatcctttcatttatccaaaaaactgctcatgtctgtatcccagacacccaagtgacggagggctgcctacttgccgccgctttcgcagtctggcgccggatatgggaggttgttataaagggattagagagcaggctcgtctcacacacggctacatagcctacagccagttctcttgggcattttgataagaaagaaaggttgttcatgagttgtggcgaccatattttcttgacggaagccttccagccacccgcctcgcggggtgcttgtagcgcgccgcgcatgcgttacgtcgagacacagtggcttgtttttaaggagaaagtcgctttaagtagctggcttaacccgggcttgttcttcatcatatcgatgagagctaccatttgcgccaaatgtagagaaaatggggcgtcacagatggcaaggctccatcaatgaggagcagcaaagactcgatgtgtttgtgagacactctcttcctggctctggagagacctggcggtgtaagtttcacagaacggcttgtcctggtttcgtttccgttttttttcgtgactataatttgaatcgcctctttttctcacaccattcccacgtttctagaggatcgtcgtctttctcccaggcaaagccacagtacaagcaaccgactgtggctacattctgctgcccagtagagtaggcaagaggccgactgttgttgctctaccaatcttttccgaagtatttccgcgcattatccaactcaggctgccactcaggcagttgttttgctgtgcgctggtcttcgtaaatatcgaggcactacgtggtctagtcttctacccggatagctggaaaacggcagttacagcttaagctgtctcccgagggtccacggagcccggcgtgtcgagacagtaccctgctgatggcgattgttatcgttcgttccttctctactcgtcggcttcaccggtttctttgtcgagatctcgaattttccccctttccagtaatagcttgcccccatctccaacca

SEQ ID NO: 2058 - DNA, 2542 bp, Toxoplasma gondii
cggcgacgtgaagaacattgcgtttcaggaaaaacagtctagaagaaagaagaggagaggcgtccggcaacgacgaaaaacagaggaggcatgcggtgcagggagagcggcggcgaagacgaggacaggaagaactggaggaaacggcgaagacggcaaggaaagatccgacagaaaaaaaacgcggggaggagcgagagacgccgaacagggggagagaacggagaagaaggacaggaagtagaggtcgaaggaagggagaaaaaagacgagagaagaagcgcgcgcaacggcacagccgaaaacgcacgcaagaaggctcacgcagaaaaatcctcgacgttggagagaagagacacagatcgaacgggagtccaagtcgatcgatacgcaagtattttttgggggggcctgcctaccctgtcgctacggctaaggcgaagaaattcacccgttacaacgcatgcatacgcgtatgtatgtaacatacatagtagaccgtatacatagacaaccttatatataaacgctatatgttatcaccagtactggcttacagaggcgaaagtgtttcgtcaacagtcatccggatctgatctatgtccgttccgtcagtctcgaatgccacgacattgtttcggaaatgaaacaaggcctccagatctgtctcgtgtggagagcctcgagcgtgaaaagaggtcgaagttgccatagacccaagcggagccgagactaccctctcaggcgacctgctttacgcctgcgaggggtatttacttccaccaaaagatccaagaaacatcgagaaaaacgggcagagttgcataccgaccgagtacaacttcgggggaaaactcacttcccttccttcccccgcagtcgcccagcgtccgcgccagcccccgcagcgaacttcatgtcttttccagcttctcaaaaaggcacaaaacactctttagctgcgaacgcgtgcagctggacacagaccagacccgacacgggtgctgaacggtaatgcaaactgtcgggaaaacctctccggcgcgaaaacagagatttacacaccgttgagatctgagtagcggaagtgcatgcgcatgtgtgtccacgagaaaggaagattttctttcgagaacgtttccctttgttcgcacattcctacgcgggctgcgtgccgcatgcatgtcgagaggactgcgttcgagtgctctttcgccgttgcagtgctggacattgcggcgtgggcaaaggatagaagtgacgacctctgacatggcagtgaaggtggcagagactcgcggaaaatccaaaaactctctgccgtttcggtcgaggaatcacctttctttttttcgtctctggacccgcctccgtggtgttcccttgcccttgcaagccgctgctatgtagctcgagggtcgggagagactcgtaaaatcgcagctcagctgcagcaaaaccgtctattatccggaaagctggacgaagaggggaaaaaagcggcggcgaaaacttcaccggtgaaaagggcagcgcctcagcggtgtgctctttctgccgcctttgtgagcagccggagaaacgcgaggacttgcgacttcccgcactgagacacatcagaagcaaatggggaagccgtgtcggaggaaaacgaagaagcagacacgaggaaagagagacgcgttgttcagctttgttgaaagcccagtttccttgccagatcggggttaaccgctcgactctggctgagcgttcccagactcgtcagcgtttttctgtttcacagaaagatcccgtttttcttgtcgagcaggggagagtgtggcgcagagtcctccgttccccgaactttctgactttctccgccggcgcttctgtctccgtgcctaccgacgctgatgtcgctccataggtgctcgttcgggagcaatttgcgtcttccccgggagtccccttgagtccatattttttccggtcctctcgagctgcgtgggggtagaggtgtgtctgtgtttcctttcgtcgaaaaacgtatccaggtttctttctccgtggtcggttggaaaatctcggcagcgcgggccgtgcatgtgaaacaggcaaatgaagctcaagggagacgcgacagtcgtcgacttgtgcagcgctttttcgtcttcatccacatttgagaagccgcgttcgattcgtttttaggcacttctgatttccggtaacttcacactctctccgttgtcgctgtagtcctctcttgttgcccgccccttcctgtgctcgtaacagtcgtagacttttctctccccctccaaagctgtttctccctcccttcttcctccttcaattcctttctgcctgcctctctcttgcctttctgcgccgttccctcgcaactttttctacacctctgtgcctttttcggtgctctttctttctgacgggttccttcatctccttcttccctgcagttttccccttccttgccgcatttcctccctttttgtacctctctctggctcttcgccgctcacctgtctcctcacca

SEQ ID NO: 2059 - DNA, 1497 bp, Toxoplasma gondii
atatacatatgcgtttaaatgcactagtagcatggcaagatgataaagcagctgcgtgagacctgcggtaagaaacgaagaggacgctccgttctcccgtatactgtttctcttcgtgagagcgagacttacttagggcagaggcctccctttgttgctttgttctgaccaccaaggactgaagggaaatgcacatactcgaggagcctcagaaaatcaattgaaagaacatgagagtaaatatcgtcgtgccagtagccgatttcccgtctgtccgtttttgcgttagcctcttgcgcaacgtacacagtaagatggtattccagtgcagttctgcaaggtgccatctcacataacgcaaactcgacaacctacacgcgggggaagtgtacccgaccatgttccagcagtacagcgaaacttgcctgctcccaccgttccctttctacaggttcaccatcgcgttggtgaaacaccgtggaacatcaccacggttcctccttcacggcggcacgcagccgcgccttttctaacgcagcttcagaagacgagccgcttgactttttttgctacttcgtcactatgcttgagctgagaaggttcgtcgccttcgacgcgttccccacaaacagcgtttgaacaacacggctctttgaggaagacaggtccgttgaagtcatcagtccactataaagtcacgttttgttggcttttcagttgtgagtctctcgatttgcaactgcgtctcttcatcctcggtgacgcgtgctctggaaaagaaacatgcgttcagttatccttttgctctgcggctgaagagagctgcgactgcgtccgcaactcgtcccgtcgcatgatgccgccctctggtccacctttctccaaactgggaacttacacttcttctctgtctcgagttcctcgcctcttctgcgagcttggttgatttcctgctctttggtcacgcccttctggcgctgcccagtcttattccagctcacgggcgtccagtcctggaacgacatcttgagtggagaaacggaggagaaagggccgacagaaaagggcaaaaaaacagagacgaacgctgcgcgctgcggaaccagacctgcgtcgcccggaagaaaggattctctgcagttgaatgctgcaggagcgcacaactcggaactcccgacacaccgagaacggcgggtgggaacaaaatgcgggagtgacgcgaaggcgaaggaggtgctgtctcgacagacgggtgtggggagagttccgcagaagcgtcctcaccaaattcgaacggacgaaaaataaccggaaaagaaacggaaattgtggcaaccgtcgctgcaaagtgaccgccggaaaaacgcggggcgtccccggtcgagggagttgcatcatttcgtgaagccggagctcttccgcgaaaagttgtctgcgggcggcctgcatgcgccagagcgccgatctcttgtaaacgctgaacttccggcagcgaaa

SEQ ID NO: 2060 - DNA, 2359 bp, Toxoplasma gondii
gagaacaacgagaacagcgggcaagagagaatgcagaagacaagacggcagcaggaggtgtgtggcacagcctcggcgcagtgagttgaagattcttttagaatcgagttaccgctgatagaaaatatgtgccagttgtgacagttcttgaaaacggtgtggaaactccgggcaactcggttcgacttgaactggcgaagcacacaacaaacgtatgtaggtcagccggtgaagaggcaggttccgcggatgtcacaagtctacaggaaagtggagactcgccagcgaaggcgacagagcatctgccgcgatgttcgagtccacctcgtggagaagcagaaaaggaagaacataggaggaaaaaggagagaccagcagcgagagaaaccagaggagcaccctccgcgttgcgtcctctcctctgtcagctgcttcaatggaccagagtcccttctagcccaagctcgcgtctttaccggtctctcttcttgtgcctgttgcgcatctcaccgtggacagtccggattcgtcgagaaactggaaaacagcagggtcaaggagaggaccggagacggaagtctcccgcgtgttctttgtgcgaggagacgcagacaaagagctctttgctcctcctcctgccggtggccgtcccgccttcttcgccatccttctcagaaagcgcagaaacagcaaagcgaacaacgaagaagacaaggagatggccgacggtaagaagtttcggcagaaatagtgcagtggggtctgatggcggtactcgctccaccggtcgtctcctctacaatgccgggggcctgtgtctcgaaaaaggagacaaaaaaactgagaaagagacgagacaaaagagacaaacgggacgaaggaggcgacagagacaagggagaactggagaagcgtgcaaggcgctgctaccgctgcatggtgaataagtcagcagcgaggcagaggcggaaaaaacgagatgaagagaagagaagaagcagttgagaaaaacacgggagacgcagggacgcggaacgaagggtgttggtcttcggcccaagggtgttggtcttcggcaagctgaagagccccagaggtccgggtcccgatctttccttcgatgaggagatggaatacgaaaggaaaacaaaggctgataaaatgcaagcaagggagatctgccgtcgagcaaaacggattcttctggtcgtgtgaagaagcctaggcagcgacgactttgcgacacctgccgcggcggcagagaaatccagcgggaggccttagtttgcgaagagacaaagataccaggggggtcttaaacccagcagaatgcggggaaaggaaaagttttgcacgaaagacagggaaaggaaggctccgcgcgcgaaggcccacaaaccacctactttgcgacagaaagagggaaaacacgaggcaggagaccaggagggtagagagaggaaatgcctctgaaaggaaaggtgttgaaaagtcgagaatctataacggggagggaaggtgaagatttttaaagaaaaagtgacaagacaaggtggtttttctgcaatcccacagtgaagaccgggacgccaaccagagaaggccctcctctcagtgtctcccttttctcgcgagaagcgcgagcgtaccgtggcgcgtccacagccgcgtttcggcctgaaaaagaggtgctccaaactctcttaaaacattttccatctggtctttcctctcttcttggcgcatgcatgcttctgcgcagcccctctctacgtgctgcggtcggtcctgggcgtcgttcaggcgacactccgttcgtttcacgccgatagagaaatgagagaaagaaactcggatcagcttcttctttcgtcagcttgttttctggagtatcctccctttccctgctgcataaaatacctttctgaggcgctctgttctgttgtttgtcgctacaggttccggtaaacatatcggatgtcctatgcctagcgcgcagaggtcctgcaacctgtcgccaccttctcttctcctccctgccaccttcttcttgctcggctcccgttcctgtcacttggttgttgcctctcgttattctgtggcgtctgtttctcccggcttttcggatcttcccctgcttctgcgtgtgtccggacggattttttggctgtcttgttcgtcggggccttctcctgagtccggattctgttgttgtttttctctaatgagaacggcacttcactcacagatgcagtgtgtgaagttttgtatataaaggtggatctctgtcttttttctctcccggtcaccctgcatgcgccgccgcaaggtcggcaccggcacacctcttccgtctaga

SEQ ID NO: 2061 - DNA, 1883 bp, Toxoplasma gondii
gacaggcttctcgagagagaaggaacgaggtagagacgacatttgtcgtcgcaggagccgagagcgacgagacggtctgcgcccagtcgcagtggagagacagagccggacacgatcgcgtcctctgcgccctcgcaaacggcttgcagacggcgcgcggcctcatcgaggagaaacggagaagacgcagaagcagaagggaggtccaagaactcgccttccggtgtttcgatcacccagcgacagcctggaggggcgtcaggaaatccggcgtcctcaccttcttcgtcttcgtccatcgatgcatcgtcgtcgtccattgacgcgtcgtcgtcgacctcgctggctgggaccgccagagcagcatcaacgcagtgttcaggatccagaaaagattcttcttccggcacgaggaccactgaatccagaggagaaacagcagaagaagaagaggaagaagaggaagaagaggaagaagaggaagaagaagaagaggaagaagaagaggaagaagaagaagaggaagatggaagaagaagggtgttggtgttcgccatcgttttgctaagaggtgagagcgctgaagcgagtgcagacgtccgggagtggagagagcggggagaccgcgaccttggaaggcagaaggaaagcgagcacaaagatacactcgcttgaacgcgtcagacacaggagcgtcgccctctgttgtttcgtcgtttgtctcctcttcgtctctcgccttttcgagtctcccgtctttctggaagaccgaggtgctcttctctctcgaggcgctgtcgcgcgtcaccctccttcgcgttccggcagcgacagcctctccgtctcttctctctgagcttctccagcctttcctcgagcggggatgcagaggagagaaaacggacggtgtctcgccttcgtaggccgcgggggggcgcgaagccaacgcgtgcatgcgaaaggaagctgcgggaactggaaccgtccctactggggagtctgccggcaacttgaagaggaaggcaggtggaacagaaaaaagacggaaaatacggagagaaaaaagattctggggggctgttttgcggggagacgagacacaaaccgcgccacagtgcatgcgccctcgagttctgtgtcccggggctgctgtctccgagaaaagaagacccgtgcatgcgcatgttttgtgtaactgtcttccgttcttgtgattttctgcactgcgcttgaccgttttccttctctccttcatctgttcgtctcttcctctcgtctccttgtgaacagcttccatgcagctgtactgagttccagagagtaactggagagacgcgtcttttctctacagagcaagtcgctggcgcccagtgccagagtgcagtcttctcgtcggcaaagcttttctctctcggctctcggaaactggtcaaatgtacacgagggtctcgacaggagacaagtttctcacgcgttcctctcggtgtctgaatcgtctcctctccctctctcctgaggccgcgttctctatccaccatttacctcgggcgtctctttctctctagtccgtcttcctcgcattccttctctcctcgctctcattgtctttctctttctcggtctccttctgtcgctgttccattctcttcttctctctcgcgttccttctcacctctcctctttctctttgcgtctcgttctctcttcttcttccttcccctctctctctcttcttttcctgtcatttcctgcgtctatgtgcgtgtaaggagttctcgggggagatctgtcaccctacctccgcagccttcgtagaggaaagcgcttcgttcactctgtctgcctcgtcctctctgtctgcctcgtcctctctgtctccgcaa

SEQ ID NO: 2062 - DNA, 2241 bp, Toxoplasma gondii
gtgcatttagatgaacgcagtttcttttgtggtgacagaaatgctgccacgtgtagctcacgcacatttgcagctggggtctgcagacagtcgggcaggtctgccgactcaggcctggctgtttgcccgccgtgcgtcgaggctgctgttttaggaagaagcgggttcctggaagttcgcgaaccaagggaaagaccgttggatctctctgctggtagagagctccgaatgtttttgaagaaatgcatgtgggcaatgggtgagccgagcggtttcacagagggaggctctcggcgcccgcggacatctggaaagaagttagggttactgtcacatgcacagaacgcgatgagtaacagaacgcgatgagtaacggcgcggaaaagtctgcccacggacgtagcgacggcagttctgtccggggatcgtggtccgcttttgaggctccgacttgcggactatagttttgcgcaactttccgtggaaagcgaaggaaaactcgacgcacgctcgccgaaaggctttttaacgattttgcactctggcgcttcgcatggtttgacgaactgtggtgaagtcgtcgctttccgtgctcctcgagtggaaagacgcccgagtctgctcacgctctcacacagaccgaaaacaagtgcgctggtcactgacctactacgctgaaacgaatcggattcctggggcttcgtcgccttgcgtgaatctgcggcaccttgaatttatgataccgcactttccctcgttcactgccgccgttgtgcaacttatagtcgccattttctgctttttagtacgcgagtataaactcgtatgcacagatgggcattattgctcttttctgacatcaccgttttagaacgcagagaaatctgcgatctgaccgccgaggcatctttcttggcagtaccagtgggcgagtgttaaggcgacgatctaacaatttcgataaagccaagccacatgggttggtttgttcgcttggaaatcctgtagaaaccactcagatccaagggcggacgaagctggggggccgccgcttggacgctgaagtgagtgacagtgttggttgagtaggagcacagaaccagtccgggaacattaaaagggaaactgccacaacgaatgccacaacaattgttaagctagtaaatcactgtgcatttcactccatgtccgccttacgactttataatcaaacataaaaccaagttttaggggaatccgggatccttcttggcacggcgttaaatcctcatacgcacatacctaagaagattaacatgatactggccaagaatagaacagacaaaaagagtacgctgacgattctgcatttacatctggaacagattcagggtatctccgaatatacgtgttttgacaaagtgtgcgacgcaaaacatgaaagagcgagcgtagctccgcgtctcgagctttcgtagcagctatcgtccagctgatttagcttccacggtcctcttcttgctatcaaagttgcgctagcagcctttcgagactaagatcccgaaggattaaacattgcgtgaagaaagcgtttgccaaagacagagacgcgacatgggagtgctgcgtccaaccaaagcgtttatcattctcaaagagagaaccggaattccatcggcactaagccttccgcagaatctacaaaagtagtcaccttcaatgaaggatctcttaaggctattgtatgtgtgtgtgttgtgacagattgtgttaggacgagatacggaaagaagacaaatctgtttgcagggggctttttcaaggggagcatttcgctcaaactcttcgttttcctgtgtatcgatggtgaagcgtgtcgcgtcgcatactgactagcggcgagtggcatgctccatctgtcgatctcgcgtacctgttcccccccgaattttacgcttgttactcagcagttgacggctgtcacggattgaaacacgggagtttgtgactcattcctgcttcgggggaatacttttttttctttggctccgacaggtgagctcgccgaacagcggcggtggttgctgtcaagatctttagggacgcgcttccagttgtggacctgtgttttcccaagccggaaagcgaccgtcgcagagtgagaggggacctgacctctgcgattcttttcagcgtgtcgttgcaaactgccggcgggatatctcggcaagaacaatcagctgtacggaacgcgtggcacaa

SEQ ID NO: 2063 - DNA, 1680 bp, Toxoplasma gondii
gtgtctgtacaccgcaaagtcacagagcgatcggagagagacatggaggcagatcacggaggcactgcgagcgaaacttctcgtcgtcgaccaggggaacgctgcagcgaaagaactttgcagactttctcgctgaagtggacggaccgacggcagtgttcgccctctccccaattcacagcctcagtgcggcgctgcgcgtcgctgtacagacacctgaacccatgcttcacgttccacagagacttgcagacatgcacaggtctctgtcgaagctgcatgcacacaggagtatctccaagaaaaacaaggaatggcctcccttctcagacacacaagaaatagtacccacacatacatacatttgtatatatatatatatatatgtatacaaatatatatatatatatatatatatagataaatatatataaatatatatatatatatgtatatatatgtgtatatatatgtatatatatatatatatatgtatatacgtgcgtgtatgcatacacgtttgcctatacaacgacacccgcgtagtacgatccatgaacgtttgcgcctcgatttacatgcatcaagatcgaaatgtttctatcgactggcagtgccttctaacctgaagaggatagatccttcatcgtggttgagagattcgaggatcaagttcatggcgcctgcgcctccatgttttttgatggaaaacagatgcgccattttcctcacgatgctcgtctcggggctgcacatcgcagcctcgagttccgccatcgtcggcaagttgaagtgattctctgcatccatcccctgctcctcttcgggagcctccctgtccacggatgcttcatcgcacttgcacattttcaaggctttataagcgaggtcgatcctttttctctggaagtccaagtgtaagtacaccatgcagcgcagagcgcagagcgtcgagagaaaggcgagtttttcggacgaaaaaggcaccacgagagtagccaagctgtcggtctgtcgaatttaaaaatagttcttggacttcatcttcctcctcgaaatatccgcggcgccgcgacgattcccgcccacgcactcgcctcgcgcttctccactcaaattgacgctgtgggagagacagcggctggtttgcgctttcgagtaagaaaagaaagtcgctgcaccggacagagacggcactttagcatggttttcagaaaagttaaaaacgtttctgacagtgttgcctccgcgaaagaaagacactgtcgcactcgctcttgcgcgctttgtccctttgctgcgctgagcgggcagatgaagagcagagaagagcgacgactttgcgtctcagtcgatctgtgtcgatctgtgcctgccgcttttcctgtctcgcaaaaatcgacagacccgccccgtgaaagcgcgaaaaacagccgccgaagcctcgggagtcgcgctgcatccccgccttgtgttttcgccgccatccacacacaaacatcctttctcccgatctgctctttccagggaattcgacttttcccgcctctctcgagaccgcgctgccgttttcttctgagtcgaagccgcgctcgcgccttttttcgctctcgcgctcgggtctctgatccgttggacggcgagctttctttggaaatctgctcttctttttgcacacaa

SEQ ID NO: 2064 - DNA, 2026 bp, Toxoplasma gondii
aacgacgtcgttcttggtgatagaagatgtttgtatttacaacggactgcatatctctggatggacatttacgaattcgactttttccttgcctgcaagaccctccagcccgaagatccccgcgacgctgccggcaacgactgcagccaggtgacggctgaggacaacaaataaacggaagaccgcatgcgcgagcggaggtgcgctcaaaataaaggtgcggtgagagaaagccacacgcatccatcgaaaaagaacaaggagggatgctatggtcggaggagacaaagggagaaacagaattaatggagaaaggaacgaggggtcggagaagagaggaggaagcaagacagttaaggaggaatcacacgaacggagacaggtttggtggcagctggagagaaggaggcaaggccttcggtctaaaatgtccagaagagataggaacctagacatgggtacccagaaaaagggtgaaagatgcgaatttttcctcagagatgatgacatcttacttcaccgtaagttggcggtagttgtgagagaccatcgaagggcgaatgggaggtgactccgcctcctttttctcggctcttcctccagctaaccgtggagaacatgtggccgaagggtcggaaacagaagaagcctcgtccccatatgtcacgtcgccttcggctgcgttgcgtgagggcgcagaggcaaggtctctcatttgcacacctgaaacaccggcaccttccattttgcggaaaagtggaaacgggagaaactgacaaagaaaagaactctctctcttgaccctttcgagtgaaaaaaacgtcgtagacaaggtgggccttcgaaagggtcccggatgctgagaaaagcaaagaatttgagtaactccttcgacagacaccggcgtcgttcatctgcccaggtcactcggccaccacttgaccccagcttgttctgagattcgagtcagcagctgagtgcggcggctaaagcggtgagttgcaaagcacttttctcaagaaaagaaagcagtttcaagaccggttatcagaggtgcaaggcagatggtgacgcaggcgtcgcgcggtgattcattttgcaggaaggtcctcgtctgtagtttgtgaagaattgaacggaaaacaggtttatgccctaggtgcaacgttggatgtgaaaagccgatttgagagtcagaagcaagacaaggagatgataagctgacttggtttcacggtctgaaaacggaacaatgaaactcggatgtgcaagaaaaaggcgctggaaatgcggacgtgcgaaacagacgcgatgcagaggatcggataagggaagttgggaaaaaaaggagaaagaggaaagggtgacaagggacaacccgaggaaaaaccgtgcaaaagttgtgtttcatgacgacgtgtacaaggcatgcctgtggcaacaacggaggctctccagggcgcgtgatcgagcggcatgtcttctgaacatgcgcaagtcgatgtagaacgcgggaaacacatgtcgagtatgtacacctttttgcttcattacagtgagaaattgcacttcccggagcattcgcgtctggacagcggtcgtttatgtggtgcggttcttctcccgtttcgcgagtcgggtttctgtgctgtctcccacgcgacgcaaagcccctacgcgctgaattcccgtctcgatgtctcctgaacagtcctgcgcccgaaacacgtagtttggcgtatgatttcacaggtacggaggcgagttttcgtgaggaagactcggcggtgttaatggcaacctcaggaacaaaatagagtcttctctggatagctgaaagctccgtctcagcaacctgtgcccggcgtccacagcgtttttgagtccatggcaacgccggaggattcacggggtcgagaagtatcctcgccaacttcaatttcctccgctttttcgtggctttgattgccgcctttccccaagatccacgccacttctccggtccgcggttccctcgttcctgcca

SEQ ID NO: 2065 - DNA, 2604 bp, Toxoplasma gondii
aaatgttcgtaccgaagtccagagaaagaagaagcgaggagagcctcgaaaggactggtcctctccgcagagggagccgaggaagcgagagcacggggagagagacgcgaagaggtgacagacgcgaaaggagattctgcgtcctccatctgcccgtccgcctccgggggaaccttcgtcttgtctctctgttctgagttttctgtttgctggctttctccggtcctcggaaggtccgcgttcggcgccttgtcctctcctgtgagagatcggtcgccctgcttgtctccttgagacataaacgcaagcaaatgctcgcctggaggcgccctttgccctcggcgttgtctctgcacagtggcggagaggccccagcctgtctcctggctcacgtcgaaaaggccgaggcgcttcgcctgtgtccgcgacagcttcaggccttctcgccgcttccgggaccttctctccgacgcagaaccaacggcttgttcagaactcttctgccgcaaagagtccaggcgcaatgcccggttcgacaacttgctctccaccagcgtcgccgctggcgtctgcagcggacagagctgaatcacaccgaccaaaaggagacaagggagacaagggagaaaagaaaggaaatgaagagaaatggagagagaaaagcagacaagggagacaaaggagaaacaggagacacacgagacgatgttgacagacgagagaggaacgaaactaaaggaagaagcaagggagagaagggagggaaaaaagagagctgggggacgccttcgagaagcagaagactttgttcagtgccgctccatcggagtgccgcgtgagacggggacataggtacgaaccgtaagcgcgagaagaagaaaagcgacactgagtggactgcagaagaggaagagccgagaagagagttccgcctttacctcgagaatttcttgaaggaaatttccatctgcggcgggggacgaacgagatacagcgtcttgtcgatacagacaagcatacagcggatgagagagactggcaagtcctgaactcgataatcgtgtcgcatacgctgccgcaagctgctcctgaacagaagaagaagaagaaggaggagaagaagaagaagaagaagaagaagaagagccgatttttttcgattgaacgccggcagatggcggagaggaagaagggggtacgggccaggaatgatggaagggagcagagagcgttttagccttcttcttccccatggctgcgagagtcttcaaggagcaacatgaaaagaagcggcggacaagaaaaagagagacctctggtgaggaaggagagggagcgaacgaggggaaattcggatgaaaaaagctcggaaaggcgcgggcgggtggaggaagcgagagaagcctcggaggcggaaaccggagtcaagtgaaaaggagaaaagggagcaccgaaccggaagctcgagagacgagaagaagagcgcggacgcgcggggcaagagaagaaggtgggggcgaaaaagagaaaaaacggagagtcaaaggagaaacgagaaaaaaaaagcgaacagcgaaaagcgaaaagcgaaaagaagagaagaatgggggcaagaatcctcggcgcgaagagacgtcaacgttgagagacagcggctcttttttctcccgcaaaaagctcgagctgaatgctgtgcacactggaagaaaccgaagctagctgaaagcgctatcttttgagttcctttcctgctgtcttccccggcttgaggaaaacgtggagagttgaagcatctttttttttcgctggttctggccctagctgtctagagacggggacggccttgcggagaggttgctcgcggcggcttcgtcgtgcgtgacgcgttctttctctcgccttcttctctccttctcttcgctttcttcttgagaagtgaactgcagacctggaaatgacaacgcgttttctaaaggcgtccagacatccttggctttccactccagccggtctcgcctgtctccgggacgcgtcgtcacttctcgcgctggaaagtctggttcctgggtcgtctttcctcgtcggcagagtccccggcgcaagttctctcaagcctctgtctcaaggctaaccattcacagacaaatccttttcttgcgtcgtcgccttttcatgcctagccttcgctcctcaagttctctcgtcttccctgcccgccctctcccccccctcccgcctgtctggcggcaagttgacgagcgcgccggcgtgagctcttcgagacgcagcaatctccactcgccgcgcctccctccctgcgtcttcttcgtttccagcggagaaggtccacgcgacggcgagttgcgccagtcagcgcttgaagagctcacgccgccgtacatttgctgggaatccctcaaccgctgcgtggtacacccaggcagcttcgccgtttgcttgcgttcctcttgacatctcgagccgaaccgattgctgcagcaggggggaggcaaggaagagagcgtctggtgaccgacacaacgtcacaactgtcgaatgcctcccccaaggacttccaacgcagtagaggccgaaagtccgcga

SEQ ID NO: 2066 - DNA, 3125 bp, Toxoplasma gondii
gtagttcttaccaagggcattaaaacctgcaactacaccgcatccttacatcccatagaaaccatactgaccaaaataaaacaaaatgcctagaaaacatgataaattttgccgccggaaacccaacggctcttggagcttctactggtagacgggactgtaaagatttgatcggtgtgtcgtggatgcggggagagtgagaggggaagagctttgcggcgcgaaatagcaggggggactcgcagagggtgatgagccctgaattactgttacagggtgagatggaacaaaatttggtttgttcatcagctgggagtgctgacagtacattgatgctctcatggcccggacgaggttctccttatcctcagtgaatgttcgaacacgtccagcgatgtctgcgaatgtttgctgaagaggacaacatgtataatacagagacgaatgggatgaaaacacaccaatattttcatcggtgttgtcgcatcctatgtcaatcaccatcaaatatatcacaccgagagctcttcttacttgcaatctgactttgtgtcccgggagccagcgaacctggttgaacttctcaatatcatccaaagactcggatgtcagcgtgcacagagtctccagctgagaacagtagtaagcagaggtcagaggtacaaggcaacacgatagaaagacgcaaatcacaaccaggtacgcaaaatgctcgaacgaacgactgctacctactgtgtcaaaacccgcgttcgtgaagtgggctgcaatttccgtgggaagtttctgcgctcggaaaaattcgacgacgccctgcctctccttctctaggtcggggtctgcacgcacaggaaggtgaacaggagacgacgatacacacaagacattccggtgttgagagtccacagcgtacgtgtctgcatgtgttgagagactgtctggatccgttggaaacaccactgttaattctacccgcacgagattcgccctggaagcacactgaagctgagagaacccgtcttgcctgcattccagattgccgcgaaacccgatagatgctcagggtaatgcttgcagaggaagtcaacgatgaagaaaatgacattcgctggtttctcgtcttcaatttcctgctcgcagccagacatgcacaaagaatccacgaagcattacactggtgtatgcaaccggatttcttagacgcacaaaaggacataattagttcttgtacgctttgtacaaataactacaccttccaaacaaacattaataccactaggagattgaaatccaacaccttcagctctgatgcggacaacccagtagagtctcgtgcagtggcgaagccacttggatcctcacttgctgcattcgagcgaagagctgctgaacttgggcgtggaccttgcttggcccgccgacaggttttccagcagacccctttggcttcgcctcgtctgttcctgttctgtcagacatcctggcacgcgttgggacgtcaactagaagactgacgcggtcaaataccgatgaagctggcgtctctagccattcaagaaaagtagggggtcaaccgcgtggtcagaaatcgctttggaaggaagatcgcacagaagaagtcgtatttacaaactcgtcaaccgacaattgcctttcccagtttctgggttgttgccggacgaaggtgtcagccgcaagctcgactcacccacgcgcaagccgccgatccacgtgtcgcgaagttacacaagagacacgttggtcttcgagttcaaaatatccccgaaaatattcacaccctctaacaagcgacacctcttcctcggcagactggactggtttttggactgattcatgtgctggtgcctggtgagagggatacggtctctgttgcacgctttcatcagcgctgaagctcgcggccagagggctagccaaacactcaggataagcaacccgacaagtgcgaagctcctcaaattgagcatccgtaaatttctccggtcccaggttttcctcgcgcatttccggacttcttgttgccacaatgaactcaaagttcgcctactctgcgcgtctttgctctgcgccggaacagacaatgtcttacgccggaatccaggctgcgctcgcggttcgttttctctcggtcttgccagttcgcgacgaggactcggagcacctcgtacttgggggtacacaggtgtcgaacgcgttagcgcgctggggcgttgtcaaaaatacctggtagaaaattaccttgattgtctcgaaaagcctcaaacgctcagcgtttattgcgtgcttcttccaggcgattgaattttttgcaacctcggaatcacagaaatttcacacgcacacgcacgctgctgcgaacacgagtcacagctttgtctgcatgcaaacattcacactcattccaagccatatttgccgatggacgcgcttgtcgccttcctattcacttagagcgtgtgcgtgactttcgcggcaagcgtggccgtttctggagcaggtttccactagaatctctttgccttctcgggaccctcatgaacagactgcaatttcaacggcatgctatacagggaaagcctgcttgcctcacggttccccagctcccacgagccctctcgctttgcattccgccacattttgttttcctaatacggtctagttctctcctccgcctagcgcctcgggacaatgctgcttgctgaccgttccgcagagagttcaccgtttctgttttcgccccggcgttcaggcctctcgcagggcaaaggtagacctccacagatctgggaaaaggcacgttagtttttggcgttccttcctccgtgtgggttctactgtgactcgtagtctcctcctgttccttactctccgctgagaagcaaaacgggaattcctggggacttcgcactgtgtgtcagcgttagatccgtccgcacactgaattggaacccgacgcacagaaaaacatacatacacacacatatgttggtatatatatatatatgtatgtatgtatatgaggtatgtgtgttgacatttccggtggagcaaacccgctgtcccagcgttttctttcgaggacacacagctctgtttcgcggcaa

SEQ ID NO: 2067 - DNA, 1770 bp, Toxoplasma gondii
gttatgccgctatgcgtttcaacttcaacttcaaagtcacagcgtcctctacagtgtggtgcatccacctatgcagaaagttattgtctgcgtgacgcaacacacataacaacggttttacagtcttgtcctgaatcggttgctctacattgtctgccgataggaaaaggcctaaagtgcggcggggtcacttcaaatctgccttttgtgtgcacgtcgtttcaggaccatcgatacactgtctgggcatgacgacggaagcgagaagggaatgccaacagacggaaagcatctctttcgctcccattctcaacacaaaaggaagagatgtatgcctgaacgcaagccctgtgttggcatgcgcagtggaccagcccttgatacacaatccagaatgcgggaaaactctggggcggaacggcgcgtcagatagtcacagtaatgatagagtagaggtagacgtatagaaaaaagcacagagaagcatcgtttcagaagattcattccacggagggggaagcggtgtccttgcggaagacaccacgtaccagtcctctgcggggaacgccccgcgtccttgggctcctccttgaagagccgttacatgctgtcgaaaccctttgtcgaccagctgaagagcgacactctcctcctcgccctgacaagattcaaagctgtgtttctccgaagtcacagggctgttggatgcctccacattgtgccgtcgcgcctgactgtttgctgtcatcgttacgagttagtgacacgattgacttctgaaatcgctacggattgaagattagagtaagcagaacacactgcaaaagcgattgctcgcgtgatggatttcttgctgaaacagaacactactggcactcaaacgaggcgggtggtgagtgtggcaaacaaccattccttatagaagatgaggaggctcgaaagtacgacgtcattcacgtctttgactcttcgtccgtctcctggcttcccgttcggttcattcgcgatcgattgtgatgtatttttcaccttggaaaaagcggcttgctatttcgcggacggggctggcggatggaggcctgtctccggtcccagtcaattttgacgaaaatagttaaatgcacaaatccgttcgcagagatcctgacgcaaaacttagaacgtggtagaaggttgtgaaagggatcgggaacactacagactcagaaaattgatgtgttgactgaaagaacacgaagtgtgctgagcgaagcctctgtggaagacgacatgcgtgtagtcgctggtgtccgaactgtgcagtacgtcgattcgttcactaagccagtccagcaacaaacacacgaacccctctattaaacgcaatggaacaattttcaaacaccgattcactcaaagaaaaacacgagacacgacggtgaggtgatggggggtgcgatgtctccggcgcgaagtgttcaagaaactgactcctgttgttgcactctgaccctttttctcaaactgggggggggggtggggatggaaagacctgaaacggggagacagcgaagccagaagtggataccggttttcagtgcgtactgagagtggctcttgaacttttcagaactttcttggtgtttttcccttctctttaccaaaagttcattctgcctcagccgtcggcagtttaaaggttgccgtttgaagctcgtttcctgttgtttgtcctttctttcgtttcagtccccgcatcttggtgagcctttgcgatatctccattcatca

SEQ ID NO: 2068 - DNA, 1676 bp, Toxoplasma gondii
gagagcgaggagggacaaggaccggagaacaatgacaagagtcctcagcgcgacggcaccggtcagatgaggacgatgaggaaaaaccagcaggtgtgagagatgaagacgaagaagtcacgcgcaggaaagaaagcgaagagaaggaagagtggggaagacacgagtgaaaagctgaaggagacgagagcgaagaggacggagaagaaggcgacgcgacaggagcttgtttgcttgctctctcctgattcgcggcgatagaaactggcgggaaagggagacgagagaaatctccaaatcgcctgtgtggaactgaacagcatacggttttgcagaagagaaggttctctctgcatgcgatccggcgtactctcgccatctctctgtcggcctctctctgacgcagaaccgcgtgctgtacagaggcagaagctacgctgaagcaaccacagcgaagagcgcgaagaaagaggcgcagagaggcgagcaagcgaagagaataaactgcacaaaagagcggaaggggagggaggaagacacagagagaacgagcgcagtctgagaaaagaactgagggaagagcgaccaagagaagaaggagaagaaagagaagaagaacgagaagcaggagaagaagaacgagaagcagaagaagaagcagaagaagagatgggagatggcgaagaagtcgaggtgcaacacaagggagagtaagacgtagaggtggaggaaaaagaagaagatggagaagaagaacgagcagaagacgctccaacgtcagcgcctctgacggattacatctcaagagacacgaacattccccgagctcgtgtggagagcgtagcccgaggtttgggaacaagaagagaaaaactgtgactctttcttcttcgaaaaactggaagcgaagagtttctttcggggaaattcctgaaaaaagtcctctctcggcgcctcttacgtgtgttctttgcgcggttctcagcagtctccaggaggaagaatacagcgtctctctcagctcttagtccagtcccgatggagacagatgtcctgcatgcggctgcagcgattcgttttcgcgacttttctttctcttgaagaggttatctgtttgaggcaacatggcatttttctccctgagacgacgacctccagttttttaaaggcatttccctcgccgagagtcgtcaagaagcagacttgctgcggcagtgcctgccttctctcagatgatgcagccgggccgttggtgtgtgaaaacatttctcggtccgcaagactcttttcgccccgccgcatgccttttcttttttttttctttttcttctgaatattcaaaggatagaaagcgtctgtagagcgcgccagaaactccttcgtctctctgcccccaggcaccgtccacacacaccgaggtcacgagggagggagaagagagcggagaaggtaaagaaaaggagacacagaaagagaggacagaaggggaaagagacggaagaaacggagagaaaaagaggaaggagagagagaagaagtgacagagtggagggagaaggaaagagagagagaaagaggggaaaagagataaaagagaagagagggaggagaggcgagaggaaaaagacagagaagaagagaggtgaagagaaactaggaaaagccaccggcagtga

SEQ ID NO: 2069 - DNA, 760 bp, Toxoplasma gondii
gcaaagagttttgaatatcgaaccactcaactctgcaccacgttgttcctgtggtcttcatattcggccgttttcttcataggttgtgtatcttcttcataccacctacgttgtttttcttcaaaggtcgtatttccaagaactggaaggcgagttcctggtgtctcgtaccacgcttcttgtgaagacacaactcagttctcaggtctcgttcagataaggggttttccatcgctttgtacggcggggtggttcaactagagatgaaagaaacgaaagcaaaggtatttgtttgccgcgatctctgctccagctatgaaacatctgggcaggctttggaagacacgttgcattgcaagagtagaaagaacctgacttcggagttccctcgctactttcacaaacaggaattataggtactttaactcgcgcttaattttactagcagcaactctctcctttcgccggtgtcgcgacgcggaagcaagcatcaaggaaacatgcggattttccaggtttccggcagatctctctggaagaaggcgttctctcagacgaaccgccctcgacgagacagctcgacatgcggtcgccaagattcctcagagaaacagcatggacatctgcaacagcatcttaaacctgcattcacacttcgcggcgaaggcggtttatcggatcaccgagcttatcgagtcaaccgggagacgtggaacactgtagtgtgaatccgtaccagcactacgcggaagtgagcaga

SEQ ID NO: 2070 - DNA, 1806 bp, Toxoplasma gondii
acgtccacgaatccgtggatcggtaactcaccagcgaaacgctgtttctcagacgcgggtgcgacaccactgctcgcagttcgccgcaaacgcttcctcgaatcctcagacggtcccgcggagttccctctgccggtcttcgcgttcgctttctcgagacctgggtcagcccgtcgctcgtgcagacggcccgcagacgcatgcagccgcctctctcgtgattcttcgctctctccgagacgcgccgaacacccagaagacgcagcagttcgagcacgcaaagaagaagaacaagaagcagacgcacaggcgaacggtgaagagagagaagcggcaggcgttgcctgcgagttcccagtgagtggcaacctggataccgactcgtctgcggcctcgtctgcggcgcatgcctgacccttgagtgcatttgcagcgtttcgttgcgactctctgtctgggcagtagacctctccaagatcttcttcaacggaggagaagccggttgcgcttcgcgaggaaaccgcacttggcgaactcgccattcgccgtttctctgcagaaaactctgcactcgaagactctactcccgaccgcgctgcctcttgaccgccgttcaagtggcgactggtgcgttccgccttgggtttccttcctcgctttctctctgctcggagtcgttcgctctccgcaagcagaaagtcgctgacgagcgtcgccatggtgaaggaacggcaagaaggcaaacggataaagcctccgtcctagcgcatgcatgccgacgcatgcagagggccgtttctgcttgatccggaaaacgttcgcgagcttgcaaaagtgtgttccccttttcaagatccggatgtttgagaagtgctccctgagaaacgggttgctgtcgatcgacttcttcgtggaatggcgtccggcgaggaggcctcctcgttcttttcactttgaaggttgaccgtaacgttgattcaacaacgacagaacgctgtgtgaagttaacactgtgctcgttgagcagtggtcgagcgacagggttccggttctctctccgctgcgtctccgtctctctgaggaagctcgtcaaggtaaaaactggagggaactgcaaagacggagaaacgaggaaaaagcgaaaaaagctctcatctagcgacattgaggccgctttgccgggcgcattcttctgggagggacatcggagaaagtaatctcgagttcttcagaggaaattggaaaagacggcacaaggacaaaccagatggctttaactgtaaggaacaatggcgaaagaaacgaagaagagaaaatgaatgcgcgcgcatgcaaatgttgagagactcaaaacgttctccgcaagccggaggcactcgggtagctcgattccccccaggcaggaacgagtttttctccgccttggatcagaaaaaggagtcttttctttccagaatttccttgagaatcagagtggagttgagaaagtgaattcaaattcaagaaagaaacgcatgcagatctgactgaacagctttatcgtgtgggtccggcgttgcatgcgccactctcgacagctgcaaagacaccctttttcgcgaaacatgtatattcaaagtgaagcacgcctgtaaagcgacgccgactccccaaattcacgtgacacttctccgtagtcctccactgcctcgtttctgtctctggtgtcccggctgactggccctattctctcactcttccgtgtttgtctacacgcgagctgtcttgcgagcacggtgtttctctcgtgctccttcccctgaatca

SEQ ID NO: 2071 - DNA, 2434 bp, Toxoplasma gondii
gtctgcttcccgctgttggtatttagaaatacatgcggaacacacgagaaaccgtagcagagccctttcgggatccgacgtaccccctagttcacgcatgttatggactctgacggtagcatgtttcttctccttcaacgatccgaaacatcacacatgcagacctgtctacatacacatgtcttctagatcaagtcttttgtccagtagcacttcttcacatgcttcatacccccgagcttccccacagatgtgcacaggagtgcggatgtattgaagtggccgagtataaacaaacatgcagcccttttagattcctcttttaatttcctccagttctgtgcatacaccagaggcatttcgtttgtacgcctaatctcaggagaaacatatgcggaaacgtttggtggtttttacacacgaaaatagagatgttcccagagaaacacatagatagctgtgcacgtacgacacttccatctttgtaggtccacacacatatgttgatgttccctctatctattttcgtgcatctgtcttgttttgttccttcgctagaaaaatgcattgtttcgccaagttccattttctcggcagcttcatcttcaactaaggtctcggtgtccttgacactagcatccctctgccatagttttgcattcaaagtgaacagatatgtggatgccgtgcatttatgtaatgatactgacatatatatatgtatacatatatatatgtatatgtaaatgtgcgccattatacgctatggcgcaaaacacacgtatagcgcatccgcggacctggaactccataaaaccggcagaccttgctcttctacccttctgacggcgtcacatgccagtggcagtaacgcaactgaacaccgtaatgaacgtgcagagcaccgcaattacatggatagaccaactactcgcccgtaaccacactcactcaataccgcatttctcccctgcttcaaactactggacagttttctcccctaatgcctcggtctctgccgggttgttccagcgtcctctgcaactgtgcatccacttcttccgttcgggctcgcgtctcttcattccccgtcacagaatgccaactaacacgtatccccgtagagttgaacgctacctgagcacgtactcggcctcatcagtatcaaatgtcccttttcggggactcatgcctgaccttcctaatcgctgaagagcggaacgctaactgcgtgccaaagggctgagagaagtagcctctttttgcggaactgaaaacgccacgaaaccaactactatagccggtctgccgagcagcagtgaactcgttggcggctcaacgcaccacgttacgaggattctgtgtgccttgattcaccatgtatagccgcagcctttgggaccatcttcggaagaagtttaggtgatcatagagccctccttctcttggtgaaagggctggagacattgactattacagtcagaaaagcttgctttttggtgcggtggacgggaggcacagcagtggcccatccgagtttccgcaggagacagaaacacgcttagaccaaaatatggatttcgcctctccacagcgtcaagccttttcaccctttggccagagttactcctcctttctgttcccaagtttccttcggtccctctaattctgcctcgcacaatttaacatatcatcgccgcttgacaacatctgtgctgtaagcgacgctgcacgtgcggtgtacatacaacagaggcggttgacagctctggcctcatcgacactcacgagcatacagtaccggagtttttgcggcttttcttaactgttcctctctagaattaagttagctattacaccctgtatgtgcgagagattctcttcggtcctgggttgagcgggtccgcgagaagtttcggttgcaaagaacccttggggaaacagcgaagagccaaggctggctggacgacgttctgcgatactccggcttttttccagattttggtccgcggaaagctaacgaggctgaaatattgaatactgcatcgctacgttttcttgtcattttttccttcttcatgtctcgtcaggcgagacacagtctagctccgttactaaccgctgtttgtgtgttctgtgtctcagtccctggacggaggaaatgacacgctagagtccttgttttttgtcataactgttttcccgttctcccctttattcactcttcgtacacctccgcgtgagcaaaaaataggagacgacaagtggaacgaggtccgtttgttactcgtcgcggccgatgcgaagtcttcatcatggagagttcgtcgtcgacttggaacttctcactatcatcttcctgtacgcaaagttgaggaattcatctcttgttcgttgtcgctgcgctaacgttttcctctttgagctggaatta

SEQ ID NO: 2072 - DNA, 1939 bp, Toxoplasma gondii
aggctagacgtcaatacacttggacacagatctcttacatacttcgcttcacttgtgagattgcatgcagccaagtgtgaaaaagtatgcttgggaaccagcctgttacgaagttgtatgtatctgtactttcgcctgcgtcgttccacgtagatctgcggattcgatcttccatgtctcggttgtcacgttgagttgttgaacgagtgtcgaaccaacaactcgttctccagtcgaagcgaagttctacaccgaaagagcagctcgtaaacctatcacgggctcctcgccagtcgcacacggagccacaatgagtgcatgcagccgcaggaaggcgctggctacacccacgcatactatcggtctcttgatgagttaaccgtgtttagaaacgaaacttgatgccatgtttgctggattcgtttcccttttagatcggtgaccagacggttttgagccagatctctgctctggcgtccgaggtgcagagaagtcacctccctattcaggccattgcagataaacttgccgcctgctttgtgcctgtggtgttggcgattgtcaccctcacgctcgtagcgtggtcgacggctgtcttttatccgttctcgacgaacctgcgttctcttcaacatactttccccggggacgacgcgaattcgccgactcgcgcgacgacacaacagtctcctctggggaacgagaaaacgttttttctctggagctccccgcgcggagacttcagcgggagggcccaacgcactctgacccagaaccgacagaacgggcaactcagtttccgtgcgagcgacgacccctgtgaagaggcgggggacgaaagctccggcaatttccaaacggcttgttcccttttcgctgacactaaaaggcacatgcaaacagagaacgaacgcaaaaactcgacgacggattcgactgtcggcagccgacaccctgggagtgcgagtggtgtagtacccgtggacgcgccgtccgtcggcattctgttccctgaattgtctgcgagtccaccaggagaaacctggaacgaaacaagcgacttcctcgttcctttcgaagacgacgcaagtaccacgaagggcgagttacccgtaggccttctttttccgtcgtttcttgaaaagaacgcaggtttcgcggtggaaaatgctgctgatgccagagccgcggaaacgcaagttgggctcttagacccgacttctcccgaagacagtctccactggaaactgtggatcttcctagtcaagtcactttttgttcttagattcgtcatcgccgtctgcagcattgcctgtccatgcgctatgggcctcgcggtgcccgtcgccttggcagccgccgccggacgcgcagccgagtggggcatcctcatcaaaaatggcacggcttttgaggctgcagggaagactcagattgttgtttttgacaaaaccggaacactgactacaggcagaacggaagtgaggcagccacatacacaaacgaaactgcagcaatttcctgagcacccatacttacacgctcatcgatgtgcacaggtgtgcaagagtagactcctatgcccgagtgtctttctctccaaatagatgaatatcgataaatctgtcgggtcccacaggtgagtatgaaatacatgaaatgcgcatacgtagacagcagagacgtgagtccagaagactaccaatgttcaaggatgggcactttctgagaggcgtcaaggtatgcatgcatgtatagcatatatagactatgcacagactgggcgtccgtatttccatttgtaggtaggtggttctatgagcctttcgtctctagatatcgtggattcgtcgatcgcacgatagcggctcacgtagagaataatagggaagtctggggattcaagtacttttcacacgagaaatcaatgtcagaagta

SEQ ID NO: 2073 - DNA, 1881 bp, Toxoplasma gondii
tcgtctttttcttttccctgcgagtcgcgcaagcctttcgacgatttctcgccgtctttgtctgagacgacaagaccatcctccgccaccctctccgcacctgcctcagcagactcgcgaagcgaatctgaagcggagggagaagaagagcgaggaaaagaaggagagggagaagaaggagagggagaagaaggagagggagaagaaggagagggagaagaaggagagggagaaggatgttgggggtagaggagagcaagagtttgcccggcgacgacaaaggcaccaggctgcaccatccatttgagagtgaggggaagcgacagagcggtcctgcgagggaggaagacgcgttcgagtttttcttgctctctacaggcttccagcgcattcgaagaaggttttttatcggggacgagggcatgcacccgcggggagaaggcagaggaagaagatgcggcgacggcagaagcagaggaggcgaaaaagttttgacacgggggtctcgacgactgcaccatgtaggttgccgaggacgtctccgttcgaatggaagggaggagcgcaggtttcttctccgctttcatctcctcaacagaccggaatcgtttcttatcgcttcgctccacctccccaagcaggcggctcgcgccccccgagacgccgtccgtctccatggctgctctgccctcgcctggaggtcgtggagacgaacggaagagcgtcttgcctccctggatgtctgtgcagatgcaagcacacagaacctctgcatgcgctccgcgaaacagtcataattacacatccgcaggtttgtgtccttccatcgaggaagggcagacgaaatgacggtgtctggcgctgtcgccttcgggaacgaacggcgagaagaagcgaggaagccaccgacgcaccagtatccttgcttcggaggcgcgcttccgtcgaggcaagcaggaggcctcgcgcgagaagaaaaggaatggagcgaaaacggggacaagagaaaagacaagaagcggcacagcgcagcggcgacaagagaagcgaagacggatgtcagccagagagagctgcgtgagagaaacgaacagaagacgagagagaaggagaacaatgccagctttctctccggcagaaagagcggggaaaaggaaaacagtaccgtggacaaaaaaaaagaagcgcctgtcgtcaccgaggcgctggcgtcgccagagtgtatgtacacatgcaaacgaaactgcatgcgcgcgggtgtttcaactggagcgtttttagcgtttcagcgagaaagtcccgcctttaagatccaggagaaaagagaagagagacattccccatcttttctgtgcacactgtattccactacaaacagccttcttcgcgctctttttttgtgcagcagaatctgctgagttcttctctccttctctcgctttctgtctctttctctctgtttctctcgctttttctcgctttctctctcttactcttttttctcaccgtttttccttctctctttccctctctctctgtttccctagccgcctcgctgcgactgtcttcgtctctccggctctgcatgcgactgtttcttggcttctgtctcgggtgtcgtggcttttccctcgctgcgtttttgcgactcatgcagccttccgtctccgttgctctttcgcttttccatcgagttcctcgttttcctcagtttctgttgccctcctcctggcgtctgtcttctccgttgtttctctcgcatctgtttcctctctctgcgcctcgacggctcggcctctggccggaagagactccagtgctgaaacagaagcgaagtcaagaggcaagatctccccaatatacagaacgaaaagatcgcaa

SEQ ID NO: 2074 - DNA, 2385 bp, Toxoplasma gondii
gctcatcttattataagcaagtgtctttattcaccaaaattgccggtcgcatgccttttctacgccgaccgagcttgagatgaacttattgacaggagcagctacctgccgtaattcccattctctgggtagcatcagtgttcacgcttgggaagcagcccgcaagtttgccagcgcctgtgctggtatacacataagagcgttctaccaagaacaggtgcccatttgtgtccggtgtgagttaagagttcttgatttaggatcatctgtaaggagacaatctctacctacaatgtgataattcgaatacattggtccagctctcatcttcatgatcttggtgtcggctttgtacagagggtatggttttggtcatggtgtatcagtcgcttcactagcataggtcacatgagtgtcctgaagttgtggtgtcgaagagactggcaagtgagtgggtttgtgatgcttcttacccgtcacagtgtgcagagtttcgcgctatcgcggagggcgcttcgttttcgcattcctagatatcgcgttttcgtcacgggaacaatgtaggcgactgtgtaacccatgctacagagatcacagcgttttagtcatatcatgtgaaacattgtttctccactagtttaataagtcatgctgctacactgcagcggcctcctctgggcgggaaaagcgccgttcaaagcctacgacgccgaatctgcgtgtcgttgtgtacgcatggatctccaagatccctggttgtcgtgcactgaagcccctttttagtgtggaagaaaacaaagtgaggctacagtgactgggaaaagagaaaatttgaagctatactcataatgtggtttgttttagcataggacgtggcttctcccgcgcctccccccgttaacagcgggaaattgtcttcaggcgcgtgtcactcccctcgtcttgtcttgagctttcctttgtcttacattgcgcaaactacctgggatacatatgtcgttgctgagattacgctcatgggctagaaatgttaggattgacattaaaagagctcgcgatacacggttaaacgacgagacaaaaagtgacttgttcttcgaaaacagctctcggcaaaaattcacgttgcttttctccgcttgaccagtgccacctcgctttgagggccaacgcgtttcccctttgccacgtcttttgacaactacgcgaagccattctccctacgggttcgtgggcacgatgcaaacacgcggtcaaatagctattacagttgacttgcggttgcaaacgtaaagttttgaatgtcttgttcttgactcggaagtgcagtggctcattcttttcttccaccgcccctccccccttctttacgcggttctcgggcggaccttacgctggtggacagagccccccctttttcgcagccgcctgttaccccttggacaaggcaaaacccgccgctttcctcagaaaagggaaacagtttgctatgaatagcgcatccttcttctggagaagagtccatcttttcgttcacagcatctcaggagaaacgtttttccctcttctatgtaactagactcatgtttttgcgcgtctacttgcgcgtcttctctgcatctgacagtgacctgtggccggtttctctccggtcttccttttccgcggagcaaaagcgcccatccttttggggttttcggaacgcattttcgggccgcgactcgctgttttctattctcaaagaaactgccagaacaccgaaaggatagattgcctgagggggcagactcggctgcaacccttcttcccgtcttgtggacccgaggtttgttgccgtggtcacctttcgggaaacgtgtgtacaaattgttcgcttaacacgtttcacgacttgcaattgctttggcgttttcttctgtgtcgctcgggccgaaagtttttccacgtgttgcgctttttttcttgtcttcgtcggcggctgtccctcttctttgggcacgaagtccacattccatcctactcgagtgctttctagtctgtctggatactcgtaagtctgttttttcgctttcggtgctgttccgccgcctattcttcggtagaagccgactttttaagataacatcggagcgaggtggccgtatcccgagtgggacgggcgcaagcagacaggccgcattctcactgtatctcctgtcttgaattataagcttctgcacgggctatgtatgcatatctcttcacgcagttcttgaagggtttcactggttctttataactgcagccggcagcacagaccgtcactgaggcacagctcgagccgactcagactgcatgcaagccgcgtacacttcattccccgtttttccttaccgttgtccacca

SEQ ID NO: 2075 - DNA, 2524 bp, Toxoplasma gondii
acaagcttccgcttatcctggccatcgaaaacacccaacgttttccaggtgcgcctgtggggattctcgagtgcggcggcagtgcgagtagttgcgaacgagactggaatgtcagtcagtgacacccgtagttccttcttgattcctggacagacacatgaacaaagatggcgtacaagccagacgcactactttcacagtgcagtggtcttcagaaaaaatagtttattgcagaaatcctggtcattcgctgacaacatctgtttctggggccttcttggaccttggtgcaatgacgaacagccgatctgaccggttccagaccaaaaacctacgtgcaagaaatatatcacatagcccctgttttggcgtgatcttttaccccacaccgtgtgtacaagcagtgaaacgagctggcaacagagttcgattcaatcagcattcagcaagaactgatatcccgcgtgaaaacaataaaagacgatatcgggaaaaggttccgctagactcgaagcaatggtgaaatagatgcaaaacacggttgtactgagttttcgtaggtcggttgtgacacggatagtctacagtagtgtctgaaaggcaaaagaaacgtacccccttgagtgctcaagaatgacttgtagtccttgagttcttcgcggagattcgaagtgtttgtatttgggcttggggagccgcagttgctaacatctccgggtacagctggagacaagtagaacgtcctggagccagagtacacaaaattggaggaacagtttcctggagatggacgagtaaagtcgaacgcatacatgaacagcgtagaatacgccaaggatcgacatcctgcattattcgctagcacaaaacggacccttgctctccaaacaacgttggagctgcgtccagccgtgttcgaataatcaatgtttcttggcgatgtttccttttgagttctgccagctctcttcgagaggcagacgcctgaatatgttcccccttcacagaaaactggttacgagttcacagtcagacgaactcctctcccttttcgatgtcgccaaccagctggttcgtatgctgccacggactgcgtgggtttctcagctggtcacggcacgaaacgtgagccttaccagtctcccttgatgtcatgtaccgtggcgtgaatgggaagatccgcttttacgccaatcgaacccagaaaaacaaggaaccccgcgacgagcggtagtgcagcgcaccgcctgcgcagcgaccccataccctccattgcagactcgcgccagaagaaatactagagataacggaacggtaacaaatcaagggaaatcaaaaatccatgtactgctaatagaaacgggaagctacaaggtacgaaacatgcggtccgtgcaccatgtttctagtggcccatcaccaacgtatcccaaaacgcccgctcaggaggaagactacatatatgaagaatgtgtagtgaagtgagagagaagaaaccaggcgacctccctccctagtgttcagtgacgttcagaacacatttctgctgccaagtccacggcgtttttcccccgcaatcacttccctggccgccagtcagctcgggaccaagccgagggcacgtgagagaatcgacgcggttcgtctcaagcgacgcgactctgctatacccaaaatggagatacagcacattcgcttagctcgctgtcgcgggaataagtgaaggaaacagatgaatgtcaaacaaatggactgagaaggcgccgctcatcggagctagcccgtagcgcaccccctcagggtccaggtggtcgaaacgctacctcacctgctgcgtatcgctgaatggaacaatcgacaccttcgatggcgctgccatgggcggtgccttccggtaggggaaacgagacgctacaaggttcttcgggtgacaccgtccaccgacatgcaggcatgtattcagcttcatggctcttgcttttccaatttgtgggtccagggccatcgttgtcagtctagaagtttccacaggtacgggaatgagtattttattttgagactctgcaacgcagcgagagtaggttgagtgtgatctttttttttgacacacgcgggaggttcgtgcgtcgagtcacctgctcgttttttttacgctgccagagatatggcaagtcagggtacggcatgtgcagcgtataagctgtgactgaatggcaactgtgaggacctgtttcgtaaactcgggtaactcttcgttctgcgcgagtgctgtactatgcaatcttgaggttatagcatgttccgcctcgtgagaacaacagcgtcattggtctcgtttagcatggcatgagtggatccagcttcttccttcgtgatgtagatcaggtggtggagtttagctggtgaaaattgcgcaccgttgtctgtcttcatcaccgcaaggcacttgatctcggtactgacgtacgggtacaatgcaaggcagtagtcaatttgcgtgcgtcgcgttttctacaggagttga

SEQ ID NO: 2076 - DNA, 2151 bp, Toxoplasma gondii
tccacagattttgaggttctcggaccaacgtttctttgcccacttacaaatgtagccttcccagcctttgatcatgttcccgacgtccgcggtggctgcgaggtagtcgccctccatttcgtagattttggcttcgatgtgttgaatgtcgctttccagtttctcctggagagaaatcatctcatttaaaacgggcattctgtgctgaaactggctcttgagtgccttctcccgcgaagagtggccagccttcctcccggatcctctatcccgctccgccccgcctgcagacggtccacgggttgcctcgaaggcaggcattttggtaagtagcgaaccgagagcggttcaacttcttgttccgaaactgaagggatgacccaccgaaatggtggtcttctgaagggctggtcgcgggtcttttccgatgtcgagaaaaagagtctctctgggtttgggtgagacacggatgatcaacaagaacagaccccgcagtccaagcatacaacctccagagggtttcaggtttctgcggaatcgatgagaaaaacagattgtgagttagtgagacgaagatcacgttctggcacgaattacggcatatgatctagacacgcattccagcgcgacatgatagccaagaacacctctgcacctcctctcctcacactttctgtgatacacatgcatgaccatgcttacaaatatacgcgtgtaaggatgaagtatatgatatgatgtggacaaacagggatatccagaagaacgcaacttgaaatattacgtgctgcaaaggctatacacgtacatatatgcggtggaagcccgagctggaaggccccgaaagaggaatggacggaccgaaacgcctctgccctccttcggcggcaggcagccccctgtcattcgcctccattagacaccaagaaatagagaaatgggaatgagatgctttctgacgggcgaagacagagacaagattccgtttgctgcgaaactggagagccagaaacgcgggtgcttctttaccgcatgctcgagggagacagaagcaggtccggattcgaattaagtgaaaattcgccgccgtttcagctttcgagagggcacgtgtctctgcttcacaagtagtcgcctattcaggcacacagcaagagcatgcaccgacaagtttgccttttctcgtgtcgcgaaaaagtgctgagaagcaagagagacaatactgcagagcttgccgtattccgagttgtgactagaaatggttgtcaaccttgtcaaccaatgcatcaattctcttctcaaacaagcagagaacatgagaaggaaacagcaatgctgccttgtatttctcataaagaacccggttgcttgtttccccggagtcagtttcgcagctggtcagcccagcctccacacttccgccgtgtgttaaagctggcctgcaggacatgcgaaaaaagtaggaacgacactattgttgcttttccttattcttctgtgactgtatgcggatagccatgatgaagaaagccaaactgatatttctagactaactctgtcaatctgtgtaactgtttgtgtttgttggagctgtgtggcgcctcctcggtcggtttggtgtcctgtgtctcgagcgtccgcatggtgaggcaggcgggccggagttctttttcttccccaggcgatggtttctattgtttcctgagactcttcacggtccagcatgccgatacacgccctgtgttgattgttcccgcgaggcagtcttccggtgttacagaatgtcacaagcatcgggcagcggccctgcaaacgctcttacccccttcgaatcattttaccctgttcgtgagacagaaacgaaatctggttgaagccacttgtatcattcttttggaagaaactcttgcacatccgcaatttaagtaggtggaggcagttcgctgagccaactcaccatttccgttctcccaaggtatcaacgtcgtagtgttaatctcaagtacctccgccttcgccacagcctcccatccgttcagtcccgcaactcttcatccgcggcaacgctgttccgagcccgtttttcctgcatgccttattaggagggtagttggctgaagtgtttttacatccatgacctgttcggcagca

SEQ ID NO: 2077 - DNA, 1823 bp, Toxoplasma gondii
cagcagagagtaaaatgaataatcacaaactctatagaagcgagtcatcacgcttatacggataaacgagcaagtgtggttgtaaggtggtggtggtgcgtcccggacaccgctggtagtattgtttggcattaggctaccgtgatgtagtgcgatccgaagttgtgggtcgtgacatcggtcacttcgtcagcacaagaaggcagctgtgctaagagcatgccgagaacttactttgtgtagaccaagattgtgcaaaatttatggcaacgttgcatgctttaattcaaagcatgtagctgctactgctttgaccgaaggcgctcttgcaagtttcagttcgcatgctctggaacatgcacatgaatggatgcatacagctaataaatgcctgtgcatagggtgacgttgagatgcagcagtttttgaagtccacctcgagtgtgagctgctgaatctacagtcgcaactggtccaacagaatagcgtctgttctcagggagctcaggctgatttgatggtgagaaaggggggggtgggcgtttgtgtgtcctctatgggagtatcgctccccaccgctgaataccgtcgagtaataacgggtgatgaaaagtcactttatgtactctggaatagcataggagtactgctgttctcagacagtctagacgggaagttcaacatatgagagtgcgttatgttccttctgctcttctgctaactctcgcccgtttagtacactgactggatttcctagcatgaatcgaacacgagttctgtgacgtcgctgctccagttacagaacccaccccatcgctagccgctagttgcagactagtcacttcaagcacgctgttccgatttccagggatctgtggcaacaccaacagaactatagcacaaaagaatacctccctcgcatacgcgtgttcaatctcaattacgtgcaccggatctcgcaatcgggaaacataccggcaatgaagccttgctcgtaggctataagaccacaccttctctgttgtggcccttcaccggtgcggacgaccacgctggctccatgcgccacgaaggctgcatggtcgatttctgtgttcaaaggctgcgcaaggaaaactgtaaaatttgttccctgttgactgatgttgcgcactaaaggtcacccgttgtgtggcttaccagtatgaaggctccctgccagagaccgactaaacggacgcgacgcggaaaagaagcgaaacaatttcttcgcattaggtccagggatgaaagtggctggagatttatcgaattatgtttaacgcaaacttccctttcggtgcctagtcaattcagcgcctgccatccgtagcgcagatataccagcgcatgcagtactggaaagcgagcaactctggcgggcgggcacgcacagactacgcataggttttcttctcccagttggcacgttcgtcttcctcgcatgttgtgcagaccgacctgcacaagtcgcatggaatgtcatattatcacgaaaacttgtggcacgcattgctgcttgagcacaaacatatctacacgctctctaagttgcctttttgaccgtggcagctgtcgaccggtggagccagcgatttttttttcgatcagctctgcttttctttccatgttgttgctcgtatcatcggggccttctaattcctaactgccgcaactccctttgattccggtagacacgctctttttgcttctttccgtcggttcctttggtggtctgcgccccggagaattcccctgccgctcgctcggtcttcgagaaaaggtgttccctcccgttgtgaaaa

SEQ ID NO: 2078 - DNA, 1996 bp, Toxoplasma gondii
aattcacttgagttttcatgacaggtacacacaggcctgggctctgctgttctttttgtcccatgcaggcgctgccgctggcactgtcgcggctcgaggtccctacgctggctgcagcggtgttggacagtctgctcagtgaccaggcgccagcagctgtcagtcagttgtcgattcacgaactgtcaaaccttgcttatgcaatcgcatgcgtctccaccaattcccaagttactgtagacacgcatccgtcctctgcggactcaggctcttgtcatgagcagaggccggagcgtttcgaggttggttcatcggaaaaggagtgtcagtctgggatgaagatgcaactgcatccggagcatagaagcgtacgcgagcaatataatgcatctgaagttgatccgggagaaaacagcgccacgggtggaggagttggagacccttttctcggaaacaagagggagaataatacttcatttaaggttcttgaatcccggtctgtatgcacacccgaggaattgaggcgtcggtcgactctgttaacgaccatcttacgcactctgtctcgcagttccctgaggcgccatccacttaactcgccgttcgaacgcgcgtggagacagctgaaaattatcgacctgtatcttcagttcaatgtaggacctctgcgtgtagatgatgaggaagcgcttcagtttctgtctcttgctcggacgaagaagctattgaacctggttcatgtgtcccaggtacagaagcgtgttgggcgcttgcttttcgatgaaggactgatgtctgaaatagacgttgagtacccactggggccttacgtcttagactttgcaataccgtctcgcaagcttgttgtagaagttgatggggaagcccatttcttctttggtacaacggtgccaactgctcagacgcgaatgaagcgcgaactgcttgccgctatggggtggcgcgtggtcgtcgttccgcaggaactttggagaaataaaaggaaagggaaaattaaagaattcgtggcgagaaaggtgcgagagggactcgagatcgacaacagtgacagatagaagccatgggagaaagacggtttgaagcagaaggaaaacgcggggtgtcatgcatttccagaagaccacaatgaagttttaggggaaacaaagtttcttgcacatgtacattttgtattgtctggtggagcgggtaggctcagtcggggaagggagaataaaacagattgtgtttccactctaaggtgcttgtattctttttcctggagagacccgtacagttgtgaaaactcgacaaaccaccgtcccttgcgcttcaccggcaccgatacatttatcaggccctgcagagctgcttttctaagttgttcatggaagctcttcaaagaaaaagatagaccatatgacagtttgctgcagcaagttccagccacagaattttgctttaccgtgagtagaagtgcatcaaacagaactgctgaatgagactcgcagtacatccttggtcatgtcaattagcaggttggacttcaatcaggagcaagcgaccttgttaaacgctggaattcagtaaggtcaatcctttgaagaccgattttaggtgcagtcctcgttcctccttcccatttgaggacgttctggctttatacgcctggggactctttaatgaatatcagttcgggtttcgtgactcgccagaatcccgccagaagtctggatgtacagatagatcgaggcattcaggtggtggacaagtattttcgaaggttttcctcggtgaacgcttcaacaacaaaccgactatcgaaggcagaacatcggacctgctgcggagcaacatgcgtcgttgcaacaggggggaaagccataagtaaagcaactcctgccgtaaactccaaaggaaacacacaccatttgagcgattcatttatcccatctacgagaatcctgtagaacatttcggatggtctcgtactaca

SEQ ID NO: 2079 - DNA, 2707 bp, Toxoplasma gondii
ttctctggtttgctgtgcgttcgtcaggttctccctgggttctcttcctgcgctcgttctattcgcactcgctctcgctagtcttcttctctcgtctctctcctctgccccgcctctccctttctctccaccatcttcctccaccctgaagttttctccacgatgtgtctgctcgctttctgtctcgtctctctgcctcctcgcctttctctcccccgcctgcttccctccgaaagccgacgtacgcatgcccccgtaggcacgctcttccgtcgcgactctggagtttggcgtttcggggaaagcgggcggcttcacgcgtttgggaaaatgcaagagaagaagcgacaactgtctgcaccgtaggtacacctggcgcactcggttggccacgccagtgtctcccaacttcttccagaaacaccacaacggaaacccgcacccgatctcctcgccttgcgacggccgcaatacgaagggctcttccaccacggaaggcatcgacggcgatgaagaggcaacagcaaaggtcggtgtcggcggtaagtgccccagcgaaagaagaagtgggacggcgtcttgtcggcaaaaaaatgcaacgggagacgccgggtcgcccaaccctgtgagaaacgcacacgcgctccacgtcagcgagtccgccaggcccattccggcgcacaggacctgaaacggcttctcctacaaagcacaagagggaaagagacgcgcagatgcacaccatcaaaccaaagagaacccataaaaaacggcacgcgttcaaatgggtcctgctgttgtggaaacaaatccgtctgtccgaacccacctgtctgcacatgcacggaaatgcgaatttatatatatatatatatatatatatgcatatagatggagacaagcaatgtgtatatagttgcacacataatatattcatacacgtgagtggcgtgggaagcatacgtagcaaccaaacgagcgggtagaggaaaaaagctatggaactgtatacacccgaatagagcaaacatcttatttgcagaaaccagatacggcttactctagggaagatgaacgagccaccgacgaggccatcgacgtgcagccacgatcccgtttcatgcgcaagctggcgaagagcaaggaaatcatcaaatccacctagagttccgcttcggcccgccgaggcaacaatgacgaacgaatatctccgttttccctcttcgtcacctctctcttcgtgcgtacccttgtcggctgcctttctctcctgcccttcctctctctctgtctctctcgttgctgcgttttccttatctcgtgcttcgcgcacttctctctcgctctcttgcacgtctctcatcttcgctctcaagcattccacgctcatcactccggagtctgggttctgatggaccgcgacaatgcgcccggtgtccgcgaacccagccaccgtgaaggcttcctggagagcccgaatatagggcgatccgctgcagacgaagatgtagacccttcgctcaccagaagagcagcgagcacaccccgtcacaggggttgaaaaggaccaagagcccggagacgaacaagcggggaagaaggacggagagacgaggccttcgcatttcagtcttcgctgtgtgtggtcgtccacggcggggtggggaaacgcgtccgagggaggacgcttgaagtggcgagcaagatgaatggcttgaaggaaggcccacacctcggagtgcatccagaatccacacagcggggcacggtgcctttgctgttgtcttgtctcttctgacgattctgctccgcgttctcccgcttgttttccatgtcgtcctcccggcttgtgtcctggctctctgtcctgtttctcgcgtttgtttctctcgtcgtctggctcggccgagccccgcccgctctcttcttctgcctcgcggtgtttctccttcccaccctcgtggacttcttcatctcccgcgccatcttcgtctccttggctgcacagtgtgctctggcaggctgttgtttcatccaggggagaccgcgagtggagaggtgagagacgggaggagaaagatggagacgcggagctgaacagatcggccagcagcttttcgtctaacttctggaggcagtctttcgtcctcgttagctctgtccgtttgccgtcctccgcacacgcgtctcccccgccctcttcctcggcttcttctccacctccacctccggcttcttgcatgcgataataagcgctgtcagaggcacaccgccgggacgcgcacagagcagcgaaagcggacgagacagtctctcccgcattcaacgcctccagaagcacttctgagtcttcttcattttcgcggagaaagtgaaccacatgcgtgagaattgcagcgtccaggtgagagaaaaccgtgcacgccgtgctgtggctgaggactgagaaaggcagagaaagcgaaaaagagcacgaagcaggcgaacacgaagacggcggacaggctggcaggagcggcgcgtgaagtacaagagaagatagagaagataacgaggcagctctcgtcgcatcgcgaggttccttggagagaagcacgtggcagagaagctgcgcaactctcgacagctgcgacccgtggcgccatccatcccaaacgcgaaaggccgagtctctgctatctgcacagatctcgtcttcctctgaaga

SEQ ID NO: 2080 - DNA, 4741 bp, Toxoplasma gondii
ttgtcgtcacggcgcagacagtttgtgtgtggccattgtcggaaataccagatgtgtcaaaaccatgtgaccatgtgatctaccggatctactccatgtctcatggtaaactgcccgtcatgtcgcgcgctttacctgcagggactgtcaccacggcctctccacaggagggagttgaagcaaaggaagagcccccggcagccacaggtgtcccctctgccccctcatcaccagctagaagacgtgccttcttccgttcccgaggttagttttcagccttctatcttcagttgtgaagtacttttcttcgaaacataccgcagcgaagtgactcaaaaaggtaacacacccaaaactgcggacggcaggaatctcttgcaagccagaggtttccgcttaccaaggaatacgagactttctggtcactttagttttcatgtaagcgagtgcgctcttccatggtgatatgcgtcttccgcaacagcggggtggtggaagaagcacgctgctcatgaggggggcggggaaaaggcaccagacgaacacgaagcatttgccgtgtttgatgcctgtcatgttccttttcagggacaaggacgattactgtgaacgtgaggcacttctttcctaacggtgtgccaatcgtcgttgtacgccctcagcggcgtagttttctcttgaggcggttctgaaggatcccaataaaatgacacgtatttacgagtcggctattctgaatgcctaagtcaacaagaaggtgcagcaagaacctagaagagacgaacttcagttggaggggcaacatttttttccaccttcctcgtcccgccccggtgaaaaccagccttcagcagtgagctgccacgtcctgtgctgcagcgaaagcaaacgtaactgttgccgccaagcaatgtttttttttctcctgagtaatgcgtgttcatttctactgccccatcgtgctcattcacacaactcgaacactttgtgtgcccatttacaatcggcttcattttcttttaacttggacgacaggaacagacacagcatttcgacacgaagcgtgcctggctgcggctgccctcactgttgttcgcagtgggactacgaaaataaacagatttgcaacactcccatatgtcatgtcacatctttttggctcgatcgtctctccctcatctctccccgcatgtaggtgctttcgctaatagcatcagtgttttcgtgatagtgcagcttacttttcacttgttagcttcttcccaactgcctccaggaacgtgctaaatgtgagaaaggaaactgacataatagttttggaagacttgcggtctcacaagaactcaccttacgtgagcgtgtcagtatcttgaaatttcgccatcattggaaaattcgacacgacttccctgcggagctaactattccagagtcaggccgtagaggcgattaattcgcgattcgccatcaccaaatacgttggggtattacgtcgacaacaaacgagactgatccatctgatatgctggcaaatgctgctctattctaacccaaagcggatagtcagagacagcccatcaaatttccacaattttctgcagcgttggccgtatccgatgtgaagccgcaagccgggctgccataatgtcaactgaccaatttgcggcaaaaatagagaggtcagaggcgacagaatctctgttacaggatctggagccacagtgggatggttttttcctatcatcggaatgagagcttgtaatctgcatatcaaggtcactcaactctcgctttcttgcgacccgcaccgtgcgccaaaagccggcggtgggctgcgcattttcaggttttgttacaaagtcaatctccttatcattctcaggaaaccaacagagaggggtgacaacgttttaagaaaggggcccgtgctttgccatagtctggtccgggtcaagcccgaagcgtccgggctgagctcggtgtcgcctgtagacattctccgtggccggcctctgtgcagtggagacggttccttttgtttcaacctgttacgaatatttttgcttggtgatttccaaaaacagagtgtgacgtggtgtgcggcttgtgtctccgactcggccagatgggttccattagaagtctctgtgacggaacgcgtacgagactgtttcgttggaatcgttcctcgagtgcgagcagtccgatgttacggctcccacgaggcaacagaggggccaggcctccaactgttgccgtcccgacccaccaccccgtcctgctgatataaacgcgggaaaatgacgcattcacctatctacgtgtgagtcgcttagacaaaaagtggcctgcagcacaaagaacaaacggtgagtcgctttgctgtttcccactttcgtgctccactgggagtggtatgacgggttctgccccgtagcaatcgttcagtttcagcgctcccggcgtcagtgcctttctttcggaaaactttcttcacatcctgctgtccaaccactttgaagttctgcccagagagtgtcgaactatggggctgcggcggaatctttagccactgcgtggcgactccgctgttttcctcgcggtgagtgattgtatggtggagcttcgtaactcgtgaattcttgcgttcttcatttgttgtttccaacgcgctccactctgcaccttaccttcatgctcagcttttcctcttcgccttccatccgcttcttccttctgcgttagaaccggtgggcgccagaagctaaaatggcgcggagccggtggtgtgcttcggcagcagttctgctgtacatttgcctggcttttctggcggcatacgacagccccgttgccaatgcacaagggagcgaagcggctttgtctcatttcctctttgacgagtggatgagtgatgttgtgccggagttggtcgtcccagcatccgaccacgaatccgaacagcccgtccgcctcagaagagattatgacaaattccgggggcagagcgcggcgtccgcgctaaaacagaaccgtcagattcgcactgagatctcgagaatactgagggcagtcgagggaatcgaagctaggcagaatgacagtgcggaaagacggatacacgagctggtactcgaggagatgagggaggcaaaactcaaagagaaggccaggcgaaaaccattgaaggggcggcacaaaaaaaaggcccgccctcgcgacagaacgcgtagaaaagccaaggcgctcatgggaaagaaacgtcaaggcaggaaggtgcccagggggacacggaggcgtaaagggacgatgatgtggcgaccctgggacgcctgggcgaaacgtcaggggaggaaggagaagctgcggaagaacgctggtggaaggcgagtggcgcacaagaagggcttcaatttgaggcggaaactctactttttggctgcgattgttgcatgtgtggtccttggcgtattcgcaggtctcatgtcgaggcacattttgacttttcggacgaagtttcgtgtctaactgcttcttccgtctaagacccttttgcctgccgccccctcacgaaacggtcgatccccaacaaatagctacgcagtcttgtagccaccatccttgatgtgtacacggtggctaccccagtctcgcctcgcctccggaactgtttagcagaacatcgaatccaaaggtcgggctccgaggagtgggaccaggcatttcgctgctgttggtgcagttcgtccaactggtgtcgcgccaggagcaatgcgtgggtctgagccagcgaacccgctcactgacatctggtttctgagcctccggtagaggactgacaaactctgggagagttcagagtccccacggtagcactgaaaagccatcgcagtggtgtggctcggcgcttcactggagaaagagcgtccgatttacgagtcagtggggtaggtaggcgcagacgaaagtcccgccccaccggcttccgtagactctggcgagacaccctggatttttaactgcgggccggtgcgacagccaccagccgattcggtttcacgaatctagggcattctgattacaccggtgggcagagctagtgcgcgtgaacggccgagggagaccggccggcccgtggccacagtggctcctcgatattaaagcaagaggcgacatctgcttttcgttggaatttccaaccgggtaaacaaccggcttgtcgtcggaaattgagactgtatctcgctccaggcccaacagcgacatgctgtaaatggtgctgttggtgaagtggattatgcgagagtcagggcaatacggatatcagtgtaaattatacagcttgcaatcgtaactcttcgaatgcatcgacgaatacctaaagcaagtttctaacggaccatgatgccgcggaagtggtgttgccacaaatctgtgtcaggaagggaagagccgtactgaacgagcgacgcggactgcgtgtgggcgccactgtcggagttgtgagcagaatagaacacaaacttgtgttgccaattgaaacagttggttgagtgaaagacgtggaaaaaatttgtctaagcgtcttcacattggtacgggcaaggtggggctaggatgcgaagacagcggttcgcgaaggcaagcaaagatcatagaataaagcacgtgctcttcgtccccctcgtacggtaatcgtgatccgcttgaacatttacaggtacccaggttacctgctgaa

SEQ ID NO: 2081 - DNA, 2574 bp, Toxoplasma gondii
cacgttcgcaagcacgaacgcgacttcgacttttacagcttctaagctggcagataccacctcgcagaggcgcctttgtttctctctttacatacgtgacatgcattctctcgtctttcgtgaacaaaaaagattcgagttctaggtgcctacgtgcacagactgtgaaatatttcgagtgattcaacagactctctgccgccgaattgcaagtctagtcgtttatcaacggtgcgggccgcgaccagcgaaaagccacacacaaacctcgcctttttctgtatgacaaagtttcaaaaggatgaaaagagccacaggatgtgacaacaggcgctttgggtgcccagtttgcacttgcataaatcagctcagagctttaaacatgcatgtatagttccgaggaaaagcaaggtggatttcggttgccaacgatactcgggttcttccacatcggtttttctaggggtagaagatggattcctctgatcactcgcgtcaacaccgggagaaacgactcccccggtgttggcattttgttgagcaccgtcgccgtgggagtgataatctctgaatctcatctcagagacatttattccaacggtttacatcgagggttctccgcacggcggaaactgtgcgtgggaagagaggagcccaaccttttgtagttacctagtggaaggagtgaaggtgcacggcaaaaacctaggggacgaaaccagcgtgcaagtggatttagagttgttcttcaggaaggaaagcaatgcaaccgcagacgggcgagagacctcgcgacagagaaagggcattctgcaagtgaacgtgtcttcgacttgtccacaaaggctgtgcagtaacgtgcggattagggtgggacagcaggaacgaaatagcttattggttgatccgtcacatgcggcagcaaccccggcagtctgtttttgagttccggatgaacgatagagagcctgtcgtgcacctcaagtccctcccaactgtgcggcggagaaagaaaactttaatcgattggttgcattggtcacaagtttttgccgacgcctcagtcttgagtagaaagcaaggccatttgagaaagtggaaatactactgacagagtgtgtttcgtttagtgccctgaaggcatcgtcgctaaacactaaccttgtgtagtcgatggacgcaactcaactttttctgaatggacgggacaagggccatggaaccagttgttttgcggaaaccggaccggtaggagcacttgatttcttcggctctcacgaagacatgacaaggacatttttgcaaggtgctgacaacgactggttatctggtaggtgctgagcgggaattttcattttctcaatcctacggccgtgaaaataaatgcagttaccgacattttaggtttccttctgcttttgaagacgagattgaacagaggcgaactgtcacggttgcttcaactccgaatctctgaacacttgtggcgctccatcagtgatgtccagaaaaagaaattgtaactgtctgtaactcactgtaaggtaccgcgctagcgcgacctggccgcattataggactggtgctcactcggcgtgtttgctatgcttgctgaagggtcttgatcatccacgatgtgggcatgcatcagtcaaagagaacacttccactagagcgatagaaacatgtggagcagactgttaattggagatcttgataaacaacagcgagcctaaaaagaaggcacaggaaaaagtgtaggccgagcaggattcgaacccacgaccacccggtccgtagccgggcattctatccaactgaactatcggcccaattacgggcggaagaagcggcaacgcgttcgtcgaagaggaaatgaaagttcatgaaaacaatgcactcttctcaagtaaacaaccaagtgaagatcccgataatccacatacagacgaaaagagcaaggtataaatttagactgaccacgacttgtgtccagattcgcttccaaacccttacttgggaacaataaggtacttcatggagtaaaccaccagctgacagtcaccataacgaacaaaagttcacgcaatccctgtcttttcacagaaaaaagtgtaggccgagcaggattcgaacccacgaccacccggtccgtagccgggcattctatccaactgaactatcggcccgtctccacacattctcgagggtaccattgctgccgcctctccaaaggtttttagaatgccactgctctattactccttttcccgtatctacagttcactctctctccaaagcaatctcctgtgagcaggcacttcaacattctcgaaaacgaatggcatgccccatgccagtagcgctgcagcatcctgtgctgcagagagcggttgcgtgcaccacctgcagatcccccccacctcatttcggcttgcattgatattcgaacatacagttttttcagacctgaaggcaagcagaagtacaccatttcttgcatgaatttgaaagagtgtggctgacagaatagcatctcacacgatagggcaactggtccgtcaccgactttcg

SEQ ID NO: 2082 - DNA, 1571 bp, Toxoplasma gondii
agttaattaatagagggtccaactgtgggttagtttcaattcctagggcggagcactggattggagacctaggtaagtgtgctcctattagtaaagatcataataaaagtcaccaggcatgcaataccaatcagataacacctgaagctagaccccctgttacatattataaaatgggattcctaggtttatataaactaccgcctgcagggggcgcctgacaggacggccattaggtggcttgtttgcaccttcagccttttcgaacacttcctcactgcccaatcgaaagcaaggaatccaaatcaataaacgggaatgcgtccctgtctaatgacagaggccactctcaatcacaaaccctcacccggtgcaggagccagcagggacgtaacgggaatggcgacgggttcgggggtttgagccggaccgacaagaatgttgggaacagtattgtctgcctcttcttctcggttgaactcgtcttcctgtaacttttcagcgtctaactcgacggggagggggacctctggggtaggaaacccgtcaatatcaacagcgttgagttgtacatctggctgatcggtgggatcgccgttcgtgggtggggcgttacggtctgtcgggatgtcgtccacttcatcttcttgagcttctttggcttcttgaatcgccttctcctcaagctccgcatccagctttgaagccgactccgacacggggccctcatcggtggagaatagctgcgcctttggagccacactaagggctgtcgtgtgtgtaagctctccggctagtaaaaaacatgataaataagcaacaaggaaaacacaaggaagaacgcgtgccatgttcgtttaagggaggaccgcgaggaaggggctgcaacggttgacggccgttacgctactaaaaacgggtgtgacttcttaggctcggcaaagcgttcgacagtgtcaccggaatttgctgcctcaaaaagacgtcgaattttagaagcccactttctgcgagaagacaacagcatatcatgcgagcgaaactgagacggcacaaagacacactgccagaattcttccacagctcgtcaggactcaacggcctcaagggtcgtggcaatcatcaggcgaaccaacggtatcgccgttggaatgcgctcctgcctttacacaacttcgcagaagttcggcacgataaaaaagcgaaaaggtgtgcttcagaaatcagtaaatagctctgtcttttgtagccgatacggcagtcccaccatgtctcactcgaccttgccagccgcagcttcctgcgaggattcagttgcgttgtggtcgctaggccgcttgaaacggcatcctcatgagggctgagtttagtgtttgctggcgggttcttgacggttctgaccaccggggacttggcaaagagtgctgaaatatgtcgtcatttttaaccggattcacactggagaccatcgccgtggttgcaccatttgcgggaaccacggctgtcctgtccgttgtcaagttgctgctggtgaggtagctcggcacgtggctcacaaagagcgaacagca

SEQ ID NO: 2083 - DNA, 4129 bp, Toxoplasma gondii
atattgcaattcatcgtgtagctatggtgttcatgttcttaaggtctgctttttgtacggagaacatggacacgtctgtgtgcccctagcatgatcagtcctctctccggaggaatcatctctgagacagcattgcttccagattcccttcggtaatctccgtctcaacgctagtctgcaaggatacacggatcgtgctttcgagaacatcgagttttctgttcacaattcgaacgacggactccagattacctgagcggcctagcggttgttgcagcgcatttctcacaaatctacatagtttctagaagttagtgtacagattcattccagtgtagtttccgaactcacgtgtccgcgttccgctttcaaagtgcagtagaacctctgaaaaaagctgccagaattgacaagcgaatatatatatatatatatatgtttatctaagggagcgttgtttgtgatgtctgtgagctagcaaagagctaaggcaatcagtttgaaattccgtttctggacgtcaacacagcattcgcacgaattgtagtggctgtcagttcgctcttcttgtctaccatatagacagttctatagggcaatattccatgttgtctggtaggtttgcgactccttgctaattttccgttgagctggcgagtcagtttcacatttgccttagtgaaataggtgctggttccgacactgcatgttaagtctccgttctggtgacgaactgcgccctctcttcgcaactgtccggatgcttgaagcagccccgctccgtgtacccggtttttttccgctaatcatccacgaattccgacttgaaagcacaattcgggacagcaatggagacaagggggaaaaaacaacgacgtttagggtgcaaataagctcagcgtgacctctctacgatggagtagggtgtatgcagtcgcctccggagagtagaaataagcctctcttagagattatttttttccacctgtaccatggaatgggtcatacaagcatctgattaatcgctctctctcgaaagtggttgctgactatcgaagttcagggactgcaaagggcagatccgatctgcaagcatgcctccccattctagagtgaaatgcgtaggcgttagttcgtttgtttttctccggagctcgcgttgtgactttggagtagcggcagtcaagttttctaataaatagccccccttcaaacagattagctgcgctaaattcatcccttcccactacgatattgtccaccttttccctgtttcgtttaagccactcacccgaggtagtgcctgcaaatcaatgaaacaaactttttttcgcctctgtgctcgttttggcgttgaaatatagacacgtacttctgaacatcagaaatacatgtgtttccatatcgaagctgtgaaactgcaaagtggttttcctctgtgatcggtccgcaaaaagacccccgatgaccgatctagagcgccagagtccgaagaaaaaataaaaagcgagatgttctcctctcaattagccacaagttttgctccctttgtaactttttcgcctgaagattctactgccacttgaggaggtcggtaataatcactcttatcgactaaagtcgactacacggactgttgtgggctgcatcagccaagaacggttctggggcttgacaggagcaaacaggaaaagctacagaactgacacggcagtcgatgttcgccgtcctcgattgtcgcttgcctgggacagagtcgatttctgaacgggtcgagtacgaatgaaaatgtgcctgtctcaatctggaaagtcaggcgaagaaagattgcgggagatcgccgtctcacaatttagccgttttcagtcggtgtgggatttcgatgagctctttccatcatttgggcagagtatgagagtcgttctgcgcaggaagatccataacaggaagaaacccatgtttgttgtctatcgcaagcttctcttcttaaagtgatcgcagtacacgaaaaacgtcggagccgaacgtatcgggtttaggacgacttcctctggtgtgcaaaagaccaccctccccgattttagtcttctttttccggaaacaaaaacgtgttttttccacaagctccatagtcttctgtattagaaagtcttcagctgttcccacggacgacctcgcagaacgcggctcttcgttgcatgtacaggtaaacagaaccgtgtgtaaaagcagacacactcgtatttccttttcctagtttgttgctgaagtgtattccgcaggttttctggttgggcgaggtaggcagttgtcacaacagaaaaagcaggctttcttgttttggcttctttatctgctggtgcgagatacggggggggtccccgttcccctgaaaacatagaaagaacgctgccccagaggcgtgctctactcgcttcgctctctccagccaaatgccacggtgcagagaaagctgatgtctgaagatacggctcagagctggttcagccaggaatttctcgaagtctcaggtgactctgtagaaacaggatgagagagctggcttttttctcgtgcgaatgaaagtcgagtcgccaggcccgtgaaacatttcctgtgtcactgtgtttcccaacggcgtgagaagaccagatggaagttttctcattttcttgtccggtctagcttttccttgtttgaccccggagggaacgtcatcttaaaggcaccacacatttgaacagctcttgatacctcgacagtcttcgcacgtgtgattctgttggtcggaagtttcgtatggcctgcgttttcgcttgctctcaatatctagtcggctttggtgtgggctctcatgctcccctgtcgctgcctctttccactcatgaggaaggaaggcagcgtcatcggtcgtgaacgcgaaagagtaaagggtcctcaatcgaattttccagatgtccttgtccatggaggcccgcagaagaggtggcggcccggttccgagacaccgagcagcagtgacgcgcgaaaacataccggaagagttcgattgtttgtctgtcggaaacttccagaagttccacgaacagcgaaaggtcctccaccggctcgaggagcgcggtacaggggctcgtcacaatgacgaagacgcgggaacagaagcggaggggaagagtaaaggttctgcctcttttgcatttgcgtgcggagctggagatttgaccgaacccctcgatgaaaaaagccgccaagacaccggcgacgagggcgtaggaaagcgtgaagaggagctgcaagtcgcaagaccgtcggggacaagccgattcggtgcttcagacgcgttttgcctgaccgcgacgcacaaaataatccggcaccgttacggtgaaaagtttccgcatggaaacaaaccatacgggactgagaacgaggaaataccagacgacgagcagtttcggaagtttcagagaggtcgaacgctcttggaggaaaagagcggaatggttgccagcgacgccggtacaacacagaacaactcaaaggattctttcccggtcgacagacacgcctcagaagcacttgcgattgcgagtaggggaaacaccgcaggaaagaatctgcagacaactgcaagtcacgtcttgaaacagcacggaaaacaacagcatgctcaagcgaaactggacggagaaaaagcgttgtagaagctaggaacatgatgaaaaccgcaacaacatgtaccgcaaacagccatttggcgacccctgaaaaagtagcaaccgcaattcagtcttcaagtcgtgaaatattcgcccacgttctctgtcccccaaacctagagtcgttctgtgtgctttctcgaacttccttttacttctgttagcataacaatccgtatatatttataagcatacattagatatttgcgtatttttgcgtgttgagtcactggatcattctcccgtcaacttttaaagagatacggtgtaaatctcaggaatccgcgtagctgctagagcgagcacaggcatcgccgcgtagggggaaacaattgcgagtaactatgatttacggtttagtcgtcctggatgaattcgacattccgccttcggcatccgttagtcattta

SEQ ID NO: 2084 - DNA, 2074 bp, Toxoplasma gondii
ctgtcactcatcttcttcctccgcatatatttctttcatgagcttaacttgttggaattcacagtagtgctgtttccgcttcaattcgaactcgtggcgccgtttttgttccagttcttcctcgtttagcgcttgccctctatcattcaccgctaagtgttccaggcacgcctgaagggccgaagcggaaacagcttcgccaggctgcggacatgagggacaacacgccaggggaagttggacatggcaatgaccttcctttagacagataacaccgtaattttgtcccgatcaatttacctacgatactctcgtacaaaaaacagcaaatcaagatacttgccccctccgccagcggatgattgatagatgcagccacgctcttacctgcggcgaattcttctcattatcgccgtgggcgtcctaaaaggaaaaagtatcatatgtggagagccactggaattgcgagggacttcgatattatttgcgactttaacgagttcacgctcgtgaaaaatggtgcatcccatacaaggaagaggaagtagttattcctctgtcggcacataacctactgcgaagactgacctggtttctccgcaaatccctacctctcccgctgaacatctcccagcctgacgttcacgctgctcctgaagagtatatttactccctcacagataccagtgctagtgggaatcgcgttttctgaaagagcgacccccgtatctgcctgccaagactgtactctcactagaagcgccttaccgatcctcgcctgtgatacggtgtcggcggttcatcaattttcatgcgggtcccacgttccaagtcgtgctccgcaatggcctgctcatcccacgtgagatgcttgctgagattcacgcacacacaatcacgtaccagtgttgaggggtcatttcactgttggcagagcccctgtttagcaaggcagcgctgttgcccgccgtcgctatgaggtcttttcgtcgccatgccgaaatccgtagtagcgcaagatgcaagcagcgtctacgaaacaggtttcctgtaattactgtagcatgatcgcgcgagtccatcggctctgatggacttactgctcttccggagatccatgtgtgcttctccttagcgcactatgggtcggctgtccgctggaaccgtttggttggtctttccctatcacctgcattctcagtgttataatgcagatctggcagttttggtcttcgagagggactcttcgggatctgcgattatgcagaaggaattcagtgcaaagtttgcagcccagacggctttgccgtctggctccttcagtttgtcgggcttatccgcaaaacaaggcaggatagcttagccttaaaggcaaattatgcaacatcaacgtgaaaccattccgaagaattatctttttgagaaaaatatgcgtacactgcgttgatgaacgatggcgaacccgtaggtgaggtcatcagccgcggtgtccagctacgctaccgttgaacgcaacgcatgcagactgcaaacattccctcaagcgacgccgtgcatgcacctcatcagcaaagtgacgcaaaattagagacctttaactgtgctcattaatcgttgttgtctgctgcacactcatccgaccatatatgttcatcttacccaatcctctcgatggagcctaccgtcttcaccccttcgcttcgaggaggggttggaaacaaaagttgatgagaatggttccctgaagcgccagccccaacgccagcaaagagcggggcgtacaacagcatcgtaacgcgggtacacagtcattcaccgacagcatatagagtttttttcatcgtgcaactcggagaatatggacgctttggtcatttcgtggcatcggtagtagaagggtttacggcggaccgcctccgtgtacttggggacttttgtttcagcgggtcatccatgatcgcgccgccgtgagcactgtcatggttcatgttcaacaggaccttcggttgtattttatcgtgaattgtacaacacagtttctcagaactctcttcctggagtggtcatgcagcaa

SEQ ID NO: 2085 - DNA, 2351 bp, Toxoplasma gondii
ttaccgttcttcccaggtccatgcttgggtttccgaaggaagaaaataaaacattacctttctcggaattctgcagtcggtcgttcagctcgcggacgatagccaatagtggatcaaacttggtgataaggaacgtctggagctccgcagagtacggcgtgggattggatggggttcttgaagccgccatttctaaagagtacactcccttggtagagttcctcttttcgttgcaggctccgtactgttgttgcgccggtggtagacctccgtccgaaacagcgcttcacgtggaactgctttatgctatagatctactggtgagagtgaggatgggcgaaattgcatccatgaaccaagtgtcacatctacataaaaacccgtcaaaatcatcgcagactcgcggttttttactctcaagtggaattttcatgaaatgtgatgagcgcatggtgcatgaccagtacccgtggcaaccacctgaaatggaaatggactacacagacacgctttaaacacgagacgagccgcgcagaaagcacatcaagcagaagcaatgcacgaaggccgagaaacgggggaaacagaacgtgctctgacagcgaccaggacgatattcacagctgaccctggttgacagattttgtgactttatgaggactggagcaacgcgcaaatgagggaaacagaaggggcgttacgttggcgccagaagtcgagagaaatcatagacttaaacaatgaaggtacgtacacggaacgccgttctcgcgcaccgacttagaaaatcaaacgcgagacaaggacgaggagagagtaaagcagctccgaagatgtgaaacgaacgccgatagagggcaatagtcactctaggcgtggagagacaagaaggaaagcagttacttgagaagagggttcctcttccgacgtagaggcgcggacagcttgaccagtgagaggagcggtgcagttactttcaccacagcaggtgatatagcggctcgccgtttcctcgtgcaatagtgaaaaaaaagccgcgattgcaagctagggaagtgtgtggtttcctcccacatcacactgtttttgcaaaccgcgaaaaaaaatacaggcattcgcttggttaagtctgtgcagctgggttccagacacttaacactctcggcaacatacgtcgggcaacgaaagagacagtcacccactgcagtgacagagactgggtagggaagaagcagtaatgatcgatggtcgagaacacctggaagatacgctttcttgcagcgtccggccgtgcgaattctctttcacgcgcgtcttccactgccttaggctgcagagccggcagggacgtgatacagcaaaatcgttgcgctgtgtctctttctgtttgcgaggagattcactttgtatcttatacaactttttggtaagagttcctgtctttctgtatgtcgtctttcctgaaatcgtaaccttcccttgtcgtagctagtcggccgcccgcccgccgctccgaacgacgcggtaagggcgctcgtgccaccgcctgaagaatgagatgacccggtgttgtataggggcacctgaagcagatgagtgtttctcaataagaacagggccccatcccacctgtaccggagtctagaaaaatgtttgtcttcctatgtaccagtgttgaaaagttcaagacaagtaaatagtcaggacgtcgcgcgacacggcagcattccccccaagcatccctccgcgttttgccaggacgctaccgccggctggctctgcctcgattgcaaaaaaatcttcacaacaagttcgtctgctttacctctaggacattctgcggtgattcgctgaagtatcttcgtttgcagttgttagaagtaacttggttgtttctagaatccaagaggagaagccttgaagtcattctgggattgggttgtcttggcggaacctccagatgacacaggtcttggcagaactggagacattgaggctcaaagctagccgtaaagacacttactcactgccgacatttccgagtattttcaatgcaggatctcgctttcgggaggtaaatccgtgatttggagtgtacaactgtgtgtctcttattggcaaagggcaagttaactctcgaaagagcagcggcacccatatagcacgtggcttgtcaggcgggtcgtaccttcgctctcgggcttttcatttgtcgagtgggggatcctctttttaaattattgagcgccttgattcggatctttgaatcctccgtcgcaggaggccgttgcgggaatcaccgcgtgtcctcccgtggccgggaagtccttcctcttccacgccctttcgga

SEQ ID NO: 2086 - DNA, 1493 bp, Toxoplasma gondii
ttgatggaagtcgtgtgaaagggtgacagcgtggaatgcagccgaggacggaggcgaagacgcgcagagatccagtggcccgaaggcaggggcgtaccacacagcggcggcgtcgaggcggttcgttcgcaggaggaaaaggaggaggagacaaagaagagaaggaacgacgtctgcatttccccgtgtgctgacagccgcggccacggggaagatggtccagcagagcgcaggaagaagaaaggcgctgacggcgggcgttgccgacgcttgtgcggagcagggagaagaaggtcgcggggacggcggagaagacgacggcggagaggagagtgaagaagacgagggtggcgaagagagtgaagaagacgacggtggcgaagagagcgaagaagacgagggcgactgcagcgaggagagcagcagactggccgcgttcgcggaggaggcgagaggagaggctctgagggcaacgggtttctcgccaggctcctcgcgagggatctgctctgaggcgaggagcagcaggagcttctccgtcaacagcgagagaagcaggtctgcagccgcgaacaggatcttcccgcatgcagagtggagcacgacgttgcctacgcagagaaacgcaatgagtggtgtgtatcgataggtatggcgtctgtagggcgactcgaactccacaacatgtcgcgcggcgtcgctgtacaccttgtagtcgatgtcggtgaacttcacacgcaggttccggtcctgccactcgccgtagacaatcaacgccgcccggagaagcgccgcgtacgcgtacacgtacagccggagccgcgacgccggcgcctccctgaggtgtacgcacacccggtggaacggggcggcgaggcgctgagcgacgccgggggcggccgacgaactcgcagagccaggcttctctttttttgcgtctggacgcggcgccatctcctctgctgtcgacacgagagaagtttcgagaaacgcagccacgcggctgccggcggactcccaaacagcgcgggtcgtccgacacaaacacagaaaaaggcgcgtgcagtcgaggaggtccgtggagagggactgcgcggtattttttcaccaggtcagcggcgcatgcgcgcttgagacttgagagaagacaacgcagcgatgcggatatgtatatgtgtgtgtgtatgttgtcgcatgcagggcgactcgaagagccacagcgagcgagaagggaagaaggggagaagcacggagttgcggcgaggtggagaaaaaatgggtgcagacgcagcagaaattggagctcagtgatgactggaaagggcggagctcgagggggcaacctggcaggcggaggggagccaggctccgcacagcgactttcggtatctttcagagaggtcgaaaagcgcgaggtgaagtcggcaccgcaggtgtgactgcatagacaaggatcgagaaaaagagaggatcggaaacggaacgcggaggaa

SEQ ID NO: 2087 - DNA, 1823 bp, Toxoplasma gondii
gaagaacaaaaagcaacaaaggtcacgggattggaaagggataaactgctcgctgccccctcgatgagtttgtcccttctctgctgttatgttcccctgcatctttacccagcacaaggacggtgtgcactgccatggatcgggagtggatgcctcggggttctctgccaactgcattttttagtgagaggggttctgcagggttttcaaaaaagtgaatctcgacaagacagcgatgctctaacttccgatatcaaaggttcttttcctctgttggccgccgctctctcttatcgagagaccgtcaaacaacatgtgagaggccatgacgcagcatcagctccaccctgtcggcgtcactgatggggatgaaggctggggaaatgtaagaattaaaacgggaactcggtcatttcgagatgacacgcaatttatataaaatatgtctgtccgcgactgtcgggacagcctcttcaggcacgattttgtactaagcatgtgtgttaagatgcacgacggtctttgtcgaatggagtaactggatccacgcctccttctcccaaagaacgcagaggaagtggaagactttgctggtgcgctggggggtctgacagagaagtcttgaagacaagggggaaaactgaggaaggacgcatgccgttagctgcctcctgtctgtcgaccacaaacggcaggtgaccctgctgacgaaggaacggggacgagcgcgagcgaaaagaaaggcaaaggacgaaaggaacaggacagctaagaactgaagttcaattggaaagcgaggcgttcactcactggtcgccaaaaacaggtgagaggagaaattcggtggtcctgaactgctgcggagcggaacagttccgcatttctgcccgttcttctcagggaaaacaggaactcctgtagaaaacagatctatcgaagagaagggtaaatccctttcaggaatgttctagcttatggaaaccccgtgaagcgccgtcttctctgcgtgctttatggccccacgtctccgattatcgatgcgtatcggcggatgcacatatagagaacgaatatgccggagacgggcgaatgtgaacaagacaatcccagagaatgtctgtcaagcttctgggccatatccaaggcagcaatgaagcgcatgacgaactaagtgtctagagggtgtgaaagcctttcgggtcaaaaaacaagaagcagaagtcccttgaagtgcattgcaaggctccatttttgtgagaggagagcgggggtgctaaacgaacaagcgacctgcgtttgctaacatgtcaaccttgcctccaccttctgggcagcgctgctgcatgcatgctcatcttatctctttttctggtggacgaggcttttggaagtctctccttgcgattgtagcggaaagtgaagtgtgattattttctgaagcacaaaatctgtgacaagtctgagtctggaaggggatccgtcgcgctttagcacctcttgacggactgtagctcacgtaatgtaactacgaaatcagggcgagtcactcgggtctattatgccaagtgtgcgaggagagagtctcgtgttggtgtcgaatttggattcgacgaagaatctgaaagcaatttttaacatatcagtaagttgcgaataagaataggacatctcttgtgtgtgctgaccaactccaggcctcactgcatgcaaacacgcacaactctagctccacatccgcgtgttgctggccttttcattggagatgccatcttcaatggcatattttttctcgctagccccaggttccacgtcttcgtgaacca

SEQ ID NO: 2088 - DNA, 1562 bp, Toxoplasma gondii
tcttgttgttttctcttgttttgtccacacgatgcgtacctcgacttctatcgcgcgctggagaagctgcttcgcctcctcgagctggccttcctcggagagcatctctgcggtgcggacgaggagcgagacgtcgctggggtgcacagacactccgcgtttgaggaacttgagggccagggcaaagtcaggtggaaacgcgttgagaagactctcggctttctgcaggaagaaggacggcgggagcgaagagctgtctgcagacgaagcctcggacgcgcctgccttctggagctctgcagcggcggccgagcgcgccgagagagctgcctgtggagtgagagtctgccgcttgctctgcttcttcttcttcatcgtgagccaaggaggccggatgcactgagtcgacgcgcgcgcgggagatagtgagaagaaacgcgaattcaagaagtccgggcaggcgacgaacagaccagagggactacgtcacctctgaggaaggaaaggcggcaacagagcgtcagcagggagaacaagacagagaacgagacagacgacgcaacagaggacggccgagaagaacaagaaaaagagagaaagcagaagggggagagtacgagagagaagagaataagagaagagagatacaagacttgagggaagaagggatgacggcgaggattccaaagaaggacaaataaggtttaagaagcaacaaggaggaagcgcagacatgcgaaggttctttcctccctgtctgcgttttttgaccgtagcgcatgcggacaaaaatacgtcacggaaaaggctcctgtgcgtcctcccccttgtctgaggaagaatgcgaagaaacctcaagaatgcgaggaaacctcaagagatggaaagggaaaaataaagttgagcagctctgcaggagagagggccgccctgcccccgcgaggaggccgtgacagagaggttcagagagaatgactcaggagagaggaaaaaacgacaaaaaatgaaagcaaaaaaagaaagagaagagagcagtgcgtaggtttgtagacgctttttcggtgtcggaaaatgtccgagtctcccgcaaaatcgcactctctcgggtgcatgcacaggaagagctaaaaacaagcgaagagcgcgagtggtgtaaggcgtcgtctctctgttgcctgtctcgtctacaacggtcaagacaacggacttgctttgtctttgccgcgtcaagaaaaaacatttgtctctgaagagaaacgccctccatcgagcattgttcgtccccgtccgcttcttgctttcagacgcttttccgttttttcaattcctggcgtcacacgctgtctccaggaccttgctggctggcgtcgcgtttccagtggttctccttcttgggtgtcgactttaaagaacattccagaatttttagacagcgcgcgcgttttctcgcagttctcttcagcacaaacaagtcgaaggcgtcacacctgcctgccgcagttgcagtcgcagtgctcagaaggtcttctcctctccccccgctctaaaaagttacaggtcga

SEQ ID NO: 2089 - DNA, 3143 bp, Toxoplasma gondii
gaaattcaaagtctcgaaggcgcaaagttttcactttactgccgccgggaacggaccgtctgcttccgggtcgccttcatgtgcatctgagaggggctgacgatgatgccagactctctgtttacacaactctagaaagcaaagagaacgggcacccggccaacgacccgtcgcttcattcacttcacgagatttctgttttctaaaagtggggaagatcctcaacgttctcttccgaaattgtgtacctgtgagatgcactcgtctctccatgagcgcgtaccacgcccgcggtgtgactgtcctcgacgccaacacaagcgtggactcttccttactgaaaagggcggtgaaatggagccagtttcagcgcacagccatttcctgacattccccacgtactcgagtgtccaattgcgaggagcaaggtttcagaacaatgagcgtcaagatagctgagtctcggagacaagtgttgatataaacttgaaagtttgtgtgtatggcacacctccatgtacaaagaacgaattcagatcttcgcgttttttcagcagttgccgatggggagaccgtggaacaccgacggttgttgcagaaacagcgaatttcttgatacaacacttttccgcactaaaaaagccatgtcacacgtcccatgagtgtactagcgagactgagagagaacagggagatgtgtcttcacacgtgtagagatactctgtcacatttaacgaaaatagaggtcgacagactcactggagaccgtgcctgcttttgagtcttgtcaagaagtcactaacagacggacttgacgtcttcaaatttgctgtttcgtctcgcgagtggaaaatggctgcgcattcgttagctttttctcctcaaaaaagggaggggccgggagcaaagtaattcaaattccggaaaaaagtcgataaacccggaagaaatcttactgtatcgaggcggagcacgaccctcttccgagtctctacactgcctgaattgtgtttgtgtaatccgtacatgataacctgatgttggcgtgtttcgcgcttacctctgagatgtgttcacaaatcttttggaacgcacacgatccggtgaaaatatgagattccttactttgtgcgaagccgtggaagaaatcaatctccttgttctacatggctttgtgggccacctgctacgagggaaagaaacagtgtctcagcgtgtcgttcgacggtcatagtttcttggtttttcaaatcgatccttgatgccgtggcttctgagacgagtgcttggctctctgttttctttacacttaagacaagaaattcgttagtgtctccgaatctgctagcaacaaaacacgcacgcagccccagatgtacgctttttctgttgtttgttgctgttcgcttttccagttttcttttgccccacagccgccatgcaattccttggagaaagtaaacgcgcggacgccagcaaagaacgggcacaatgcggcttttgtttttaccgttcttcacttcagcggcagcttctccatttctgcatgcgggtcaacgacatacggggcagaagagtaaatctgtgttccccaaatggtgttctgtgctgttggtcgctggtctgatcttctgcgttctgtttcccgcaaacgcgtagtagcttctttcgcggtctctcttgtctccactttcgtctagaaggtcagcgcgactttccttccgcttggcattggttcgcaacgaaaatccttcgcctgatgcaagtgtcctggaaacgaatgttcctttctctttgtttgcttgcgtcgtccctacgaaaccctgtaaaactgaattcaacgtggtgacgctctttagctaagacaaaccggcctgaaggaaaggacggaaacgccgaagccagaccgatgaagacttgaggacgcacacagctcggacgtttttagcggacgagaaaaacagtgtcggaaaaaaggtggcttcaaagcttcggtcgcatctatcagctactcccatactctctcgcttcctgctcttgagatatttcttcttttgttgacactcaccgagtgccatccgcacatcggacgctggcaacccggtcgtgtttcctcatatgcggcaaagatttaaagaacgctccttacagcctaaaaccgtgttcagcgtgtctctcattctccacgttccttatgcggatgagccaaacgcagaacggctctctgtgtcggtcaatagacaccagcaggtccatgcaaagcctctcttttgctgtcctttacagtgaactcaggaagaagtgcagctaactgggacacaaggatcccagatcgtgtctgcttttgaaagcctttcgtttttatctgcccccctaacacggtagggattttgtttgcctccatcgacctagagcgatatcaacttacatctgcgtcatcgctaaactgttttctgccaacgtcgtgatcagacttctgctcgctcttagccgacatcaacgacataacgatcatagctagaccggttatcgtagtcatcgtaagcggatgctgttaccatatcatccgtacaagtctagtaaggcacaagtaaatattgcctttgtacaagtgatccgcgatccagaagtgaatcacccaaatcgaaatacaccggttctccacctgcgtactgctttgtagccagtgcgttgttcgctctatcatcaaccagacggtctcgcggtgtttgcgctgtcccaaatggagagaatgcgttggcgtcacatctaaatttttgtacccgcaaactggagctcagcacgtgtttcttccttgtgtccgtctctaagaaaatctgctttctatgagtcaaaccgaaccctcaagttcccctacgaacaaggactgacgctgtcatcgccatggtgttttcttggccgcgattcgcgtgtctgtgtggcatctccctctggaccgcgaggtagagcgtttttgcttcctccgggttagtcctccgcaaaaagcactctccatcttacccgaaaaagaactacgaaaggttgagaaactcctctggtgtctcccagtctctgcggaactgaacaaagaagtaatcgtcaatgtggatggacaaaacacaagaaaacacccgtgcaaagca

SEQ ID NO: 2090 - DNA, 4477 bp, Toxoplasma gondii
cgttgacgtgaagccgttttgtgttgccgccttccagtgcatgaacagcgacagcggaaaacgccttctagccgcgaaaagtcgatcaagcgcaagcgccttctcccctacctgagcattgtcgtccgcagcgccgatactggcttcgcgaagaagaagatcggacatgcgaactggagcaatgagctcctgtccagtctgcggcgctattccgtcgcctttcgtttctccccgacaaggattagagtcgctctctgtaccacgacaaagacgaacttgaacaaaagaagggtcgccacctgcctccggtgaattcgactcccccgtcttcgcactcttgtgccgcagccggggatccacctcggcgtggggtgtgcgtacaccaaagccgcgaacagcgtgagctgcgacgacctcggcagggtaaaacgggtgctcagaagcgcggaagtctggctgactgcggtcggcgtttcccaggagtctcagggattggtcgcgagcctggtcctcacagagcagccgctttcgactcgttttgttcctgtcggaactaggcgtttcctctgccgaactcgacggctggagcagcgcgggcggagacgcagttgccgcgcagccacccgaagacgacggtggatctctacaggcttgcggactcgcaactcgacgcagagatcgcgcgagaaacggaaagctctcttcgccgttggaagccgagacgggggcagaattcgctcctttgatcgctgtggcgctgcggtctggaacgagacaccgcgctggaacccacaccagagtgccaggcggcagcggtgacggagctgcacagagaccggccgccggcaaccgagccggggagtggaggtgaggcgactgcggcgggggctccagaacgggcgaggaaagagcacggacggattgctggctcgcgcagagtggagagcgcaagtgtggtcgacgttcgagaagaagtccaggaagcgaggggcctctagagagtctccgagacaccgaagactgaatctctgaacgcacagtctccacacatgacgtgggggcactgacagaaattggaatgtcggacgacgacggagaacggggaactcgagctgaaccagttccagactgcaggcagcgacgggaacgaatgtggtcgctctctgtcgagtctgtggcttccgtgaaggagttggtgtctgccaagagttgggtctccggcggttgttgcaggtttggtctgcctggggcagaagaacgcacaggaaaatccattttttcctggtgcaaagcagaagtgccggtggaaaggaccgtgtaaacccgagtcgcgaaacacgcggcagaggacacccggggaaagaggcgacacagcgtcccgaggcagatggctcttcggaacgaatgaaggcgtaacccgtccgatatcgtccagatgcaagagtttctcaaaagagtaagtacaacgatgtgcggaatattctgcacgagtttcctgcaagtgtgtatcgagcaaagactcgacaaacgaaaagcaggaccgagactcccaattagccgctgctgctttagaggcgaccagtccggaacgcagcggtacgtggtcaagagagcagtctgcgagaaagtggcacacgagagaccggtccttttccatgtcagaaaagaaggagctttttttgtgcatttgctctcggacggcccttgtctgccgctcggtctgtgtctgctgaccacacgcttttccccgctttgtcgtgctggagggcggcgcgaaaagagctcggcaactgtgtcacctcccagaaagccgccgccccccgatgccgcactcaagctcgatatcagctggcagctgcggtgacttgcaacgcagttgctgctttttgcttattcgtatcccttgttttgaagaaattggatatcttcgcgtgtgtgctgccgcgaggggagacgagcaacatgcaagagtggctagtctcccgtggcggggagggaacgcactgtgtctcccgagtctacgcgtctcaaccagtaggattaaagcttaccggaaaagcatcactcttgttctgtcaaattgcatgtgcttcgttttgtcaacaatcggcaaaacggtgccgaaaatgaaaaaggtctaggtttcctaaacttcaagtgagctggacctgaaagggtgcggggggggcggggggggggggggcacggacactttgtaggaggcgcgcacagacctaagaattgtacaacaaggaaatcgcgggagtctaggtggttcaggtcctctacaatctactcttcgttcccgcggagcgatcaggagtttcactggagcggcatataagcgctagtgccatgtgcgaagaatcgaagagttgtaaccacgaacccaagcgactgctccccattgtaaaccttgcacatgcgagaaacaagaatctcgtagttttggggggtttttaatcgctctcgcatacatggttcctggtaatgcagtagagctaggataggatacagtgaagacagatattcaagatctcaatcagtagtccaacacgtgtagttcagcaaaacctaggaatgccatttttacactgtgtaaaacagagtctagcttcagtcgcgtcaaacaagaatatggggtgacgtgaacgctgctcggggtggcgaggatggtagtcgtgtaccacagacaactgaggcacgggattcgtaatagagaagcctatgcagcactgacggagagaatcagtgccagctgcactgcggtaatgcaggataataaaaccttagtcgagatctaaagatagtctggacttcggcatacgaggaatgtttctgttgttttctccgaggacgctcgggtggcttgtggaagaggcaactctcccccctctgtctgggaagtttcttaccaaagagatgccccaagcaccgatttggagtctctagtcccaccatgtctgatacgctttcggaatcaattgaactcagaatgtcgactacgaattgtgtgaaaacggagtgagtagatccatttcaagctccggtcaaacacactaacgcacaccccggtacgtcggttactaattgtgtctacagccagctgagacggacgacgcgtacgatgcgtccaacgagttgctaaacatgctcagtcgaacagcaagactgctgtgacacatcggattcgctggcaaagtgaatcccctggcatatgttctacgaataggatacagccgttccggtgacacacgtgctggtagtctgcaacgtggccggcacgtcaacctccctgctgcccattcgacacagtaacacagactattcaaggcatagaaatcgacgtgacagaatacgccgaccgtctactacctggggaggcggtgcagcagggtccgttagacaggtgatgccgattgtttcgttgctacagtgcacgaaaagaaacgaagttgcgacattttgcgctccctacgccttctgtacaggagatctcccactctaaattacacgaaggcactctacgaaggacactctctagcgcggtgtcggatataaactgtgtttggattcgatcctggacttgggatgctgaatttaaccgtagtatactggcagttttcatgagcgcactcctttctggaacccttcacgttactggggcttccgtttcgatcgccgtgcaccgaactgcgaactagccagagaggtaccggctgcgtttttaccgacagatgcgaccgtgaaacgtatgaatttggacaggcaatcggggacacacgaaacagaagatgtgacagtggttttcaaagggagtggagaaagcaatgtgttgaggatggggttccacctggaccttcgcgtgtctcactggccaggcgctcgaaccgggaagtgctcttgcgcacacagcatcgctggatttcctccaggtgtgtgctccacctttaaatcacattcccaacctttctcacgttttggagatttctcgtgaacacacactctgttgtcggacatccattctccccctggctcaaagaacgaaagcgaaaaccgccacccgcagggaaaagcgacgagggcgggagcgagcagagagagtacgtcgaggaggggcagcgaagtcaacagccgagttccactgtgcaacacgggagctgacacatctttccgtgaacatctttaacactaagcttatcttccactaaatcatcatttaccaatcgttccattctcgttctttcttccgggctctcggtcctgccgctgtatcgagcggcgtctacctcctgtctgagatggggagtcccaggcgaccggtgtgtcttgcagttaacggagaacttttccagaacggcgtgagcccgatccgtacgcttttctagccattctcttttgtcctagtatgtctaacggttcttttcttttttgcactcgaaagagttcccgaaaaacgaaggtggtccgtcgaaca

SEQ ID NO: 2091 - DNA, 4749 bp, Toxoplasma gondii
tctaggaaagcaccgtctcagaggttcgcatgtccaaccgaaaaaaggtgtctaaaaacgaagagaacaacctcaggagtcttcgctatgatacggtcattatagatacaaatatatatatatatatatatatatatatatgtatatataagtcgacgaatgtatcagtgttgtgtttgacagcaagggtacacttgctgggtcttttcggcgagtatgtgtgctgtgcaggttgtacatgttttgtacggacgagcacagaccgagtcctcgctccacctggacgaactgtgggcagaggaaagttgttgagcgtttctccatcgttaagtgcagtagtgaagtgcgaacatgcttttgcgtggcgtcaacgaacgacgaaaaagagacagcgtgcgagagaacgaaggaacagtgaacggaggaacagatgcaaatccttacactgccatacgccgtctgagtttggtgacgccgatctgcagccttacagagaccgagccagtgattccctaagatcgtcgtaaagaaaaacgggcaggtgaaaggtcaatcccaaagcatttcttttcatctcaactcgggctccgaactttgacctatatggcgggaccgcagaaagtcaccaaagagcgaaagcgaaactgcaggcgtttgccgccttggtcacctgccgagaatcggtgcctacatgcctcgtcgtggacgagatatctttgtcgtgcgttcgtttccaactatacagacgcaactcaacatgagtatgtaaaaagatcaaagacaagtgacgcaaaggaattagcgacgcctcttcccagttctttatttctgattactaattatatatgtgtgtaatggagcagagaacggcgcgacgactgatggattcgcgacacacgcaccggcctcgaaagagaattcgcagaacaaaccgtcagaagtccggaacccgtaacctgcctcgagttcgccgatgaagtgaatctgacaccaagaaaaagtacacacagctgagcatgagaaacaagcggttagacaggcctctggaaaactttatctgtctccaggggtccacattctcgcctcagacgttgtttggcatgtggttcttgtcgccttatgtagttctttgcgtcacgaatttccacagaagcacctgagagttgttggtggcaaacgaatggagtttttagagcctgacgttgacttgtccctttccctctgtctgttggtgattcaagaatccatagggatttctgaattaaacgtttttctaattgtgaaatattagtgtgcctttccaagtaaataaatataactaagactgtaacaacattcttgagtgccgacagccacatggcaaaaatgtctctactaggaattagaaatagaactctgccaaacccactgcgactgattgtcgttaatataggcaggcagacctacgtctcgcatacagagcagcagccggcagcagagcagcagagcggggaccatggggaagtgcattctttcgtacctcggcttctgtgctgccctgattgacaaggaaaggctggcgggcgttttgatgaagggcggagagcaggagacccggggcaagagggcctgtgttcgtttcactcaagcgactcggccatctctccaacttaggagccgacgcttccactttttgccttcgatcttcagcgtttcccgtttcttccagggtaggctggaatcgtgccgcactcggtacgggtgaactgtgattcactcccagaggactggaagctgggtaggtatgttctggtgccctcgctgcgtcgtcttccccgtttcccctgtttgttgccggaaatttcgcgtcgaactctgccgatctgcggctctgctgacgagaagcttctgcaattttacttttttcaagcgcacaagctggggaaggcgcggcagcagctgcagacgcttgtgcgtcagcacccgccggtatgtcgacgcggtcctgccgtttcgtgtcactcgttcgctttgctttttttcgcttccctgtcacagacgacgaaggggcttcgccttcgctgtatccagaaatgggcggaatcagggagctgggtgggtctgtattcccaggtggattgctgtgtgcggtgttggaaggtgccatgtcgaccggaatcttggtgaaaaggaaggcatagaaagcagaaggagaaacggggggaagtgacagtgaggtgctccacagaagtgacaaagatacagacaatgaatcggctattcagaggtggtcaggcgcacgtgacgtttgctttttccagttttctgttaagatgcgctgccaaccctagactgggaaggggcgaactagtcagcaaccagatgcagggttggacgaatcgcgtttctctccatgctataactcgggtggtttgggttatgtcacgtgaccggggaagaatgtggttcttccacacggtgcgggagtggggggaagccgtagcggaacttagcacgtaaacctgaggaactacaagaaacttcgtggacgagcagaactgctggatgatattgttgacacaaagaagcaaaatggaattcgcggtgaaaccgttggttccttctcagagagccgtcttagttttctagcttccgtgaatgttcgcttccaaagagtccactgttatttggcgcgcgcttcagtggagcctcggataggccgcaccaggtgtttgtcagtataccctagctttcgttccagctattcgaaaggtgaatttctctataaacgttggcagcggtctagagctgacaggcactcggacgtcgcacgacacgtcggcgatcaaaactttgggggtcgtcgggcaaagccgtttaacatgcacttatgggctgtcctcgatcgaagaaaccacgtgtttgctccgcttgcaaaaaccctcaggtcgaaccaatgagtcccacttccaacacttgggataaaaggaagagactaaaagcgatacgctggatcgggttatctgacgcctcccataaggtgaacctgaaacagtgcaggactacgcccctgaatggacatcacgtaaaaacggtgcctacagtatcttatcgctgaaactcagcgacgcctcatactagctttttggaggcaccacgttttcgtgtcggaaaggaggttcattcaaagtccatgaggcatcgaagactaaggaaaataagccgaggttcttttccctcgagtcgctcgaaaggtagtatattctttgaagctcactcccggactccaaccagtgaagaataatggcgacaagaacatccctcttcgcttcttgagggctctttgacaagcaagcgtgtcctatagtacacgccgctctacgttcgtagattcgccacggttccagagaaaatggtagcggtctagctaacaaagaatgcctccagacgaggtaaagacgctctggaaagacagcgtcgcagacggatctccatcacaatacgtgagatattcttcagaaaggcgtgaaatagaatagccatgataggccaggtaaagagtccctctcttgcgcagattccgagaatccagcaagagcacttttctccgctacacgcatgcacgcgcccgctccgatgtttgtgattctggctaacacttccgttccttcctacacaaaactcgatttaggaaggaaagattgaccatagaaaaaaaaagcttgcaaccgaccacgatcggaacataacacgatgtccacacacaaaccgccattgctagacgtctatttggtctctcgggcaatctcatatgattatccgccaacttaacacgcatgtgcgtgccggcaaaacatactccaagcgcttttttctcaatcgtaagctgctgtgaggctcatttcagtgccggcacgagtctcctccactgcaagcacggagtaagatcctgaacttgcaaaggacgccagcgatctacggatagatgactgaacagtcaaagttagactagatacgtaacgcagtcgtgcgcggtagttcactagcacctcggtgttgaaacacgtctctggtgatttttggatgattcgcatgacatgcgaacagagaacaggaaacttattcgaggtcggcaaaatggaacgatacacgctggatgctcttggaacatgtccggacccttcatgaaaacgagactttgtcgaggattgtggaagataggagaagtggacgctgatgttgtgttgcatagggtcactcgtttaatttgattgcaacccaataacgcagttaactcgagcgctgggatcgaccggggtgtaaagaaggcaggagcgctgacaaagaactgccagcgtgcttccacaagcgtattcgaatgccacgccacgaatggcgcagtaacttctgtcgacgttgttctgggcagtagccagacggcagagaccatagcacttcttctagcactgtaaaattgcgcctggccggagttcctttagacgaaatagcacatgatacctgatctacgctttgtctgcactagatctgtgatggcataaagccttacggcgttcgtctgcttcttgcgtgttttcgagccatggagtgttcgcgaataacagccgggcattattcaaagctcgtatctcagacagttgtccaagacgacgtcacggatgtggtaaataccgacaaaccaccggtttaggatcgaattacttttcacaccgatttgtccaaatcaccttcagcagttccttcctgtcacaa

SEQ ID NO: 2092 - DNA, 1785 bp, Toxoplasma gondii
ggacaccgagcaaacatgtgtgcaggtcagatgggtggttctcgtgcctccgtttggccatggaaaatatacattttaacgcgatttaaaccacgcaagatgtaaacgttcctccgaaggggacattcccactcgacctttcgtctgtgacaaacaacgaagacttcttcccgctcccaggaggcaatcgcacccgtcgcgctgtcctgtggtggaggttttcccctaccatttcgacgatagaccgtttatcttttatgttgtatggacactcttcctcaacgcagtgtggagtgagtgcagcagagagtcgacacggaaagtcatgacttgatgtggggtccgtgtctgagctggaagggtttcggtatttgcagcagagttttgaccagcgtgtaggtggcgctgtattcacacaagctacactcatgcagagctcagcttgaacaagccgaacgttttccggaaggggttttgtcttggcttagcaactttcccgtttgctctattgtattcgaggaaaaaacgaatggcgtgttgagaaccaccaccagaaccacgtggtccaagaccgcctacacctcgcagactccctttgcagaaacgctcaaacatccaacgctgaagtcgaaccgccaaaatgccagactttctgcaaaactaagctgtgaaactccccggctgctctggtccgcacttctgcagccgtggcggcttttgttaaacatggatggacgtgtgcaggcgaaaaaaaaagtgcccgaccgtctaatgctgcagctgactaggaaagtggggaaacagagctgggcactgaatgccagttttttttctgctacttcctgaatttcgcagcatcatctgcacgggcacgggagctcaaataggagcccttttttggtgggtgggttcctctttgcggtaatggttttctccgagcggcaattgcatgttttctgcgtagaaaggcaccgcgagaaccgtggtatttcctttgcaaagacagccaagcgggacgcaaaaggcacatcacaccgcattcccaactctgcttgtgtgcactggtgctccgcagcgttgtggatcgatttgagatttgaacacttcaaaagctgccttccatgagattcgaggaaacacaagaagtacgaaacaatgctctgggcttgctggagaaaaagcaactcgtctttgtgagtcagaacacaggcgatccgttcagtgaagcacgcagccggtgtcgggaaacaagcgtaactggaagtcggttctgaaaaagtgttggaaactaggcagatgtaactgagtcgtgctttgcgaaagcgcaggagaaaaacagaacgacgtttcctcctcctttactagactatcaaacaggggaaacttctacccatgattcctcttttcgaggagtctttgcagctcccgttttggagctctccaggactggttgtttcaccgcagcatgccccaaacacaaactctcattgaaagggcacgttgaggaaatgatgctgaggaagcggcagagcacgtggacgtaaaaatcgagtgttgttggcaaagaagtctgccccctcttcaggtgcgaggcatgcctggtacagcgcagactccaatcctgccagcacgtcctataattcggaccgcaggaatttatcgatttcatggccgatcgatgatggccatctgcgctactccctcctgtgaaaatcgcgtcgaaacgaggccctgaatacatagaaacgcgaaccatagtcctaagatttcaccttagttctaccg

SEQ ID NO: 2093 - DNA, 4844 bp, Toxoplasma gondii
caaccaaaatttgattcgcgaaaagcgcagacggagctcttcgaccccagaaggcgtacacggcgcgtagctgccgagcacctggaaggcaaaaacgggcaaaaacgttcagtgcggcaaaagaggccaagtgactgagcgctcgctcatgcgcgcaagaaaagattgcgcaagattctccggaaaggtttgaatctttttgcagggtgtctccgctccgggccaagggcagcgtggatggaagtgaaccactctgaaacacgagaagggggacgactctagaaagagaaaaaagaagaagaagagaagctcgaaaaaagaagaagaagagaagctcgaaaaaagaagaagaagagaagaacatgaggacgagaaagcgacaaaaaaggagggacagcaacgcacggacagagaggagttgaagggtcgccaaggagagaacgagaaaaacggtacacgggatggaaagccgagaacagaaatggcagacagaagacgaaggcgagaatggttcactgcagagaaaaacaggttcgctgcacagacgaacaagttctttgcaaataaaaaacgagagaaaactcttcaagtgaagaaacggggagattcgtttacctccatgtgctttccgtctcgagggtctctctgattggcagcgacgatcttgtaaaaccgctttcctttcactcccgcaacttgcatgcgaatgcgcgggggtcctcgctctttcgagtagaacggcagaaacatgtgcctcaccatctctgaaaaagtaaagaacaagacgagaggaactcgggcaggcagagccagccgcgcggaccccgcggcagacggaggaacgggaagaacgaacagcgacagacgaccggagagaagacagagagaaagagagagaaggagagaaaaagagaaagaaagagagagacacaacgatagatcgacagacggagagagctggaaaaaagagaaaaaggagaggcgcttgagtaggagaagagggcgagggaggaaaggagcagatggagagactgtggagaagaaaattccagcagaaacggaaacaagacgtcttcgcggaaagcgtcagccgttgaaaaacgtagcgaataaaattgcgagagcggttgacggcgccgaggagagaccgagacagcaagaagcctgggaggccagacgaaaaaacgacggaggaggacgcgaagcgaaaatagggaggaatattaccgaagaactggagcgtttgcaccgacagccgttgttttcgcgctaaaaatcgttttcaaatgactgcatgcgcttcacggttcgaggtctgtgaagagacggcagatgtgtgctatgaaaacgctgcagcgaaccgggtggacaggcacggcactgtttggcgtgatcgttccctgagaaaggacgcttgtaagaagattagtccaattaattgggatagacgcactcaacatgtttcggcaacaagtgaacaaatgagaaaaggcacctcgagcacggcatctatgtcgcccggcttcctccacagaaaatctcggtcgttcgccgcggacgactcagttaattggtttcagctttgatattttgtaccaagtgctctgaagtcgtcgcacccgctgatcggacggtttctttagtgtgggaagttcgcagtgcgcactggcaagaattttcttcgaggcaggggcgctagagccgttgaaatgtgaagacactgcttacgtctacaaatcgaaatgctcaggggcagagctgtctggggtgtccgcattgtgcacatcgtaaaacagaggtttgaaggaattgcgatctcatggagacacggaagcctgcctctgcgtcagctgctcgtctctacaggaggaatgatttttcctggggagtgtgtgctgcgagttcgactgctgcctgagaccgtcaaggtcttactagatccacgtcgagcgcgcgcttttcatgggcgtgtgaactgcataaaatacagtgctatcgagcgcctggttgaacagcgtccatctcgtgatctgcgctaccagcatcgaaaagcatatcgcgaccatctgtgctcttccagccaatcatacggctttgtgtctctggaaacagaaagaaatagaggtgtcgccgactggaaagaaatgcgtctgcctttggctgcccgctcgcgagcaaggtttccataccggagctagactgcctctcgcgcgagtgcgtatgtgccgttcctcggtctacacatacgctctttctgtggcgaatctctgctacgaaatagagagcagacagaggggaggaaaagccttgaggacaagtcaaagacgtgcaccagacaaggaaaatggatcggttctggaagtgcatgtggcaagttttcttgatgaaaggcagggacaggtgtcgcctggtcagaaaacactgtggtcggtgaaacaagaactgggatcttctccgagtaacggaagcaggaacaaacaccaaacggtttttttttccccagttcttctttatcactttgaaaggttaccaacgaccagaagggaagtgtgttctgaagaaagaaagatgatgtttcgaggtcagatgaaaagaaccggtctctcgagcgtaggaagagaaaaacgatgcaggcagacccagtgatcctaaaactgtatcaagaaacctgggcagtgcagactagcataagagctgcaaagattgattaaagaagcccaagataggaccgacaataacatgactgaaatgtaaaccagtaatcataaatagaccattaccaattccatcaaatagagcttaactaattggactgtgcagtgaatactcgaattccattcgaaaacactcttgctttcatgctgaatttaaaccaacgattcttcgtttagaagctgaaagcgagttctcgcaggggttcacggtcgcgcgtccggagcgtcgtaggctgtcaatctggaagcggaggcgtccataatactcaccgagtggtggtgtttctctagcttcttaccttccacttctttctatctcgcttctcctgtttacaacttgaggttctacacagtgttcacgagagggatagaaaacacttgaagaagagtcgatttcaaaagccgagcaagatctggaccgcatgtccataggcgcggacgagaatggacccttgactgaaatttatgccagtaagtgggagaataccgccaccaaatccgcagctgttctgtacagactaacatgaggaaggcgactacccaaacctgaatgtgaaaatccacgaacacacacttccacggggcatgcccctgccaagggcaaccacacactgcagctgccgccgtggttttcccgccccttcactccgctgattacgacacctttatgcgaccgttttcaattcgtttttctctttacacccaccagaagacagcgtttcgatgtatggatgtgtagctgcctgaaccgtcggcttagaggtcccctctcctccaaccggcagccggggttcttgaatgtggaacctgactcgaaaaagttcccgacaagcacacgatttcttcagcccaaatcaacaaacagtcccgcgtgcgttctgcactcttgaaggtctctttttgcgttggacgttcgccgtttggactgtactgtcggcgaatcgcgtccgatgcaccacatctccgtcggtggaaagctcgaccctctcggctgtccgcctcccaaagtgtcgctgcccgtcccgaggctctttctgcattctcgtggcttttgctgctgttactgagaaagggtcctcagtacccagttgtctttgtttttgacagttgggggggaacttccgaactactgatgtagattagtacagaggactcgccgtttcccacgtacaaaggcggcaccacacgaactgcgctccctttcataagaatccgtgctgtcagaagagcttctcactgagctgctcaagagagctcaagaagtgatgccgccggaaactcgggtgtgtgtgtacctagcgtgagttttaggcttcgaagcaccggacagagaaacaggagagtccaacgcgcgtcccacccctttcgcggaacagaaaactgtgaacaagttctcccgagtttacatgtttccccctctgagagatccgcatcacgattcggccttgtctgcgtcttggtctttcgacagtcgtgtcgtcgcatgtctgtgtgatcccacacgggaacctggatcttagtacttacgctgtttccgctgatataagcccctagtttccacgcgtcagctctcactttacccttcatgaaaaggggagaggccttcacgaaaagattgtgacatagctaacgacgaggtggcgaatctgtgtcgaaaacaaaacgttcgtctgtttgctacctccgcagctcgagatccgggcgactgccttggcgtgtgtgtcgagtttttcgttccggtgagtacacacacacacacacttgctgcttgcactgttgaaggcgtagaatatgtttttgactcttctttggcggccagccgacgttttcgcgccgagacgacttctgcgaccccacatcgaaaaccgcctttcgccgaaggtcggccgaccgacacagatcaggcgtcctcccttttggccggggacgtctccacgctctgaccggcaagcgactgagagaagcccgcagttagattttaagaaatcagaaaaccaaggagagaaacgtaggtggggtgtctgagaaacggcgtctgtcaataggtccttcgggtgcgggcgggaagaagagcggcagctgcgccgcgccgtgcatgcgagaccgcgaggcagggtgcgattttcctga

SEQ ID NO: 2094 - DNA, 2771 bp, Toxoplasma gondii
tttttctcgctttgcgtttcctctgcttttcgtccttctcctaggctctcgaggagagtctgtcgtgcctgagtccgggcgacagtgggaatgttggagttgtctaggaggtctctttcttcgtgtctctttttctctttgtctctcctgacagccctgatttctcacgtccgtgtcttccttgactgcatgtggtggtgtgcactcaaacttctccgattgaggtcgtccgtgtatttgtcgccaaagctcaccgagcctctctcgcgctttgatgccgcgcgcagaccaatggttgtctgcgagaatatttttctctgtacccacacgcattcttcgacttaggacggtacagacgcccttgtacaacctccctccaccgtcgtgtattgccaacactcgtgcgtagcccggaaaaagaaaatcagagaatttcttagaaagccatcattcgggttgcctcgctcacaacacaggttcgctaaagggcatgcttcacagccgtcgttttcccgttcgcgcgaattcctctctcgcttcagtcgcggttgtagagtgccggaaactctaaagcctaggaccccctgaccccttgtctgtgccatcgcttcgcttagcttccctcgcatgacatcgaggcaattgacatcaggtatttgccagaaaccaggtgttgttcttattttacgattttccggctaaccgttgactcactgaaccatcctgatatgggtggtaagattgatcgtggactaccttatgaaacaatatgcctcaactgtaaacgtctttatttaaccaatttaggattcgcgcgaccgcctaaaccgtaaacggagatggtcgcaggcctgctcaacatccagcctgtgcatcggtgaaaatgaagtgcgccacgcgcgtgcacatctccgtgccaggatagaagcgatagggagtgacctgaatccattaggtatcctcctatacggtgaggaagacagttgacaaaggacctggtcgacggacactttgagggatgaagctgaggaaatggcttgtcataaccgttcaattcgggtgcgaatcccactacttgctaacgcctggttcctcctcctcctccaagaggatagtcccaaaatgtcgactgttgctcgtagggtgcgtttgtgtatgcgagtttcctatacgtacgcgaggagttgtaggcccgtcataattgactgaaagagagcacatcccgtacccagagcagcggtttggatacctgtgagttggaggcaagatgttacagaggtgcaactacttcgacggaaccgtcgttttttctgattcctcgcattctgtgttgcaacgagacttttgaaacagggaaaccttgatgaaagacacactatttcagtgtagaaggaatccgctgcccggcgttctgtgttagctgccaggtcagcttcccccggaacattcctgactagagtcaaataaacatatcgattcttggagtgttgagttcccaatgccaagttgcaatggattgggtaggacgtaacctttctgttcaggaactagaggccgtggcgctctgactttgccttgcggacacggtgtcagattgtcttgcctggcgcacggccatatgtattccattggtctcattgatttgtcgataactgtccgcctcgagcctgagacccatgttcattgcagtttcctccatctctcctgtccagtgctgttagctagtatctttctcatgtgatgctgagtcttgcgagtctcaggtgtgacactggggcagccgtcacggtctaatggtctccgttaagactaagagacgttaccagttcacacgccgccaggagcgccgccggaccgatgtttctcgatttaatgaaatcagtttgaatctctgggtagaacagcaatagacagcaagtcttgcgtgaggacttccgttggatatgaaaagcagtaccatacccagaaattttgtcctattcgggccgactccgctgaatttagtaccgtcagtggtaggccttttaatttgtgtacgtgaaagacatagaactgcaaacatcccagaacctcacttggagtcatcgctgcttcagtgttgggcagatccgtaccaaatagtagactcctctatgttcaggcttttagtattcaacttagcgcggccccggaaaacatcggtcctagtatgccgcgcgctatcatctgtgtggcatctgcaagaccagacgctaggacgaacgcgaggacaaagaaacgagacgcagcgtagttgtgtctgcttggacacgagcaggctgtgcgtcgtttcaaacattccgagcgagtctcgtgagcagtcaactaaaatgggaaacgaagcattaaatttatcaaacatacacgataccagcttcatggtgacagttctgatgctagggctgtgttctagagtagcgagtggctagcggaagacactaccagccacgctagcagtccagccctgaagtgtttgtcaatgcaccactggtagtgcctatgagacgtgccgttgttcagaaggtctgtggggcattttgtctcgaaacgacctgcagtcttacacctgaccacgcatattaggttcctgtaatgttggaatgtctcaactggagcccgtgtgcgtgggctcgcgtgacacatcttgacgtgagtcgaaatcttcgtctggaaacggtgttgtcggttcccgaatagggaggtttgtcgtctgtaggcagttgaaactgcctgtgatcttgtttgtcgcaaga

SEQ ID NO: 2095 - DNA, 1648 bp, Toxoplasma gondii
tacagacacccggaaggctcgttccgacaccgacttctccaatcttgcgagacgctgacgcgtcagaatatcgcgtggaaaaagtcaatcccccttgcccactcccggcgcagactgggcgcgctgcctctgcgtcgctgcctacatcttcgccgcgacatccgatagaatcagggagaaagctcccaaagacgacctcccgcgaacgctctggtccgagcacagtttgtttgaacagcatcgcaaagcgcatgtaacggagaaagcgagtgggacagtgttgaatggcaacgccagccgacttgcagcctcggaggcacgtactcaggatgagctgtaacgcagggaagagagtagcatgaagaggaaacgaggccagataatcgtgcaaggaacaaaggagacgggaaagcacagaaaatctcgcaccttcttcaaggagaggcggtgacgacggagagaaaatctaatcggcagctggagaacagcgagacccatgatctccgttgttttcccatcgtttttacagcaggttgaacagcaagaaaaacccagatttctgcgacggaaacccggggggagaaaagacacgacccacgtccgtagtcatggtgcttcgctgttgttcaatgaagcaacggaatagacgagggcagggatgattggcggtgtttgaagagaagggccctacgtctttttgatttgaagccgcttgcagagccgagccaacacgtttttggcagttctgagctgagtctacgcgattctacagcgggaaagcgtacgacgggtatgacaccagagtgtcgatcgattccttacgttgcgaaaggggcatgaaggcacaattccctcttaccggcagcctcaaaaagcggtttccaagcacgacgccggaatttggagtggagaaaggaaagagagctgcaagaaaacgagagcttcatttgctgttttatgccggatgcggtcgcccccgctgagtaaatcgacggctcccatcgccggtcgcggtttttgacattgtgtgcacgaatcccggcggcactcaccactgtcctgaatgcagaaggccgttgaacgagcgaaaaaaaagattactctgcaattgagtcacgatgtggaacaccgtggcaccgaagaagagcatcgacgctgccgcttggaaatctgttcacagctgcatgaaatggctactcgcatgcaaggaaacatttctcgcagtcaccacatctgatgaactgaacagaagacaatgagacggcagctgtcgactgaagaaaccggaccacggaacttctggacccacgagggatccaacccgggcggttcccagaattgctgtgcttcagagtggctgccgattcccagaaaaaacgaccgacgggttctgtggcgggcgtacagacaccagatccatcctgcctcgcattcatgcggcgacttttcgttgagttagcggttgggagtgcaggtcttccaggcactgcttcgtgtcattccggtggtaaattattgaatttcttggaagacacttctttggagtagttctcttttctttatccttcgttcttctgcgtccacccacacgttttttccaaatgggaaggaagaggaggggcttgccaaccgggtccgacttgcatca

SEQ ID NO: 2096 - DNA, 2481 bp, Toxoplasma gondii
gaagagtgatctatctctcgttgtttcacaagaggaacaacgctcttctcacgagatgaacagcccttaccgggacactctcgaggtctcttttgaaggcgttgctgagatccttcatgcgtcgacctcgttcgatgttgctttcctcgccgagctgtctctgtagcttcacttcttcttcgtagttgacgagcgcgccttctgcagactcgaggccgccctcggacatggtggaaatgactctcgttcggagtccaccctgcttgtttgttgccccgcctcgacgcatgctgtttgtctggaactcgagagtttctcccatcatgcctgggtgtccagacatcgtcatggtcatgtcttcctcgccgccctcggtggtgtcggcgccaggggctcccggctctggccggtcgaagtcgtctgtcacgtaggacgccattttcgtgttttttgtcgagcaaaaagccacaggaaatgcccgtcgagcgaggcgagggaggggccagggtttcgagaagggtacgcccgaaagcgaggagacgcgcggcgtggtcgacgagcaattcaggactgtacgcaggagggagactcggcgtcggcaagcgtgcacacttttcagtcgggggttcaagaaatagcgcgagtgacgggaaacgcatacatttcggcgggagaagctggaacgcaaacgggcggaatcctgcagagtttcgccgcaaatttcggtactcaggttcgggggtgagaagacttgcacactcactgggcagcgcggcgcgactagttgataccggcaagttgagcaactgtggcttccgccaaggaggcgaacctggagtctaaggtggagaagaaagaatttcaatgtttcaaagacaatggagtcgagtaccgaaacacgggaacgccggcggacaagcagggaagacaccgaagacacggggtcgggaaagggtgcgtccgcccaacgattttgtggcgcgaaaataacggacggatatgtggaaacggcaggtcaacccgcgtttttatgcttccgcagaaaacgttctgaatcggagagataggaatttcgcttggagtccccggcgggactggcagaactgccccgccgctacagcgaccaggaacacacacggggaagcagagggcccctggaagtcttggccgcaagagcagttgggaaaagcgagtctctgcaacagacttgctgagcgtgaaggaaacggaaaggttctagatattgactcagtcggacggtcacggatcgaagaagaatcggtgaacctccagggcttttcccccgatcgacttgcgaatgcggagggggggctacaggggggtggtggttggcaaaagtacgctttttgcggacccgccaactgggggaaagcgccgttggagggtcactcaacggatgtctgaccggaaaagtcccaactgaaagcgatttctgtccagtttctcgggtgtacaaacaccgggaagtgagctagagactgagtgcaaatcggcgcagtgtttcgcgtcagcgtggcgttcacacgcgcagttcgcaagtgtcgatttccgtaagtcagtttcccagtgtattgcctcccaccctcatctgcgtgcatgtggtggcagtcaagtgatcggtgcacactcaagtcggcaaacaaaagcggcggaactgcggcggtttgtcaatcggcggtagcagccgcgtaaactggctgctctctgctcccagttccgctgaatggaagagcgctcttgaggatggaagtcagcttcaggtatcctacccgatatgtaccggaacgacacaactcgcgtcaggccctgacgattcttctatgctacaccgcgaaccctggaaccccttccggtttttgcttcgcctacagcgcagcttctgcatcactcatctggctgttaaatctcaaagtacggatcggtcaaagattaactgccatcaaccctaagtctcgactcgaaaaagtttccacgagggagttaagcgaggaagtaacaccgccaccgggatgcgacacggacgtcgacggcatcgagcgtctcccgccaacaaacaatccgggaaaaggcgggcagcgacggtgactgcattcctcattactaaacctctcagcactccacaggaggcactgtaggtgcagaaataactgggaagagaagggtttacagtagcattcagggtcacaagcaatgtgagcattttattgcacgagcatgcgcgttatgtgagcacgtagacagcgtcagtcagagacgcgagatggagatcccggagtagcacatatgctggcggttcttttcttcggtggttgtttcatagttacgaattgacgttatctccccgggcaagtgtctgtcctttatcttcttgaggggctggtttctttcggtcgctgcctctgttgtggtgcctctgatccagctgcagtgtgacggacattttcttcagtttttcgacta

SEQ ID NO: 2097 - DNA, 3534 bp, Toxoplasma gondii
agcctctgtcgccttctatttcactctgcggatgttcaaggcaggccaactcgcaggggagatgctgctcagccaaacctgcacagctggacacaagtgagtcttctacagagagagcgtggaagcttcggcacctcgaacgcaggcgcgcgattcgtgtgaggtcctcggcgaactgtgtcgtgtcaggtatcctcgtgttgacagagaggttgagtgtgggctaacgacgcgtgggctcctcgagtctgctctcctttgacggacagaaagagagcgagagcagagccacaaggctggccgcgcggagctgtgcgggtctgctggggagctggagagacgcgcctgctacagaatctaaacgaagctgccgtgtttgcaccggacacgaacggacaggctcgccagccacggtgaccggaagtattcgcaaagtgagcactcaaggtcggagacggccgcgacagagaaaactccggtgtgggctggcgatgcacttgcgcgtggaggacggcgggccggcgtggaacagggccagcggtgcccgggacggagtgtacgtatattcacccaacttgaagagagtttgacagtgaatcgatcgaatcgcgacacggcgaatgtttttatgttccacttctgacggcagccgccgtgaatatcgtcagtgaggaggcctccgccagaagggtggacggattcctgacaccaagacaagcgaacaaattggcacggaataattcgagcagaagggtcggcactgcatgcaccggcgatggacgccgtgcgtggattcacaaagaacgcgacagaaagacttgttgaaagcggacacacactctgaataggtagcggtgttttcgtacacgagacaaccagcggatggaaaagatactctccagagaaaccggaaagcacgcaccacaacagacatccggtttgtagccagcagaaacgcgaaacgcggttccgccacctcctctcgacagagacacgcaaatctaagagacgattctgctgcaccaggcaggtggctgtcgcagtggggcctctctggatctgtttcgtcttctattgcttgaaggtcgggcagcagaatccagccatatcggtctcaggccgcgcagccggggaagggtctacgaatggccgaaagccttggctgggagtaactaggggacagtgcgtttcacgttcacatgaggcaaagtgcgggtacaattagacgtcacgtgccatgttcgagcgcaggcaagtgtcttcacggaaacgcgttagaagacggaatggggaaacggacataggaaaacggaaattggagacattgaagaaggacaagaggacaaattggttaggcgcattgactgagacgactgcagtggacgaggaaagcaaccggaagggtggagaccacgaaacggaggcgggaggcgagtgcgaggggagacacagccacctatgaaggacgccaagtgcgaaaaaaaggttttttctgaggtcgaatttttgccgcgacgggctgctgacaaacaacgtcgctctggggagaacgggttcactccgcagtgcggctggtgggcaaacccagtaaactgttcgggaaggcgcacaagcacgcattcctcactgagttggaactgggtagggccacaggcgttaacgaatactttgcaggcgcttgtctcggactacagagagctaccacacaaaaacacgatgaagcttcgggtcaccgacaccccctccgtggcgggtgagtcaaaaacaagggaaactaagcgtgaggggaattgcacgtgacggaaggtgggtactccacgagagagacgagtgggcacggaagagccacgaactcacaagccaacgaactggaggtaagagcactcccggacgaagaagtctagtttggacgcgcgttggagctggtgggcagtccgttcacttccgtcgctcgctaggatagccgtaaagagacatgagggaacagacagcacgattcgcgttgcaacgggaggaagaaagagttctggacagctaagactgccgaccaaaagaaacgccttccccaacaacacccggtaaggagacggcaacgtggggatgtgcactttatcgtcggcctgtttgacttgcggcactggcaagaacatcacacaccaagtaaagaacaacagtaggatctggcgcactgcagcggctcctcagtccggtctgggcaacagctctggtgcgcagggcagagacactagaagaagtatgcacttgtcgggcgtccttgcttgttccaccactgacaacttcccattagcatcatctatctccttcactctccgggggaaatatccaaaaggaaaaccaccaccctccactacctgttccccacgccggcgattaaacacgcgacaacctgtcgctcagcgtcgactgaactgcggccgccagatgacgctgacctcctgtagcaagcgcaaactctgctctgcaacttttcgttcaagggttgctcgtgctctgctgttaagtgaccacggcaccctatgcacacgctcggccgaacacacccgccaaaaacggacaccgttcacaaacgattggatcacaaaagtgtacttaggtgcgagtggctcttttagtgacgcttccttccgtttgtgtcttggcttttgcaacaacaacaggaactccggtcccacacgctgagctgagcaagcaatggcaattgtggctggcatgcagtgatccaaagtggtacgccagcgaccccccaaaacctggtctttttggctacaggagagcgaaatagacacgacaaagaactcgtctgtttgatcttcgaagcaaatttctctctcacttctccagagattgcaagggccttttgggcactcaagccgctggctgctctgtgcgctggttcctgtgagcgcaagcgcacggcatagccacgcgttctcgttgatatctccgtgacgtagagaaattttactggggtgctgacaactgttccgctgtgacgcaaatctgtccacgttgtccgccgctccgaatgagtggaatcaactgaagggtgagcaggatgggcttcattagtacacacaactctgcagtttacgagatcaaacgatgtctgcgcgtttcactggtcgatgcacaacccgagacaagaacactaccggaaggctctaggaacacagaaacatagcaaatggagtgcagcatcagctgtacatacagtggggtgtttcacgcttggatgcctacactttgccatcagtgcgatgcagtcgcggcgttcacatccagttgtcatccgtgaatcctggtcattaaagaatccgaatctttgaaactgacagaaccactcctcttacttacaacatcagctttgtgtctgcaaggtgccgccgacttcccagagaaaattcgaaaacgttgggagggtccatcttgtttctcgcctgttgcggaacgcacctgccagtctacggaaaaaagagacatacgagtactttgttcaacgcaagtcacttctaa

SEQ ID NO: 2098 - DNA, 1759 bp, Toxoplasma gondii
ttaacgatgtaataaaacgatataacgctcaagatgcgtttccaacgcatccaacggagccacgtttagtcctcagtctccatcttgaatcggatagcttgccagcatcggatttctcccataccgtatttggtacctcggctatttggaggacactgtcgacggggcattgaacagaagaccaacttctccacctggaggtctgttacgtttcgcttaacgggaaagatatgccggagagttagacgagcgttggacgagatcgtttcgttgtacagagtcttctcgtaatggccgttagtggctttttctttcttcctgcgactctgccgactccatcgtactatttactttcagttgcacagaatggaacgagtatccaggcaaagaacttggccttctacttttttgcgtgggcagctacctgcctcaagccggaacgtctctttgtttcccatttttcctttctgtgtcggcgagcaagagtgactgctttgtacctcgatttgtcgtcccccccttaaacgctttgtgtaattgtgtatatatgctaacattaagctaagtaccctatattattcaagcgtaggtagcttgttttttacactgcgaagtaatccacggtctactagccagtcacgtcgcaacggacagttcagacaattgtttgcgagtgactcttgagttgtatcttcgcccttttaaccactgaaaagagaagatgtgcagaggaaaccatcagcatgatggcgtagcgtctacaacattgatatatcacagccttttagcactttcccccagtgcttcttccgtgagtcgtgacctctattctgaccacctcacgtgctcatcgaatctccggtggctcttgctccagcaaaacccgttcggtgatgtcaagcaagctcttgcgattcaacgaaggagcagaagtatgcagtatggtgtgtcaactttctccgacagcattttgtactcaaaaagtcatgatggtgatgggagtctcgcacgtccggctcgagaagaccctattcgcgacgacgaagtggaataattctctgtgcgcccgagcaagctcgaacacgcttactgcaagttaatgtggagaaggagaatgaacaaatctctcaaagtggaaaatgtgtctgcatctcgggagaaaggtctgcttctgtatgagatccaaggtcaactctgcatgcacgcagcttgcctctgattgccggaagaacgaccaccgtcaacatttttcacagaacgactttttaaaaaacgaaaaaacacttttgttcgtcgcaattcttaaccgaggcgacaacgtaaatgaacgtgggagaacagatttttcttccgcagcagttcgtctgcactttcctctgtggcccggccgctagcgtggcttggtcaactgtgcaaggaacgtgcgaattctcagcggcatttttgcttgattatttaccgcccggcttgttgctgtacttgactcggtagcttttccaggttgcggggcttagtccactgcatacggaaggcggagagcttcgttgctctcctcgagaattgtggtcgtttgtcgcctcgtctgccgccggcttcgattctccgttcctcaagtttgcgcaggcgcttcgttagttcagatctgaaagcctcacgtaactttcgacgggcgcacacgttttcttctgcggagttcgccgggtcaacaaaggccggtactgccactttttctaggtgtgaagtcaggctgtggctgcga

SEQ ID NO: 2099 - DNA, 4344 bp, Toxoplasma gondii
ggcttttgcgtgtcggcgaaagcggcccttttccattactggtggcggggaaagtccatttagtgcggaactcgaaagtgtctcggctgcgtggggtgtggacgcgacgcagctctttttcccgcatcttccatcccacatgcacttgtggccgccagcagagaaaattgaagcgtggaggcgccgggacgaagaggctcggactgagaatcgcagctttctccagtgcaaattcgtcattggggtacgccacgtgatcgcgcacggcttgaaaagccagcaagagctgcatgcagcgatgacagagttttggccgattctccggttcttcacggcgccttcacattgccggttccggagtgttggtccgtcgagagcgtcagaagtggatggcgctgacccgaagaaggcgcaaataccccgcgcgtttcgacctctcggggaggaagaggcctggccgagactggaagaagacctttcgacagtcggtgagtctttactgaaaaacgacctgctcggggaaccgcgaaaacgccgaggtggaccgacgctcaaacctccggcgaccccgccttcccagcctgctgtttcgctgcttccgcccggactttcggccgggcgaaacgagctggggaagactcgggcggaacctgtctctggaaattcacctggtgctcaaaacggcgcgcgaaaacggactgatatgttcaggccgactgccgcgggcctgagcgacgattctgcgagtctgcagccgcgtgtgagagttgagagcaaggcggagaacgtggactggaactccgttcacttgggtgagcagacgagcttgtagaaaagggaggagaacgggttatgggggggagaagggctttcatagcgtgtgacaggggacggaaagggagctccatgggagaatgtagcggacgtgaagcgcacaggttgggtctgctggccatcacgccggagactccacgagcgtctgctcgagttgcgcggatggaagaaatggtggcagcagcttttttctttggaatgaaatcagatgggaaacagaaaattgtcgcagataaggctgaggaaagaagggcggcgtgactgatgaacggttcagttctctactgtggacgtggacaggagctgcagagccgttagaaaagaagtgcagtgtcagtgcctccatcgtttgcgaaaaaaacgaaacgttccccacacagctgcgacggagtgtgttgtgcaaaaccgaatgcgaaccatgtttctaatagacatgtttgtacggggttctaggtccccggtgaatacagatcgttctttccaaaccgaccttcggccgtttggacttttttaaacgagcaaacaggcatcaaacagatgtccgcggagtttttcatgcagctagaccacaaaacacaccaactggttacttctggctagggggtatgaatccgtcacggacgcacgaccgggagtacaactagatatccataacaaccgaagcatacgatgagtttagtaggaaacttcggtgcaggaattgaacagataacttacgaatctctggatacgcgtgatatcgcgttttaattttgcccctgctcgcattgtcttccatttgtcgcctactgaaagagattggtagtgaaccttcagtgatgcaaacactggggggttcacagtccctcaacaaaacgcgacggagaaaaattacaagaaccggtgctgattctctaggagacgttttccttatttctgtcctgcatctaacactgaaagaacgtggttatgtggagtccacactggggacatgcgttacggtcacaatgaactatgtttcttggaatgatgtaatgcttgcatgctcgtggtcactggcacctctttccgtcgtgcgcatcaaacgagtttgcgctttgagaactctccaactcctgcagctcaagcgactacaaatctttattccaggggtttggatttctgaataatagaacacgcttcctcaaagagcgaatgacatcatgctcgagtgtgtccttgcttgtgtgtcttctcatctgccacgatacatctagcgactcttcctttaccaaaagaagcaagtgagatccgacaaggactgccggggtgcatgtctcgttctcgattcagcgaccaatacccctgcactagtctcgttaaatatatacgaaaaaggtttagttgcactcgacaacttaggcgtgtgattctcgctccccgtctctgctggtcctcaactcgacaccgtgcttccgtgtatgtggaaaactacagagactgtcgctcctgagaaacatcgtcctgcgtcgagtcttcgagaaagaaacctgtgtttgaccgtaccctcgaattagcaaccgcggacaaggtgacaaagatcatagctaaacgatggtaattttcgcattgaaagtatattgcctcgctgcattgaggccacgagacgctgaaggcatgcgagctgtgaactgcaagtatatgatcacatgcctctgccgtctagtatcggatgctagtgaggtcagcataccatcgtactgggatgccagttctccacaaatggaattctacatattgattcatttacataaacgtgtatttacaaaacaaatggtactcagatgctagtatggtccgcgccatcgtaccgagagtcatgatctatgcggactatttataagcttttcaggggagcatgaactacgagttggactacgggttgacagctcaggcttttccgtgaaccagaaatcgcaccttcacgtcgttttcctctcatagggacttcggaccgtcctaccttatcgacaggttgtttctgtttccgttagagaggcttttcccatgcactttccgtgcgttgaaagcacgcgtccagtctcggcttccggacggcatgcagttttgactggcgttgtttgagtccactatctgtggggcatcttccctgcccgttgccggtgaggactgaaattcgtaagtggtccctggttcctcaagtaagatcgtgtcgtttttatcttcaaatgcattcaacacccaacaatccgcttcagtccttttcgcggaaggtttttccgggccaagtgtggtcatcaattttgtcggattctgcgaagacccgcctcgcggcggttcgcgtccggttgcgggactggtgtcaattctcgacggcgaaaaagcctttccttgtcgaaattcgcgcgcaaattgagtctttgagtcgccgagggccgagggaaaagagtaagcattggaacattcccggtcacctaccctaaatcaggctagagcctcgcggtccgtttgagcctagcatcgctcgcgagttctgcacggactctcgggaggccggcctaggtagagtgcgaggggaagagtcgtctcgatgcttcggaactttgttttgagcaatcgagctcgaagaggaagtgaacagctcattcgcaaacaacagaagttttttcgtgcaagtgcgcactttctgggatcattgatcgatacggcatcacttccgtccgcaagagtaacgcgtgcttcccggttctcgccgcgcgtgtctgaaattgcagggcgcggctactcacgagctactcacaacacgcgagaagaaagttctcccggtggtcactttacgttttccaaggtatttccacgtccgccaaccggacgtttttctcaccgggtgcagcaggtatttcttggggacaagccacagtcacccgagtctcttccccggaacttcagtcgagtctgaccggagttccctttgtacgtgtgcccgcggaggctgtgagcgggtgacgccatgctttatgacgaagtagaaatacctcgacacgcgaaaacagacaggcgaaaaaatacttcgctcggagcgacagaagaggctgttcattctggtgtcctagtttcgctggcttcgtgcgcatgagcttcttccggagtgcctcgccagctaacgtttttcgcgtttcgagcggaccagctgcgaattcgtgttacctttgagcatttcatttcaagaaggtgatcatttcctcgtagatatccctttgtgcccgtctacgtggcttgtctcaacgccgaaagcgttttctgtgttcacccgcggcggcgttgtgcctcgtggcttctcgagctgcccttcagtctccggcgtttgtacacgcgcctgcgccaaagggttattcttgattccctgtcctttcttagtgcaaaggacatggaggcgactcttaagctccctcccgagtgtaggaagcgtgagttcggtgaatgtgcagaagcggcagttcccacttgacttgggtttcgagtagagaataa

SEQ ID NO: 2100 - DNA, 1638 bp, Toxoplasma gondii
ctccgtcgtttgcttatgctcctcggctgccctctgtcgtatctcttccagaacgggcacgcggatggatccgaagaggtgggcatgcagctcgatcttaggaagagaagcaatttcctcaaacgacggtagagtggcggatggagacatagtggacgcctcgggtatatgaacagtgaagaatgaattcctggaatccgctgtggcacatcaagcgcagtcgacgaccttgagggactccccggcctcctgcagatgtttgctcgcttttccgtcctgtaggtgacactacgcgaagaacccgacttgaaagggaaaaagacttttcgcgtagactaccgtcgatattcgtcgtttacttccagtctacctcctcgggaaaagctgttcatgtctgcttctcaattaaatttccacgcgataaaaacccttcgcctgacgagatgaatgattgctagatgaggcgcgtgttacatgcgcacagagtacgaacgcggttcttttctagagtcgcggaggacgactgtgcgtgcggaagaggaatttctagatgaagtagctgtagaaaacttcaaagacagcgaacacatgttctgcttctgctgtgtttgaccttgtttgcacggtagaagaggctcagtgtgtcagcggttgacggggctcaacagggccgttagtgatcaatgtagggaagcgagccctcatacaaactcgggtataaggaaagggaaggcagcgcctggcgcagagggaaaatatccctttggctcagcctcgcaatggaagacaaacggaccagcgcatgtgaaaaccgccacgttcttaatggaagggtggactagtctccaaatttgaagcgagcaatatcgataaaccgtaactatgaactggtcaacagtagtttaccgctggtcgcattcttgctatcagcaaactgggccgacatttggtcggcgactgcgaaggccacgtattgacatacacagactctgtatccacaagcacacatacaaaaagacgagcactaccggtataatcggtatggatatgaatgtagtaaggtccttctaaagcgtatgttgctatgcatatctgggtattttaggtatggtactcagccttgaagatgttctgcgcaggcgggacgtggtgtcgcgattgcctagggaaaaaatacctgtttccgttacggtgtctttcgctggatgcatgcgcaccgtttggcgtgcggagacagtgacccgcctctgtgccgtcccgcgaaaggttgtccatggggccgttgcttcggattgtggtgaattacagaataaaattgtcacttccgcaaactccctctggtatttgttcctaaaccccagcaccgtttgagggcaacttgcactcgtagctcaaagcaaagcagacacgttgcgtttcgttcgcctcgctgttgaacgcgttgcgtttcgttccccccaccattcgccagagtactcgcttcttgtgtccttggaggggcgtttgtctctttcaattctctctgaaggaattagtgtctcactgaggagacccccgggtccactatatcgtctggctgtgctccgcagaaagaggcggactgagaaatctttgcggcgactgtcgacatcactggca

SEQ ID NO: 2101 - DNA, 2396 bp, Toxoplasma gondii
tctccttatctgtctgtacacctcacgagactgttgctcgtgctttccccaggcctccgacgctgattggtccagcgtactgcctctgcagtcgtcgtggcaggaaggagaagacgaagtctctgcatccatcgctccttctccgcatttccgatcgacgtctcgtttttcagcttccaaagcatctaaacaacgaagatggcgtccgtctccgagtgtactgcgagtcccgcgatatacacccggagtcgcctccgagggcggcaggtgtgttgggttgttctttggagatctcaagagtcgaatcggagagcaaaactcagacgagggaggcgctccagactgcttcggtgtcttcaactgcgactcgttggtttactcgcgagacagccggtcgcgacgccgagttcctgttgaggctcccgtcggcgagcgcgacaggtggtgaagaatgagcggagggaaggcggaagaagcagatggtcgaccggaaggagcaagaacaacgtcactgatgagcgcggttgaagcgtacttgtgcagagcagagcgcgtgcccgcagtgtgaggagtcgggagcggtaaagagatggaaatgcggagggaaaaggaagcagagaaaagtctggagaagagccgcaagtcttcgacaagaaagggaaggcgaagcaactccgcggaagaagtcgccagcgggatatgggcaagaccgacaacgtcggagaatcccgaaggccgagtgtgcggtctcagcagatccacgagaagagcgagagcggcggaagacacagatggggcagagagagacgcgaaccactgttcctttaaaagcttttcatcgagggaaggaaatcggtggaaactggacaaaagcttccaagagagtcttcagaaagcagtgtgcacagttacgactcggagcgcgccggcaggtgggcgcactcatccctgttcgccgggaaaaaaagagagaaaggcatgcgtttaacacaagaaaggcagatcttttttgcgggtcttctttccttctttcactctggaaacgtcgcgagcgacgtcggctaccaccggtgctcaagacacgcggtcaagtgtgtgcatgcatcaccttttctcaagttcgagagaatctcggcaaaccctataaaacctcgaccggcgccaggaagaccctctcgctcgccttcgaaaggtgaaaacagcgcagcggaaactcttctcaaggtggaccgcgctcttccacgccgggagcgagtagagtgagtgaagtgagtggagtgagtggagagagagtggagagagagtgtagagagagtggagaaaaacaatcgcattctgagaaaggagaaagtttcgtcttcttggcgaccagcagagttggtgtagtggtcatcacgtctgccttacacgcagaaggtcgcgggttcgatccccgcactctgtacttgcgcgctcaactctttcatcgaaggaactggatccttcaggttcttccggttgagtgtcgttgcttttttgtcggctgtcttgtcttggtagtcagacccgttgcaggagtcttttattaggcggttttcgcagttttctcacttttcttctgctgtcttctgctggaccttgttgccccgggatggatcggcggctccgcatgcacccttgttatacagccgcagtgagagtggaaacatgccagtcgcgcagacaagactcacgagagaacctgtgaagcattgctcagtgtctccctccagatttgaatcgcattcactaccttgtttttcgctcgctgtgaacactttagacaggaagaaagatgctgccattcgtataggcaactagggtgcgtcccgagttctccggtcacgaaggaatcgttgcatgcgtagatgcagtcttgcggaactcgagcaaggcgcgtcagcgcttcgttgtctcctctcagtgtcgcagctttcgtccaaggagcttgtcacgactcctgcgctccagatgcacttggtaaaaacgaagaagagagatatgaatgtgacttttcgtgctattgtggtccctgggtgacggcggggggtcgtcgaagtcgtctctctcgtctccgcgttctgacgaagtggagacacggcaaactcgggaacagaatcatgtctcctctctgtattatattggatgtgtttcccgtcaggtctctgcattctgcagccgtggttctggggtgctctgtatcgtttgtgcctccatctgtgcgtcgaagacgacgctcgctcacctgtgtttgacgctgaagaatgccggatgagtccagcgaaacgtgcctgctttatcggccggcgcctctgcatttcacggcagaccatgctggggccatccagagttctctagcatccagcctgggcatcgaa

SEQ ID NO: 2102 - DNA, 2917 bp, Toxoplasma gondii
cgaaggaagagcgaaacgaagaacttcaagaggcaactcaacaacgcaaaccctctgaaggggagagagatccgacgctcagctgggacgagtcaggcgactcgacggagacaacggaaaaagcgaaggcagtcgcggcggaagaaggcgaaggctcagaggaaaacggagacagaagccgcagcacacatccaacagcagcagagggaatgcaggagggtggagaacggctagaaagcatgaaaagaatgaagacacacagttggggagagcaagaggaagatcgggaggacctggaggacatcctcgcagctctctaaggggttctagagggtgtaaactcttgcactcttttgccagttgtctttctctcatgtcgtctgtagaggatgcgcttggaaaggccgccttgctgattcgtcgtcagccacagaccgcgttttctccagactcgtttctgatctgcaggtagagtctgccggggattgctcggactgaggcggcgcctgcgttcgatagaaagcgggctgcgagcttcaaattcttgtcaattcagtgttttctctggagagaaaggaacgattcgaacatgcttcacgcaaaaaaaaaaacgcttcgcgaggaggtgatttgtttttcaggtgtctacgcgttccatcttggtgtccttactctttctgtcgttgaatgcttccccatctttctctcttcctcattccctcttagatcgcccccttttttcgcagtccctgtatctcctcctctcccctcttcctgccaatctctgtctctctttccatctccttctctcacttgctgtctcttttctttatctctccttctggttatgcgtctctggttcctcccgccttctctatcgctttgccgctgtttcgagcgctgcgggaacttcccctttcgctctttgtgggcttcctgtctggccaaacaaagtatgccgcgaaaactggcgttcctcattccctggcgagccgcagaggccctctctccacttgctgcgaactaaaccaagtagaacgtacagatgcacctcagactcacatcagagatcttgtagagaagagaaaaggcactcagcgtgctgtcgcacctctgcattggggttcggaaggtgctttcaaggacggacgcgctctcctctttcccaggacctcctctgggttctgtgtttggagctgaaagtctctgttcggaattcggtaatgctctcgctcattagtcatacgccatgggcgcatttcagatgccagatcgtccaccggcgaggttcctgttgagacactctagggggtttcttatttttcttccttccttactcaagacatgcaacacgattcagggtatttcccggcgctagctgccaacagccttctttcgtttcgctgcgtatcacactgtgcgtgcctgtgtcgtcgtaaaacgcgattccggttgtttcacacacgaaaagactccacgagtttcactcagaagaattcaggtgccggccacacgtccgattcgcagtcacgtgcatgttttcggggtcacctgcgaagcggcagcccggtcaccccccataccagtttttgctgactgaggaggaaagcgcgacttttcttggagtctcggagtcacttccacactgttcgtctgcgcctttgagagacggagtgtgccggatcccgcttcctcgtgctggacgggtgcttcacgcctagagtttcacctaacagaggcgcgaaagacgcgaatcgtccgcttctcgctttttcggggagagctggtcacgtttgactccacgctggtgtgtcctgaggggaattttcaacttttcccggaaccgtccgccatccttgtgtcgagcgagtgcgtccgtgctctgcagcagtgcggcgtgcacagccgattctcagcgagaaactgtgaaaaagtcaaggttccgatcgatttcttcaacggcctttccgctcgttcatccctcaaggtgagaagagcttttgttgggtgcaaagcctctcgaacactcagtgtcttctcgctggaatcgcgtctcaagcacccccccccggtctccccgtctccggccgcgctgcttccactctctcgcggtatgcgcgttccagcttaactggcgaactgcgtcgagactcgtgtcgcggctctcctactctggcttcgccttttaacgcaaaacttccgaagctgacccctcgcatccagcgcagccttgcttgtctccgtgcctgtggctgttcccagtttcctgtttctttcgggtggatgtacacctgaaaagccgccgcgatccgagcctttcgactcagctgcgcgagacacaccgcagtgtgacgtctcctggtcgctgatttggccaagtttcccctcttttttcttttcgtaactgtccggtttgcctttcgagtgccttttcaattatgtcggaccgttcgtgccttctttcgcgtcatcgttcgcctgttcgatgcgcctccggactgtctgccacgcgggtctttgccccttgtcttcatcgcagcgtctcctttgcgacttgtgcgtctttgctgcagccagccgaccgaagctggagtcacctcgctgttcccttctcttttcaacgccgctttttccgtttctgaggaaaacagctgtcggcaggtcgacggagagcgacttccctatttctgccttgccggtcgctccacctggttcctcccgcggcaaccttcgtccccgctgccgcgtcccgctgtcttccctttcctgttcggttaccccccctctttgttctttttctttcttcgttcctttccagtctctctctcctccccctcctctcctgcgactcgttgacgatgccctgtggaccttcccgaggcggtttgtgaggcgtgtcggacgcgtggagccgcga

SEQ ID NO: 2103 - DNA, 4904 bp, Toxoplasma gondii
tttacaatgaatgcgctcacgtacgtttgctaccacgcaccttacagattgacatgcatcggaggaacagcaaacgagtgttgttcgcggatatcaagtaatgtttcaaaagctgttgagtgcgcgtatcttcaaaggtttttgctttggaacttccggaacaaaacctgtccgtggagtgtacgttgtgtacgctcattcaccgctctgaagagttttgagttttcgagtctgtccgtttgttggtccaagcggatgaaaaaacgaggctgagcattctgacgagtacacaggcacttcccgttcgacgaggtagcaagttcgtaaaattggcattctaatcgtgtaacatgtgtgagcactattcgctccttgacctccaaacgttatagcgtttttgcttgttatcgtgtgcgattagaacggcagacgaaattactcttcattgaagtgaatcagcagtcccccatgtaaggttcaaggtacaccgcaaagaaaagatccatgatccgttagatggaggcgggtgaaaaactgttctgctggatcgttcgtcagtgctactggtgaggagaatcgaacagcagcttgcagaaagaacaaaggacactgtttcctcctgtgtcctgtactaggctgcttgatcacccaaaaaactctggtcacccacaggacaacggctagcgggcaaaatctcaatacactgtagaccaaagagcaccgagttttgcgagctcgcttggtttcaagaattctcacgtgcagacaatacaaagcagagcactctcattgcagatgctaaccttgagcacaaagggcaaacgaacggtccagactgatgttggagtgatcgctcgaatgaggcttcaggcattttgacatttctggctagcatcgtctgcagcctatcacagaataacggtgaagaattagacgagccttgggagtgggtgccttctcgagaaacacaaccattctttctctagcgcggttggttagttgctgctaaaaccgatattgccaaatcatgctcagacatagccacagccagctcctcgcgggcacggccggctggacgttctgtgacttccggagtacgttttctttttttgtgaggtgtcagttgctctaatgcaccgattgacgaagccgcgtggaggagcaagtccttcctccgtttcgtcgtaacatttataggacaaatgtagcgcttctgcgacggagcagacctcttgcgttgtttgtcgtcggtgactgtctggctggcgcatagtttcaagatgagcagggtaagtcagcaattcagccacaagggaaaaggaaatctccgcgcaccgggaggtcgcacaggtcgtggcactgctgccgaaaacgaggaaaaggtaagagctgggacaaatcctccgctgaactggcgtattagcgatcgctgcatagtcagtatagcgtggcatccgcctgagaatggatacagatatcgcgtgtcttgcacattctcggatgtgggcccgcaaatgacatagatgttgagaggcgtcaggtacggccacacaagcatccgtttagcggcttctacgaagcggtaacccagcacattgactagctcactataataagaccggtatttacagacggggcgttctgtgccgcatgccttgcatgtaaagtgtgctttgtatggttgtttttgtatgcacggtatctgagtgcctcatttacttgggtagggatgattgttctattgcccatacgcatttgctctatgcacaactactgtttcgcatatggaaggctgtgagtctgtgttgtgctgtctgcctctagcaacaacacccgcggtctgcgaaaacagaggggagatctagaaggactcctgaagaatgcaaagcattttcgaagtggtatgaaactaccgacacctcggaaggagcggccaacagggggagcatgccaggcgacgaaggtgcggccacgtcttctgacctgaaggttgttattgattcctcgcatgctcgccctcgccgagccgttccaaatcagcacaggccgcctccagcaaataccgaaagaaagtcatggagagatcgtacaccgtccagaggggtctcgaggaaaccacagcagctcgcttccctaccaaaggcaggcgactctaaaagatggattcccccgattcgacgcaggaagaacggtgagatgctgccatcttaccagttcatgtcccaagcagacgctgccttagaaaaagcggcaaggattatgattgcgaaagtccaagcaagtccggcagcggctttgggaaggggcagaactcctcaggatcccctctcaggcaatgcatccgttagatcgagcgactcagagtcaccgaggaaaaacaaggctctgacaacacgtaccactacgcataccatcgaagcagaaaccgaacatgcacccgtgcaatatgttcctgaatcaacattcgatggttggaagtatgcggagtggaagggggagaaggaaacggatgacataaagtgtgaccccgaggccgcaccgcagaaatacgtcaatagacgtgctagagcataagaatgaaagttggattcacaaattccgtaggatgaaccatgcgtcaaggaccgaaccaacagtgcatgtaccggcactgccgagttgatcggcatgcgccaagtcccagcggtcaggcaatatgttgtcccgcagcaaatgaactggcgtgtgggaaaaacaaaaatgctttctcctgaagaggatgctgtggccattcattcgttctcggccccggcatatgcggtcgacgtgagccgcaccagacccactcgatttatttgctttttaaatcaaaaccagagtgaaagtggatcgaaacgggagaaggttgctcgcatgagtatgacgcttttgaaaagacatcccaaaaggcgtgacacgtatctcattggtgtaggagatggaagggcttctcccgtcggcctcatgttgcacaataggcacagcgatacgtgcacaaatattacaacacgtaccaaacagggttctgcatgtcctagctttgtactggattcaaatacaaaaataataaatgatacaacatgttgaggagcgagagaagcccccgatagtctaatgtgttgcgtacagctctcagcagcgagcatggcacgcctccaatgggatgtctccacagattgtaggcacagacaacttgtgcgccaacgcagctgtacatctcgtcgagcgtcgttttcaccaagcgactctccatgcactgattcaccttgcttgtgtagtggtggaactaacgttcccagtgtgccgggacaaatttgcttcgccgccacgcttcgtgaactgtccgcccaggagcatctagcagcgtctatcgacttacgccgttccctcgcagtacgcttccgttcgccatacaccatgcatgacactaatacgttctttcagagcccccgtatttttcacaaaccctccacgcgaaagtaagcggtgcgaaggcatgcgtcattcaacaaggttgtgcgacgctcgcagatcgttcatcacagaaactttcgtaaatactagcagatgcggctgttaatcaaacagttgatttgaaacgttcacccactggttgacttgatgaaacaacacaacaatcagtcttcgccccgataggattcctattaagctgctgttttcgtagacagatgtgatcgccagccaatgcacaaaacgtttttgaggcagagctaagaactatgtcccgaaaaactctcgtcaccttgcttgactgagatctggcttctgttttatagttgtatatttagatatacttacgatacagactaagcttcagaagcatggtatcgtggttgcacctgactgaagtttctcgggcgtgccgtcgtgatacctctagtcactccccacgatggtcatgcatgttgaggaactaacagcagtgacaagacaagcttgtgtggaaattcgtgagaacagtgacatatccagttagagatcccagacacatatcgctcaagaacacggcagcaaaccacacggaggaaaggaagacggtgtccgaagtcagagaggctgcatactatcctctgcgtgcatcgttatcttcccttcgtcgtccgtagtgacagtgcaaactactgaaaaccatttgggatactttcctctcaggttgctggcttttttttgcgcttttgtttcttcttgctccggtggccgtgtgcatgcatttcagtccacaaatcgcggaatgtgcgcttgctgggacactgcctgcacagtgatgcgtctccgctggacccatgggctattttctgccacaagatgttgtaaaatccgaagaataattcgctgcataatatcttgaaagcaagtgtttggacatcttcgtcctgacaacgccgacgttgttttctctcaacgattgggcttcgggttcgttggatatccgactaacccaggcgtagacctgcgcgttcctgtttttatcagcttttgctcgccccctctttcgtctacgagtgaagcctatttttgctgtctttttcctttttcgttgctctcgctttctctgggcgtgttccttcctgtttgcgcagctgcctcgacgagatttatccgacggttgccgttcgtccaagcgacctttccggagcattctcaaggaccgtcgtgggtttgtcttgtctgaggagctttttatcgcagctttcttcgtttgtgttgtattcgtttttcccgttggatggcgccgatgactgtgcctaaccgcttcccccggtgcttgcacccttttcccccagcgctgcgttgcgcatctccagctgtctgcgaatgatgtcacggtcgccggcgttgtcccgctctctgtccacttaccaaaa

SEQ ID NO: 2104 - DNA, 1892 bp, Toxoplasma gondii
tcgcttcttttcgtagcttttctgtacttgtttcttcctcccttaatatccctgaactgccgcgctgtcctccgtttcccccctgtttctcttcctcctcttttttgttgccttctgtcgtttttccacttcatccgctctgcctgcttgtcaaggagctgctcttcccccacagcgatttcgttttgcacctttcggacgcaacgaaaagctccacgttcctttcttgtccgtcttgatttttctgaccaactttctgaccatatgtcgattttttcccgttttccgggtctcaaatccggttcacagtctcggggcgcacaggcgcgaagtttctactcttctcacaaaaaaacgaactgaaaacgcgtggtctccccgaggcgatacccgcttcggttgccgggtactggaaaaagagagacgatagttagagcatctgctgggatatgaaaaaggcaacacactgccactgaatagacacctgccttcgtcgagaatgttctgctccggagttgcgaagacagactttgggtgaagttttagaatattttcgcagcggattcaaatcttccgacaacgatattgttgcctccgcttccaagatctgtatcagcaataaagtgaccctgcgcttgttacaggcttcatgtgttattaatcgtgactttctcattgaaaggtggcagaggaacggagcacggcgtagaaaattcaaatggacacaacgtctaccactgacacagaaaatgagtctgtttcctgctactgacttctcgttgtctaatttccacgctgtcacaggttttgaaacaacaatgaaacgcggttttcccgctcttttaccgccagtaaacaccagagccgatttcgctggtgtgtcgggtttcctttcaacacgcttttggttctgaccagtcatgttttttctgtttgtgtttaaattctttccggagttccctaatcgcggaaacaggaagcatcgtcagaatcaggttttggaggaactatgcgctctgcgagcttcgaggatagcaaatgcggataggggagaaacttagaaaactattttatgctgtgtctagatatgtagtaaactcatggctacatgaggcttgatgatgctgtagacagttgtgagcactgcatatattttacaggttcctgctaccttcatgtttgcctcagcgggcagatttcatgaaacgcctttgtgagaatcagacttctgtccaatgtgttgtgggtgccacatactgtcacagtttcagaatacattgatgctgacccatttgattttctgtcgatgaaccaagagatatgattctgcaagctctttaatatggtcactaatgtgtcgccgtcgtcctcagaaaagcgaacaggagaatggggggcttgttttccactgaagcatttcaagctctttttttattggcaaaaggagccgcaaatacgagagtggaacagagacatggatcgctggtccataccgtatccgggcgagaatttactcaacctctcgagttcacctcagactcatctccagaaacatccacaattgcacgagcttgaataacggccttatataaagtgttcatttcttctgtgcatcctttcatcgacaaaaacagtaagcagtgtgcacccttgactaagatcgtcgcgggatgcccggggggccacgcagcgcggcacgcatccgccttgccatcgagtcgccccagaaatccaccaagcaacggctcgggcgatgttccatgcgctatgtcaggcggcggatgccttgtaacactcagaagcaatctgtattttcgagcttgcgtcttcggctcctatcgcgttgtctgtcactttgacttcgcctcaatttgtcttcaatctcttcacaa

SEQ ID NO: 2105 - DNA, 3841 bp, Toxoplasma gondii
gtctcttgcaaacgtcttgcctggcagtcttggaagacctgatcagacacctgggcgacttctcgcgggggccgaggcctctgaggctgcggtacatgaggcgctgtctcgcgcgctgcacgcgcttcgcgttcaagggagttccaggcttcacgacgactccgtcttgcctgctggttcttgtcaggtgcgagaaggaaaagagcaagaacttgacatcgcggagagagctctccgtttggcggctgctgccgagacagcacttgacaacgtgttaatgtcgatattaaagctgtcgccgacttgcgaagatgactcgagcttactgggacaccaccccctggcgcgggagctgctggagagcttgaactgtatgcattctttcggcgagtcttccgcgaggtccaacgcggtcgcttcggagacaggccgcgccggcggccttggcacaaccgcgagcgagtgtgggcggtttttctctcgagacaaacagggcggagaaacggccgagatcgacgccgtggggacgcgctgcgagtggctgaccgacagtgtctctttgctggaaaagcagagacggttggccgaccagcgcagaaggggggaagcgcccgagagtgaactgtctgagaagcgtggacgttgcttggcagaaccacgtggagtcgaccttccggcaatttacagagagagaatgcgcagaagcagagaagttttttgcgccatggcaaacgcgcgcgactgcatctggaaaacgtatgcagcagctgaagagtccaagcagaatccctaattcaggtttccaaaacgaaatccgaagaaaacgattgttcaaagcgacctgtcaaatacttcggcccctctctgccttggtacaatcacatatgcatgcatgcttgtgcgtatgtgtgtgcatgtatacgtgtaggtggatatgtatgcgcaagtccacatacacatgcagatgcttaagtacgtcctgtgagacagtgggaaaagtaaagctcgcgggctgttgggttgcatttgctgagggatttttcgtgggaaggtggtgacagggttggcgatggtttggagaggagactgcttcagggacggtgaagagcaagtgggtacgaattgttttcttgtcacgtttcttcgttttccgcgtgttcgctgaaaagcgacgcttcgagagattcagagactcgcaagaaattcatttgaggacgcgaaggctggcgggccgtgctggtgtggtcgccggcgactcttcggaggacacggaaaattcgacaaaagcagcatcgaaaagcgacgagagtggatctggagcggcagacaataacagggctgccgacaataataggacttgactgtgtgccagtgaggatagactactaccaaatccataatcgttaggtctttcgcacagactaacgctaggaaggagattagcaatgtgtgggtatcatgatgtgtgtatagctagtatgaaaatggtggctgttcgaatttgcgctgaattcggaatacacccacgcctgatgcatttgacatggccatgaaaagcatgttttgtcaccttttcgcctcgcttttctgtctcgtcacgtttaaaaagcaaagtagttcgtctgtacttgcagtgtctcttctatcacccccgcctcaggacccgcagaggaaagctaaagaggacattgtttcacaggtcacatatccaccaaagagccattccagcttgtccaaagtgacacagaccgcaggtaacggcaggggcaaagtcccgcatctaaatataaggtctacaaacgcacgcagtgatgcagctcacaagagacaggggtgcctatccagggaggcagtatgagcgagtggtacgttggatttcggtttcttgttgcccatggtgaggcgctgcactggtacgacgctctgtgctagagaaagggtgttcttttgtcttactgcggccacacaaagaaatagataatcttatagctgtggatgtgcgtcgcgcagaaaaggcagagatgtgtgagacatccagtcaccggaacgctccgccttaaatgcggttgggcacctccaccgttgccaccaagaagacaggctgccaacagagagtcgcttcttcatgaacagaaagttcgcatcagcatgaagttcatatcataacggttacgaatcaacctatctttcctagttacgcgtgtgtcacacaggtcgctgatgcgcacgtgaaaaagaatcttcagtcaggccggccactacatcttcgacgcggcgataccagacacactctgaagacgtgaacctggaaaacaaagtatctcgccgcttacgaaaaagtggaaacggagcattgctgtgttcggacgtgcgcctgcgctgttctgacgactttcaacgcagccccagaaacagccaggttttgcttcagaggaaatcctacatttcattggaggacgacagttaatcgaggagttgcagaggatctagatgtagggttctcaaacggatctttttctgttggcgtgtgaaggcaatttaagagctttctctgggtaggacggaaggacgcagcagctggaggcgacacccccgcccagaacaacgcagtctcgggcagttgagtcgcgccgcggagaagctggccaagtcactccaactgcacagccaggttttcgttggattttccgacattcatcacattttcaggactgttacattgcttggctcttgcccgattgcgagctagggaactgtgtccgcgaaacgacgtttttcccgaccttcctcggtaccatcgtccatccctttttcgtcggttcctaccctcgaacctccccccccccctcccccgcctctttgacggcgaaaacaggaacgctacgattgatcgatacctcaagttttcgacgcatacttttagagtttccaatcttgtcttatgaatggagaggaacgtgagggaaacctagctatttgtcctcagcccggcttgtcacggtgcccgccctgggaagacacccctgccttgaacttaatcaagcccaagcagctgggtaaattctggttttttattcgtagcggggtccgcattcgtctcggttgttttcaaggaggacgctaccggtggcgggagctgctgcctttccaagctccgtatttaaccgtgggtgcttgcaagctgctgagcaggcatctgggtgttgcgcgagcaagaagtgaccctgtttcactgcacgtgtctcttgtctggaggtcttttttcctccatgtcgcggtttctgaaactttaggtattagcgtggatggctaccgaggcgtagttcgcggaaatctctctgccgtgtcggcagcgctaagagctaaaggcagatgcgttgtggagagtgcttcgttctccgtcgtctgaaggctgcacagaagcctcattatttcctctccaacttttctgttaatctccttgtcattgctttttccgtctggcgtttgttggcgaatctccagggtgtccgtgtgcaggtagcgtttccccgaaaatggatcgagggaagcgtctgtctctggatgtgccagtcccgtttctttttacttcggcttcctcgtttacggtctagggtgagaagagcgtccttgctctttcaacccgcatttccaagctcgtccaggacgccgcatcgcgggtgagctgccgtaaggaagcctcccgcgtgcttactcttggcttttcgcgctggaatttctcgccgaagtctgtctgcctcgagtcttttgtttccctcgccgttcttgcatttatgttgcgcacttcctcggccgttcgtccttttccgatcgaagggaa

SEQ ID NO: 2106 - DNA, 2297 bp, Toxoplasma gondii
acctttttcgaactactttcctcgggcacgcaagcttggctggaaacccctcattcagtcagactgtaaatcatcaggattgcgtctaatggacataatggacagtccacaagtgatgggggtctagagaaaagggatttcaaagtggaaaatctgagggccgggaacaaggacacatcgtggttcctcattctgtgtgtttcccggaaatatttgagagatatcgagagagcgcattttccctggcttatggaaaagacgggagagagctttccggtaggcacaagggcggtgtggccatgttgtgcagtagaaaggtcgtccgaggcgctactgaacgtgtttgacagtgtagaagccaagacacttcgtgacagcaaagtcatttcatgccactacgaaattgccacagagcatagcatgagacagttatgggtgacacaggatgaactgcaagtttgaccaccatattcaggcagtgcaaagatgtcttttccactgataaccacctgccttccgtccagtatcacggagacctgccaccggcaagggggaccatcagcagagtccctctgtgcattagagaaacaatggctgggctttcgacacacctcactcttctcacaaatgctcttcccgctccaaatgtccatatcaccatctagcttgtagagttgtgtgctgtctcttctattcacgtcatgcctagttgcagccagcaagcgtttcgctttatttgcctccttcctctgttgacaggagaaaggctttactctctggacctcggcaccaaggtgaaaagcacatagcctacgcgctacgggcatcaacttcgtggggaatggactgtcaatttaatccgtaaggaaaagcacacctgttgtttccccgcatgttacccggcttcttgaggtgttgcgttttgaatccgtcccactgcaccaccttttcgactaaaacctcaacgatggtgccaactatgttctttcgaagacaccttctggcctctactgctacacttgaaaaacctagggagcccgctgtagtgtgggtttttgtgtctcgacgactgcgttccagccatgacaacagttctcacctccgcagctctcacagcaggaggtgactgtaaaagagatagctttcactttgaagtcagaaatggtatcatgggaaaattactccaagttcgaagactacaaataccgggatgccgctctcgtctcgcagtctcccgcgtgtacccacacctcgggtcccgcaattactagagttactgccgcgtgacgcaaaaatatcggcttcaagtataagtttactttccaacttcagtacagacagtgccaccgtctaccactgcacaaaaagtctccaacactttggtgtgctgtacaaaaattgaacaagttaagtgtcatacgagggggattggaggtcagcagctagctgacccgcgcacgcgtgaaccgagcctcttgatcgccgaagggtttagggacccgactgcgggtcaaaacgactacggattaggtgagaagaaaacttgattattcgggtttcccgacgaatttaccacattcagcgatgccacacaaaaagaagaaagttaggatggaaggaatatctccttcaagacttacaggaagggttgaccgtccgcgatgctgaaaactggccggtgaacggcatccgacaggggtgacgccagtcgttgcagctgggcctccttccacatagaacagttttttctttttgatgaccgcaagtctaactgttcccttgagctcacgtactaccttccagagtggtgcagcagggtaggtatcctgcacaccatttactcgtgtcaatgtttcggctgcagttgcgtgcccgtagtatttgccacgccgttgcaagtgtgcagcaaccctccggcaggaaaagcgcggcggtgttgcatttttgtcttcaaacgaaactggttaacttgagaaggtcctcatgttggaaaggcaccaagccatccacgacatgggctccctctgctgcgctgcctggtgtgtttgtcaacctgtgtctgtcgttcatcgtagtaacatgtccgcaggccatcgtttcgccgacactgactcgcgacgttcctccacgtcactttgagcacaaccagttccgtctacccccacgctgttcccactcagtcacagtgccgctttttttctcatccgaatgaagaccacactgcttcttcgctcgttcacgagagaaatctgctcaccagccggtctattccacctgcagtgaagaacatcgcaaaa

SEQ ID NO: 2107 - DNA, 3894 bp, Toxoplasma gondii
tgtgaatcagtagtaatcaactcgaagtgtccttacccgtcagaacaaggtagaataaaatggaaacttcggattcccagtgtatacgctttcgcagagctcgccgtacgcacacgcgtatcaaacgttctagaagtgaatttacacaacgcagcaggctctcgcttggaaccagcgctctgtctctttcaagggttttgacgaccggattctaacggttttttgtccggtctcgatattctctcggttgcgaattggaatttcctcgtggaggagccgccggagaagagagtcgcgaagtccgtcagcagtctgccattctgctctcagaataaaaggatgttcctgtgtgtcggggttttctctacgtttctcgcttcgcagaagccgacagtttccagtgccacaataaggaacgtaactttgtttttcgcggcgaagtgccggaaactgccaggagaccacaacgaactggaacaaagtgtgttgaagtgaacattcatgcacagttgtaaagacaacctttcgccaactgttcgttgaaaccagacggttttgagcacggtgcgtgggtggtcgttccgcgatcgtagggcttacatccggtcacagaaaacagaatttcctggcaaagaaccacggcgacccagcaggtgggaagagtgatgaagttggacttcacacgggaattccctcggactcttaagtcgtgctgcctttttgtcgtttacataaacgtaaaagtgccagtcaagagttccttcagtccctttagctcgctgcaagatcacagcagcggaaaaagaaggatgcagaggtaggtgttcatgaaattacattccgaaggccaaagagacgcttatgtctctctgtttattcggtctcaactacacagtgcaggatcctgcatcacgcatcgacagctgttgtggtaaacggcattccattcttttaagatactacaccaacaccgagtcaagaaacaggacactctctcacatctagtgtcgcagacttcggtatttacaagcaaagtagttttcaacttatccatttgaaaaccccgttaggaattcgtaccggcagttccacagcgactcatgcctctgtcgagaggtggacgggggaaaacagtcgctaacatcagtgaataaaacgatttggtaaacgttttagattgttgtagacgtaacagtctgataggaagcgggtaagcctgtagagagtcacttctggtgagcatccacctcatcaccgagtgctgccctctcgcttgcttaattcagagaaacggttgacaaatcggcagtccagttgtccgaaatcacccccgtctttgctcgagttcacgccagttaatgctaatgctgcgttcgacaaaattgctggacaaaaccaaggcttttttgtagcagacatatagcgatgtgtgtcgaaatcacttatcgtggatcagctgcgcacaaaacaacagaaccagtatcgtgcgtggtggtggcctatacagtctgtttctatgatcttgtttgtcggtgccagagggtcaagggcatttgagaacatcgcaaactgttcattgtttttgcgtatttgtgaaaacgagtcaaacctggcaacaggaggctcagaggtgccgagctgcatggccctcaaaaatttcacaaactgttttcggatttcgcttttctctttgttcatttgtttagactctgaatgaccgtgcactttggctgaaaaaaagaagcaggcaacaccctcgtgagaagtcgttgtagattcactgtcgtggcaaccatatagcgaaatttagtttggcacacgggacctcgattcatcaccgttaagaatgagcactgacggcgttaacgtcgctgacttctctgacgtcatgatgcgcgacttggatgggatcaatgtgttcaatttgagatttgaggataagaaagcgggagtggaaggaccagaaatgtactggtcgggttcattgtcagtgcatttgagtgctgtccctggcgttctagggcgcagcatttctcacgagagaaactgtttctcagaacagcaggccttatagagttccctctgaagaatctagtgttgccgacggcgaaggatttgtgtcgagttccagagaaagatgcgtgctcgtggtgcaaaggagggttaactcaagaaacgcgcgccacgcgaggggcgcgacagcttgcgaaagcgtgtttcaagctgcttcggaagttgctgttttccctcatagtctgcttggagcaaggcgtctcaaacttttatccagaaagttctccaattccgcccaaggctaaagcagcccccttgcagaggccacacaggacagacactcgctgtcgcagaaactcaagtttctttcgcttctttcatcgtttctcttcttcctcggggacaaacatctcatcgtggtttgatatttctccagagagtgaatcagttacatcgctattaagtggtaattccttctcctctgagaagcctcaaacccaagcataagttcaaaggttctggaaaacacaccaatactaaaggaatgaaaccgggttccccttcggcgacgttgctagcctgctttaacgaacagtgcttagttgcagagggattgcctctctcctcttaaagagcagaagcgacgacagaggactcctctgtcatagaaaaaccaggtggcacacgaaagcaccagaagagttgacagtgggacaggagcaaagacgtgtggatgaaagcggaagaaactcgaggcgctggcaaaaggggtcaaaaacgaggcacggaaagccagtcaaggtttcttcatttcccttcatcgcgatttaaagatatatatgcatgtgagtttttcatcatcgccttcagcctgcgtttttaacaagcacctttcatcgactctacaaaattcaacccgcaacagtgcatatctctgcgtagttctctttctacattcgcagatgttcgcgtgtttcgtcgacaaacaaggataggcgcgcaccttctttcgggtctggtgacctcctttcaaatactgccatttagagtgtacagatctataaatccgtttttacacaaagtccaacacgggctctcctggatgatacgccagttttgagagcacacttcaccacctttacacctccgactcttctgctgacctgaaccgccgagtatttccctttcaacatcgagttccgagccgcagccccgcttgtgcgtttcaaacggttctcccgtgactccacatctccttgacaaacagcgatgtgtacacgcgcgttccggaatcttcctgcccaatgccgcaaggatcccagagggcttcagtccgcgtaaaatcgtcaagcgagttggtgctgcagtttcgcaggattccccgcattttcgtctcagcaaagaacaacgacaaagctgcgtctgtgccaggcaaaagcctaaacgtcgaactctggaaatgtgaaactccaatcgcctttgcctctgcaagcccctgaacgctccttttctacagcctccgagcctgtttcggggagagcactctggggcgctgttgcttttccgcgcctttcaccgtggaatgatcttcgaccacaaaccgggaagacggcagtggcaactcttacggacacaccggcctacttcttttgttatccactgccttgaagttttcctgtgtggcagatcttcgcagactttgttctggtgtacctgcactggaagccatctggatatctctttctgccatcgaaaaaacgcttgaattcctcagagaacgcagcgtcttcgttgaacttgcggagaagagtgctcatttcttcaacggaacaaaaggagtctgttcacgatccacatagctacctcccagaacggtcagaa

SEQ ID NO: 2108 - DNA, 2401 bp, Toxoplasma gondii
gatatgggaacctaccgcttgagctgtattggcaaagtctccagagacccgcgtagcttcttcagcgagttcgaagaaattttttctgtcttccagtcccgttctcgatgtttcggatcctctatagtgattctgccggaggccttttttcccgagttgagcgcatccgaaagcgactagggagacgcccaaggtgtccgcaccctgcagaatcaccggcgttattatcgagagagtgagtttcaacccgtatgtcaatgcgacaactgctgctgcatatgaagcacaaaatacaacgccggctactcgaagaggcggcgaagggtgagcctgagagagcgacagagacactgtcgaaggaggaacggcgtcaaaatcctccttggaagcgtcgattctgtgagggcggcgcctgtgcagcggcccgggaaggcagtcagggaaaatctggtgaagacatgggaagtgacgtgccaacaaagcgaggatggcggtgtacaggccagacaaaaacagatccgccgcccccaggcctcctgcagacaaagtaaagaagacaaatgaatggaacgcgtttctcagtggctgcagcaagcacctctagacgctaggtgcggaaagataattgaatttgcggcccgtcgcttggtgaatcgtacgcagcaaccatacagtggaggcccacttgcatgcacaacgtgtcattaggacactatatgggtgtacaaggcgatgcatccgaagccgagtcaccaccttatcgcaagacatttttcaatccgataccatctagctgcctactccgaaggttactcagtttgcttcttctgtgtcatgtgtcgtttccccttcttccctctgtcttatcaaatcagccaagcgcgagagacatgagctagaatgagaaaaaacattcaacagatcacattaggagacccacgaggcttacctacgatatggccagggacgcctaaagtcttggcgacggcgtaaaaattgatgcttcctccaatgtatgtcgctgcaacgcaggctgcgcacattgcggcaatgcgatgcgttacgtaagacacgccgaggcaccaggcatacgacgatataacatgaatggtgaggtggtacgtgccaaagacgctaaggattgtagccaccgctcccagcacaaatgccacaccaaccgtgtgaaagcgccgcgcagcccccgtttttgtctcggttgtgccactaccgccgcttccaagagacaacggcggtggcagagagacggattgagagggagaagcgcccgatcccgaagaacgcacgacggaaggagcctggtgcaaaaagcaggcgcgattggccgcgctcgaggatgaggaacgagtgtgcatgcagcccgtggccacgtgctcatctagccaagacgtgacagcgacactgttttggggatattcttcgtgcgaagtcccgcacgctggggtccgtggatcccccgcttcctgacaagtcctcgctgaggtgtctaggacgacgctagtgacaagaagaacgagaataagtggcacaagaaggtgccacgcagcgtcataaaccggtgactgcgtgggaagaagccagggaaacgcattgctgatggtggcagcggtcaagaaggcggttagagagcttgacaaggcagccccgatccgggtttgccgggccatgatctccgcgacacatgctatagtgacaagaataaaagtcacctgcagagttgatgattcttgccacggttcgggaggcgtcggctcgcccgtcaaccgaagaaagtagcaagacacatcgtctgcgcttcctcgtggcagtgggggcctctccgaggagacaggagacacccgcaacgccagagagtccgccatggcagcaacgggaaaaccagcatagcggcgagaggggccgcggctatgatctgccctaaatgagagtgaccccaatccgaagcacaaacaaatagaaaagtgaaagcttcgtggcagcggagccaacagcggtccacagaaaactcggttgcgctgtgcccagcgttactgcatgcgtgtcttgtttattctgctgttgggccggttgcttgtgtagtccaagcatagccgagtagctcgagaatgctgtcgaactgcttcgttcagattgactgaggagataatgtgtaacaacagagatactgttcggggaacaaggttagatggaacccaccacaatgtcagtcaggcgtcaagctctcggttcatcggacgataacgcagagccttccacgatacccacgatttgcgtggtgaatttgctcagaacgacaggaggcgcccgtagcactcgaagaccaaagataataataataatgctccggctgtcatcttgtggttccttttcgacttgtttcgga

SEQ ID NO: 2109 - DNA, 3231 bp, Toxoplasma gondii
agatgtatgcatgaaagacggcagaaatgaggcaggaaggaagggagacgctttgtttctggaaagccccttaacttcacttgttgaaagtagaaacaccaactatttgtttggactctggagaattctgcatttctcaatgagaaaaagctccccgatatgtttttcaaagaaaataagcatcgcgtaggttctgcgtcatcgccggaagcaggagcagagggcgggaccacgcaggaaaaaagaaagcgcagaggctagaaaagctgcagaggccagcgagatgaaagatactgctgcagcgaactagtgcatgcatagggtttgaagagaaagcgaggagatacaacacagatgcgaacggaaactgtgtctcgcagcagggggggaacccaaaagtcacagggactcttcgccggcaatcgacagtcttccacgacctttttcgtgtctcagacttggtcaggtgtctcgtcagcctttacagctcgacagtggattctggcacgaggttcgaggagaactgtgtgttcttagtcctgcttgtccggtcgtccgttcgaggctcttctgccaaagagatttcgtgacaaagtgtgtgcctctgtggcttcgctaggcaaatcgggaggcgaaggcagcgggcaacagacacccacactgactgggacgaatggtgaagaacagaagactggtaaggaaggcagcaaaaaagggactcgtcaggccgaatggagaaaatcggtgtgtaacaaagaggagagaatcaccaagtcttcagctggtcgcgacctcgcaaggtgattgttcgtgtgcagccgcctgtggttctcgtgcaaatggcatgactatttcgaataacagttgcgagatgggaacaaaagagttcaatcagcagaatggaagggagacggaaggcttgagagagaggaaagtggggaatgtggccgattcaaaaacccggaaaggcgctttcgccacgttaacctaccgaaggaaagaggagggaagaagccagccattgcgtcggcgaactggaaggagacggaagaatttcagggaagattctacgacacgccgccgagaaaccaggcagggtgaccggagactggagaagccgagacactggaaggctctcgaaggtcgcggttctttccgcgaacacgaagagccccagaagacaggagagggacagtctgggagaaagtcaaaaaaaagaaagatgcgcaggagcaatctctaggggaaaaggtaggacaattggtctcgactctgcggcgtttgacgtaataaggcttggtgaacggaccggcgccgccgccctcatttgaggcgaagcgaaagggtatacgcctgcgtggcagtgcccacgagaagagactcaggcagaaggttcctcagagacgaggaggtgctttagacagaacgaaggaaaataagtggaggagttggtcagcatgcaaaaagcaagacacggaagctgatggagggttcccgcgagagcagtggtcgtctgctcgcgaggagtctgcctctcaaaaacgtggtcgaggcgacggtattacctccggcaaaagcgaaggaagctcgttgtttgagggcagttctgccgatacggacgacacgacacaagcgaaccgtccgaagaaaagagcgcggatcagaaactctggttttcttggacaggaaagtcgatcacagtgcccgcctgcctcacccatggttgacgaaccagcgcgccagccgagaaaagtctgtcttgacagatgctgcggcgaacaagcgaacaagacacaacagaggtagcgcgctggccgcatttgcggttgaaaggatttggggtcagggttgaaaacacaggatttgttgagaaaggaagaacgcacgagttctgtagttctctgggcctgttctttttgcgacaagatgaaactgacgagaaatggaaacgaacgagctcgaacacgcactcatggcccgtctggggaaccacggcgcgggctctagcgtcttctcctttccaagcaaattctcggttacctcctttcggtttactcgagttacgaacaggtggagaaggggatgcaggagcaaagacccaggcagacattaaacaagacagctccatcaggtctaggttcctccccccgcaactggcgcacgtaggtgtagacagctaccgcattcaagaagtgttcagaggagctttttcttcctaggaagaccagcgcgtggccttcagctctcttggttcctctctgagcgctctaactgacatggcagtcgtacatgtgcatttgaatcgaggcggcgcggggtaggtccacatcgggacggaagaccgaggctgcctccaagagagttcagcacgtttcggacggctcggttcgtctgccgtgcatcaactaatcagtcaacccgctcgacgatcggtcaaaccaggtgacaagagttcactgatgttaaaaggaaacgggaagtcgcgttgccatgagtgaagtgttggtctgatcctaagtaggcctcttagctgcagctgagcgtgtcacggtcctgcggaaataattctcagctggcgcagtggaacggaatgctacagtgctcatctttagtcggagaccacgacagcgttctccactctggagagtggcaattaggtgtcgactaccagagccgccatttgaccagtaggatattgtcctccacggtagacgggtgtattcccttgcgctacgcaccagagcccggagaacgactctcctccgacactggtttcgtcggaagtgtctcaaaagctttagaacggcttgactccatcatgtctttgccttttaccaggcattcaacattggcgcgtccacaatgtcttagagctgcagaacggcaggtgtacagacacccagcagtggcgatgaactacttggcacgtttgtcatgcctttcctcgcttcttcaaaccaccattttcgcacccattcaatttgtcgaaaacagagaatatgtatgtgatatgtttgattattcccatctgcattcttcctggcgaaaacacaggactgtcagtctgagtaattgagtggatactcctgcccgtcagggccactatcagtcctctgtctcacaagttactgcactgaattgctttaactccttcggaaaaaggaaactcgcggcactgcttctgtttgtcttcgacagcctagccgtctttttagttgcctacaacgacga

SEQ ID NO: 2110 - DNA, 2376 bp, Toxoplasma gondii
atggaaaccgaggtgcctgtttgctggtcaccaaccagactggcgaacaggtgtcgtgggttggggcaatgcaccggcggcgaatgttagctcagtcactctaaatcctgacgctgctgacaggttgatcgaactctgctgccttctctgagaggaggcgcctcgcttccagaaaagaagccggacgccacacaaaactgaatcacttacggcattctttgtctctcaggttgccagtgaacggattgggaggcagcgagtggataggcgccgggacagtgttcaccaaatacgattcaccgcctctgcaggaactctcgaaggaatagtacccgacggcgaggccgaggatgtcactgatgaactttccactgaaaacacgcagagactcgagaaaaaccagtcggtgtctctgaacgccacagacgctctggctcgacaccgtcgaattcccgtttcgtgcgtagacggtggcgggcgctgcggcaagcagcagagttctgattcggaagaacgaaacctcgtaactggacccaggattttctccagaagcgcgaaacgccttactagggtagcaagttggctatctcgaagtcttggttcagttgctcgctgatcatgttgttgaggtcggcaaagctgctccctatggaggaaataatggagtccgcggggtcgtttacgccatcctaaatgcacacacaagccaaagtccgagaatgcagagacggaaaataagtccacttcgtcatatttcgaaacctccacggacacatgctgcgagaatccacggttctgtcgactgtcgcttctcactctgggaagtggcgtcagtcttgcatgaaacgacagagcgatagaaagaggcgagattgtagacggcataacacattcaagaccaggtggcaaacgaacccttgcaacaactttgcaaagtgaagctgatccgggcatcctttttgtacactctcaaccgtggaaatcaattcgcagaccccagatgcgccgcagcctttgtaaattcacgaggccaaattccgctcctctcgggagccgttctgtcagacagccttttcgcaatccggaactcgaccagaaagggtcaaaagagctgattcgacttccggcaagcccagtgccttctcaggaaccacagaaccagcactcgcacagtacatgggtagtaacgcgtccccctgagatacccgccatcttgttttgcgcattcgttgaacacgacgtacttgctgttcgcatctggcttcggacacgtctaaaatgcctgtcagtgagttttccattgtcctcaacaattcggagcccacaactgcagtggtgtcctgccagaaatgtggcccggggacaaaagacgtcaaggacaaaccacagtaaacggtcctctgttgaccgtggcaaaccccatgaagctgcttcacaaaaagtcactggagaaaggtcgtgaccgtggcaaaccccatgaagctacttcacaaaacgtcactggagaaaggtcgctgttccgcgagaaatgcaactgccaaggcgtgcgtgcagttgtcttagggagacagcacatcgggtcagatgcaatcgtcacaactcgatgcaggaccgagcttgaaagctgaaagttcttgtatctagggaaagttttcttttttattttgcaggtttcgcgtcaagctgtgcctctcgcgactgcgggaacgggcgagaccaatcgtttttccacccgcagacaggacgtcttttctatgtgaggcacagcggagcgacgactttccccccttggcgcattttttcgcagcggccggtttgctcggcctttccggcgatgctctgtcgtgaacattggaagaaaaatactttgacttttgctttggaggaccagaacccgcccacttttccaagtcagacacggtctgagtctgacggtgtcgtctgttcacactggggattcttgtgcggtgctccctctgcacctcacagctgacgccgaaaccgggcgaggattctttggttccagcctctctcgttttcgggacgaaactttgactcttcattttggcaaacgtatgttttcgtttcctccttgtcttccaaacgatcgtttgcatgcaggaagtttccgctgctctcttttgaggtggtcacctcgctgtcttcggcagcctaacccgtagcgaaagatttacggagactggcgactctctggcgactacaaatcccttttgaatctttctcttcgtcaacaaattgcggagccggattctcccgacccctctctggcgttggtttttccactgatcgatctggcatttaccggaggcgggacagccccggagggaggtcctcctctaaagttcagtgcaaaca

SEQ ID NO: 2111 - DNA, 2250 bp, Toxoplasma gondii
ttcatatgtaacgtttgtgtctcttgctctcgtggttgagttggaaactggaaacccgagccgagaacaaacgatctgctggagaaatggaagtctgcctcgacgaatgcagatgggctgggtgaatggacacaacgacgatgcagagtgtcgcttttcgaacggtcgacatgactttttcgtggcccgtacggcattcctgggcccggtgattctcccggtcgtaactccgtgaaacgtacgccttttcccgcacgagcttgcgcaatctatacgactgcaatcccaattcaagggtatttgacaaaaccgcatccagatactggaggtcgtacctcgtgagccagacccggacaaggcagaagtgctccttatagaacaggtgtctactgtaagtcttctgcaagtcgctacctccaggtatttagactaacacacgaaagctaccacgtccaccgtacaatgccggcatgaagagcaaaaaggtgatagctgcaatacgtggtgcagttaccacattataaggttatcttgtgtgaccaaggtgaggcggcacgttgctgcgttctgttccccgagaagacatgaacgggacgctggcttggccgcttgttcttgtaattcaagacgcttgttgctaattgctccgtacttcacacgagaactatttgaattttaacttcctatggacagcgggagcaaagataatcaaacatgaaactccgccctctgctaagacagtaggacacggatccaataaacaggcctttaaggtggaaaaaagtactcctctgcttacataaatccggcctactcacttcgtcgctctcacccacttttctccctttgcttctcccctttccacacagaagcattctaccactggatgtggtgcaagtctgctaggcagtgaagttgtgcctgttttctgaggccgagaaacggattctacagttgccagagagataacagtttgtgcaagagtatggaacgcagagatccactctgttttctggtcgacggagacgacaccgacagggataggcaaacgtgaaacgattgagaggactcctgcgcggacggaacacgcgatatgatttgaagagatgaagcatctcttgagcagttgcgctttctaccagcagggggcaaagtcacagaaactgtgcatcggtccacatagcacacagtcccggtgaactacggctccgttaaagtggtgagtcaagcaacacaaactgtaaaagcttctgctgtgtccatctgtgcatccaaagttgatatgcggctatttatgttagatgcatggacgcgaggaaaacaaatagaaaagcgtcttgagctagatcgcttctcaacatcttttcttctcgcccaggcggaacagagtcggccgtagttccacgagcctgacgtcctgtgcgttttccacgtgcacagaaaacgaaaggaaacgcaataggaggtttcaaatgttagaagaaaaagacgcgcttttccaactagaatgtcaagtacatctccaaatgctctactttctgagctgtattccctggatgaatttagctcgttgaagttgatttcccatgtaaatgttgaaaaattgaagaatgtcgttgttttatggatgtatgtgttacacattaccagtggaggacttgaactgaggtgtgcattcttgcttactgtcagaaagaattctccagacgcctgctgcatctccgcgggtctcggacgaaagactcttttcgcatgacgcggccgagcaaagcctcacaaaaggttgagggatttttccccttcttgctccacctgtatctctcgacgctgtcgtgtttctccgcctttttatttttcgtcttttcctgtatctggcatccgttcagtcttccgaccctccgaacaattgcttttctccttttctcccaccctccagtgtgtcccgtagctggcgctgcccgttcagcgtatttgcctacgctcctctttcatgtgtctctcctcggttgtttcctgtcctttctcaccgtccgtctccatttttctcggcctcttccctttcctttgggctccttccctgtgcagctcttgcctggtgccacccctcgtcggcgcccgcctcctgaactccgcaatttcgcttccttctgcttgtctctctgtgtgccgctacggtgaaatttcgatggcttttcctttgtgtattttgtccgcctctcgaactttttttcctggactttctagaaacga

SEQ ID NO: 2112 - DNA, 3102 bp, Toxoplasma gondii
  misc_feature (1954)..(1973): n is a, c, g, or t
cgttccgttgccctaccttgttgctccgcgacttcggagaaacctcgggccgcgacgtcggagagagttgggcgtcggaaggcgcggctcttgagcaccggtcttcctcaaacgcctcgccgaggacgccctctggcagtagggaggaagcttctgcaatcatctcaattgcagagtgaagccacgaagcgtcgcggaccatcacagtcgaaaacgccagttgatagtgctgcgccgcaagcgcggccgaagcctcctcgatacgacatggcgctgacgaaggagaagaagcagaagaaggagaagacgcagaagaagcggtgtttcccatcgcctcttggaggaggggaagccagccaggaacccagtggagagaggaggcgtcgttttccttggagtctggaatctccttttcgggtgagtgtgcgcctggctctttgtttgtctctttctctgcagagcaggtcgcctgcgtcgcggcggtcgcagcgaggagaggcggcaggggggcttggcttgctccttcgtctggaacggagacagaagacggcggaatttggtgaaggaactggagcagcagatcctgggaatccacgcgtttgcatcttctctgcgtgtcgagacactccttttcgaggctcttccagaagcgcgaaaggtcgtcgaggttcagggaaaccagctcctcgaccgcaggcgagagagcaggagaggcggcggaagacccgccgcggtccgccatgtttctagcagaaaatcgctgacgttggtcgaagcagcaagggaagagagaccggtttagtgtgctgtcaagacacctcaagaaggcgcatgcgccgtcgcatgtgcgtgggaagcggcctgccagtcgagagccaacggcgagaggagcagcagagacgcgagagaggcgaaaaaggaagcgagggaagggagaagaatgcgaagaaagctcagcgacaacgtgagccccgagaaaaactcgcgtctgccgagagaaaccgagggtcgactgctggctgccctggtgtcaaaacgcgtacatgcgcgaaacgtttcgcgggcgatcctcgtcgaatccgcacagccccccatgttcagtccccaggaaacgaacaggactcgaccacttggcagctcgatcctcacggaggcgccagatgcacagagcacggtgtacaccaaaatatgacgcagctgcgattcatccggtcggcttctcccattcttcagcgcctcgcccaagaaaaacaacgcgtccggaagagtgacacagttccttctcgctctcgacagaggggcagactagtccgtttccgggcggtcgagctccagcgctgccgacgacgagacacccgaaagaaaaaagtaacgctgtccacatggccatctgcagagagagatagagagagaggacaacgattgaagtccgagagagacgcttaggcagccacagcgagcggagacggcgcgggcgttggtggtctcggcgcgcgagtctccggcgttgcccggggggtgcctatcaaactggagtttgtatgcgaatcgcaagcaggcctccagcggagaaggctcacactgacaagggaaaaaacagcaaaggagctgtgagctgttgagagaaaatggaaaaatggaaacagggtgtacaggcaacttgtccggtgggcgctgtcggcagaatggccgagtggtctaaggcgctgcgttaaggccgcagtccgaaagggcgtgggttcgaaccccacttctgtcatctttttctcttctccaatttactctacattttactcattcctggttcttctccttcttatgtttgcgcacgcgcttcttcgccacaagagaacgcaattctttcagttcctctcctccgcccctgtgtctccggttgggtccttccctgtccggatccacctgttcccgtcatcaggctcagactgtccagaannnnnnnnnnnnnnnnnnnnttcactaaaacattcttaattgtctgccactgcgcataaaatgactttctacaaagttgcaggagcttctcatcgcttaacaacttcctggatgagcagaaagaccggggcggacaggaggagggtgactctcagactcacgtgacggaagaaaggcgtctgcaacgaaacgtgtaggactttgaaatcctgcgacagtaatgttatggcgcatcggggacgttctacgcgcgtccatccgattgaagtcgccagaaacgcgcccaagagctgaaaatcggagatagtcgaactgtcagtgatgtgctgacatgcatctataaacttacatatgaaggtacgtaaagaggtgtaaacatatagacataagtgagagtaaaatagacccgtatggacgtgtacagaattaaaaaactacagtgggagacacgagaagagccatgcccgagatggcgagcacggagacacagaccttctcacgacgcgcctccctcgtctgatgagggtgctttcaccttttcgtcggatgtcagcttttgcgtcttcttctgcagacggtcttgaagcgatgcaagtgaaagggaccctcgggccattggaaaaactcgaatcctcgagaatcatcagggtcgcagccggcgcggctgtggttagagaagaaggctttgcatgtgacaaaagatgaggaaaaaggtctcaagtgtacgatggagaaagaagactcttgcgagactcacgcgaggcgtgcgtcaacagagaaggagaaaccgtcatcgaaaacacactcgacaggtttttccagtcactgattcgtgtcgactctatccacatggccatctgcagagagagagagagagagagaggacaacgattgaagtccgagagagacgcttaggcagccacagcgagcggagacggcgcgggcgttggtggtctcggcgcgcgagtctccggcgttgcccggggggtgcctatcaaactggagtttgtatgcgaatcgcaagcaggcctccagcggagaaggctcacactgacaagggaaaaaacagcaaaggagctgtgagctgttgagagaaaatggaaaaatggaaacagggtgtacaggcaacttgtccggtgggcgctgtcg

SEQ ID NO: 2113 - DNA, 1561 bp, Toxoplasma gondii
acgagaaaaagcaaacggtgggcactgactggaagaggaaacttgagagaagggtgaagagcacagagaaaaagaagaacgacagagagaggagaggcgagagacatgtgcgagagacgtagcacaggaggaaggcgacaggacggtaagaccgatccgcctgagtgaagaaggtaggagttgtactgcggccattttcagttgattgaaggagaagtcatcttttcagagaacaccctggatcgatttgaagttcgacagaggattccccgtgacgaaggctccaccttgaacttacgctttacttcttcagcactgcatggatttctgtcggaaacgcgactcctccttttccttcgtctttccctgactccgtgcacctcgtctctctctctcctttctcgtttctctcctctctcgtttttctctccttcgcgagtaggctcttcctttctgtccttgcggagtttccttttcttgatccttcaaacgcagcgcgtcacatcgagaccggagacgaagcagacgcagtgacgcgcgagaaagcgacagaaagcgacagaaagcgggaggaaaggtcgccaggaaacaggcacgccgctgggcagatccggggcgcgcagcggcgagtttgagtgtacatacacctcgagcagtctctctgctgcatgcggtttgaggagggaaaaggaggaatcggtagcgaggcactgcaaacgaagatggcagcagagagaaagaccgaccgagtggagacgaagagagaaatgtaggaaagaatgaggagagtcaaggagcaaagaggagaaaacccgttttcgtggaggttctttatttgccgtcagtcacatctcccctggagcatcgcgacggcagcgatgatgagagaagtcgatgcttcgtggagtgcttccaactcaactcttcttccggatttcgcctgggttccttggcatttacatttctccaggagaaagccattcctcttgcaagtccgcagaagaattctcttccttttcttgacacgttctttttcttctctcgacctcgcactttctcgcgccttgcaaaactgcatgcgcgtcggcgcggcgccgaaacttcggcacccttgcatgtccgttgctctgtctctgtctcatagtgtctctcgccttctcttcgagtttctcgtccatttcgttcttcacagagccgttttctcttctctgaccgtcgacgctggaaagcctgaggctgcgacggggtctgtggcgaagaacgcgctgcgtttcctcgctgtcctgctcctcaaaacaccgacttcatggctccgttcttctgctctcgttccgttctcgagaaagtctcttcttcttcgctctcctctctctgtttcttcttttctgcttctgcccccagctgcctccctctgtcgagaggggatgagagtccaggagaggttcaaaggaactcgaattgtcaatgtccggctccatcggggtggcagaccagatgtctggtgtactcgcttacgagatgtacatacaccccaaaaagcagtgacaagccgctagcagaa

SEQ ID NO: 2114 - DNA, 4875 bp, Toxoplasma gondii
ggaaaggtccgggaagaagaacagcatgacaacgagggagcagttggaggagacgaagaagacgttcttgtctcctccacgttcctggtagtcggcatgtcgacagcggaacggtcctccggctgactcagccttccggaactcccgtcgaccagcgtctccagatgagctgcgtggatgccgcgcctttttctctccttctctttttcgctcggggttccgagttggttctcgcggcgtctgccaccctcggacaagggtccgcgcgacggagacttcgcgacggcaaagacggacgatcggaaggaagcagagtgcagcggaacggggaaagtccagtcccctggccaagcgcctcgcttctctctgcggcgcagaggagacgagacgctcgcggccgcagcagtcgtctcgcgggagggcgtggagccgtcgagagaccgcgaagtcggacgtggatcttcatgttgtgaagaggcgcagaccggggagcggcggagagaagaaaggaccacagttgcagaagcagccgcctggggaagggaggcagacgcgagaggaggaagagcggaggactcggacgaggcctgggagcgacactcagcagtcgtggtcaagagatgcaacagagaaggaacagcgagcgtcgcgagaggcagaggaaacagacgccctacggaagtcgtcatagggtccccggagaaagagacgtcgccaggccaccgctctctgtgtacccaagtcctttctgtcaggtcccctctgtggcgcagaaaggtcgctgcaagccgagatggtcttcgctgtgtcgtggagagcttctgtttttttcacgtttgcgaggctctttgtgtagctgacaaatcaggcactgactcagaaaagaccgaaggggaagcgcgaaaaacaaactctaagaacaagagaacactgcgctgcactgtatgctctcacgcctggaccacgctgaagggagggtctaggcaacccagtcaccgaagtagtcccagagaagtcgtcaaatcctttcggcgtgatgggggtagaaagttacaggaccttctacagaaggcgactcttttccaacgtggacatgatgtgctcagggttctcacgcggctcgagaacgccgagacaccaaggcggctgcgaatcacaacgggggaaaggaaaatatgtgttgcatgcgtcttcgtcaactcgctcggagaaaagaaaagtctcacacgtatttgtgtgtgtttgtgtcgccggacgatgcaggctacctcgaggaaaggaccaagacacggttcttggagtccgcgtcacgcgcctgaggcttttgagcagtaaaacgcccgcaaaagccacgtttttcgggtcagacggagacaattatacgtgctatttccagcggaacgggaaaggggaaaaaggatggagggagggaactcttcacgcggttccgcttgcgtaaccttgcgaaaatgcagctgacgagttcgaagatgagctgtatgtgcatgtgcgaggactgactgcgcgtgtctcgcgagttcgtgtcagtcgccagtttgcgcgattgcgtggggatgtttatggagaaacactcgcttaacggagaaaagctcgcgttacggaacctgctgagttttggggtgagtgtgaggaaagtgaaacggcgaggaggctgtgcgaaaacggttcttgcagcctgcagctctgcctgcaacagccaacagcacaccgcttgacgtcgagaagttcctcttttttacctctgctccataacttcgtgcgcctttctttcccttcagacacacgcaacgaaggaagagaaagagctcgtctctcctgttgattcgactgacaccgtggtgtagccggttttctccgcgaaaaaccggtggaatcgacgaacggcaaacgacgcggaatcctaggagttacatggcagggtgaacttgacagttcgtccgttggtggtaatgcgaagcggaacaagaactcaagttcccgttctgggtcgtgctcttgcgagtgcgagtggcgttttctgtggaaggagaagcagatttttcgcacgctcattcagagtcggtcctaaacacaaagagcactcatcggaatgagtagttgtggcttttcggattgtccgtaaacatagaacacattccctgcaacttagagagggcagcacgtactttcagttagccttctatgtgcttcagcactgcaagttgcagggcagtgactttagacattttgcgaatctcgaatgtgaggggcgagacgccccgacggttcgaccctgagcgccattacgtcctttctgtcgtaaacaaggcagaatccaccgacacctcggcgaggcagagctgttccggatagggtggacgacgtctgattccacagaacacgagcgagttgttgaacggttgacgcctaggcagggaaactgaacttcgtgtgtctgtcgttaatacagaggggaagctatctatttatattgtacctgaacggtactttctagcatactcacagtacgacgctgctgatcatcctagcatctgaggaagtggataaagggtctgaacttcgagatcggcgtaagagtttaaacgccgaaacggacgtcagacaacaaagctgggaaacttctgtatcggtagatgacgagggtgcgttttctcgtgatgcacggcaatcagatccgcaagcgagttacgtttcggtagtcctcggattcgtggcatctctatgctctccgggacgcaggcggaaagcctggtctctgcgcttttgaagacaaaaagtcacggttccctcgcagaaaaaatgcgtaacgatattagatcctgtctgaacgactgttaccaccggttttcgaagccgaaacaacaacgttggctaacgtttctatccatttctagccgtgtgggacagcggattttgctgcagatttgattgaaagaagccttcaaagagttgtgcatttgtctgctattctctgagctgtgtaacgcgtctacatgtcgtctagaaaatattagaagtcccgcggcaattcgaaaagcctagagcaaaaccaattagataaggcacacatgtacacacagagaactccgacttctgttagattccgactccaaactttcggcttcattttctgtgaacgaaacgagtgttggatttctcggtacatgccgctttcttgaagtgcactgacagtgttaagagtgatttcatcccaaactggtactgcatgaaagacgcacgaaaaaatgcaacacatgaagcaaagccgcacactcgaagtctagcaaatggatgggtgactatttgcgtatacagtacgctattcttggttattataggtcggggtattccgcgagcacagctgaaaaaagtccgtgatttccagtttgatcgtcttccctcatagttccgatttttccttccttgttaacgcttactccctttcctctaaattcgcgaagtctctcgacaacagggtcgcttctgtcgactggatgtatctctcttttgcttggttgtctgtatctcataactgtagagtcgcagtgggtgtcctatgtactccagtgtctgtgttcactcgattgctgcgctgaaaaagggtgctctacttcttcttctaggacgctgtctgcgactcgagctttgacgacccccagggaaactctgacttattgaatacacctgtatgtattctcaactcttggttttggaattgaacgcgggacatctgcttccgaaagtctcatcttctgttcgctcatgtttcttaactgtgacgctcctctagcatgtgcgttttccggttctccccacgcgtgtgtgaaaattgaggtccgcgagcaccaagtgaaaaagtgaaatgcgcagagggacggagaaagcagcgtctgagtcaaagaaggacaacgcgggagagcaacccagaagagggagaggccgcgaaacaacgaatgcgagagagaggagaggggtgcgaactgaggtacgcatgggagggctgcccagagggcggaaacgacaaggaagaaagggggaagggcgcagaatccggtaaaagacatcagacaccggcagacagcaaagaaagggagaaacaagcgccaagtccttttgggcgcttgccagatttttgtcctcccgtgaggcgtctcgtgggtttgtgtggcgcatgcaggaaatgcagccggtgtcttttttgctcatgcttttctccctcccagtctctcgtgcttctctcccgttttatgatttttcttcgctttttttcgcaggagaaaagcgattcgtttttcgtagatcgacggtatgctcatttgaagcagccgaccgagaaaatcagtttttcgcgatttttcctgtccccctgcctctgcagctgaggacgtctccacttgttcggtttcctgttcggcgtgtgtgccttcttttccttcgattctttgctcgcagaaggcgtcgcctcttctcagaagaaacggtcgagaaagaaaacgagcaagagacggacgctgtagcgcgttctcttgccttcctccatctccgtttcgcagcacacaaagagcagcctggcgaggtccttccttcttgcggccgccggcacgcgtttctcgcatttcttgtttttcccgcctttcgttttcctccagtttttgccgtcgcctctctgtcgtgtccttccaactttgtcggaattccctgctggctgtactccacccacctttcgaaccgtgacgcgttctgcgttgaggtcgcgcgtttctgctttgtgtttgtgcgctgcttggtgagagacatttctgctgatttctgctcctcctcttgttctccgctctccttcttacttcaacgaaa

SEQ ID NO: 2115 - DNA, 3657 bp, Toxoplasma gondii
tcgttaggccgtcttccctgggcgagcatcgaggtgcaatagacggcaggagccgcggacgcccgccgggccgtaccccgctgaaggggattcaaaagggaactcgcacacacgtggctccactttgaaacccaacggggcacgaaacgcaaaagcacagagcctgcacgcagcctcgcaggtttcatattgacccgtcctcacacgttccgaaatgtgctttctatgtcggaagtatgtccgttcatgatgccgctcacctgccattgtggagggccatcgcctcatcaacaacggcgacacagtgtcttattatggatgctattgccgtaggtgcatctggggaagaccctgtcgacgacacggatggtcacctccttcgtgctgtagttcgttgcgttcgctgcctgcaataatcacgagttttctatgctgcattccgtactgcaggccactccgcagtgcgtgaaggcacggagttggcagcacctaccaatgtgtcgacgctcaacgtaactggacaagtgacaggatgataacaatgaggaccggcgtaggcacctgcccgtcccaatccccacattccgaggccgctgtcggtgccgctacccctgcttcgtatcgttgccgacaccatcgtgtggtgatgttcacttttttccatggcattcttctctctataggggatgttgccgcccccgggcatgatatcatgcagggcggacccaaagcaccactcaaatatatttggcggtgtcttgatagatctccttcatccgattcttttgcccctccaaggtgttgttcgcgtgaatcccgtcctcgcccctactggtgcagagaaatccacattgatcgaggccacgaaatgaagtccttgtggttgtccaaggcaccaaggtgatgctgccgtcttgcgtccatctgcttcattttgcgaaacatgcgccccatcgtgatgactgataaattcaatatagctgttcctcggcagtcacagaatcagcgttcccaacagtgggagatcggtgatacaagcacctcatgtagctgttccttgacacttgcagtctacagtttcggcaatgggatggtcagtgacataatggggaccactttttcgcctgacagcgaaaatgatcacacgcgtctacgcttgttggcacgaacacaccgtcgtctgccactgctgctagaatagctatcattcgcggggtcggtaaaaacggtcaagctgcaaatcccaccccttcacgaaggcgaaaatagcaaagcgcggcggctgtcaccaagtagcgacgaaatgggaaagaacacatcgtcagcgtttgggagccaagaaacacagtctctgtcacctccccgctaccatgtatgtggttcattaagggcgtctgcgtttcatacaactaaatcggacggggggtctgcttcctatccaaaacgagcttgcaattccaaccgtgtaattgtgcgttgtgtctctgttttcgcacgccgagtcgcacgtgtctgttcaggacgcttgacaccagtggtttgtcggggctgtcattatttccttgcagggatctgcatgccgactgcagtgtgatgcacttaattcgtacgctgtactaaacatggatgcttcttcttcggacgatccctctcagcggcgtctaaggcagtgcgacggacaaaatcaatacagaccgtttttcctagtgatcgtagaggcacgcacccacaacacatattcagatgagcacctttgaggctcttggacgtattcgtggatgtctcagaccagagagattccgatcaacctagaatacaagcgtgaattccagactgtcctttcttgtccagtaccaagcgccgcgtacagtacagccagcgccagccggaatcagttgctggtagagtgcatacgagacgcgaacatccttagtgctgacgttagtttccgcctggctaaaatccacgaaaacacacggcgagttgctgtttccgtggcctgcatgtgggggcttcctcctgaccgagaatgtttacttccggttagtgcagagagtctcattgctgccgggtacacaactgcatcttctgctcggtaactagcggcactccctccttatcacatgcttcgccttgtcgctgactctgttacacacgagtcataggctggggggcgggaatgctgtcggggcatagggagtctcatggcaacactgcagtagcaacgcagctggtaagagtggtagcagatgccgttagggggtagcaagctgtgaagatcaatcatggtgtctcaacagacgatggttcggcgtatggcggaacccggtcgctggggtctttgttgctgcacaaacgtggcagacactgacatacctcaggctctagttctgaccggtttcccgacaagtctgctctccagaggctcggggggctgcgtcgcaatagccgtaacgcaacaccctgagccagtgctgcgttcttgtgcgaggtccaggccaggccgcgcttacccggcggccactgcgactcgctcgaaggtgtaccggtgcaattcgctgtctgtgcagagatggcccttctctctcaagggcatttgccatcacgggaatgcgtcagagcaggacgaagggcagaattgacggctgacgacagatttacgtcgtgtacagctgagaggcaggaatcggcgtagggtgtcggagccgatgaggagtggcatctatttctccctgtagggacattggcttgagttcaaggcattcaatgcgcgatcttcaggggcattaatcgactcggacgatgtacgcagtatcataattaatcctctaaaatgtacttattcatgagggaggcactgcggcgtagaactggccactaatggttagccgtacattccagaaacacgaacttctcttccagacaatcccaacggttctagctgacgagttcgggggagatgattacaacaaggacggtaacggctacggaacggcggctgaagtgcaactgtttgagtaagagtaggcaccaagacaccaagaaatatgactccagttatgaacatcactagtcgcagcctttgagtcgaaggaggtgttgctgcgatcccgaagcgctggtgacaaaacgtaaatttcttggtttctctcatggtacaacgcactgctgtcatcaagtgcgtgtgtgtgttttcgtgtgtgacgcgtgatttagctatttaatgaatataatggagtcaacgttacaatttctggtccaatatacctctatagagtgtcggtctctcgtgtcctactcttccatagatctgctgcaagatgctcaccagggtcttcccctcaactcgagtcgcccgcacgtttcccggctctgttccggccgggtgtcgaggcccgcaccatggcagccgttttctgaagtacgggacaatgctgtcctgcgacagtcttgaattgctacacactttttacactacgtgtcggcacgttcaccttccaaaccatggccactgtgggagaaacttttacgtgtttcaaggagcgtaagcgaccgtgggagcagctcgtcaacccgtcgaaaaaattgcttttcgcgaaaaaatcgtgcctgctcgtgaagctgcctatttcgatgtacctgcggttcaactgcgca

SEQ ID NO: 2116 - DNA, 3193 bp, Toxoplasma gondii
tgaacaactgcatattcacttagtgtggtatatccaaaacagcctttacaagcagaggaccctgtctcttgctcagcgactgtcccggggagacgacctccgccacgaggattccctgacagtggcgttgtttgccggagaaaaagcacccctgacaatagtcacaaaatcacttcactgttcgtggcaaaaatctgacaaggcacgtgctcccaccaggaatcacagccgcaacttcaggatacctgtacacaagtgatattgcgacctggaacaagacaacactaacggcccagacaccatgcagatgtagatctctttctggctcaaatcgagaatcctgttgagacacaaccgagatccctgaaatggggtcctcacccaaagaagagaaaaatgctcgccgcactcgagcaaagccggacagaaagggttacgcctcgcacatgtaccgataaacgtgtgcgtgaacatgcatacttgcaacacatgcggtacgcactcccgggttcgggcaaacactcgcattaacacttcttcaaatgtaccaccggggtttccttcagacgggcctagtcaaaaagtggatcccgtcgcggggttctcgagaggcacagcgttaacgaacaaaaagtgcctcccccctacgcgtggccagtcacatgcacgggaattttttccgcaccatcttccacggggttcgatgaagccatacattcaacggtacgtgactgctcgttgacggagacaagcattgacctgcatggcagggatgcagaacatcaacatcgaaacaatgggctgagcggccgttgtgcgaacaaacaaagcacgaaaccacagatttcagcgcactcggggtcacactgaaacctaacgcgtttaaagtgaagatgaactgcctgccagagctcttgctgccaccggcggaaaaaatcgtgaggaagatgtaatttgttgggactgtcgtctgcagccgcaccgttgagtgagaacagcttgactttagtcgtccaacggcaaccgggggacgcaaagagaaacggaaatcagagaaagacggaatatttaacggtgacgcacgccggggagcaggagagcgaccccgaacacattgacgtggtttcggaacgaataaaggaacatcagttgcatggcatacacatacttgctggaaagtggattggcagctcttcataggagcaaaagacggaactcccagcgacgaaaccggaataaggccgtccccactgcgcttccactttttccccaggcgaagttaccttgtgactgcgcgcggggcggggggctcttttttgggtggcgcagtggaggccgccgtctcgcgggtcgtcgtaccaagccaattcaaagactgaaaagggaatccgttcactgaaaaagactgaaaaacgaataaaggagacggactaaagactgagcggtgtagggaaacggaagctcttcaagtcgccttccgtcggagaactactttaacgcacgagagacgggtaattccacgcgatcacgtcttctgctcagacatccagcactaccttgccaccgcgcccgagaaccacgtgaagagaaaaaaagaaagtcgtggcatgcggcattgcacacgccacacgcagatgcaacagaaccgcgctcaaaatggggacgaccacttcaacgccggcggcaaaatcgataaaggccctgagcgtcagccattcccgcccaacaggcgacagggaataccgggagcaccggtggatggcgcctgagagaaaagctcacagaaagcaggtttttttcgcaatgcaaaacggccaagggtgctacatggcaagtgacacctatgctgccgtcaacaagcagctgcattggcaaacaggcgttgaaaaggcacgctagtcgcacgacacacacgcaggtacggcctgatgtccgcaacggcacacacactgggcgaaactataaagatgaacccaggttctcgctccccccttgcgcttacggcaatgcacgacttggtgtatgcacggctttctccatggaacggtgctttctgttttggtaaggaaaatggagaaatgcccactagagaaggactctttcagtttcctaacagaccattggtgacagaccaaccgagaggaagacgcgcttcaagtgttcgctctcgagtccggcgcgcccgcgctaacgcaacccatggacgtttcacaattacgcatgctgcaacaggtaggtgggtgccttccgacccaatcgagcacctgagttccgaaaatgtagttgcgtaacctacccgctgggattttgtagaacgcggaagggttattgaggtcacgtttaggattgtttactgttctgagacgtgtaccggttcgtgcttgtggctgttccatacagcgggaatccgcttgttgctggtctgtgctagcccacggcgaattttttgcctggcgagctgctcgcagcgtcatccgtcccaatcaagagaatcgtgatgaagtccgacaaacggaagccgtttcttttttgtggacgaaccatgtgctgatcttgtggaaatttgctttcgcaaaagagaagccctgctgaagtgcctgcggtcgaagagcacattccagctcctctaccaaatcgcgtttcccactgatgacttgcagccgactgtttcgcgtcgattgattaaagtacattctaattgctggaacgcccagttttctttctcacgtgcaagaggccgccgattgttgtgacgacgaggagacgcgtcaaagcatgcaactgaccagtgcggacccgatcgttttcttggatctgacgtgataagaacagaatatttcgttgtaaacttttgtaaccgtgcgcccggcgcatgctcttcacgatatcgtatactgcttgatcaggtggggagtggacaaccttagaaaccagtgatttttttacgcagtttcttgcgaatctcatttcttgcacacccgttcctcccctgctttgggtagccgtctcgggcaagcctactggggtcgcgcctgcgctgaacgtttttgggcaacattattggtgtgattgtccctgtctcagtccgtagtaacgtcatcagtaaacaaaacgcaaaagaaagaacttgggttattcgaagcccccaacccggccaactgaagtgacgttttctccgctttctgctgcaaaa

SEQ ID NO: 2117 - DNA, 2790 bp, Toxoplasma gondii
atccttgtgtgtgcatgaggcgcgaccttgctagggaaggtttcaaagcggctaaaccgcgagaaagaaacgcgcgcttgcggggacttcatggagattttcggatttttcgaagaacctgtttgagtgtctgttcccgggagtatccaaacgagacagttgccttccaaagtttgtccacttctctcgacaggtcgtttgcatgttttccgcgcagacagcccttcagtcaacaaatatatgtatatgtatacatgcatatatgtagaagtatataatctgcacacagcatgcatgcttcacaggtgaactacatgtgcgtaaggagtttttcacaaggtcggaaccggtcgttttttcgagtaggtgtgtgcctctacacgatccttttggtgcatatgtgtgacgctgcgcgtgcgactcgggtgaaattgagaagcgacacacgagggaaatggatgtttacgccactacagtaatgcagcgtttcgacttgctccgtgttcgtttcgaatgaactgggagtttgagagaatttcgcctctctttgatgcacacatcgtacggacaccgtgttgcacaagaggcgttctgtgggtgccgcaaccagagctgcgtcgcccgggacgactcacgcacctgtcacagcctctgcatgcgctcgccttccaacggagtgatgcagatgcagttgccacagaaactcagtcgattggacgggggcgtttattgtgctccaggatggaaaacacaccggtgagcaacacggccgtcgcacagagatcaagctaccgcagagcatccttcggggtgcttgctacctgtacccgctgagcaacagaactcggtttttccattcggcaacattcaaaagggctgcgacgctggaaaattcctaggaacagcacatcgtggcactcgaagctgcaggcactgtgacgttttcggcgaagcatgctccatttcgtcagacagcgaagatggaacgcggcttgtttccaggaaggtttatttttctacggctgtttcgcgctgcaagactcaacagtgcgtctcacacgagtaacgaacgcagatatgacacggcagctgagcagagttgtcacctctgtttctgatgtcacacgaatgagacgggtgtgtgttttggtgtacagcaagctcgatacatgtgtgtagtccatcgaaaaactgatatggtctgggattagcgggcaacctctgttcccccaacttggggtccgtttcgccgacacccttcctgggtttcaacaagagacctgaggccctctgtggtggttgggttgacttgcggtcttgctttgcgcgttacacgctgcgcccgtgtttctggctgatggtatcgagacagtgccttatactatgaaggaaagtgtgtttatttcgcagtacaattttcgtgaagtccgctgctcgcgtagtgctcgagtactcaggtagctcaggacttggcagctgcgcaaaaggacatccgaaaccccgagaaagcgccgtttttcgcacctcgaaatgaggctgcgtgtctgccctttggcttccctagcacagccagccagccttgtgtccggcgctcttcagctgcggagacgaagaacaggcttcgactcggcttgcgaaccaacgaaaaactaggaatagtcgcatacggcgtcaaaaatgcaacaccggaaacggcactctgcgcacgacgctttggaacgtctggctcgggtttctggctggctgtataataagagaccgcgtgtggcgcgaggaattttattcacgaggaaacgtaggaaagtctcgcttcctcatttgcgctgttttacgccaccattcatcctgtgaggcagaacgggacattttgctcccgaaaaggtcaacgcctcttgacggaaaagggatttttgtgtctcgcttcctgtggcattgctggcttgtggctgcatctcgggcattctgcccgctgtgggtggacgggcaatccccgtgctgcgcgctttgtcttgcacggaacacagctttgagagacttttcgccgagaaatcaagacgtccgcggttgtctttctcggaggacggagccctcactgcacaggacgtctctcgatcgcagatgtctccctcttcttcactgtgaactttcgaggaatctccgcgttcatgcgacgtcatgcacatacatcttgctgcacggctcactacagaggcctctccgggtcggtacgcgtggaccgcgtcgtttttccctgctcatctgcaaagcatttctgctcgaactggaaattgagttcgcaagggaagcttggttttttcttgtttgtcgagcgaaaacattggctgcttccgctgaaggattcgcagccggcatctcttcggccgacgtcgaacgggggtgaatctgctcgcccttggcggcaagcatgtagtgagagatgcatcttcaaacacatcctggttcaatttcatcttttttcagggtgtcagacgccttttcctctgcgattcacgtagcatgcgcaagatgtgcaaggagtgcgcggcgcagaaaagcgacttccggctctagccagggagggggactcacgcattaaagctgtttgttgagtccgagctgccgcacacacttggttttatctctagtaaatgtcacacttcgaggtttgaaacgcgtgccgacctctggaactcgattctgtgtagcctcaaccctcgaggctcttctctgctctgtgtgttccctccctttcttcaatctcttaaccgtccccagcacatcgctttcaaa

SEQ ID NO: 2118 - DNA, 4233 bp, Toxoplasma gondii
cagccgaacgagtgttcggcagacgtagctgatcgctcagaatcagttgcaattcgcataagttcaaacatttcgccgagcggaactctgaaaagggcagacgaaaaaggaaaagaggaaacagttacatacgcctgcaacgcagtgtgaaacgctccatgctccgcggtttgtcaagatggcttcaacatctggaccaggagctcatcgcattgttcataccccccagaagaagaggatgaatcctcctgcctagcggcatgacgacgacctctgaacttgatgatgggatgtggaatccaaataaaaatactctgcaggttgggacaacgaccaccccgagcgaaacgaaaggagaacagtggaaatgataagacatgaaacatttctaattttccgcactcccacctgaccttgacgagtctgttcattcgagccgaatccggagagaggcagagacacaacatacagcccagcactaaagacaaaaggacactgcaaacgatcccctcgcacaagggacggcagtaatgtctgtgacactcggtacaggcggaccacacccgctttctcggcagtttctgcgagggaaaagtgccacgtaccggggcctagtcccatgaattgtgggtcgagtttgcgctccatggagatggagaatgaagagaaataaaatagggattcgaagaaaacgttgagggggacacgatggctctgcactacttgggtagagtgtagagtcgtgctgcttatgctcgaggcccttgagtgcctagaaaattgtctccagggcgtggtcgacacggaaaacgaaagaaacggtaaatgtcgaaaacgaacggattagacagaatgcagaacaagaccaggttcgatcgaaacctccctttcctaggggcttggagggaccgcagcttgcatgcgcaagaggttacaagaagacaaaccctagctgccagtcttttctgcacgccgagacatgtctacaaaggggggaaaattagaagatatatctaattagaaggaaagggcttgaaatcaaaattaagccgcctgaaacgagatcacaccaacggccaaacaccgaaacctctcgttacgtaggccacaggatgccccatgtactgccatgcaagaatatggaacgtggcagatggtagaactggaaaggccagtacagtttcggtttttctttgctgacaatgcagtgattttggctagggatactcgacgggtggaaaacgagtatattctttggcaaccgctgttgtcgatgcctctctcgtccgcacaatgcatgcggctgacgcaaatgcaagcagccctgccgctgttggccttcccccttagcaaaccatgcactccacgttgcaaatcagcacagctgccgaacttgttaaaatcaagaacaagagggtataggggaattatgggggcgagactgtagcgtggaggggcgcacgaggaatcatgtgttttttgaaagtagaaaccatctagcgtaactacgaacaagcgagagaaaacaaccttgtgttcagtcgacgtttttggtctgctgataagaaaagccaaacgcagaatgacagccgcccagtagccgttgatttcgtttattcggatcgagagatactgttcactttagcacaatgaactcactgatcgtgtgcttctttttgccttaacggtttcggcgatgaactgacgtgtacgaagccggccttggggctcaggcaagtaaacgttctcgtttcagtgctgtgaggtcaaccacaccgaaacgccactcaacgacgccatcgtagcggtctcctaagacggtgggaagacaccgcagcaagaagggtggaaaagactgggcaatgtcagagatttcctgacgccccgtttttcgatttcccgagcaagcaagagcgcgccgcaatgtcttgcgcggcagacttgccctttcacaaagatttggggcactgcttgacaaggcttaggaccgagcgttaggtacgctccaagggtaacaaattgtttaccgttaccaatcatagtaacagcgaaagaaacaactactcaggtgctagtataatcattacggtcgtagtgggagtaatacttggtgagagagctttttctggggagtttcaaacgacgagttgggctactggccgaaatcctgaagaccgttgtttaccagatcgaggctgtattgtgttagctacataaccctgaagattcgccggctcatcagcttgcttgacaagacacgcatataggcttcacagaggaaaaagaggcgttaccatacgcgttctaaagctgctctgtcagactggccacgccctctgaaaaggcctcactacaagctcacaccgaccacagtaatcttttattcgaagcggcatgttcccactttagaaactgctttggccgcaactctattaagactgtctcgattgagaaacggcaaggttctcttgagatagtttgcttgttggagatcttgtcgacagcgtccagagaatatcgtgctgcggccgccagagttcatgcttctccattactcgtaatcgccccaaagtaactttccgggacgtcgcgccgcaattgtttcctttgtttggatgtcatactgtcatgagtccggaacagagcatatttcaccagatgaaatgcggcatgtgaacatagacaatgcttttctgtcttttcactacggcgtcgccgctgatttacgccccgtccacgaaaccgctgaaacatccccctcgctttagtatcgctcttgctgtttcgtactttccctttcgcacatttttaaagttgtgtgacttccgctgtcgatttttactggccatcgatgtgcgagagttcaatctgacggggggttgtgttgcggaagcccctaagagcgccttgcgacaggccacgtaactcaaccagtgatccctttctgtcgccgacaggaggaaacatgcgttcagaaaacgagggaaacagaccctttaggtgaccttctttttcggggtgttggtgatgacacggtgctaatgtagctttctcgattgttctggaagccccaagccccaagaatgacccgagctggcagggcctgccaggcgtcgagacacagggagtcccgtagcttctttatatgaagacgaccaggaagaggctgtttctaagctgcacgaagagttgccgttatacatgccatagacgcgtgacaactccaatcacgtattctttgtatttccaatgcgcttcgaaaggacaggctgcaagaagggggggtgggggaggggggatgcactgacagtcacgtaacgacaggaggtacataactctgtttgccctttcggtggttgcagagatctgaccgttaaaaggatgagaaaacttctagacggcacaccgatggcacaggaacagtgtgaagggggattgatccgcagggagtaggcgtcgccccgtcgtgagaaagtataccatctagggtctctaccccgggcaagacagccgctaaccggagcatctttacgccgccttactgggcgcacgtacgcattcggcagatttttgttgttctcgaaggtggggaaagaagaggctttttctcagtttgatctcggaaagaaacgacactgaggaatgcagtaaggagagttctcgtgtctccgccaggacgagacgcctgccttctcccgatgcggacggggagcctcggagagactgggcagatgcaaggtccgattttagagaactgcgagtttgtctgaatgcattttgcctttttttgtgttgtacgttcgtatctatgacggctgttttcagcgcgaaaaactgcggaacatttttcgatctgtagccaactcctacaactgttttcccctccagcccggcggcatcttttggcactctttgctggtcgcggcggttatcaacttggatacgattttctcttgtctcggatacgcagccgctgccatcccacctttcctttcgttacattttctactgcatttccgttttcctgatgtttcttccacaacgcccacttgcgcaggagatgtgacccttccggtcgggaagcggcgctggtaggagtgacgatgcgtcgcggcagggagtgttttttctaggtctattcgcagcgctcttcgctgcatactcgcgcgcgtctcttcagttgtatgaactcttcagcgacaagcatggaggacgaaacaaccggagaaggca

SEQ ID NO: 2119 - DNA, 1841 bp, Toxoplasma gondii
atacgctaacacagagtaatacgtgaccagataaacagaggtggtctgagaatttgccatacgcgtgtacgcaaacgcaaacgagcccgcggacaggaatgaaaccactgacaggaaacgtggaaaacgcgactagcttacactgaagatgcgccgtttttctaccaccatctatgcgaaagtggccctggtttgtcctaagacggaagctagatcgcggatacatagcaacaaaagggacgaagctgcggtaacgtttcgtgatcatgaaattgcctgtacctgctgcaagctcggaggcgaaacactcttgaatgatgcgatcgaccgtccacgtagggtcaatctgcgcatctgagaaattgcaacggcggaaatggaccgaaaagaattagggacaccaccaaatcccctttggaagcactgggtcagtgataggaacatcatgcgccaaggtgatatatccgcttcctccggttctagctgctgtctttccgtggccgcgtgtagattgccgtctggctgaattcagaattctcacaaaagaataggctcgttttctcttctcacctttgatggtaggcagattgcccgtcctgttcacaatgaatcgaatgacctgcgacggaccggtcgccatcatcgacattcctgttcacctgacaacgcgaatcatggcgactggcggaggattcctgctgctgaaatgacactgccgctaaaaactggtagtcactgtcttcttggtgccttccgacattcgtctccctagcggacaaggctccgccacaaaaaatcaccaccaaaaccgtcagacaagggacactcctcacgcttatattgctttcggtcacattaaacgtccgccgcctcgaatagcgaaagcactgcggttaccaggcttgctgttaccattctttactgaaaaaaatgcgcttctcggttcgaaaaggtaaccaggaggggtctgcactgccacatgaagaccagcacaggtgtcccgcctgtacaccagagcgcccagaccggcagacacacgtaggatgctttgttgtctttcctcgatatcgcttttctactgaatgacacaaaactcctagaattgaggaacttggtatcacacacgtcatcgcaacgatttttgtgcggcacggtgtccggaaccacactggctcaagtcaaggcccctacgaagctaccaccatgcagacgttggtccccttccttgcaacttcactctttgagcaaatacataaactaggtttctttgaatggtgcaggacggaagccatagttaagagcagctgccgcgaaagtacgaagaggtggcgactcgacagcgaacgcttgcatgcagtcgatgtctgcacgtcaaaccggctgaggctagtcagatggaagccgtcctacgtactgcactcgacatacgattctgcggccgcctcggtatacttcgtcaccccccacctcacagtcccatcgaagaagacgtgtaccccgacttaacagatcccaaaaaggccttcaacatgagtcctcttggtcctgttattggttttataagaatatggtctatgccatgctgaggtgaacccgccgcttgtaggcgcgtgacgtatcgcgggcgacgcggctaaaggtgagctcgatgaacggcggcctgattccatcgtgacatcagcgacgactgcaccgactcacacaccagtgagccacagcctgaagtttcacattccgttcggtacctgacggttgaaacgcgtaattgtgtctactgcttccggcttttccacatgttttgtagttgtagactgtcccctattttctttttacatcagcca

SEQ ID NO: 2120 - DNA, 2731 bp, Toxoplasma gondii
cagcttagccttcatttctctgcgtttcttcagaggcacatactcctcggcgtctgcagcttcttctagaaggcgcagagtctcctgcagttcttcgtctctctcctgtcgcctccgcgaggaccgcggcgcgccagaggcctcgccgctctcagacggcgacggcgacgaagcgcgcagcacgggtgccattggagcaacggaggaccgagaacggggaggaaaacgaggggaaacgagagaaaagaacgacgagaacggagaaagataagaaaggcgggagagggagaaggagtggagaggaaaggggactcgaaaaggaagacaaggacaagaagaaagacgcagggcgaagaagagacgagaggcggggactcaaagaggcgacgcgtccccaccgagcgcgatcagttgcggtggaaaggcagcggcgatgaagctgctgctacacaggttgcagacgaaactctcggattaacgcgaagttgtttcggaccacaaaaaacgatgcgatctcttgggttcgccgtcttcgtcgctctgtctctcctctcttgttgtgcgctcgttacgatcgacaacttgcacatttctaccccgtctccgtactgtcttctgctttgtctgcgaagtgcacgccgcgagcgcgatccctcgtttacggcatgtctggggtctctccagatccaagttgtcttgcgtcttcaccagtctgtctcctttaccctgcttgtcggtctccgttctcgcctgtcgttcgtcgccgaagtcgcgctgcagaagggcgggcgagaggagagaagaagacttggaggaagagaacggagagaaccgacaagagagaggagactgcgagaagacgactcgagaacagtggcaccgaagacgcagacgggagagaagaacggtggaggaaaggtgcaggaagagagggtgagcagcagcatgtgcgagaagaaggcgaatacactggaaagatggagaaatgtgcaggaggaaggaagaagaaagaagcaaaggagaagaacggagagagacgcagccaggcctgagcgggacgacaggaaggagcagggagaccggaaagagaagaagagagaggagagcggaagaaacaagagcggcgcgacgaagagagcttaggagatcgaaggacctcgacagacgttggagggaaccacacagaaaacgatttcgtacgctgtcgggagagaaaagcgaggagcagccacgcagcgaccgggagaggggggacgcgttgactcgcaaaaagcctcagagaagctcacaagtgcctgatccatcagtgccaagacagaccgtttcaaaggcgacgttcgagtcgccgaaaaagcacaagaaaaacgttctgaaagactcccgccagaaagcatgcttttaccagacacaggacttcgggcaaacctgcccgttctcctcggctacggagaaacagaaaggagaaaaagtcagagagtatggaagaagaaacccaggagactctaggaagtgacgcaactgaaggagaagaaaaaaatgaggaaaggccacagtgaatctcgcgaaccccatgctccggttttgtagagttgcttcgaggtccgttggtgacactacagagaagcctggaaagagtcacgagctcgtttatggagacaaccccctcggaaaacaaattttaatctctgtatctcacgcgcgatttcctctcttgtgtgctagtgtctgcgtgtacttctctagcttcttgccgcggaaaacgtgacccgaaatcgactgtcgatgctgctcgggcacgttgaccgaatataagccgagccgcactctggagggtcgcgagcgagcgcgagggggttccgggaaaaagacgcggcgcggcaatcgagcgtgtcttctggctggccagcgcgaggcacttgcgtttctgtggtcgcagagaaagcggggaagagaggcgttttctcgagcgagaataaggaagagtgacaagacatagcgaaagagggggagaagcgcggcgtccaggtgtatgtacagcgtgtgaaagggagcgcgcgagagactgagagagaggcagcacgagatccgacagaaaaacgagctgggaggtctctccagcctagagcggaagctgcaaatggattcctctctctctgctttttctcttctatttccagatgtgtgatgagtccacgagaggctgaagaaggcgagaagacgagcgcgcggtgacggagaggactgcgagaaatggagttataaaacctcgtcttcctcgccctccaagccgcacgcactcatgttcctctcctcgtcctctttctcctctttttctttcttctcctcctcttttttctcctctttcttcttctgttcctgagcctttatcttggtgtcttagagtgttgccacatgcgttctgtctcgtggttttgcttcacggactgtctttcacctgcctcgcattctctcctcccttcgtggtctcttctgtgctttcttctttctttcggtctttctctctcctccctcttctatcttgtcatcccttctttgctcgtcttccgccactctcttgtcttttgtctcttctcttcttacccttctctcgctgtgtctctcttttcttatccgttttcctctttcggtaccctgtctctcccgcctctttcggtgctttcctcttcccttacttagctgtttttcgtggatttccttttatttctcgcga

SEQ ID NO: 2121 - DNA, 4054 bp, Toxoplasma gondii
tagcttcaactgtccgtacgctgcgtccggccgttgtgatgtttcaggaggtcgttgcggtgtctctacagcttctcgcgtcgcatctgtcgcctctgtaccacatctatacgccttcttcttctctgggtgacgccgccgcttcgctgctccgtgaaacggatagcttctcacccgtctctggaccacccccgcccctcggctgtccgtacttttgcgtattgatgctgtgccgagaacagatgctgccgctggacgtcgaccaaggcgccctcacagagtggtttcctcacagccagatgggccggcacctgctggggatcgtcgcggcgccgatgagctggccagacgaccgcctcctcttcctcacatcgcaccttgagtcgatcaaggagtaccgagaggagcgcgtccgccagttccgccgctgcatgcaagtcgtcacgcgcagcttcgcccacgtcagcgaagaggaaacaaaccagtcagcttcggaagcggggcagcagagaaacggtgaaaccggggagagagtggagacacgggagacaagggagacagaggaaagagagggtgtaggggagatggcggagtggaagcccgcgtttgcggcggtctttggaggcgataccaatctccgggactccgagttggtgcaggacggcgcctcggggtgcggggggaaggcggagaagttttctgggaggccgcagaagacaccgaacgaagagaagaggcggccgcgcttggcaaacgagagtggaggaggggagaccgaatcggtgtcgatcatcccccgcagcgtccgagacgtttgggaagttctgggcagacctgacgagtgtaggtacacctgggacatgctgcgaaacgacaacaaacaaatgaagtggcgcccgaggcttcgcttcgaccggctgtactggtggagcccgagagcgagttcgtcctcttcgccttcgagtgggccggctcccggaacgatcgccaaggctgacaagactgggagggctggcgagacggaaatgccagctctcacaaaagactccgagagccgctcttcttctgcttcacttcagcgtggacgagaaaaaaaagacgagtcgcttctctccactggcgcaccagggacccagacacctatgacctggattcctcagtctctgcggctcgtgggcgtcaaccgcctgccgacgtgtggccgcttcccaagcgaccactttggtcttctcgcgcgattcaagcgcgggccgatcgcagagcacagtgagcactgagtttggagaaatttgtactgatgtgtatgcaagtttcgagaaacaagacggtgacacgttgcccatcttcacgcatgctgagacgccgggtgtagggacaccgggtgagcacttcaaaactcagggagcgagaggcacgagcggctgcggtcgccctcgttttcatttctcgatggtagctacggtgatggggactgcgaggtcgccagaaggcagaggaaccggatggttttctgtgatacctgtttttgtggcgagtccgaaagaggcgaatcacggacggcgaaactgacacgagttctctagcacgcgagtgttggcagatgagtgactggctttcattctcaattactggatgtcgagggaacacatatgatggcagagagggaagagaatgatgcagcacgacaaaagagcggcatgaacgccgtgctgggacgcgcagctcgccaatggccaggtgttgactatgcagtgcgttccgctgtacagaacagtcgcatggtttttgttcacgaaaaaagggaaatataagctatcgatctaagttagagaaacaacgaaagttccgtcgcctttcgcccagcttcccacgcgttaatacggacggaaagaccttagtgagattgtctgagtggagtcgacggagccgtgggctgagacacacacagtatttctgccacgtttcggcggaacaacggacacgaaatcggtgcaggaaagaggggggataaggcacagatgacaacaacagtagcaagagaggtatcaaacaacgcggcgacatgcgtgttgtacttgccacacacccatcctggggggtggatagccgtcatttcgtgtacacgtgagggaactcggacgtgcgtcagaaagctaagaaattacagaggtcggaactctctagaaagagaactagtgttacccggtcgattggcgcgggcgacagaccgactcgaggaatgcagctggctgaaaacagtgcagtgggaacctgttgacagtgaggtccggagcggacaaactgcatgggcccctccagccaatctgtcactcacggcgaccgatccggtctcaactgtttgtcaccggaatactctacagctgccacttccttaccctctggaaggggttgaagctttttcgcactgaaacgcgagagacacgaatgagctgcacttttcctgcattcgctggccctgtaccggccgcagtctctacttcgtacaccttcactgtactcacacccgaaaacttcagaagtcgggctttgctgcaggcgactcagggcagaggagaaggtgaacatgccttccccaattttgcccgcagtttgcctcgggttgctctcttccccaacctagatgaaatgaaaccactcgatcagccatgtatttcccgcaaaaggttggctaccaagcccacatttggtaagcactctggaagatgcggcgccacggaagcaaccctcgaccgcaccgctgtcgcggggtctcgacgtcgtccgcgttaacacgatgtcccgccagagcttccactgttctgacgagtacatggatgcaataagcaagtcgtctccactcgtacacgaatgtccagcaccagcaagctgcatcacttcaatcgcttggtagcccaacgcttcttttgtctgctttctgtttttgctgcgagactgaccgagcacgaagcttacacgaaacgcgaagctctaatggcctacatcccactccttcttcagaaatggcagggaagctacactcttgttaacgtctctaggtttaaagggtttgtgcaccgagccgatcacgttacggacacgggctcggggttcactacgttacaaggaataaacaactaacgcacaatcctggttacattcgggcccacagcatataacccctccggaggcttgtattccagctatcgaaaaaaaagcaattcgatgtaatttcctccaacagccccgagcgcatgtcatctacaagtggcagccttggtagggacccctcttgggtatgcccggacagatgcgccagtgagatctttaacctccgcgtaaagataggtgtctgctgtagcggtgcgcttttttgtgttgcatgcatgcatcaagctggccgggacaaggcggttgccccgatggatggatggcaaaaccactgtgctgcaggcagcagccctccctcggaggctcctcttgtggggcacggcgcatgccccagcacaacgtagcggccttgtccagcatggacgaaaagcagtgggggagactcccagaggaaagcgttgccatgcaaaggggaaacaggggatttttgtcacgacgagctgtttgtccacttttgtgaggtggtaatttgacacagttctcatccctgttttgtccaagatggcgtcgaccggcaacgtaaggggattctccgcactgcattgctctcttgagggagaaaaggccgccgtgaaaacatgctgttctccaccagttggcagattgaagcagtctacgggaagatgcacggtttaatcattgttgaatttcgtctgcagtctgacgcttccgtattggagcacgcgatgtctcgttgcgtgtgaaatcgtactgtctggatctctttgagtgaagaacacgcggcaggccgcagtttttttgcagggccttggtaccaaatgcttgtttacatatttgccttgtcgagttcttttgcatgcttttagatatgcgtggagactgttaaatcaacaaccgctcggagatattgtgcgcggcccagcaa

SEQ ID NO: 2122 - DNA, 923 bp, Toxoplasma gondii
ttcttgtcgctgtgggcggaacgacttccagacgaactgcttcacgcatgcgctgaagcggttctccacgcggccgccgccatgtcgatgcagcaggcggatctgttcctcgagtttacagaggacgcaaaacgcgaaggagacgcgcgccttgtccgagtcggaagctccggagctctgctcgcgctggcgcccctgggagctgtgcgtggttggtccgcgcgcgtcctcctcgcgggcattgcggctctcctgctcgaaggcggccctcgcttgcgtctgttttgtctcggactgggcgtcgtccagtcttcggagtctggcggccgcgcgacgcgcctgcgcgacagggcagacgcgcgagtgacgcccctcgatcaggtgctcggcgaagcctggggtgtacgcgagagcctgaagcaccgagttcatgaagcacaaagagcttgggttccgcagacctgcgccggcttgccgcgcttgcgtccagaagggtggcgggagggcctcgcgcgggaagagccactgggagaccggcagcgtcggtggacgcggaacggcttggcggagcgcgccccccgcgacgaggttcgcagccgagggcacaaagttgatttttctctcggctaaagccacgacgacggcgtccgaggttgtctgcgctgtccgcgtccctttgcgcgcagaaggcgcagcgcagactctcgacgcaagctccggaggcggctccctagcctcccgccccgatacggcgacggccaccatcctagagctggacgaagggagcagaaggagaagggagaaagctggaggagacctagaggagacctagaggagacagggcaggagaggggagagacagagagacggcctggaagcggggaagggagaatcatgcagttacacacaaatacagacgtaga

SEQ ID NO: 2123 - DNA, 2389 bp, Toxoplasma gondii
gcgttttctacttggtttttcgttcctggcgtgctctttagagctgtgtgttcgtccgctttcaattggggtccactgtagctctgccgtggcgtcttttgttcgttcgttccttgtgtcgttgtgcttgtcgtcttggagaggaacgccgcgttgtcgcctcgcttgaggtttttacggacgtcacacagtccgagtaggaccggtgagactctggaagagtcgagtgtcactcgaacacactgctcgtcgcgcagccaacggacgccacaatgaagaccgagaatcaacctagaggcacagatgtgcataattaacacttggatggcttgtccgtactttgattcctcagttcaggtgaagaggtcctctgtatacaagttgtaccgttacgaaaagtcgcttgttaaaggcgcgcccgacgccagcactcagcttcagttagttctacacttcgctcgcatctgcggccagcccaggaaaagcggtagacagacacgggaaatggagcatgaaatggtgaggaaggtggcgggggggagaaccgagaaagagcgaagggacgcgattttcaggagagaaggaactcgattaaagagaaccgttttctgtctgaaggaaacacctttgtgaggagagaacgctccccgcatcatggcacacgtgcaaggcgatcgaaattctcaagggaggactctcctgttcacatgtgacatgcacaacgtctgttgcttctgtttcgagggggatttccgctaactacggcaaaggtgaaagtggccatcctcgaggcatcggtttttcggtggatatgagagcaagaatcaccggatttcaatccgactaacggagccgtttttaacgggtgtgcccgaagaattacgggggagtcgaatttgtttttcccagtttggccgcagaaaactgagacgcaaggtctggctctttcggcggcactgtacacttcaccgattcttacctgaatagaggctagcccgcaaaagtctgtttacggccaaggaaagccacgaaactacaagcggtctgcggagtctcggatgtgcccatacagttcgtttaccatcgcttcaaagcaaaaacccagtcttgttgctcaacaagggaaatctgcacgagcacttgatacgaacgactagagttggaagctcccgacgtaggagaaattgattcgacttgcagtgctggaccgatcctcgtatggcagccacatgatggggtgttgcttaggcatgcgtgagggacataacggaaccgggagaatcgcgcgaagccttcaatcagcagaaaacgagccgcctcgcctttgccaacctgtctgcttctccctgtttttcacactggagcaacgatcaaaagctcttctcgctttccagtgttaacttacagaaggcttacttgcccaggcaccggtgtcggtggtaggtagaccgtcgtctttgtttttgtacatgccagtttattggttcttctctcgtttttttatcccacaaactgtcgccatgccagccgatgactgagaggggaacctccgggagcaaagaacgctcagacatgcctgcaggctttttgtttcttcccctgatgcggtgtgtctactttgcctccacgtaagttctgattagaggcgcccgcggatgtgtgtgtgttcctttgtcgacaccgacggttttgcccgcagaatcagtaccggagcctatatcgtacacaagatctccttgtgggccagtccgcacactaaaagacagtgactgtgtgtgggagaccttcacgcgttcccagtttggatcccgtagcaggtttcgcaagccggactgtgtttacagcgcccgtaagaataacatcctattggtcacgcatgtgtgtcatactcgagagaaacgcagtagagtgaaatccggatgtggttcgcgctgctcataagagcatgcggtagctcaactgttccgcgtgggtctctgttagtactgccaccgcgactaaactttcgcaaacaaccggacaatgcattcagtagctaagggaagccggcgttagccttgccgatggcagtgtttttccgagtgacgctgcaagtgtacgtttcaaacagcagtagttcatcccggtatgtttagtggaaaactgctcgtttttttcaagtcagatcctcgaagagtggtcgactcaacgtgtctctgaaacctagtgagtgatagctaacagtctcagttggcgggaatcggttttcaagggtcgggtcgagagaactcatttttctggcattagtgccccgagagttatttagttatttacatcgatagttgtgtagctgtaagtcgttctcttacctcgactgtgtagttttatcggctgcgaaaaaaattcagta

SEQ ID NO: 2124 - DNA, 1834 bp, Toxoplasma gondii
tctcagattcaagttcttcgtatgatgagataacagagttgcacggtaggcaccatgcagttgatcgtgaagaggcctgaaaaagaaaagcgggacgctacgcaggagcatacggtcgttcagaacccgcgtcgggcttcggacgatgtttcggagtcgccactctcagtccgcagttccccgtcctgcgactttatctgcgtgatacatcttatatcacacacatagagatgtggaagtatctagaagaacacggctcacctgcccctgtaatcgttgatatcgttaacgaccgagggccgtcgggagccgtctacggaacgcaggggcgttcggaggtcatcatatgagttttggcgcccttctttagctcgaatttcttcctcatgctgtctttgaagctcctccaaccgcgttattgtgtcctgctgccggagccacagcgatttggccacttttgattcccttttcagcaaagaagttcctccgatatccggagtgaccggaccggaccccccgttttccttcctcttcgattccacaaccgacattgtgagccgacgcgtatacagatttaggacagtctgtcaaagctagaatcgatacgccctgcgtacttcaggtcaagtcgtcctcggcaccttgcttcgacagctctgccaaccggcggtcagtgtctgaacaaagcgtcagccagagctttgaaactgaaacgcgcatactaagagccacagcaagacagtatccatttcatgtggctaaaatggaatcaccatcgtcaccaacggaaggaatacacacattgctctttgaagaaaactcctatgcgctgtcagggtgtctgacagtaccaactctgaacgaggcttcctaccgatgtaggagacaggatcccgactctggatcgaaaaaaagtgtttgtcttgttggaacccaacacgcccacaaacagaggcaggggaagcaaggcggagaaacgcctcaatttatcctgtgtgctttatcgagaagacaacagacgtcattttgtaaaaaaatcaaacaggcagaggaggccactaccgtctgtagtgcgacagcaggcagtatagaagccaggaaccagcctcccggccagatacgaaaagatggcggacaagttccggactttactgttttcgtcaagaatccagctggtttctccctttcgcgatgaaacagggaagcgtgggggaggacggaaaatggatatccattgaacttgtatttacgggagttgcaaacagttgccactttttcgcgcatttccctcattcattgcttcgctgtttcagctacgatactttcacatgacactgtagcagagtcagccggaggtttcctgcgaattttcagttttcagctgcgttaacaggggctctctttctcagctggtccgattatgaaccgtctctttgtgttcgggcgacacaactcctactgcatttgacgtgcatgctatcacgtgctcgtcgtccgaggcttccacggaggagcaggcactatcagcttggatggaggctatagacatccacaggtcacggtgctttcgcattttgtttgacgacaaccgagggataaactggattcgaacgcaggaactgtgtgcgctgccgtgacgttgcctggcagaactgccccaggtggaagaaatccagcgccattgtgtcggggatgaacgccacctcgaaccaacactattaatttcgactttttcttaccacccgaaatcaggggggaaaggagacatacgctgtcttacggcaggtgctgcgcctgtgcggccgatgttggggttccacgtatctctttaata

SEQ ID NO: 2125 - DNA, 2764 bp, Toxoplasma gondii
ggaagtttgacagccactacgacgacgatgctgaaatggaaaaaggcgacttttttgcctggtctctcgtcaccaggattggcggcactcagtgtcactgcgatgccagcgacgtcggagctacgtggaaagtgtgcacgcctgaggaattcaaggcccttttcgaagagtgggccgccgttctggatgccataaaaggactcccacagaagatctacgacgccatgtatgccagtcctgcgctcgcaggtgcttctaattagtagggacagccggaagctttttcagaaagaacggtgggaccctctcgtccttttgaaacgatgcatttcctacgttaagcacagaaaggaatgctgcagtcccaataagttgtttactgacaggaggttctccgacgcagtgacggtgcgtcacgtggtttgcgacttactcatgcagatctcaatgattcgacaggggaagaattatgtggcagtatcaataaagagatacatataacattgtgaatttttctgttggacagaaccttgctgttcgaatctgattaccaaggtcaagttcagtgttcgctggcacgcggcaacacagtggctcagaacaggaacacccagcaacgtaaactagtttctattaaagcgtaggttgctggaaacttgaggaaccaccctttcttgaacatttacttgtgcgacaatgaagtttctacgactagcagctgctctagttggcaggtattgccgtctgagtccgacatcatcgtgcgtatactcgctggcagattcacacagtttctacgagatctcatacatttgcatattctaaaagccattcgcgtgcgcagacgtgttggaaaaatatagtgccttgtttctgtccagaggcagtcacaagagtttcgacagtgaataactgtccaaaaccacttcggagacccgattcataagacattcacatgccagagggcgtcccatttccaccgacagacgtcgagtttttaccagagagaggcactctttccgagtgtcggagccattctttcagcaaaagaagaagatagacgactcgtttccttctccttagatagtttgctcgctgactctgcgtctcactaggatgccactgaaaacctctcgtgtgcgtgtagtcgaagtctaagcacgcgcacagcgttttgctgacggcacaatgagccagcgattcgcttcaattcacgcgcgacgcttacagtgaacttcgaacgagagctagagatgccatgcactctgattcatatgcgctttggttcgacagcccacccgatgccgcaggctctctttagtcaaacattcgctctgctggaataaaaaagaaccctcgaaaaagacaagacagcatcactgtttttagctgttgttcaacttgtcccccttcatctgacattcactctgccctgtgaacaaggcaccgccctgttagcggtaaaacacggcggaatggaataccccgaccgattctgtcttgctagagacgccaatttaaaatatcaacgccatcaccacgcactttgagaaaacatttttgtttttcagcatgcccagtgccacctttcccttcgggacggggggtctggctgtcttgtacacaaacagcgccccccagtggcactcctgttgtcacaagcatggaaaggagcgtttctgttcgacaggcttctaaaaactttgtgttttttctaccacactcaaggccagttctttccacctttctctttgtcctcatgttctctgaggttttctggcacaatggaggaggcagtttccggcgatacgctaccttcttcactgaagtttcatgggtgactcgcccgcgtcttgcccccgcgcgggcagtcgtctctagtcgatcgggtgtttttgactgcttcttttcttgtcttgcgactcaaaagctgctctttttgtgtcagggtatttaagctgcagggccaaagtgaccctttctagctcttcgaaaagaagaaactcttgccgataaggaatttccctcgattaagcgcacagaaaatccactctttccgcaatggaaagtgcgcgactcattcagatgccgttttgacagagcattgtcgccgcccctccacgtgtcttgtccgcgcaaacaagttcggaaagcgaattgtctttctgcctaccttttcttggggttttcttccgacgtttcttttccccctttcccctgcaattttgtattcgactttttcccacgggtttcgtcaggaattcattatctgcgttgctcccttgagtgcagaccccttggcttctcgatcccgccctcttagtctctcttgccttgcgcgcttccccgtgcccacatttattcattctttgcatctgtcttcaaataatccaaggacgtttccattgtacgccgacatttgtttttgtatgtatgtccccggacagatgaacgcgtatcccgcccagcgcggcccatctagccactcaggtgtacatgcacctcacttgttgcattcacacatcgacaagtttccatgcatatgtgtaccttcgcctgcggctgatccgcgctttgtgaacggtgttcttgtgaacggtgtcctttttcttgacgacgcgtccagatatgcgaagggcgcgaccatccacttaattccatccacaaggtcgcgactttcccctccattacctacttgtaaacgacccgcttcaagccaccagccgcttcttccccgtcctcggaaacctgcttcgagttgaaa

SEQ ID NO: 2126 - DNA, 4713 bp, Toxoplasma gondii
cacaaatgcaagccactctttggaagcctatccacaaagacatccatgtacttattcctgtacatacaacatgtatatatatatatatatatatatacagacaagcatctgtaagacgtacagacatatgcacacatacatatgcatatatggacaaatatatgtacaagcattcatagggatagatagatagataagtacagagagagacagataaatagatagatgaacagagagagatagagagacggagatagagattcagagatagagagattcagagatagagagattgattgagataatgtcgtggagtatgcggtcgacacagacgcttcaggcgaaccgaatggtcacagcagaggttgagatcttgcgaacagagacgcgagaggaagggagtgagtagaaagaaaagaacgggagaaaaacgagcgtggcgagtctttttcgagtttgaggatgtgaagaagagcacacctccgaagggcaggctgcgaaaacgtctcctgcctgaggaagaaatgggtccgagaagaatcagattcatggaacaaagcatttttagacgaagagaaatatttgcgttactgtgtggagtcgctctggaggtccgtagggcgtggtttttgcagactctgccgcccttgacacttgtctgaaggggccttgcacaacgggagaaaagcgcatcttttcgcctgccaaagaaacaagtctgagggagaatcaagagctgcgagacgcatggggaaaaatgaacacaaatgcgtccttcgaacctccaaacgtcgtgaggacacaacagcaaggctcagctcgaagagcctctgccggatcctcggagaaggcctcgccgggcggctcagtccgagaaaagagggtgaagaaaacgctggacgcacaaagacgcgtgaaagaaactggaagaaggaggtcctgaaaagacggagagaggaatccgcgagaaactccagagttcagcgagccggtgaatgcgccttctctgcgtgcaggcgcggaagacaacgatggagacacggacggccaaaaaagcatcgcgggcgaaaaaatttggacgccacgatcttcacagaaaaaacgaatcagagtggaggggaagatgaacggtaaaacgagcgtcggagaaaatgcaacgagggaaaaagtctcgagatctgacgcaaatgaaacctgcgaaaagaaggcggcactcccatcgacagctagtcctcgctctgtctcctcgtgaccacggccttggagatatcttgaaaacgggattgtcctcgctatttctcataaagagtatggtgccagtgtggaaggaggtgggagacaagaaaatatggcgaaatagagttcaggaacgtatgtgttgagccatgtgcaggcgaaactctcctgtgaaaagccgcgcgactctgaacgaaaaaatctcgtgacacctttgtgagatgatggggacttttacatggggagtttgagtaacatgaagggacacagacgcttactctttccgctcttcgtcactcttctctgaagcctgaagaagtcgcctgctgtttttctgaacggcaaacgacagaaccctcggacggcagctgggtgggtgtctgactttcggagctcccgagacggtggaacggtgtggttccaaaatgtccatatacggagcgaatcttgcggggaacgctgtgttttgacaacttccctgataaacgcctctcttcttattcgcgtaacacacatcacgtctcgtcggtactgacagttggaggaaccagagtggcatggctgttctgtgctccaagtccgtttgacaccgaaatgtttcgcattctgaaggtggaacggatcgcagaaaaacgcgtgcaagctgttgttcctcaaactgttgatttcgtgtgaatccggtagcaagaacagcaaggaagctccgacccagcaagtcgaagtcctggtctctgtcgaatcgttggacagaaaagagctgtctgtgttaacgacaatggaattcacggtctcttgatcctcggattgatctatttctaacaatgatggctttgacggcgcaggtctacccactgttacgcaattcagtcatgttgttgcgtgtttttgccatctggggatttgccaatcagggaatttacgcctctgtagtttcgaccgtgcttggaaacccacgtggatttgtgcccgtccagcctgagaaaattccagtctgtctgcaagttcctttcgtctgcctctggtttgcggtcaaacgactgtatgaatcgaggcttctgacggttagttgcacttctttggtttcgtctgactgcagaagcccaccgtgtagatttcctggcgtccattcagatccagcctcacacaaacacacccttaggaagctccgcatatacggctgttcacggtttagggtgaaaatacgacaggtgccagcagaaacgggatgttctgtcgtggggaaatagtttcaaatcggcttcaaagcggtcctcggaaaccgaaactaagtcgggaacttagtttatagaactaccttcgcgccgcgtatggatacagcaaaggcaatcagtttaacagagtatcgtctcggaatgatgtttatggtagaaattgaacgatacggccacctgtgtttttgctacagccaaggtcatctgtccgtctcggtgcaccgagctcgctttcggtccgggaggtcgtcagacagacaaaaatcgatcggacttcgctcgtattcagctttggatactccaggcggtccaaactggaggagggctgtgaaaagacccctcgacttttctcgcatcaaatgcgttcccctgagctcccgtctactttgctcccgtccaactcgtgaataaatttgcagctgctcaagatacaaagcaccttctttacaccacacgagggaagtccttgtttggctttgtacggaggatatcgcagcttctctatgccatgctatttcaaatggtattagagagtcgctttcccgagaactaacaagattttctctggggactatgtacagcgaggtggactacagctctgaaaacgctggacgcctttccttaccgcattcccacgcaagtcacgactcttgctgaggtttccctcagtcgtcggtcggcggcccgtgatccgggaagtacgcggcaagacgctgctctctccagaaggaaacactttgctctagaaaatgagccgaagaaaagcattgccttaatttctgaagggaaggggtttttgtgttaaaaacagagtgagcatgtgcctgaatgtggctttgccttcgtgttttaaatacgggagtcttaccgtcgcacatgttacagcagcacaggtaagccgttttagtttttaaacgtgcacggagaccagagcgaagacgagccgttctttcagctttctggatatctgtgctactaaaaccgacgtcctatgcggtgtatacataaacatatgagtcgcttctttctacacaaactcgatcccctgttcacgtgtgtgacttctgctctcaagggctatgtcgacacacaacttcaagaacaagcctgtgtactggagcttcgactctcgagatccacaacatggaaatgcgttttcaggcaacgcgtttgtgtttctttcgggatcagagcacgcgtctgaccccctaacggacacggtttttgtcgacacttcaactggcgctcctctgtgggtggcgcttgccgcctcttggcgcttccttttgaaaagtacacgcacgcatccttcctcttggcagtcggagcagaaaaaaaaaacaaagaaacctacaagtcaacactcgtgaggcggcctgctggcatgtcctcccggccggccccgccatatatgcgggtacgccagggaacagtgggtggatctctcccgctttccgcgttttttcgccaccaaaaagagtttactccagtcccgcgaccaacctgcttcttggtgccacagttgacgcgcagaacagccgattttactcactacttcgagaaacggtttcacgcggggtacagagccaccgaagagggcgctccagtccgcgcatgtcccgcggacacagcatgtacacagcagccgctgaccgagcttcacggccgagtgtgtttgtaactttgctagctttcctagctgtcccctggccgttctttcctcccgttctgtctttctgtctccctcttcaggagtttcgcagtgttttcttgtccagtgactctgaacgcacccattcacctactctctcgattgactggtagagcccgtctcccggttttctgccgatgggagagtgaaatcagatgcgagacagcagccctttttctgtcgcttcgccagtgttcagcggtcgctcgttctctgcagtgtcgattttttgcggaaagttgcaatagtcagctggtttttaaagccagacgagcgtcgctgtgtcgtgagaagagccccgaacttcgtgttctttcgcggtttctcgtcgtcgtttctcctgctggaacaaacccgctgtttctcttgattttttccgtttccaggacgccctcccgtgtgtgtgtgagttcggcctctctgtcgcagtcagcctctccgctcgcgtgtacgtacacctgacatacgtgcgaggcagttcgcttctgttccttgaactttcgtttccctcgttcccttctcttctgcacaaaa

SEQ ID NO: 2127 - DNA, 2088 bp, Toxoplasma gondii
agtcttcttgtgcgaggatgtgcctgctccactcccgtctatattgcgggttcccaagtgatcacatctacgtggtggggggaggagctgcaaactgtcgcgggatgaagtgtgtgtggtctgctaactcgaaagacagggcttaggagtacacgagaattcttctctcctcagactgtgtcaagtgactcttgacaggttgatttgcctgcttgccatgattgcgaaatagattcgtccacaaggagttctacgcatctttgtattcggttttttctcgtggaagtgtccctcaaatctaccgttgcaggtagcgatactaaatctgccagttctccggaaaatggggcgccatctggcataacgtgccggcaacgctggcgtgtacaaacgtcagaagcatcttgtacattcgctggcgtccactccctagagaagtagcaggatgggaaattgcgttgttgcacgttgcagcagtccctctcgttttgtgatgtcttctaattcacgtaaatcgaggattgcataaccggggttacagaattcaactttggagcacgatacgtcacacggcggggtgtcgacaagtgaagagtgtaaacgtacttttaatacgacaacgtggagaccgcgttctggacggttatactacgacttgggctactgggtgtaaggtcgctgtttctactggatccgagttctagtgtgtggatacacagcactaacccgcgggcgcgtttatagcaacagcctaagttcttttttagcacatcctaccacagaaagttaccactcttgtcatggaatcctcgtccgaaatggcttcccctcagtattctgtgccacacgtagttggttgcgacaggtgaccgtgtatacacgttggacggcggggagctgagtatgcacgaaagtgggtgcttcgtccacggcgtacgttattggctgcatgacctattcagagtataagtgatacgatgcatccctttttctttatcttttctccttgttcagacgattcggttttaataaaagaggctcccagattccgcagatttgttgtaactgctacacctctgcatttcggtatcgccttaagaaacggtttgtcccgcggctgacacgcgtccttttctggtgggggtgcctgcgtccgcatggtcactttatggcgtaagaaaaagaagttcaaaatgcagctagaaacaaaacagccaagacattgaggttttccagcgcgaacttatccgctggcttcccgtacctgctgcacgctaagtgcaccaagtgcagccacagcgaactctcgtcgaaaacggccgggcacagttgtggatgagggttgacatttcgtgtgcggagggtcccggcgcctttcccgtcgactgttcttaccgaagtgatctgaggcgtttggtgaaaaaacagaaagtttgttgtgttgcccttgttccgcggcaacgtgtggctgaacgctgtctcgcagagtcctttcacccattacaaaggcatgctgagcttttctcggggttgagacgcgtccgcaccgaaggagggacggagtatgcacagataattgcgaggatcgcgaagtcggccgcctctgatcgtctgaaaggttataggtcctggggaaacgcgtagatacttcccgttccttttgtcatgccacaaagcgaacgttgccttttgagagacttattcatgcatgcttacgttgtggttcgcttgatctcttaaccggtagaggcgggtacgtctttgtaagttccacatttgagggggaacaggtttcggatcccccacgtagatgctgagcctcaagtgttcacaattccctcgcctatttgggggaaagtccgtatttgcggtaacatccaaacgaatatatgtttttcatttttcctggcctgcgggctggcgttttattgtctgttgtgaggggctttaagcaccgcatcaaagtagcagggaggcgccccagttttgcggcaaatttgaacctcctagacgcggattaacagacgtgtgttcgagagtattcaagcttcagtagcaccaacgctgtgtagtcgcctaagtttacaa

SEQ ID NO: 2128 - DNA, 2048 bp, Toxoplasma gondii
acccacatacctttataaattcatgacttgaaaggaataggcatatacgcagatgtcgcagtgtagatacacacatatgcaaacacatttgcccatatacatacacacataaatatatgtaatttgtacatatatatatatatatatatatatacatatatatataaatatggaagtgaagctgggtttgaaatgtgcacagtttctcagatatgtgtgcgtgggtatcggagtacctggtacataggggtgaaagacttctctgcttttcggtttgtaaggatttgcagagaatctccgtgtctggaacttcagtgcggcagaggaggagacaagtgagagcacgggcgtccgaagtccagaggaagaccgagacaagccactcgaggaggaaacagaagacgaaggcgacagaaggccgggagagagagaggcgggactcgggagacagagtgaagaggagagaggagaagacgaaaacgagaaagaaactgaccgggcagagactgaagaaggcgctgcggcgcaaggacgaggaagtgacgagaagaaacgaaagagaggaagggagcccagagacggcagaaaagagcgacaagggggagacagagagagaggcagacgcgtttctccggcgcgaacgcaagagcacttgtcttggagcaaaaaagacaaggagaggagtttcactcctccaacgagtggagccccggccgcagcaccgaggtgccgccgagcgtgaggcggcgccgctaggacgacagtcgccatgaggaacaccacacagaaatggagaactcgacggaaaatcgaaaaaaggcgaagtagggagacaaggaaagagacaagagaagcgagagagagagagaagagaagctacagagagaagaacagagacacgacgaccaccaaggaggagatggaagcagagagcccacaggtgaccagagactaaaggaaagaagatcacaccaaagagattctgaactctcatatggtgcagtgggaaaatgaggacactggaggtcgattgtgtaacgagaggatcttcctcgacaggaaaaagcaagggcagaactccggttctcgcgccgaaggaacgcgtacgttccactaagataagcggggaaaagcagaaaacgaaaagactacaccacagaacctctgctgcagtccttgtcgcttcgaacccaaagcgagcggcgaggaattccgagttctaaatttcacaaaaaaggcttgttcgttccaaagtgtgcgtgcatgcatctgttgttcttcgcgtcatcagcgccgctgcatgtcgcagcagcccccgcatggagactttttctgtcatttttctgcggcgcgaagaaccgagtttgcctccggatgtggcgcttcaatgtcgcctttgccgaacaaagaaggcaggcttttcgcgtgactctgcagggacctctctggttgaggcgcgcgacacagaaactcgcggaagacccagggagggtttgggtgtcgagacacttgaacggcgaggcgccccggagcaattttgagttcagcgcctcgtttcgagtgctttgcgacaaacaatgtctctctttttccagactttctcagaggttctgttcctctgaaagcctgttgcgcgtttcagcgtcgctcttgcgggtttgcgcgtcacccgaccggggacccgtcaagactggaaggtccgcgggggaaaaggcgctggctgcaggaggaaagcagccgcgacgaacgcgaacgcagggtaatgcgaaggaaaaccacgagaagcactgctgccgagagacgcgaagtggagaaaagccgaaggtgtctctgaattctctgcatcacgaccaggggaacttttagctgcgtgtaaagtgctacatcctcctgagaagaggccttcgcggcattgcagacgaaagtaacgcgagaacactcgacgccacaaagaggaaacgcggacacaaaaacatgcacggaggaagacgctgatgataggaagagagctttgagggagtctcgcgacacctgtgtcatccccaaga

SEQ ID NO: 2129 - DNA, 1044 bp, Toxoplasma gondii
gcagcagaggagaaattgatgtaacaggtcggtcaagcatcaaccatgtatcggctccgttcgatcggtaaattctatttgggtttatctatcggtacaaccggcagtcactcgaaggagccactggaagataactggagagccacatgcattgaggatccaacagtcgcatttcgtgatgacacctgagtcagcatcatcagccggttaaacgggatcggggcaaattcgagtacgggtctggatcgagctctagagaagtggagccgcttgtccgtaattcaccgttgcttatcaatggtcatagtggcattgttgaatgctccgctttggcttttttgtcgatgggaccagctcggaagcagtttattccctcttgttcgaaggcggaaatcccttatggaacacgcgtttcttatgattttgcgcgaacaacgtatcctgtggtgtcagctgagcagactcactaactgttgaaatcccggatataaccgtgaaaaggtgtggtgattcatggtagttcaaacatgctacctacgaccagcacatacacgcacactgagccacacagtgcagttcacacgcaggcttcgtcgcagcattagcgatgttcgccaggttctccagaaaccacggcttctgcctttcttcgcgagtgagcggttcgagacagcaggtcactttcttattaaatgtcatgcttataaaacgcagacgatcctccgcaaggcgtgaaagcagcagtttttcattcgttggctagtaccagtgtggaaatccgactgtaccgacaccggcgttgcgaaccacatggtcagtcacaagcgtagtaactgcaagaatggagtgtccgcctgttcaggcgcaactgttttggtgtaatgaatttcgtacccgcacaagtaggccgtagcagtcccgtgaagactttcctcacaaattgtgtgtctccggcaatgtctttcgtcaaagacaactcagccagatatttggatcttttcctgtagcggtcgtccacccgtcgcagtaacaccagtttgaaca

SEQ ID NO: 2130 - DNA, 3942 bp, Toxoplasma gondii
gtcggtgactatcgacatagacgaaaaggctgtaaccaaagattttcgttaacaactgtcctgttttctcgtcgatacagtctaggctgctgggaaagtctgttcaacatacgaagatgctatggaattcctagcaacacaaaaactagtgtggattgaacgttgttaaacacgcgtcgcacgagacaagaattcacactaccgaatactattactaactcgcggtctgccacctgtgctgcatggtccgtataccagaaacggccatctcgattcattggtgtatattccgttacaagtgagcaaacaattacatacgggaatctccagccagaaagtcaacgccagaataacccccaccaagtttatgccttgttttcattatgtgtagacgccggcgctcttcatgcacagacagtgcacggcttgttttcaacttctgcagggcctcatgttttgcagtttcaattctcctgagagactgaacaagacagaaacacgcagagaatatgtcaccgattacacacccggaaatgcgaaaaaatgagcagaacacgatgagcacaagaagagcaaacgaaactaaccggaaacaggaaacagttgactctccccttccgcgctaggcacgcaccccgtgagttaacaaagatggaaagattgatgaaacagaaagaatgatgtggcgtgagcccgcaaaagtgactataacacgaaccgtaaagactcggcaaaaagtgaaggcaaacgaggcacaccacaaccagcgaagctgcaggaataatacagtcagttccctcgatcgcagcactcgaatacagctgccgaaaagcatactgcccttcctgtttgtttctgcaggtacgaccagaaaggcgtagtgtactccaataaaatccagaaaggcagggcaacgtgtctgcacgccacgaaccacgcagcttcctcaaccgcctgctgagcacgcaaccctggacccccttcaggcgatagcggaatgagcaattgtgcacctggggcagaaacagttcttacaggcaagggaaccggacaaagcaggcaagagactgaggtgagaaaacagtgacacaagaactcagcggatctcgtattcattgaacctagaagctgctcgttgacccacgttttccgaccgaaggcaccggccctctgctcatctagcgacaactgttgaaggctatggtgtacaatcgttcgcaaccataaaaaacagttcggacgggcttgagcctatccccctcgaggtagaaaggcgacactctcttccaactgacgaatggatccaaaacgcagcaagcatgggaacaaagattacggacactcagcgttcgagtcttaccgccgcccgacgttgggccatgatttctgcctctgttgagtcgctcgtctccagtttcgaaggcggatgagtttccctgatttttccttctgctttacatgcattccccatggcgtggttgttcgtatgaaacacatgtgcaagaagaaactgtcagccagtctgcagaccggaccgcctttgtgagggtagcgcgaagatcctgctggagctctaccccagcagcggaaattccacccatcactcaggcgtttacgctacagcaacgggcaatgtcggtggtcgatatcgagatacaaaagctgcgccggggggaaaaagcgtgggaacggaagcagagggttctgatgtgctgttggacactggcgcaaacgttgcagagaagagacgcggcagctgtgagggcgtcgcgctcagtggtgtgtcgaacacttgcaatgcagaaacggctccaagcgtaaatgtcaacgttattctccgcttgcgggaaagaagcggcgggggaagaggcagcttctgcagggtttagtcaaagcgaaacgagcaggaacgatttgccagggaagagagactcgggtgactgcgcggaatgccagatgaaggttgtttgccgtcgattctctcggggtcgctcgtggggtttccgctaatttaccgtatttttttgcgacataaaacttaaaaagcagactccatcgcagcggggcctgttaccaagtaaccgtttttgcaagattcactttcggttctctccctacggacgacgcagtcccggtgtggcggtatctctttcttggactcgtaccgcaaaagcacgaaggagaagcgacgcaagaacacctccaataggatacgtaactcgattcaggacacactgtgacgaaacgacgcacaacaggtggttcctgctgtaagtgatatcgatcctctgacaactgaagagttccaaacagatccaagatctcttgtgcactttcatgaccaagtatcgcgcgataagtgtagaggaatctggcgtagaggtgaaaaaccgtcacttgtatacaagctgtacaaatatcatgatattcactttagtagtcccatctgcattttagtctgtacggaatgcttgcgtgagagtccctggtgaccgcaactcctgttcagactacgtttcagctagacaactacccacttatcactgaaggtaggacctcgagtgcctctcgacaaccatgcgctactatcgcacgttgttctccgtccagaagcataccaaactgcggaacggaattatctattttccatctagcattccctgtcactttcaactgtccttccgactggcggctttttctagtggcctatcgggagcgtggacgaaagtaagcgtagctcctttcggataacgctgagtagtagtggtgtgccaaagtgtctggatttcccattcttctgctttcacgctccttcatgtaacacgcaggctcctgccgcaactctgctgaacttcagcacaacgccagccaagaacatattcgcatggctgtaaacggtgaaccgcagcctggcttaaagggcagcttgcgagacggtgtttttagtataaatcatcgtatctcttcttctattgctatgcttttgttcgcttccttgagttaatgcttcgtactgaagctttcgaactccggtaacgacaaacctgttatctgaaaagtgtcacccggggtgcactttcgcgccgcaagaagcacatcgacgcgtcctgtgcagtcattgagtatattcagtgtttctagagatagtgcacacgcgtgcgtgtttcaaccttcatttctgctcctaaagccaaaagagacacattgcctcccttgactatgggtgcagtcttgattctgaggaaggtgccgtcagctgactagcgccagtacaatgccgtgtggcatttcttgcctcgaaagaaacgtgaaaatatatgcacgcgtgcaaggtacgcttcttgtttcatcgcgggaagattcctctctaactatttttgtgtcacttcagaaggataagaaaaaacacacgtctgtaaacacttgaacagatcgctggccaacgacgccctgccttttctgtggcgggcggggggaactcggagcatgctctctgtctcctggcttgtctgtctcggagaagtcggtgcgtttccggtttgcaggttgtgtagcaacggtttgctgttatgcagtatcactcctgaaaggactgtgctgtgccttgtcgcgtttcttcatctgtgggtgcggccgagcccccctctctctctgtccccagcagctcccagattttcccttcgcgaacttcgtgccgttgagcaacgctacgtgtatcacgcgcgagtaacttaccactgcttgtcgcttttcttcaacctcgccacacctgagctggcggtccacaaagttttttcgctctccataggcagcaatgattcttcgataacgcaaaacagcttttgggggacgggtgccttcccgaggagcaccgactgtgtcatgcagttgcatttccccgtgccgcgtgcttgatccatgtttccgcgatccccggaacga

SEQ ID NO: 2131 - DNA, 2141 bp, Toxoplasma gondii
ggcagacgtctgcgttcctcccattcccgagctcgtaaatcgaaaggccggaggccggaacaggccacgaaaatgacgcggagaccggggaagagagagaaaacaaagaatgaaacccagaaagggtcgtccctccttcgtgtcgatacggcggggtcaaaaacggcttcgcgtgattctcgaacaccagatgacgccttgaatctcggttctggacaacttgccatggccgaaaaagaaacagtggagtcgtcagtcgtgctccatcttgtttgtgctctcgttcctcgggacgaaaaggcggaaatctgtcactcaggctcctgcatctgtcgccggcaccacgatagaatgctggcacttcgcctccaaggcgggcgccggagatttggctggccacaccttctccgccattcgcacgagggacagactgataacggagaagcgaaggaactgaagaaaaaaaggaaaacttctctggcaaaaagtccttctgcgtcggaaatgcttgagcggcagtgcgccgccatcgatgtgtgaacggtcgcagaaagtcactgggtgtctgtacaccgcgccaatcaggtccgccaggcgttctggcacccgttctttcctggacctttcgcgacttggaatgcgtgtcaacacgagcaattctcgtagcacgattctcttcgcctgggttctctttagcctctttcagaagcgcggcggaaaggtctggatggaaaaaaagcgactcgaatttgctggaaggtttcccagaggctcgcgcgtccagtgccggcggcttccaggacggaaggcggccgccacattgctcacgtctgaccaatgcagcgcaagaagacagggaaaaaaacacggagagaaagagcaccaagagcagaccgccggtgttccatcttccacccgccatagaatcgaaccccagacaagactgggcgcgtgtgaagtccactggtcggttgactctcctcgacaacacggtcatgcccttaggcatccaatttcaagaacttatgtctctctgcaaagggtggcgatccagactctggacgccttcttcggtggggctgcatgccgcagtcaagagaaaggccgcctgtgtcagttacgaaacatcgagagcggagacaagactgaagaacagacggcgggagccccgaagccttcgagaatcaaggattccagagaagacgaggaaggtagtctttgcttgtggttaataaaacacaggcttggtccttacattcccctgcagagcagcgaacatcgcacgccgttgtcttgcgacgagtcctctcacgccctcagacaacagggatagatgtttgcagatcttgaaaaagaattgaaacaacttctatccgtcactccattgggatgaaggaaaagaaacttatgagaggctctgagtagaatggaaatgacgtagaggcggcggcaagaagaagtgacttgcgcacactttgctgtgcaactcgctcagagtgtgcttctagttgcggcgatttcacacgcgcgatgcatgcatcttcaccttagaaagatgttttgtggggctagaggaaacggcgagtttcttgtttcatacaaacttctgaatcctgaaaaagtgaatctttcgaggtaaaaatcctcccgtcttgagggacgcttccaggtttttctcggagatttccgagttgaaccccaggcaagtttcatgcctcactgagttgaggcgtgcttctccgttttcttttgcatctggagaaaaaaagcgaccgcaaaatccgccctttttcacgcataatccttcggagttttccttttcatctgttttgtgacattcaaatagtgttggtggagccctctcaaactcgcacgttgcttcaactcaaagtagacggctcgggggtcattgggtcttcgctcgtccgcatccgtttcttcccggttttctgtttttttcgtcattttttcccctcttccgcgtacttccccttctagcacctggatcgtgtgagagactctgtcaacagccgctgatacgcactcattcaagatccatttacctcagtttctgtcccggaccttttctctcgctttctctcgtttcttctcctctcttctcgtctcttctcgggcagcca

SEQ ID NO: 2132 - DNA, 2037 bp, Toxoplasma gondii
taccgctgtacgtgcacatctatcatttgccttttaatgttaaaacgatcaggtcatgcatgaatctgcatgcgcacatacaaaaaggtacattcatcagcacttgtacccttttctatacacaggcttgcgatatctgattgtgtgcggatgctgtctaaatgtgcatctaacgtttatctctgcacgatgatgcagccctcgtcactatttgtgtcatagagcattcaagaattcctgtactttccgaacagacggcaacagacacggttttcttggttcagcattcaaacaatcatcagcctatagcttacgttgcttagagaattcagcagatatactctcaagaattaacaccagcttcaagactcaccaagaaacgtcttttctcctcatttgtttcgcccctccttcggttctacacttcactacgaggaactctctgtaagcacaaaaacgctcgaagcgccagtgaagctattgtacaatcaggtggtgacacaagctctgtcacagtcgtagttgacactgctgatgtgttcactgacctcttggctgttgctcagaacacgtgtatgaaacagagtgaagacccgttgcgaagaacaaagaaggcgtcaacaatagcgtcgttgacataaatcctaccacacaatagcgcggtatataaaaatgctttgtaatacttgtaactatgtatcttggccaatttgcatccgcatcatcacctgccgaccaccgacactgaagattcacacgggtgtatcgtgtccacctggttttcgttggcaggcaatcgccttccccccttcgtgtgttccgattcgactctgtgcagctttcaggtcttcactgagagcgattttggttcactgaactagtgcctctccccgcgtaattcctgctcttgacaaattgacatttcgtcttgcctgcgcggccttctaagcgccctagttatcgggcgagctctacagagaacagacgcgtgaggcaaaagcgtagaaggccattggtgtaactctgcagcaatatttagcctctttcgaaaggcagcttcccccctcttcaacctcctactgagtagcactgaccgcatgcagctccctagtgcatgcatgcgagtgtgttctggcatgcgccaccgaaacgaaaaaatacccggtggccgagggtcgtgccacctgctcgctagaaattgcgcaaatgagttgtgaaaattatgggacgtgttttcagacaaattcaaacaactcttggcgaagccagatttcttcagggatgcatgctttccgcagggacttgatccacacgtttcgcgctggcagaacactaactcgttctttcttccggggcagcagtggagcacaagcgactcctattgggcgacaaagagagcttgtgacctgaagtggaaatttcgtctccttgtatccctgaaaagacggaggtattgctagcccctttaccttgtgcgcttgatttttgcgcttcaatacggtatcctgacccttcgaagtaaatcgcgtgcttcacggtcaatcggtgttgtttttttgccattctgcgagcgggctcccttgagaagaaaggagaaaatctgctggcgacgtttcacttgagattgtttgagttgtctttgaaccacacttgtttgcttcctttcccgctctctttagagctgtgttcagcgttttcagagagttttgcgaagttgttccgggagaattcgcttccgcagttgtgggctgcaattattttcccgtccacttccccagcagatatttccgagttctcgcactcgaatgaccgggcagacttgctgaagtgttcattccacacaaacctgtcgtcgttaattgcctgaaagcccacatgcgccttcggagctaaacgccctctgaagaatagttgccttccacgagtatacctgtttgtaaagttccgtgcaattgtgtccataaaagtaccgtggagtcacgtacgaattcgtgttcacatcgctggaacatacacgggaacacgtatgtgtgtgaa

SEQ ID NO: 2133 - DNA, 4827 bp, Toxoplasma gondii
agagaagcaggccagctcgatctcccatccaccgctctcgagatggggggacaaaacgacattcgcatgagtgcggtttgcactacatctgtggtcctcagagttgcggaaggcgcgcatggaggctcctccgccgcgcgattcagcttttgcgtcctcgtttgtttcctcgcctcttcttccgtccgcaatacgagcagcggcgcctcggctctcttccgttgagcgacaagagagcagaagggaaagagacggctggtgaacgagcgagaggtgctggggcgtcaaagtcaggcgacagagcctacccacgtcacggctgctaggcggtgtgtagaacgtgacactcggattctcaggaaaagaagaaagagacgatgaggaagaaggagacagttgccgtggaggggactctcctggagattcgtggcctggcaaagcccactgaacgaacgcgggtcgcaggcgctttggaggagcgaggcggtgaagagtccgaaaggcggttgcaacggggaggagtctcgcagcaggcagaagccggtcaagaatgtcatgcaaggagaggaactggagaagcaggcagaggagatcctgcccagaaggcgagagaaagtgcgagaaaagcgaggtgttgtcttttccagagcgagcaccggggatctggcgagacgtgagggggatacaaggaggccccgaggcaggtgacacgggcagagagggcgccacagaagcggccagacgcagacaaggcgtggacggcgaggatgggtcggaggagacctcttgagacgaggaagacggcagagaagagtacgatggagaggtcgctgtcatcgtctctggagtacagagagagaccgcgttctcgttcacacgctcgcctttctctcgcctctccaatgctcggctgcggctgcagctggcatccatgactgcgtgtctaagctcggggaagactggagaggacgagaggaacaagacagcggtgtgcgataggcgtggaaggtaggagctttactcatagctgcttcgactttgaaggattgacggacccgtgtcttcgatatcgatgtgagctggtcatctcccttctttgttactttaagccatggagtgcctccgtttttgcctcccaccttctgtctagagtgcaatcacggacctgaggtagacaacttttgtcggaaaacaaggagaggcggggagaaacaggggaagagaaggatgagcaaacgaaaaccgagtagggggaagggagggagggaataaagagaactggtcagactcaaggacttgcagaaagggtggggaagcacgttcctgaaacgacgcagggtgactggtcagtccgagaactaccgcagagccgaataccagtggtagaggggcggcagcgacggagaaagtgagaatttcagagggtgcttcaagaagggcattgtcatcagaaatggcttttcctgaaaatctagcaaggagagcatgtcagaacgtttcgccttcggtctctgtcaccgacagcggaaagatggagtacttaagaacctacgagttttccgggatacgggagcaaactccccgttgacgaggaaatacaaggatttggactgccggtgttgtcagaaaaccacgcagaaaaaattcaaccgctgcatggcaacgacgggtgcgaatgaagacaagtatcggagtgcacgctacctggcgactgcgtagtccggacgtcgaaggcaagaccgagtgcaaggcgggagcgaaacctcgacgggttggccgtgaaagggagtttggatagaagaaaataagacgcgagacgggtaacaaagggtgcgaacataaatgacgttgtcaacgactggtctagccgtctgggtgtcgtttgcgtgggagcacgcgagaaaacgaaagatgacgaggacgaccaaaatatgtgcaagggaaaaagaggcacgagagaaatccagacgggtaaccttaaaaaacaagtgtcgtcttgaaaaaagaatgcagaggagcgacagagaatgagtcaggtgaggcaggtgtgccactgccataaagcgagcactaacagttcacagacaagaaacgaagaacggcgcccgtccctatgagtgaaagtctgacaaacagaagtttccgtttgcaaaggattaaaaacggaaagtgggccacagcacacacacggcttgcgaccatgaggcagagaaaaccggcctggcgagagttgccttctccttgcaactctctctctcagctgtctagggactctttccagtggcgcttgggtcctctctcaggagccaaaagttattcttgcaaaaggcaggccgaatgcagcagtgcacagcgactgctagcaaaaagacacacgcgcttgagtgcccacaacagaacgcgggacggtttgcaagtcggaaaaatccagcaccattcctccggcgccttgagacggctgcctgtagaggatatgactaacgcacaaaatagagacaaaaggagctgtttttcttgcttcgtcgacgcctgccttctacccacagcgcaccgcaccgaaagggcgacaaaccgctgtttgcagggaacgggaagaaactggtagaaaggttgcacttctgagactgagagagaaggtagaagtcgcgagacttgccgccccgctgttgccaaacacgctcatgagcaaggccaaactcgcagacggctagcacaccattttgtcgctcgtgcacgtcgctctgcgtttcaccgacgaccaaaagcggcaaaaaactgacccctggcagagtaaagcggccccactagccaaaatggtgaatcgactgtcggaagtgctcaccatgcctagtccagggccgcacccctctttcgcttgtacggatgatgtgcgcgcctcttgctcctcgttcctgttcgcgttgtcatctacatctttcatcgtctctctacgtccacatccccaccgtccgccccctcgaacccgcgacttgcagggagacccactgactggtctgaaaaccgagggtaaacgctttctcgcggcagcgtagatggtacgggcacttacacgttccaaacaggcatcttttgcataaacgttcatggccttaagaaagcgtgttttggcaaaggaattccaccactacgtgcatattgtgttctgcaacacagaagcttgacccgcgctagcgccgcgcgtatcggcggaaccctccaggtggcagtttttcccgctttagcaaataagacaagcgagaggaagccccctcgtgaacacgtgtgtctcgcttttgtgagaagctgagtcacctttttcgaactggggaaatggccactttcagttgcggtgcttctggtgcgggtacctagcgctcaaatggatataccacgccggtgtttccaccatgagtctcaactgaaattgatttggactcgaacatgatacataactgcaaaactagctgacgacagaaattagatcggtgaactggtgaaaaggaggaacagaaactcagtttacatggtgtgctaaaaataccattcgcgtacccagtgcatcaagacgcacggcagtgtcttcaaaatcgagcattttgtgtgagctgatgacgacacactgaacagtgaatatctgcagaagttcgcacctcagatgccagtacataaatgcgacaaagtttgttgcaggaccttatttcaacgctgttacctgccgcgctaagaataagcggtggtcagctgcatttgacatgcctaaggccaggtttacagacaccggggaccgctaattttcgtgtgaaagctggcaaggatgattactccagagagtaagtcccccagaggccctccagaacaggattgtctcgtcaaaggaggaagcgtttgtgatgctagagcgagcacgacgccaagaagaagcgccacgcacttccggaggcagaacgtttgatcatcggggccgctacttggccgtaacctctactctgtgcgtgtctcccccgatgtacgccccgttctctgctctacgtcctgtggtgagacccaacaatcggtacgaccgcaacttcgctgacagaccgcacgcattcagaatgagagcatctcttggactgctgctttcttgcgcgagcagcgcacaccgagagaatgacgcgcgaactgcagtctcgagcacgtagcagacacgcaaagatcctctggttttcagctgttcagtcgccaaacctacggtgcttgtctgctgcgccgcgcggtcacctgcatctaacctgcctgttgtccagactctccagggacgggtcacattgttccttcacaggcgcttgtgaggaaacggaccacgtcgagcatctggaaacggtgaacttaggaaccgtgcatcgccagtccgtctgatccttttgtgatggtgagcgagactcaacgaagcagtctgtaccacagaaacaccacgtcttgtgctacctcgataggtggggcctatcaactgtgcgttcgacacaccatttcagtctcccgcaggaagaggctgctgcgcttgccctccacactttgctcggatgcctcttcgtaactgcttgatggatccgacaaaggtttgcagctccttttgctgttacctgcgaaaggcatcaagtgatttttttggcagaagatgtacccgctacatgtgcgaggggggtgtgttgcgggttgctaaccgatccactctcctcgtggcatggtcgcagcatcgttccgagttttttgctcttttcagaggtgaaaccatgaaagagctcctttctgtttctttccattgaatccctcgaagcatcgcatcaa

SEQ ID NO: 2134 - DNA, 1982 bp, Toxoplasma gondii
ccgaacaacgtccataaaggcgcccggttttggctcctagaacacagcgtggcgccgggcaggtggacaaaaatcggaaagtcggggagatacactggctgacacccaggcgacagcgacgcacagcccatacctgctatgtacatatagagggtcaccatgcagagagatgaaggaacggatccgagaatataacaaaactgagtcgtgtggcagagagataaaactcccggcaccgcttttagccagttatcctcgaagcaccgtgcctcttttcctcgcttgactgtcaccaattaaatgcacattctttgcgtcttgttaatcgtttgctgcgacgaaccttgctgatctacttctggaaagttgtgtcgagcgcttctgccgcctctcgctctcttccttttgcctccttcttcttctatgcctcttcgcttcccaagccgtcgccccacgctgtctcctcgagaaaaaagggaggagggaagggaggaaggaagggaggaaaggagagaagaggctccgagagacgccgccttcttcctctgctgagaaggtcgacgacctcgcatggtgtccgagaaagagccccgtcagctgaagcgtgaagagagaaaaacacgagagagagaagaaaaacactgaggttataacgcgtgtcggcctcttcaaaggaccacagcgatatgtgcagcctaacagaggagagagatgagaaggagacgtgcagcgcggagcccgcggtgtacgtacacccggtgaggaggtccggcagggcgcttcaacgatggttggcagacggtcaagaggggtacggaagacaagagtgagcctttaagaaagcgcgaaagaactcgagacaacaaccacgagaaagacgaggcaaagcccgccagtcgggattccaggcgcgcgaggagagccgtgaattgggcggcagcggagagcaatcaagcggcctccgaggagatacagaagcctccctgggcactccaggatggcatagacacgaccggccacgcgtctgggactcacgcgcagtcgagaaacgaagacaggagacggccggtgtcgaagaacagtctgcaatcgacgtccgggccggctttgcatgcgcaggtcgagtcgtggggccagagcgcagagcgaaaaagctcaggaaaaaccaagcagggacgaggagtaggaaagaagagccttcgatctagatgcaaaaaaaggatccttaggaagagaaagaaagaagagaaaggagaacggattcgctgccctcagctgattcaaccgggcagcgaccttgctcgtattcgccagcgcatttgcatgcaccacagcgacgtgctcttccacggacctttttcgtgccagaacgaggtgctgcttcaaagaagagaacctttcgacgggaaacgcagaagaaagtgaaaacagaaactgttttacttcgtgtaaactcgacgtcggtcccctctgcggtccgacggcgtccctgcgtccagcaggtgtacatacacctcgctcgtggtctgttgggaacaccgctacgtatcgatcccagggtatttttcggctgtttgattcacactcgcgtccagaactcaaaagctttctctgctttgtgtctcggctgtgtcgcgcaaaaacgccgttttccgagttgtcgcaccgtcgagggcatctggaggcgaagtacttccgcactgccaccgtgtccgcgagtcatcgggtgtatgcacacctcagaaccgtctcccatcgtcgccttctttgtgtatgccaaggagcagaactgttttcagttgttgtctcttcgttccgctttgtctcccttttctcgactgtcgtggcatcccgtcgtttcctaacgaagtggagacttctgttcgcggttcgcaggaggcgagtcttggacgacgcctgccggtcctttggccactctgtgctctggaatttgactggttctgctccccaaggacccagaa

SEQ ID NO: 2135 - DNA, 4064 bp, Toxoplasma gondii
gtttttctgtgttcagggatgaggagcaccgcaacgggtttgtcttcttcttgcgtgtcatggtcaagagggcgaagcaagctgagcaggtgggagctgaataattatggcgttctgtctcctgccctgtcgcttcgtggaatgcctgtaaagggcgcttacgcggcaaaagtcgcaacggtgaatttaggtgaagaagagcgacaaacacatctgtcgaaacacaaatagcctgcgaacgtcgtctataggccgaagcctgaaaacacggtggcagtcgggtatatggttgcggagaaactgtcattgtgcgtgtttgtgaaatcaaaatcttggtgatttgcccaagtatcttcactgtgtggtgcaagaaaagaaaacgtgtggtcccgaccttcccgacccttaacagtcgtttgagaaatttgcggagcgcagttcgggaaaaggcatcgaagcgggggaagtttttccgtgtgcgtcttgtcatctcgtgcgtcacccggccctgctcttggtgagcgagaaggtgtaccagttggtcacctcatgcacactgcgaatccggtggtcctcgaaatcaaacgagaccgaacctcgagtacgggaaaaggcggcttttgccgtgatggcactgtcacacccggatcgcctactaccggtcaggcggttcgtaacaccgcttcatatcgcaatagaaggcttttgtagcacattaggcggtggcgcaagtccttccatcgataggcataagcggccgtctcggatcgtgaaccagcatttcacaccgtacgtgctgccacacgcctgtaggttttgtaggcacttcagcggtccacgggtcttctgtaaaaatcgagttgcaaattgttcctgaatttcacagaagacacccttgcaaaaacggctgtcgacttttgccattcccacgtataatcaacgaaaactggtccagtgttcgtcgacaaaacagtgcgacttgcacagcctgatctactcatgccagtatatgtccagccctaggtggcggaacacatacacacagatgcccacgcgagaatacagttaatgggagagtcgccagacgctaataaggagaaggtaggttgctgtcacgttaaggataaaccaggaacgccgatggcgaattcttctaccttctactgggaagaaggctgcagcataggcggaagatcagtagcataaccgcagctggatgtgggtaacagtcattataacacatccagtgacagcggtccaggtggcatatcgtctggactattacgcttcagtgaaacgttcgacaagacagacgatattatcatgtgtgtagccaacagagccattcaagggacgctgcattccagatttttgctggaggtgtagagataccactctgactatccaacaccagccaagaaatatcaatctagtgctacggttgctgtaagaactcaaacatgtgcgttcgtgtaactctccaaatcgtcactttcatcactgcggacgacggcctgttccaccaggcctctggatctttcaacctccctgaaatggctgtgtcgtgccgttgacgtactgggtgacatgtgaagtctttggggcttttcgggcactccaaacgagacaggtaactgattcatgaagcgtttctggcacagcgaagcacatcaccacaaactccttcttctaacgaagtgaaaacgatccgtggaagcgaactgttcgatgcatggcacatgcaggtttgtgtttcgcagagagcgtgcaactgtttcgagagtcacaacgacaacgcacgtggcgaaaagaactctccaccggtcaaagtgcaaatctgtctgtctaacggactttgcctcagtttagcgaaaccgaaagcgaggatcgtggtcagagtcagttcgacatgtcgctgttaggacgtggctctgtttatctcaggggtctcgaggttgtgtgctgtccaaacgaacgagtgacactactgtacaaaacatgtgtgggcatatttttgaaaaatttctcatcttgtcgttgtgtgttcccattctggcgggctggtagcgcagtccagtggtctactgctgcttgcggcagcggccttaccaatacagagaaaggacgggtcgtgagcgtttcaaaaaagacggctgagatgcaaaaactttctttcaagtactgaaattgtgttttcagtcacaggcagactaacatgggatccccgacaaaattcgacgaggatgcgttgaattgtggctaaccgcattttcatagagactcaactaaataaaagaacatgtggatcacgtgtctccagagaatggaagacatgcttgagcaagtcgtagttacgagagatctacatgtcgaagaacgaaggggagagctgaattgaagacgccaatggtgttgggtagaagcgagcggctggagtgtttcttgctttggggcatgcaatttactccttcgtatttttcatggtttctgcacatgcatgtttcaattctctcgaagcaaaaatccgaactctgcacaaacggtctttttcccgaagaacccccgcagtcgttccaccgcaccttggaacaggaaagcgaccctccatgtgccctcagaacagcctgttctgtgaggttgcaggacagcccacttgtcgcttctgcttccttagggtgaagggtcaaggcccggccgctaccgaattcagagcagacattctgagttgctgacacacctaatgaaactacggagtaagaggtcgcgttcgttcgtttcggagaacgagctccgaacgcccagtataaattatcacaagaagtacgatatcttccgtacaaaaccggagttaagaatatcaagggcatggctagatcaggtaccgcatttaccacaatatcagcacgcactgattgtattttacactgtgtaacatgaacagttacagctgttgttcgactggcgttgcatgccttctctcccttttcgaatctctgtggtgcctctaacacaccagtgagcagcttctgatgctactgcgagacggttaggtttctcgcgaggttctactaatttttttcgactgcgaatccggcgcctctgtcgaactcgggggtcacaaagagtcaccagaagacgaccgcaattccacgaagagacaggcacatttacttttatctcatttgcagatatatatatgcatatgtatatatataaacagacatcagcattcactgccaagtacaaggcaagggtgtgcgcgtgccgactcagagcgacagacgcgtgcttttcatctgcctggatggtaattttcgctgcatgcgcacatgcacgagtcaaaatgatttaaagtggagtcgggtgcctttcttctcagaagattcttctgcatgtcggggacaaaaaaggaggagggagctctcgatcgtcagataggtgccagctttgttgccagttcttttcttactcctttgctattgggcgcagccgtcatgactctccttcagagcttctacttcgatttcatgcgccttctctcgacttgctccccattttgaccgcgagttcctgttattcttctttctctctccgttcttccactctgtatgtacaccagatgcctgcccgtgcttgttctgcaagtctcccttcccccagtggtcccgtcgccagactgtttccactgcgctcttctcacctgccgctcgatccgctgttttcgctcttctccatgcacccttggtttctctctttcttacattctctctctgaatcgcttctccgctctctttttctctccttcctttcttcttgcttcctcgcttgcgattctctcccttcctccactccactccttctcttctctctgttacctctttcctccattgttcctttttgtcgctcctctctctagcctctccacccgtctccccttttcttcctgcatacttatctctctttcctctctctcccctccggtctacttttcctctcttctctccttgcttccctcttctcgctgctctcgtcctttctcgttgtttctcggcctcggagcaaga

SEQ ID NO: 2136 - DNA, 4155 bp, Toxoplasma gondii
acatactaacctatacgggagcgtatatggaaccatacgtgggatatacgtatgtatgtatatgaatatatatatatatatacatatatatatatatatatacatatatatatatatatatatacgtatgtgaatatgaatatgtctgtctgctggcgtgcttaggtttgtggtgccggagtcgcgaccaccgtgttgaagagttcccggcacacgagcgaagcaggtttcgatttacctgagaaactctgtcatggcttttgcaatttttctagaggcggaagcagagccgctacaccgccgatggaaaagaagcgggaactgcgtcgttgtcccccttgctggtttatcttctgcagtggagatttgttcgggcagaacgatcgatcggagaaagcagaagcattcgtagctgctgtgcaggtcgtcgtctgtcgtccccccgaagggaggagggcaaggaagaagcagttggtgccgtctggcaagaaaagtttgttggaagacagaccgaacagaaaacaaacacaaaaaaggaagaatcagaaggcaaaaagtggcgtccgacttgcttgcgcctgatcaattgtcggagacagagaaattcagcgtgaaacgcgggagcttaggagcggtgaaagggttcgcggaattcgccggattctttcgatacgaaatgcgtttcttcgtgggaacaacacggaagaaagcggagaaacgccacgccgaacacgcaaaatccctgtttttgagctctctcccgcgttttgccggtccccatgaatccggtagtcgagggaaatgcgcccatgcaacgtggagaaaatgcgctgctctttccgagacagcgcaccatgaaacaaaaaccgtattgggttctaaaaagaaagggtccgcggattcaaaagcggaaatcgttggagaggaaatcggtcaagattgccggaaggtccagttgtgcatgcaggaaccggccgcgctcatcgaaacatgcgacacagtgtcacctgtagacaagaacgagagcaacacgcgtttttcgtgactttcccatccgataaatcacacttttgacagaagagaattccgggagaaaccctttgttgttgctgtttttcaagatcaaactgcgacggaagaagggtatcttcttggtactttacgccggtttcccgcttcccttaccaccgtgagactttacacactttaaccgcttaaatactcgaaggttctggtggtatttttggtgaagaaaagtagactttctactgaaggacgtatgtgtgcggggactgccttgtgtagtgggtattctgtgccgcgggctctgtgtctcggatcgccgcaaactcgggtgtgacgccggcaacactaaaaggttccttccgcggaccgatacccacgcaaaaagacaatgcttgtgaaatagaggtaaatgaggttcgcagattgaagaattattggcgttagagacaaaatgctgggagagcggagtgaactctcgtgactgcagagtcgcctacggtaccttctcagtttcggtttaggtagcttttacacgtgtggactgacacgaagctgcggaatgccctgcaaaagatgtccaacaggcaaaccaatgaatacataaagctcctcgtgctttatgaggtacgcagaattgagccattcaaagccaagctctttgaaaacgctgaaatgggaatgcgacgctgagacactactcctagaatcggggagaagaaaactgacgaaggcgtatctcgagttgcatgtgtatcaaacgagaatacgtctgctccatactcccgggctcttcgcggatagcgtcaactgtgtcaatagtgggaggaccttgacttttcgacgctctgacgctagcgacggacaacagaaccctgaccagtccaggattctccttcgatctgttacagttccgttattgagcgacagcaatgcaagtcgccgtgcatgttgagaacatgcccttggcttacataaaaaaacagaacatgatcaataaatcactctgtcgctaccgtagctcgagtatgaggcgagttggcatttctgggaggggtggtcacagaaaagacacccggactcataaataggcctgtaacatccgagatggattcaaacggtcactgtatcgatgtctgttctgaggagtagcgccataaaccgtggtcggagggttcgttgcttgctttatatggctcaccgcaacgaccttaccaagaaagctcagtgtgcacatgtttcgcgtccgtcagtaacacaaacggacaacaggtaactcttcagagcttggtgtgtctctcttccaggttgagattagacagaacggaacccaaggaaacgtttttgatctcgaaactggttagcagtcaatgaacgactacgctccagttgttaatcgtgaagagttctcggggcagtgtggatctcccataggcagagcaacgctcatgcatttagtgttacatcagacttggagtgaagtttgcggcttccgaacagtttgtgggttctagcctccaagttaacgtgaataccggtgtcaatgccggttctctaaaaagaacctgtgccatctacactgggtgtggtggttccgtgaactcaaaagcgcactgtataggtgtagtgcaggatccctgcctggtgcagcgacacgtcaacggcagctgctgcattacgcgggtccgaaagtgagagaatatttgcaggaaactgtcgtcatgcgtgaaaaagtcggtccgacggataccactgttgctcgagtctctgtaggtcctgggaaggtggatgcagagaaatggtcggctgatgtctcgaagttcgatttgcgctcgcaactgcttcctttttctatctccaacgcactttcttcgtcgcatctatcgttcgaaaaaaagaatggataacaccgtcattcttttcccgcttcgcttcgttctcgagctggagggccggcggggcaccccgcgcgcgcaggggtttgcctcagacaatcgctcggcagttcgtgcacaccgtggaaaagtcaagattttgggaggacagtgactttttgtggagcaacattgcagctggcttcttggagaacccgcaaaacaccgggaagatctgctctggaacctgtatatttatatggatttctcgtctgctctcctttgtagcgtcccgccgttcgactctcacggggctgggataatcatcccggcaaggcagcagtccggcagaagagcgacgggggacccgagaaggggagacaggggtttcagatgcgtgtggaattacagtgcgtaggagtaggagccgactaatgctgagacgaacacctgaagaggaaaaaataatcggcgtgcaacactgtcggagccgcggcacatcttccgcagcagccggtgtgccgcgactgcttgtctcacgcttctcaggtcgggtgaaaggatttgcctcgtgcatgctcgcatctgtgacgagtcctggaggactgaagatcgctgcgtgaagacaagtcaaaccaaacaggtgacgaatcttctggaactgcggtagacaaagttggccgcggtcgtctcgtagcgccttcgaggtccgctttttcacgcatgtgttccctggctgctccgtagcagctaggagggttctgcggcacccgagaacgggcagcaaaaccctttggctctccccaacccgaagaagacattctttcgcgagtgtttattttccagttacggacccaaagccccttttggaccgcgatgaatcaatgaggaacaaatgtctgtcgcgaagcaactcagaggtctccgacagtttgagtctccgagccggtaacgggaggtgccacggtcgctgagaaagacttgcgcgggtggctgctcgccactggggtcctctgcagtctgctatagtttgtttttgatgtgacggggactgaagaacaagaaagcgttcaaattgcctctcgcgttcaaccaaccgctgtcgtccccgcgccagacgcctccgcgggtccgcgcgtaccctgccctcgcgcccaccacaccagggcggcaggaatcggtgtgggtctgcggagttctagcagggactttcgcttttatctctccttttgcacttcgtgtttgcgcgtcgacaaca

SEQ ID NO: 2137 - DNA, 3624 bp, Toxoplasma gondii
acgcatgcggacaaggcctagagaaaactcaaccttcttttcgctctccgcgttatttaggcgcaggcgaaagtagacagacaggcgtgtgtgtcataaagagaagcttttctctctcgaagaggcttgcatttcgtctcacttgaagcatgagggtccaccacttgtgtttgtcggagacgacgcgcatggcgtctcgtttgtgcctcgggtaaagtcgaattttttcttcttccatccagacgacgacgtcgcgcgtccactcccagtcggcctgtctttcgccctcgagcattgcgcatgcaagcgccttcagcttcctctctgtgaagggggtgagagccaccgggaggcatccggagcgaggcttgcatgcagcagaagctgcatccgccatcgtggagcggagggaaagcgcagaagactcggcggcgagaggaagtggaaaggaccgaggagggaggagacgcgacagaaggaagatggggaggggagacaacagaaaggagagagaaagcagatgcacacgcggcacgcggaggcgctggaggcgcggaggcgctgcgaggcgagagacgagagaaagagaagaaaagaagacggtaggggagaaagagaatcggaagaaagggaggagagagaggaagaaccgcggtcagaagagccgagaagaggggcacaccgaactgttaaggcaaggagcagacgagcgggtacgaaggaaaaacggacgaggtggagagacagaaaacaaggcttatgatgaaagaggagcggacgaatacaagtgaagagagtacggagatctgcaagcgcgaagaaacagagaaagtgcatctgcggagtcaaagtacctagggaggtcttgacatagtggaaaggaagagagaaaacgggcaaggtagctgacgcatggggttaatgctgccacttgggcatgtgttgcgaaacaggagcccgaaaactggggaacgaagacgtaacaaagagttccattgcgggaagaactttgacaattctccggcgtacacaatacactgcggaaatgcgcgccgctgcttccccgatttcgcgttgcggcggagcagcttttcaggacttgcagaagcgcggacgacggtgaacaacccgtcaaaacgttctgtgttgcgcaaagcagaacacaaggatcgcggagaccctctgagttccgatttcttttctgcccattcttccaaggaccattttcctgaatggcatcgcctcagcgagacatgagacaccgagcagagcacacatgcgcgcttcgcaatgttgtcctgccaataaatgcgcatctgcctgttcctttagcacgagcccgcgtttttttcagtgcttgtcacattttctttccttccggcttctgcacttgactggcgaagacttcgggctgccacgggcgtcttcgcggttctctttgcgctgtgtttcgccgacatgttcagcccaggtcgtgtccagaagccaacaaggcacctacagagtctgaagaaagttctcgagtgcgcagcttcctcgcgcgcacaaaacgaggcattttctgctttctgaccgcacaagcccgtcaggtggatcgatacgtcagtctgtagtaggcccggcaagtgctattccaccataaagcagggcttagacacgagcttgccatcaaggtatcacgaattaaagggatttggcaaacgaaaagaccattctgcttcacaagcacgcaagtattggttcgattccgacactgcccataaaataaaagacaaaaggtgaaaggctacgctctgtcctccctcgtccaaaccaaggaaacgacgtggatacgtagtgccctatcttcagagggcatagagtcatataattctgtatttacacgcaattgggtagggtcgtgactgattcacctgttgaagtaggtgctcctgtgatgtgtaacaagattcagccgcgaacgactgttaatcatctggagtaatgcgggagttacgcgtttcttcttgtgggtcagaagagcagaggccgctctctacgtattcagcactgcggctccgtggccggcttggactttctcacagctgcgccggtgccggtaaattcatcgacaaagacagggatatgggtttcaggatgcagcaggacttttgtcacttggtaggaaatgcagtctgcgtcttttgatagagactacggcttgctgtgtgcgacgtcaagcgtgatctgtgttccacgatacagacatggatttgcgtttcgccatggatagcgcgacttctctggcgtgagaggcataatgcagttgacatatggcttttcctaaacgcacgggagaagactgatcctttctcacaaaacgatgaagacgtctagcggtcatttccagatctagataggtggtttctccctcgacggagtctaggaaggaaccagttcgagacgggaggtgatctgagatggatcgcccgcagctcttcgtccgatccccctccaactcagattgagcggttaggtggcgacatgcttagctccggggttcgcatgcagccgcaactgcttactctgaggtaactcgtctgcgccggcgtattcagccccgggcactcgaggaaacggcacagacccgtctccctcctgctcctgcgtttcatagaaaggcgttcggagcggcgcgagcgttttccactactcttgtcgcaaagctcagctcggtcgaaacagcgagtcgaggaaacgcacaacccggggttaccaacaggccagtagggtcggaaaaaactaagcacgcgaaactgaggccggggatcttcctcttgtggaaggaactcgtggaatactctgcagcacactggagcggttcagtcgagagaattcctagggcaaggtgagccgacaggcgctttcctttgtccgtggccagggatttagggctgagacgctgatacaatgctgcagactgtactcttggcgcgtcatctctttactgttccccagtttgtgtgtgcgacactgccgggggacgacgtgcaagacaaagcgctggaaagagctggaacacgtagagataagtcggcgtccgggtgtgtggaggcgggttgacgaatgcctggtgagtgtgagggttcgaaatctgttttcccctggagtctttctgtcgcgaaacttggagatcgttggtggtttcgcacgtaggtccaacccgtacaaggattacctgtgtccatctgtgcatcaacgtggatactcggttacattcgttggacgctgacttcccggcgaagcatccctttgctttgaaacacacctcccttctcgccgtgcgtgtgacctcaaagtagagaaaccctgctgttgtcctggcacgtgtatgcgacattttctgtcagaacggaatgcgcgtgacacggctcgtgaaagcggattctctgtgcaacggcaccgcgtgtgtctgcatcgtttccagtcaggccccggtggtgagggtttccccttgtgatttcgagagatttcttcgtcgcggtgaccgaactcggctgctctgtttggtgtctttgaccgccactcgcgtttcctactctgcgcaattttcgaactctgtgacctttaagacttctgcgcgta

SEQ ID NO: 2138 - DNA, 3570 bp, Toxoplasma gondii
tcacattcattgatataatgcttatttgtatgtgcaagtgtagaacttcggtgggaagcaagtgtatttggtgtcactatgcacgcatgcggaaggaaccgtttttgatggatgaagctgcctgtgtgttttatcttcagagccgacggaactgtggtcgtccacgaagttggtgtcccggtggttgctgcggaaaaaattgtggacaccaacggcgcgggcgacgcgtttgtcggcggttttctctatgcactctcgcagggaaaaacggtgaaacagtgcatcatgtgcggcaacgcttgtgctcaggatgtgattcagcatgtaggatttagtctcagcttcacttcacttccgtgttgaactggttgatctgcagcatgtacacccttgaaaggggggggattggggaatcccacacacggtccaaaaagttcgcttctttgaacggccgtcttttgccaggcgtcaacgtgtgccctgtgctcaactgtacagaaatcctcagtttagtttcgccgtttggctcttccgaacccatgtacattagccttgcagggtcgtgtttcccagtgctttccgccgtgatgcgaccgtgtggcagtctccgtgtgtttgaggtggaagttcgttcggtccaaaatggtgtggcagtgaaatggtgcattcacgggaacgtagtcccacagtttcgctccatacgccgcgtgtattggccaaaatagtcgttgcagaactcgtttggcaagtcaaatgacggattcagttccacaggatatcgcgagcaatcagccaaagggcctccaacgggatcagcaaagtcccaaaatctccttttccggtcaaaactgaggcacagagatgtcaacggcgggtttttatggcgtcagacatgcagctggacaaacagccacgcacgattgccgccggccgagagacaccgaaaacgaaacgaaagacttagaaatttccacacaacgaagcatatacgaaacgcagctgggatgtctgacaccagcaatcgccgctcatctgaaacaaaaacgacaggcacatacacaaaggcaccattttctcgcttcatgcatataaatatgtatgttcaaatattttcatcacaaggccctttcggtcggttcaacttctgctcaaacaaaccaagaacctctaacatgtgtacctcagtttgacgacgctggagacgcgctggtatgtctggatatatatttgcatgtatgtgcacgatgcgtgtgtcttcctatgcgcaccgtgttcgtttataggcagcactgctctgtataactgttttcgtggagtctaggagcctctcgaatatacatccatgtatcttgccttctttcgctacgtccgcactattgaatccacagcgtttccaaggggtggaacgagagactagaacatggttgcttttcgactcctagcaagttgtaagaacgttcacgattgtttccattcttccatcttccacaccagtgacctcatgagcctgtcagtcattgtcctctacgttcctagacctacgaacaaataagcgaggtctgctggcgacattccgcacagtactcgataatcgaacgatttaaaacaaggtgttgttgcaactgttacaacacccccctcaaatcgaatcacagatatgtgtcgggcctggggcgtgcaccctctatggataggattcttgtttcgactgcatcaacgagactgacaaggcggaaggctacgactgatgctacgcagtggcaggcagagtagacaagaagcctgacaatcagtatgccacgaaaactgtgcaacaacactcaactcatctggaattccgaacgtgtcagttcgagatcccggcgtttctggaggccaagatatcgacagaggagcaagaatctgcgcgcatgtgtgccaggtctcttgcttggattagcagacaacaccttcaggaaacactgtcgggcgcatttgtcggtgccccgcgagttgcttgcgtttcttactctccataacatcatcaacatcacagctatctactgctatcgtaccggaatggtactttctcgtatatcccgggatgttaaaagtgcccagcgtatatttgaaaacccaacatttgccgacggagtatacacataccaagatattgttgcacatctgcacttgtctcgcagagcaacctctgcaacttccccaggaatatagtgcctcgggacagcattgaaggacacgataaaccagttattgccgtctcgttttccggagtatacgaggagggaaggcgacgagaacaaaggcaatcttacattgtcttgactcgagagaaacgcaacatcttgtatagaagagacacacgtgcagaaaagtgaacggtcgcgacatccttcagtttctgtgtgcggtaccgttctagcaatcgttaaaccatgtgtacagtgagagacgctcgacactttttcaccccttcttcccggttccgctgcattccctgcctttctggaagtgtgcaagcgtgtccaatctctgtgcgaaggtagaagatcacgtctaaatcgagaggttgaaatttgagggcataaacggatggggctgtcgactgactacaaggatctttgctgaggtcgcagtttatccactgcgagatcggcggacgcgcgcggggcgacgcccgtaagtggctaggcgagttgagagaaaaattttaccgctagcgagcgccccttttcttcgtttcttcttcgatttttgatgttcttccgcatctttgttctctgttttcttccctgcgaagaatttcccgctcttcgcggtcctgggtgcttccctccagctctcccgttccctctcgacagagctcgcgctaccttcctcagagccagcgcatgcctacaaaggacgtcttttttgttctcggcgtgaagtctccttctttgtcgcttcgtcttccccagaagcaggctctaggttccttgtctctcttcgctgtcgctgcctgtccttttctcgcgggtcctgctttctccacggtgcctcgcacactcctcccttccgcctcatggaacgagacgagaagtgagtcgcccgtgagctgggctaagaacatctctcggcagtttgctggccaccttccatttgaaattggaggcctgaccactgcttgccaaggactttcctgcctctggggcgccgcaatgcagctgctgtttacgtgctcctgcactggacacggattatacactgcaagacttcctcatgcgtcttagcagttaacagaggccgatgtgcatcagacgcgtctcccgttagagactttgcaaccctcacgtcttgtacggcttctgttttgcgagaagcaactgacgctctctctcccttctctagttcctaggttgcttgtcgccgtgctttactcccgaattcgaattccgcgttgcttttctcgtgtctccgctgccagctccgacaaagtatttctcctcttcccttctcagttcgcattccatccgccatctctctgtcttgctttctctgcaccagctgtctcatttttccgtctctccaaga

SEQ ID NO: 2139 - DNA, 1262 bp, Toxoplasma gondii
taaagtgtcaacagcagaggtttcgaaacctgccattcacccgatcattatggccccgtgtgctaccagtacgaaactgcgggctgatgcattccgtgtgacagctaacgcagagacgagcgagaagaaaagtactaagaggggaagagactgggtgatcagtggaagcgccaccgtcgatgatctacttggaaacatcaaggtcccacgcaaaggggaaacaatatcgggacgggcgccttcggcagttgtgtagtgctgatgagaaatctttaagccttttgaggcaaactgataaaggcttcttcttcgctgtgaacgcattatgagcttgcttgagttgaccaacaatctgcatgttactactctgacggtgatgaatcagtcaaagacctgtggaagtaccgcagttgcttttggggaagtttcaaggatgtgctcactccgaacagtccgcgccagcaatcataagacatgtattgcgtagcgcagaagggaaaaccgaggttcaaggtaacctgcgttgatgcaaagaaagtcgaccgcaggtgatagcttctatagtttgccttggacggaattaagaagccacagccgcttgcctcagtattgcggttgtcgcctgccctgtctccgaaattctgacactccgcgatcaacgcttgcttgatagggcctgctcaacatgtcagagccggcacgacactcgctcatgttacacgggtttctcccactggacccccgatttccagagccctcttggggaatgcgagaaaagcattttaacttgcacaactgcaattcagggttcattcttggcacagatatcgaaacgtcccctggtgtgcaggtagagtagctgttcgacagattgtactgtttgagtggcgagctgtcgtccacggaaggactgtgggcaaacgtcattgtacagatttcactgttcactattcgccgtgctttgtgtcttgcacggatgtgcaggctcttctcaggttgcgggatatgtcgtgtttccgtaaataacacgatctatggcacatgtggtaaatcttttcacaatgtggcaagattcttgaccgctcagaacatcgaagtggccgttcgttgtgaaatacggttcccggctcacgctcattgactgtacgtacacagaactgaatcgcatcttgcatgcggctccggagcagggtatctctgaagaaaccaactacgggcgccgttgtagtttgttcgtagccttttctcgaaattcattaaga

SEQ ID NO: 2140 - DNA, 4866 bp, Toxoplasma gondii
caaaatccgcttgtgaaagatctttgcctccacctaccacgtcggctggcgcctcgtactccggtcgactcattgtgtctcgtttctatggagtgattctgcttaaaattcaaaattgtttgctcccctcagagcagcgctcgccttcctcatgtgcaaccgccttcacaggtgcgtcggtgttctcttttccctttcgatctcgtccttctttccccggataggggcattcctatcgagatcacacgcaaacggctgcgagagctgtcgtccgttatacatgacagaagtgaaagggatttgtgtccgttgttttggaggcttccttctctgttctcttctgggtacgcagttgaatgaaacacagatgtgcgagtcaggcgtcgctttccaggaaacaggggcagagaataaatcaagagtacgtgaagatagtggacactcggaagggggaccaatgagatggaaatggagggacggaaggaaaggaaactgagaatacaacaacagaaaagacgaaataaagaaacagatggacaagcgaggcggcaccagtttcttgttcagattcaattcagacaagcgcgccacgtagaagcgtcttgaatgcacgaaactctgctgctgagtgcagaaaccttccaagaaactgagacaaatggtcaaaggagccgagaaaaatggagctcagccgtgtgaggaagggacagcggcacggaacaaaaaccaatacgagaaacgctgatcaatcgcagcgaaggcgatctacgtacagaagctggggactgaagaacgcaagccctgtgctcgttgcaagggcctggcaccgaacgatggaacgtgggctcaattctcgaaaaaaactctacaaaacaaaggagaaaacgaaaaaccgggggaaaatccggcgcgattcaaagcacaaaggcgttcagtggggtggcagttgcggcgcatgcagcgaaaattgaggtacccgtaggtgatgacattctttgggtttattcgtggcatctaatcagaacgagatattttgagaggagcgtttgttctcgttaaaagctagagggagattataccctcaatttgattcagtttctgcataatttcatgatacaaccgtgaacagatgcatgcggtcgccggcgagtggatcgacttgctcaaaacggcgtttccccgtaaaggaaattccctcaatgttccgaaatgctttcagcgttgcattgacatccttatccctcacagttaactaggagcgtagaagtggtgggcgacttagtactttcagaaactccgagttaggaatcggtgtgcgtgctgaaggaggtaccaagcgtgagtagcagcggtagctgatacggcagcctatgtctcactcacacgtggcgttccacggcatctttgctccaattgcaaatgtacctggatggaattttcaaagggagcttgacagtggcacatgatagcggtggtggtcagagggccgttgcgtctgtgaacgcgccgttctaataatccgttgaactgaaatatcatgaagttcgttatttttcttagcttacaagtcaggaggtgagacactggattgcggaaagtcaatgccctaccaggtgtctgtcgaactagctgacgtaggctatcgcgcagggactacgtcgttacacagcccctgaattggtgttgaatatgtttccccagtttttggacctcactcgcgaaggcctggaaccacgtcagagttcctgtgatctttccgggggtgaacctacacgcgtgttcacttgcttcgacctgtggtgcttgtacatgaatgtatgtggacgactgctgagtacggtcactctccttgcggagaaatgggaatggattaccatcgagcaagaagcatgtccggtcacaaaaaataatgtgaaagcgatcccccccacgtcgttggagcgccggtgacggcgtggaacaagcaaaaccactttttcgtgagagttgtttgcgaacataatggcatattgcagtggactcctggtcagaatgttgtcatctgtagaggcaagacagaaataggttcgagaacatttccacgactaccgagacttgccgtaatcacgtatgcactgtttgggctgacttttcgcgagggagttgcctttggggtcgttttcagatctgtgtgatcgacgaatgtagtcctctctcaaccaaaaacacggtgacttttgccatacatagaattcttcgcttgactactggtacgtactacaaaggaattgccaagcgaaagtcacgggaatgaataggtgtgcggcagaggctttttgtgtggccacaattccgcggcattttgaaagagtcagagtgacaacgataagtctttaagtctttcttgcacccgcacatctgtgcatagcccttgccagtacacagttttgtcgcagagctcacatttactcatttacaacatataatctgcgacgacgagcagtgcggcacagccttaagctgtcttcaagtagaagcaggtgatacatttccacacgaccgccagtcctagatctttacccgtctggaaatgtaagcgaatataccgctgacatctcccactatgcaaagcaaatcgacaaactagttgtgcgttttcacggtggctgctgctttcaaccaaagcctaaggcggtcacgcgggactgaccctgggtaggcgtttgaatgtgtgcccggggaagaagcacggtagcttttaagtgcttgtgtccgtaaacactgcagaaatattgaacggtattccttgctcccaaattaactggaggccaagtatccggaatctagtacgagagaaattaggcttgtgaccagagtttggtgagagagatgcgtgcactgaagacatgaatatgtgaagaagcagagaaaaagcacggaatatgtctgtagattgaaaaccatttgctgctcggcaagaatcctacgctcacaaacagcctcatctcgaatagcggagcactcttggtgatagggatgagactccggtggagaaaatgggcttttccaagtcctacggttggtatttccaagatatgtagcatcttgatacgacatgatttgaagatgtcaaaggaaaatgttgagttgctcttcgtggcagtggcatttttaaaaggctggtgtacacttcccaacaagcgtctataattgttgctgtatgtgtaggcagcgggaaggtaatccacaccatttgaacgaaattgtgtcgcctacattttccagagtgtcacgacaacgattgaaacctttctcgacggatctgcctcgtggatacatctgctcggtctttcttctggaaaggttctcccccctttttttccccaattgcagccaacctgtagaccctctccacctcgtgaaaatcactgcggtgtgtctgtgttgcgctgtcgcaggccctccgttgataccgacggttagggactgaaagtgttcgcgataatttgccccatttcgtcccgaatcacggaaaatcggtgttaccgctcttgtctgtgttccgcccagcgacctcccggctgcctcccagttaaatgtggtgtcctgtcttttaaggccgtttgtctctccgaaacgatgccgctgtttgagtgtgtcctgttgagggcttgtccccgggtgtgtcgtgtcgtggaaagatagctccgtccagcgttatagaggacactgatcatcatgctgtttgtccgggactgtagtataccatacatcgtgtacaccacgctggctagcctcactggcggttcgttttcctgctttttctcactgtaaggccgttctctctcagatacaatttgcgtgtatataaaaagcgtcgttcgtccgtcggtgcacgctgaagccaaaccccctttgtttcggtgcggtggtctgagccgtggtgtgccggtcgggttgcataactgagcacttggagggaagtcttccgatacaactcattcacggtttctgggggctggcgtggcctccttggattcggttttccctcgcgaaaccgttgccgtatgtgatctgacaatacaccggggtcgacgaatgttgagcgatttccgtcccaagaaagtaaaaaaggaatgcttccccagtttggcattgcgctataggagagggccgcaacgctggatttgccgtgatatctgcactgccgtaatcgtatataggccgcaaagagttgctgcgcactttggaacgtggtagcgcggcagagcaagactgaaaactcataatcgtgttgcgaagcgattccacgtttccccctaaaccgcgtctgtatgagataaaagattggttttcgtcagacctctagagacgcatggccgccgcgcgaccaaaatattccccgtacgtttcgcgtcgcgacccttgacccgagaaagcggcgtttttccggctgtcggttgacgaattgcaaagacacagcatcgtatgtacgattttttcttgtaaaacgcatctctccatgtgaactgctggagaattgactgtttttgcctctccccgtctgctggttcctgtcttcccgttctcgcgaataactctctccgtttcttcctgaaactggcttgtcagtgcgtcggtttcgggtttcccctgctcagtttaaagttcagagccagttttcggcggccaacgatttcatccaggcaaggaacgcgcgcgtttcttctcgcttgctcggcgctgtgtccagaggaagaaactccttccggttgctgccgctccagagttaacgacctgtgtttaccgtccatttctccgtcatatcttcttccttcttgtcgatctgagggcgtctcatctcttttcgcggcttgcgggcgaaaa

SEQ ID NO: 2141 - DNA, 4649 bp, Toxoplasma gondii
aatcatttcggttaagaacgactaggccgtcattcctgtggaactgtttcagtaatcgccgtagaaaggagttcgtaaagagacttcttgtttaactgtggcttcgtctggggtagaagaacgggccggccggcctgatttgtggtcgtagtgctgaatcgagaaaggaagtactccttctccttcgaaagcaggtttctcttctgcaaagtagtgacagcttgagattgctgcagcggacgaaagaataactgctcgggactcaccaattctagagcttcgatttctctctctaacttctgaatcatcaatggacctcggggaccctcggactgaagttctttaagctcggcatcaaagcgagttctcagaatggcgactgtttgagcgtgtctttgcagtaacagctgcctttcactcttcgaagtggcaacagcttcccgcaagcggcacacaccctctgtcagttgagacagttgcgcttttttctcggtgacttgcctcgacagcgaggagagactcgcttccttatccgcctgttcacacctggcccagtggagctccgtttcgggtaacattacgccacacgcttacctttgcccgcttatacgatgtttcacgctccactgcattggctccactcttttcgacttgcaaggcgagtgccagcttgccttgaatgataacagcaagtgaaacccagctggtgtcagcctgtgctgttcggtatgcacttacgttcgactgcctgcgcttcacaaagttctatttccgaagtgtggcgcataatcgtctcttggtacagctgaagcctgatccccaaataagcaggttcttactgcggggacgtgaagcatatcctactctcgaagcgcagaggcgttcttaattttttggtttgtccgacatttcagttccgatgccaaaggaagccagactaagcgatgccggcagttgttcgtgaagattaaaacgaagcgaactcgcttaccctccgactgcatccggagttgctgccttgcaaatctgactttgtcagtgagctccgacagctccaaagcgaggcgggaattctgtgtggtttgtgcgccaagcaagctcatgaacttctctgtttcatgtcgagcagcctccaaatcgacagagatcaccattttctttggaacgacaacagcaggacgctgagtggctttcgtatgtcagggagagaagagaatctactagttctgtgtatccacccgcccgggtactcagacatgcctatacacctgaaacgctagctggattgaccgcttgacttcagcacgttgccttcgcaaaaaaagtgtcctctacttttgcagtgacagagtccttggcaggaacttgcaccgtcgttctttttggaacagccgatgtacagttttccggaagaattacggttctaccttaatctttgcggcgacacttctgctaagtgcgatcaccatattgagtgccattccttagtttattacgcacgcagagttggcaaaagcagcattcctgtgagtcacccatgcgccaggaaaacagaatacaggtatcggattcttgttggcatcgcacctgtttagtaactgaatgaacgcctttacgcctagtatgtgtggataacactcgactcttctctgttataatcactcaccgccgaactgacacaccgccgcagcaaaaaaactcctattgttttctttctgtggaagggcaagacggtgtgcaaaaagtcagttcgaacgaaaaacccgccgtgggatctgcctgtttcctagtggaggaattaatgcagtcagacggaatagaaaaagagagagaaatgcagtttaccttgccgatcggtgcttgtagaaaccctcggccatcgcgtacgtgccattagtaaaagatatcgcagaagtgttgtactgcatacagcagacacgacatggcaccccgaatctcctgaagtggacaacaagacacatcggaaacctgtgtacactgtcgcgacgtttgtgtcgtctactcttaaagcgaaaaacgaccactagcagtttatcacagtgtggactcacccaaggtgtgagtgttgagctccagtagtccccggtgacaataaactccggatcccagagtggcgcgtactcaggatctacccactttcggaaggcatggggaatctcgagaacgctttggacgtaaatgtcgcctttcggcttgggattaaacaagatattcccaactaaggctgcctcggccttgccagcagcaatgtgcacgaatgtgtggaggtcttgtccgtaagctggttgaaactggagataagtgttttctcgatttccatctcgacggcgcagtttacgcgggtgccgtcgttgattttcgatcgatcctggctttttgcgccgatgaaagagagaatcggcctgggtagttctgtggtctctgctagtctcaaagtatcctcttgtttgcggcgcgtctgcatactttgccacactaatgcggttcctctccagatggtccgggtctttcaactcttcagcaccaaaatgcgggcggccgagataggtggaacttttctgaatcgagtaaggccttttccatacgccttgagtttgaggctcctgcacgtgggccgtcaatgtgtcgccttcggtcccgtttccgtagtacacggtaacaaacataaatgctgagtcgtcatgcagcatggtcccattgagtgctgcaatatacacatctacagtagttggcggggatctggactgtactgcttcgacaggcacggtctcggtgatgtacagaatggtgaactcatgcgaagactctcgggattgacctatctcaattgtctctggtgtcgcgatttcgccgtcgagttccactgatgcttcctgcgcagcgctaacttgagacagcacttgcgcatcagtcccagactcgaatggcgcttcagcagccgtgggatctgaaattgctttttcggaactcgctgcaaaggagagggcaacgcataagagaaggaactgtgttttgcctcgtgctgtacgaaccatgatgtgtgaagggttcaggcgggaaaagcaccgagaacaacgagaacaacttgcaatcccttgggtagcctcttgaaatgcaggtgttttacggaatatactttagtcggcttcggccgcctccactacgtggcattttgtctcgcaagcggtttccggtgagaatccagaaatgcgaaagaagcttcccgaagtcgcatagcaaacagtgggtaaagaatacgaaaacagttgacagtggttgaacattttcacctcgtgcgacggcatgatctcgactttgctcggctgttttcagaccacttctgcaaatctgcagcaccatttaagcacatgtgagtcaacccactgtctaacacttagtatcgagttgatttattcgcaagcgatgaaccgaaacctcttcacgagccggtgacgtgccccgactgttggttttacttcagccgagcgcgagaccagccaacctctgcaaacaggcatctaacagtaatgattagttcaagagctttctagtccagcctttctctcctgtgtacttctgcgcaacgatttcattgctgtacgagttgacaagggggtgtacaattgccggccacacaaagcatctgtgtcactgtagccatgtgcgcctcattgttaaggcatgtagcgcttcagaggagagaaccttcggtgccaatggcttttgacggatgcgattttttgcagctgcacggtgctttcactgctgaatgcgtcagttgagaatcgaacagctttcgaacagggtgagtattttacacttctgagtagtgcaacgaagtcacgaaaaggcaaaactgttagtgactcggctggaccctgggtgcgaccgtagaccgatctcgacatcacgaaagcccttttagaagagtatagggacggtacgtggcacgtaaaacctgcaacggctctgaggctcccaacgcaattcccatgaaaaatccgcagtgcgctttgtcagtagcgctgctgatccccttggcaagtcaaccttttgagaatgaacagagcaccgcgacacctctgagagttttcagcagggaagtttgcacataacaagcagatacaacttgaaacacctcatgtgtactggtgagaaagaatatgcccttctttcgtctccgaagcggctgcattttgataccgagttttggctaaactgtgcaggtggatgtaaaacgacgcgttctttgtgccaaaaagaaaattgtgaccctcgcggcctctctatgattgtaatcttcaggtttgtttttactgtcagtgaagtggcaagtgagccgctcacgacccggtggttttgaccaacctacatcgcgttgttagacactttcatgatgcttctcggtggccacgaccagtcgtcgttagttctagcacttttgttgctagcaacgttctgtacctctgtcaatgccattgtcgagtccacacacctgaatatgggcatatcactacaagcggtcccgtcagaatcagtacgggaatcttgccggctgaaacacgggggcgaaacaagtcgcgatggaggtggaaactgtcttgttaatgcagctacgaactccggga

SEQ ID NO: 2142 - DNA, 3453 bp, Toxoplasma gondii
caaattcatgatgcggattttccgtgctttcttcgtaaggcgtcctatcacgtatttctcgtcgagccaccagggtgtcccgattgtcgttgcccattcgccggaggggtacggtggtgggatgtggatgaatctgccttgcggcgtatagggctgctcgattcctgtctctgggtcaatgtatcgaatgggatttttggtttcgacgtcaaaccagtcagaaatgtccgttccagcagcggctatcagaggaagagctaactcattttggtgctggataagtaaaggcgtcaaatctagaacacgaccgaagagggccacccaacaatcgtactgagaactgtgcctcgcgaggtcggacaaggtatagtaacggcaccgagccatttgtttggcgaccagacgaggatccacatcttcatagttctttaccgttactggtgtcttcaacatctttccggaattgttggttccactgcaatcaaaatggcttcgaagctcggtattttctaaaatcggttcccgtacgtgttgtaaggtcctcggtttcgttcctctggtggcagctcgttggaacgtgcttacgtgtcgagcgccgccaactgtcttcaggttgctcgtgttaatcgttgtgccggtagaaacgaagctgttctccaaacttgtccccacgtttttcaatgcacagacaggaaaccagcagcactgacgaaccagtcagggagatgacgagcatttctaccatctgcccaactgcatttctcaagcccttgctaattctcaacaacctccgtttcagtatcctattcagcgcctggccaatagcttcgaacaacaagaaggaggatacgtgttgctgcccgctaaactcattctgtacggccgacatcgaaaagggtgctcggggctgtccccacatgaccgtggctggaccttcggacttatatgggaaagcacgcctcgcgcgttcactggaataaactcgaagactttgttctgtgtcactgttggaggcccagctgcaacacactggtaacacgatattgcttacgattgtgccgcctcaggtacgccgtgacggtggttttgctgctggcaggaagacgcgcatgacgtagcagcatgaatggatttattggcgtatgcctgaagcagctctattatattgagcatggacacggtgtgctccgccacacgacacaaacgagcaagaacatttggggcacttcctcttttgtgtgttttagcaggagttcctcgtattgttgccaacctcctgttgcagagcaggatgacaaagagagggtcttaacgtagccgatcctccttatgcgagggtgatactattataggattccgtgatctatgtaaaggaaccagttttctatatgttgagcgcagttatttagcgctcacgacgaaaatagtgttgtcgagcctgctgttctgctgtagaacaggccatcttccgcgtgtaggctcctctgtgctggaccttgtgaatctggtcttgcgccatggtctagttaccagatttattgaccgcattgtctcatgggacctgcttcacgcatggtttggcgaagaaaaaggattccgtcgagggcaaactactgtttctgtaccgtgtgtgtggtgcgcgcttgaccgaaactcccgcgattcagtagcatgctcccgcgcttgttaattctgtagcagcgtcttcatagtggcgtagtgtccatcttcatcgacaccaaaagcacaaagggtgctgtatctagcatgcacaactctcaaaataacgatatgccgaataacagactggaagtcgtcacagccgtgagggggtatgatatcagcatgaaaggaatgttccagcaagatgctcacttgttcgacttttcagaagcgtattcctctacgctgtacatctgcgccgacgtacctatgtagaggtttacctgggaatcgcgaatctgtttccccaccaattcagttacagattatcctcacccactgatgcacctgtgcactgccacccatatacacggctaacatcgtgcatacacgcggttggtgaacaatcccattcatatcgatctccgtacaaactcttaaggtggtatcagcatgcgtagaccagagcggtgcggacagtggtcgcgctgccagttcatgtgctgtgcccgttagagttacgaattcgtggccagcgcgaaagagagcacctcgcctagtagccgtgctcgcaattcaagacaaaacgccggaggaatgcttattcactgaagtactccctgattttttcaaggaagagccacactgtactacgatgaggtgaagaggcgacgcggaacttcgctgagacaaaaaacgatgacgtgccttgcgaagcagcagttatcaccatgttaccttttggcattgcattgtagctcccaaaagacgtagggacacagtgctgtgccccgaataccaccactaaccagtttcacaatagtgtagtctccacacgactatttttcaggcctctggcaagccagggaacggtgcttgaccgcatctcctagactgccctgtaaatgaaagtttactcgttgtgggtataacggatagcacggttcactttgacttttcatttgctgtcaaaaccgcaaccgtcacggcatatcggtgtattagccggccgtggcccccaggggacctttgccagttgttgccggacctatgagtgcgcatgcagtcggacgaaggaactcgccagctctctaccgtggggagacgaacgtctttcagagcagaggaaaaggtagcggttcttttcggaggagaggaagtctagaaaagggcagcgtagacggtcgaaaagcgcagggaagggaatttcacgcgttccctccttcttcacgttccctctcggcagtctgcccccctctgccaagttcgcaactcccaaattcatgtgtttccccccacatgttttgctcgtgtatctccctcctctcccgttgctccagcttttgccttgacagccttttatcgcgtccgtctcctctttcgcttgttctctaaaacatctgacacacgagcggttccgcctgctttgtcaaaaaaacacaggaaaccaccttttctccgttcttcgccgcgacgtctttgaacctagtcctccactgacttctggcgtgtctttggaatctgcattctttccccggtctcgtctacagccgccttttcttcggtccgtgagtatttttgtctctttctcttccgtgcgcctctccaccgcacccttcgtcccgtgtgtccgtgttttctcccttcgcctctctcccccgtctccctgcacgactctctgagttcttttgggtctttcactttttctccagccattcctcccgcgacctcagaggaatctccgcttttctccgcgaaaagggtacttgcttcccagaaaaaaagtcgcca

SEQ ID NO: 2143 - DNA, 3590 bp, Toxoplasma gondii
ggaacagcagagacttcaagagctcctcgacacaaaacgaaagtcgcagagagtcttggggtcgagcaagctgtcggctgatcgggagccaactgaggcggcaagcgacagaacgcgtttcggacgcgagcctggcgtcgcgtctgcgtgtcaacagccgccccgtgtcaactatgacactgtttcctcttgtctgtcttctgattcctcgcatgcgtcttgttccgtttcttccttttcttcgtctccagcttctcttcctctgtcgccgccttgctccgccttcggggttccacactcgctctcgacgcaggttgcggcgctgcacagtcagcgaagggagtcgttctccgcctccgacgggggcagtggcagcttccccggcttgggtgtacaggatgctccacgttttcagtcgcacagctccgtcgccgtgaagccacagagtcagttgcagtctgctggcaagcggcggttcgcagcgtttctctcatcgcaagaaagcagcgcacatggggcgggaagaaacacccagacgaacgatgagcatctgcagacgggacggagcaaattgccaggcaacttgtgtgacacaccccaacaacttgcttcttgggtggacgcggcgccttccatggaacggctgcgcgcctgtcgcaacgaagatgcacaaaaccgttcgaacgcagttgacgtgtctgcacaccccagatccgatagcgctaactcggcgcacacacgttccccccacgtaacggagaaagcgcacacttcgttgactttcatgtctttcaaaaaaagtgcgagtcgaaccgtcgtttctcgttccgtcgcctcgatttcggcgtctgcatccccgcggccttcgccggacttcgccggtgacttcttttccggaaagacttgcagtggttaccgacacgaacagaaagacatgccaacgaaagcacgcagttctccggcactctctgattcggagcggaaagtgatgtcggccaagacacctgaaaaagatgtagaggcgataagtagggatggagaagaaaaaagggggaaggggacagaggggacgaccttggcgaaggcggtggatcgacaagacgtggaaaagaaaagtcagaaaatgacatatctccaggcaggtgcgaaacaagcgacgaaagagcaaggcagagcaccgtgcgccatgcagaggaaaggccttcagaagggaaagaagaacgaagcgaccatcctagaggggcagaggcatatcactcgttattttgcgacgaagaacaccggggagagaaaaggaaagggcgctgatccagttattgatgttgacaacgtgtcgcacccatgagaggagaaatggaagggtgcttcccggttcactgtgaggtggatgggacctgagtgctcagaatttgttcgaccgccacattcggtcgactccgagtaacaaacctagggaaggtgatacaagagaaacgtgggccgctgacgagagggagaatggattccacacgcctgagttgttcccttcttttctttctgagagtgaagagccttgtatgtctgctgtgctgatgtggagagcaagtaccgcagagatggtgctgtgacgtggccatggcgatgaacgtagatgggaggtcgagtgaagcgtgtgtcaaggaatcggggaacggtgtgtgcaagcagctcggtgctaattgaaattggtgaagcgacatatgaacagatgtggaagtcgcgtaggtgtttctgatttgcgcatctgtcgggaccaaaggaagggaaggtgagggatttatgttcgttagttttatatccaagttctcacgcatcatgcaacagtagaacgctcgttcgtttattagacccactcatgtagcgtttctaccgttctctgtttctctaccgattgtccggcaacatcttccccatggtgagctagtatagcattgtcttagaatgagcagtcttttccgcactactgctttagatcagctggacaccagttgtgggagtgtgtttctacttgtggatatcttgtttgtatcgggactttaaaaatgtcatcatgcgagaccttttcggatctacatgtcgtggaggcgattgcaagtacctcattaatactgttttgagggcgtaccgtccctttccatgtcctgtggcttaaatttttgaagtgaagtgtaatgaagcgacatacgggcgcgaagagctcagcccaaaaattcccgtttgagaacaaatttgttaaagttgctcaccaacagcttcctctcccatttgcctacaactgcagtcttcgataatgggagagagaaatgtatgtcaaggatggtgaggattttgacggcgaaatcctcaaggaggcgaaacaggtctttatgaacgtcgtggctcaaaaacaagtttcaagttgccgcagtcacaaaaatggggggagggaaggaaatcgggccgaggtgaggtcgtcttgtttcgtttttcggaggtttgtccgtcccgtgaacgaactttcacatagctaaggaggtagaagtcgaaactggattttctgtttggcttcgcagtggcccacagagcgggttctcgcacaagaagctttgttcggacgtacctgtttcactgattaaaccgtatacggcgtacttctatgtcaacgtgtcgccaaacagtggctaaaagaagcttcgtgggaccggctgcacagcagggatttattaacatggttcagtcgtacactaaggtgatccaaggaacgctgagaactaaccgaggctaccgtggtaacggcttctagtggaaagtgcggcgtatgagcggtacattataagatctgatgaccacccggactcggcaacacactggaacctggactgcctctctggaaaatgtgcagcacggctgctggaccctttttgtataaaagggaggacgacatttcgtactactcaccggctaacacaagctggacgcaggcggccgcgtctcagcagaagtctaactgcagccgtcacgcacacgaattgtctaggactgcagtatgtacgggtaaaaaaagcgggatccacaacggattcacctcacgtttgtaggcacacgggcaaaaaggatatgaggacactatgattcacctgaaagagagaggttcgtcttccgtgatcggtgtatggctgcaatgtagaaagagagaggttcgtcttccgtgatcggtgtatggctgcaatgtagacatcgtgttggttgttaaacatggaatcccatcgacgaaaggggtgaccacgcgctccgctcgaactgtcacgagctgtctatccctcatcgcttcttaccgactagtaacgaatttctcttcctttcaattgttccgttgtctgaaggcaatcctccatgaaaagtttgccggtgtacggctggtggaatgagaaccgtgtgagttgtgtgtgctccacgttccataacttcgactcgctgaaccggcagtcaacccataacttcgactcgctgaaccggcagtcaaccactgtgtgacaccgctggtgtttgagcatcagaactcatcatcgtgactgcatccagaaagccgaaga

SEQ ID NO: 2144 - DNA, 1941 bp, Toxoplasma gondii
caagtacatgcatacctgaaagtgcagttgccagtacacacatatacatgtgcatatatatatatatatatatatatgtatatatatatatatatacccatacgcatacacaaatactaaccccgatataaataaacacataagtatatatatatatatatgtatgtgtagatatacatacatacacacacgacgtcacataccgatatatatatatatatatatatatgtataaacatctgcctttttgggtattttggagggagacactgtggaggagacaggtgaggctcctgcacgcaaggggaagcctttcgatcttctggactggctgcgagtctctgatagatcaggctgcctcgtttctggtgtgagaagacgcttctctcacctcatcagcctttgtgcggactctgttgtaggtgtcagtgagtagctttccccacatggcgtcgaaccgtttttcagtctgatcagaagaaaaggaagttcggttctcctcgaggtcccgttctttcggaaagctctcggcacttggcggacagctctcaccgcggcgaggaaggagaaagagagaagaaaggcgaggagagaagaagcctttgtgtgagttgaaagaccggctgtttgcgactggggagggcgagatacagccaggactgctttccccaaactgtggaggtgccaagcgcgcgtgaaagcgctctgcacgtagggttggttttttccgagtcgaagagcgacgagaaaattcagcaaagaggaaggcgctccggagagacagaacggaggcaaggagggtgaaggtcgcgcagagaccgcgtccggggggccgtcgctgcggaagaagaggaagtcaaggttcgacaaaggattctcgggacatccgcgtttcgccggcgaagtcctttggcacccggtgaggtgtgtggacaccggaccgcagagctgcgccctggggaagccaaaagtcggaaaagtcaaaaggacaagggaagctggagaagtgtgcaacgctttcgcaacattcagagacgaaagaaactggtggaacgggaggtcctctggcgtgcttctgcagtgtacagacacccgggagccggcgaaaaccgacgctggttgaggagagctttcggggaagtctgtcagccagcggcgaatgaagtcggggcgagaagacaacgggtgcatgcaaacaaaaacaccgttgcacaggaggagtgggcgttgcgctgtcgcactgcgacacaaaacggcaccgaaggttccgccagagaggcgactcgcctctgaacaatttgcacagtttacttctctcggtcgacgcgatcgtctgaacaacacaggagggttccaaaaagtcttcctgccaaggacaagtgccggacgagcgctcccgcgcaaccgtcggcgcctgcagaggtatcgctgtagagagcgttccctgttgacaaaaagaaggtttttgcaaagaaacaccgttcgagctcctgcatgcgtcggcgatcctctctcttctccgtcgcgcttcgcagaacacagaaggggacgatgggcagtcctcttcgcaggcgcagatccgcgtgaaaaggagacgcctcgctccgaccgacgaaggcaggtgaatgcacagcgagacaggcgctggattgagacagctcctaaaagggagacacgacggaccctctaggaaaacaggagagaggaggagagggcggagaaaaagcaagacagagagccagcggagaacgcgaggggacagagcgagcagaaagagagagagaacgaggagaacaagtggggagacagaggcagaacaagtgcagaaagagagtgtaggacagaacaacgcaaaggggagaacgctgacggcgaaggacgaaggatcgatgcggagaccggaagttgcaaagagtagaagaagctgaattggggagagaa

SEQ ID NO: 2145 - DNA, 4273 bp, Toxoplasma gondii
ctgccacaaaggaaactgttgcggtctcagctggacaacgaacatggcgcgcgccgttctatctggagaagtcctttctctgttctgatttctttttcgacttacgaacacgaagaggcagcagttgatcctctgctcctctgtcgacatttgcgacgtagaccgcgtggaccattacccagacgctcagcaagagtgccgtgagcatcgtgcgtgcaaaacccatttttcgaaaaatcggcaggcgacgtctctggagttttcgctcttctcttcctccagcgaccgctccgagggaaatcgcgaggaaaggcaagccagcaggtccgctgcaagacctctgttacaactccagaagtgaagcatgcccctcgactacctgagtgtccgagagttgccgggacagttgcttcattcgaaatccaggaagaaacccacagaactgcattcaaacacaagaaacgcgacatcgagcaccgcagcgtttcaaagaatcgaagtccacggacttaccgctatacctgtattagatgtagatacgtatgagacaaagacacatatacttgtgtaggtatccaggcgtggaagtttgtgtgcatggatgcagaaactttttcagatgcacggtttgacggctggggtcaagacgaacgcggaaagagaagaggaagcaccctcggtgaaaaggcaggcacctggatttaaaagtggagaacaccgagtttcgctcgagtctgagaacggaatggggaaaaaacagagacacgccgacaggcagcttgttctcagtacagttgctcctccgtccagaggccgtcctttttttcggagctctgtgcttttcgcggtcgaaagtctctcgaagaaaaaagtaagctggagaaaaaggcgagtgacagttttgcacgaaacgtctcgcgtttcacttgaaggctcacagcttttcccggcgcttctgcggcgacgcgcttgcgacagaaaccgcacgacggcgacagggtttcaccgtaaaacgctcaaggaaaacgagaagaaacgccttgccaaccgcccgatccgttttccgtcgttcctgcgtttcccttccgcgaatttgccactttcaactggacttgcttgcctcaacacgtgacgagctgcacgacacaaatctgtcggcgagttcggcatgcagaaagttccttcgtgtgtgtcatggcaacgaaaacaaaggaaagcacgcatctgcgcagaaaagggcgcgagccgaaacggagaaaacggaagaagcagcaggaaaacacccgtgcaatgtcgggcaatgtctggcggggcttgtcgccgcggctggatgagggttgtcttgctgaaaactcgcggctatgtgtcacacgagagaagaacaaagacacacagacatttcgcctttttcgacttttcgacgccgctgtttcatcccgattttttattagaatatccacgaacagtctccgttacagcgactgcatgcaacacagagcgtcggaggcgcgaaaacaagacactgctagatgcgccacacacgctctctcgatgccgcttcaagccaatttttggaactcagagcggttgaagtcttttgccgaaacaggagtcaaatcgaaggcctgtctctcagctcacctatgcacagcattcaaatcaaaaagacactcacgctctacagctctctgcagcacataaagagtatacacattcatatacagaaggagacagggctgtacacgcgtgtatctggagagaaagagaggcaaatgtagcaaacgtatataaatatatatatatatatacgtaagcacgtatatatttgtgcatatggagagagagatgtacatatatatatatatatatatatatatggagagagaaatgtaaatgtatgtatatgtgagaaaaaagaattcgaaatgctcggggactgaacgctatgaaggctacaaagaagtagtctagatgcacacgtcgtcaaaggtaacgagttgccagtgaggatcgctagaggtaaggtgcattcacaccagatcgacgcgtgcaccgcagtgtgtgggtaaatccacactcctccatttccctgggtgtttgtgtgtgcgaacgcatgcactcgttcttaaaatgttcatttgcacatgcgtgcttgtgtgtctacgaagaactgctcagaaataatcacgcccagttcgcatggggtttgtagcgcgaacaaccgcgctctcctcgaccgcccaatgtgtatggcatctttcttcgtacagattggtcacagatgctggttttgcaaagatgccctggtggaggtgaattctacagaaaccggatatccaaagacacttcacgagcatccagcaaagcgagaaaaggcttcaaaggcagttttctggaccgagcgtcgtcctttaaacgaaggttcctcgcttcctgtggagagagaaacggtgaaaatgtgtccagggattcgcagcaaaaaactcgtccatttcgggggcactgcctttcctgaaataaaaaacggagttcttgagtccgtgtcatctcgcctgaccaatttttcgtctgaagttctcgcgaagaaaatctatgcaagtttggaaacagtctccgtgctctttgatttcgagatgtgtagccagtgacgcttcttccccagagagcgaaagccgcgaatgcagaagagctatgtgtcttcacacactcacatcgaatccctctccaaacacggatgcacatgcatacacaaaccggcctctgtggactcgacgtgaagacggcaaagtgctgacgcgggaaacagcggctcgtcgtatggccatcacaaccccatttgtgggtgaggcggtgaacgcaaatcacgcgcaagaaagaagcgttcgctgcccagtaaatcggatgaggacatgacagaagactgtaggaggcacgtctacgtgctctgatacttgggcgacgaacagcgacaccctcgaaaagtgacatactcattgcacggagacatgcacttatggaacaccatgtacaggcacagtaagtatatatatatatatatatatatgtatatacatcggcggtaaagtaagaagacatagattcacttgcaagtaccggtaaaatctgtgcattgagaaaggcatttggatgcacaacagtgaacacagacggtgccagctgcaaagatggacattctgatccttgtgctggcgtatcatcgcctgtatccctctccggttttgaaatgtggcagggaaatatccttcgcacaaacccccgctgcgacgcggctgtcgccttcgaagttcagggaactaaagaccgccgaatatgttttcgcgcaagttgaacctttcagtgctttcgagtcctgaggaaggcgcccatttcggcagccatcaacctctcgagaacgagctgctggatgtcgtaaccccagcaactccgtgacacggaaccggacattcgcgcagtggttcatcggtaaattgcattcgcaaacgctgctgaatccctaccgagctaacagttttacggacgacagctttcacgcgcaagctgccgggttacctctcacgtattctgccagctgaatcagaaggcgcggcaaagctacaaagttagttcgcccgtcagaaacgccagcgcgtctttttctagccgccgactccctttgtcggaaacccattcacaccaactacccccgtctctagggtcggcaaaagctcccgttctctgtcgatagcctctccacgtgaaactatctaaaaagtccgtcagttgaaaggacaactacgccatagctaaatccgtcatcgatctgaagtcgcaaaaaaaagcaccccgccacgcaggccaatgctgagagccggaatcatccgttgtttcacagacgcgccacgggaccatccaaatcgaagagtcgaacgattcgagagagtctgcgttgtttgagaagtcattcccctgcgctgcagcgatctggagaaaagatggccggtgaaaagcctcgctattttagagagttgcgccggctctgctttccccgctgtggtttttccgttcacacccaatatacgccggcgggactcgcgcgcggtagggccatgcaagggcgatttttctcacggcaaccaccgcagaggttcgtttctctttcgttggatttctttttgtggcgttctcgagagaggagacgacgcagcctgcggggctcagcttttttctttaacggtttgggctgtctctgtctcgtctgctccccgactaaaaa

SEQ ID NO: 2146 - DNA, 1465 bp, Toxoplasma gondii
atgcagagtcctgttgaggtatggacgacttgttcgttctcactcgctgtcgtagatgtctcgccatctccggtcactttcggagagcaggtctctcttctcagaaagcgcgttccccgcgtctgggagtcgcagatgtgtatgtgtgtctcggcggaggcgcgcagaagtttgcgagagtgcgtcgctgccaacggagaaatgtcggaagctgcagaaagaccctcccccctctgtctgtccagcggcgcgcggtgcagcgcgactctcgcgagtgcagagagaaacatgcaagagagtaaggcacctgtgcagcagctctttggagatccagacgcttggttggtcttctctgccctgctctgagatgagattacgcatcagtgcttgctctggaattgcagcagaacagatgatatggggacgagagtgaggtcacgatgctcggcgcagtcgctcgaaacaggagttcaactcgcactgggtgtcgctccccggaagagccggaagagtcttgttgcacacaagtgaccaaggtccgcttgaagaagtcttctttccgtccaattaaaagcggaagcataatcgctgcgcaagaggcgactcctgccccatgttcgcccctctgtttcccaatagtggcacagaagccgtaacacagtcggtacgaagtcgaaacaaggcagttgatggtgaaccactggctgaacaaaccacggatcggactcttgttggcctcgcacctgtttagtaactggatggacgcgtttgactcagcgcgcggcttcggcctgagagcctcactagtagccactggctggcgcacagatgctgagacagtgtcctctctctgtgatttcgcggtctctcgcaatgctcggaggcaagcagaaacggttctgacgaaaaggacatcctcagaggcttgcagccgccgaccgtcttgtggcgacaatacacactggagttcacgcatatgaaagtatagaaaaaatacatacatatagagagctgtatatgcttcactgtgtgcacaggtgcaaattcatcttctcacagaagagaccgtgtctccacacggagactgcagcgtcttgttcgacggtcgcgacttcttgaagaagggtggaaagagtttgagcctgtcgcattttccagagaacggaggaagtggagactcggaaaacaagaaatctgttcagcggtgtcgctgttcgctttttcttcttcgcgggtgcgtcagagcgtccttgcgcaaatgtcgagcgcgcgcatgcggtgtcgcatcgcacgagtgtgacgtctctcgctgagtttctcctgcgttttttaactgagagcctctctccgttgcgttttttctctctttgaccttttttctcggtgtctctcccgctgtctttgccgggggcttcgccgcgacacgcgcgcagcgctgctctcgcgtattttttttttgtcggca

SEQ ID NO: 2147 - DNA, 4702 bp, Toxoplasma gondii
gtacacagacgatctgctcttgcatggatctgcagacggagatgaagagctgaataggttgatggagagagaaatcgaggaagacagactgcaagacacagagagaggaaacgccgcaccgggtacaggtacatttgtgcgtcgatgcaggttctggagtccgagtgaggaggtcgcaggttcctgatgtatcgcgttcaagacgcgctttgcaagagggcgttgtggtacgcagacagggaaggcgaaatggcactcacgtttggcgtctttgtctttcgcgcgtccaggagagactccagcgcctgccttcctagacggccgctcgaatcgttccagaaacgcgcgacctgcggcctctacgcggcgctgagcggtgcagagagaacacaagacttgagggggacaggagacgcttgagtctccctcagtgggctggaagtcgcgcaggcgcggaaggaagaaggaaggagggaagaggacgaaaggagacgccatctcggaagacaggaaggacccagaaaaagcgcgaagggagaagccagaagaggaaggagacgaaggcgagacggagagaggaaggagaggaagaaggccggcacagggaagggagaaggtgaagaaagaagaccaaggacgagcgaacgacgaggagcgagcggatttttgcgaggaaaagaaagcactgagggacagtcgactaagaaaaaggttcgttctctcgatgcgtccgtggagaagggacgacgcaccaggagacagggagacgcaggacgccggagtcgacaagagaaatggttgcagcgaagaaagcaagaaacaagcctgagactctccgatatttataccgagtgtgctatgcaacagagcctctttctgcctttcgtcccttttcctttccttcttctcccccctttccccttttatcttatttttcctttctctctttctcctttctccctcacgagaggctgtcacggagtgagagcctggccgcggacggagcctgggagagagaaccgaacggcgaagagctacggaggtcgtcgttcggagtcttcgtactctcggatggagggaagaaggcgcgactggtcgactttcttccaggaaaaggactttcgactccaagaattcacctccctccttcaggtcggcatgcgcatgcacagcatttttcagcagcccacgcgaaaaaggcccagagagtgtctgtgtctccctttctactttgcctgggtgtgtgtgtgtctccccgaggcggctgccgatctctcgttccagtcgttttcgacgccgcctcttccattttttcctttcttccccgcggagggtcttgccttgtttcctgctccgtcgcttcgccccctcgctgttcttcgctgcctcgacctctcccctcacggtgccccaggcgaagtaaagaacggcgttgccctttgaagaaggaagaacgaccgccggagcgcttcaggcagcatgagatctcagtctcatctccacaaagggaggttaagaggacagagagagagcgagggaggaaccgaggaaacgtttccagaaaaaggaaaggcaccagcttcgcttgaacgagatccgcgaacgtcgctgtttagatgtcagccacaaaccccccaccgctttctcctcggcctttacttttacagaagcagcaaaacgcctgaggtttctctcgcctcgatgtcgagaaaggcgaggagtggagtgaactctgcatatgccacaggacagttttcccactgcgctctgcaaagtccgaaacgcatgcagttagaaccgaaaaaggaagacgaaaaactttcaacgccccctacacagtccacttgcctgcgacgcgtgtctccactctcgacaaagcataacgagaagacgcacgaggctgaaaagttcagttctcacatctcccgaaagccccagtgcctttgttggttccgttcgagttgaggaaagtcacgttgttctcaaagggggcacaagcagagtgaatgcacgcttgtcagcgagtctgcatgaaccggaaaaagaaggcttttcccggtttttctccatctcttcagagctgagcagctccacgtttttcgctgaacggaggggaactccaggatgggcgtcgaggcctcgatctaggagcacgaagaccgggaaaaggaaatgtcacatgcagagttgaagaaacgatgctacctgcttcgggaaaggggacccagaggaacatccagtgaggaagataggtgtgtgcaggttcatgcgaaacagaggcagagagctctactgacctcaccgaaaaaattgctagaagcttcctgctacctgtctgttcactgcacagaagagaaagtgaccggaggtcgtagcttgctggcgcgaaacagctcacgcaaacatgaaagccaggagaacgatggtgagaagcctggcaagcgcgtttgagcagccgagaacctgttgggaaatgaaaacacacgtaaacggttcctctttctcagtctactttttccagattcacttggacgcctcgagtttcgccgccgctcaaggcactcgggcatctcgctcgtgtctcgttttccagcctttgcaccaatctcggggagaagaaacagagagcgagaaagtgacagacgacggtgcgttccttcctcacgccccttggggaacgcgtctgtctctgggggggaggggggatttcgaacgaaaagaaagccgaagaaacgaagcaaaacaatgtctaacgggatgtggtagtacctgagacaagactatttacagtcttctctgtggagtttgtaaagacgttgaaacgcttcgtttactggatgcgacttcggtcatgtcctcttcgtgactctctaacgtcgttcaggagactgttcccagagcactgcattcggaaagccaccatttctttaaatgctcaagttgtccaagtaccctcctattcaccttcgaaggagttaagcctggtgtgtgtacatcgccgaaaactgtgtcggaaacgacgcatgttcctccagactgctgtctttctaagccgtgttgctgtcggagcctcgtcagattctttaccaaggataaacgcgagaaaaacacagcagtttccacggttctttccatacacagtgactgcagagagatctcctctgtcttgcagtggtggaaggggaatcgaagaaacctacgcaatatacagaagatctagggtacagaggaggactcctgtagtcgatgactctttttgattcgactgaaagagagactctgggagattgaacatcctgaaaaaatctccgcagggtgtagttcgcgtctccacgttctccgtttaggtacgacctgcgtaggactgttttctctgtcgttttcggcgcgttttacgttcatggttgagttgcgaaaagctgtgtggcggttctttttctttttctcgaactttccccgctctgtcccccggtccccttttcgtttcctgcctcctccgcgctcgttgtcggtctgcgccgcttcctcatgcccctgcgaaaatcgcgggggtcacccgacggctcgggcggaccggaacgctccttccttgcttggcttgttgcacggccgactttgactctcgaggcgtttagcagcttttcttttcaacgcgtagctgcctttctcctgcaagactccggctttccttcctgacttccccgtcgttgtgcgctcctcccaacgaaaaaaaggttccccggcgcggaggctcttccccatgcgtgagaaacgacgagttttaactcggttccggtgaaaaccttcaggcttgtcggtcccgtgaagagccacagcgaaagaggccggaactccgaaagagagtttttcactgctctcaacttttccgctggaaagaagtaaggaaacgcggaccgttcgaggaacaatcgggacgctgcttagccagcaggcagcagcagggcaacgctgtcgggtctgattttaacgttcggcgtttgagaaaaaagagaaagatgacagaaacgcgttcttccgtacgagaccctgagagaaatgacattcagttctttcgttttcctgctttctgcgcaaagatttaggactcaagagcgcctctctctcgagcttcaagcgaaaggaatctcttcgcactccgggctccaggcaactagctgcggctcttctttgcggttttccggcttttctcggctttaaaaaacttcaaatcgacttctttttgtccccggactgaaggcgatttctcgctcccctttgtccctgcttacttccagttgtttcgagccttctcggcgttcgcttctcccgtgcagccttcagcgggccttccgcggttttttcgaaaaaagagaactcagccaattctcttctctccgccgctgtacttttcataacatccgcgtttttccgtctctctgctcttttctctgggttttgtgcatttctcaaacgaaggcttgggctgctttatcgctcccgtgtccttctctttcaaattctctctctcctcatttttccttgcttctccttctctcaccttctccttctctttctctctcgttgttcttttctcaccttcttctgccctcagcttctcctcttccttccgccgcctcttgagtttgtttcttctttttctgcggctttctccccttggattcttcctcttttgtgtctgcga

SEQ ID NO: 2148 - DNA, 3662 bp, Toxoplasma gondii
gagctcgaccagcttaacctgtgcacggaagcccagtcatttgtgaccaccttcttctcaccataaaccctgccgtttcgtggagagaaatttggagacttttccacctggtcgggacgtccactcccaaaaggagctgcggcccgcgcagaggatcgcgtccgattagccttgaagtagttaggggaagggatttccgaagtagcgtggtggtccaagcgtagagtttcctgctgtctcctgtagccacgtgtttgaagcctctctgcgataatttcctgcaccttttgtatcatcttcggattagacccgacgttgacaatccagtcaattgaagcgttcacatcgtccagagtgacaactgttgaggaaggtggagtagaattactccagtcactcaccatcggtgactctttgcggatcttcccggatgcagtgtctcgccgagtgcacgacacttcacagtagctctcgtcaaaatattggttgccggtgtaagttgaccatccatcgctccgggcaccttgactgccactcggagatgtggaagttacactcaacctacaaggagactcttcctttcttccacgaagcaacgctttcttcgacaacacttgctcctggccgtttcttgacgaattctgcccaaactgacctaccgacctgagtgatggtgcagcggtgggtgctgtctttcgatttacgtttctgccctcgaagtggcgcctagtctcgagcggccgaggaggtcgtctgcatcttggtctttctcttgacatgctcggcagttccgcaaattcaccttccgtaatttctctgctttgaggcaattcgtctctatcggatccattcacctccatgaagtcaacttctgaatgcgaactcctttctcgatgccgagagacctcgaaaaggccatactcgttcgcttcgctgccgcttgccattctcctaggtgtctgcggtagcgacaaatcatgacgataattcgataattctgagtcaccacaagagtcggcttcccactcctgttgctgagcagtattccgatctcgcagttgatcttgaaaactccgatggtgcatgctccggatatcatgagagccgacgcagcccgacgcctgcacatgaatgttgttctctctagacgcgctgtttttgcgtcggcatcctacagtttgcctttcgtcgtctgccatagtatcttttgcagcctctcctgcttcttcccgagtatttctccagcggcactcattattcacagacagcctccattcgggaaacgatgaatgatcacacgcatcactgccgatcgatccacagaaatccgagttgtgctcgttctggttggatgcaccggaacccacaaaaattttcttcagacacttatttgccctgttccccaagtctcttgaacgaatcgttcggccgttgtccgtgctctgactagcacagtggcaacttttgtgcttcagtcgctgcgaaaaaccaacttccttacactgtctttctggtggagcaagactcgcctcgagagggaaagtccctggttgtccgccccgtcgacatatagagtgactaccatgagtcgctggcggtgaatttatgtctctcctccatccaacggtctgactacttctcatttcccgttcagaactgcttgagaaatcgacccacgaaacaccacttgcctcgctggtgctctcgctgttgtacgactcgtcgcttccacttgactccgttcgcaaagcattttcctgggtcattcgtgaggcaagtccttgactacccttcgatagacgctctgcgtaccttgtggcagacaagtgtcggcgactcctgtcttgcctttgtgtgccttcgtacggaacacctgcctcgcaactgctcacatcaagccgcaccggcgaccactgtcccgcatgttgacttaagaacttttcgctggcgctgttgctgatgatgccaaccttcggggacatatttcgtgctggtgactcgcttatgcagagcctttgctgcattgaaggtggtgatcgcgaccgacagttcgctgactgcacgtttgccgcatcctcagggcacgagcttgcactatcaccgccagtgccacacgcctcagaaggtgagtaggcatcggaaccagaatttccacacgtgtgccttcgccctgtagccgagtttaacaacgccgaaactacctcagctggagcaaacccctgaaggcggcgacgtgaacagacccgggcacgccgccgagctgacgcgagccggactcgaccgtcgcctagttttgtccagtgcctctgcattgtcgatgtgcaggcgattagatacccgttacaaaatatcgagctgactaggtatggtaccttttgatcagaagacgcacagccagctgttgggaagaatgagaatttcttaaagatgtgtcctgccactcgtaacagctggatggacggcgtgaacatcgtccgagctgccacggcagcttgtggcaccgttcaccttagcacgcagagcgaaggaaaaagtcacttgagagaagggacaacacgcttttacgggacacagaaagatgacgcaggaaaccgaatgactctgttggccgtttacgtcgttgagttatcttttgagagaaaccgccgtcatggtcttactgagctagcactccggcgaagtctcgatagcccgagtgactgaccgccggcggtgccaggcagtccaagattgactgcccggacaaaatgttggcagtcaaatccgaaagttttcaaccgacaaaagtgtaaccagatttttgtgaaggaaaaaatatactgaagttgacgcaggtcctctacgtactgttttgcgtagactcaggtgtgttgctctccaactcctccggacacatggtgacaatgcggagcgcctcagcaccagatagaggtggaggtcgctgaggttctcgatgtttgaaaacagaacccgcagtgcgcgttgcactggctggcggtatgatggggtctacgtcggcttgcctaacagagatgcaccagacggacgtcttggtgcgtgtcgagcagcaaacaggcactcggcaatacttcagccatcgactgtcaaccgcgactgaaactgaaactagtcgatttacggagtgggagttctcatttcacaacagccgctgtgcgactttacaagaaaagcattaacgataaacggagtacgtagtgctaggaacaggccacagcagtcagcgaaaatatctttggtatccgaatcgcggggcgtacagccaccatttgacgatcgctgaagtcgagaaaccggattaggtactggtgattctactaccacccactagccttctcggaaaagtactctccgtgaccgtgcttcggttttccactgtttcctcgttcaacgtttcgccaacgaaaaaagatgtatgtaattcaatgttgcgatctggcaactgttcggtgctgtctgtacactgcggtctttcgtccatagcttgccgctatgagaggcgccgagtactgaatcactctgtgagaagaaatgagggtaccactggctgcgtaggaggcaaaacggcgaggcaaacatccctgggccaattacttgtgaagtccatccacttgcagtataccgctcagaagcagcaatcacga

SEQ ID NO: 2149 - DNA, 4175 bp, Toxoplasma gondii
gaataactccgtttgatcctccgaccgcggccgtttctccgaggagtgcaacgcaggtgggatgaggaagagggtgactctccaccgctttcgtagatccctcaacacaggaggcctcttctcgcgccgtcggaggagactgttcccgagcgacagagtgcctcccttcttcagagccttgctcctcagtctctgcctgcaatcggtgtcgcagcgcgcctgcccattcttcttccagaagcggagagacgcggtggagtgatgctggagacggagacgcgacatgagagaacggaccagcgcgttgcgagccgcgagtcttttcgtcctgtgagggagacggatggaacgagttggggagtccgctgccgcctggggccgcgtccgacagcagtgagagaggaaaagcttgcgtgtagaaaaaatctacaagagaggacgaattgcctggctcgacaggcagcgcgacacagcctccagaggacggagcacgattcgcctccatcgtcacgaacgacagacgctcactcaactgtctgcggtcgttctgcgcaggcgtctcgaggtccgcatgctgtgttctctcccgacagcagactcctcgcagtctgcagggcgcgagggaggaaatgcgaggcaggcggtcaagcggcgagacgcgaacgagaagtccaggaacaggagccgcctcccatggcggatccgcagcgttagccggtcagactcattggacgcgccgaacgtcgaggtgcatgcggcgtctccagagacggcagaacgagcgcaggagagagacttggatacgcccaggagacgaacaccccgcagaagcgagatgagggagcagagggagaacggaggagaggaaagaaagaaaacgagggatgaagaaagagaggagagagacgcgctctcaaatgccttacgtttctgagtgactgtcgaggatcggcacctggtaagaaagcgaacttttcttcaaaaacagagaaaagcctctcaaaaggtgagagacaatgaatacgacgcgagcgctcctcaggtataaaagacaggaaaaactacgcagaacgtccctggaaagtcgtacagagaaacgaccattcttgtcaatctcctcactcggctttcctccctgctcttcctcccttctcttctctctctagacatctctctgcctcatctgtcttcgtctacctcccttctctctgctcctctctccttctctccagttctctctccctcgccgtctctggacagctggtcctctgctgtgcttcctggaaacggagacagtgcttgtcgctgtgtatgagaaatccagaagagagagaaacgccgcggcactgcatgcgaagacgcgccgtctcgtggacctctcagcaagtgaagagccgcctgtcaggaagaggtccttcccctcgaaaagaaagttggtccaggaaaacgagaacttccttgcgtagtaaaatcctgacacgatcctgctgaggaggaacgagaagagctgtcgagacagccccggagcagaaaagacatggagggagaggccgcaaaagtttgcgttgtaggggacagaaacgaagagaaaatgcggtcgaattcctttaaaaagagaaacagagacacctgcagcaaagcgtcgtttctagaagagttctccgacaacaggagaacaagccggcagaaaaaaaagccagcgatccgcgctgagagaaaacatccaaaaggcatgcagttcgctccctggcagcagggcaggaaaaactcttgaaggatgaaataacggggagtttctttgatttcttctaacggtcctcaatccgaaacagaaatctgtctcacaaattcctctggagaaaatcatccaggctgtctctgccccccacccccgcccgcccaccctcgatgtcttgttctcttttctcagggtcacctcgccggtgtttttatcgtctttattttccatctgtcgattgttttgccaacctctcgcctccgacctccctcctgctctccagctttagtgtctttcgtctctctcctcccttctcgttgcagcgttccctctcgcctgctcttttctcccctcttctagcctgctccccggtgatccctcgatcgcttctctctcttcttctccctctccctcgttctctctgtcgttccttctgtctgtctgtgttggactcgctctctccccaagttttccctctcgctgtctctcaacgctttggtccacccttctctcttgctcacctacctcctatctcatatgcttctttcctccctctagcttgttctctccctttctactcttctccccctctcgtgtcatctctcttttcttctttctctcttcgctcccctctttcgtcttgtttccttatccttttctctctcgactgtttcctttctgcctgtctcttgttgtctctttctctccgtttctctccctcttttgctctccttgtgatttcctccgtttatgcgccgtccttctcgggggatctgccgagacggggcgcgagccgcctttctcccaaaaaagccaagaagatgccgagtcagatacactttcctgcaaacttttcacagcctccagagcagaaaacgcagccgcaagattcgcagtttttacatgaaattgccatacacccctgacaaccgttcggcctactctcctcgttacaaatccacaaacataatcacacatatatatttacatatatatatataaatacacggaagtgcagttgtgaacacgaatagacatgcaattaggcaaacgcgtatatatatatatatatatatatatatatatatttatttattcatacaaatctgccaacatatgtatccataaacagctgttagtggatgtgatttgtcggggtccctgaaaaacaggaatcggcatccgaatatatatatatatatatatatatatgcatatatatgtatgtatatacagatctgtttgtacacaactgttctgttgataagggtggcttcccgcattatattctctccttactaatatatgcgtgcatgttcttgttttttgtgggactaatttattcgcggacatatcgttgtccacttcatgaaagaagttgactttcgtcgaagctcatctggttgccgtcaggggactctcttctttcttcctcagcgtggatacaatgagagtccaccttgacttctgttcatctcggtccttctcacatctggacgccacagtaccgagattcgcatgcttcgctttttacgcgtttgcctgattctgagttctcgcagggcaggttgttggtttccaggctcctgcgtttgtctacatttccgtccagttgactagagtgacaccgtcgcgcccaccactgcttgccgtcacatctctgtccctctgcatctctctcgatttttcgtttctgctcgcactcaagagcgttcgcgaggtcgtttcactttccgtttgaggaacaaagggagcgaaaatcgaaaaaatcccttccgctgcttcaggtgcatgcagccgcggtgtctctcacggcctgtctccgagagaagaaaggctgtgtgttctcccgaggatctgttgcctcctcgttcacggttgaggctgagtcgagtcccctcacaaatgcattcttctcggaactgcgcgtttttcttctctgctactccgcatttgcgcgcggccccccgcccccccggcaagacactgcactcgcggccgttctctccctccaagggtgatggctttgcccagtgttcgttggcataccgctccacgacgttgacctttctgagatgaggcgcgctttgtcctcgagctttcttgttttgtcgacaaaaaaggcgagcaaaggaacttttgtagtcttctttttcccgcgggcagccgcagcaggagcgctctcctccttgtgaagctcgcgctgcatgcaccgggcgcgtgccgcgctatctgcgtctagcggtgcactcaagaacgcaaagcgtcctggtttctggcgaagaggagccgttgccttgtctttgggagcgaaacaagaagtcggaaaagagaagggaagctcgagagagcgccgaagaaaggcagacgcgccagagttctttcgtgtgtatgcatgcaaccaccaaggactaggcaagagacagatttccaccca

SEQ ID NO: 2150 - DNA, 2776 bp, Toxoplasma gondii
ttggattttctgctgatagcgactggtgacaatgcgctgaatctcgacgtcgacattgtcgcggccgtagatctcacgcagcagagcggtcgccttcgctctctgcttcttctcgaccatgtactgcggggtctcaaacgggaagacaaaccacagaagccagattgccagcaaactcacgaccgcaggcaaacccaacatgactcgccaccacgcttgctggaaggtgctcacttcgtacacctcgtctcctgccggtgcgttgccgaaagccagaccgagcagggtgccgaagaagattccgagcgtgatgaacagctgatgaaaggtgccaaaatagccacggcggtcatctggagtcacctctgacaggtacatcggaacgcaaaccgtgaacatgccgacggccacaccgacgacaagacgcgcaatcaaaagtgtggggaaaccctcagcagccgctgacaggatgcaacccagcgtgcagacacaatgggtgaaaatgagagatgcgcgtcgtccaaaatcggtcaatctgccaccgagaagacatcctacgcaagcgccgaggaaaactgcagtgttaatcagggagccgtatacgagaccagtgtcgcagtcggagtaatggcctccgttttcatctttgcaccatccgaagtcgaggataatgaacgccttcgaggtgttcaacgcagacaggttgaagccgaactgaaaagatccaagaaccgccaccatgaccaactgggcagctgttcccatgcaggaacacgccttagaggcgtaagattcgggtgggatatcccagagagattcagcctctctcttaaggcttttctcacgcatctcctccgtcgccatgatgaacgcgtccttcgaaacaagtcggggtctcgaagacgggtatactgctggaaacaacaggaaaaacaatgcacgtctctcggaaagaacgatccacttcctctcggacggctgatccccttgtatgcacacacccgcaaacaaactcgattgcccttgccccaaaacgtttgcgtgccaaggcacctggtgcagcacccagacccgggttgcgttatcctttcagagttccaacggggaacaacaccctgaatccacaatctaccggtgatgttttctgacgctgcgtcctggacagataacgtggcgtcatagctcgtccacgaaaaatcaaacccagttagcccgaccaccagttgaagaataaacaccggcaaaacgcggtggtgcgcttacagaacaactacagcccgacacgacctagtggaaaacgaatcgggaagcaaattgggaagtgggaaaccgctaattgaacttgatactgccacagagaaaaacaggggcgccataggtgggaaaaagtggcacgcgcgtccgagtacgttgtagtagttcgggaaatggatgcggccacccggaagaaacacccccacgaaactctgtagaacagtatgtgaccgccagctcgtggcccgacattcattcgacgtttgcttacctaatttgcaccttctcttgcctgcaggcaatgcagacctccaggtaaatttttgggtcgttgaaaaaaaaagcctgttacagaaagattccggggaaaatcagaagtgatgggacggtgaactcgaaccagggctgcggggtccgccccaccactgattgcccggggcgacgcattccggtggtcctgcggttcactggatgctggacgattatgttccccgccacccccgtcctaaaaggattttaaagctgaagccccacaactcgccttacgttccctacctcaccctttcttgcacttcggtttgtcttcgaggtcttgagggctcccagaaagcgatgcgtcttccgattggtgctaaatgcaagcagaccgctgacagcacgaaaatgctcgtgcggcgcaccaacagttcgagcgcggaaaggtccatccaagacgctgtcgttcctggataatacccttgtggagtcatggcaactgcactaattacagcgcttccgtgaactgtacactttcttatgcttgccttgccttttcaggcacatactctttgctggtcgcatagattctgtcttcgtactgttatgttaggaacctgtagctacgggatgggagaggacttacacagccggaggtgtaccgagtccttgttcgatgtggcggtcgctaacattccgctgcacacagttgagcgaaaaccactggtactgctgtgcacttttgttgatggaaatacatcggtgacgggacacaagtttgggttgaactagtagagattcccagaaagccccctttggagtggcgctgcggctgttcagcgaaaccggaagctgcatgcggattggaccatacgcgtgcagcagttgggaggcggcacgtgagacagactcgagcaaatcaccgatcaaaaacacaatttatctggtagaagctagactcttcactgcagagtcgaattcacggccattcagtgcgacaggaactccacagcttcagtgttcactgtgtccaggattcggggtggacggtgtgcgccaccccgtgtccgtgagttaccttatcccttggcctttttctatctgcttgtcactgattgtagaactggtgaagggactacgaagccatggcttgttaacacaaattatacagcgtgaccgttgggtgcagtggcaccttgcgcacacctgcgtggacacgcgctgacttctattggaaatgacaggaaaggcgttgtcccagtcctaa

SEQ ID NO: 2151 - DNA, 4621 bp, Toxoplasma gondii
atctggaagttcttttctcggatccaaggtctgtctgactcggaagtgcgacagcattagttgtgcaagttcctaaaggtgcctccagtctctgacttccccgcacagccacaatgtatcgttttggaccagctacgctcatgccggagtgcttgaggccacatgtcactgccgctgtgagcagcgccctcgcgctctcgagatccgcgcattcaacgtgcatcacgaatggctcaactttgagatcaacagtcggttttccagagtgacgtgcaaccttgaatgtgtcgtgcctgggatatttcagtgcctcaggagctggctggtctcggtggtcaggaaatggagagctccctccctcggcgtcttcaccatttagagggcgacgcgtcgcatcgtgttttactttgctctgataatggctctcgtcgctacgaagtcgctgtacgatcacagccacttcagcttgttcaatcggcgagtgacttgcatagatgagcttcccgcccttctttgaattcccttcgggactctttggtccattttgaaagacgctgatcctcccgctgcaacagctggtagtgacgtaactcggattggtgttgataatggaacaaatccgcagcagatcacggtcaacggagcccttcagggacttgtccagtctggggggaaagaccagggattcagactcccccttgtctttgctctgaagtaatgccggctcgcgtgagtcagcaacagaagggtgttctgtctcatcaaacttctgcgacctcccggggccagtgactccctcggtaccggacatgctgccatcgaaatcgagaccggacaagatctgctttttcctgcgcaagaatgacgccatcgtgtcccccgccatttttccactgaaggcacagatggcccgttagaaatgccagccaagacagagtagcaaagttcagatgtccagtaagttcctagcatctagtaaaggacccctcatgccgataatttggcaagttgtggccgcatgctcccggaataaatgcacgcagaccttgcatttttttctgtgctcaaattccaccggaagtccatcctatcccaaataacttattgcagttgataagtaaaatgatggacacgtcgttgtgtttcgttgggggctgttatctttgccccaacaggttaccgcaagatgagttgagtctcgtgcatgcatatcggcacgcagcgttctatgttgaggctggctgacgtgcatgcggcgtcgccggcccacccgcgctcccctacgaaacaagcctcgatgacctcgcaccgatttctgtctcagtccgtttctaaaactccacactcaacgtatcccgctcaacactgacaagctggtaagcgagaacagttttcacgtctggctagctgggcaggttacaagcagagccagctgaataaatcggggtgtctgtacaggcggcgcccataccaaacatagaatagatggtggttccaccgccatgtctaataggaactccgccatgttatcattccatctaatcaaagcaagtggatcattccccataggagttcgttcagaacctgaaagcccagtcactcggggtctcacatggttatggggccggcagcaaggatgtcgaatgcagttgagaccaatcaaaccttgctggtcatcatcagatctctggaagcagatcttcgtggagttcgagacgagctcaggcaaatcctgacggtcggcacaaaccactgaacagatgagctaaggtttcatgttcttctgtacacaggtgctgaaagacttcctgtatttggccgatgaaaggaagcagaaggaatctcatagcccgggataccttccaccacagaggaggactctggttatgggagaagggccagagctgaacagcggggtaccggcgacaacacgagtgcccgacagggtatgcttgacgacgtcacatcccttacaacaatgggttagtgcttccgtttgcaggtcagtcctgcatctggtagatcgtctgtgcaactcggccgattgcatcccagaggttcgaacaacgcaagcgtcgttgaacgatccgtatttaagcctgtggattgcaccagcgctggtaaaatcctcgtcccagtacgacaacacgaagacttcccaacgattttttgctccccctgcatctgttaagcggtacatacagtgaccgtttggtccggaacggattttgcaacagtgttgccacagagcgaatacatggatggcgccacgtcgtatcaactacttggactgctcaaacagggggcatgacgtgccccacacccgagacagcaacgtaacagcagacgcggaaaagaatgacgagaaggcacgtcacaacccaaaatgcctctgcagtgacccgctgacgaaccagtttcaggaagttcagcgactgaacgagggaaagacgcggtgcgcggcaggggccggtgggaacggggagcggaagcaggtgactttgcccaccttcgccagttatttcgcgggtctcacgaattcgtgtttcccttgtcgatagagtcaaacacgcgcttcggacaagctttattgttttggagggtccagcgtgaaactagaaaaagcatcgttcaagaggcagtgcaggattacagcccactccgccacggaattacatgcttcgatacccgtcaacgaagaggaccctgagcagaatgatatttgtaatttggtaagcgtcattccacctgcatcgattcgtggctcaaaatgaggcgagcattgtttttgcgtagtgccttatgcacaagaaagattctctgcacccgggacctcctgtacttttcactctcgaatgtggtaaggtagaatgacgttgcctcaaagacaacttgttgcaccttcaacaaactcagggcacgaatatcatttggcatggtaagtcaatgcctagatggaatgcggctagttcctcctaatgatcgtgagatcaatagtttatcagagtgtgtgtctaggagggagtgcagaaaagactgtcccatctgcaccaaaccagtcgaggaggatgacatcagaaagatattgaccaagagaaaacttctcaaaagaggcatgcaaatgcagcagaagcagctcgcacgggctgtagcggaagctgttgtctgacaactctgctctgaatgcaacgggcgaagcctgtgtactgtgttttctgctttcggactcgtgtttgtaaatataaaagagatgtgtgagatgccggtcgctgtgggcaccctgcacgtattattaactgggctatgttcgccctaagaatctgctttagactggaatgaattgcttaaaggcagtcttgatgacaatctacaggttgctccccgatttgcgaccacatctcgcagtgccacgcgaactacccagttgcatttcagcataatcggaacctcaaacccacctctctcgcatgccgttccaattcttcatttccacatttcaataactaattaagctgccttactcgaagtacaagtggatggacacatgcaaatggtctgagggacaatcctccagacgtgaacaaatgtgacagaatgtctgtcatcttgcaacctgtttgataatccgagcatgagcaagccgggaggaaggcaagaaaacagcctggaacaacgttcatcgaccgttgacgcgcgagctcctgagtacggaattgagaaaattgtggcaggaaccacgtcggaacattttttacaaagtttaccgcgttgcttgctggtttactcttattggcccaattttttatggccacagtcaaacggaggaggcaaaagcatgacttgcaccgttgttcttctgctgttttgactcatgctgaagagcttaaagcaagtgtccctgtcaaaaaggggaagatcttggatagcggtgttgaggaagtcaagctttactcgaaggttggtgtaaattgacaaaatgacctcggtgccactccgcccaattgcacagccatacgactgtatgccgccggagacagccgtagccgtctgtgctggcttgagtgaaacataattttggtgatcagtatggtgccaactgactacctgagactgagaacacgagtcatgttggactttcgtgaaactacgcctccgccactctgcaaaaagctgccaccgctagtgtggtaagcttggacggcttgcctggacacagctgatgttaacatatccactgttcatacacagaaacaagagttctgagttcgtaacagcttcgtcgaactcgattttgcatagccggcatcaccctcccccccgtccccgtggccgcccccctgaaggcgccgtacttgacctgttgcagcgtcacacccccctgcgggtactgacaacaccagaatatgggagggactttgcgacactagttatagcgatacgcagtggcttccttttaaacacgcaggaaaacgtatgttttcgtgtttctgacgtgcctagattcctctgtatcacaacgagttaatattatagagaagcaggggcaggaccacagatcgtccacccaacagtcggccaccgagctgtatacgcgtgacttcggtcgtcttcagtcaatgca

SEQ ID NO: 2152 - DNA, 2031 bp, Toxoplasma gondii
ttcagctctttcggacatctccacatacacagagtcgctacacaatctgtccacacaaatgtttctgttttgctaaaaaaacttctaattgagtgcagttgtatgcagactgcgtaggtgtcagcacagggaagggcatgccttagccacgagcagactcaacgtctttcttctgtgactgcacttttttctttcactttgttttttctcacacctttttttcgatccagagcacttctcggagacgttacatgcggtcgaaaggaacaacacagggaaaacaacccaaatcgacatttcttccgatttcaccctgtgatgactcaggcgccacagaccttggtcttcactcggccggcctgatcttcttcctcctgttctcctctttctttgttcactctttcttccatgtgggggttcactctttctttcacctgcagctctccctttcttctatctggcttctctcttttgtttctcatgttgctcttgtcctcgttctgttgacctcgcccttccgtctctgatctccccctcttctttctcatgttctctgtctgtccttgatctttgtctctagatgccttctcagcttgtgtgtgtgtatagtggcgaagaagcgcccgtgtcgatcgagaagatacgtattggctctgcttctgagaagaacgatactgttgtttcgtatctccctctccctgcgagacgccttctctgctgttgctcttcttcgactaggacagactgaccatctttcgcgctgttcttctcccgacagacctctttttctccgctcatcctcctctccgcgacttcagtggtacacaggggaagcctgcaggggtgtacgtcctccccagccgtgctcccctctccgtaaaccatctctcgtcgcatgaacagcggaaggatactctttcgctttggagagcggtctttcctttctctctttcctcttccatcatcgcttctgtcttctgtcgcaccggattcctggggaggaaaaccgtctaccgccacgagcagcagcatcgtgtgtctggtctgttgtctcctgcgtcgtcttgtgtgaatccttcgactccggattccccccgtttgtgccgtcgagaacttgagtttctgagactcttttacaagacgtgtatctcttttcgagcgcgttgtgccggcgcgcgggtcggacgctttcgggagcgtttttatctacgctgcgtttttgcgcgtgttgtctttcgaggaggcccgcgagactgcatgcggtgggcgaactgtgtttcctgactttcctgcacattgcgtttccattttctcgcggcagaaacgtcgcactttgctgcgccgacacaactccgcgtttccgatttgaacgcccagtctctcttctcgcctgtctgtacaccccgtccgaagaagccatccacggggctctctcctctcctgcgaagaagagaagaagaggacgtcttgctcgtagcactcttcttctcttcttctcttttcttttctctccttttcttttctctccttttctttctctccttttcttttctcttctgctcgctcagttgctggtcttcgattttcggtggacatgtgacgagacactgagggtgacgctcatcccgaaatcctctgtctttcggcggtggaaagacactttgaaacccagggagggtcgagattcaggatttttcgaccaagttcctcttgcacggtttcccccagctttctgcttcagtgctctcttcagttgtggagacttacgcggtgcgaaggcgacgcggctcgaactgttttctcgcgtttccaggaaggagtcgcccgagccgctgcccggttttccggaagacgtcgccgtccttgtcctctccttcttcctctcttctctttcaactatgtttggtgtcgactctgctttactcctccgcctttgagtgctccaggttccgctgcgcttgtgtttctctcgcggctctcgtcctcttcctcgccgtcgcttggacgctcttcccctccactctttcaaga

SEQ ID NO: 2153 - DNA, 4982 bp, Toxoplasma gondii
cagtaattttcctttttgcaggccggtgacgcaacgcatgacgtgcacatcagaccgcagagcagcaaaggagacgtggagagtcaagcggatttaatcaagtgattactcagtgaaatcgctgctctggtggcgcgatgctggcaagaatccgataccgtatcctgggggttatgcggagcgggttgactgaaagggcatagtgaagtgtgtgagcgtctcctgaggggagatacactctttgaaaagggcgttctggaagcattacaggttttggctgggtaggccgcttcgcaggcaccacgttagactgtgtcgtcggcacgagcacaatagaggcttccacctagcgttttgttcagcggtgcttgacacgggcttatgttactggggtagagaacctcagcaggcgtattttgatagcatttcgttcgaaggggctacatcagcatttgatggattccccctaccatatgtgactaagcgcgttttccgtgatccgcacacccttctcatctcgtggaacttagcgggcgggggggggggcgtggatgtcctctgcatgcaagagtgtctttggaggctgttcttatttcaatatgttctctggtgatcttccatacgtgaggtggaagaaaagagttagcaaagcagagagcggcaaagaatggctggtccgcgcgtgctgactgctgttgaacttgatgtgaacaactgggtgtcggaaaatgtcatcaaggctgggagcgtcagcagcaatagtgatctcgaatgacgagcagtggggtgcttgacgggtttccataggacacgtacccgacttgccgacacctgaggggattgtgctagggaagtgagaacagtagcgggcattgtagctgggtagcattctttgtggagctgccatacactcaggatagccatatagcatacaataggcacctttccagaaaaatatactgtttcccccgtaagtctcactgtagcctttttcgcttcgcagaaggggtggcgactttgacagttcgttgctcaacgaatcgcgggtacgggttaagtgctgctcgagggaagactcagtttctggatagtgtgtaataactacagccttttcttgggaaaacattcatcaagaaccacattctaccagaaactttgtgcgtgaggttgcagcgtttatcggccgcagtcgcagtgctagatgggggggccggacgcgcagctcctagcaggcagttgtgctgcagaacttccagtgtacgaggggtttaagcttgtagaactccgaagagacacactcccccacagcacgtccttttacgtcagtgtgtcatttcttgatttttcgccaattgtcgaatgagtgcatatgttcactctccagtgtgacgtacctgtggcgtgggccccccgcgacaacggccgccgcagagcggacggtggtccacaggaacggcacccgatgggcgcctggtcccgtgacgaaagaatgcgcttccaaacgcgaataataaccaaatttcgaaagcatttttgaaaccccaccgcagtactctgtgataaatctcaagatctggcgtcgaacctacgcagtacagcatgccttttattttgtgctcttctgatgtcgtgaagcatcgattgaggtgtcggcagtacagcctgtgctttgattcgcggttacggcgggcggaagcagcgcggccgcgcacggggttcacacaacagtttgtctgcttctcatttggcgtgttgcagcgcctgctttgtttcgtttgtcttcttaagaatgtctacacggacaacacccacagggcggtctgagactttgccaactcaaaaaagtcaacacctttgtgagcgcgccaacgaacggcaatcggtggaaggggccattttcggttggagctgtgcgagggaagtggggacggtgtgcgcgagtgcagaagccgcatgcgctgcgtttgtttgtcacaaaggccacgaagcgaccacgttcgaacaccccacccaccgtagttcacccgatcaagaaatgtctcggccggtgcggacacttctccctcatggtctttcccctcacggatgtttgacgcacacaacacgagttggtacgccagcgacctgcgcgtcacttttttgtcccaaacatccacgtctttggaagagcgtttactttctcagtatctggtttctgtgtgccgtctttgttcctatcaccgtgggagcagtacgatacactaaacatccgacgcgtctccgaccgggatctttaccgtgtgttgctttttgtttatattcttcaagactttccacaatgccaaacccacgcgtgttcttcgacatcagcattgacaagaagcctgcgggccgcattgaattcgagctgttcgccgatgttgttcccaaaacggcagaaaacttccgtgctctgtgcactggcgagaagggtacaggtcgcagcggaaagccgctatactacaagggatgccccttccacagaatcattccgcagtttatgtgccaaggaggtgacttcacccgcatgaatggaactggtggcgagtctatttacggtgaaaagtttgcggatgagaacttcagctacaagcactccgagcccttcctcttgtctatggcgaatgctggacccaacaccaacggctctcagtttttcattacaactgtgccctgcccctggttggacggcaagcacgttgtttttgggaaggttgttgctggacaggaggttgtgaaaatgatggaggcagagggccgttccaatggtcaacccaagtgtgctgttgaaatttcgtcatgcggtcagctctcgtaatcatatcacgtgtatgcatgagttacctatagctggttcggtgtatgtgagctagctgctggtgacaagcactcgttcaacaagaagagactgttgaacacgtggatgctgtgtggtgagtttggtggtgcgtcgattgtgaggcgcttgctgcgcatcggttgtcaagactagcaaaacccagtctatccccggatctatgtcattcctcgcatgtaagatacaacggcggctttcggaaaagcttttttgctttccacatgccgttactccaagcagcgggccagcagcacaccgccactacatcgtcagaaacagcaaacgcaccgccccatatagttttgaattgatgtaataggctagttcaacccgttaagaaggccactcgtatgctgtcggagaggctaagcgcatcacggaataaccgtctcacgggtgggcagcacacagggtcctgtgctgttgttgttcacggccacaacgacatagcggtaagtcgcttagagaaagtatttcgaagtggcagacctggcactgaaacacaggtaggaagaagtgtgtctcgtagaagctttgttaggggcgccccttgttcgcggtttgccaagaaagtggaagcgcatctcctggaaggtagtcgcgcgttctgagttgggacgcaagtagggtggtagtttctcgtggccgacaggattatgtctactagcttcagtgacaagtgcagggttatcccaggagatgtcgctgttaaaggtcgattcatcgaaaatgcactttttgggatgcacacggtctcatcattcaggtgttgtacactgctccgcacctgcgtagcataacaccagtacattttgtgatgctggatcacgaccagtttactggcattccgcagtaggtcaactgcagtagccaatattttcatggatataatatgaatagcacccctcgagatgccttgggcgctggtaagaattgtggcgctggtacatccggttcctcgtgtaaacgatgcgagcatccacctctgtttagggtggctgacccaggctgtttgcgcatcttgcaaacggcaggccacacggagttgatgctcgcactcatctcactagaacttgtttatggcgtgagttttagactgcacaacaccagtggatgagtgactgatttggaccaggctcaacctcagcgtcgatgttatggagcagtgacatttatctgcagcagtttcacttgctgcgtcgccttcctagctaaaaagaatcacagcaattaagagtcacgagaaactgccacttcagctcgacaaggcatggtttgaagcacacgtcaggtgacgtcttgcgcgtgtgggcgtgtcgtcccgagcttctgttcgcgcatgcctgcatactgtcggctagctggaaagtaaaaaagtgcctcgcgaaaagggtgccgttttctgtggattgggaacgccatgtttgcatatctaatacatgtctatctttgccaagcaaccaacaacagcatatctgttgttcgttcagtgacggttcctttttaaatccccgtgacggcgttgaaactggttccttgtcttgccctactgctcggtgaccgcacgctcgcggattttcggtaagactgcgtttttcggtttgcgcagtttcccattttgaatgtgtagatgactgaggactttatgtattgtgctgcgaatgcgaacgttattatccatcgagaattgacgcacaacaccctgcattcagcgccttctctctggttttcgcagcaccgcccaactcgtccttgtggcccgtcctccactttcgtgggtgcccatcccatggcactatgccacacgccattttcccgcggctcactgtgtttcgatctttgagtgaagatgtgttgctcgcatacaaataattgggcaagcagtgaagaatgctcaacaagttcgtggcaatccacgaaaaatacggggagctgatgtgacttgcaaaggggtgtgcgttcacggcaaccagtttttgcgcaattaggggtcccaagaagatcgctacctcatcttatcaacgcaagtccttcgtgaatgtggtgaggtgggctttgacttaacggttgtagaggtgtttagggtgccaggcgcataactccataa

SEQ ID NO: 2154 - DNA, 2200 bp, Toxoplasma gondii
cgtgtgagagtgttggcgaggctatggaattctgcgaattcaaacaggggggttgtctgggacacgacagtacttccttcaaagaagaaaagacgccgcaagacaaaacctcgagtggaaagagcgaacaggcgacagcgcgagctgcagcagacgcgatcggtgccgagtttacacgaaatattcgcacaaccatgaatgtgccaaatgctcaccttcgccctcactggcaggtccagaactgaagaaatgttgatgcacacatttgtggagacatcgttcggctgcgacacttgcaggtttttcaccagaaggcgccttcacagcaccaaagagcacactgtgacgtgctttgaggaacggctagaggctccctgtttccgtgcagtggtcaaaaacaaaggttatgctttttcagtccgcggcaccccactttccgttggttgtcagtatgacgtatacaagggggcagcaagatacgccctgcggacacaggccgatacttccgcatgtttccatgtaacttttaaagaccgagatgtggaagcacctgactgcatgtggagttcaaagacaacccagtaaatctaaagatgacgaagcaaagtcgcggtaccagaacttgcgccgccgaggcaccgctttttcatcgtttgcgaacgacaaattttgccatatttggggacctaaatgctgcaagcgggcttccatgggtttaatagattgaagcaacttcctatgcgaacactgtttgtttagccacccatttccgtacgtaagggtgagaaccacaaaaagcggttggagcaaatcacggtggcaccgatatgtttgttgtctataatccaggtgtacgaatctgacacgtcgtcagcgaaaattcagcagtggctgctgtcgaaggtgtcatacgatgcagtcgccgttgtgcagtgacagggattcgtttctctacggcagtggtggctggtccgtgaattcttcctccgcgatttactttcgaatcacacattccgtgactggcactcttttgcattcatccacgaacatattcgggcgttctcggtcagaaacggatctctcagcacgcgctcttcaacccgcagaaagtaaggggtgtttctgatgcggcatctgctttgaaacagtccatgtgtgttcggattggaaggattcctgaccctcttgagtgacagaaggtcaaagtgagaagaaacttgacggccgaatctcccccaaggacttgaccggatctattactgtggttgagttttcaccgatacaaaaaagagagcggagctcgtgtctttcgctcgagcacttttttttcgagaccactgtaaattattttgcgcctaaagtcacactcgtgtggtcgtcgcctaccggtggagaaccccacatcatcagcagtttttgcagtgaatctacaatcgtgttgcttcagctgactgacaagatcgaagcgggccggcatgtctccctgtttgcagacatcagcggatgtgctttgtgccgttcgatcacagaccaaaacaccggtcggcacacgcccaggtacagtgtcttcgtgtacaacggcactttcctgtgagttcgttactgtgtttcttgcgattgaatacatcgtcaccatcccagaagctcttgattttaagttggtgttcagagtggaccttttccgagacgcagttctggcttcaattaagtggcctcgccgtttagagcacgggttgacaacgcagtcgggagtacccactgcctccgacctgtacaaagtgtgggcacgtgatttcgcggtggtttgtagcgcttcgctgagcgctgagtgttgcgttgacgcaaactgccgcaaagaaagattcgtcactcatgccagacgaagggaccgtgtgaccgctcagtcgcgcttatggtcggggagcggtctcgagttcgaagggacggtgttatttctcccctcgctgcatgtcctgaccacgaaattcgcgcgcgcgcgagacagagagggtgggcgttagaccgcccggcacccgaccctaatcggtgctggatgctgaactgtatgtacactcgccctgacgggggttctgcgctcttcgacgggtgtgggctgggactccatcactgtttgtttgttcgtgtgccagcgaaatagccttgacagaagagatttcctgccttttttcttcacagaaaa

SEQ ID NO: 2155 - DNA, 1700 bp, Toxoplasma gondii
ggaggcttattctccagtcatagctgtagtagttgttctattgtgggttccttgtgtttgtgaatgacatcaccaccagaaagttgtcccacgatacggttgtccctaggcgaggagcgctgaccaggtggtggtcatggaaaacgactacagaaggctattttgtaatctcagctctgcaaggacagcgcaagtagtttacctatccacgttccattgattttgcagcgggtacttaacacgacaacatgtgtggaggtatagtccgtaaaacagcacatatttgtaagattgtggaggtagaattcgtcaaacagcacatacttgtagaacgaagagactcaaggtgacctaggatccttcttagcctcacacctgatagatgacacaaaatactgttgcagcttctattcgacgaactcctcatgaatccaccagatattcgcgacgtttcttcctgcatgggtattgtagcgacaggactgcacaatatgcgtcacaaagtggcagtcgccaaagactatcgatataggtggttcccgggtgctattactggttcgtgacggttccaacgggacccgctttgcatgaggaccgcttctgggacccacaacacactttccttcacatcgtgtttacctaaaagtttcacaaataacattatctttgcttttgaggatttagctgggccgacggctagaccctgatcaccttcacatccctccaatcgtactcaggctcaaatcttccttgatcgacttggcaggcacagcgtatcgggaacagccagctcgttataaaactctgattatccccaaagcatgtgcaagatgcagcgaaccacaaccctgttatgctggctgatgtgacgcttgctgtcacccggtttgattctgatcagagaacatgcgccaaactgccttcaggactcgcaaccgcttgctatgctcagtggcaatcactcaagcagtcgtggccgttcactccgaacaataactcgatcttcattcggtagcaacagagcacacttccaggaaaaacttgtgctaaaagcaacccggtaaatttgtacaaggtcaggctcgagtcaccctgcaatgaccccaaacagttccgacttgccacgcgtaggcaggattcggcgactttgtttttcgattaaaaggccaagtgacagcgcacagaactaccaaagaagcatcctttggcgaggctatccacagctacatcctaaaggaaaggcgtagcctaattatgagccgtgtcaactgtttgctgcacagggcgctggttttgtaatcccaggagaaacaccacccgtgtgttccttgacagactctggatttttatcggagacgaagaatatcgagaaggaaaggctgagctcaatcgttcccttgcctgcgcaacgtgtcttcgctggctgtaagcgccgcttccacgcggcagttactacactgcgttttcctaatgcggagtgactctttacttcgccgcgccgcggacgtgggaatccgtgcgtttgcgtttcttttttaagccggagggacgtgggtcacgacaatgcctctgggtctgttatgaaagttttcgtttttcaactatacgccgatgcttgtgactgcatgcggggctgctggggattttgcgggctgagtggcaggagggaggggcctgctgtttggttctcccgaggcgaa

SEQ ID NO: 2156 - DNA, 4700 bp, Toxoplasma gondii
caatgatcgcggaaatgccctgttgtaccagatccggcatttcgcttgagcgtctccggacagccagtccagcaggtggcgagcttgttgtcagcgagtggcgtatgcttttgaggttgacgttgcatgcggcctgggcggtccagtctgtggttttctggaaactaccaagttgcaaagcgttgtgttttgaagcgccaacgccttgacaccttgtgttggacctgtttcgttctggctcgctaggccgtccaccgtgggagcggcgaggggctgtaactgcactttttcccgctcacacagcgtcgtatttatcttcgcactttaagcagtgtgctcactgaagcgcgggtgcgtgaaataactctcgcgcgcgcaggcgaacgaatggtcgcgcgagacatcaagacaccttccacccacaccactcctctgagaaatcgggcagggtagcgtttaaaaaaccacagaacagttgagtactgtccgcactcaccaggcctaaaaagcgttcatccagttcctcaacaggtgtcaggcgaacaagaatccgacctgtagattccggtcagaccagcactggaacacaaggaaagagcatgtcgctgttcacacgtcaacagcattctgtctccctgtccacatgcatcgagaaactgactcgtccacatgccagaaccaaacaggcgtctgatgtacgaaagtctggtttctaagtgggaacctctggaagatgcgaccttccttgtggcgtctgctattcagggacacttggatgtacatcgagtgtcgtctccgcattcgccagttttcttgttgtagtttttcatcgttcggatgaaaggcttctttttcctcattcgggggcctcagcatcgctgaggaacacccctggctgggttcgcgtccaacagatggaaggcacctgcatcttgctgttctaaaagggtcgccgagccagacctccccaactagagggaaagatgaggtccttagacggtcagtttgtggttcgacacatggtggagggtaactggagatcactcacttactcaccactctcggaacaacagctgcgcttgcgtttgaggaaaattgcctaacgtttgtcgatttctcgtagcagcagccaagtggccaggggacccgttgccagacggaggacggtcgactacagaagtgggggtcacatacctgttgcagaactctatattgataccgcctccgcttaactcgtgaagcagtaatcgcttccgtttgcacggaactcaagtccacgtggcgtactaccaccgaaatcggcataccacgggttgaacgtaaacacactgcaagtcccgcgcactgcgaggcgttaccgtcaaaagattcctttcctttttctgtgatttgccgctgtaggagattgagcagttggcactcagcattcgtgagagtttactgacagaaagacccaacctcttgatttgatgaggccataagatctaacgcgtgtggcaatttcgcgtagctgatctctgggactggacggcggcgccgagtggagtgccacaaagttgtccattaacagagacagccgcgcgcactccaagcacattttcttgcagagagcggttctgtcgtaatactgctcagctgcaacgtacctaacgaggcgctatgaaccgggactgtcttcctgaaagaatacgtaattaaattagttcgctctcggttctatggtgtagcggttagcactgcggactctgaatccgccgacctgggttcaaatcccagtaggacctctcttggcgactggttgcatgcaaatcgcgttacttctgcatacgccgaccgcggctgaacactacagttgaaactcttggatgctacaactcagttgattctgtggctaccgccagctggtgcacttatcgtcgtcttccgctacgttcttctacggtggccttagcacagaccactggtccatctgcagtccgttctgtacgttctggaaggtgctttgcgtatacaatcctcagaacaggtcgatattgaaaattttcgatgacacacagtcgacaccgaggtagcgttgtcacgaagaatgaaacatgctaccacacggatacatctcaacgggagcgcacagggcgtgtgactcttgtattttcaccggcgaaagcgagacctcagaaagccagaggcagcgtggtcaagctagagcgaaggaaaagtgagtttgcatctgtttgtcactaagaaacattcgtcaaccggggggcagaccgagaccgtgtaaccatggcgcttattcgatgtcccaggaaagcggggattacacgcccgtggcctagacgaatttatcgcacgctacgttggcctgagactaatcgatggcaagatagaagaacatcggaagactctttgcgcttcaaagccggacggcgttgttgcctctcgtgaatcgtagcggcgggcggtagagcccaagaagccatggtgcacatatatatcgatgtgtagccagcaccgcagtcccgagcagcgatgactacgtacccaagtgagaaaacgggctattgacactccctggtagtcgagcaggtgaaaaggaaccgattttgtgtttctttcgggagcttgctgaagctggaagcgatatgtgtgactatgatgcgcggagccatctgacaccagtaggggcagtagagagacgccatctgcctgagacaatcaatcagggagaaagagaatagtgagacgcaaccctggcccccaaaatcagttttcgctagggactgagcgaacagaaaaggacattccccctctgagacgcaaagctcgatgtctgctaaaggctgtcatcccatgtagtctaggtggttaggatacccggctttcacccgggcgacccgggttcgagtcccggcgtgggaatcttttcgcaggcgatacatttgcgttccctttgcttaatttgctgttttgcagcattgcttttttcatttgtggagtcagctccgattcacggaggttcgaggctgcaatagagacccgttttcaggcggtgcacacgagtcagatcgatgatcagcctgtgccgcaatgacattcgtctggcatgctagtgtgatacgcccaaatttctcatgcactccgcttgacattcagggtcttttcttcgaacgtcgtgtttaccagtttgggtttcttgaaaacgtcagactttcacaacactcagttgatgccggtgggcttctccgtctttggcgagctccatccggaagggccgctacggtgctcagattacgaagaacaagcactacagcgatcaaactgtttgtcagacgtctcagacgttgttgacctgccccttttcgcttaagtggaacgatgtcaggtctttcgacaaagaggtactaaccgcctccgagtgtgcgtcaaggaaagcgtacttagagcaggcttgagccgcgttgtcaaccgtggaaagccacggtgtcccgtgtctcgagaattgcgatttttctgaaaaggaagtgaggctctcgagttcgcggtgcagctcctccgcggaatgcgattgtcaatcccctgaggaaagacgcgttccgcaagggatttccgcgtcgcggacgaccgacgacgcatgctcgcgaccttgtcttgtttctccgagagcggaagcaagttcgaagtgcggccgccgtgcgtgtttttgaacttggaagaagttcgagctttccttgacggtgtgtgctgaaacttctgcgtttttgttttgcacaaggcgcaaacaggggctagacacgaacgtgttccgtccgcgcgtttctctaaaacgaagaatccgttttgagaaagactcctcccatttttccgcggcgctgactcaagctcccgcgctcgctttgcggacctttttcgcagtccagcgcacagctgagaggggtggtgtttcccggcagtgcgcagtcgttttcccccctttttttcgcgaaaaaagcaggcgcggggccggtcgaaatctcgcggggaatttcttctttccgaactttccacttttcccgcgagaaacccgattcccagttgcgaaaacgggcaaatcgggggctccgtccagagcgtcgtctgggcgttccacccgcctgtggcagaacttcgcggaacgggcgtgtgtgtgttgcgagtaatttttttgctgcctgcatatactctccttgctgtctctttgctttcctagaattgcgccagccgccgacccagccgctgacccagctgccgacggtttcttccgcggactccttgctggacggcgtccctttctgggttgtgtgccctcgtcgagcgtatctctctccgcgtgtctctcttcaggatctttccgcgaactcacctcggaatctcgcgttcaggaaagatttcgaatctcttcgtcagtctcgcgacagcgagtcaactcccagggaccgtccattccggagcgtctcgatttcgctcagggtcgctcccgcgtccgttcgagcggcggcgacgcccgtcgtctgcgttgcttctcagcgttctcggtcagaagaagacggctcttttttccggcagaacagtgccttccgtgtagccttgtggacctctttgagatcctctcttgagggtcgattccgcactgcgtgagctagggtgcgaggcccagacaggctttttctcgttccgccttttta

SEQ ID NO: 2157 - DNA, 1992 bp, Toxoplasma gondii
aataattcgtttttccagagctgatgaggcgcaaagtgtcactagtcttgagacccagcctggaacctcttcgtcggcgcatgcgctgcgctgttgtgcttgttaagcctgctggtgtggtactggtactgttcttgttcttattcaaatcagtcgccatgtaaagcggcttattctgatgcgggcctgacaacctccgaaaacggtttcctctgaaaaggtacctgttctgcgagcatgcgtgcggaacagtgcgatacacgagcgtttatttagttgtgtgtctcatgtcgaccatatgtcgtttcagaagatggtttgtctaaaattatctaggagatgtcataagaataggactttgcaacataccaagtaaatgcgacagaacgaacaactgtccttcgaagggcatgctgatgtcatgggtggttcgcatttgaataaagaaacaaggcaggaccatagattccatgaaatacgcttaccctttgtgaatggaagccactagcgtgcatatctgaagcatacgggaaaatgtgggttctaacttgcaactgtcgaggttgtttctactgaaatgacgccttttatcgtatgcctgtcaatcgtctaagaagacaaatggaaatcaggcttcaagaatcttgcggcgtacatgccactttgcgtttgttgtttccatctttcgaagcacatttccgactagcatgtcggtggtcaaaaaaaacaatgacttacatctcgagttaaaggtgaaaccacggcgtagagtcttcaccttggacagaacttccgcagaaaatatgatatcgtgtcatgatcagtgcacaatgctgccttcggaattagccttaacataatgagtcgttttttaagtcgaaccgtgctgtgcatgcccgctctgctcagtaagtctgtctcaaacgaaacacacagtgagtcaccacatcgaacagcacgacgatcgaagcagactgcaactgcctggttcaagcctgcacagtcattttgagttcggttcgtaggaggtccacgaagcaagacgtaggggaaaagttgtacataaaaggaaaaaagggctactttttcatagagaagactatcgtaatagaggtatgagaatacatgccggcacacgcttgttcgatatgcgtgggggtcacagcggaagtacttgctttcccttgaagttttctatttatcagcggcaatcgtgccgagatcatatgcgtagttgaaagttatattcagctatctgaagtgggtgacacagctttacaatcttgacagctgaaaagaagtgttgtgactgtatcctggcctgcctgtctcaagggtaggccggtgtggagcacgctcgaacgttttgcacattcagctgccgtatccaacagccccgtatggttagtcattgttagtacgctctctctgtgtctaccgctgaaaatatcaagtgcgagaggctggcggatgctactttacaggatgaacgaagatgaatactggcaatatgcgcgatgtacgttttgtccaaaggtgtgagaacttcgccgggatgagacccatgcggcgtcgcaaaaactcgggaaacaatttctaaaagcgagaatcatgtttccacatgcgtttcagcaggcgaatgggagatatgatgtttccggaagcttcttcgccgctagggtttgttgtgtccccgctccgactgatgtgtctacgtgctcttttctgttctgtttcgagttcaataagtgtcacacacaatggtctcatggatttctatcaggcagcccgaagagcaatttttaggtggatccaacatatctcaaaaggcgtattagtcaattctgtacatattaaaccacgccgtggttttgtgtttctagctagctgaatttgctgaccgactggtggccccagtagtcttgtgagtatggttaaagttctgcatctcggcgcggtttgttgatgcatttcgtgcctgttctccagaaa
